United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 109

SEQ ID NO: 3868065 - RNA, 13 nt, Shigella flexneri 2a str. 2457T
agauaaaaaugaa

SEQ ID NO: 3868066 - RNA, 16 nt, Shigella flexneri 2a str. 2457T
agauaaaauuaacgac

SEQ ID NO: 3868067 - RNA, 17 nt, Shigella flexneri 2a str. 2457T
agauaaacgaccacucu

SEQ ID NO: 3868068 - RNA, 19 nt, Shigella flexneri 2a str. 2457T
agauaaccacguucauuuc

SEQ ID NO: 3868069 - RNA, 16 nt, Shigella flexneri 2a str. 2457T
agauaacggugcugaa

SEQ ID NO: 3868070 - RNA, 21 nt, Shigella flexneri 2a str. 2457T
agauaacuacccaaccgauaa

SEQ ID NO: 3868071 - RNA, 15 nt, Shigella flexneri 2a str. 2457T
agauaaggcguucac

SEQ ID NO: 3868072 - RNA, 18 nt, Shigella flexneri 2a str. 2457T
agauaaggcguucacgcc

SEQ ID NO: 3868073 - RNA, 23 nt, Shigella flexneri 2a str. 2457T
agauaaggcguucacgccgcauc

SEQ ID NO: 3868074 - RNA, 19 nt, Shigella flexneri 2a str. 2457T
agauaaggugccaauccuu

SEQ ID NO: 3868075 - RNA, 22 nt, Shigella flexneri 2a str. 2457T
agauaaggugccaauccuucuu

SEQ ID NO: 3868076 - RNA, 18 nt, Shigella flexneri 2a str. 2457T
agauaauagauuugcgaa

SEQ ID NO: 3868077 - RNA, 14 nt, Shigella flexneri 2a str. 2457T
agauaaucaccugc

SEQ ID NO: 3868078 - RNA, 20 nt, Shigella flexneri 2a str. 2457T
agauaauccccaaugaccuu

SEQ ID NO: 3868079 - RNA, 14 nt, Shigella flexneri 2a str. 2457T
agauaauggcuguu

SEQ ID NO: 3868080 - RNA, 21 nt, Shigella flexneri 2a str. 2457T
agauaauugaagguuuaauac

SEQ ID NO: 3868081 - RNA, 18 nt, Shigella flexneri 2a str. 2457T
agauaauuuuuucuucca

SEQ ID NO: 3868082 - RNA, 15 nt, Shigella flexneri 2a str. 2457T
agauacaaccaaucg

SEQ ID NO: 3868083 - RNA, 16 nt, Shigella flexneri 2a str. 2457T
agauacaaccaaucgc

SEQ ID NO: 3868084 - RNA, 21 nt, Shigella flexneri 2a str. 2457T
agauacccggauacaacucgc

SEQ ID NO: 3868085 - RNA, 18 nt, Shigella flexneri 2a str. 2457T
agauaccuaacauuuuac

SEQ ID NO: 3868086 - RNA, 15 nt, Shigella flexneri 2a str. 2457T
agauacgaccguucc

SEQ ID NO: 3868087 - RNA, 22 nt, Shigella flexneri 2a str. 2457T
agauacgaccguuccauucaaa

SEQ ID NO: 3868088 - RNA, 19 nt, Shigella flexneri 2a str. 2457T
agauacgacugauaucugc

SEQ ID NO: 3868089 - RNA, 20 nt, Shigella flexneri 2a str. 2457T
agauacgauguuguagcauc

SEQ ID NO: 3868090 - RNA, 17 nt, Shigella flexneri 2a str. 2457T
agauacggauucuuaac

SEQ ID NO: 3868091 - RNA, 14 nt, Shigella flexneri 2a str. 2457T
agauacggcgcauc

SEQ ID NO: 3868092 - RNA, 16 nt, Shigella flexneri 2a str. 2457T
agauacugaugaacgc

SEQ ID NO: 3868093 - RNA, 14 nt, Shigella flexneri 2a str. 2457T
agauagaacugcau

SEQ ID NO: 3868094 - RNA, 20 nt, Shigella flexneri 2a str. 2457T
agauagaggucauuaggcca

SEQ ID NO: 3868095 - RNA, 20 nt, Shigella flexneri 2a str. 2457T
agauagcacgacguuucuuu

SEQ ID NO: 3868096 - RNA, 19 nt, Shigella flexneri 2a str. 2457T
agauagccagguuuaccag

SEQ ID NO: 3868097 - RNA, 21 nt, Shigella flexneri 2a str. 2457T
agauagccagguuuaccagca

SEQ ID NO: 3868098 - RNA, 17 nt, Shigella flexneri 2a str. 2457T
agauagcggcugacggu

SEQ ID NO: 3868099 - RNA, 21 nt, Shigella flexneri 2a str. 2457T
agauagcguucuuuaacugcc

SEQ ID NO: 3868100 - RNA, 15 nt, Shigella flexneri 2a str. 2457T
agauagcugucccag

SEQ ID NO: 3868101 - RNA, 15 nt, Shigella flexneri 2a str. 2457T
agauaggcaucagca

SEQ ID NO: 3868102 - RNA, 15 nt, Shigella flexneri 2a str. 2457T
agauaguugauuaau

SEQ ID NO: 3868103 - RNA, 21 nt, Shigella flexneri 2a str. 2457T
agauauaaacggguauuugau

SEQ ID NO: 3868104 - RNA, 15 nt, Shigella flexneri 2a str. 2457T
agauauucuccagcu

SEQ ID NO: 3868105 - RNA, 23 nt, Shigella flexneri 2a str. 2457T
agauauuuuuaugcaugaccuac

SEQ ID NO: 3868106 - RNA, 15 nt, Shigella flexneri 2a str. 2457T
agaucaacacaucca

SEQ ID NO: 3868107 - RNA, 15 nt, Shigella flexneri 2a str. 2457T
agaucaccugcugga

SEQ ID NO: 3868108 - RNA, 16 nt, Shigella flexneri 2a str. 2457T
agaucaccugcuggac

SEQ ID NO: 3868109 - RNA, 15 nt, Shigella flexneri 2a str. 2457T
agaucacgcaucacc

SEQ ID NO: 3868110 - RNA, 15 nt, Shigella flexneri 2a str. 2457T
agaucagaccaaucc

SEQ ID NO: 3868111 - RNA, 13 nt, Shigella flexneri 2a str. 2457T
agaucagauaaua

SEQ ID NO: 3868112 - RNA, 22 nt, Shigella flexneri 2a str. 2457T
agauccaaaccgacugccugca

SEQ ID NO: 3868113 - RNA, 17 nt, Shigella flexneri 2a str. 2457T
agauccagcaccuuuug

SEQ ID NO: 3868114 - RNA, 15 nt, Shigella flexneri 2a str. 2457T
agauccaggaacaga

SEQ ID NO: 3868115 - RNA, 13 nt, Shigella flexneri 2a str. 2457T
agauccagguuac

SEQ ID NO: 3868116 - RNA, 20 nt, Shigella flexneri 2a str. 2457T
agauccagugcucauccuuc

SEQ ID NO: 3868117 - RNA, 21 nt, Shigella flexneri 2a str. 2457T
agauccagugcucauccuuca

SEQ ID NO: 3868118 - RNA, 14 nt, Shigella flexneri 2a str. 2457T
agaucccuucaccu

SEQ ID NO: 3868119 - RNA, 12 nt, Shigella flexneri 2a str. 2457T
agauccgccagu

SEQ ID NO: 3868120 - RNA, 16 nt, Shigella flexneri 2a str. 2457T
agauccgccaguuugu

SEQ ID NO: 3868121 - RNA, 12 nt, Shigella flexneri 2a str. 2457T
agauccgccauu

SEQ ID NO: 3868122 - RNA, 19 nt, Shigella flexneri 2a str. 2457T
agauccgccauuucuccuc

SEQ ID NO: 3868123 - RNA, 18 nt, Shigella flexneri 2a str. 2457T
agauccgggcauauuucc

SEQ ID NO: 3868124 - RNA, 16 nt, Shigella flexneri 2a str. 2457T
agaucgaacacgguga

SEQ ID NO: 3868125 - RNA, 16 nt, Shigella flexneri 2a str. 2457T
agaucgccgcuguaau

SEQ ID NO: 3868126 - RNA, 16 nt, Shigella flexneri 2a str. 2457T
agaucgcgcaucagcu

SEQ ID NO: 3868127 - RNA, 18 nt, Shigella flexneri 2a str. 2457T
agaucgugaaacucagcc

SEQ ID NO: 3868128 - RNA, 16 nt, Shigella flexneri 2a str. 2457T
agaucucucuugcuau

SEQ ID NO: 3868129 - RNA, 20 nt, Shigella flexneri 2a str. 2457T
agaucucucuugcuaucacc

SEQ ID NO: 3868130 - RNA, 22 nt, Shigella flexneri 2a str. 2457T
agaucugcuucaggaauauguu

SEQ ID NO: 3868131 - RNA, 18 nt, Shigella flexneri 2a str. 2457T
agaucuggcgauuauuuu

SEQ ID NO: 3868132 - RNA, 22 nt, Shigella flexneri 2a str. 2457T
agaucuugcgcgaccacgauau

SEQ ID NO: 3868133 - RNA, 17 nt, Shigella flexneri 2a str. 2457T
agaucuuuaaugcacgg

SEQ ID NO: 3868134 - RNA, 16 nt, Shigella flexneri 2a str. 2457T
agaucuuucacgccca

SEQ ID NO: 3868135 - RNA, 18 nt, Shigella flexneri 2a str. 2457T
agaugaagcuggcaaagu

SEQ ID NO: 3868136 - RNA, 16 nt, Shigella flexneri 2a str. 2457T
agaugaauaauguuua

SEQ ID NO: 3868137 - RNA, 21 nt, Shigella flexneri 2a str. 2457T
agaugaauagcgcaaaauuau

SEQ ID NO: 3868138 - RNA, 22 nt, Shigella flexneri 2a str. 2457T
agaugauaaccccgcaauuuca

SEQ ID NO: 3868139 - RNA, 23 nt, Shigella flexneri 2a str. 2457T
agaugaucgccgcacuuucuccu

SEQ ID NO: 3868140 - RNA, 14 nt, Shigella flexneri 2a str. 2457T
agaugaugauacug

SEQ ID NO: 3868141 - RNA, 18 nt, Shigella flexneri 2a str. 2457T
agaugauggcauucucac

SEQ ID NO: 3868142 - RNA, 19 nt, Shigella flexneri 2a str. 2457T
agaugauggcauucucacu

SEQ ID NO: 3868143 - RNA, 13 nt, Shigella flexneri 2a str. 2457T
agcaacugacugg

SEQ ID NO: 3868144 - RNA, 16 nt, Shigella flexneri 2a str. 2457T
agcaacugauuuauag

SEQ ID NO: 3868145 - RNA, 11 nt, Shigella flexneri 2a str. 2457T
agcaacugcgc

SEQ ID NO: 3868146 - RNA, 16 nt, Shigella flexneri 2a str. 2457T
agcaacuuaaucauca

SEQ ID NO: 3868147 - RNA, 19 nt, Shigella flexneri 2a str. 2457T
agcaacuuaaucaucaaug

SEQ ID NO: 3868148 - RNA, 22 nt, Shigella flexneri 2a str. 2457T
agcaacuuaaucaucaaugcca

SEQ ID NO: 3868149 - RNA, 14 nt, Shigella flexneri 2a str. 2457T
agcaagagcaaaua

SEQ ID NO: 3868150 - RNA, 23 nt, Shigella flexneri 2a str. 2457T
agcaagagcaaauaaaacaucac

SEQ ID NO: 3868151 - RNA, 20 nt, Shigella flexneri 2a str. 2457T
agcaagauaguuaaucaaua

SEQ ID NO: 3868152 - RNA, 19 nt, Shigella flexneri 2a str. 2457T
agcaagucggcaucgccac

SEQ ID NO: 3868153 - RNA, 14 nt, Shigella flexneri 2a str. 2457T
agcaagugaauaaa

SEQ ID NO: 3868154 - RNA, 19 nt, Shigella flexneri 2a str. 2457T
agcaagugaauaaauuuua

SEQ ID NO: 3868155 - RNA, 19 nt, Shigella flexneri 2a str. 2457T
agcaauaaaaacuccgccg

SEQ ID NO: 3868156 - RNA, 21 nt, Shigella flexneri 2a str. 2457T
agcaauaaucagauggcggcu

SEQ ID NO: 3868157 - RNA, 21 nt, Shigella flexneri 2a str. 2457T
agcaauaaucucuuuacccag

SEQ ID NO: 3868158 - RNA, 16 nt, Shigella flexneri 2a str. 2457T
agcaauaauuucaaca

SEQ ID NO: 3868159 - RNA, 16 nt, Shigella flexneri 2a str. 2457T
agcaauagacaguucu

SEQ ID NO: 3868160 - RNA, 20 nt, Shigella flexneri 2a str. 2457T
agcaauagacaguucuuccu

SEQ ID NO: 3868161 - RNA, 21 nt, Shigella flexneri 2a str. 2457T
agcaauagccgccauacggaa

SEQ ID NO: 3868162 - RNA, 14 nt, Shigella flexneri 2a str. 2457T
agcaaucaccagau

SEQ ID NO: 3868163 - RNA, 19 nt, Shigella flexneri 2a str. 2457T
agcaaucaccagauguccc

SEQ ID NO: 3868164 - RNA, 22 nt, Shigella flexneri 2a str. 2457T
agcaaucgaccaggccaucagc

SEQ ID NO: 3868165 - RNA, 17 nt, Shigella flexneri 2a str. 2457T
agcaaucucuucaagcu

SEQ ID NO: 3868166 - RNA, 19 nt, Shigella flexneri 2a str. 2457T
agcaaucugauugacauca

SEQ ID NO: 3868167 - RNA, 22 nt, Shigella flexneri 2a str. 2457T
agcaaucugauugacaucauuu

SEQ ID NO: 3868168 - RNA, 12 nt, Shigella flexneri 2a str. 2457T
agcaaugagcua

SEQ ID NO: 3868169 - RNA, 14 nt, Shigella flexneri 2a str. 2457T
agcaaugagcuaug

SEQ ID NO: 3868170 - RNA, 17 nt, Shigella flexneri 2a str. 2457T
agcaauguaaggugcau

SEQ ID NO: 3868171 - RNA, 19 nt, Shigella flexneri 2a str. 2457T
agcaauguuucucuggcgc

SEQ ID NO: 3868172 - RNA, 17 nt, Shigella flexneri 2a str. 2457T
agcaauuaacagugaca

SEQ ID NO: 3868173 - RNA, 20 nt, Shigella flexneri 2a str. 2457T
agcaauuccagcgccaguaa

SEQ ID NO: 3868174 - RNA, 22 nt, Shigella flexneri 2a str. 2457T
agcaauucucucuucagcuucc

SEQ ID NO: 3868175 - RNA, 14 nt, Shigella flexneri 2a str. 2457T
agcaauugucgcag

SEQ ID NO: 3868176 - RNA, 14 nt, Shigella flexneri 2a str. 2457T
agcaauuucuccgc

SEQ ID NO: 3868177 - RNA, 17 nt, Shigella flexneri 2a str. 2457T
agcaauuuuaguaucca

SEQ ID NO: 3868178 - RNA, 21 nt, Shigella flexneri 2a str. 2457T
agcaauuuuccuugaaaaaga

SEQ ID NO: 3868179 - RNA, 22 nt, Shigella flexneri 2a str. 2457T
agcaauuuuccuugaaaaagag

SEQ ID NO: 3868180 - RNA, 17 nt, Shigella flexneri 2a str. 2457T
agcaauuuuuccugguu

SEQ ID NO: 3868181 - RNA, 20 nt, Shigella flexneri 2a str. 2457T
agcacaaacauccaucugcu

SEQ ID NO: 3868182 - RNA, 13 nt, Shigella flexneri 2a str. 2457T
agcacaaacccag

SEQ ID NO: 3868183 - RNA, 21 nt, Shigella flexneri 2a str. 2457T
agcacaaaguggcggcuaccc

SEQ ID NO: 3868184 - RNA, 18 nt, Shigella flexneri 2a str. 2457T
agcacaacaggcuauuuu

SEQ ID NO: 3868185 - RNA, 15 nt, Shigella flexneri 2a str. 2457T
agcacaaucacguca

SEQ ID NO: 3868186 - RNA, 23 nt, Shigella flexneri 2a str. 2457T
agcacacauaagagcgggacaac

SEQ ID NO: 3868187 - RNA, 24 nt, Shigella flexneri 2a str. 2457T
agcacacugguucccaacaacagc

SEQ ID NO: 3868188 - RNA, 20 nt, Shigella flexneri 2a str. 2457T
agcacacuguaagccaccga

SEQ ID NO: 3868189 - RNA, 21 nt, Shigella flexneri 2a str. 2457T
agcacaucacucauaaugaug

SEQ ID NO: 3868190 - RNA, 13 nt, Shigella flexneri 2a str. 2457T
agcacaucagcca

SEQ ID NO: 3868191 - RNA, 14 nt, Shigella flexneri 2a str. 2457T
agcacaucagccag

SEQ ID NO: 3868192 - RNA, 14 nt, Shigella flexneri 2a str. 2457T
agcacaucaucaaa

SEQ ID NO: 3868193 - RNA, 20 nt, Shigella flexneri 2a str. 2457T
agcacaucuggcgagucacc

SEQ ID NO: 3868194 - RNA, 23 nt, Shigella flexneri 2a str. 2457T
agcacaucuggcgagucaccaua

SEQ ID NO: 3868195 - RNA, 16 nt, Shigella flexneri 2a str. 2457T
agcacaugcugacauu

SEQ ID NO: 3868196 - RNA, 19 nt, Shigella flexneri 2a str. 2457T
agcaccagauaaugagaaa

SEQ ID NO: 3868197 - RNA, 13 nt, Shigella flexneri 2a str. 2457T
agcaccagcaacg

SEQ ID NO: 3868198 - RNA, 15 nt, Shigella flexneri 2a str. 2457T
agcaccagcagguga

SEQ ID NO: 3868199 - RNA, 18 nt, Shigella flexneri 2a str. 2457T
agcaccagcccgacgaua

SEQ ID NO: 3868200 - RNA, 17 nt, Shigella flexneri 2a str. 2457T
agcaccagggaaauaau

SEQ ID NO: 3868201 - RNA, 21 nt, Shigella flexneri 2a str. 2457T
agcaccauccgcccacaccag

SEQ ID NO: 3868202 - RNA, 16 nt, Shigella flexneri 2a str. 2457T
agcacccugaguuuuc

SEQ ID NO: 3868203 - RNA, 17 nt, Shigella flexneri 2a str. 2457T
agcaccgcgcuauuuuc

SEQ ID NO: 3868204 - RNA, 22 nt, Shigella flexneri 2a str. 2457T
agcaccgcgugcgcggcagcca

SEQ ID NO: 3868205 - RNA, 19 nt, Shigella flexneri 2a str. 2457T
agcaccggacuauccgccg

SEQ ID NO: 3868206 - RNA, 14 nt, Shigella flexneri 2a str. 2457T
agcaccggcggaau

SEQ ID NO: 3868207 - RNA, 17 nt, Shigella flexneri 2a str. 2457T
agcaccugcgcaggcau

SEQ ID NO: 3868208 - RNA, 16 nt, Shigella flexneri 2a str. 2457T
agcacgaaugucguuu

SEQ ID NO: 3868209 - RNA, 15 nt, Shigella flexneri 2a str. 2457T
agcacgaccgccauu

SEQ ID NO: 3868210 - RNA, 14 nt, Shigella flexneri 2a str. 2457T
agcacgacuauuau

SEQ ID NO: 3868211 - RNA, 17 nt, Shigella flexneri 2a str. 2457T
agcacgacuuucucuuc

SEQ ID NO: 3868212 - RNA, 22 nt, Shigella flexneri 2a str. 2457T
agcacgauuuguaggccggaua

SEQ ID NO: 3868213 - RNA, 13 nt, Shigella flexneri 2a str. 2457T
agcacgauuuugu

SEQ ID NO: 3868214 - RNA, 23 nt, Shigella flexneri 2a str. 2457T
agcacgauuuuguaggccggaua

SEQ ID NO: 3868215 - RNA, 21 nt, Shigella flexneri 2a str. 2457T
agcacgcagugagaagccacc

SEQ ID NO: 3868216 - RNA, 13 nt, Shigella flexneri 2a str. 2457T
agcacgccagaca

SEQ ID NO: 3868217 - RNA, 17 nt, Shigella flexneri 2a str. 2457T
agcacgccccggcggcc

SEQ ID NO: 3868218 - RNA, 18 nt, Shigella flexneri 2a str. 2457T
agcacggauaccgcacgc

SEQ ID NO: 3868219 - RNA, 13 nt, Shigella flexneri 2a str. 2457T
agcacggcagcaa

SEQ ID NO: 3868220 - RNA, 17 nt, Shigella flexneri 2a str. 2457T
agcacggucaggcuaaa

SEQ ID NO: 3868221 - RNA, 18 nt, Shigella flexneri 2a str. 2457T
agcacguaaaucuuuacc

SEQ ID NO: 3868222 - RNA, 18 nt, Shigella flexneri 2a str. 2457T
agcacgucuuccauugcc

SEQ ID NO: 3868223 - RNA, 14 nt, Shigella flexneri 2a str. 2457T
agcacguugaacug

SEQ ID NO: 3868224 - RNA, 15 nt, Shigella flexneri 2a str. 2457T
agcacuaugacugcc

SEQ ID NO: 3868225 - RNA, 20 nt, Shigella flexneri 2a str. 2457T
agcacucugacggauaguau

SEQ ID NO: 3868226 - RNA, 21 nt, Shigella flexneri 2a str. 2457T
agcacugauuuuuuccaacag

SEQ ID NO: 3868227 - RNA, 22 nt, Shigella flexneri 2a str. 2457T
agcacugccagaaucaagguga

SEQ ID NO: 3868228 - RNA, 13 nt, Shigella flexneri 2a str. 2457T
agcacuggcggca

SEQ ID NO: 3868229 - RNA, 15 nt, Shigella flexneri 2a str. 2457T
agcacuggcggcagc

SEQ ID NO: 3868230 - RNA, 19 nt, Shigella flexneri 2a str. 2457T
agcacuggcggcagcaggu

SEQ ID NO: 3868231 - RNA, 17 nt, Shigella flexneri 2a str. 2457T
agcacuguaaaccucuu

SEQ ID NO: 3868232 - RNA, 17 nt, Shigella flexneri 2a str. 2457T
agcacuucacccaucgc

SEQ ID NO: 3868233 - RNA, 20 nt, Shigella flexneri 2a str. 2457T
agcacuucgccaucugccag

SEQ ID NO: 3868234 - RNA, 14 nt, Shigella flexneri 2a str. 2457T
agcacuugcaggaa

SEQ ID NO: 3868235 - RNA, 18 nt, Shigella flexneri 2a str. 2457T
agcacuuucgccugcggc

SEQ ID NO: 3868236 - RNA, 13 nt, Shigella flexneri 2a str. 2457T
agcagaaagcgga

SEQ ID NO: 3868237 - RNA, 18 nt, Shigella flexneri 2a str. 2457T
agcagaaccagggaaaaa

SEQ ID NO: 3868238 - RNA, 13 nt, Shigella flexneri 2a str. 2457T
agcagaccagcaa

SEQ ID NO: 3868239 - RNA, 14 nt, Shigella flexneri 2a str. 2457T
agcagaccagcaaa

SEQ ID NO: 3868240 - RNA, 22 nt, Shigella flexneri 2a str. 2457T
agcaucggcagcgccagcgaag

SEQ ID NO: 3868241 - RNA, 18 nt, Shigella flexneri 2a str. 2457T
agcaucggugaggaucac

SEQ ID NO: 3868242 - RNA, 21 nt, Shigella flexneri 2a str. 2457T
agcaucggugaggaucaccag

SEQ ID NO: 3868243 - RNA, 14 nt, Shigella flexneri 2a str. 2457T
agcaucgucaucag

SEQ ID NO: 3868244 - RNA, 16 nt, Shigella flexneri 2a str. 2457T
agcaucgucaucagcu

SEQ ID NO: 3868245 - RNA, 15 nt, Shigella flexneri 2a str. 2457T
agcaucguccgccag

SEQ ID NO: 3868246 - RNA, 22 nt, Shigella flexneri 2a str. 2457T
agcaucuacucguuuauuaugc

SEQ ID NO: 3868247 - RNA, 15 nt, Shigella flexneri 2a str. 2457T
agcaucugccagcca

SEQ ID NO: 3868248 - RNA, 22 nt, Shigella flexneri 2a str. 2457T
agcaucuguucuuuuaacgcau

SEQ ID NO: 3868249 - RNA, 16 nt, Shigella flexneri 2a str. 2457T
agcaucuuauccagca

SEQ ID NO: 3868250 - RNA, 13 nt, Shigella flexneri 2a str. 2457T
agcaugaaaugaa

SEQ ID NO: 3868251 - RNA, 22 nt, Shigella flexneri 2a str. 2457T
agcaugaaaugaaaaucaccau

SEQ ID NO: 3868252 - RNA, 16 nt, Shigella flexneri 2a str. 2457T
agcaugaacauugcug

SEQ ID NO: 3868253 - RNA, 16 nt, Shigella flexneri 2a str. 2457T
agcaugaugccugaug

SEQ ID NO: 3868254 - RNA, 21 nt, Shigella flexneri 2a str. 2457T
agcaugauuucauaacugaug

SEQ ID NO: 3868255 - RNA, 14 nt, Shigella flexneri 2a str. 2457T
agcaugcacccuca

SEQ ID NO: 3868256 - RNA, 14 nt, Shigella flexneri 2a str. 2457T
agcauggcuucuuc

SEQ ID NO: 3868257 - RNA, 18 nt, Shigella flexneri 2a str. 2457T
agcauggcuucuuccccg

SEQ ID NO: 3868258 - RNA, 23 nt, Shigella flexneri 2a str. 2457T
agcauggcuucuuccccggauga

SEQ ID NO: 3868259 - RNA, 18 nt, Shigella flexneri 2a str. 2457T
agcaugggugaacugcuu

SEQ ID NO: 3868260 - RNA, 17 nt, Shigella flexneri 2a str. 2457T
agcauguguaaccgcuu

SEQ ID NO: 3868261 - RNA, 18 nt, Shigella flexneri 2a str. 2457T
agcauguguaaccgcuuu

SEQ ID NO: 3868262 - RNA, 14 nt, Shigella flexneri 2a str. 2457T
agcauuacacgcgg

SEQ ID NO: 3868263 - RNA, 18 nt, Shigella flexneri 2a str. 2457T
agcauuacccagauaaua

SEQ ID NO: 3868264 - RNA, 19 nt, Shigella flexneri 2a str. 2457T
agcauuacuuucggugacu

SEQ ID NO: 3868265 - RNA, 18 nt, Shigella flexneri 2a str. 2457T
agcauuauuuuuaaacau

SEQ ID NO: 3868266 - RNA, 20 nt, Shigella flexneri 2a str. 2457T
agcauucagacacgccgcca

SEQ ID NO: 3868267 - RNA, 12 nt, Shigella flexneri 2a str. 2457T
agcauucaguua

SEQ ID NO: 3868268 - RNA, 13 nt, Shigella flexneri 2a str. 2457T
agcauucaguuac

SEQ ID NO: 3868269 - RNA, 14 nt, Shigella flexneri 2a str. 2457T
agcauuccagauac

SEQ ID NO: 3868270 - RNA, 21 nt, Shigella flexneri 2a str. 2457T
agcauugaugcguuagaugau

SEQ ID NO: 3868271 - RNA, 17 nt, Shigella flexneri 2a str. 2457T
agcauuggcaugcacgu

SEQ ID NO: 3868272 - RNA, 13 nt, Shigella flexneri 2a str. 2457T
agcauuuaagcau

SEQ ID NO: 3868273 - RNA, 13 nt, Shigella flexneri 2a str. 2457T
agcauuucgcgau

SEQ ID NO: 3868274 - RNA, 18 nt, Shigella flexneri 2a str. 2457T
agcauuucuuccagcguu

SEQ ID NO: 3868275 - RNA, 20 nt, Shigella flexneri 2a str. 2457T
agccaaacgcccagcuaauc

SEQ ID NO: 3868276 - RNA, 16 nt, Shigella flexneri 2a str. 2457T
agccaaaucauccaga

SEQ ID NO: 3868277 - RNA, 13 nt, Shigella flexneri 2a str. 2457T
agccaaauccagc

SEQ ID NO: 3868278 - RNA, 16 nt, Shigella flexneri 2a str. 2457T
agccaaauccagcgca

SEQ ID NO: 3868279 - RNA, 13 nt, Shigella flexneri 2a str. 2457T
agccaacagcagc

SEQ ID NO: 3868280 - RNA, 20 nt, Shigella flexneri 2a str. 2457T
agccaacagcagccacacca

SEQ ID NO: 3868281 - RNA, 22 nt, Shigella flexneri 2a str. 2457T
agccaacgaugaugacguaauc

SEQ ID NO: 3868282 - RNA, 17 nt, Shigella flexneri 2a str. 2457T
agccaacuuaccgccgg

SEQ ID NO: 3868283 - RNA, 20 nt, Shigella flexneri 2a str. 2457T
agccaagcgccgccucagcc

SEQ ID NO: 3868284 - RNA, 20 nt, Shigella flexneri 2a str. 2457T
agccaauaaaugccaccaca

SEQ ID NO: 3868285 - RNA, 22 nt, Shigella flexneri 2a str. 2457T
agccaauaaaugccaccacacc

SEQ ID NO: 3868286 - RNA, 16 nt, Shigella flexneri 2a str. 2457T
agccaaucccggaagc

SEQ ID NO: 3868287 - RNA, 20 nt, Shigella flexneri 2a str. 2457T
agccaaucccggaagccacc

SEQ ID NO: 3868288 - RNA, 13 nt, Shigella flexneri 2a str. 2457T
agccaaugcaggc

SEQ ID NO: 3868289 - RNA, 22 nt, Shigella flexneri 2a str. 2457T
agccaauggggacaaucaccau

SEQ ID NO: 3868290 - RNA, 19 nt, Shigella flexneri 2a str. 2457T
agccaauuaacgaaaucuc

SEQ ID NO: 3868291 - RNA, 15 nt, Shigella flexneri 2a str. 2457T
agccacaccuggugc

SEQ ID NO: 3868292 - RNA, 22 nt, Shigella flexneri 2a str. 2457T
agccacacguuaaugcaaucaa

SEQ ID NO: 3868293 - RNA, 23 nt, Shigella flexneri 2a str. 2457T
agccacaggcuuuccugauaauc

SEQ ID NO: 3868294 - RNA, 16 nt, Shigella flexneri 2a str. 2457T
agccacagggugauca

SEQ ID NO: 3868295 - RNA, 17 nt, Shigella flexneri 2a str. 2457T
agccacauugcugcaca

SEQ ID NO: 3868296 - RNA, 13 nt, Shigella flexneri 2a str. 2457T
agccaccaucccg

SEQ ID NO: 3868297 - RNA, 13 nt, Shigella flexneri 2a str. 2457T
agccaccgccagc

SEQ ID NO: 3868298 - RNA, 13 nt, Shigella flexneri 2a str. 2457T
agccaccucaacg

SEQ ID NO: 3868299 - RNA, 18 nt, Shigella flexneri 2a str. 2457T
agccaccucaacggcaau

SEQ ID NO: 3868300 - RNA, 19 nt, Shigella flexneri 2a str. 2457T
agccacgccgaaccauguc

SEQ ID NO: 3868301 - RNA, 18 nt, Shigella flexneri 2a str. 2457T
agccacggcuccagcaau

SEQ ID NO: 3868302 - RNA, 19 nt, Shigella flexneri 2a str. 2457T
agccacggcuccagcaaug

SEQ ID NO: 3868303 - RNA, 20 nt, Shigella flexneri 2a str. 2457T
agccacggcuccagcaaugu

SEQ ID NO: 3868304 - RNA, 13 nt, Shigella flexneri 2a str. 2457T
agccacugcgcca

SEQ ID NO: 3868305 - RNA, 21 nt, Shigella flexneri 2a str. 2457T
agccacuucuuccagcggcag

SEQ ID NO: 3868306 - RNA, 16 nt, Shigella flexneri 2a str. 2457T
agccacuuucggcagc

SEQ ID NO: 3868307 - RNA, 13 nt, Shigella flexneri 2a str. 2457T
agccagacgccag

SEQ ID NO: 3868308 - RNA, 15 nt, Shigella flexneri 2a str. 2457T
agccagauggcugcc

SEQ ID NO: 3868309 - RNA, 15 nt, Shigella flexneri 2a str. 2457T
agccagcaccaggcu

SEQ ID NO: 3868310 - RNA, 17 nt, Shigella flexneri 2a str. 2457T
agccagcagagcaaaaa

SEQ ID NO: 3868311 - RNA, 19 nt, Shigella flexneri 2a str. 2457T
agccagcagcgaaucagcc

SEQ ID NO: 3868312 - RNA, 12 nt, Shigella flexneri 2a str. 2457T
agccagccaagc

SEQ ID NO: 3868313 - RNA, 18 nt, Shigella flexneri 2a str. 2457T
agccagccaagcauguca

SEQ ID NO: 3868314 - RNA, 17 nt, Shigella flexneri 2a str. 2457T
agccagccccacagcag

SEQ ID NO: 3868315 - RNA, 14 nt, Shigella flexneri 2a str. 2457T
agccagcgcauccu

SEQ ID NO: 3868316 - RNA, 18 nt, Shigella flexneri 2a str. 2457T
agccagcgcgccuucauu

SEQ ID NO: 3868317 - RNA, 13 nt, Shigella flexneri 2a str. 2457T
agccagcuggcag

SEQ ID NO: 3868318 - RNA, 14 nt, Shigella flexneri 2a str. 2457T
agccagcuggcaga

SEQ ID NO: 3868319 - RNA, 19 nt, Shigella flexneri 2a str. 2457T
agccaggaaccaccgaugc

SEQ ID NO: 3868320 - RNA, 17 nt, Shigella flexneri 2a str. 2457T
agccaggacgcagucca

SEQ ID NO: 3868321 - RNA, 17 nt, Shigella flexneri 2a str. 2457T
agccaggagccaacacu

SEQ ID NO: 3868322 - RNA, 22 nt, Shigella flexneri 2a str. 2457T
agccaggagccaacacuuucac

SEQ ID NO: 3868323 - RNA, 23 nt, Shigella flexneri 2a str. 2457T
agccaggagccaacacuuucacu

SEQ ID NO: 3868324 - RNA, 15 nt, Shigella flexneri 2a str. 2457T
agccaggcacgccgc

SEQ ID NO: 3868325 - RNA, 15 nt, Shigella flexneri 2a str. 2457T
agccaggccgccagu

SEQ ID NO: 3868326 - RNA, 18 nt, Shigella flexneri 2a str. 2457T
agccagggucaacauaaa

SEQ ID NO: 3868327 - RNA, 19 nt, Shigella flexneri 2a str. 2457T
agccagguuuaccagcagc

SEQ ID NO: 3868328 - RNA, 14 nt, Shigella flexneri 2a str. 2457T
agccagucaguaac

SEQ ID NO: 3868329 - RNA, 16 nt, Shigella flexneri 2a str. 2457T
agccaguccagaaaug

SEQ ID NO: 3868330 - RNA, 17 nt, Shigella flexneri 2a str. 2457T
agccagugauuaacgcg

SEQ ID NO: 3868331 - RNA, 13 nt, Shigella flexneri 2a str. 2457T
agccauaaagaaa

SEQ ID NO: 3868332 - RNA, 24 nt, Shigella flexneri 2a str. 2457T
agccauaaucacucuuccccgcuu

SEQ ID NO: 3868333 - RNA, 12 nt, Shigella flexneri 2a str. 2457T
agccaucaccac

SEQ ID NO: 3868334 - RNA, 12 nt, Shigella flexneri 2a str. 2457T
agccaucaccau

SEQ ID NO: 3868335 - RNA, 11 nt, Shigella flexneri 2a str. 2457T
agccaucaucc

SEQ ID NO: 3868336 - RNA, 12 nt, Shigella flexneri 2a str. 2457T
agccauccagca

SEQ ID NO: 3868337 - RNA, 16 nt, Shigella flexneri 2a str. 2457T
agccaucccagacacc

SEQ ID NO: 3868338 - RNA, 23 nt, Shigella flexneri 2a str. 2457T
agccuguuuagccgcuucugcag

SEQ ID NO: 3868339 - RNA, 16 nt, Shigella flexneri 2a str. 2457T
agccuuccuugugcaa

SEQ ID NO: 3868340 - RNA, 21 nt, Shigella flexneri 2a str. 2457T
agccuucgccaccguguucau

SEQ ID NO: 3868341 - RNA, 21 nt, Shigella flexneri 2a str. 2457T
agccuucgccuuucaguucaa

SEQ ID NO: 3868342 - RNA, 21 nt, Shigella flexneri 2a str. 2457T
agccuucggacguuugccaug

SEQ ID NO: 3868343 - RNA, 22 nt, Shigella flexneri 2a str. 2457T
agccuucgggcuggcauuuuuu

SEQ ID NO: 3868344 - RNA, 19 nt, Shigella flexneri 2a str. 2457T
agccuugccguuugcugcu

SEQ ID NO: 3868345 - RNA, 12 nt, Shigella flexneri 2a str. 2457T
agccuuucacuu

SEQ ID NO: 3868346 - RNA, 12 nt, Shigella flexneri 2a str. 2457T
agccuuucucag

SEQ ID NO: 3868347 - RNA, 14 nt, Shigella flexneri 2a str. 2457T
agcgaaaucgccuu

SEQ ID NO: 3868348 - RNA, 17 nt, Shigella flexneri 2a str. 2457T
agcgaagcgaacaucga

SEQ ID NO: 3868349 - RNA, 14 nt, Shigella flexneri 2a str. 2457T
agcgaaggaucacc

SEQ ID NO: 3868350 - RNA, 18 nt, Shigella flexneri 2a str. 2457T
agcgaauaaaaaaagaaa

SEQ ID NO: 3868351 - RNA, 21 nt, Shigella flexneri 2a str. 2457T
agcgaauaccgggcaguacca

SEQ ID NO: 3868352 - RNA, 18 nt, Shigella flexneri 2a str. 2457T
agcgaaugaggcagcaag

SEQ ID NO: 3868353 - RNA, 12 nt, Shigella flexneri 2a str. 2457T
agcgaauuuuuc

SEQ ID NO: 3868354 - RNA, 19 nt, Shigella flexneri 2a str. 2457T
agcgacaaacgccugaaca

SEQ ID NO: 3868355 - RNA, 19 nt, Shigella flexneri 2a str. 2457T
agcgacagggccaggaauc

SEQ ID NO: 3868356 - RNA, 13 nt, Shigella flexneri 2a str. 2457T
agcgaccgcuuca

SEQ ID NO: 3868357 - RNA, 21 nt, Shigella flexneri 2a str. 2457T
agcgacgggcgacaaacgcug

SEQ ID NO: 3868358 - RNA, 16 nt, Shigella flexneri 2a str. 2457T
agcgacugcgccgugu

SEQ ID NO: 3868359 - RNA, 18 nt, Shigella flexneri 2a str. 2457T
agcgacuuugccuggcgg

SEQ ID NO: 3868360 - RNA, 18 nt, Shigella flexneri 2a str. 2457T
agcgagagcaaugcgcau

SEQ ID NO: 3868361 - RNA, 16 nt, Shigella flexneri 2a str. 2457T
agcgagcuggcgcuga

SEQ ID NO: 3868362 - RNA, 18 nt, Shigella flexneri 2a str. 2457T
agcgagcuggcgcugaua

SEQ ID NO: 3868363 - RNA, 16 nt, Shigella flexneri 2a str. 2457T
agcgagggagaaaacc

SEQ ID NO: 3868364 - RNA, 21 nt, Shigella flexneri 2a str. 2457T
agcgagggagaaaacccggcc

SEQ ID NO: 3868365 - RNA, 21 nt, Shigella flexneri 2a str. 2457T
agcgaguuugaucucgaugcc

SEQ ID NO: 3868366 - RNA, 19 nt, Shigella flexneri 2a str. 2457T
agcgaguuuuucaguccac

SEQ ID NO: 3868367 - RNA, 15 nt, Shigella flexneri 2a str. 2457T
agcgauaauuuaugc

SEQ ID NO: 3868368 - RNA, 23 nt, Shigella flexneri 2a str. 2457T
agcgauacauacugagaaccuuu

SEQ ID NO: 3868369 - RNA, 21 nt, Shigella flexneri 2a str. 2457T
agcgaugcccagugaccaaag

SEQ ID NO: 3868370 - RNA, 18 nt, Shigella flexneri 2a str. 2457T
agcgauggguuaacauca

SEQ ID NO: 3868371 - RNA, 18 nt, Shigella flexneri 2a str. 2457T
agcgauuaccauuucacc

SEQ ID NO: 3868372 - RNA, 13 nt, Shigella flexneri 2a str. 2457T
agcgauucagcac

SEQ ID NO: 3868373 - RNA, 15 nt, Shigella flexneri 2a str. 2457T
agcgauuccaguucg

SEQ ID NO: 3868374 - RNA, 20 nt, Shigella flexneri 2a str. 2457T
agcgauucucgccgcccuga

SEQ ID NO: 3868375 - RNA, 18 nt, Shigella flexneri 2a str. 2457T
agcgauuuguaggccuga

SEQ ID NO: 3868376 - RNA, 24 nt, Shigella flexneri 2a str. 2457T
agcgcaaaacgcaggauccacgcc

SEQ ID NO: 3868377 - RNA, 20 nt, Shigella flexneri 2a str. 2457T
agcgcaaaauaccagcaauu

SEQ ID NO: 3868378 - RNA, 14 nt, Shigella flexneri 2a str. 2457T
agcgcaaauugcug

SEQ ID NO: 3868379 - RNA, 15 nt, Shigella flexneri 2a str. 2457T
agcgcaaauugcugg

SEQ ID NO: 3868380 - RNA, 18 nt, Shigella flexneri 2a str. 2457T
agcgcaagggccgcagcu

SEQ ID NO: 3868381 - RNA, 22 nt, Shigella flexneri 2a str. 2457T
agcgcaauccaccauuggcgca

SEQ ID NO: 3868382 - RNA, 16 nt, Shigella flexneri 2a str. 2457T
agcgcacaacguuccu

SEQ ID NO: 3868383 - RNA, 22 nt, Shigella flexneri 2a str. 2457T
agcgcacaacguuccuucguuc

SEQ ID NO: 3868384 - RNA, 12 nt, Shigella flexneri 2a str. 2457T
agcgcaccagaa

SEQ ID NO: 3868385 - RNA, 17 nt, Shigella flexneri 2a str. 2457T
agcgcaccagaaacaau

SEQ ID NO: 3868386 - RNA, 20 nt, Shigella flexneri 2a str. 2457T
agcgcaccugaucagcaauc

SEQ ID NO: 3868387 - RNA, 20 nt, Shigella flexneri 2a str. 2457T
agcgcacuuugccagaaauc

SEQ ID NO: 3868388 - RNA, 21 nt, Shigella flexneri 2a str. 2457T
agcgcacuuugucaucagucu

SEQ ID NO: 3868389 - RNA, 16 nt, Shigella flexneri 2a str. 2457T
agcgcagauagcccgg

SEQ ID NO: 3868390 - RNA, 15 nt, Shigella flexneri 2a str. 2457T
agcgcagcagcgcgc

SEQ ID NO: 3868391 - RNA, 21 nt, Shigella flexneri 2a str. 2457T
agcgcaggaaagauaagcgaa

SEQ ID NO: 3868392 - RNA, 24 nt, Shigella flexneri 2a str. 2457T
agcgcaggaaagauaagcgaacau

SEQ ID NO: 3868393 - RNA, 15 nt, Shigella flexneri 2a str. 2457T
agcgcagucaccagc

SEQ ID NO: 3868394 - RNA, 12 nt, Shigella flexneri 2a str. 2457T
agcgcagugaca

SEQ ID NO: 3868395 - RNA, 20 nt, Shigella flexneri 2a str. 2457T
agcgcagugacauucaccuc

SEQ ID NO: 3868396 - RNA, 16 nt, Shigella flexneri 2a str. 2457T
agcgcauaagccaccu

SEQ ID NO: 3868397 - RNA, 19 nt, Shigella flexneri 2a str. 2457T
agcgcaucaggcaaucucu

SEQ ID NO: 3868398 - RNA, 13 nt, Shigella flexneri 2a str. 2457T
agcgcauccggca

SEQ ID NO: 3868399 - RNA, 21 nt, Shigella flexneri 2a str. 2457T
agcgcauccggcaccagcgca

SEQ ID NO: 3868400 - RNA, 16 nt, Shigella flexneri 2a str. 2457T
agcgccaacggugaaa

SEQ ID NO: 3868401 - RNA, 22 nt, Shigella flexneri 2a str. 2457T
agcgccaccacaaaagcgguga

SEQ ID NO: 3868402 - RNA, 23 nt, Shigella flexneri 2a str. 2457T
agcgccaccagcgccgcgccacu

SEQ ID NO: 3868403 - RNA, 14 nt, Shigella flexneri 2a str. 2457T
agcgccaccgguuu

SEQ ID NO: 3868404 - RNA, 19 nt, Shigella flexneri 2a str. 2457T
agcgccaccgucagugcga

SEQ ID NO: 3868405 - RNA, 14 nt, Shigella flexneri 2a str. 2457T
agcgccagaaggga

SEQ ID NO: 3868406 - RNA, 17 nt, Shigella flexneri 2a str. 2457T
agcgccagacaaaccac

SEQ ID NO: 3868407 - RNA, 18 nt, Shigella flexneri 2a str. 2457T
agcgccagacacuggaaa

SEQ ID NO: 3868408 - RNA, 23 nt, Shigella flexneri 2a str. 2457T
agcgccagauaugaucgaaaaug

SEQ ID NO: 3868409 - RNA, 22 nt, Shigella flexneri 2a str. 2457T
agcgccagcaagagcaaauaaa

SEQ ID NO: 3868410 - RNA, 12 nt, Shigella flexneri 2a str. 2457T
agcgccagcaug

SEQ ID NO: 3868411 - RNA, 17 nt, Shigella flexneri 2a str. 2457T
agcgccagccagauggg

SEQ ID NO: 3868412 - RNA, 15 nt, Shigella flexneri 2a str. 2457T
agcgccagccauuca

SEQ ID NO: 3868413 - RNA, 13 nt, Shigella flexneri 2a str. 2457T
agcgccagcgaag

SEQ ID NO: 3868414 - RNA, 19 nt, Shigella flexneri 2a str. 2457T
agcgccagcgaagccagcu

SEQ ID NO: 3868415 - RNA, 12 nt, Shigella flexneri 2a str. 2457T
agcgccagggcu

SEQ ID NO: 3868416 - RNA, 23 nt, Shigella flexneri 2a str. 2457T
agcgccaucccuaccgcccgcgc

SEQ ID NO: 3868417 - RNA, 22 nt, Shigella flexneri 2a str. 2457T
agcgccauuucuucuccggcau

SEQ ID NO: 3868418 - RNA, 16 nt, Shigella flexneri 2a str. 2457T
agcgcccgccagcacc

SEQ ID NO: 3868419 - RNA, 18 nt, Shigella flexneri 2a str. 2457T
agcgcccgccagcaccgg

SEQ ID NO: 3868420 - RNA, 15 nt, Shigella flexneri 2a str. 2457T
agcgcccgcuugcga

SEQ ID NO: 3868421 - RNA, 23 nt, Shigella flexneri 2a str. 2457T
agcgcccugcaaugucaucagca

SEQ ID NO: 3868422 - RNA, 18 nt, Shigella flexneri 2a str. 2457T
agcgccgacagcagcccu

SEQ ID NO: 3868423 - RNA, 22 nt, Shigella flexneri 2a str. 2457T
agcgccgaguaaaaaaacauca

SEQ ID NO: 3868424 - RNA, 14 nt, Shigella flexneri 2a str. 2457T
agcgccgccacugc

SEQ ID NO: 3868425 - RNA, 19 nt, Shigella flexneri 2a str. 2457T
agcgccgccacugccacca

SEQ ID NO: 3868426 - RNA, 20 nt, Shigella flexneri 2a str. 2457T
agcgccgccagaaucaccuc

SEQ ID NO: 3868427 - RNA, 15 nt, Shigella flexneri 2a str. 2457T
agcgccgccucagcc

SEQ ID NO: 3868428 - RNA, 17 nt, Shigella flexneri 2a str. 2457T
agcgccgccuccucaga

SEQ ID NO: 3868429 - RNA, 19 nt, Shigella flexneri 2a str. 2457T
agcgccgccuccucagaaa

SEQ ID NO: 3868430 - RNA, 17 nt, Shigella flexneri 2a str. 2457T
agcgccgcuuuccaggc

SEQ ID NO: 3868431 - RNA, 20 nt, Shigella flexneri 2a str. 2457T
agcgccgcuuuuugugcgga

SEQ ID NO: 3868432 - RNA, 22 nt, Shigella flexneri 2a str. 2457T
agcgccgggaaugccacgcaaa

SEQ ID NO: 3868433 - RNA, 19 nt, Shigella flexneri 2a str. 2457T
agcgccguugcgcccauca

SEQ ID NO: 3868434 - RNA, 12 nt, Shigella flexneri 2a str. 2457T
agcgccuaaauc

SEQ ID NO: 3868435 - RNA, 20 nt, Shigella flexneri 2a str. 2457T
agcguuccauaauggcgcga

SEQ ID NO: 3868436 - RNA, 17 nt, Shigella flexneri 2a str. 2457T
agcguucgccaaaccca

SEQ ID NO: 3868437 - RNA, 15 nt, Shigella flexneri 2a str. 2457T
agcguuugcggcugu

SEQ ID NO: 3868438 - RNA, 21 nt, Shigella flexneri 2a str. 2457T
agcuaacgaaaauggccugau

SEQ ID NO: 3868439 - RNA, 20 nt, Shigella flexneri 2a str. 2457T
agcuaaucaucaucagugcu

SEQ ID NO: 3868440 - RNA, 22 nt, Shigella flexneri 2a str. 2457T
agcuaauggcugcgggcgacca

SEQ ID NO: 3868441 - RNA, 13 nt, Shigella flexneri 2a str. 2457T
agcuaccagcccc

SEQ ID NO: 3868442 - RNA, 22 nt, Shigella flexneri 2a str. 2457T
agcucacaaauacgcuuuuucc

SEQ ID NO: 3868443 - RNA, 19 nt, Shigella flexneri 2a str. 2457T
agcucagcuggauagagua

SEQ ID NO: 3868444 - RNA, 12 nt, Shigella flexneri 2a str. 2457T
agcucagugacc

SEQ ID NO: 3868445 - RNA, 15 nt, Shigella flexneri 2a str. 2457T
agcucagugaccgaa

SEQ ID NO: 3868446 - RNA, 19 nt, Shigella flexneri 2a str. 2457T
agcucaguuaacggcauaa

SEQ ID NO: 3868447 - RNA, 19 nt, Shigella flexneri 2a str. 2457T
agcucauaaccguccaguu

SEQ ID NO: 3868448 - RNA, 22 nt, Shigella flexneri 2a str. 2457T
agcucaucaagcuguucuuccc

SEQ ID NO: 3868449 - RNA, 11 nt, Shigella flexneri 2a str. 2457T
agcucaucguu

SEQ ID NO: 3868450 - RNA, 15 nt, Shigella flexneri 2a str. 2457T
agcucaucuaaugca

SEQ ID NO: 3868451 - RNA, 19 nt, Shigella flexneri 2a str. 2457T
agcucaugggcuuucauca

SEQ ID NO: 3868452 - RNA, 14 nt, Shigella flexneri 2a str. 2457T
agcucauuaaaaau

SEQ ID NO: 3868453 - RNA, 18 nt, Shigella flexneri 2a str. 2457T
agcuccacaagaaugccu

SEQ ID NO: 3868454 - RNA, 21 nt, Shigella flexneri 2a str. 2457T
agcuccacaagaaugccugcc

SEQ ID NO: 3868455 - RNA, 22 nt, Shigella flexneri 2a str. 2457T
agcuccacaagaaugccugcca

SEQ ID NO: 3868456 - RNA, 18 nt, Shigella flexneri 2a str. 2457T
agcuccaccgauuuugag

SEQ ID NO: 3868457 - RNA, 16 nt, Shigella flexneri 2a str. 2457T
agcuccagccgcuccc

SEQ ID NO: 3868458 - RNA, 11 nt, Shigella flexneri 2a str. 2457T
agcuccagguc

SEQ ID NO: 3868459 - RNA, 18 nt, Shigella flexneri 2a str. 2457T
agcuccauccaccagccc

SEQ ID NO: 3868460 - RNA, 13 nt, Shigella flexneri 2a str. 2457T
agcucccaggcuc

SEQ ID NO: 3868461 - RNA, 18 nt, Shigella flexneri 2a str. 2457T
agcuccgggcugguuuuc

SEQ ID NO: 3868462 - RNA, 24 nt, Shigella flexneri 2a str. 2457T
agcuccgggcugguuuucagcgaa

SEQ ID NO: 3868463 - RNA, 15 nt, Shigella flexneri 2a str. 2457T
agcuccguccagcca

SEQ ID NO: 3868464 - RNA, 20 nt, Shigella flexneri 2a str. 2457T
agcuccguuaaccgugggaa

SEQ ID NO: 3868465 - RNA, 18 nt, Shigella flexneri 2a str. 2457T
agcuccucgaguccuucc

SEQ ID NO: 3868466 - RNA, 17 nt, Shigella flexneri 2a str. 2457T
agcuccucuuucaucuc

SEQ ID NO: 3868467 - RNA, 15 nt, Shigella flexneri 2a str. 2457T
agcuccugcauugac

SEQ ID NO: 3868468 - RNA, 16 nt, Shigella flexneri 2a str. 2457T
agcucgacaccaaaca

SEQ ID NO: 3868469 - RNA, 16 nt, Shigella flexneri 2a str. 2457T
agcucgcuucaucugc

SEQ ID NO: 3868470 - RNA, 14 nt, Shigella flexneri 2a str. 2457T
agcucggauaaggc

SEQ ID NO: 3868471 - RNA, 20 nt, Shigella flexneri 2a str. 2457T
agcucguuguuuaugccgga

SEQ ID NO: 3868472 - RNA, 19 nt, Shigella flexneri 2a str. 2457T
agcucguuuacaaccugau

SEQ ID NO: 3868473 - RNA, 18 nt, Shigella flexneri 2a str. 2457T
agcucucagacgauuacu

SEQ ID NO: 3868474 - RNA, 19 nt, Shigella flexneri 2a str. 2457T
agcucucagccagcuggca

SEQ ID NO: 3868475 - RNA, 23 nt, Shigella flexneri 2a str. 2457T
agcucuucuucacucucaccacg

SEQ ID NO: 3868476 - RNA, 23 nt, Shigella flexneri 2a str. 2457T
agcucuuuuaacuuacgcgucag

SEQ ID NO: 3868477 - RNA, 15 nt, Shigella flexneri 2a str. 2457T
agcucuuuuccagcc

SEQ ID NO: 3868478 - RNA, 18 nt, Shigella flexneri 2a str. 2457T
agcugaaaauggcgcugu

SEQ ID NO: 3868479 - RNA, 15 nt, Shigella flexneri 2a str. 2457T
agcugaaaguuuucu

SEQ ID NO: 3868480 - RNA, 17 nt, Shigella flexneri 2a str. 2457T
agcugaacaagaauaca

SEQ ID NO: 3868481 - RNA, 17 nt, Shigella flexneri 2a str. 2457T
agcugaagcucguuguu

SEQ ID NO: 3868482 - RNA, 13 nt, Shigella flexneri 2a str. 2457T
agcugacguagca

SEQ ID NO: 3868483 - RNA, 23 nt, Shigella flexneri 2a str. 2457T
agcugauacgggaggucaucagc

SEQ ID NO: 3868484 - RNA, 19 nt, Shigella flexneri 2a str. 2457T
agcugauccuucuguucuu

SEQ ID NO: 3868485 - RNA, 18 nt, Shigella flexneri 2a str. 2457T
agcugaugauuaacagca

SEQ ID NO: 3868486 - RNA, 16 nt, Shigella flexneri 2a str. 2457T
agcugauucagauaau

SEQ ID NO: 3868487 - RNA, 23 nt, Shigella flexneri 2a str. 2457T
agcugauucgcgacguaagaaag

SEQ ID NO: 3868488 - RNA, 19 nt, Shigella flexneri 2a str. 2457T
agcugauugcggagaaggu

SEQ ID NO: 3868489 - RNA, 15 nt, Shigella flexneri 2a str. 2457T
agcugcaagaugaau

SEQ ID NO: 3868490 - RNA, 23 nt, Shigella flexneri 2a str. 2457T
agcugcacacagggcgcuagcca

SEQ ID NO: 3868491 - RNA, 18 nt, Shigella flexneri 2a str. 2457T
agcugcacgaugacugaa

SEQ ID NO: 3868492 - RNA, 22 nt, Shigella flexneri 2a str. 2457T
agcugcauccgggguucgaauc

SEQ ID NO: 3868493 - RNA, 23 nt, Shigella flexneri 2a str. 2457T
agcugcauuucauauucaaaauc

SEQ ID NO: 3868494 - RNA, 16 nt, Shigella flexneri 2a str. 2457T
agcugccaguugucgg

SEQ ID NO: 3868495 - RNA, 12 nt, Shigella flexneri 2a str. 2457T
agcugcccggcu

SEQ ID NO: 3868496 - RNA, 18 nt, Shigella flexneri 2a str. 2457T
agcugccgacgccaguuc

SEQ ID NO: 3868497 - RNA, 17 nt, Shigella flexneri 2a str. 2457T
agcugccguccccauca

SEQ ID NO: 3868498 - RNA, 17 nt, Shigella flexneri 2a str. 2457T
agcugcgacaucauuuu

SEQ ID NO: 3868499 - RNA, 18 nt, Shigella flexneri 2a str. 2457T
agcugcgcaucaugccac

SEQ ID NO: 3868500 - RNA, 21 nt, Shigella flexneri 2a str. 2457T
agcugcgcaucaugccaccca

SEQ ID NO: 3868501 - RNA, 17 nt, Shigella flexneri 2a str. 2457T
agcugcgcguuaucuac

SEQ ID NO: 3868502 - RNA, 22 nt, Shigella flexneri 2a str. 2457T
agcugcggauccugagcaaaca

SEQ ID NO: 3868503 - RNA, 22 nt, Shigella flexneri 2a str. 2457T
agcugcguuugaaauaccaggu

SEQ ID NO: 3868504 - RNA, 16 nt, Shigella flexneri 2a str. 2457T
agcugcucccagcgca

SEQ ID NO: 3868505 - RNA, 19 nt, Shigella flexneri 2a str. 2457T
agcugcucgcgagaacggc

SEQ ID NO: 3868506 - RNA, 23 nt, Shigella flexneri 2a str. 2457T
agcuggaaaaucuacguuaaaaa

SEQ ID NO: 3868507 - RNA, 16 nt, Shigella flexneri 2a str. 2457T
agcuggacggucugcu

SEQ ID NO: 3868508 - RNA, 23 nt, Shigella flexneri 2a str. 2457T
agcuggaggaccuuauggaucug

SEQ ID NO: 3868509 - RNA, 12 nt, Shigella flexneri 2a str. 2457T
agcuggcaaagu

SEQ ID NO: 3868510 - RNA, 14 nt, Shigella flexneri 2a str. 2457T
agcuggcaucagca

SEQ ID NO: 3868511 - RNA, 18 nt, Shigella flexneri 2a str. 2457T
agcuggcaucagcaaaca

SEQ ID NO: 3868512 - RNA, 16 nt, Shigella flexneri 2a str. 2457T
agcuggcauugauguu

SEQ ID NO: 3868513 - RNA, 22 nt, Shigella flexneri 2a str. 2457T
agcuggcgacgccucuauuaaa

SEQ ID NO: 3868514 - RNA, 20 nt, Shigella flexneri 2a str. 2457T
agcugggcgauuuucuacuu

SEQ ID NO: 3868515 - RNA, 15 nt, Shigella flexneri 2a str. 2457T
agcuggguacgaaaa

SEQ ID NO: 3868516 - RNA, 16 nt, Shigella flexneri 2a str. 2457T
agcugucagaacgguu

SEQ ID NO: 3868517 - RNA, 21 nt, Shigella flexneri 2a str. 2457T
agcugugggguauuuccaggg

SEQ ID NO: 3868518 - RNA, 23 nt, Shigella flexneri 2a str. 2457T
agcugugggguauuuccagggcc

SEQ ID NO: 3868519 - RNA, 15 nt, Shigella flexneri 2a str. 2457T
agcuguucaggagaa

SEQ ID NO: 3868520 - RNA, 18 nt, Shigella flexneri 2a str. 2457T
agcuuaaucaccagcgca

SEQ ID NO: 3868521 - RNA, 24 nt, Shigella flexneri 2a str. 2457T
agcuuacgcugauauucgacacca

SEQ ID NO: 3868522 - RNA, 19 nt, Shigella flexneri 2a str. 2457T
agcuuacguuacccagcac

SEQ ID NO: 3868523 - RNA, 14 nt, Shigella flexneri 2a str. 2457T
agcuuauccagcaa

SEQ ID NO: 3868524 - RNA, 18 nt, Shigella flexneri 2a str. 2457T
agcuuauuaacagucagu

SEQ ID NO: 3868525 - RNA, 20 nt, Shigella flexneri 2a str. 2457T
agcuucaaauagugccuggc

SEQ ID NO: 3868526 - RNA, 22 nt, Shigella flexneri 2a str. 2457T
agcuucaaaucauuacaguuuc

SEQ ID NO: 3868527 - RNA, 20 nt, Shigella flexneri 2a str. 2457T
agcuucaaauuagccgcagg

SEQ ID NO: 3868528 - RNA, 21 nt, Shigella flexneri 2a str. 2457T
agcuucaauugccaccaugca

SEQ ID NO: 3868529 - RNA, 21 nt, Shigella flexneri 2a str. 2457T
agcuucacaaaggcuugcugc

SEQ ID NO: 3868530 - RNA, 12 nt, Shigella flexneri 2a str. 2457T
agcuucacccgc

SEQ ID NO: 3868531 - RNA, 15 nt, Shigella flexneri 2a str. 2457T
agcuucaccgcaucg

SEQ ID NO: 3868532 - RNA, 21 nt, Shigella flexneri 2a str. 2457T
aggcaagccgcuaacagcagc

SEQ ID NO: 3868533 - RNA, 15 nt, Shigella flexneri 2a str. 2457T
aggcacaaaaccugc

SEQ ID NO: 3868534 - RNA, 22 nt, Shigella flexneri 2a str. 2457T
aggcacaaguuuuuaggcauga

SEQ ID NO: 3868535 - RNA, 17 nt, Shigella flexneri 2a str. 2457T
aggcaccagccccugga

SEQ ID NO: 3868536 - RNA, 15 nt, Shigella flexneri 2a str. 2457T
aggcagaaacaaacg

SEQ ID NO: 3868537 - RNA, 18 nt, Shigella flexneri 2a str. 2457T
aggcagacguauccugga

SEQ ID NO: 3868538 - RNA, 15 nt, Shigella flexneri 2a str. 2457T
aggcagauacaacca

SEQ ID NO: 3868539 - RNA, 16 nt, Shigella flexneri 2a str. 2457T
aggcagauccaguuac

SEQ ID NO: 3868540 - RNA, 22 nt, Shigella flexneri 2a str. 2457T
aggcagcaucucgcgcucuucu

SEQ ID NO: 3868541 - RNA, 15 nt, Shigella flexneri 2a str. 2457T
aggcagccuuucuca

SEQ ID NO: 3868542 - RNA, 16 nt, Shigella flexneri 2a str. 2457T
aggcagcuuagaaauc

SEQ ID NO: 3868543 - RNA, 18 nt, Shigella flexneri 2a str. 2457T
aggcaggucuuucaccug

SEQ ID NO: 3868544 - RNA, 18 nt, Shigella flexneri 2a str. 2457T
aggcagguuaaugaccca

SEQ ID NO: 3868545 - RNA, 22 nt, Shigella flexneri 2a str. 2457T
aggcaguaaaccgucagcacca

SEQ ID NO: 3868546 - RNA, 14 nt, Shigella flexneri 2a str. 2457T
aggcaguuuaucca

SEQ ID NO: 3868547 - RNA, 20 nt, Shigella flexneri 2a str. 2457T
aggcaucacuuuaccgguuu

SEQ ID NO: 3868548 - RNA, 16 nt, Shigella flexneri 2a str. 2457T
aggcaucagacaaaug

SEQ ID NO: 3868549 - RNA, 21 nt, Shigella flexneri 2a str. 2457T
aggcaucagaucccaauucau

SEQ ID NO: 3868550 - RNA, 13 nt, Shigella flexneri 2a str. 2457T
aggcaucagcaau

SEQ ID NO: 3868551 - RNA, 14 nt, Shigella flexneri 2a str. 2457T
aggcaucagcaauu

SEQ ID NO: 3868552 - RNA, 20 nt, Shigella flexneri 2a str. 2457T
aggcaucagcaauuguaaau

SEQ ID NO: 3868553 - RNA, 22 nt, Shigella flexneri 2a str. 2457T
aggcaucggugcacuccgccac

SEQ ID NO: 3868554 - RNA, 16 nt, Shigella flexneri 2a str. 2457T
aggcaucuucuucauu

SEQ ID NO: 3868555 - RNA, 15 nt, Shigella flexneri 2a str. 2457T
aggcauuaucucuug

SEQ ID NO: 3868556 - RNA, 16 nt, Shigella flexneri 2a str. 2457T
aggcauucuuuuucau

SEQ ID NO: 3868557 - RNA, 23 nt, Shigella flexneri 2a str. 2457T
aggcauuuacgccgcauccggca

SEQ ID NO: 3868558 - RNA, 19 nt, Shigella flexneri 2a str. 2457T
aggccaaaaaacagccccu

SEQ ID NO: 3868559 - RNA, 18 nt, Shigella flexneri 2a str. 2457T
aggccaaagccgccgagc

SEQ ID NO: 3868560 - RNA, 17 nt, Shigella flexneri 2a str. 2457T
aggccaaauccuuccag

SEQ ID NO: 3868561 - RNA, 17 nt, Shigella flexneri 2a str. 2457T
aggccaacggcccauac

SEQ ID NO: 3868562 - RNA, 16 nt, Shigella flexneri 2a str. 2457T
aggccaaucagcaaua

SEQ ID NO: 3868563 - RNA, 17 nt, Shigella flexneri 2a str. 2457T
aggccaaucagcaauaa

SEQ ID NO: 3868564 - RNA, 18 nt, Shigella flexneri 2a str. 2457T
aggccaaucagcaauaaa

SEQ ID NO: 3868565 - RNA, 16 nt, Shigella flexneri 2a str. 2457T
aggccaauccagcccu

SEQ ID NO: 3868566 - RNA, 22 nt, Shigella flexneri 2a str. 2457T
aggccacccuguacgaaaacgg

SEQ ID NO: 3868567 - RNA, 15 nt, Shigella flexneri 2a str. 2457T
aggccagauaagacg

SEQ ID NO: 3868568 - RNA, 12 nt, Shigella flexneri 2a str. 2457T
aggccagcaauc

SEQ ID NO: 3868569 - RNA, 16 nt, Shigella flexneri 2a str. 2457T
aggccagcguaccuug

SEQ ID NO: 3868570 - RNA, 16 nt, Shigella flexneri 2a str. 2457T
aggccaucacauccug

SEQ ID NO: 3868571 - RNA, 13 nt, Shigella flexneri 2a str. 2457T
aggccaucagcag

SEQ ID NO: 3868572 - RNA, 23 nt, Shigella flexneri 2a str. 2457T
aggcccaacuguugauccaggag

SEQ ID NO: 3868573 - RNA, 15 nt, Shigella flexneri 2a str. 2457T
aggccgacagcaggc

SEQ ID NO: 3868574 - RNA, 15 nt, Shigella flexneri 2a str. 2457T
aggccgacuggcaug

SEQ ID NO: 3868575 - RNA, 16 nt, Shigella flexneri 2a str. 2457T
aggccgaggcacagca

SEQ ID NO: 3868576 - RNA, 23 nt, Shigella flexneri 2a str. 2457T
aggccgccaguguuggcgucaga

SEQ ID NO: 3868577 - RNA, 19 nt, Shigella flexneri 2a str. 2457T
aggccggauaagaugcgcc

SEQ ID NO: 3868578 - RNA, 22 nt, Shigella flexneri 2a str. 2457T
aggccggauaagaugcgccagc

SEQ ID NO: 3868579 - RNA, 14 nt, Shigella flexneri 2a str. 2457T
aggccggauaagcg

SEQ ID NO: 3868580 - RNA, 21 nt, Shigella flexneri 2a str. 2457T
aggccguggaucacaucgccg

SEQ ID NO: 3868581 - RNA, 19 nt, Shigella flexneri 2a str. 2457T
aggccuaacaccaucagug

SEQ ID NO: 3868582 - RNA, 19 nt, Shigella flexneri 2a str. 2457T
aggccuacaacuccguuga

SEQ ID NO: 3868583 - RNA, 21 nt, Shigella flexneri 2a str. 2457T
aggccuacaacuccguugaaa

SEQ ID NO: 3868584 - RNA, 20 nt, Shigella flexneri 2a str. 2457T
aggccuacaauguuucugca

SEQ ID NO: 3868585 - RNA, 14 nt, Shigella flexneri 2a str. 2457T
aggccuacagcaua

SEQ ID NO: 3868586 - RNA, 21 nt, Shigella flexneri 2a str. 2457T
aggccuacaucguuccugcaa

SEQ ID NO: 3868587 - RNA, 20 nt, Shigella flexneri 2a str. 2457T
aggccuacaugauuucugca

SEQ ID NO: 3868588 - RNA, 23 nt, Shigella flexneri 2a str. 2457T
aggccugagaagcgcaacgcauc

SEQ ID NO: 3868589 - RNA, 19 nt, Shigella flexneri 2a str. 2457T
aggccugauuaccgcggga

SEQ ID NO: 3868590 - RNA, 15 nt, Shigella flexneri 2a str. 2457T
aggccugcccacggg

SEQ ID NO: 3868591 - RNA, 15 nt, Shigella flexneri 2a str. 2457T
aggccuggacucuua

SEQ ID NO: 3868592 - RNA, 22 nt, Shigella flexneri 2a str. 2457T
aggccuuaguagaagaggaacc

SEQ ID NO: 3868593 - RNA, 12 nt, Shigella flexneri 2a str. 2457T
aggccuucgccu

SEQ ID NO: 3868594 - RNA, 22 nt, Shigella flexneri 2a str. 2457T
aggccuugaacucugaaucgcu

SEQ ID NO: 3868595 - RNA, 14 nt, Shigella flexneri 2a str. 2457T
aggcgaaacgccug

SEQ ID NO: 3868596 - RNA, 21 nt, Shigella flexneri 2a str. 2457T
aggcgacauaucauuuugcug

SEQ ID NO: 3868597 - RNA, 21 nt, Shigella flexneri 2a str. 2457T
aggcgaccguuuucaccaguu

SEQ ID NO: 3868598 - RNA, 13 nt, Shigella flexneri 2a str. 2457T
aggcgagaaucaa

SEQ ID NO: 3868599 - RNA, 21 nt, Shigella flexneri 2a str. 2457T
aggcgagaucggcaggcaggu

SEQ ID NO: 3868600 - RNA, 16 nt, Shigella flexneri 2a str. 2457T
aggcgaggcggacuga

SEQ ID NO: 3868601 - RNA, 19 nt, Shigella flexneri 2a str. 2457T
aggcgaggcggacugaaua

SEQ ID NO: 3868602 - RNA, 18 nt, Shigella flexneri 2a str. 2457T
aggcgaggggaccgcccc

SEQ ID NO: 3868603 - RNA, 14 nt, Shigella flexneri 2a str. 2457T
aggcgauguucugg

SEQ ID NO: 3868604 - RNA, 17 nt, Shigella flexneri 2a str. 2457T
aggcgauuuacuggcag

SEQ ID NO: 3868605 - RNA, 22 nt, Shigella flexneri 2a str. 2457T
aggcgcaacauauuccgcaccu

SEQ ID NO: 3868606 - RNA, 20 nt, Shigella flexneri 2a str. 2457T
aggcgcacgccgacaaagau

SEQ ID NO: 3868607 - RNA, 19 nt, Shigella flexneri 2a str. 2457T
aggcgcagaacuucacucu

SEQ ID NO: 3868608 - RNA, 21 nt, Shigella flexneri 2a str. 2457T
aggcgcauaagcguaaaaccu

SEQ ID NO: 3868609 - RNA, 22 nt, Shigella flexneri 2a str. 2457T
aggcgcauugcuggcugcggga

SEQ ID NO: 3868610 - RNA, 14 nt, Shigella flexneri 2a str. 2457T
aggcgccauuuuca

SEQ ID NO: 3868611 - RNA, 17 nt, Shigella flexneri 2a str. 2457T
aggcgccauuuucauau

SEQ ID NO: 3868612 - RNA, 14 nt, Shigella flexneri 2a str. 2457T
aggcgcuaaaagca

SEQ ID NO: 3868613 - RNA, 23 nt, Shigella flexneri 2a str. 2457T
aggcgcuaaaagcauagccccag

SEQ ID NO: 3868614 - RNA, 17 nt, Shigella flexneri 2a str. 2457T
aggcgcuacgcuaucag

SEQ ID NO: 3868615 - RNA, 19 nt, Shigella flexneri 2a str. 2457T
aggcgcugaaagaagcggu

SEQ ID NO: 3868616 - RNA, 20 nt, Shigella flexneri 2a str. 2457T
aggcgcuugucgucccaggc

SEQ ID NO: 3868617 - RNA, 13 nt, Shigella flexneri 2a str. 2457T
aggcggcagaaca

SEQ ID NO: 3868618 - RNA, 21 nt, Shigella flexneri 2a str. 2457T
aggcggcucaccugcacacca

SEQ ID NO: 3868619 - RNA, 15 nt, Shigella flexneri 2a str. 2457T
aggcggcuucgcauc

SEQ ID NO: 3868620 - RNA, 22 nt, Shigella flexneri 2a str. 2457T
aggcggguacguuucgccugca

SEQ ID NO: 3868621 - RNA, 22 nt, Shigella flexneri 2a str. 2457T
aggcgguaaaucggcgaagaga

SEQ ID NO: 3868622 - RNA, 15 nt, Shigella flexneri 2a str. 2457T
aggcgguaaccgcca

SEQ ID NO: 3868623 - RNA, 16 nt, Shigella flexneri 2a str. 2457T
aggcgguaaccgccag

SEQ ID NO: 3868624 - RNA, 13 nt, Shigella flexneri 2a str. 2457T
aggcgucacaucc

SEQ ID NO: 3868625 - RNA, 15 nt, Shigella flexneri 2a str. 2457T
aggcguccugcugaa

SEQ ID NO: 3868626 - RNA, 22 nt, Shigella flexneri 2a str. 2457T
aggcgugauucauacagcggcc

SEQ ID NO: 3868627 - RNA, 14 nt, Shigella flexneri 2a str. 2457T
aggcguuaaaacag

SEQ ID NO: 3868628 - RNA, 20 nt, Shigella flexneri 2a str. 2457T
aggcguucacgacgcauccg

SEQ ID NO: 3868629 - RNA, 17 nt, Shigella flexneri 2a str. 2457T
aggucaucacaucccag

SEQ ID NO: 3868630 - RNA, 20 nt, Shigella flexneri 2a str. 2457T
aggucaucauugcagucaua

SEQ ID NO: 3868631 - RNA, 16 nt, Shigella flexneri 2a str. 2457T
agguccccgagcacau

SEQ ID NO: 3868632 - RNA, 20 nt, Shigella flexneri 2a str. 2457T
agguccuccuguaccuucac

SEQ ID NO: 3868633 - RNA, 18 nt, Shigella flexneri 2a str. 2457T
agguccuguaaugagaau

SEQ ID NO: 3868634 - RNA, 19 nt, Shigella flexneri 2a str. 2457T
agguccuucaggcccugcu

SEQ ID NO: 3868635 - RNA, 14 nt, Shigella flexneri 2a str. 2457T
aggucgacagcagc

SEQ ID NO: 3868636 - RNA, 15 nt, Shigella flexneri 2a str. 2457T
aggucgaucagcuga

SEQ ID NO: 3868637 - RNA, 19 nt, Shigella flexneri 2a str. 2457T
aggucgaucagcugacaac

SEQ ID NO: 3868638 - RNA, 16 nt, Shigella flexneri 2a str. 2457T
aggucgaugcgcucgc

SEQ ID NO: 3868639 - RNA, 13 nt, Shigella flexneri 2a str. 2457T
aggucgcacugcu

SEQ ID NO: 3868640 - RNA, 21 nt, Shigella flexneri 2a str. 2457T
aggucgcccggauuacagcuc

SEQ ID NO: 3868641 - RNA, 13 nt, Shigella flexneri 2a str. 2457T
aggucgugccaga

SEQ ID NO: 3868642 - RNA, 20 nt, Shigella flexneri 2a str. 2457T
aggucuccgcccagcguacg

SEQ ID NO: 3868643 - RNA, 15 nt, Shigella flexneri 2a str. 2457T
aggugaaaaauaaaa

SEQ ID NO: 3868644 - RNA, 17 nt, Shigella flexneri 2a str. 2457T
aggugacacuucauuaa

SEQ ID NO: 3868645 - RNA, 14 nt, Shigella flexneri 2a str. 2457T
aggugacaucgugc

SEQ ID NO: 3868646 - RNA, 15 nt, Shigella flexneri 2a str. 2457T
aggugaccagcagac

SEQ ID NO: 3868647 - RNA, 18 nt, Shigella flexneri 2a str. 2457T
aggugagucgcaaaacuc

SEQ ID NO: 3868648 - RNA, 23 nt, Shigella flexneri 2a str. 2457T
aggugauuugcgccugcuuaaca

SEQ ID NO: 3868649 - RNA, 20 nt, Shigella flexneri 2a str. 2457T
aggugcagcccguaagcaaa

SEQ ID NO: 3868650 - RNA, 18 nt, Shigella flexneri 2a str. 2457T
aggugcaucggggaauug

SEQ ID NO: 3868651 - RNA, 17 nt, Shigella flexneri 2a str. 2457T
aggugcucaaugagcac

SEQ ID NO: 3868652 - RNA, 20 nt, Shigella flexneri 2a str. 2457T
aggugcucauuugauugccg

SEQ ID NO: 3868653 - RNA, 21 nt, Shigella flexneri 2a str. 2457T
aggugcugaaagggcaaauaa

SEQ ID NO: 3868654 - RNA, 17 nt, Shigella flexneri 2a str. 2457T
aggugcuuuaacgaaag

SEQ ID NO: 3868655 - RNA, 17 nt, Shigella flexneri 2a str. 2457T
aggugguagcugccccc

SEQ ID NO: 3868656 - RNA, 16 nt, Shigella flexneri 2a str. 2457T
agguguauuguucugg

SEQ ID NO: 3868657 - RNA, 15 nt, Shigella flexneri 2a str. 2457T
aggugucacaugcag

SEQ ID NO: 3868658 - RNA, 21 nt, Shigella flexneri 2a str. 2457T
aggugucacaugcagcgccug

SEQ ID NO: 3868659 - RNA, 23 nt, Shigella flexneri 2a str. 2457T
agguguguauccguuuuacuggg

SEQ ID NO: 3868660 - RNA, 22 nt, Shigella flexneri 2a str. 2457T
agguguuacccgcuaacuggug

SEQ ID NO: 3868661 - RNA, 13 nt, Shigella flexneri 2a str. 2457T
agguguugcguuu

SEQ ID NO: 3868662 - RNA, 15 nt, Shigella flexneri 2a str. 2457T
agguguuugacugua

SEQ ID NO: 3868663 - RNA, 17 nt, Shigella flexneri 2a str. 2457T
agguuaaaguacucuuu

SEQ ID NO: 3868664 - RNA, 17 nt, Shigella flexneri 2a str. 2457T
agguuccaauauugguc

SEQ ID NO: 3868665 - RNA, 18 nt, Shigella flexneri 2a str. 2457T
agguucggaguggcagcc

SEQ ID NO: 3868666 - RNA, 19 nt, Shigella flexneri 2a str. 2457T
agguucuuugcugccguua

SEQ ID NO: 3868667 - RNA, 15 nt, Shigella flexneri 2a str. 2457T
agguugaacccuuuc

SEQ ID NO: 3868668 - RNA, 17 nt, Shigella flexneri 2a str. 2457T
agguugaccuggaagga

SEQ ID NO: 3868669 - RNA, 16 nt, Shigella flexneri 2a str. 2457T
agguuggaucaacagg

SEQ ID NO: 3868670 - RNA, 17 nt, Shigella flexneri 2a str. 2457T
agguuguagauuuugca

SEQ ID NO: 3868671 - RNA, 19 nt, Shigella flexneri 2a str. 2457T
agguuguggcauuagauau

SEQ ID NO: 3868672 - RNA, 23 nt, Shigella flexneri 2a str. 2457T
agguuguuaaccaccaguaaauu

SEQ ID NO: 3868673 - RNA, 16 nt, Shigella flexneri 2a str. 2457T
agguuuaaacagagau

SEQ ID NO: 3868674 - RNA, 15 nt, Shigella flexneri 2a str. 2457T
agguuuaccagcagc

SEQ ID NO: 3868675 - RNA, 19 nt, Shigella flexneri 2a str. 2457T
agguuuaccagcagcccug

SEQ ID NO: 3868676 - RNA, 18 nt, Shigella flexneri 2a str. 2457T
agguuucacguaccagau

SEQ ID NO: 3868677 - RNA, 20 nt, Shigella flexneri 2a str. 2457T
agguuucacguaccagaugc

SEQ ID NO: 3868678 - RNA, 22 nt, Shigella flexneri 2a str. 2457T
agguuucauagcgucccaguaa

SEQ ID NO: 3868679 - RNA, 16 nt, Shigella flexneri 2a str. 2457T
agguuucccgccguaa

SEQ ID NO: 3868680 - RNA, 21 nt, Shigella flexneri 2a str. 2457T
agguuucgccuuuugauacuc

SEQ ID NO: 3868681 - RNA, 11 nt, Shigella flexneri 2a str. 2457T
agguuucugcc

SEQ ID NO: 3868682 - RNA, 20 nt, Shigella flexneri 2a str. 2457T
agguuuucuuucaccucuuc

SEQ ID NO: 3868683 - RNA, 16 nt, Shigella flexneri 2a str. 2457T
agguuuuucagcugcc

SEQ ID NO: 3868684 - RNA, 12 nt, Shigella flexneri 2a str. 2457T
agguuuuuuccu

SEQ ID NO: 3868685 - RNA, 17 nt, Shigella flexneri 2a str. 2457T
aguaaaaaaacaucaua

SEQ ID NO: 3868686 - RNA, 14 nt, Shigella flexneri 2a str. 2457T
aguaaaaaagaagg

SEQ ID NO: 3868687 - RNA, 19 nt, Shigella flexneri 2a str. 2457T
aguaaagcgcgucaccacc

SEQ ID NO: 3868688 - RNA, 12 nt, Shigella flexneri 2a str. 2457T
aguaaaguuacc

SEQ ID NO: 3868689 - RNA, 14 nt, Shigella flexneri 2a str. 2457T
aguaaauauugucg

SEQ ID NO: 3868690 - RNA, 13 nt, Shigella flexneri 2a str. 2457T
aguaaauccauaa

SEQ ID NO: 3868691 - RNA, 20 nt, Shigella flexneri 2a str. 2457T
aguaaaucguccguuugcgu

SEQ ID NO: 3868692 - RNA, 18 nt, Shigella flexneri 2a str. 2457T
aguaaaugacagcgaaug

SEQ ID NO: 3868693 - RNA, 22 nt, Shigella flexneri 2a str. 2457T
aguaaauucacugccugcugau

SEQ ID NO: 3868694 - RNA, 18 nt, Shigella flexneri 2a str. 2457T
aguaacagguuuugauua

SEQ ID NO: 3868695 - RNA, 17 nt, Shigella flexneri 2a str. 2457T
aguaacagucaguuauc

SEQ ID NO: 3868696 - RNA, 19 nt, Shigella flexneri 2a str. 2457T
aguaaccgcuuuuucaauu

SEQ ID NO: 3868697 - RNA, 22 nt, Shigella flexneri 2a str. 2457T
aguaaccuucgcggcacuggua

SEQ ID NO: 3868698 - RNA, 22 nt, Shigella flexneri 2a str. 2457T
aguaaccuuuaucgcgcagcag

SEQ ID NO: 3868699 - RNA, 14 nt, Shigella flexneri 2a str. 2457T
aguaaccuuucaga

SEQ ID NO: 3868700 - RNA, 17 nt, Shigella flexneri 2a str. 2457T
aguaacguuaguucgcg

SEQ ID NO: 3868701 - RNA, 22 nt, Shigella flexneri 2a str. 2457T
aguaacguuugauuaacgccag

SEQ ID NO: 3868702 - RNA, 15 nt, Shigella flexneri 2a str. 2457T
aguaacucauugcca

SEQ ID NO: 3868703 - RNA, 17 nt, Shigella flexneri 2a str. 2457T
aguaagaauugauaaaa

SEQ ID NO: 3868704 - RNA, 14 nt, Shigella flexneri 2a str. 2457T
aguaagauuauaua

SEQ ID NO: 3868705 - RNA, 19 nt, Shigella flexneri 2a str. 2457T
aguaagcaguccagcgccu

SEQ ID NO: 3868706 - RNA, 23 nt, Shigella flexneri 2a str. 2457T
aguaagcggcguugcucuucucc

SEQ ID NO: 3868707 - RNA, 23 nt, Shigella flexneri 2a str. 2457T
aguaaggcugcgagguuauccgc

SEQ ID NO: 3868708 - RNA, 17 nt, Shigella flexneri 2a str. 2457T
aguaaguuacauuuuaa

SEQ ID NO: 3868709 - RNA, 18 nt, Shigella flexneri 2a str. 2457T
aguaauaacuuccugagu

SEQ ID NO: 3868710 - RNA, 22 nt, Shigella flexneri 2a str. 2457T
aguaauaaugaucaguggaaga

SEQ ID NO: 3868711 - RNA, 14 nt, Shigella flexneri 2a str. 2457T
aguaauaaugccca

SEQ ID NO: 3868712 - RNA, 22 nt, Shigella flexneri 2a str. 2457T
aguaauauucaacgucacuggg

SEQ ID NO: 3868713 - RNA, 19 nt, Shigella flexneri 2a str. 2457T
aguaaucacaucaaagucu

SEQ ID NO: 3868714 - RNA, 19 nt, Shigella flexneri 2a str. 2457T
aguaaucaggcuaucuucg

SEQ ID NO: 3868715 - RNA, 14 nt, Shigella flexneri 2a str. 2457T
aguaauccuuucuc

SEQ ID NO: 3868716 - RNA, 18 nt, Shigella flexneri 2a str. 2457T
aguaaucgccagcaaaau

SEQ ID NO: 3868717 - RNA, 16 nt, Shigella flexneri 2a str. 2457T
aguaaugagcacagaa

SEQ ID NO: 3868718 - RNA, 18 nt, Shigella flexneri 2a str. 2457T
aguaaugauuuaaaacca

SEQ ID NO: 3868719 - RNA, 21 nt, Shigella flexneri 2a str. 2457T
aguaaugccggaggcaaguuu

SEQ ID NO: 3868720 - RNA, 15 nt, Shigella flexneri 2a str. 2457T
aguaaugcgcccaug

SEQ ID NO: 3868721 - RNA, 16 nt, Shigella flexneri 2a str. 2457T
aguaaugcgcccaugc

SEQ ID NO: 3868722 - RNA, 16 nt, Shigella flexneri 2a str. 2457T
aguaauguuauugcau

SEQ ID NO: 3868723 - RNA, 23 nt, Shigella flexneri 2a str. 2457T
aguaauuaucuuuacugauaauu

SEQ ID NO: 3868724 - RNA, 16 nt, Shigella flexneri 2a str. 2457T
aguaauugcagcagcu

SEQ ID NO: 3868725 - RNA, 17 nt, Shigella flexneri 2a str. 2457T
aguaauugcuuuuacca

SEQ ID NO: 3868726 - RNA, 22 nt, Shigella flexneri 2a str. 2457T
aguccacgguugguuuuaucca

SEQ ID NO: 3868727 - RNA, 21 nt, Shigella flexneri 2a str. 2457T
aguccacguucaaaacgguga

SEQ ID NO: 3868728 - RNA, 22 nt, Shigella flexneri 2a str. 2457T
aguccagccccgcgcggcgcag

SEQ ID NO: 3868729 - RNA, 24 nt, Shigella flexneri 2a str. 2457T
aguccagccccgcgcggcgcaggc

SEQ ID NO: 3868730 - RNA, 14 nt, Shigella flexneri 2a str. 2457T
aguccagcgccuga

SEQ ID NO: 3868731 - RNA, 15 nt, Shigella flexneri 2a str. 2457T
aguccagcgccugaa

SEQ ID NO: 3868732 - RNA, 17 nt, Shigella flexneri 2a str. 2457T
aguccagcgccugaaau

SEQ ID NO: 3868733 - RNA, 16 nt, Shigella flexneri 2a str. 2457T
aguccaggcugcaaag

SEQ ID NO: 3868734 - RNA, 19 nt, Shigella flexneri 2a str. 2457T
aguccaggcugcaaagucu

SEQ ID NO: 3868735 - RNA, 18 nt, Shigella flexneri 2a str. 2457T
aguccauacccagcauca

SEQ ID NO: 3868736 - RNA, 15 nt, Shigella flexneri 2a str. 2457T
aguccccacaucacu

SEQ ID NO: 3868737 - RNA, 21 nt, Shigella flexneri 2a str. 2457T
agucccgcgacaaucgccccc

SEQ ID NO: 3868738 - RNA, 19 nt, Shigella flexneri 2a str. 2457T
agucccgcgauggcccggc

SEQ ID NO: 3868739 - RNA, 14 nt, Shigella flexneri 2a str. 2457T
agucccggcaagau

SEQ ID NO: 3868740 - RNA, 18 nt, Shigella flexneri 2a str. 2457T
aguccgcgcuugccgccg

SEQ ID NO: 3868741 - RNA, 22 nt, Shigella flexneri 2a str. 2457T
aguccggcugcgauauucggaa

SEQ ID NO: 3868742 - RNA, 12 nt, Shigella flexneri 2a str. 2457T
aguccguugaaa

SEQ ID NO: 3868743 - RNA, 22 nt, Shigella flexneri 2a str. 2457T
aguccuacacacgccagugcgc

SEQ ID NO: 3868744 - RNA, 15 nt, Shigella flexneri 2a str. 2457T
aguccugagucagaa

SEQ ID NO: 3868745 - RNA, 16 nt, Shigella flexneri 2a str. 2457T
aguccugagucagaaa

SEQ ID NO: 3868746 - RNA, 15 nt, Shigella flexneri 2a str. 2457T
aguccuguugucuuu

SEQ ID NO: 3868747 - RNA, 18 nt, Shigella flexneri 2a str. 2457T
aguccuguugucuuucca

SEQ ID NO: 3868748 - RNA, 13 nt, Shigella flexneri 2a str. 2457T
agucgacuucaga

SEQ ID NO: 3868749 - RNA, 19 nt, Shigella flexneri 2a str. 2457T
agucgcccaguaucugaca

SEQ ID NO: 3868750 - RNA, 18 nt, Shigella flexneri 2a str. 2457T
agucgcccauuuugccac

SEQ ID NO: 3868751 - RNA, 15 nt, Shigella flexneri 2a str. 2457T
agucgccugcuuuau

SEQ ID NO: 3868752 - RNA, 16 nt, Shigella flexneri 2a str. 2457T
agucgcgcaauugcca

SEQ ID NO: 3868753 - RNA, 20 nt, Shigella flexneri 2a str. 2457T
agucgcgcaauugccagaca

SEQ ID NO: 3868754 - RNA, 16 nt, Shigella flexneri 2a str. 2457T
agucgcgccuuacgcu

SEQ ID NO: 3868755 - RNA, 20 nt, Shigella flexneri 2a str. 2457T
agucgcgguccgggccgcaa

SEQ ID NO: 3868756 - RNA, 23 nt, Shigella flexneri 2a str. 2457T
agucgcgguccgggccgcaaacc

SEQ ID NO: 3868757 - RNA, 19 nt, Shigella flexneri 2a str. 2457T
agucgcuccugccacauau

SEQ ID NO: 3868758 - RNA, 19 nt, Shigella flexneri 2a str. 2457T
agucgcuuucauucagaac

SEQ ID NO: 3868759 - RNA, 15 nt, Shigella flexneri 2a str. 2457T
agucggcaucgccac

SEQ ID NO: 3868760 - RNA, 14 nt, Shigella flexneri 2a str. 2457T
agucgggaccagca

SEQ ID NO: 3868761 - RNA, 16 nt, Shigella flexneri 2a str. 2457T
agucggggccagcauu

SEQ ID NO: 3868762 - RNA, 20 nt, Shigella flexneri 2a str. 2457T
agucgggucgccguaagcaa

SEQ ID NO: 3868763 - RNA, 13 nt, Shigella flexneri 2a str. 2457T
agucggucacagu

SEQ ID NO: 3868764 - RNA, 14 nt, Shigella flexneri 2a str. 2457T
agucggugccaugg

SEQ ID NO: 3868765 - RNA, 19 nt, Shigella flexneri 2a str. 2457T
agucgucgccgauaauuuu

SEQ ID NO: 3868766 - RNA, 22 nt, Shigella flexneri 2a str. 2457T
agucgucugucgggaacacuuu

SEQ ID NO: 3868767 - RNA, 17 nt, Shigella flexneri 2a str. 2457T
agucguucaaccacuuc

SEQ ID NO: 3868768 - RNA, 13 nt, Shigella flexneri 2a str. 2457T
agucucaagggag

SEQ ID NO: 3868769 - RNA, 14 nt, Shigella flexneri 2a str. 2457T
agucuccauuuuuu

SEQ ID NO: 3868770 - RNA, 23 nt, Shigella flexneri 2a str. 2457T
agucuccuuuauagugugcaauc

SEQ ID NO: 3868771 - RNA, 19 nt, Shigella flexneri 2a str. 2457T
agucucuucuuugcaggga

SEQ ID NO: 3868772 - RNA, 21 nt, Shigella flexneri 2a str. 2457T
agucugaaugauguggucagc

SEQ ID NO: 3868773 - RNA, 21 nt, Shigella flexneri 2a str. 2457T
agucugaaugccgcuaccgcc

SEQ ID NO: 3868774 - RNA, 20 nt, Shigella flexneri 2a str. 2457T
agucugaccucuucuaccac

SEQ ID NO: 3868775 - RNA, 13 nt, Shigella flexneri 2a str. 2457T
agucugcauuuuc

SEQ ID NO: 3868776 - RNA, 14 nt, Shigella flexneri 2a str. 2457T
agucugcauuuucu

SEQ ID NO: 3868777 - RNA, 14 nt, Shigella flexneri 2a str. 2457T
agucuggaagccag

SEQ ID NO: 3868778 - RNA, 18 nt, Shigella flexneri 2a str. 2457T
agucuggacaaagagcuu

SEQ ID NO: 3868779 - RNA, 21 nt, Shigella flexneri 2a str. 2457T
agucuuaaaggggugaaaaaa

SEQ ID NO: 3868780 - RNA, 14 nt, Shigella flexneri 2a str. 2457T
agucuucaucaucc

SEQ ID NO: 3868781 - RNA, 13 nt, Shigella flexneri 2a str. 2457T
agucuugcuggau

SEQ ID NO: 3868782 - RNA, 24 nt, Shigella flexneri 2a str. 2457T
agucuugcuggaugccagcgaaga

SEQ ID NO: 3868783 - RNA, 23 nt, Shigella flexneri 2a str. 2457T
agucuuugcgaggcgcgucccag

SEQ ID NO: 3868784 - RNA, 21 nt, Shigella flexneri 2a str. 2457T
agucuuuguauuuauuuucag

SEQ ID NO: 3868785 - RNA, 16 nt, Shigella flexneri 2a str. 2457T
agucuuuuuucaacuu

SEQ ID NO: 3868786 - RNA, 17 nt, Shigella flexneri 2a str. 2457T
agucuuuuuucaacuuu

SEQ ID NO: 3868787 - RNA, 22 nt, Shigella flexneri 2a str. 2457T
agucuuuuuugguuauccagca

SEQ ID NO: 3868788 - RNA, 20 nt, Shigella flexneri 2a str. 2457T
agugaaaaggucaauguuga

SEQ ID NO: 3868789 - RNA, 19 nt, Shigella flexneri 2a str. 2457T
agugaaaauucuccggcgu

SEQ ID NO: 3868790 - RNA, 14 nt, Shigella flexneri 2a str. 2457T
agugaaauuaaacu

SEQ ID NO: 3868791 - RNA, 17 nt, Shigella flexneri 2a str. 2457T
agugaauaaauuuuauu

SEQ ID NO: 3868792 - RNA, 23 nt, Shigella flexneri 2a str. 2457T
agugaauauaccauggaagaaaa

SEQ ID NO: 3868793 - RNA, 18 nt, Shigella flexneri 2a str. 2457T
agugaauuguuuuauaaa

SEQ ID NO: 3868794 - RNA, 22 nt, Shigella flexneri 2a str. 2457T
agugaauuguuuuauaaagaac

SEQ ID NO: 3868795 - RNA, 13 nt, Shigella flexneri 2a str. 2457T
agugaauuucacu

SEQ ID NO: 3868796 - RNA, 18 nt, Shigella flexneri 2a str. 2457T
agugacccgcagccagca

SEQ ID NO: 3868797 - RNA, 20 nt, Shigella flexneri 2a str. 2457T
agugacccgcagccagcacu

SEQ ID NO: 3868798 - RNA, 15 nt, Shigella flexneri 2a str. 2457T
agugaccuuaaucag

SEQ ID NO: 3868799 - RNA, 14 nt, Shigella flexneri 2a str. 2457T
agugagcacugaau

SEQ ID NO: 3868800 - RNA, 21 nt, Shigella flexneri 2a str. 2457T
agugagcacugaauaugaguc

SEQ ID NO: 3868801 - RNA, 17 nt, Shigella flexneri 2a str. 2457T
agugagcgauucaaauu

SEQ ID NO: 3868802 - RNA, 19 nt, Shigella flexneri 2a str. 2457T
agugaggcuauuccacgca

SEQ ID NO: 3868803 - RNA, 17 nt, Shigella flexneri 2a str. 2457T
agugauaacgauuuggc

SEQ ID NO: 3868804 - RNA, 16 nt, Shigella flexneri 2a str. 2457T
agugaucaaacacaaa

SEQ ID NO: 3868805 - RNA, 23 nt, Shigella flexneri 2a str. 2457T
agugaucaaacacaaaguccuga

SEQ ID NO: 3868806 - RNA, 15 nt, Shigella flexneri 2a str. 2457T
agugaugaaaacgaa

SEQ ID NO: 3868807 - RNA, 18 nt, Shigella flexneri 2a str. 2457T
agugaugccauacuucau

SEQ ID NO: 3868808 - RNA, 19 nt, Shigella flexneri 2a str. 2457T
agugauuaacgcuuguaaa

SEQ ID NO: 3868809 - RNA, 17 nt, Shigella flexneri 2a str. 2457T
agugauuaacuguucug

SEQ ID NO: 3868810 - RNA, 14 nt, Shigella flexneri 2a str. 2457T
agugcaaaugccag

SEQ ID NO: 3868811 - RNA, 16 nt, Shigella flexneri 2a str. 2457T
agugcaaaugccagau

SEQ ID NO: 3868812 - RNA, 23 nt, Shigella flexneri 2a str. 2457T
agugcaacgugacucaauggcau

SEQ ID NO: 3868813 - RNA, 17 nt, Shigella flexneri 2a str. 2457T
agugcaaucaguggugu

SEQ ID NO: 3868814 - RNA, 20 nt, Shigella flexneri 2a str. 2457T
agugcacgaaccagagacag

SEQ ID NO: 3868815 - RNA, 15 nt, Shigella flexneri 2a str. 2457T
agugcagcaugcacc

SEQ ID NO: 3868816 - RNA, 19 nt, Shigella flexneri 2a str. 2457T
agugcagcaugcacccuca

SEQ ID NO: 3868817 - RNA, 12 nt, Shigella flexneri 2a str. 2457T
agugcagcgaag

SEQ ID NO: 3868818 - RNA, 22 nt, Shigella flexneri 2a str. 2457T
agugcaggcaccagccccugga

SEQ ID NO: 3868819 - RNA, 16 nt, Shigella flexneri 2a str. 2457T
agugcauccagcagcc

SEQ ID NO: 3868820 - RNA, 14 nt, Shigella flexneri 2a str. 2457T
agugcauugagucc

SEQ ID NO: 3868821 - RNA, 14 nt, Shigella flexneri 2a str. 2457T
agugccaaagccag

SEQ ID NO: 3868822 - RNA, 13 nt, Shigella flexneri 2a str. 2457T
agugcccccaacu

SEQ ID NO: 3868823 - RNA, 19 nt, Shigella flexneri 2a str. 2457T
aguuccgggaucaccagac

SEQ ID NO: 3868824 - RNA, 22 nt, Shigella flexneri 2a str. 2457T
aguuccgggaucugauucugau

SEQ ID NO: 3868825 - RNA, 14 nt, Shigella flexneri 2a str. 2457T
aguuccggguuuuc

SEQ ID NO: 3868826 - RNA, 16 nt, Shigella flexneri 2a str. 2457T
aguuccuacugcuccu

SEQ ID NO: 3868827 - RNA, 16 nt, Shigella flexneri 2a str. 2457T
aguuccugccagauuu

SEQ ID NO: 3868828 - RNA, 20 nt, Shigella flexneri 2a str. 2457T
aguucgaucucuucgccugc

SEQ ID NO: 3868829 - RNA, 22 nt, Shigella flexneri 2a str. 2457T
aguucgaucucuucgccugccu

SEQ ID NO: 3868830 - RNA, 16 nt, Shigella flexneri 2a str. 2457T
aguucgcgaaaguuac

SEQ ID NO: 3868831 - RNA, 20 nt, Shigella flexneri 2a str. 2457T
aguucgcgaucgcgccagaa

SEQ ID NO: 3868832 - RNA, 19 nt, Shigella flexneri 2a str. 2457T
aguucgcgcgcugccagaa

SEQ ID NO: 3868833 - RNA, 14 nt, Shigella flexneri 2a str. 2457T
aguucgcuuuccgu

SEQ ID NO: 3868834 - RNA, 12 nt, Shigella flexneri 2a str. 2457T
aguucuacaauc

SEQ ID NO: 3868835 - RNA, 14 nt, Shigella flexneri 2a str. 2457T
aguugaaaaacaug

SEQ ID NO: 3868836 - RNA, 13 nt, Shigella flexneri 2a str. 2457T
aguugaaaaccuc

SEQ ID NO: 3868837 - RNA, 14 nt, Shigella flexneri 2a str. 2457T
aguugaaaaccucu

SEQ ID NO: 3868838 - RNA, 16 nt, Shigella flexneri 2a str. 2457T
aguugaaaaccucucu

SEQ ID NO: 3868839 - RNA, 20 nt, Shigella flexneri 2a str. 2457T
aguugaccagcuccagcaga

SEQ ID NO: 3868840 - RNA, 17 nt, Shigella flexneri 2a str. 2457T
aguugaguaucagagaa

SEQ ID NO: 3868841 - RNA, 13 nt, Shigella flexneri 2a str. 2457T
aguugaucaccag

SEQ ID NO: 3868842 - RNA, 14 nt, Shigella flexneri 2a str. 2457T
aguugaucaccagu

SEQ ID NO: 3868843 - RNA, 19 nt, Shigella flexneri 2a str. 2457T
aguugaucuauaccaccgc

SEQ ID NO: 3868844 - RNA, 19 nt, Shigella flexneri 2a str. 2457T
aguugauuaauuucauuuu

SEQ ID NO: 3868845 - RNA, 20 nt, Shigella flexneri 2a str. 2457T
aguugauucggccaguaacc

SEQ ID NO: 3868846 - RNA, 21 nt, Shigella flexneri 2a str. 2457T
aguugcagcaacucuuuuucc

SEQ ID NO: 3868847 - RNA, 18 nt, Shigella flexneri 2a str. 2457T
aguugccaucaucaccag

SEQ ID NO: 3868848 - RNA, 20 nt, Shigella flexneri 2a str. 2457T
aguugccaucaucaccagaa

SEQ ID NO: 3868849 - RNA, 17 nt, Shigella flexneri 2a str. 2457T
aguugccguucuucccg

SEQ ID NO: 3868850 - RNA, 14 nt, Shigella flexneri 2a str. 2457T
aguugcgccaguag

SEQ ID NO: 3868851 - RNA, 14 nt, Shigella flexneri 2a str. 2457T
aguugcuccagcaa

SEQ ID NO: 3868852 - RNA, 15 nt, Shigella flexneri 2a str. 2457T
aguuggggaaaaguu

SEQ ID NO: 3868853 - RNA, 18 nt, Shigella flexneri 2a str. 2457T
aguuguaaucauauuaaa

SEQ ID NO: 3868854 - RNA, 20 nt, Shigella flexneri 2a str. 2457T
aguugucgauaaacaguuuc

SEQ ID NO: 3868855 - RNA, 19 nt, Shigella flexneri 2a str. 2457T
aguuguugagguucggagu

SEQ ID NO: 3868856 - RNA, 15 nt, Shigella flexneri 2a str. 2457T
aguuguuuacaguau

SEQ ID NO: 3868857 - RNA, 15 nt, Shigella flexneri 2a str. 2457T
aguuuaauucuuuga

SEQ ID NO: 3868858 - RNA, 14 nt, Shigella flexneri 2a str. 2457T
aguuuaccagccaa

SEQ ID NO: 3868859 - RNA, 17 nt, Shigella flexneri 2a str. 2457T
aguuuacgaaccuucac

SEQ ID NO: 3868860 - RNA, 16 nt, Shigella flexneri 2a str. 2457T
aguuuacgcagcagau

SEQ ID NO: 3868861 - RNA, 18 nt, Shigella flexneri 2a str. 2457T
aguuuacuucuauaauga

SEQ ID NO: 3868862 - RNA, 18 nt, Shigella flexneri 2a str. 2457T
aguuuauagaacggcaga

SEQ ID NO: 3868863 - RNA, 14 nt, Shigella flexneri 2a str. 2457T
aguuuauccagcca

SEQ ID NO: 3868864 - RNA, 17 nt, Shigella flexneri 2a str. 2457T
aguuucaccagcaguaa

SEQ ID NO: 3868865 - RNA, 18 nt, Shigella flexneri 2a str. 2457T
aguuucaccagcaguaaa

SEQ ID NO: 3868866 - RNA, 14 nt, Shigella flexneri 2a str. 2457T
aguuucagaccaau

SEQ ID NO: 3868867 - RNA, 16 nt, Shigella flexneri 2a str. 2457T
aguuucagccccauca

SEQ ID NO: 3868868 - RNA, 18 nt, Shigella flexneri 2a str. 2457T
aguuuccgcuucugcuuu

SEQ ID NO: 3868869 - RNA, 19 nt, Shigella flexneri 2a str. 2457T
aguuucggacgcggcacgc

SEQ ID NO: 3868870 - RNA, 20 nt, Shigella flexneri 2a str. 2457T
aguuugcaccucugcugcug

SEQ ID NO: 3868871 - RNA, 13 nt, Shigella flexneri 2a str. 2457T
aguuugccguuga

SEQ ID NO: 3868872 - RNA, 21 nt, Shigella flexneri 2a str. 2457T
aguuugccuucacaggccgcc

SEQ ID NO: 3868873 - RNA, 20 nt, Shigella flexneri 2a str. 2457T
aguuuggcuucguguacaaa

SEQ ID NO: 3868874 - RNA, 18 nt, Shigella flexneri 2a str. 2457T
aguuuggugagaacacca

SEQ ID NO: 3868875 - RNA, 19 nt, Shigella flexneri 2a str. 2457T
aguuugucuggcaauccua

SEQ ID NO: 3868876 - RNA, 18 nt, Shigella flexneri 2a str. 2457T
aguuuguguguggcgcgc

SEQ ID NO: 3868877 - RNA, 15 nt, Shigella flexneri 2a str. 2457T
aguuuguucagcugc

SEQ ID NO: 3868878 - RNA, 14 nt, Shigella flexneri 2a str. 2457T
aguuuguuuagcca

SEQ ID NO: 3868879 - RNA, 14 nt, Shigella flexneri 2a str. 2457T
aguuuuaccuucau

SEQ ID NO: 3868880 - RNA, 18 nt, Shigella flexneri 2a str. 2457T
aguuuucacccuuucguu

SEQ ID NO: 3868881 - RNA, 21 nt, Shigella flexneri 2a str. 2457T
aguuuucauauaccgcaucag

SEQ ID NO: 3868882 - RNA, 12 nt, Shigella flexneri 2a str. 2457T
aguuuucuuugc

SEQ ID NO: 3868883 - RNA, 20 nt, Shigella flexneri 2a str. 2457T
aguuuugucgcugauuugcu

SEQ ID NO: 3868884 - RNA, 12 nt, Shigella flexneri 2a str. 2457T
aguuuuucaaca

SEQ ID NO: 3868885 - RNA, 19 nt, Shigella flexneri 2a str. 2457T
aguuuuuccgugagcggca

SEQ ID NO: 3868886 - RNA, 15 nt, Shigella flexneri 2a str. 2457T
aguuuuugcccauca

SEQ ID NO: 3868887 - RNA, 12 nt, Shigella flexneri 2a str. 2457T
aguuuuuucuuc

SEQ ID NO: 3868888 - RNA, 24 nt, Shigella flexneri 2a str. 2457T
auaaaaaaaacgccagcaacacau

SEQ ID NO: 3868889 - RNA, 18 nt, Shigella flexneri 2a str. 2457T
auaaaaaaagaaacuauc

SEQ ID NO: 3868890 - RNA, 16 nt, Shigella flexneri 2a str. 2457T
auaaaaaaaguauuuu

SEQ ID NO: 3868891 - RNA, 21 nt, Shigella flexneri 2a str. 2457T
auaaaaauccgccagaaauca

SEQ ID NO: 3868892 - RNA, 13 nt, Shigella flexneri 2a str. 2457T
auaaaacagggcg

SEQ ID NO: 3868893 - RNA, 10 nt, Shigella flexneri 2a str. 2457T
auaaaacauc

SEQ ID NO: 3868894 - RNA, 15 nt, Shigella flexneri 2a str. 2457T
auaaaacgccugaua

SEQ ID NO: 3868895 - RNA, 21 nt, Shigella flexneri 2a str. 2457T
auaaaacguugucaguucuuu

SEQ ID NO: 3868896 - RNA, 22 nt, Shigella flexneri 2a str. 2457T
auaaaagauaguaagauuauau

SEQ ID NO: 3868897 - RNA, 17 nt, Shigella flexneri 2a str. 2457T
auaaaagcccugggcac

SEQ ID NO: 3868898 - RNA, 19 nt, Shigella flexneri 2a str. 2457T
auaaaaggcaccuggaaau

SEQ ID NO: 3868899 - RNA, 22 nt, Shigella flexneri 2a str. 2457T
auaaaauaaccaaauaaaauaa

SEQ ID NO: 3868900 - RNA, 17 nt, Shigella flexneri 2a str. 2457T
auaaaaugauuucgcaa

SEQ ID NO: 3868901 - RNA, 18 nt, Shigella flexneri 2a str. 2457T
auaaaaugauuucgcaac

SEQ ID NO: 3868902 - RNA, 13 nt, Shigella flexneri 2a str. 2457T
auaaaauuaacga

SEQ ID NO: 3868903 - RNA, 23 nt, Shigella flexneri 2a str. 2457T
auaaaauuauagggaugcagaau

SEQ ID NO: 3868904 - RNA, 14 nt, Shigella flexneri 2a str. 2457T
auaaaauuauccag

SEQ ID NO: 3868905 - RNA, 15 nt, Shigella flexneri 2a str. 2457T
auaaaauucauucaa

SEQ ID NO: 3868906 - RNA, 17 nt, Shigella flexneri 2a str. 2457T
auaaaauucauucaauu

SEQ ID NO: 3868907 - RNA, 10 nt, Shigella flexneri 2a str. 2457T
auaaacaaag

SEQ ID NO: 3868908 - RNA, 23 nt, Shigella flexneri 2a str. 2457T
auaaacaacggcaagaucagcau

SEQ ID NO: 3868909 - RNA, 19 nt, Shigella flexneri 2a str. 2457T
auaaacaagcguacaaaau

SEQ ID NO: 3868910 - RNA, 15 nt, Shigella flexneri 2a str. 2457T
auaaacaaugagaua

SEQ ID NO: 3868911 - RNA, 20 nt, Shigella flexneri 2a str. 2457T
auaaacaaugagauauuuaa

SEQ ID NO: 3868912 - RNA, 18 nt, Shigella flexneri 2a str. 2457T
auaaacaccagcaauaau

SEQ ID NO: 3868913 - RNA, 11 nt, Shigella flexneri 2a str. 2457T
auaaacagcag

SEQ ID NO: 3868914 - RNA, 15 nt, Shigella flexneri 2a str. 2457T
auaaacagcguaaau

SEQ ID NO: 3868915 - RNA, 19 nt, Shigella flexneri 2a str. 2457T
auaaacaguuucgccaggg

SEQ ID NO: 3868916 - RNA, 20 nt, Shigella flexneri 2a str. 2457T
auaaacaguuucgccagggu

SEQ ID NO: 3868917 - RNA, 23 nt, Shigella flexneri 2a str. 2457T
auaaacaucagcuauucuuauaa

SEQ ID NO: 3868918 - RNA, 16 nt, Shigella flexneri 2a str. 2457T
auaaaccagcaaccaa

SEQ ID NO: 3868919 - RNA, 19 nt, Shigella flexneri 2a str. 2457T
auaaaccagugccaaacca

SEQ ID NO: 3868920 - RNA, 21 nt, Shigella flexneri 2a str. 2457T
auaaaccagugccaaaccaga

SEQ ID NO: 3868921 - RNA, 15 nt, Shigella flexneri 2a str. 2457T
auaaggccaugcugc

SEQ ID NO: 3868922 - RNA, 14 nt, Shigella flexneri 2a str. 2457T
auaaggcgcaauaa

SEQ ID NO: 3868923 - RNA, 20 nt, Shigella flexneri 2a str. 2457T
auaagguaucgcgaaaaaaa

SEQ ID NO: 3868924 - RNA, 17 nt, Shigella flexneri 2a str. 2457T
auaagguucauugagcg

SEQ ID NO: 3868925 - RNA, 22 nt, Shigella flexneri 2a str. 2457T
auaagugauggcgauuauauga

SEQ ID NO: 3868926 - RNA, 22 nt, Shigella flexneri 2a str. 2457T
auaaguuaaccccaguaauuca

SEQ ID NO: 3868927 - RNA, 15 nt, Shigella flexneri 2a str. 2457T
auaaguuacacauca

SEQ ID NO: 3868928 - RNA, 13 nt, Shigella flexneri 2a str. 2457T
auaaguucaguau

SEQ ID NO: 3868929 - RNA, 21 nt, Shigella flexneri 2a str. 2457T
auaaguugccacgcuucaauc

SEQ ID NO: 3868930 - RNA, 13 nt, Shigella flexneri 2a str. 2457T
auaauaaagcuac

SEQ ID NO: 3868931 - RNA, 23 nt, Shigella flexneri 2a str. 2457T
auaauacagcccagacaaaugaa

SEQ ID NO: 3868932 - RNA, 13 nt, Shigella flexneri 2a str. 2457T
auaauaguauuaa

SEQ ID NO: 3868933 - RNA, 19 nt, Shigella flexneri 2a str. 2457T
auaauaguauuaagccagu

SEQ ID NO: 3868934 - RNA, 21 nt, Shigella flexneri 2a str. 2457T
auaauauccugccguuuuuua

SEQ ID NO: 3868935 - RNA, 13 nt, Shigella flexneri 2a str. 2457T
auaauaucuccag

SEQ ID NO: 3868936 - RNA, 15 nt, Shigella flexneri 2a str. 2457T
auaauaucuccagcu

SEQ ID NO: 3868937 - RNA, 11 nt, Shigella flexneri 2a str. 2457T
auaauaucuuu

SEQ ID NO: 3868938 - RNA, 14 nt, Shigella flexneri 2a str. 2457T
auaauaucuuuucu

SEQ ID NO: 3868939 - RNA, 17 nt, Shigella flexneri 2a str. 2457T
auaaucaacaaaccaaa

SEQ ID NO: 3868940 - RNA, 20 nt, Shigella flexneri 2a str. 2457T
auaaucaaucuuuacacaca

SEQ ID NO: 3868941 - RNA, 13 nt, Shigella flexneri 2a str. 2457T
auaaucaaugaca

SEQ ID NO: 3868942 - RNA, 20 nt, Shigella flexneri 2a str. 2457T
auaaucaccugccuucacuu

SEQ ID NO: 3868943 - RNA, 19 nt, Shigella flexneri 2a str. 2457T
auaaucacucuuccccgcu

SEQ ID NO: 3868944 - RNA, 17 nt, Shigella flexneri 2a str. 2457T
auaaucaggaauauggu

SEQ ID NO: 3868945 - RNA, 19 nt, Shigella flexneri 2a str. 2457T
auaaucauuucgccugaaa

SEQ ID NO: 3868946 - RNA, 15 nt, Shigella flexneri 2a str. 2457T
auaauccaucacuuc

SEQ ID NO: 3868947 - RNA, 18 nt, Shigella flexneri 2a str. 2457T
auaauccaucacuucauc

SEQ ID NO: 3868948 - RNA, 22 nt, Shigella flexneri 2a str. 2457T
auaauccaucccgcucuguaag

SEQ ID NO: 3868949 - RNA, 18 nt, Shigella flexneri 2a str. 2457T
auaauccccaaugaccuu

SEQ ID NO: 3868950 - RNA, 22 nt, Shigella flexneri 2a str. 2457T
auaauccccggccuuugauuau

SEQ ID NO: 3868951 - RNA, 17 nt, Shigella flexneri 2a str. 2457T
auaauccgcuguaauug

SEQ ID NO: 3868952 - RNA, 20 nt, Shigella flexneri 2a str. 2457T
auaauccugccgagauacag

SEQ ID NO: 3868953 - RNA, 15 nt, Shigella flexneri 2a str. 2457T
auaaucgaaccaaac

SEQ ID NO: 3868954 - RNA, 22 nt, Shigella flexneri 2a str. 2457T
auaaucgaucgcguaauaaaau

SEQ ID NO: 3868955 - RNA, 17 nt, Shigella flexneri 2a str. 2457T
auaaucgauugcacauu

SEQ ID NO: 3868956 - RNA, 19 nt, Shigella flexneri 2a str. 2457T
auaaucgauugcacauucc

SEQ ID NO: 3868957 - RNA, 19 nt, Shigella flexneri 2a str. 2457T
auaaucgcgcuaauuccag

SEQ ID NO: 3868958 - RNA, 15 nt, Shigella flexneri 2a str. 2457T
auaaucgggaacgcu

SEQ ID NO: 3868959 - RNA, 14 nt, Shigella flexneri 2a str. 2457T
auaaucgggaauac

SEQ ID NO: 3868960 - RNA, 14 nt, Shigella flexneri 2a str. 2457T
auaaucguaaucag

SEQ ID NO: 3868961 - RNA, 17 nt, Shigella flexneri 2a str. 2457T
auaaucguaaucagcau

SEQ ID NO: 3868962 - RNA, 21 nt, Shigella flexneri 2a str. 2457T
auaaucguaaucagcaucuca

SEQ ID NO: 3868963 - RNA, 21 nt, Shigella flexneri 2a str. 2457T
auaaucucuuuacccagcgga

SEQ ID NO: 3868964 - RNA, 17 nt, Shigella flexneri 2a str. 2457T
auaaucuguuucaucuc

SEQ ID NO: 3868965 - RNA, 13 nt, Shigella flexneri 2a str. 2457T
auaaucuuuaaaa

SEQ ID NO: 3868966 - RNA, 16 nt, Shigella flexneri 2a str. 2457T
auaaucuuuaaaaaaa

SEQ ID NO: 3868967 - RNA, 17 nt, Shigella flexneri 2a str. 2457T
auaaugaaggaugaaac

SEQ ID NO: 3868968 - RNA, 17 nt, Shigella flexneri 2a str. 2457T
auaaugacggagaguac

SEQ ID NO: 3868969 - RNA, 18 nt, Shigella flexneri 2a str. 2457T
auaaugacggagaguacu

SEQ ID NO: 3868970 - RNA, 14 nt, Shigella flexneri 2a str. 2457T
auaaugagcagaaa

SEQ ID NO: 3868971 - RNA, 18 nt, Shigella flexneri 2a str. 2457T
auaaugaucaguggaaga

SEQ ID NO: 3868972 - RNA, 14 nt, Shigella flexneri 2a str. 2457T
auaaugaugucauc

SEQ ID NO: 3868973 - RNA, 20 nt, Shigella flexneri 2a str. 2457T
auaaugcaauggaauggcug

SEQ ID NO: 3868974 - RNA, 11 nt, Shigella flexneri 2a str. 2457T
auaaugcccag

SEQ ID NO: 3868975 - RNA, 19 nt, Shigella flexneri 2a str. 2457T
auaaugcccagcaacgaaa

SEQ ID NO: 3868976 - RNA, 18 nt, Shigella flexneri 2a str. 2457T
auaaugcccgaugaccuu

SEQ ID NO: 3868977 - RNA, 22 nt, Shigella flexneri 2a str. 2457T
auaaugcccgaugaccuuguca

SEQ ID NO: 3868978 - RNA, 14 nt, Shigella flexneri 2a str. 2457T
auaaugccggauac

SEQ ID NO: 3868979 - RNA, 19 nt, Shigella flexneri 2a str. 2457T
auaaugcgacaacagaaau

SEQ ID NO: 3868980 - RNA, 13 nt, Shigella flexneri 2a str. 2457T
auaaugcugacaa

SEQ ID NO: 3868981 - RNA, 11 nt, Shigella flexneri 2a str. 2457T
auaauggcugu

SEQ ID NO: 3868982 - RNA, 17 nt, Shigella flexneri 2a str. 2457T
auaaugggcgcgggcga

SEQ ID NO: 3868983 - RNA, 15 nt, Shigella flexneri 2a str. 2457T
auaauguguucaacu

SEQ ID NO: 3868984 - RNA, 22 nt, Shigella flexneri 2a str. 2457T
auaauguuauuuaauuacugag

SEQ ID NO: 3868985 - RNA, 13 nt, Shigella flexneri 2a str. 2457T
auaauuaaaaaua

SEQ ID NO: 3868986 - RNA, 15 nt, Shigella flexneri 2a str. 2457T
auaauuaaaaauagu

SEQ ID NO: 3868987 - RNA, 16 nt, Shigella flexneri 2a str. 2457T
auaauuacuuacaucu

SEQ ID NO: 3868988 - RNA, 14 nt, Shigella flexneri 2a str. 2457T
auaauuauuauaau

SEQ ID NO: 3868989 - RNA, 21 nt, Shigella flexneri 2a str. 2457T
auaauuccauucaccauuuuu

SEQ ID NO: 3868990 - RNA, 23 nt, Shigella flexneri 2a str. 2457T
auaauuccucccguuaugaucag

SEQ ID NO: 3868991 - RNA, 13 nt, Shigella flexneri 2a str. 2457T
auaauucuguaau

SEQ ID NO: 3868992 - RNA, 22 nt, Shigella flexneri 2a str. 2457T
auaauugaccagaucuucauca

SEQ ID NO: 3868993 - RNA, 16 nt, Shigella flexneri 2a str. 2457T
auaauugccagcuugc

SEQ ID NO: 3868994 - RNA, 21 nt, Shigella flexneri 2a str. 2457T
auaauuguuccguuauuaugc

SEQ ID NO: 3868995 - RNA, 14 nt, Shigella flexneri 2a str. 2457T
auaauuugugacga

SEQ ID NO: 3868996 - RNA, 15 nt, Shigella flexneri 2a str. 2457T
auaauuuuuucgcca

SEQ ID NO: 3868997 - RNA, 14 nt, Shigella flexneri 2a str. 2457T
auaauuuuuucuuc

SEQ ID NO: 3868998 - RNA, 16 nt, Shigella flexneri 2a str. 2457T
auacaaaauuuaacac

SEQ ID NO: 3868999 - RNA, 15 nt, Shigella flexneri 2a str. 2457T
auacaaauagccaau

SEQ ID NO: 3869000 - RNA, 14 nt, Shigella flexneri 2a str. 2457T
auacaaccaaucgc

SEQ ID NO: 3869001 - RNA, 12 nt, Shigella flexneri 2a str. 2457T
auacaacccacc

SEQ ID NO: 3869002 - RNA, 13 nt, Shigella flexneri 2a str. 2457T
auacaacgccaug

SEQ ID NO: 3869003 - RNA, 15 nt, Shigella flexneri 2a str. 2457T
auacaacgccaugaa

SEQ ID NO: 3869004 - RNA, 16 nt, Shigella flexneri 2a str. 2457T
auacaacgcgcgguga

SEQ ID NO: 3869005 - RNA, 22 nt, Shigella flexneri 2a str. 2457T
auacaagagauaugaauaugaa

SEQ ID NO: 3869006 - RNA, 17 nt, Shigella flexneri 2a str. 2457T
auacaaggccaauccag

SEQ ID NO: 3869007 - RNA, 14 nt, Shigella flexneri 2a str. 2457T
auacaaucauuccc

SEQ ID NO: 3869008 - RNA, 20 nt, Shigella flexneri 2a str. 2457T
auacacuaacagaacaauaa

SEQ ID NO: 3869009 - RNA, 17 nt, Shigella flexneri 2a str. 2457T
auacacucuuucaauau

SEQ ID NO: 3869010 - RNA, 18 nt, Shigella flexneri 2a str. 2457T
auacacucuuucaauauu

SEQ ID NO: 3869011 - RNA, 20 nt, Shigella flexneri 2a str. 2457T
auacacuucacacacuuuua

SEQ ID NO: 3869012 - RNA, 15 nt, Shigella flexneri 2a str. 2457T
auacagcaauggaaa

SEQ ID NO: 3869013 - RNA, 15 nt, Shigella flexneri 2a str. 2457T
auacagccaaaucau

SEQ ID NO: 3869014 - RNA, 15 nt, Shigella flexneri 2a str. 2457T
auacagcccagacaa

SEQ ID NO: 3869015 - RNA, 20 nt, Shigella flexneri 2a str. 2457T
auacagcccagacaaaugaa

SEQ ID NO: 3869016 - RNA, 12 nt, Shigella flexneri 2a str. 2457T
auacagccgaag

SEQ ID NO: 3869017 - RNA, 15 nt, Shigella flexneri 2a str. 2457T
auacagccgguacau

SEQ ID NO: 3869018 - RNA, 17 nt, Shigella flexneri 2a str. 2457T
auacagcggacagccau

SEQ ID NO: 3869019 - RNA, 19 nt, Shigella flexneri 2a str. 2457T
auacuuucacaaaaauaau

SEQ ID NO: 3869020 - RNA, 15 nt, Shigella flexneri 2a str. 2457T
auacuuuccagcaua

SEQ ID NO: 3869021 - RNA, 16 nt, Shigella flexneri 2a str. 2457T
auacuuuuucaagaau

SEQ ID NO: 3869022 - RNA, 23 nt, Shigella flexneri 2a str. 2457T
auacuuuuucaagaaucggcuuu

SEQ ID NO: 3869023 - RNA, 19 nt, Shigella flexneri 2a str. 2457T
auagaaacucauaugcagc

SEQ ID NO: 3869024 - RNA, 15 nt, Shigella flexneri 2a str. 2457T
auagaaagugacugc

SEQ ID NO: 3869025 - RNA, 22 nt, Shigella flexneri 2a str. 2457T
auagaaagugacugcuggguua

SEQ ID NO: 3869026 - RNA, 18 nt, Shigella flexneri 2a str. 2457T
auagaacaaaagaccuga

SEQ ID NO: 3869027 - RNA, 16 nt, Shigella flexneri 2a str. 2457T
auagaacaucucuucc

SEQ ID NO: 3869028 - RNA, 14 nt, Shigella flexneri 2a str. 2457T
auagaaccacgcaa

SEQ ID NO: 3869029 - RNA, 20 nt, Shigella flexneri 2a str. 2457T
auagaaccuaagaaccagaa

SEQ ID NO: 3869030 - RNA, 11 nt, Shigella flexneri 2a str. 2457T
auagaauagcc

SEQ ID NO: 3869031 - RNA, 19 nt, Shigella flexneri 2a str. 2457T
auagacaucuuuauaugca

SEQ ID NO: 3869032 - RNA, 14 nt, Shigella flexneri 2a str. 2457T
auagacuucccucc

SEQ ID NO: 3869033 - RNA, 15 nt, Shigella flexneri 2a str. 2457T
auagagauuuuuccc

SEQ ID NO: 3869034 - RNA, 19 nt, Shigella flexneri 2a str. 2457T
auagagcaaccaccugcaa

SEQ ID NO: 3869035 - RNA, 14 nt, Shigella flexneri 2a str. 2457T
auagagcgccugca

SEQ ID NO: 3869036 - RNA, 18 nt, Shigella flexneri 2a str. 2457T
auagaguguuccucugcc

SEQ ID NO: 3869037 - RNA, 15 nt, Shigella flexneri 2a str. 2457T
auagaucagacgaca

SEQ ID NO: 3869038 - RNA, 13 nt, Shigella flexneri 2a str. 2457T
auagauccaggaa

SEQ ID NO: 3869039 - RNA, 22 nt, Shigella flexneri 2a str. 2457T
auagaucuaaaugccacugaau

SEQ ID NO: 3869040 - RNA, 23 nt, Shigella flexneri 2a str. 2457T
auagauuaguuguacauuaccac

SEQ ID NO: 3869041 - RNA, 16 nt, Shigella flexneri 2a str. 2457T
auagauuuuuaaugcu

SEQ ID NO: 3869042 - RNA, 20 nt, Shigella flexneri 2a str. 2457T
auagauuuuuaaugcuuuuu

SEQ ID NO: 3869043 - RNA, 13 nt, Shigella flexneri 2a str. 2457T
auagcaaaguaau

SEQ ID NO: 3869044 - RNA, 15 nt, Shigella flexneri 2a str. 2457T
auagcaacagcagcc

SEQ ID NO: 3869045 - RNA, 18 nt, Shigella flexneri 2a str. 2457T
auagcaacagcagccaac

SEQ ID NO: 3869046 - RNA, 12 nt, Shigella flexneri 2a str. 2457T
auagcacacuuu

SEQ ID NO: 3869047 - RNA, 17 nt, Shigella flexneri 2a str. 2457T
auagcacccgccagcgc

SEQ ID NO: 3869048 - RNA, 11 nt, Shigella flexneri 2a str. 2457T
auagccaauuc

SEQ ID NO: 3869049 - RNA, 19 nt, Shigella flexneri 2a str. 2457T
auagccaccuggcugcguu

SEQ ID NO: 3869050 - RNA, 15 nt, Shigella flexneri 2a str. 2457T
auagccagacguugu

SEQ ID NO: 3869051 - RNA, 19 nt, Shigella flexneri 2a str. 2457T
auagccagcagagcaaaaa

SEQ ID NO: 3869052 - RNA, 17 nt, Shigella flexneri 2a str. 2457T
auagccagccucaucca

SEQ ID NO: 3869053 - RNA, 21 nt, Shigella flexneri 2a str. 2457T
auagccagguuuaccagcagc

SEQ ID NO: 3869054 - RNA, 14 nt, Shigella flexneri 2a str. 2457T
auagccaucugccu

SEQ ID NO: 3869055 - RNA, 15 nt, Shigella flexneri 2a str. 2457T
auagccgauaccuaa

SEQ ID NO: 3869056 - RNA, 19 nt, Shigella flexneri 2a str. 2457T
auagccucaaauuccuuau

SEQ ID NO: 3869057 - RNA, 19 nt, Shigella flexneri 2a str. 2457T
auagccuuuauuaaugaca

SEQ ID NO: 3869058 - RNA, 15 nt, Shigella flexneri 2a str. 2457T
auagccuuucaauaa

SEQ ID NO: 3869059 - RNA, 19 nt, Shigella flexneri 2a str. 2457T
auagcgaaguagacagcgu

SEQ ID NO: 3869060 - RNA, 23 nt, Shigella flexneri 2a str. 2457T
auagcgacuugggcgauuuuugc

SEQ ID NO: 3869061 - RNA, 15 nt, Shigella flexneri 2a str. 2457T
auagcgcaaaauuau

SEQ ID NO: 3869062 - RNA, 21 nt, Shigella flexneri 2a str. 2457T
auagcgcacaugcaacuucgc

SEQ ID NO: 3869063 - RNA, 17 nt, Shigella flexneri 2a str. 2457T
auagcgucccaguaacg

SEQ ID NO: 3869064 - RNA, 17 nt, Shigella flexneri 2a str. 2457T
auagcguuaaucaucaa

SEQ ID NO: 3869065 - RNA, 20 nt, Shigella flexneri 2a str. 2457T
auagcuaacucuaaucccuu

SEQ ID NO: 3869066 - RNA, 19 nt, Shigella flexneri 2a str. 2457T
auagcuaaucaucuguugu

SEQ ID NO: 3869067 - RNA, 19 nt, Shigella flexneri 2a str. 2457T
auagcugcgacaucauuuu

SEQ ID NO: 3869068 - RNA, 17 nt, Shigella flexneri 2a str. 2457T
auagcuuauucuuauua

SEQ ID NO: 3869069 - RNA, 20 nt, Shigella flexneri 2a str. 2457T
auaggaaagcuuauuuuaca

SEQ ID NO: 3869070 - RNA, 14 nt, Shigella flexneri 2a str. 2457T
auaggaauuaaaac

SEQ ID NO: 3869071 - RNA, 17 nt, Shigella flexneri 2a str. 2457T
auaggaauuaaaacccc

SEQ ID NO: 3869072 - RNA, 19 nt, Shigella flexneri 2a str. 2457T
auaggagucacucgacagc

SEQ ID NO: 3869073 - RNA, 18 nt, Shigella flexneri 2a str. 2457T
auaggaugagguuucccg

SEQ ID NO: 3869074 - RNA, 23 nt, Shigella flexneri 2a str. 2457T
auaggauuucugauuauggcggc

SEQ ID NO: 3869075 - RNA, 19 nt, Shigella flexneri 2a str. 2457T
auaggcaaaaaaaaugccc

SEQ ID NO: 3869076 - RNA, 14 nt, Shigella flexneri 2a str. 2457T
auaggcaccgccaa

SEQ ID NO: 3869077 - RNA, 14 nt, Shigella flexneri 2a str. 2457T
auaggcaucccgca

SEQ ID NO: 3869078 - RNA, 18 nt, Shigella flexneri 2a str. 2457T
auaggcggcaaacaguuu

SEQ ID NO: 3869079 - RNA, 14 nt, Shigella flexneri 2a str. 2457T
auaggcuuccaccg

SEQ ID NO: 3869080 - RNA, 15 nt, Shigella flexneri 2a str. 2457T
auagguaaacaucac

SEQ ID NO: 3869081 - RNA, 16 nt, Shigella flexneri 2a str. 2457T
auagguugaaauaaac

SEQ ID NO: 3869082 - RNA, 16 nt, Shigella flexneri 2a str. 2457T
auaguaauuucaucug

SEQ ID NO: 3869083 - RNA, 19 nt, Shigella flexneri 2a str. 2457T
auaguacgggcaauuucac

SEQ ID NO: 3869084 - RNA, 14 nt, Shigella flexneri 2a str. 2457T
auagucaucucuuc

SEQ ID NO: 3869085 - RNA, 20 nt, Shigella flexneri 2a str. 2457T
auagucaucucuuccggcac

SEQ ID NO: 3869086 - RNA, 16 nt, Shigella flexneri 2a str. 2457T
auagucaugaugacgc

SEQ ID NO: 3869087 - RNA, 14 nt, Shigella flexneri 2a str. 2457T
auaguggcucaggc

SEQ ID NO: 3869088 - RNA, 18 nt, Shigella flexneri 2a str. 2457T
auaguucaaugauaguuc

SEQ ID NO: 3869089 - RNA, 20 nt, Shigella flexneri 2a str. 2457T
auaguuccacuauuucaaua

SEQ ID NO: 3869090 - RNA, 21 nt, Shigella flexneri 2a str. 2457T
auaguucgcgaucgcgccaga

SEQ ID NO: 3869091 - RNA, 20 nt, Shigella flexneri 2a str. 2457T
auaguuggcccgauagaaac

SEQ ID NO: 3869092 - RNA, 19 nt, Shigella flexneri 2a str. 2457T
auaguuuuuacaaacaaga

SEQ ID NO: 3869093 - RNA, 16 nt, Shigella flexneri 2a str. 2457T
auauaaaaauccgccu

SEQ ID NO: 3869094 - RNA, 15 nt, Shigella flexneri 2a str. 2457T
auauaaagcaucaau

SEQ ID NO: 3869095 - RNA, 16 nt, Shigella flexneri 2a str. 2457T
auauaaagcaucaauu

SEQ ID NO: 3869096 - RNA, 16 nt, Shigella flexneri 2a str. 2457T
auauaaagcugaucac

SEQ ID NO: 3869097 - RNA, 20 nt, Shigella flexneri 2a str. 2457T
auauaaauauuuucugaaaa

SEQ ID NO: 3869098 - RNA, 21 nt, Shigella flexneri 2a str. 2457T
auauaaauucccgcagauaaa

SEQ ID NO: 3869099 - RNA, 12 nt, Shigella flexneri 2a str. 2457T
auauaaauuuca

SEQ ID NO: 3869100 - RNA, 17 nt, Shigella flexneri 2a str. 2457T
auauaagcauguucuuu

SEQ ID NO: 3869101 - RNA, 14 nt, Shigella flexneri 2a str. 2457T
auauaaugcaacau

SEQ ID NO: 3869102 - RNA, 15 nt, Shigella flexneri 2a str. 2457T
auauaauuaaaaaua

SEQ ID NO: 3869103 - RNA, 16 nt, Shigella flexneri 2a str. 2457T
auauaauugaccagau

SEQ ID NO: 3869104 - RNA, 22 nt, Shigella flexneri 2a str. 2457T
auauaauugaccagaucuucau

SEQ ID NO: 3869105 - RNA, 23 nt, Shigella flexneri 2a str. 2457T
auauacaggcggguaaucuuucc

SEQ ID NO: 3869106 - RNA, 20 nt, Shigella flexneri 2a str. 2457T
auauaccauggaagaaaaau

SEQ ID NO: 3869107 - RNA, 15 nt, Shigella flexneri 2a str. 2457T
auauacccuucucag

SEQ ID NO: 3869108 - RNA, 19 nt, Shigella flexneri 2a str. 2457T
auauaccucagcagacuga

SEQ ID NO: 3869109 - RNA, 21 nt, Shigella flexneri 2a str. 2457T
auauaccuuccgguuucaaau

SEQ ID NO: 3869110 - RNA, 17 nt, Shigella flexneri 2a str. 2457T
auauacgccaucgccag

SEQ ID NO: 3869111 - RNA, 22 nt, Shigella flexneri 2a str. 2457T
auauacgccaucgccagcagcc

SEQ ID NO: 3869112 - RNA, 15 nt, Shigella flexneri 2a str. 2457T
auauagacaaaguaa

SEQ ID NO: 3869113 - RNA, 14 nt, Shigella flexneri 2a str. 2457T
auauagccagccuc

SEQ ID NO: 3869114 - RNA, 19 nt, Shigella flexneri 2a str. 2457T
auauagcgcacaugcaacu

SEQ ID NO: 3869115 - RNA, 22 nt, Shigella flexneri 2a str. 2457T
auauaguagaucuugauuuacu

SEQ ID NO: 3869116 - RNA, 20 nt, Shigella flexneri 2a str. 2457T
auauuccugaauggugaccu

SEQ ID NO: 3869117 - RNA, 18 nt, Shigella flexneri 2a str. 2457T
auauuccugacccagcac

SEQ ID NO: 3869118 - RNA, 20 nt, Shigella flexneri 2a str. 2457T
auauuccuuuaucauuaaca

SEQ ID NO: 3869119 - RNA, 17 nt, Shigella flexneri 2a str. 2457T
auauucgccgcccugca

SEQ ID NO: 3869120 - RNA, 13 nt, Shigella flexneri 2a str. 2457T
auauucgcuuuca

SEQ ID NO: 3869121 - RNA, 14 nt, Shigella flexneri 2a str. 2457T
auauucgcuuucag

SEQ ID NO: 3869122 - RNA, 11 nt, Shigella flexneri 2a str. 2457T
auauucguuau

SEQ ID NO: 3869123 - RNA, 13 nt, Shigella flexneri 2a str. 2457T
auauucguucaga

SEQ ID NO: 3869124 - RNA, 16 nt, Shigella flexneri 2a str. 2457T
auauucucaaaauaca

SEQ ID NO: 3869125 - RNA, 17 nt, Shigella flexneri 2a str. 2457T
auauucucaaaauacag

SEQ ID NO: 3869126 - RNA, 13 nt, Shigella flexneri 2a str. 2457T
auauucugaaaua

SEQ ID NO: 3869127 - RNA, 21 nt, Shigella flexneri 2a str. 2457T
auauugcacaguauagcauca

SEQ ID NO: 3869128 - RNA, 19 nt, Shigella flexneri 2a str. 2457T
auauugccgaagaccagau

SEQ ID NO: 3869129 - RNA, 18 nt, Shigella flexneri 2a str. 2457T
auauugccgcgauagcaa

SEQ ID NO: 3869130 - RNA, 13 nt, Shigella flexneri 2a str. 2457T
auauuggucacca

SEQ ID NO: 3869131 - RNA, 12 nt, Shigella flexneri 2a str. 2457T
auauugguguug

SEQ ID NO: 3869132 - RNA, 14 nt, Shigella flexneri 2a str. 2457T
auauugguguugug

SEQ ID NO: 3869133 - RNA, 19 nt, Shigella flexneri 2a str. 2457T
auauugucuucaagaucag

SEQ ID NO: 3869134 - RNA, 17 nt, Shigella flexneri 2a str. 2457T
auauugugguuggugug

SEQ ID NO: 3869135 - RNA, 23 nt, Shigella flexneri 2a str. 2457T
auauuguuacgguguucacucau

SEQ ID NO: 3869136 - RNA, 23 nt, Shigella flexneri 2a str. 2457T
auauuuaaauugcgguuuuuaag

SEQ ID NO: 3869137 - RNA, 18 nt, Shigella flexneri 2a str. 2457T
auauuuaaucaguucuac

SEQ ID NO: 3869138 - RNA, 20 nt, Shigella flexneri 2a str. 2457T
auauuuaauggcgacauaaa

SEQ ID NO: 3869139 - RNA, 18 nt, Shigella flexneri 2a str. 2457T
auauuuagccagcaacug

SEQ ID NO: 3869140 - RNA, 21 nt, Shigella flexneri 2a str. 2457T
auauuuauaggguaaauuacc

SEQ ID NO: 3869141 - RNA, 11 nt, Shigella flexneri 2a str. 2457T
auauuucacau

SEQ ID NO: 3869142 - RNA, 15 nt, Shigella flexneri 2a str. 2457T
auauuucaggccaac

SEQ ID NO: 3869143 - RNA, 19 nt, Shigella flexneri 2a str. 2457T
auauuuccccuguugcaaa

SEQ ID NO: 3869144 - RNA, 16 nt, Shigella flexneri 2a str. 2457T
auauuuccuuccuugg

SEQ ID NO: 3869145 - RNA, 18 nt, Shigella flexneri 2a str. 2457T
auauuucucggcaaauuc

SEQ ID NO: 3869146 - RNA, 22 nt, Shigella flexneri 2a str. 2457T
auauuucugcggcauucccagc

SEQ ID NO: 3869147 - RNA, 16 nt, Shigella flexneri 2a str. 2457T
auauuuuccgugaaga

SEQ ID NO: 3869148 - RNA, 23 nt, Shigella flexneri 2a str. 2457T
auauuuugaaucggcggcggcag

SEQ ID NO: 3869149 - RNA, 20 nt, Shigella flexneri 2a str. 2457T
auauuuugcuuuaaguucag

SEQ ID NO: 3869150 - RNA, 20 nt, Shigella flexneri 2a str. 2457T
auauuuugggaucggugcag

SEQ ID NO: 3869151 - RNA, 17 nt, Shigella flexneri 2a str. 2457T
auauuuuuaaauauaaa

SEQ ID NO: 3869152 - RNA, 14 nt, Shigella flexneri 2a str. 2457T
auauuuuucccuga

SEQ ID NO: 3869153 - RNA, 15 nt, Shigella flexneri 2a str. 2457T
auauuuuuccggcag

SEQ ID NO: 3869154 - RNA, 20 nt, Shigella flexneri 2a str. 2457T
aucaaaaaacuggaaaaaua

SEQ ID NO: 3869155 - RNA, 13 nt, Shigella flexneri 2a str. 2457T
aucaaaaucauau

SEQ ID NO: 3869156 - RNA, 15 nt, Shigella flexneri 2a str. 2457T
aucaaacaauuuuca

SEQ ID NO: 3869157 - RNA, 17 nt, Shigella flexneri 2a str. 2457T
aucaaacgugacauucu

SEQ ID NO: 3869158 - RNA, 19 nt, Shigella flexneri 2a str. 2457T
aucaaacuuuuaaauugaa

SEQ ID NO: 3869159 - RNA, 21 nt, Shigella flexneri 2a str. 2457T
aucaaacuuuuaaauugaaga

SEQ ID NO: 3869160 - RNA, 13 nt, Shigella flexneri 2a str. 2457T
aucaaagaugaug

SEQ ID NO: 3869161 - RNA, 21 nt, Shigella flexneri 2a str. 2457T
aucaaagauuguuggcaaaaa

SEQ ID NO: 3869162 - RNA, 14 nt, Shigella flexneri 2a str. 2457T
aucaaagguuuuuc

SEQ ID NO: 3869163 - RNA, 19 nt, Shigella flexneri 2a str. 2457T
aucaaagucuccuuugcca

SEQ ID NO: 3869164 - RNA, 13 nt, Shigella flexneri 2a str. 2457T
aucaaauaaaaau

SEQ ID NO: 3869165 - RNA, 22 nt, Shigella flexneri 2a str. 2457T
aucaaaucaccauauucagcag

SEQ ID NO: 3869166 - RNA, 23 nt, Shigella flexneri 2a str. 2457T
aucaaaucaccauauucagcagc

SEQ ID NO: 3869167 - RNA, 14 nt, Shigella flexneri 2a str. 2457T
aucaacaagcgaau

SEQ ID NO: 3869168 - RNA, 22 nt, Shigella flexneri 2a str. 2457T
aucaacaauaaaaccaguaaug

SEQ ID NO: 3869169 - RNA, 15 nt, Shigella flexneri 2a str. 2457T
aucaacaguuuguug

SEQ ID NO: 3869170 - RNA, 17 nt, Shigella flexneri 2a str. 2457T
aucaacaguuuguugca

SEQ ID NO: 3869171 - RNA, 24 nt, Shigella flexneri 2a str. 2457T
aucaacaguuuguugcauuugcag

SEQ ID NO: 3869172 - RNA, 15 nt, Shigella flexneri 2a str. 2457T
aucaacauauuaaaa

SEQ ID NO: 3869173 - RNA, 16 nt, Shigella flexneri 2a str. 2457T
aucaacauauuccccu

SEQ ID NO: 3869174 - RNA, 14 nt, Shigella flexneri 2a str. 2457T
aucaacaugaaaau

SEQ ID NO: 3869175 - RNA, 15 nt, Shigella flexneri 2a str. 2457T
aucaacaugaaaaua

SEQ ID NO: 3869176 - RNA, 21 nt, Shigella flexneri 2a str. 2457T
aucaacaugauggcuggcuuc

SEQ ID NO: 3869177 - RNA, 23 nt, Shigella flexneri 2a str. 2457T
aucaaccagaucgcucaucugcu

SEQ ID NO: 3869178 - RNA, 15 nt, Shigella flexneri 2a str. 2457T
aucaacccagcuggu

SEQ ID NO: 3869179 - RNA, 20 nt, Shigella flexneri 2a str. 2457T
aucaacccugcccuucaggg

SEQ ID NO: 3869180 - RNA, 15 nt, Shigella flexneri 2a str. 2457T
aucaaccugaggcuc

SEQ ID NO: 3869181 - RNA, 15 nt, Shigella flexneri 2a str. 2457T
aucaacgacagccug

SEQ ID NO: 3869182 - RNA, 17 nt, Shigella flexneri 2a str. 2457T
aucaacgccaucgccag

SEQ ID NO: 3869183 - RNA, 14 nt, Shigella flexneri 2a str. 2457T
aucaacgcuggcau

SEQ ID NO: 3869184 - RNA, 15 nt, Shigella flexneri 2a str. 2457T
aucaacgcuggcaug

SEQ ID NO: 3869185 - RNA, 19 nt, Shigella flexneri 2a str. 2457T
aucaacgcuggcaugcucu

SEQ ID NO: 3869186 - RNA, 15 nt, Shigella flexneri 2a str. 2457T
aucaacggcaacaau

SEQ ID NO: 3869187 - RNA, 22 nt, Shigella flexneri 2a str. 2457T
aucaacguaguaucguaaucag

SEQ ID NO: 3869188 - RNA, 14 nt, Shigella flexneri 2a str. 2457T
aucaacgucugcgc

SEQ ID NO: 3869189 - RNA, 22 nt, Shigella flexneri 2a str. 2457T
aucaacguuauucgcuuccuca

SEQ ID NO: 3869190 - RNA, 14 nt, Shigella flexneri 2a str. 2457T
aucaacuaaauauc

SEQ ID NO: 3869191 - RNA, 18 nt, Shigella flexneri 2a str. 2457T
aucaacugcguucugucg

SEQ ID NO: 3869192 - RNA, 15 nt, Shigella flexneri 2a str. 2457T
aucaagaaugcucgc

SEQ ID NO: 3869193 - RNA, 13 nt, Shigella flexneri 2a str. 2457T
aucaagacaugau

SEQ ID NO: 3869194 - RNA, 15 nt, Shigella flexneri 2a str. 2457T
aucaagauuaaaagu

SEQ ID NO: 3869195 - RNA, 23 nt, Shigella flexneri 2a str. 2457T
aucaagcaaggccagguuuucuu

SEQ ID NO: 3869196 - RNA, 18 nt, Shigella flexneri 2a str. 2457T
aucaagcaugauauucac

SEQ ID NO: 3869197 - RNA, 19 nt, Shigella flexneri 2a str. 2457T
aucaagccccagcaggaug

SEQ ID NO: 3869198 - RNA, 20 nt, Shigella flexneri 2a str. 2457T
aucaagcccugguaacugcc

SEQ ID NO: 3869199 - RNA, 21 nt, Shigella flexneri 2a str. 2457T
aucaagcccugguaacugcca

SEQ ID NO: 3869200 - RNA, 18 nt, Shigella flexneri 2a str. 2457T
aucaagcgccgaguaaaa

SEQ ID NO: 3869201 - RNA, 20 nt, Shigella flexneri 2a str. 2457T
aucaagcgccgaguaaaaaa

SEQ ID NO: 3869202 - RNA, 14 nt, Shigella flexneri 2a str. 2457T
aucaagcugugccu

SEQ ID NO: 3869203 - RNA, 14 nt, Shigella flexneri 2a str. 2457T
aucaagucagaugc

SEQ ID NO: 3869204 - RNA, 14 nt, Shigella flexneri 2a str. 2457T
aucaaguugauuuu

SEQ ID NO: 3869205 - RNA, 14 nt, Shigella flexneri 2a str. 2457T
aucaauaaaaauac

SEQ ID NO: 3869206 - RNA, 16 nt, Shigella flexneri 2a str. 2457T
aucaauaacagcgcaa

SEQ ID NO: 3869207 - RNA, 22 nt, Shigella flexneri 2a str. 2457T
aucaauaacagcgcaaucaccg

SEQ ID NO: 3869208 - RNA, 14 nt, Shigella flexneri 2a str. 2457T
aucaauaccagccc

SEQ ID NO: 3869209 - RNA, 16 nt, Shigella flexneri 2a str. 2457T
aucaauaccauuauca

SEQ ID NO: 3869210 - RNA, 22 nt, Shigella flexneri 2a str. 2457T
aucaauaccgcguaauacauca

SEQ ID NO: 3869211 - RNA, 20 nt, Shigella flexneri 2a str. 2457T
aucaauacuuuccagcauau

SEQ ID NO: 3869212 - RNA, 21 nt, Shigella flexneri 2a str. 2457T
aucaauacuuuccagcauaug

SEQ ID NO: 3869213 - RNA, 15 nt, Shigella flexneri 2a str. 2457T
aucagcaacuggcaa

SEQ ID NO: 3869214 - RNA, 16 nt, Shigella flexneri 2a str. 2457T
aucagcaauuuuuccu

SEQ ID NO: 3869215 - RNA, 21 nt, Shigella flexneri 2a str. 2457T
aucagcagaaucgcaaccagc

SEQ ID NO: 3869216 - RNA, 13 nt, Shigella flexneri 2a str. 2457T
aucagcaguucac

SEQ ID NO: 3869217 - RNA, 18 nt, Shigella flexneri 2a str. 2457T
aucagcaucccaccugaa

SEQ ID NO: 3869218 - RNA, 17 nt, Shigella flexneri 2a str. 2457T
aucagcaucucauccau

SEQ ID NO: 3869219 - RNA, 11 nt, Shigella flexneri 2a str. 2457T
aucagcaugac

SEQ ID NO: 3869220 - RNA, 19 nt, Shigella flexneri 2a str. 2457T
aucagcaugacaaaaaagc

SEQ ID NO: 3869221 - RNA, 22 nt, Shigella flexneri 2a str. 2457T
aucagcaugacaaaaaagccaa

SEQ ID NO: 3869222 - RNA, 12 nt, Shigella flexneri 2a str. 2457T
aucagcauucuc

SEQ ID NO: 3869223 - RNA, 19 nt, Shigella flexneri 2a str. 2457T
aucagcauucucaucacca

SEQ ID NO: 3869224 - RNA, 19 nt, Shigella flexneri 2a str. 2457T
aucagccacuuccugcucg

SEQ ID NO: 3869225 - RNA, 13 nt, Shigella flexneri 2a str. 2457T
aucagcccagccc

SEQ ID NO: 3869226 - RNA, 16 nt, Shigella flexneri 2a str. 2457T
aucagcccagcccuga

SEQ ID NO: 3869227 - RNA, 15 nt, Shigella flexneri 2a str. 2457T
aucagcgcagcaccc

SEQ ID NO: 3869228 - RNA, 19 nt, Shigella flexneri 2a str. 2457T
aucagcgcagcacccagaa

SEQ ID NO: 3869229 - RNA, 15 nt, Shigella flexneri 2a str. 2457T
aucagcgccaccaca

SEQ ID NO: 3869230 - RNA, 15 nt, Shigella flexneri 2a str. 2457T
aucagcgccaccagc

SEQ ID NO: 3869231 - RNA, 14 nt, Shigella flexneri 2a str. 2457T
aucagcgccagcgc

SEQ ID NO: 3869232 - RNA, 15 nt, Shigella flexneri 2a str. 2457T
aucagcgccagcgcg

SEQ ID NO: 3869233 - RNA, 14 nt, Shigella flexneri 2a str. 2457T
aucagcggacugca

SEQ ID NO: 3869234 - RNA, 16 nt, Shigella flexneri 2a str. 2457T
aucagcguaacggguc

SEQ ID NO: 3869235 - RNA, 23 nt, Shigella flexneri 2a str. 2457T
aucagcgucgccugguguugccc

SEQ ID NO: 3869236 - RNA, 22 nt, Shigella flexneri 2a str. 2457T
aucagcuaauggcugcgggcga

SEQ ID NO: 3869237 - RNA, 16 nt, Shigella flexneri 2a str. 2457T
aucagcuauucuuaua

SEQ ID NO: 3869238 - RNA, 14 nt, Shigella flexneri 2a str. 2457T
aucagcuccggcag

SEQ ID NO: 3869239 - RNA, 19 nt, Shigella flexneri 2a str. 2457T
aucagcucugggcuaacac

SEQ ID NO: 3869240 - RNA, 14 nt, Shigella flexneri 2a str. 2457T
aucagcuuauccau

SEQ ID NO: 3869241 - RNA, 12 nt, Shigella flexneri 2a str. 2457T
aucagcuucacc

SEQ ID NO: 3869242 - RNA, 19 nt, Shigella flexneri 2a str. 2457T
aucagcuuuggugaaaaaa

SEQ ID NO: 3869243 - RNA, 15 nt, Shigella flexneri 2a str. 2457T
aucaggcaauuuuac

SEQ ID NO: 3869244 - RNA, 18 nt, Shigella flexneri 2a str. 2457T
aucaggcaggucuuucac

SEQ ID NO: 3869245 - RNA, 17 nt, Shigella flexneri 2a str. 2457T
aucaggcaucugagcau

SEQ ID NO: 3869246 - RNA, 18 nt, Shigella flexneri 2a str. 2457T
aucaggccaaacagacca

SEQ ID NO: 3869247 - RNA, 19 nt, Shigella flexneri 2a str. 2457T
aucaggccuacauuuucuc

SEQ ID NO: 3869248 - RNA, 14 nt, Shigella flexneri 2a str. 2457T
aucaggcuaucuuc

SEQ ID NO: 3869249 - RNA, 17 nt, Shigella flexneri 2a str. 2457T
aucaggcuuauuuggca

SEQ ID NO: 3869250 - RNA, 18 nt, Shigella flexneri 2a str. 2457T
aucaggcuucuguaccug

SEQ ID NO: 3869251 - RNA, 21 nt, Shigella flexneri 2a str. 2457T
aucaggcuuuuuuauugccau

SEQ ID NO: 3869252 - RNA, 16 nt, Shigella flexneri 2a str. 2457T
aucaggggcagcacca

SEQ ID NO: 3869253 - RNA, 14 nt, Shigella flexneri 2a str. 2457T
aucaggguaaauuu

SEQ ID NO: 3869254 - RNA, 14 nt, Shigella flexneri 2a str. 2457T
aucagguaagcaaa

SEQ ID NO: 3869255 - RNA, 22 nt, Shigella flexneri 2a str. 2457T
aucagucuagcccgauggcauc

SEQ ID NO: 3869256 - RNA, 17 nt, Shigella flexneri 2a str. 2457T
aucagugguguagggca

SEQ ID NO: 3869257 - RNA, 23 nt, Shigella flexneri 2a str. 2457T
aucaguguacuuaucuuuuacaa

SEQ ID NO: 3869258 - RNA, 16 nt, Shigella flexneri 2a str. 2457T
aucaguuccaguucau

SEQ ID NO: 3869259 - RNA, 22 nt, Shigella flexneri 2a str. 2457T
aucaguugauuaugaucgccac

SEQ ID NO: 3869260 - RNA, 17 nt, Shigella flexneri 2a str. 2457T
aucaguuggggaaaagu

SEQ ID NO: 3869261 - RNA, 23 nt, Shigella flexneri 2a str. 2457T
aucaguuucagccuuaaagauaa

SEQ ID NO: 3869262 - RNA, 22 nt, Shigella flexneri 2a str. 2457T
aucaguuuuuucauugaaugcg

SEQ ID NO: 3869263 - RNA, 15 nt, Shigella flexneri 2a str. 2457T
aucauacugaacuua

SEQ ID NO: 3869264 - RNA, 12 nt, Shigella flexneri 2a str. 2457T
aucauacugauu

SEQ ID NO: 3869265 - RNA, 16 nt, Shigella flexneri 2a str. 2457T
aucauagacuucccuc

SEQ ID NO: 3869266 - RNA, 21 nt, Shigella flexneri 2a str. 2457T
aucauagcgaauaaucccggc

SEQ ID NO: 3869267 - RNA, 13 nt, Shigella flexneri 2a str. 2457T
aucauauuaaauu

SEQ ID NO: 3869268 - RNA, 22 nt, Shigella flexneri 2a str. 2457T
aucauauuaaauuuuuucacug

SEQ ID NO: 3869269 - RNA, 14 nt, Shigella flexneri 2a str. 2457T
aucauauuguuccc

SEQ ID NO: 3869270 - RNA, 13 nt, Shigella flexneri 2a str. 2457T
aucauauuuucca

SEQ ID NO: 3869271 - RNA, 17 nt, Shigella flexneri 2a str. 2457T
aucaucaauaccagccc

SEQ ID NO: 3869272 - RNA, 18 nt, Shigella flexneri 2a str. 2457T
aucaucaauaccagcccg

SEQ ID NO: 3869273 - RNA, 13 nt, Shigella flexneri 2a str. 2457T
aucaucaccagaa

SEQ ID NO: 3869274 - RNA, 15 nt, Shigella flexneri 2a str. 2457T
aucaucacgcaucac

SEQ ID NO: 3869275 - RNA, 13 nt, Shigella flexneri 2a str. 2457T
aucaucagaaaug

SEQ ID NO: 3869276 - RNA, 12 nt, Shigella flexneri 2a str. 2457T
aucaucagcaug

SEQ ID NO: 3869277 - RNA, 15 nt, Shigella flexneri 2a str. 2457T
aucaucaggggcagc

SEQ ID NO: 3869278 - RNA, 18 nt, Shigella flexneri 2a str. 2457T
aucaucaucgccaggcuu

SEQ ID NO: 3869279 - RNA, 12 nt, Shigella flexneri 2a str. 2457T
aucaucaucgcg

SEQ ID NO: 3869280 - RNA, 13 nt, Shigella flexneri 2a str. 2457T
aucaucauuugca

SEQ ID NO: 3869281 - RNA, 18 nt, Shigella flexneri 2a str. 2457T
aucauccagaccgcucag

SEQ ID NO: 3869282 - RNA, 13 nt, Shigella flexneri 2a str. 2457T
aucauccagcacg

SEQ ID NO: 3869283 - RNA, 17 nt, Shigella flexneri 2a str. 2457T
aucauccagcacgguga

SEQ ID NO: 3869284 - RNA, 16 nt, Shigella flexneri 2a str. 2457T
aucaucccccugcgau

SEQ ID NO: 3869285 - RNA, 23 nt, Shigella flexneri 2a str. 2457T
aucaucccccugcgauugugaca

SEQ ID NO: 3869286 - RNA, 17 nt, Shigella flexneri 2a str. 2457T
aucauccccguaucuuc

SEQ ID NO: 3869287 - RNA, 19 nt, Shigella flexneri 2a str. 2457T
aucauccccguaucuucau

SEQ ID NO: 3869288 - RNA, 18 nt, Shigella flexneri 2a str. 2457T
aucauccgcacaaucccu

SEQ ID NO: 3869289 - RNA, 19 nt, Shigella flexneri 2a str. 2457T
aucauccugcugcacgccc

SEQ ID NO: 3869290 - RNA, 14 nt, Shigella flexneri 2a str. 2457T
aucaucgaccccag

SEQ ID NO: 3869291 - RNA, 17 nt, Shigella flexneri 2a str. 2457T
aucaucgcauccagugc

SEQ ID NO: 3869292 - RNA, 15 nt, Shigella flexneri 2a str. 2457T
aucaucgcggucaac

SEQ ID NO: 3869293 - RNA, 19 nt, Shigella flexneri 2a str. 2457T
aucaucgcguacucaccgc

SEQ ID NO: 3869294 - RNA, 20 nt, Shigella flexneri 2a str. 2457T
aucaucgcguacucaccgcu

SEQ ID NO: 3869295 - RNA, 15 nt, Shigella flexneri 2a str. 2457T
aucaucggcaaacau

SEQ ID NO: 3869296 - RNA, 21 nt, Shigella flexneri 2a str. 2457T
aucaucggcaaacaucgacuc

SEQ ID NO: 3869297 - RNA, 22 nt, Shigella flexneri 2a str. 2457T
aucaucgggcugagauuuauga

SEQ ID NO: 3869298 - RNA, 17 nt, Shigella flexneri 2a str. 2457T
aucaucgguaccgccag

SEQ ID NO: 3869299 - RNA, 21 nt, Shigella flexneri 2a str. 2457T
aucaucgguaccgccagcagg

SEQ ID NO: 3869300 - RNA, 19 nt, Shigella flexneri 2a str. 2457T
aucaucguucauauauucc

SEQ ID NO: 3869301 - RNA, 22 nt, Shigella flexneri 2a str. 2457T
aucaucuggcugugauccauuc

SEQ ID NO: 3869302 - RNA, 14 nt, Shigella flexneri 2a str. 2457T
aucaucuuccggua

SEQ ID NO: 3869303 - RNA, 13 nt, Shigella flexneri 2a str. 2457T
aucaugaccccag

SEQ ID NO: 3869304 - RNA, 16 nt, Shigella flexneri 2a str. 2457T
aucaugcaauaaauau

SEQ ID NO: 3869305 - RNA, 17 nt, Shigella flexneri 2a str. 2457T
aucaugcaguaccagau

SEQ ID NO: 3869306 - RNA, 18 nt, Shigella flexneri 2a str. 2457T
aucaugcaguaccagaua

SEQ ID NO: 3869307 - RNA, 18 nt, Shigella flexneri 2a str. 2457T
aucaugccggccagcgcc

SEQ ID NO: 3869308 - RNA, 19 nt, Shigella flexneri 2a str. 2457T
aucaugccuacaaccguug

SEQ ID NO: 3869309 - RNA, 21 nt, Shigella flexneri 2a str. 2457T
aucaugcucagaugccugaug

SEQ ID NO: 3869310 - RNA, 22 nt, Shigella flexneri 2a str. 2457T
aucaugcucagaugccugaugc

SEQ ID NO: 3869311 - RNA, 15 nt, Shigella flexneri 2a str. 2457T
aucccgccaacagga

SEQ ID NO: 3869312 - RNA, 15 nt, Shigella flexneri 2a str. 2457T
aucccgcgauaugcc

SEQ ID NO: 3869313 - RNA, 21 nt, Shigella flexneri 2a str. 2457T
aucccgcgauaugccggcauc

SEQ ID NO: 3869314 - RNA, 18 nt, Shigella flexneri 2a str. 2457T
aucccgcgcguuuuucuu

SEQ ID NO: 3869315 - RNA, 21 nt, Shigella flexneri 2a str. 2457T
aucccgcuaaguugaaucggc

SEQ ID NO: 3869316 - RNA, 20 nt, Shigella flexneri 2a str. 2457T
aucccgcucuguaagacauu

SEQ ID NO: 3869317 - RNA, 14 nt, Shigella flexneri 2a str. 2457T
aucccggaagccac

SEQ ID NO: 3869318 - RNA, 20 nt, Shigella flexneri 2a str. 2457T
aucccggcuccaaugacuau

SEQ ID NO: 3869319 - RNA, 19 nt, Shigella flexneri 2a str. 2457T
aucccgguuauuaaaacga

SEQ ID NO: 3869320 - RNA, 19 nt, Shigella flexneri 2a str. 2457T
aucccguaguauuuucuuu

SEQ ID NO: 3869321 - RNA, 13 nt, Shigella flexneri 2a str. 2457T
aucccucauauuu

SEQ ID NO: 3869322 - RNA, 14 nt, Shigella flexneri 2a str. 2457T
aucccucauauuua

SEQ ID NO: 3869323 - RNA, 22 nt, Shigella flexneri 2a str. 2457T
aucccuccacgacguguuccug

SEQ ID NO: 3869324 - RNA, 24 nt, Shigella flexneri 2a str. 2457T
aucccugaugcgacgcucacgcgu

SEQ ID NO: 3869325 - RNA, 17 nt, Shigella flexneri 2a str. 2457T
aucccuuccucccuuuc

SEQ ID NO: 3869326 - RNA, 13 nt, Shigella flexneri 2a str. 2457T
aucccuucuccac

SEQ ID NO: 3869327 - RNA, 19 nt, Shigella flexneri 2a str. 2457T
aucccuuucgcuucaagua

SEQ ID NO: 3869328 - RNA, 13 nt, Shigella flexneri 2a str. 2457T
auccgaagaacca

SEQ ID NO: 3869329 - RNA, 12 nt, Shigella flexneri 2a str. 2457T
auccgacaaaug

SEQ ID NO: 3869330 - RNA, 14 nt, Shigella flexneri 2a str. 2457T
auccgacacuggca

SEQ ID NO: 3869331 - RNA, 12 nt, Shigella flexneri 2a str. 2457T
auccgagaaucg

SEQ ID NO: 3869332 - RNA, 13 nt, Shigella flexneri 2a str. 2457T
auccgcaaugugu

SEQ ID NO: 3869333 - RNA, 19 nt, Shigella flexneri 2a str. 2457T
auccgcaauuucuggccau

SEQ ID NO: 3869334 - RNA, 14 nt, Shigella flexneri 2a str. 2457T
auccgccauuucuc

SEQ ID NO: 3869335 - RNA, 16 nt, Shigella flexneri 2a str. 2457T
auccgccauuucuccu

SEQ ID NO: 3869336 - RNA, 20 nt, Shigella flexneri 2a str. 2457T
auccgccgcgcggugggcua

SEQ ID NO: 3869337 - RNA, 15 nt, Shigella flexneri 2a str. 2457T
auccgcgacuggcau

SEQ ID NO: 3869338 - RNA, 13 nt, Shigella flexneri 2a str. 2457T
auccgcgcugaug

SEQ ID NO: 3869339 - RNA, 20 nt, Shigella flexneri 2a str. 2457T
auccgcgcuuucuggcgcag

SEQ ID NO: 3869340 - RNA, 22 nt, Shigella flexneri 2a str. 2457T
auccgcucccuggcccaucgcc

SEQ ID NO: 3869341 - RNA, 16 nt, Shigella flexneri 2a str. 2457T
auccgcuggcccauca

SEQ ID NO: 3869342 - RNA, 20 nt, Shigella flexneri 2a str. 2457T
auccgcuggcccaucagaau

SEQ ID NO: 3869343 - RNA, 23 nt, Shigella flexneri 2a str. 2457T
auccgcuucaggaauaagacaau

SEQ ID NO: 3869344 - RNA, 18 nt, Shigella flexneri 2a str. 2457T
auccgcuuucgguuuuuc

SEQ ID NO: 3869345 - RNA, 22 nt, Shigella flexneri 2a str. 2457T
auccggcaacaaaauauccugu

SEQ ID NO: 3869346 - RNA, 16 nt, Shigella flexneri 2a str. 2457T
auccggcaagaucacc

SEQ ID NO: 3869347 - RNA, 16 nt, Shigella flexneri 2a str. 2457T
auccggcaaguuguau

SEQ ID NO: 3869348 - RNA, 18 nt, Shigella flexneri 2a str. 2457T
auccggcaauaagcaacg

SEQ ID NO: 3869349 - RNA, 12 nt, Shigella flexneri 2a str. 2457T
auccggcaccaa

SEQ ID NO: 3869350 - RNA, 13 nt, Shigella flexneri 2a str. 2457T
auccggcaccaau

SEQ ID NO: 3869351 - RNA, 20 nt, Shigella flexneri 2a str. 2457T
auccggcauaaacaaagcgc

SEQ ID NO: 3869352 - RNA, 22 nt, Shigella flexneri 2a str. 2457T
auccggcauaaacaaagugcac

SEQ ID NO: 3869353 - RNA, 22 nt, Shigella flexneri 2a str. 2457T
auccggcaucaacaaagugcac

SEQ ID NO: 3869354 - RNA, 21 nt, Shigella flexneri 2a str. 2457T
auccggcauucagugcaaaug

SEQ ID NO: 3869355 - RNA, 20 nt, Shigella flexneri 2a str. 2457T
auccggcauuugagcaggau

SEQ ID NO: 3869356 - RNA, 23 nt, Shigella flexneri 2a str. 2457T
auccggccuacaaauucaauaaa

SEQ ID NO: 3869357 - RNA, 19 nt, Shigella flexneri 2a str. 2457T
auccggcuauauugcagga

SEQ ID NO: 3869358 - RNA, 22 nt, Shigella flexneri 2a str. 2457T
auccggucuaccgauccggcac

SEQ ID NO: 3869359 - RNA, 23 nt, Shigella flexneri 2a str. 2457T
auccggugccaaagucaucaauc

SEQ ID NO: 3869360 - RNA, 18 nt, Shigella flexneri 2a str. 2457T
auccgguuuacccgcuug

SEQ ID NO: 3869361 - RNA, 21 nt, Shigella flexneri 2a str. 2457T
auccgucagcgaguugaucac

SEQ ID NO: 3869362 - RNA, 15 nt, Shigella flexneri 2a str. 2457T
auccgucauccauac

SEQ ID NO: 3869363 - RNA, 20 nt, Shigella flexneri 2a str. 2457T
auccguccuacgaaucccgc

SEQ ID NO: 3869364 - RNA, 22 nt, Shigella flexneri 2a str. 2457T
auccgugguggcagccagccau

SEQ ID NO: 3869365 - RNA, 20 nt, Shigella flexneri 2a str. 2457T
auccguugcagcauuuauga

SEQ ID NO: 3869366 - RNA, 23 nt, Shigella flexneri 2a str. 2457T
auccguuuuacugggaagaaugg

SEQ ID NO: 3869367 - RNA, 18 nt, Shigella flexneri 2a str. 2457T
auccuaaacgcuggcagg

SEQ ID NO: 3869368 - RNA, 14 nt, Shigella flexneri 2a str. 2457T
auccuaccaaagaa

SEQ ID NO: 3869369 - RNA, 16 nt, Shigella flexneri 2a str. 2457T
auccucaacgccgcau

SEQ ID NO: 3869370 - RNA, 15 nt, Shigella flexneri 2a str. 2457T
auccucaagaauaug

SEQ ID NO: 3869371 - RNA, 20 nt, Shigella flexneri 2a str. 2457T
auccucuaucuguuugccag

SEQ ID NO: 3869372 - RNA, 23 nt, Shigella flexneri 2a str. 2457T
auccucucuuuccuuaauaaaaa

SEQ ID NO: 3869373 - RNA, 20 nt, Shigella flexneri 2a str. 2457T
auccucuucaagaauacugu

SEQ ID NO: 3869374 - RNA, 12 nt, Shigella flexneri 2a str. 2457T
auccucuucagc

SEQ ID NO: 3869375 - RNA, 20 nt, Shigella flexneri 2a str. 2457T
auccucuuuacgcaaaauca

SEQ ID NO: 3869376 - RNA, 23 nt, Shigella flexneri 2a str. 2457T
auccugaauaacuggcgcgacaa

SEQ ID NO: 3869377 - RNA, 23 nt, Shigella flexneri 2a str. 2457T
auccugauagcacgucacggacu

SEQ ID NO: 3869378 - RNA, 14 nt, Shigella flexneri 2a str. 2457T
auccugaucaagca

SEQ ID NO: 3869379 - RNA, 18 nt, Shigella flexneri 2a str. 2457T
auccugaucaagcacaug

SEQ ID NO: 3869380 - RNA, 19 nt, Shigella flexneri 2a str. 2457T
auccugauccugcaacagc

SEQ ID NO: 3869381 - RNA, 14 nt, Shigella flexneri 2a str. 2457T
auccugcaaauuca

SEQ ID NO: 3869382 - RNA, 21 nt, Shigella flexneri 2a str. 2457T
auccugcaccacgacaccuuu

SEQ ID NO: 3869383 - RNA, 13 nt, Shigella flexneri 2a str. 2457T
auccugcacuuuc

SEQ ID NO: 3869384 - RNA, 13 nt, Shigella flexneri 2a str. 2457T
auccugcagugcg

SEQ ID NO: 3869385 - RNA, 13 nt, Shigella flexneri 2a str. 2457T
auccugccgcagu

SEQ ID NO: 3869386 - RNA, 17 nt, Shigella flexneri 2a str. 2457T
auccugcggcagcucca

SEQ ID NO: 3869387 - RNA, 20 nt, Shigella flexneri 2a str. 2457T
auccugcguuaaucgccgua

SEQ ID NO: 3869388 - RNA, 20 nt, Shigella flexneri 2a str. 2457T
auccugcugcacgcccugau

SEQ ID NO: 3869389 - RNA, 15 nt, Shigella flexneri 2a str. 2457T
auccuggaacagacc

SEQ ID NO: 3869390 - RNA, 15 nt, Shigella flexneri 2a str. 2457T
auccuggauuuccuc

SEQ ID NO: 3869391 - RNA, 21 nt, Shigella flexneri 2a str. 2457T
auccuggggguucaucaccac

SEQ ID NO: 3869392 - RNA, 18 nt, Shigella flexneri 2a str. 2457T
auccuggugguacgcgua

SEQ ID NO: 3869393 - RNA, 17 nt, Shigella flexneri 2a str. 2457T
auccugguuauuucacu

SEQ ID NO: 3869394 - RNA, 24 nt, Shigella flexneri 2a str. 2457T
auccuguacgacaaaagaauggcu

SEQ ID NO: 3869395 - RNA, 21 nt, Shigella flexneri 2a str. 2457T
auccugugccggcaacaauau

SEQ ID NO: 3869396 - RNA, 18 nt, Shigella flexneri 2a str. 2457T
auccuguucauccucuuc

SEQ ID NO: 3869397 - RNA, 17 nt, Shigella flexneri 2a str. 2457T
auccuucacuuuugcca

SEQ ID NO: 3869398 - RNA, 18 nt, Shigella flexneri 2a str. 2457T
auccuucacuuuugccag

SEQ ID NO: 3869399 - RNA, 13 nt, Shigella flexneri 2a str. 2457T
auccuuccagcuc

SEQ ID NO: 3869400 - RNA, 14 nt, Shigella flexneri 2a str. 2457T
auccuuccagcucc

SEQ ID NO: 3869401 - RNA, 18 nt, Shigella flexneri 2a str. 2457T
auccuuccagcuccagcc

SEQ ID NO: 3869402 - RNA, 13 nt, Shigella flexneri 2a str. 2457T
auccuucccccac

SEQ ID NO: 3869403 - RNA, 20 nt, Shigella flexneri 2a str. 2457T
auccuuuccuuaagccagcg

SEQ ID NO: 3869404 - RNA, 23 nt, Shigella flexneri 2a str. 2457T
aucgaacaugcgggucuuacugg

SEQ ID NO: 3869405 - RNA, 13 nt, Shigella flexneri 2a str. 2457T
aucgaacuccgcc

SEQ ID NO: 3869406 - RNA, 19 nt, Shigella flexneri 2a str. 2457T
aucgaacuucccgccgugg

SEQ ID NO: 3869407 - RNA, 18 nt, Shigella flexneri 2a str. 2457T
aucgaagaacugcuggaa

SEQ ID NO: 3869408 - RNA, 13 nt, Shigella flexneri 2a str. 2457T
aucgcugauauac

SEQ ID NO: 3869409 - RNA, 20 nt, Shigella flexneri 2a str. 2457T
aucgcugcgcucuaaaauca

SEQ ID NO: 3869410 - RNA, 21 nt, Shigella flexneri 2a str. 2457T
aucgcugcuuauggagucugc

SEQ ID NO: 3869411 - RNA, 17 nt, Shigella flexneri 2a str. 2457T
aucgcuggccuccagua

SEQ ID NO: 3869412 - RNA, 20 nt, Shigella flexneri 2a str. 2457T
aucgcuguccgcuucaccac

SEQ ID NO: 3869413 - RNA, 14 nt, Shigella flexneri 2a str. 2457T
aucgcugugcugcu

SEQ ID NO: 3869414 - RNA, 14 nt, Shigella flexneri 2a str. 2457T
aucgcuuucagugu

SEQ ID NO: 3869415 - RNA, 18 nt, Shigella flexneri 2a str. 2457T
aucggaaacaaauacaug

SEQ ID NO: 3869416 - RNA, 19 nt, Shigella flexneri 2a str. 2457T
aucggaaacagcgguacaa

SEQ ID NO: 3869417 - RNA, 23 nt, Shigella flexneri 2a str. 2457T
aucggaugacgccacagcauucu

SEQ ID NO: 3869418 - RNA, 13 nt, Shigella flexneri 2a str. 2457T
aucggcaaaucgc

SEQ ID NO: 3869419 - RNA, 14 nt, Shigella flexneri 2a str. 2457T
aucggcaaucacau

SEQ ID NO: 3869420 - RNA, 18 nt, Shigella flexneri 2a str. 2457T
aucggcaauuucgcugcc

SEQ ID NO: 3869421 - RNA, 12 nt, Shigella flexneri 2a str. 2457T
aucggcaggcag

SEQ ID NO: 3869422 - RNA, 15 nt, Shigella flexneri 2a str. 2457T
aucggcaucgcucca

SEQ ID NO: 3869423 - RNA, 18 nt, Shigella flexneri 2a str. 2457T
aucggcauugcucccugc

SEQ ID NO: 3869424 - RNA, 19 nt, Shigella flexneri 2a str. 2457T
aucggcgaagagagcgcca

SEQ ID NO: 3869425 - RNA, 22 nt, Shigella flexneri 2a str. 2457T
aucggcgcuacggcguuucacu

SEQ ID NO: 3869426 - RNA, 20 nt, Shigella flexneri 2a str. 2457T
aucggcggcgauguccagac

SEQ ID NO: 3869427 - RNA, 19 nt, Shigella flexneri 2a str. 2457T
aucggcggugaccagcagc

SEQ ID NO: 3869428 - RNA, 21 nt, Shigella flexneri 2a str. 2457T
aucggcggugaccagcagcau

SEQ ID NO: 3869429 - RNA, 21 nt, Shigella flexneri 2a str. 2457T
aucggcgucauuuuuucgaca

SEQ ID NO: 3869430 - RNA, 17 nt, Shigella flexneri 2a str. 2457T
aucggcguuuucugacc

SEQ ID NO: 3869431 - RNA, 18 nt, Shigella flexneri 2a str. 2457T
aucggcuaguaauugcgc

SEQ ID NO: 3869432 - RNA, 17 nt, Shigella flexneri 2a str. 2457T
aucggcuaucgaaggau

SEQ ID NO: 3869433 - RNA, 15 nt, Shigella flexneri 2a str. 2457T
aucgggaaauaacau

SEQ ID NO: 3869434 - RNA, 22 nt, Shigella flexneri 2a str. 2457T
aucgggacuucgcaauacaggu

SEQ ID NO: 3869435 - RNA, 17 nt, Shigella flexneri 2a str. 2457T
aucgggagagauaagau

SEQ ID NO: 3869436 - RNA, 19 nt, Shigella flexneri 2a str. 2457T
aucgggaugccauuugcca

SEQ ID NO: 3869437 - RNA, 22 nt, Shigella flexneri 2a str. 2457T
aucgggcagcaucgccaggaug

SEQ ID NO: 3869438 - RNA, 14 nt, Shigella flexneri 2a str. 2457T
aucgggcaguuuac

SEQ ID NO: 3869439 - RNA, 20 nt, Shigella flexneri 2a str. 2457T
aucgggggaagcugaaaguu

SEQ ID NO: 3869440 - RNA, 15 nt, Shigella flexneri 2a str. 2457T
aucgggucaccugcc

SEQ ID NO: 3869441 - RNA, 18 nt, Shigella flexneri 2a str. 2457T
aucgguaccgccagcagg

SEQ ID NO: 3869442 - RNA, 22 nt, Shigella flexneri 2a str. 2457T
aucgguaccgccagcaggaacg

SEQ ID NO: 3869443 - RNA, 15 nt, Shigella flexneri 2a str. 2457T
aucgguauuuccauu

SEQ ID NO: 3869444 - RNA, 20 nt, Shigella flexneri 2a str. 2457T
aucggugaaaguaacaaagc

SEQ ID NO: 3869445 - RNA, 15 nt, Shigella flexneri 2a str. 2457T
aucggugcaaaugcc

SEQ ID NO: 3869446 - RNA, 18 nt, Shigella flexneri 2a str. 2457T
aucggugcacuccgccac

SEQ ID NO: 3869447 - RNA, 17 nt, Shigella flexneri 2a str. 2457T
aucggugcggcaaugcc

SEQ ID NO: 3869448 - RNA, 21 nt, Shigella flexneri 2a str. 2457T
aucggugcuggccuauuauga

SEQ ID NO: 3869449 - RNA, 14 nt, Shigella flexneri 2a str. 2457T
aucguaauacccuu

SEQ ID NO: 3869450 - RNA, 20 nt, Shigella flexneri 2a str. 2457T
aucguacaggcacaugucca

SEQ ID NO: 3869451 - RNA, 14 nt, Shigella flexneri 2a str. 2457T
aucguauccggcau

SEQ ID NO: 3869452 - RNA, 15 nt, Shigella flexneri 2a str. 2457T
aucguauccggcauu

SEQ ID NO: 3869453 - RNA, 19 nt, Shigella flexneri 2a str. 2457T
aucguauccggcauuauca

SEQ ID NO: 3869454 - RNA, 21 nt, Shigella flexneri 2a str. 2457T
aucguauugguacauaacaca

SEQ ID NO: 3869455 - RNA, 15 nt, Shigella flexneri 2a str. 2457T
aucgucaaaauuaga

SEQ ID NO: 3869456 - RNA, 19 nt, Shigella flexneri 2a str. 2457T
aucgucagcucgcugccau

SEQ ID NO: 3869457 - RNA, 22 nt, Shigella flexneri 2a str. 2457T
aucgucaguagcgcaaucacca

SEQ ID NO: 3869458 - RNA, 13 nt, Shigella flexneri 2a str. 2457T
aucgucaguucac

SEQ ID NO: 3869459 - RNA, 21 nt, Shigella flexneri 2a str. 2457T
aucgucauggcuguccuuuac

SEQ ID NO: 3869460 - RNA, 17 nt, Shigella flexneri 2a str. 2457T
aucguccacgucaucaa

SEQ ID NO: 3869461 - RNA, 18 nt, Shigella flexneri 2a str. 2457T
aucguccacgucaucaaa

SEQ ID NO: 3869462 - RNA, 16 nt, Shigella flexneri 2a str. 2457T
aucguccacuugaaaa

SEQ ID NO: 3869463 - RNA, 17 nt, Shigella flexneri 2a str. 2457T
aucguccacuugaaaau

SEQ ID NO: 3869464 - RNA, 19 nt, Shigella flexneri 2a str. 2457T
aucguccacuugaaaauua

SEQ ID NO: 3869465 - RNA, 16 nt, Shigella flexneri 2a str. 2457T
aucguccagcagcaau

SEQ ID NO: 3869466 - RNA, 13 nt, Shigella flexneri 2a str. 2457T
aucguccauuucu

SEQ ID NO: 3869467 - RNA, 21 nt, Shigella flexneri 2a str. 2457T
aucguccgauuaaaaacccug

SEQ ID NO: 3869468 - RNA, 15 nt, Shigella flexneri 2a str. 2457T
aucgucgccagacca

SEQ ID NO: 3869469 - RNA, 16 nt, Shigella flexneri 2a str. 2457T
aucgucgccagaccaa

SEQ ID NO: 3869470 - RNA, 22 nt, Shigella flexneri 2a str. 2457T
aucgucgcccgaugcauaaucc

SEQ ID NO: 3869471 - RNA, 17 nt, Shigella flexneri 2a str. 2457T
aucgucggaauggcauc

SEQ ID NO: 3869472 - RNA, 18 nt, Shigella flexneri 2a str. 2457T
aucgucugcgccaccaca

SEQ ID NO: 3869473 - RNA, 20 nt, Shigella flexneri 2a str. 2457T
aucgucuucaaccgcaguga

SEQ ID NO: 3869474 - RNA, 14 nt, Shigella flexneri 2a str. 2457T
aucgugaaaaauca

SEQ ID NO: 3869475 - RNA, 23 nt, Shigella flexneri 2a str. 2457T
aucgugacaauaauacccagcac

SEQ ID NO: 3869476 - RNA, 14 nt, Shigella flexneri 2a str. 2457T
aucgugauuucaac

SEQ ID NO: 3869477 - RNA, 17 nt, Shigella flexneri 2a str. 2457T
aucgugauuucaacgau

SEQ ID NO: 3869478 - RNA, 18 nt, Shigella flexneri 2a str. 2457T
aucgugcaaauucaauau

SEQ ID NO: 3869479 - RNA, 20 nt, Shigella flexneri 2a str. 2457T
aucgugccaggaccauucac

SEQ ID NO: 3869480 - RNA, 19 nt, Shigella flexneri 2a str. 2457T
aucguggccaugaccgccg

SEQ ID NO: 3869481 - RNA, 17 nt, Shigella flexneri 2a str. 2457T
aucguuacucuuaucaa

SEQ ID NO: 3869482 - RNA, 23 nt, Shigella flexneri 2a str. 2457T
aucguuauauagaacaagugcca

SEQ ID NO: 3869483 - RNA, 14 nt, Shigella flexneri 2a str. 2457T
aucguuaucaccaa

SEQ ID NO: 3869484 - RNA, 22 nt, Shigella flexneri 2a str. 2457T
aucguucugugccgucugcccc

SEQ ID NO: 3869485 - RNA, 23 nt, Shigella flexneri 2a str. 2457T
aucguugcgaucgaccugcgccu

SEQ ID NO: 3869486 - RNA, 16 nt, Shigella flexneri 2a str. 2457T
aucuaaaugccacuga

SEQ ID NO: 3869487 - RNA, 19 nt, Shigella flexneri 2a str. 2457T
aucuaaccauuauuaaauu

SEQ ID NO: 3869488 - RNA, 21 nt, Shigella flexneri 2a str. 2457T
aucuaaccauuauuaaauuua

SEQ ID NO: 3869489 - RNA, 20 nt, Shigella flexneri 2a str. 2457T
aucuaaccuacuuuuuaauu

SEQ ID NO: 3869490 - RNA, 16 nt, Shigella flexneri 2a str. 2457T
aucuaagaucccugcc

SEQ ID NO: 3869491 - RNA, 20 nt, Shigella flexneri 2a str. 2457T
aucuaagaucccugccauuu

SEQ ID NO: 3869492 - RNA, 20 nt, Shigella flexneri 2a str. 2457T
aucuacaaaaccacacuucu

SEQ ID NO: 3869493 - RNA, 20 nt, Shigella flexneri 2a str. 2457T
aucuacacgcuaccaaaaaa

SEQ ID NO: 3869494 - RNA, 18 nt, Shigella flexneri 2a str. 2457T
aucuaccguuacggcugg

SEQ ID NO: 3869495 - RNA, 21 nt, Shigella flexneri 2a str. 2457T
aucuacgcucucuucaaacgc

SEQ ID NO: 3869496 - RNA, 20 nt, Shigella flexneri 2a str. 2457T
aucuacgguggaacauuuac

SEQ ID NO: 3869497 - RNA, 23 nt, Shigella flexneri 2a str. 2457T
aucuaucaggacgaaaaaucaca

SEQ ID NO: 3869498 - RNA, 16 nt, Shigella flexneri 2a str. 2457T
aucuauccggcauaca

SEQ ID NO: 3869499 - RNA, 14 nt, Shigella flexneri 2a str. 2457T
aucuaugguuuuuu

SEQ ID NO: 3869500 - RNA, 17 nt, Shigella flexneri 2a str. 2457T
aucuauuauuauuuuug

SEQ ID NO: 3869501 - RNA, 17 nt, Shigella flexneri 2a str. 2457T
aucuauucauuuauguu

SEQ ID NO: 3869502 - RNA, 17 nt, Shigella flexneri 2a str. 2457T
aucucaaacgguucuuu

SEQ ID NO: 3869503 - RNA, 14 nt, Shigella flexneri 2a str. 2457T
aucucaaccgcuuc

SEQ ID NO: 3869504 - RNA, 16 nt, Shigella flexneri 2a str. 2457T
aucucaagcgcgucga

SEQ ID NO: 3869505 - RNA, 19 nt, Shigella flexneri 2a str. 2457T
aucuucccagcccagcgcu

SEQ ID NO: 3869506 - RNA, 14 nt, Shigella flexneri 2a str. 2457T
aucuucccagcgca

SEQ ID NO: 3869507 - RNA, 15 nt, Shigella flexneri 2a str. 2457T
aucuuccgucacagg

SEQ ID NO: 3869508 - RNA, 20 nt, Shigella flexneri 2a str. 2457T
aucuuccgucacaggcacac

SEQ ID NO: 3869509 - RNA, 23 nt, Shigella flexneri 2a str. 2457T
aucuuccguggaacaaaaucuua

SEQ ID NO: 3869510 - RNA, 15 nt, Shigella flexneri 2a str. 2457T
aucuuccucacaccc

SEQ ID NO: 3869511 - RNA, 13 nt, Shigella flexneri 2a str. 2457T
aucuuccugauaa

SEQ ID NO: 3869512 - RNA, 23 nt, Shigella flexneri 2a str. 2457T
aucuucgugucuacgcccggcag

SEQ ID NO: 3869513 - RNA, 15 nt, Shigella flexneri 2a str. 2457T
aucuucguuauccca

SEQ ID NO: 3869514 - RNA, 20 nt, Shigella flexneri 2a str. 2457T
aucuucguuaucccaggcgu

SEQ ID NO: 3869515 - RNA, 14 nt, Shigella flexneri 2a str. 2457T
aucuucucuucccc

SEQ ID NO: 3869516 - RNA, 14 nt, Shigella flexneri 2a str. 2457T
aucuucuucuaugc

SEQ ID NO: 3869517 - RNA, 15 nt, Shigella flexneri 2a str. 2457T
aucuucuugcagcuu

SEQ ID NO: 3869518 - RNA, 20 nt, Shigella flexneri 2a str. 2457T
aucuucuugucauauuugag

SEQ ID NO: 3869519 - RNA, 21 nt, Shigella flexneri 2a str. 2457T
aucuugauaccaaaauggcgc

SEQ ID NO: 3869520 - RNA, 23 nt, Shigella flexneri 2a str. 2457T
aucuugauaccaaaauggcgcag

SEQ ID NO: 3869521 - RNA, 22 nt, Shigella flexneri 2a str. 2457T
aucuugcaaauucaauauauug

SEQ ID NO: 3869522 - RNA, 18 nt, Shigella flexneri 2a str. 2457T
aucuuuaaaaaaagcauu

SEQ ID NO: 3869523 - RNA, 17 nt, Shigella flexneri 2a str. 2457T
aucuuuaucaaucaccg

SEQ ID NO: 3869524 - RNA, 17 nt, Shigella flexneri 2a str. 2457T
aucuuucacaaagacgc

SEQ ID NO: 3869525 - RNA, 14 nt, Shigella flexneri 2a str. 2457T
aucuuucacgccca

SEQ ID NO: 3869526 - RNA, 13 nt, Shigella flexneri 2a str. 2457T
aucuuuccagccc

SEQ ID NO: 3869527 - RNA, 14 nt, Shigella flexneri 2a str. 2457T
aucuuuccucacuc

SEQ ID NO: 3869528 - RNA, 23 nt, Shigella flexneri 2a str. 2457T
aucuuugccagaucgccugccgc

SEQ ID NO: 3869529 - RNA, 16 nt, Shigella flexneri 2a str. 2457T
aucuuuuugccugaga

SEQ ID NO: 3869530 - RNA, 17 nt, Shigella flexneri 2a str. 2457T
augaaaaaaguuuuauu

SEQ ID NO: 3869531 - RNA, 14 nt, Shigella flexneri 2a str. 2457T
augaaaaaauagaa

SEQ ID NO: 3869532 - RNA, 13 nt, Shigella flexneri 2a str. 2457T
augaaaaaauccc

SEQ ID NO: 3869533 - RNA, 15 nt, Shigella flexneri 2a str. 2457T
augaaaaccguauuc

SEQ ID NO: 3869534 - RNA, 20 nt, Shigella flexneri 2a str. 2457T
augaaaauaaccauauauga

SEQ ID NO: 3869535 - RNA, 16 nt, Shigella flexneri 2a str. 2457T
augaaacgcaaauacu

SEQ ID NO: 3869536 - RNA, 15 nt, Shigella flexneri 2a str. 2457T
augaaacugccggaa

SEQ ID NO: 3869537 - RNA, 18 nt, Shigella flexneri 2a str. 2457T
augaaagcgaucuuucug

SEQ ID NO: 3869538 - RNA, 16 nt, Shigella flexneri 2a str. 2457T
augaacacgaucucac

SEQ ID NO: 3869539 - RNA, 13 nt, Shigella flexneri 2a str. 2457T
augaagaacugga

SEQ ID NO: 3869540 - RNA, 22 nt, Shigella flexneri 2a str. 2457T
augaagccuaccgggaugcuga

SEQ ID NO: 3869541 - RNA, 20 nt, Shigella flexneri 2a str. 2457T
augaaguacuuuggaaguau

SEQ ID NO: 3869542 - RNA, 13 nt, Shigella flexneri 2a str. 2457T
augaaguccacgc

SEQ ID NO: 3869543 - RNA, 14 nt, Shigella flexneri 2a str. 2457T
augaaguccacgcg

SEQ ID NO: 3869544 - RNA, 15 nt, Shigella flexneri 2a str. 2457T
augaagucugccguu

SEQ ID NO: 3869545 - RNA, 13 nt, Shigella flexneri 2a str. 2457T
augaauagcgcaa

SEQ ID NO: 3869546 - RNA, 17 nt, Shigella flexneri 2a str. 2457T
augaauagcgcaaaauu

SEQ ID NO: 3869547 - RNA, 22 nt, Shigella flexneri 2a str. 2457T
augaauagcggaaaucuccaga

SEQ ID NO: 3869548 - RNA, 19 nt, Shigella flexneri 2a str. 2457T
augaauauauaauuaaaaa

SEQ ID NO: 3869549 - RNA, 20 nt, Shigella flexneri 2a str. 2457T
augaauauauaauuaaaaau

SEQ ID NO: 3869550 - RNA, 14 nt, Shigella flexneri 2a str. 2457T
augaaucaccacag

SEQ ID NO: 3869551 - RNA, 16 nt, Shigella flexneri 2a str. 2457T
augaaucagcaaggaa

SEQ ID NO: 3869552 - RNA, 15 nt, Shigella flexneri 2a str. 2457T
augaauggaguuguc

SEQ ID NO: 3869553 - RNA, 16 nt, Shigella flexneri 2a str. 2457T
augaauguuuuccugc

SEQ ID NO: 3869554 - RNA, 21 nt, Shigella flexneri 2a str. 2457T
augaauuacacgaugcaagag

SEQ ID NO: 3869555 - RNA, 11 nt, Shigella flexneri 2a str. 2457T
augaauuacuu

SEQ ID NO: 3869556 - RNA, 20 nt, Shigella flexneri 2a str. 2457T
augaauuuaucuuuaagcac

SEQ ID NO: 3869557 - RNA, 14 nt, Shigella flexneri 2a str. 2457T
augaauuucucgcu

SEQ ID NO: 3869558 - RNA, 17 nt, Shigella flexneri 2a str. 2457T
augacaagguugauauu

SEQ ID NO: 3869559 - RNA, 14 nt, Shigella flexneri 2a str. 2457T
augacacaucaccu

SEQ ID NO: 3869560 - RNA, 21 nt, Shigella flexneri 2a str. 2457T
augacacguuuauuauagaca

SEQ ID NO: 3869561 - RNA, 23 nt, Shigella flexneri 2a str. 2457T
augacacguuuauuauagacauc

SEQ ID NO: 3869562 - RNA, 14 nt, Shigella flexneri 2a str. 2457T
augacaucuccagc

SEQ ID NO: 3869563 - RNA, 12 nt, Shigella flexneri 2a str. 2457T
augacauuaucu

SEQ ID NO: 3869564 - RNA, 22 nt, Shigella flexneri 2a str. 2457T
augacauucacgcugucggcac

SEQ ID NO: 3869565 - RNA, 20 nt, Shigella flexneri 2a str. 2457T
augaccagugaggaugcggg

SEQ ID NO: 3869566 - RNA, 16 nt, Shigella flexneri 2a str. 2457T
augaccauaaaaggca

SEQ ID NO: 3869567 - RNA, 21 nt, Shigella flexneri 2a str. 2457T
augaccauaaaaggcaccugg

SEQ ID NO: 3869568 - RNA, 14 nt, Shigella flexneri 2a str. 2457T
augacccgagccac

SEQ ID NO: 3869569 - RNA, 20 nt, Shigella flexneri 2a str. 2457T
augaccgcguugcagcauau

SEQ ID NO: 3869570 - RNA, 16 nt, Shigella flexneri 2a str. 2457T
augaccuuccagcgcc

SEQ ID NO: 3869571 - RNA, 19 nt, Shigella flexneri 2a str. 2457T
augaccuugucaugcagcu

SEQ ID NO: 3869572 - RNA, 21 nt, Shigella flexneri 2a str. 2457T
augaccuuucaguuugccgcu

SEQ ID NO: 3869573 - RNA, 15 nt, Shigella flexneri 2a str. 2457T
augaccuuucauucu

SEQ ID NO: 3869574 - RNA, 20 nt, Shigella flexneri 2a str. 2457T
augacgcccuacaaggaacg

SEQ ID NO: 3869575 - RNA, 13 nt, Shigella flexneri 2a str. 2457T
augacgcccugug

SEQ ID NO: 3869576 - RNA, 19 nt, Shigella flexneri 2a str. 2457T
augacguccuguacuguuu

SEQ ID NO: 3869577 - RNA, 17 nt, Shigella flexneri 2a str. 2457T
augacguuaauaaaauu

SEQ ID NO: 3869578 - RNA, 22 nt, Shigella flexneri 2a str. 2457T
augacuaccggggacaggcggc

SEQ ID NO: 3869579 - RNA, 18 nt, Shigella flexneri 2a str. 2457T
augacuccaacuuacuga

SEQ ID NO: 3869580 - RNA, 22 nt, Shigella flexneri 2a str. 2457T
augacuccaacuuacugauagu

SEQ ID NO: 3869581 - RNA, 18 nt, Shigella flexneri 2a str. 2457T
augacuuaauaaaauagc

SEQ ID NO: 3869582 - RNA, 20 nt, Shigella flexneri 2a str. 2457T
augacuugccuccagcgacg

SEQ ID NO: 3869583 - RNA, 20 nt, Shigella flexneri 2a str. 2457T
augacuuuguacuuggccgu

SEQ ID NO: 3869584 - RNA, 16 nt, Shigella flexneri 2a str. 2457T
augagacguuaucucg

SEQ ID NO: 3869585 - RNA, 15 nt, Shigella flexneri 2a str. 2457T
augagaugcuggaga

SEQ ID NO: 3869586 - RNA, 13 nt, Shigella flexneri 2a str. 2457T
augagcacagaaa

SEQ ID NO: 3869587 - RNA, 15 nt, Shigella flexneri 2a str. 2457T
augagcagaccaaua

SEQ ID NO: 3869588 - RNA, 21 nt, Shigella flexneri 2a str. 2457T
augagcgauuuuuuauaguac

SEQ ID NO: 3869589 - RNA, 19 nt, Shigella flexneri 2a str. 2457T
augaggcguuaacagcgca

SEQ ID NO: 3869590 - RNA, 20 nt, Shigella flexneri 2a str. 2457T
augaggcuuuaauaccugcc

SEQ ID NO: 3869591 - RNA, 15 nt, Shigella flexneri 2a str. 2457T
augagguuucccgcc

SEQ ID NO: 3869592 - RNA, 18 nt, Shigella flexneri 2a str. 2457T
augagucggaccaucauu

SEQ ID NO: 3869593 - RNA, 15 nt, Shigella flexneri 2a str. 2457T
augaguuaagaagau

SEQ ID NO: 3869594 - RNA, 19 nt, Shigella flexneri 2a str. 2457T
augaguuauacagaguguu

SEQ ID NO: 3869595 - RNA, 16 nt, Shigella flexneri 2a str. 2457T
augaguugaaaaccuc

SEQ ID NO: 3869596 - RNA, 15 nt, Shigella flexneri 2a str. 2457T
augaguugcuggacg

SEQ ID NO: 3869597 - RNA, 18 nt, Shigella flexneri 2a str. 2457T
augauaaaauucauucaa

SEQ ID NO: 3869598 - RNA, 22 nt, Shigella flexneri 2a str. 2457T
augauacguuuauuaccaacca

SEQ ID NO: 3869599 - RNA, 22 nt, Shigella flexneri 2a str. 2457T
augauacugacauuaacgugau

SEQ ID NO: 3869600 - RNA, 14 nt, Shigella flexneri 2a str. 2457T
augauagccaggcg

SEQ ID NO: 3869601 - RNA, 21 nt, Shigella flexneri 2a str. 2457T
augauaucgcuggcaggcaaa

SEQ ID NO: 3869602 - RNA, 21 nt, Shigella flexneri 2a str. 2457T
augccgucaccagcaucaaca

SEQ ID NO: 3869603 - RNA, 16 nt, Shigella flexneri 2a str. 2457T
augccguuauacaucg

SEQ ID NO: 3869604 - RNA, 18 nt, Shigella flexneri 2a str. 2457T
augccucuuucauccgau

SEQ ID NO: 3869605 - RNA, 21 nt, Shigella flexneri 2a str. 2457T
augccugaugcgacgcugaua

SEQ ID NO: 3869606 - RNA, 20 nt, Shigella flexneri 2a str. 2457T
augccugaugcgacgcuugc

SEQ ID NO: 3869607 - RNA, 19 nt, Shigella flexneri 2a str. 2457T
augccugauguacaaccau

SEQ ID NO: 3869608 - RNA, 21 nt, Shigella flexneri 2a str. 2457T
augccugcacuuugugucagc

SEQ ID NO: 3869609 - RNA, 23 nt, Shigella flexneri 2a str. 2457T
augccuguccucuucagcaucaa

SEQ ID NO: 3869610 - RNA, 20 nt, Shigella flexneri 2a str. 2457T
augccuuaaacaugagcgaa

SEQ ID NO: 3869611 - RNA, 21 nt, Shigella flexneri 2a str. 2457T
augccuucuggaaaucaggaa

SEQ ID NO: 3869612 - RNA, 14 nt, Shigella flexneri 2a str. 2457T
augccuuguuugau

SEQ ID NO: 3869613 - RNA, 18 nt, Shigella flexneri 2a str. 2457T
augccuuguuugaucauc

SEQ ID NO: 3869614 - RNA, 19 nt, Shigella flexneri 2a str. 2457T
augccuuguuugaucaucg

SEQ ID NO: 3869615 - RNA, 13 nt, Shigella flexneri 2a str. 2457T
augccuuucucag

SEQ ID NO: 3869616 - RNA, 17 nt, Shigella flexneri 2a str. 2457T
augccuuucucagaagu

SEQ ID NO: 3869617 - RNA, 14 nt, Shigella flexneri 2a str. 2457T
augcgaaaaaaaag

SEQ ID NO: 3869618 - RNA, 13 nt, Shigella flexneri 2a str. 2457T
augcgacacuguu

SEQ ID NO: 3869619 - RNA, 22 nt, Shigella flexneri 2a str. 2457T
augcgacauagaucuaaaugcc

SEQ ID NO: 3869620 - RNA, 13 nt, Shigella flexneri 2a str. 2457T
augcgacgcuugc

SEQ ID NO: 3869621 - RNA, 12 nt, Shigella flexneri 2a str. 2457T
augcgacggcac

SEQ ID NO: 3869622 - RNA, 20 nt, Shigella flexneri 2a str. 2457T
augcgacguaaaaacuacaa

SEQ ID NO: 3869623 - RNA, 20 nt, Shigella flexneri 2a str. 2457T
augcgaguaaacaggggcug

SEQ ID NO: 3869624 - RNA, 16 nt, Shigella flexneri 2a str. 2457T
augcgauaacccgcuc

SEQ ID NO: 3869625 - RNA, 17 nt, Shigella flexneri 2a str. 2457T
augcgaugcauccggca

SEQ ID NO: 3869626 - RNA, 16 nt, Shigella flexneri 2a str. 2457T
augcgauggagugaga

SEQ ID NO: 3869627 - RNA, 18 nt, Shigella flexneri 2a str. 2457T
augcgcaaccguaaacga

SEQ ID NO: 3869628 - RNA, 21 nt, Shigella flexneri 2a str. 2457T
augcgcauugccagagugaaa

SEQ ID NO: 3869629 - RNA, 23 nt, Shigella flexneri 2a str. 2457T
augcgcauugccagagugaaaau

SEQ ID NO: 3869630 - RNA, 15 nt, Shigella flexneri 2a str. 2457T
augcgccagguaacg

SEQ ID NO: 3869631 - RNA, 12 nt, Shigella flexneri 2a str. 2457T
augcgcccagcg

SEQ ID NO: 3869632 - RNA, 18 nt, Shigella flexneri 2a str. 2457T
augcgcuaaauguuuagu

SEQ ID NO: 3869633 - RNA, 18 nt, Shigella flexneri 2a str. 2457T
augcgcuacgcucaucag

SEQ ID NO: 3869634 - RNA, 19 nt, Shigella flexneri 2a str. 2457T
augcgcuccucgccguuaa

SEQ ID NO: 3869635 - RNA, 21 nt, Shigella flexneri 2a str. 2457T
augcgcucuguugguaaaugc

SEQ ID NO: 3869636 - RNA, 13 nt, Shigella flexneri 2a str. 2457T
augcgcuuccugc

SEQ ID NO: 3869637 - RNA, 16 nt, Shigella flexneri 2a str. 2457T
augcgcuuuaucgccg

SEQ ID NO: 3869638 - RNA, 20 nt, Shigella flexneri 2a str. 2457T
augcgcuuuaucgccgcugg

SEQ ID NO: 3869639 - RNA, 16 nt, Shigella flexneri 2a str. 2457T
augcggaauuugauga

SEQ ID NO: 3869640 - RNA, 22 nt, Shigella flexneri 2a str. 2457T
augcggcaucuucuccacgcca

SEQ ID NO: 3869641 - RNA, 16 nt, Shigella flexneri 2a str. 2457T
augcggcgacuggaua

SEQ ID NO: 3869642 - RNA, 12 nt, Shigella flexneri 2a str. 2457T
augcggcgagga

SEQ ID NO: 3869643 - RNA, 18 nt, Shigella flexneri 2a str. 2457T
augcgggucaggccagga

SEQ ID NO: 3869644 - RNA, 19 nt, Shigella flexneri 2a str. 2457T
augcgguaaccuggcaguu

SEQ ID NO: 3869645 - RNA, 23 nt, Shigella flexneri 2a str. 2457T
augcggucguaaucgcccgcuuc

SEQ ID NO: 3869646 - RNA, 17 nt, Shigella flexneri 2a str. 2457T
augcgguuaaaccgaaa

SEQ ID NO: 3869647 - RNA, 21 nt, Shigella flexneri 2a str. 2457T
augcgguuaaaccgaaagugu

SEQ ID NO: 3869648 - RNA, 16 nt, Shigella flexneri 2a str. 2457T
augcgucuuccgugcc

SEQ ID NO: 3869649 - RNA, 18 nt, Shigella flexneri 2a str. 2457T
augcgugcacuggcgcga

SEQ ID NO: 3869650 - RNA, 14 nt, Shigella flexneri 2a str. 2457T
augcguucucccuc

SEQ ID NO: 3869651 - RNA, 15 nt, Shigella flexneri 2a str. 2457T
augcguuugccagcg

SEQ ID NO: 3869652 - RNA, 16 nt, Shigella flexneri 2a str. 2457T
augcuaagccgugcau

SEQ ID NO: 3869653 - RNA, 18 nt, Shigella flexneri 2a str. 2457T
augcucaacaauaaacug

SEQ ID NO: 3869654 - RNA, 23 nt, Shigella flexneri 2a str. 2457T
augcucacugcgaaguuuuuccg

SEQ ID NO: 3869655 - RNA, 21 nt, Shigella flexneri 2a str. 2457T
augcucauucuuccuccagcg

SEQ ID NO: 3869656 - RNA, 20 nt, Shigella flexneri 2a str. 2457T
augcuccacgcugcaucgcc

SEQ ID NO: 3869657 - RNA, 16 nt, Shigella flexneri 2a str. 2457T
augcuccgcaccccug

SEQ ID NO: 3869658 - RNA, 15 nt, Shigella flexneri 2a str. 2457T
augcucucaucacua

SEQ ID NO: 3869659 - RNA, 13 nt, Shigella flexneri 2a str. 2457T
augcucuccacca

SEQ ID NO: 3869660 - RNA, 21 nt, Shigella flexneri 2a str. 2457T
augcucuccguaggccagaua

SEQ ID NO: 3869661 - RNA, 21 nt, Shigella flexneri 2a str. 2457T
augcucuuugauguacgcugc

SEQ ID NO: 3869662 - RNA, 17 nt, Shigella flexneri 2a str. 2457T
augcucuuuucugaagu

SEQ ID NO: 3869663 - RNA, 20 nt, Shigella flexneri 2a str. 2457T
augcugaaaagaguaguaau

SEQ ID NO: 3869664 - RNA, 14 nt, Shigella flexneri 2a str. 2457T
augcugccgucuuc

SEQ ID NO: 3869665 - RNA, 15 nt, Shigella flexneri 2a str. 2457T
augcugcuuucugcg

SEQ ID NO: 3869666 - RNA, 14 nt, Shigella flexneri 2a str. 2457T
augcuggaaccaca

SEQ ID NO: 3869667 - RNA, 18 nt, Shigella flexneri 2a str. 2457T
augcuggaaccacagcgc

SEQ ID NO: 3869668 - RNA, 19 nt, Shigella flexneri 2a str. 2457T
augcuggaaccacagcgcc

SEQ ID NO: 3869669 - RNA, 17 nt, Shigella flexneri 2a str. 2457T
augcuggcugcgcucug

SEQ ID NO: 3869670 - RNA, 22 nt, Shigella flexneri 2a str. 2457T
augcugggccgccauccggcaa

SEQ ID NO: 3869671 - RNA, 14 nt, Shigella flexneri 2a str. 2457T
augcugguuccuga

SEQ ID NO: 3869672 - RNA, 21 nt, Shigella flexneri 2a str. 2457T
augcuguaaccagcgcagaca

SEQ ID NO: 3869673 - RNA, 19 nt, Shigella flexneri 2a str. 2457T
augcuguauucuucagcga

SEQ ID NO: 3869674 - RNA, 18 nt, Shigella flexneri 2a str. 2457T
augcugucgaacgcuaug

SEQ ID NO: 3869675 - RNA, 17 nt, Shigella flexneri 2a str. 2457T
augcugucggcugccag

SEQ ID NO: 3869676 - RNA, 17 nt, Shigella flexneri 2a str. 2457T
augcugugaagauggcu

SEQ ID NO: 3869677 - RNA, 18 nt, Shigella flexneri 2a str. 2457T
augcuuaagaaauuauuc

SEQ ID NO: 3869678 - RNA, 17 nt, Shigella flexneri 2a str. 2457T
augcuuccgccagcggc

SEQ ID NO: 3869679 - RNA, 22 nt, Shigella flexneri 2a str. 2457T
augcuuccgccagcggcggcaa

SEQ ID NO: 3869680 - RNA, 16 nt, Shigella flexneri 2a str. 2457T
augcuuccuuccuggg

SEQ ID NO: 3869681 - RNA, 22 nt, Shigella flexneri 2a str. 2457T
augcuugcgauauucuucagua

SEQ ID NO: 3869682 - RNA, 22 nt, Shigella flexneri 2a str. 2457T
augcuuuccaacuguaccagca

SEQ ID NO: 3869683 - RNA, 15 nt, Shigella flexneri 2a str. 2457T
auggaaaaucaucag

SEQ ID NO: 3869684 - RNA, 13 nt, Shigella flexneri 2a str. 2457T
auggaaaucaccc

SEQ ID NO: 3869685 - RNA, 15 nt, Shigella flexneri 2a str. 2457T
auggaaaucacccag

SEQ ID NO: 3869686 - RNA, 20 nt, Shigella flexneri 2a str. 2457T
auggaaaucacccagcgaag

SEQ ID NO: 3869687 - RNA, 16 nt, Shigella flexneri 2a str. 2457T
auggaaccguacagca

SEQ ID NO: 3869688 - RNA, 18 nt, Shigella flexneri 2a str. 2457T
auggaaccguacagcaug

SEQ ID NO: 3869689 - RNA, 17 nt, Shigella flexneri 2a str. 2457T
auggaaggucacgccag

SEQ ID NO: 3869690 - RNA, 14 nt, Shigella flexneri 2a str. 2457T
auggacaaaagccc

SEQ ID NO: 3869691 - RNA, 16 nt, Shigella flexneri 2a str. 2457T
auggacacuauuuccc

SEQ ID NO: 3869692 - RNA, 17 nt, Shigella flexneri 2a str. 2457T
auggacgcagaccaaag

SEQ ID NO: 3869693 - RNA, 16 nt, Shigella flexneri 2a str. 2457T
auggagcuaaacagcg

SEQ ID NO: 3869694 - RNA, 20 nt, Shigella flexneri 2a str. 2457T
auggaucagaguugaaaaac

SEQ ID NO: 3869695 - RNA, 17 nt, Shigella flexneri 2a str. 2457T
auggauuaccgugaauc

SEQ ID NO: 3869696 - RNA, 15 nt, Shigella flexneri 2a str. 2457T
auggauuagcgaccg

SEQ ID NO: 3869697 - RNA, 17 nt, Shigella flexneri 2a str. 2457T
auggauucgaugaucaa

SEQ ID NO: 3869698 - RNA, 21 nt, Shigella flexneri 2a str. 2457T
auggauuugaaacgaaaucuu

SEQ ID NO: 3869699 - RNA, 12 nt, Shigella flexneri 2a str. 2457T
auguauccggca

SEQ ID NO: 3869700 - RNA, 22 nt, Shigella flexneri 2a str. 2457T
augucacaaauaaaaaaugaga

SEQ ID NO: 3869701 - RNA, 19 nt, Shigella flexneri 2a str. 2457T
augucacugcuuuggcucu

SEQ ID NO: 3869702 - RNA, 14 nt, Shigella flexneri 2a str. 2457T
augucagaugcggc

SEQ ID NO: 3869703 - RNA, 15 nt, Shigella flexneri 2a str. 2457T
augucagcaaucacc

SEQ ID NO: 3869704 - RNA, 12 nt, Shigella flexneri 2a str. 2457T
augucaucagca

SEQ ID NO: 3869705 - RNA, 14 nt, Shigella flexneri 2a str. 2457T
augucaucagcauu

SEQ ID NO: 3869706 - RNA, 24 nt, Shigella flexneri 2a str. 2457T
augucaucagcauucucaucacca

SEQ ID NO: 3869707 - RNA, 21 nt, Shigella flexneri 2a str. 2457T
auguccguuggauaagcggua

SEQ ID NO: 3869708 - RNA, 21 nt, Shigella flexneri 2a str. 2457T
auguccugcggacagucacgu

SEQ ID NO: 3869709 - RNA, 20 nt, Shigella flexneri 2a str. 2457T
auguccuuuuaccacuacau

SEQ ID NO: 3869710 - RNA, 13 nt, Shigella flexneri 2a str. 2457T
augucgcgccagg

SEQ ID NO: 3869711 - RNA, 16 nt, Shigella flexneri 2a str. 2457T
augucgcucaaugugc

SEQ ID NO: 3869712 - RNA, 14 nt, Shigella flexneri 2a str. 2457T
augucggaugcggc

SEQ ID NO: 3869713 - RNA, 15 nt, Shigella flexneri 2a str. 2457T
augucggaugcggcg

SEQ ID NO: 3869714 - RNA, 22 nt, Shigella flexneri 2a str. 2457T
augucggauuucgcagccauua

SEQ ID NO: 3869715 - RNA, 20 nt, Shigella flexneri 2a str. 2457T
augucggcagugauuuuccc

SEQ ID NO: 3869716 - RNA, 15 nt, Shigella flexneri 2a str. 2457T
augucgguuguacaa

SEQ ID NO: 3869717 - RNA, 19 nt, Shigella flexneri 2a str. 2457T
augucgguuguacaaaaaa

SEQ ID NO: 3869718 - RNA, 12 nt, Shigella flexneri 2a str. 2457T
augucuggcaga

SEQ ID NO: 3869719 - RNA, 20 nt, Shigella flexneri 2a str. 2457T
augucuggcgagcuccaggg

SEQ ID NO: 3869720 - RNA, 21 nt, Shigella flexneri 2a str. 2457T
augucuggcugagcaaacagu

SEQ ID NO: 3869721 - RNA, 18 nt, Shigella flexneri 2a str. 2457T
augucuuuuuuccagcac

SEQ ID NO: 3869722 - RNA, 14 nt, Shigella flexneri 2a str. 2457T
augugacagagcca

SEQ ID NO: 3869723 - RNA, 14 nt, Shigella flexneri 2a str. 2457T
augugacgcugucu

SEQ ID NO: 3869724 - RNA, 18 nt, Shigella flexneri 2a str. 2457T
augugacuggaaaucaaa

SEQ ID NO: 3869725 - RNA, 13 nt, Shigella flexneri 2a str. 2457T
augugauccauca

SEQ ID NO: 3869726 - RNA, 13 nt, Shigella flexneri 2a str. 2457T
augugaugccuag

SEQ ID NO: 3869727 - RNA, 22 nt, Shigella flexneri 2a str. 2457T
augugauggccgcgcagggcau

SEQ ID NO: 3869728 - RNA, 18 nt, Shigella flexneri 2a str. 2457T
augugcaguuccugcaac

SEQ ID NO: 3869729 - RNA, 11 nt, Shigella flexneri 2a str. 2457T
augugccauua

SEQ ID NO: 3869730 - RNA, 18 nt, Shigella flexneri 2a str. 2457T
augugccggaugcaucac

SEQ ID NO: 3869731 - RNA, 17 nt, Shigella flexneri 2a str. 2457T
augugcucuaacccuuc

SEQ ID NO: 3869732 - RNA, 19 nt, Shigella flexneri 2a str. 2457T
augugcucuaacccuucca

SEQ ID NO: 3869733 - RNA, 13 nt, Shigella flexneri 2a str. 2457T
augugcugagugu

SEQ ID NO: 3869734 - RNA, 14 nt, Shigella flexneri 2a str. 2457T
augugcuucaucag

SEQ ID NO: 3869735 - RNA, 14 nt, Shigella flexneri 2a str. 2457T
augugcuucuacca

SEQ ID NO: 3869736 - RNA, 12 nt, Shigella flexneri 2a str. 2457T
auguggaaacag

SEQ ID NO: 3869737 - RNA, 22 nt, Shigella flexneri 2a str. 2457T
auguggcccagccuuuccggca

SEQ ID NO: 3869738 - RNA, 19 nt, Shigella flexneri 2a str. 2457T
augugggcaaucucacucc

SEQ ID NO: 3869739 - RNA, 18 nt, Shigella flexneri 2a str. 2457T
auguguaagaaaggcaga

SEQ ID NO: 3869740 - RNA, 18 nt, Shigella flexneri 2a str. 2457T
auguguaaguaaugacaa

SEQ ID NO: 3869741 - RNA, 13 nt, Shigella flexneri 2a str. 2457T
auguguuagcccu

SEQ ID NO: 3869742 - RNA, 21 nt, Shigella flexneri 2a str. 2457T
auguguuauucagcuggcagu

SEQ ID NO: 3869743 - RNA, 19 nt, Shigella flexneri 2a str. 2457T
auguguuggcaccaucccu

SEQ ID NO: 3869744 - RNA, 23 nt, Shigella flexneri 2a str. 2457T
auguguuuacgcguuuuucagaa

SEQ ID NO: 3869745 - RNA, 14 nt, Shigella flexneri 2a str. 2457T
auguuaaccgccug

SEQ ID NO: 3869746 - RNA, 21 nt, Shigella flexneri 2a str. 2457T
auguuaccgaucgccagcagg

SEQ ID NO: 3869747 - RNA, 23 nt, Shigella flexneri 2a str. 2457T
auguuacugagcggaugcuuaac

SEQ ID NO: 3869748 - RNA, 17 nt, Shigella flexneri 2a str. 2457T
auguuauuuaauuacug

SEQ ID NO: 3869749 - RNA, 17 nt, Shigella flexneri 2a str. 2457T
auguucaauaaaagcau

SEQ ID NO: 3869750 - RNA, 22 nt, Shigella flexneri 2a str. 2457T
auguucaauaagcgcagccaaa

SEQ ID NO: 3869751 - RNA, 11 nt, Shigella flexneri 2a str. 2457T
auguucacugc

SEQ ID NO: 3869752 - RNA, 13 nt, Shigella flexneri 2a str. 2457T
auguucacugccg

SEQ ID NO: 3869753 - RNA, 21 nt, Shigella flexneri 2a str. 2457T
auguucacugccguacagaca

SEQ ID NO: 3869754 - RNA, 17 nt, Shigella flexneri 2a str. 2457T
auguucagauuguugau

SEQ ID NO: 3869755 - RNA, 19 nt, Shigella flexneri 2a str. 2457T
auguucagauuguugauua

SEQ ID NO: 3869756 - RNA, 15 nt, Shigella flexneri 2a str. 2457T
auguucaucaagcug

SEQ ID NO: 3869757 - RNA, 18 nt, Shigella flexneri 2a str. 2457T
auguucccaccagccacg

SEQ ID NO: 3869758 - RNA, 21 nt, Shigella flexneri 2a str. 2457T
auguuccggcgacacaucuaa

SEQ ID NO: 3869759 - RNA, 18 nt, Shigella flexneri 2a str. 2457T
auguuccuucugucauga

SEQ ID NO: 3869760 - RNA, 17 nt, Shigella flexneri 2a str. 2457T
auguucgacuuaacgcg

SEQ ID NO: 3869761 - RNA, 22 nt, Shigella flexneri 2a str. 2457T
auguucgccagauuuuuaucca

SEQ ID NO: 3869762 - RNA, 20 nt, Shigella flexneri 2a str. 2457T
auguucggcgucuuguugaa

SEQ ID NO: 3869763 - RNA, 20 nt, Shigella flexneri 2a str. 2457T
auguucuaugaagaacugga

SEQ ID NO: 3869764 - RNA, 13 nt, Shigella flexneri 2a str. 2457T
auguugaaucuuc

SEQ ID NO: 3869765 - RNA, 14 nt, Shigella flexneri 2a str. 2457T
auguugaccgcccg

SEQ ID NO: 3869766 - RNA, 13 nt, Shigella flexneri 2a str. 2457T
auguugagcggca

SEQ ID NO: 3869767 - RNA, 20 nt, Shigella flexneri 2a str. 2457T
auguugcaaaggccagccag

SEQ ID NO: 3869768 - RNA, 13 nt, Shigella flexneri 2a str. 2457T
auguugccacacg

SEQ ID NO: 3869769 - RNA, 16 nt, Shigella flexneri 2a str. 2457T
auguugccacacgccc

SEQ ID NO: 3869770 - RNA, 16 nt, Shigella flexneri 2a str. 2457T
auguugcugcaccagg

SEQ ID NO: 3869771 - RNA, 10 nt, Shigella flexneri 2a str. 2457T
auguuggcgc

SEQ ID NO: 3869772 - RNA, 15 nt, Shigella flexneri 2a str. 2457T
auguugucgccagua

SEQ ID NO: 3869773 - RNA, 21 nt, Shigella flexneri 2a str. 2457T
auguuguuccuuuuauuuaac

SEQ ID NO: 3869774 - RNA, 14 nt, Shigella flexneri 2a str. 2457T
auguuguuuuuaac

SEQ ID NO: 3869775 - RNA, 15 nt, Shigella flexneri 2a str. 2457T
auguuuaugccuggu

SEQ ID NO: 3869776 - RNA, 18 nt, Shigella flexneri 2a str. 2457T
auguuucaacggaccaau

SEQ ID NO: 3869777 - RNA, 19 nt, Shigella flexneri 2a str. 2457T
auguuuccgcgcagguaaa

SEQ ID NO: 3869778 - RNA, 23 nt, Shigella flexneri 2a str. 2457T
auguuugaaucaacauauuaaaa

SEQ ID NO: 3869779 - RNA, 11 nt, Shigella flexneri 2a str. 2457T
auguuugccau

SEQ ID NO: 3869780 - RNA, 19 nt, Shigella flexneri 2a str. 2457T
auguuuguauucgcagcga

SEQ ID NO: 3869781 - RNA, 21 nt, Shigella flexneri 2a str. 2457T
auguuuuaacacacaauuacc

SEQ ID NO: 3869782 - RNA, 20 nt, Shigella flexneri 2a str. 2457T
auguuuucagaccagacugc

SEQ ID NO: 3869783 - RNA, 14 nt, Shigella flexneri 2a str. 2457T
auuaaaaaaacacc

SEQ ID NO: 3869784 - RNA, 21 nt, Shigella flexneri 2a str. 2457T
auuaaaaaaacaccacaaaac

SEQ ID NO: 3869785 - RNA, 16 nt, Shigella flexneri 2a str. 2457T
auuaaaaagccugcca

SEQ ID NO: 3869786 - RNA, 15 nt, Shigella flexneri 2a str. 2457T
auuaaaaaguaagaa

SEQ ID NO: 3869787 - RNA, 21 nt, Shigella flexneri 2a str. 2457T
auuaaaauucaucaaauggca

SEQ ID NO: 3869788 - RNA, 16 nt, Shigella flexneri 2a str. 2457T
auuaaacagccaacug

SEQ ID NO: 3869789 - RNA, 20 nt, Shigella flexneri 2a str. 2457T
auuaaacgccucugucagaa

SEQ ID NO: 3869790 - RNA, 21 nt, Shigella flexneri 2a str. 2457T
auuaaacugucgucgcuuuca

SEQ ID NO: 3869791 - RNA, 20 nt, Shigella flexneri 2a str. 2457T
auuaaagaaaauaaggccau

SEQ ID NO: 3869792 - RNA, 12 nt, Shigella flexneri 2a str. 2457T
auuaaagaaagu

SEQ ID NO: 3869793 - RNA, 22 nt, Shigella flexneri 2a str. 2457T
auuaaagccgccaaacggauac

SEQ ID NO: 3869794 - RNA, 16 nt, Shigella flexneri 2a str. 2457T
auuaaaggaaggucau

SEQ ID NO: 3869795 - RNA, 15 nt, Shigella flexneri 2a str. 2457T
auuaaaggcaccaau

SEQ ID NO: 3869796 - RNA, 17 nt, Shigella flexneri 2a str. 2457T
auuaaaggcaccaauau

SEQ ID NO: 3869797 - RNA, 23 nt, Shigella flexneri 2a str. 2457T
auuaggaauaaugucuuuaaugg

SEQ ID NO: 3869798 - RNA, 19 nt, Shigella flexneri 2a str. 2457T
auuagggcggacaaccagc

SEQ ID NO: 3869799 - RNA, 16 nt, Shigella flexneri 2a str. 2457T
auuagucuuuaucugc

SEQ ID NO: 3869800 - RNA, 23 nt, Shigella flexneri 2a str. 2457T
auuaguggcaaccacaaccgccg

SEQ ID NO: 3869801 - RNA, 18 nt, Shigella flexneri 2a str. 2457T
auuaguguguauauacug

SEQ ID NO: 3869802 - RNA, 15 nt, Shigella flexneri 2a str. 2457T
auuauagacaucuuu

SEQ ID NO: 3869803 - RNA, 24 nt, Shigella flexneri 2a str. 2457T
auuauagacaucuuuauaugcaac

SEQ ID NO: 3869804 - RNA, 18 nt, Shigella flexneri 2a str. 2457T
auuauagggaugcagaau

SEQ ID NO: 3869805 - RNA, 19 nt, Shigella flexneri 2a str. 2457T
auuauaguaucguuaaauu

SEQ ID NO: 3869806 - RNA, 17 nt, Shigella flexneri 2a str. 2457T
auuauaucgcucucuuu

SEQ ID NO: 3869807 - RNA, 15 nt, Shigella flexneri 2a str. 2457T
auuauauggaaaaau

SEQ ID NO: 3869808 - RNA, 18 nt, Shigella flexneri 2a str. 2457T
auuaucagacaccgauug

SEQ ID NO: 3869809 - RNA, 15 nt, Shigella flexneri 2a str. 2457T
auuaucagcaaagca

SEQ ID NO: 3869810 - RNA, 19 nt, Shigella flexneri 2a str. 2457T
auuaucaggcuaaagguau

SEQ ID NO: 3869811 - RNA, 13 nt, Shigella flexneri 2a str. 2457T
auuaucauuuuac

SEQ ID NO: 3869812 - RNA, 19 nt, Shigella flexneri 2a str. 2457T
auuaucauuuuacguugca

SEQ ID NO: 3869813 - RNA, 22 nt, Shigella flexneri 2a str. 2457T
auuauccaucaaagguuuuuca

SEQ ID NO: 3869814 - RNA, 12 nt, Shigella flexneri 2a str. 2457T
auuauccaugcc

SEQ ID NO: 3869815 - RNA, 20 nt, Shigella flexneri 2a str. 2457T
auuauccgcaucacuccaca

SEQ ID NO: 3869816 - RNA, 16 nt, Shigella flexneri 2a str. 2457T
auuaucggcaccauuu

SEQ ID NO: 3869817 - RNA, 23 nt, Shigella flexneri 2a str. 2457T
auuaucggcucgaucuggugcaa

SEQ ID NO: 3869818 - RNA, 14 nt, Shigella flexneri 2a str. 2457T
auuaucucaacaca

SEQ ID NO: 3869819 - RNA, 19 nt, Shigella flexneri 2a str. 2457T
auuaucucuugccaggcuu

SEQ ID NO: 3869820 - RNA, 16 nt, Shigella flexneri 2a str. 2457T
auuaucuggcaagccu

SEQ ID NO: 3869821 - RNA, 21 nt, Shigella flexneri 2a str. 2457T
auuaucuggcaagccugaaaa

SEQ ID NO: 3869822 - RNA, 12 nt, Shigella flexneri 2a str. 2457T
auuaucuucacc

SEQ ID NO: 3869823 - RNA, 18 nt, Shigella flexneri 2a str. 2457T
auuaucuuuauuaucaac

SEQ ID NO: 3869824 - RNA, 19 nt, Shigella flexneri 2a str. 2457T
auuaucuuuauuaucaaca

SEQ ID NO: 3869825 - RNA, 16 nt, Shigella flexneri 2a str. 2457T
auuaugaaacaagaag

SEQ ID NO: 3869826 - RNA, 14 nt, Shigella flexneri 2a str. 2457T
auuaugaucgccac

SEQ ID NO: 3869827 - RNA, 16 nt, Shigella flexneri 2a str. 2457T
auuaugcagccuucau

SEQ ID NO: 3869828 - RNA, 23 nt, Shigella flexneri 2a str. 2457T
auuaugccgccgacaguuaucaa

SEQ ID NO: 3869829 - RNA, 15 nt, Shigella flexneri 2a str. 2457T
auuaugccugauuac

SEQ ID NO: 3869830 - RNA, 18 nt, Shigella flexneri 2a str. 2457T
auuaugcgaccauaugaa

SEQ ID NO: 3869831 - RNA, 15 nt, Shigella flexneri 2a str. 2457T
auuauggaucaccau

SEQ ID NO: 3869832 - RNA, 16 nt, Shigella flexneri 2a str. 2457T
auuauggaucaccauc

SEQ ID NO: 3869833 - RNA, 19 nt, Shigella flexneri 2a str. 2457T
auuaugucaucaucgccac

SEQ ID NO: 3869834 - RNA, 20 nt, Shigella flexneri 2a str. 2457T
auuaugucgcucaaugcgcu

SEQ ID NO: 3869835 - RNA, 16 nt, Shigella flexneri 2a str. 2457T
auuauuaauauucagc

SEQ ID NO: 3869836 - RNA, 14 nt, Shigella flexneri 2a str. 2457T
auuauuauuuuugu

SEQ ID NO: 3869837 - RNA, 17 nt, Shigella flexneri 2a str. 2457T
auuauucauaaugccca

SEQ ID NO: 3869838 - RNA, 17 nt, Shigella flexneri 2a str. 2457T
auuauucauggcaggag

SEQ ID NO: 3869839 - RNA, 16 nt, Shigella flexneri 2a str. 2457T
auuauuccguuucguu

SEQ ID NO: 3869840 - RNA, 20 nt, Shigella flexneri 2a str. 2457T
auuauugagcgcaaauugcu

SEQ ID NO: 3869841 - RNA, 17 nt, Shigella flexneri 2a str. 2457T
auuauugcgcacaucaa

SEQ ID NO: 3869842 - RNA, 23 nt, Shigella flexneri 2a str. 2457T
auuauuggcaucguauuucagac

SEQ ID NO: 3869843 - RNA, 23 nt, Shigella flexneri 2a str. 2457T
auuauuucaaugcauuaucagag

SEQ ID NO: 3869844 - RNA, 19 nt, Shigella flexneri 2a str. 2457T
auuauuucuuuuacauuau

SEQ ID NO: 3869845 - RNA, 14 nt, Shigella flexneri 2a str. 2457T
auuauuuuuaaaca

SEQ ID NO: 3869846 - RNA, 22 nt, Shigella flexneri 2a str. 2457T
auuauuuuugugaagaauaaau

SEQ ID NO: 3869847 - RNA, 19 nt, Shigella flexneri 2a str. 2457T
auuauuuuuuuaucauuuc

SEQ ID NO: 3869848 - RNA, 17 nt, Shigella flexneri 2a str. 2457T
auucaaacgugaacggc

SEQ ID NO: 3869849 - RNA, 12 nt, Shigella flexneri 2a str. 2457T
auucaacaguag

SEQ ID NO: 3869850 - RNA, 21 nt, Shigella flexneri 2a str. 2457T
auucaacuggauaaaauuaua

SEQ ID NO: 3869851 - RNA, 15 nt, Shigella flexneri 2a str. 2457T
auucaagaaacagca

SEQ ID NO: 3869852 - RNA, 16 nt, Shigella flexneri 2a str. 2457T
auucaagacaucaaua

SEQ ID NO: 3869853 - RNA, 16 nt, Shigella flexneri 2a str. 2457T
auucaaguaucuauuc

SEQ ID NO: 3869854 - RNA, 15 nt, Shigella flexneri 2a str. 2457T
auucaauuaauaaca

SEQ ID NO: 3869855 - RNA, 16 nt, Shigella flexneri 2a str. 2457T
auucaauuaauaacac

SEQ ID NO: 3869856 - RNA, 17 nt, Shigella flexneri 2a str. 2457T
auucaauuaauaacaca

SEQ ID NO: 3869857 - RNA, 16 nt, Shigella flexneri 2a str. 2457T
auucaauuauaguauc

SEQ ID NO: 3869858 - RNA, 17 nt, Shigella flexneri 2a str. 2457T
auucacaaacagcgccu

SEQ ID NO: 3869859 - RNA, 16 nt, Shigella flexneri 2a str. 2457T
auucacaauucaucau

SEQ ID NO: 3869860 - RNA, 18 nt, Shigella flexneri 2a str. 2457T
auucacaguuaaguuaau

SEQ ID NO: 3869861 - RNA, 22 nt, Shigella flexneri 2a str. 2457T
auucacaucauccggcaccuuu

SEQ ID NO: 3869862 - RNA, 17 nt, Shigella flexneri 2a str. 2457T
auucacauuuuuaagcc

SEQ ID NO: 3869863 - RNA, 17 nt, Shigella flexneri 2a str. 2457T
auucaccagaccugaaa

SEQ ID NO: 3869864 - RNA, 18 nt, Shigella flexneri 2a str. 2457T
auucaccagaccugaaac

SEQ ID NO: 3869865 - RNA, 17 nt, Shigella flexneri 2a str. 2457T
auucaccagcaaaucca

SEQ ID NO: 3869866 - RNA, 19 nt, Shigella flexneri 2a str. 2457T
auucaccgcaucaauauua

SEQ ID NO: 3869867 - RNA, 21 nt, Shigella flexneri 2a str. 2457T
auucaccguaauaguuucuga

SEQ ID NO: 3869868 - RNA, 16 nt, Shigella flexneri 2a str. 2457T
auucaccucugcggca

SEQ ID NO: 3869869 - RNA, 17 nt, Shigella flexneri 2a str. 2457T
auucacgaauauuuccc

SEQ ID NO: 3869870 - RNA, 21 nt, Shigella flexneri 2a str. 2457T
auucacgaaucuauucauuua

SEQ ID NO: 3869871 - RNA, 22 nt, Shigella flexneri 2a str. 2457T
auucacgaaucuauucauuuau

SEQ ID NO: 3869872 - RNA, 20 nt, Shigella flexneri 2a str. 2457T
auucacgagguuuuuucgga

SEQ ID NO: 3869873 - RNA, 20 nt, Shigella flexneri 2a str. 2457T
auucacgccacugucauauu

SEQ ID NO: 3869874 - RNA, 23 nt, Shigella flexneri 2a str. 2457T
auucacgccgcauccggcaucaa

SEQ ID NO: 3869875 - RNA, 18 nt, Shigella flexneri 2a str. 2457T
auucacguucgugaacau

SEQ ID NO: 3869876 - RNA, 15 nt, Shigella flexneri 2a str. 2457T
auucacucuauaccg

SEQ ID NO: 3869877 - RNA, 17 nt, Shigella flexneri 2a str. 2457T
auucacugccugcugau

SEQ ID NO: 3869878 - RNA, 16 nt, Shigella flexneri 2a str. 2457T
auucacuuucugaagg

SEQ ID NO: 3869879 - RNA, 13 nt, Shigella flexneri 2a str. 2457T
auucagaaaguaa

SEQ ID NO: 3869880 - RNA, 23 nt, Shigella flexneri 2a str. 2457T
auucagaacacaaaaccgauuaa

SEQ ID NO: 3869881 - RNA, 16 nt, Shigella flexneri 2a str. 2457T
auucagaccauuccuc

SEQ ID NO: 3869882 - RNA, 21 nt, Shigella flexneri 2a str. 2457T
auucagagggcaaauucuuca

SEQ ID NO: 3869883 - RNA, 21 nt, Shigella flexneri 2a str. 2457T
auucagaugaugauacugaca

SEQ ID NO: 3869884 - RNA, 23 nt, Shigella flexneri 2a str. 2457T
auucagauugcagacaaagugag

SEQ ID NO: 3869885 - RNA, 11 nt, Shigella flexneri 2a str. 2457T
auucagcagca

SEQ ID NO: 3869886 - RNA, 20 nt, Shigella flexneri 2a str. 2457T
auucagcccgagguuauuuu

SEQ ID NO: 3869887 - RNA, 17 nt, Shigella flexneri 2a str. 2457T
auucagcccggcaacgu

SEQ ID NO: 3869888 - RNA, 18 nt, Shigella flexneri 2a str. 2457T
auucaggccguagagcac

SEQ ID NO: 3869889 - RNA, 14 nt, Shigella flexneri 2a str. 2457T
auucaggcgcagca

SEQ ID NO: 3869890 - RNA, 20 nt, Shigella flexneri 2a str. 2457T
auucagguaauuaacauuca

SEQ ID NO: 3869891 - RNA, 14 nt, Shigella flexneri 2a str. 2457T
auucagguggcagu

SEQ ID NO: 3869892 - RNA, 17 nt, Shigella flexneri 2a str. 2457T
auucagugcaaaugcca

SEQ ID NO: 3869893 - RNA, 18 nt, Shigella flexneri 2a str. 2457T
auucagugcaaaugccag

SEQ ID NO: 3869894 - RNA, 22 nt, Shigella flexneri 2a str. 2457T
auucuguucaguacgaaauaac

SEQ ID NO: 3869895 - RNA, 18 nt, Shigella flexneri 2a str. 2457T
auucuguuuuaucagacc

SEQ ID NO: 3869896 - RNA, 17 nt, Shigella flexneri 2a str. 2457T
auucuugacgccauuuu

SEQ ID NO: 3869897 - RNA, 19 nt, Shigella flexneri 2a str. 2457T
auucuugacgccauuuuuu

SEQ ID NO: 3869898 - RNA, 20 nt, Shigella flexneri 2a str. 2457T
auucuugacgccauuuuuua

SEQ ID NO: 3869899 - RNA, 21 nt, Shigella flexneri 2a str. 2457T
auucuugacgccauuuuuuau

SEQ ID NO: 3869900 - RNA, 16 nt, Shigella flexneri 2a str. 2457T
auucuugccuuuccuc

SEQ ID NO: 3869901 - RNA, 16 nt, Shigella flexneri 2a str. 2457T
auucuuugcuguacau

SEQ ID NO: 3869902 - RNA, 19 nt, Shigella flexneri 2a str. 2457T
auugaaaaguccaggcugc

SEQ ID NO: 3869903 - RNA, 19 nt, Shigella flexneri 2a str. 2457T
auugaaagcauaguuuuua

SEQ ID NO: 3869904 - RNA, 22 nt, Shigella flexneri 2a str. 2457T
auugaacucuuaagguucacuu

SEQ ID NO: 3869905 - RNA, 15 nt, Shigella flexneri 2a str. 2457T
auugaagaauuuuug

SEQ ID NO: 3869906 - RNA, 20 nt, Shigella flexneri 2a str. 2457T
auugaagauguugccacacg

SEQ ID NO: 3869907 - RNA, 17 nt, Shigella flexneri 2a str. 2457T
auugaagcaauccauac

SEQ ID NO: 3869908 - RNA, 11 nt, Shigella flexneri 2a str. 2457T
auugaagccaa

SEQ ID NO: 3869909 - RNA, 21 nt, Shigella flexneri 2a str. 2457T
auugaagccaaaucauccaga

SEQ ID NO: 3869910 - RNA, 18 nt, Shigella flexneri 2a str. 2457T
auugaaucacgacaaaca

SEQ ID NO: 3869911 - RNA, 14 nt, Shigella flexneri 2a str. 2457T
auugaauuuuaugu

SEQ ID NO: 3869912 - RNA, 20 nt, Shigella flexneri 2a str. 2457T
auugacaguuuauuuucugc

SEQ ID NO: 3869913 - RNA, 15 nt, Shigella flexneri 2a str. 2457T
auugacguuccuuuc

SEQ ID NO: 3869914 - RNA, 23 nt, Shigella flexneri 2a str. 2457T
auugacucgccuucaggaauacg

SEQ ID NO: 3869915 - RNA, 23 nt, Shigella flexneri 2a str. 2457T
auugagaaccacaaugaagaaag

SEQ ID NO: 3869916 - RNA, 20 nt, Shigella flexneri 2a str. 2457T
auugagaucgcuuaacagaa

SEQ ID NO: 3869917 - RNA, 15 nt, Shigella flexneri 2a str. 2457T
auugagcauuggcau

SEQ ID NO: 3869918 - RNA, 21 nt, Shigella flexneri 2a str. 2457T
auugagcgauuuaugauauuu

SEQ ID NO: 3869919 - RNA, 14 nt, Shigella flexneri 2a str. 2457T
auugagcgcaaaug

SEQ ID NO: 3869920 - RNA, 18 nt, Shigella flexneri 2a str. 2457T
auugaguaauugauugau

SEQ ID NO: 3869921 - RNA, 17 nt, Shigella flexneri 2a str. 2457T
auugagugagcacugaa

SEQ ID NO: 3869922 - RNA, 15 nt, Shigella flexneri 2a str. 2457T
auugauaacggaacg

SEQ ID NO: 3869923 - RNA, 22 nt, Shigella flexneri 2a str. 2457T
auugauaaucucccguuccugg

SEQ ID NO: 3869924 - RNA, 15 nt, Shigella flexneri 2a str. 2457T
auugaucaauucuaa

SEQ ID NO: 3869925 - RNA, 20 nt, Shigella flexneri 2a str. 2457T
auugaucuaccgcuucccuu

SEQ ID NO: 3869926 - RNA, 16 nt, Shigella flexneri 2a str. 2457T
auugaucucacaauca

SEQ ID NO: 3869927 - RNA, 17 nt, Shigella flexneri 2a str. 2457T
auugaucucacaaucau

SEQ ID NO: 3869928 - RNA, 15 nt, Shigella flexneri 2a str. 2457T
auugaugcacaccau

SEQ ID NO: 3869929 - RNA, 19 nt, Shigella flexneri 2a str. 2457T
auugauguaauuaucgcag

SEQ ID NO: 3869930 - RNA, 15 nt, Shigella flexneri 2a str. 2457T
auugaugugaaaacu

SEQ ID NO: 3869931 - RNA, 17 nt, Shigella flexneri 2a str. 2457T
auugauuaaaggaaggu

SEQ ID NO: 3869932 - RNA, 16 nt, Shigella flexneri 2a str. 2457T
auugauucaucucuuc

SEQ ID NO: 3869933 - RNA, 15 nt, Shigella flexneri 2a str. 2457T
auugauuuaucaggu

SEQ ID NO: 3869934 - RNA, 13 nt, Shigella flexneri 2a str. 2457T
auugauuuucuug

SEQ ID NO: 3869935 - RNA, 16 nt, Shigella flexneri 2a str. 2457T
auugcaacauguugaa

SEQ ID NO: 3869936 - RNA, 14 nt, Shigella flexneri 2a str. 2457T
auugcaaccacaca

SEQ ID NO: 3869937 - RNA, 20 nt, Shigella flexneri 2a str. 2457T
auugcacagguggcaaacgc

SEQ ID NO: 3869938 - RNA, 18 nt, Shigella flexneri 2a str. 2457T
auugcacaguauagcauc

SEQ ID NO: 3869939 - RNA, 19 nt, Shigella flexneri 2a str. 2457T
auugcacauucccugcagu

SEQ ID NO: 3869940 - RNA, 18 nt, Shigella flexneri 2a str. 2457T
auugcacuugcuuaaaau

SEQ ID NO: 3869941 - RNA, 17 nt, Shigella flexneri 2a str. 2457T
auugcagauaccacauc

SEQ ID NO: 3869942 - RNA, 19 nt, Shigella flexneri 2a str. 2457T
auugcagauaccacaucaa

SEQ ID NO: 3869943 - RNA, 13 nt, Shigella flexneri 2a str. 2457T
auugcagucauaa

SEQ ID NO: 3869944 - RNA, 19 nt, Shigella flexneri 2a str. 2457T
auugcauccuuuaccggau

SEQ ID NO: 3869945 - RNA, 17 nt, Shigella flexneri 2a str. 2457T
auugccagagcccauca

SEQ ID NO: 3869946 - RNA, 13 nt, Shigella flexneri 2a str. 2457T
auugccagaugcg

SEQ ID NO: 3869947 - RNA, 20 nt, Shigella flexneri 2a str. 2457T
auugccagaugcgacgcugg

SEQ ID NO: 3869948 - RNA, 22 nt, Shigella flexneri 2a str. 2457T
auugccauauacgccaucgcca

SEQ ID NO: 3869949 - RNA, 23 nt, Shigella flexneri 2a str. 2457T
auugccauauacgccaucgccag

SEQ ID NO: 3869950 - RNA, 13 nt, Shigella flexneri 2a str. 2457T
auugccaucuaaa

SEQ ID NO: 3869951 - RNA, 16 nt, Shigella flexneri 2a str. 2457T
auugcccgaagccaau

SEQ ID NO: 3869952 - RNA, 20 nt, Shigella flexneri 2a str. 2457T
auugcccgaugcgcaaacuu

SEQ ID NO: 3869953 - RNA, 18 nt, Shigella flexneri 2a str. 2457T
auugccgaagaccagauu

SEQ ID NO: 3869954 - RNA, 13 nt, Shigella flexneri 2a str. 2457T
auugccgaagccu

SEQ ID NO: 3869955 - RNA, 16 nt, Shigella flexneri 2a str. 2457T
auugccgaugaacggc

SEQ ID NO: 3869956 - RNA, 17 nt, Shigella flexneri 2a str. 2457T
auugccgaugaacggcg

SEQ ID NO: 3869957 - RNA, 23 nt, Shigella flexneri 2a str. 2457T
auugccgccagacguccggcgcu

SEQ ID NO: 3869958 - RNA, 15 nt, Shigella flexneri 2a str. 2457T
auugccgccucugcc

SEQ ID NO: 3869959 - RNA, 20 nt, Shigella flexneri 2a str. 2457T
auugccggacagaucugccu

SEQ ID NO: 3869960 - RNA, 11 nt, Shigella flexneri 2a str. 2457T
auugccggaug

SEQ ID NO: 3869961 - RNA, 15 nt, Shigella flexneri 2a str. 2457T
auugccggaugcggc

SEQ ID NO: 3869962 - RNA, 19 nt, Shigella flexneri 2a str. 2457T
auugccggaugcggcguaa

SEQ ID NO: 3869963 - RNA, 18 nt, Shigella flexneri 2a str. 2457T
auugccgggcgcaucaga

SEQ ID NO: 3869964 - RNA, 20 nt, Shigella flexneri 2a str. 2457T
auugccgggcuaacuucuuu

SEQ ID NO: 3869965 - RNA, 17 nt, Shigella flexneri 2a str. 2457T
auugccgggugcaagag

SEQ ID NO: 3869966 - RNA, 18 nt, Shigella flexneri 2a str. 2457T
auugccgggugcaagagu

SEQ ID NO: 3869967 - RNA, 16 nt, Shigella flexneri 2a str. 2457T
auugccguugauaaag

SEQ ID NO: 3869968 - RNA, 19 nt, Shigella flexneri 2a str. 2457T
auugccguuucgcagguuc

SEQ ID NO: 3869969 - RNA, 21 nt, Shigella flexneri 2a str. 2457T
auugccugaugcgacgcugcg

SEQ ID NO: 3869970 - RNA, 16 nt, Shigella flexneri 2a str. 2457T
auugccugauggccug

SEQ ID NO: 3869971 - RNA, 16 nt, Shigella flexneri 2a str. 2457T
auugccuggcuugccg

SEQ ID NO: 3869972 - RNA, 22 nt, Shigella flexneri 2a str. 2457T
auugccuuccaccagauggcuu

SEQ ID NO: 3869973 - RNA, 15 nt, Shigella flexneri 2a str. 2457T
auugcgcaaauguuu

SEQ ID NO: 3869974 - RNA, 21 nt, Shigella flexneri 2a str. 2457T
auugcgcacaagcuaccagcc

SEQ ID NO: 3869975 - RNA, 21 nt, Shigella flexneri 2a str. 2457T
auugcgcaccagcuugcgaca

SEQ ID NO: 3869976 - RNA, 19 nt, Shigella flexneri 2a str. 2457T
auugcgcagagaugcccau

SEQ ID NO: 3869977 - RNA, 22 nt, Shigella flexneri 2a str. 2457T
auugcgcaggcgcgcguaaauu

SEQ ID NO: 3869978 - RNA, 23 nt, Shigella flexneri 2a str. 2457T
auugcgccagagcgcggcgugaa

SEQ ID NO: 3869979 - RNA, 21 nt, Shigella flexneri 2a str. 2457T
auugcgccagccuuucaauac

SEQ ID NO: 3869980 - RNA, 17 nt, Shigella flexneri 2a str. 2457T
auugcgcgacuuuuucc

SEQ ID NO: 3869981 - RNA, 18 nt, Shigella flexneri 2a str. 2457T
auugcgcgacuuuuuccu

SEQ ID NO: 3869982 - RNA, 19 nt, Shigella flexneri 2a str. 2457T
auugcgcuaaaaaguuccu

SEQ ID NO: 3869983 - RNA, 22 nt, Shigella flexneri 2a str. 2457T
auugcgcuaaaaaguuccugua

SEQ ID NO: 3869984 - RNA, 18 nt, Shigella flexneri 2a str. 2457T
auugcgcugcuuguugau

SEQ ID NO: 3869985 - RNA, 19 nt, Shigella flexneri 2a str. 2457T
auugcgcuggcaccgcaga

SEQ ID NO: 3869986 - RNA, 18 nt, Shigella flexneri 2a str. 2457T
auugcggaacaucgccug

SEQ ID NO: 3869987 - RNA, 14 nt, Shigella flexneri 2a str. 2457T
auugcgggccaaag

SEQ ID NO: 3869988 - RNA, 15 nt, Shigella flexneri 2a str. 2457T
auugcgggccaggaa

SEQ ID NO: 3869989 - RNA, 22 nt, Shigella flexneri 2a str. 2457T
auugcguaaccagacggcguaa

SEQ ID NO: 3869990 - RNA, 15 nt, Shigella flexneri 2a str. 2457T
auugcgugucccacu

SEQ ID NO: 3869991 - RNA, 22 nt, Shigella flexneri 2a str. 2457T
auuuauucuugacgccauuuuu

SEQ ID NO: 3869992 - RNA, 22 nt, Shigella flexneri 2a str. 2457T
auuuauugaaagcauaguuuuu

SEQ ID NO: 3869993 - RNA, 19 nt, Shigella flexneri 2a str. 2457T
auuuauuuuuccuccauug

SEQ ID NO: 3869994 - RNA, 13 nt, Shigella flexneri 2a str. 2457T
auuucaacagauu

SEQ ID NO: 3869995 - RNA, 18 nt, Shigella flexneri 2a str. 2457T
auuucaacagguuuuguu

SEQ ID NO: 3869996 - RNA, 13 nt, Shigella flexneri 2a str. 2457T
auuucaauaacuc

SEQ ID NO: 3869997 - RNA, 18 nt, Shigella flexneri 2a str. 2457T
auuucaauaacuccaucu

SEQ ID NO: 3869998 - RNA, 16 nt, Shigella flexneri 2a str. 2457T
auuucaauaugauaaa

SEQ ID NO: 3869999 - RNA, 19 nt, Shigella flexneri 2a str. 2457T
auuucaauaugauaaaccu

SEQ ID NO: 3870000 - RNA, 20 nt, Shigella flexneri 2a str. 2457T
auuucaauaugauaaaccuc

SEQ ID NO: 3870001 - RNA, 16 nt, Shigella flexneri 2a str. 2457T
auuucaaucacaucau

SEQ ID NO: 3870002 - RNA, 13 nt, Shigella flexneri 2a str. 2457T
auuucaaugcauu

SEQ ID NO: 3870003 - RNA, 19 nt, Shigella flexneri 2a str. 2457T
auuucaaugcauuaucaga

SEQ ID NO: 3870004 - RNA, 21 nt, Shigella flexneri 2a str. 2457T
auuucaaugcgcguaauuugc

SEQ ID NO: 3870005 - RNA, 22 nt, Shigella flexneri 2a str. 2457T
auuucaauggggugacagguuu

SEQ ID NO: 3870006 - RNA, 22 nt, Shigella flexneri 2a str. 2457T
auuucacaacgguccgguugca

SEQ ID NO: 3870007 - RNA, 16 nt, Shigella flexneri 2a str. 2457T
auuucacaccaucaac

SEQ ID NO: 3870008 - RNA, 15 nt, Shigella flexneri 2a str. 2457T
auuucaccagcgcac

SEQ ID NO: 3870009 - RNA, 13 nt, Shigella flexneri 2a str. 2457T
auuucaccaucuu

SEQ ID NO: 3870010 - RNA, 22 nt, Shigella flexneri 2a str. 2457T
auuucacguucacguaaguacu

SEQ ID NO: 3870011 - RNA, 17 nt, Shigella flexneri 2a str. 2457T
auuucacuucaaccaca

SEQ ID NO: 3870012 - RNA, 19 nt, Shigella flexneri 2a str. 2457T
auuucacuucaaccacauu

SEQ ID NO: 3870013 - RNA, 18 nt, Shigella flexneri 2a str. 2457T
auuucagaccuguugccc

SEQ ID NO: 3870014 - RNA, 21 nt, Shigella flexneri 2a str. 2457T
auuucagcgcagacaaucaca

SEQ ID NO: 3870015 - RNA, 15 nt, Shigella flexneri 2a str. 2457T
auuucaucaccagcu

SEQ ID NO: 3870016 - RNA, 17 nt, Shigella flexneri 2a str. 2457T
auuucaugaagcugaca

SEQ ID NO: 3870017 - RNA, 23 nt, Shigella flexneri 2a str. 2457T
auuucauggcggaaaucagagau

SEQ ID NO: 3870018 - RNA, 22 nt, Shigella flexneri 2a str. 2457T
auuucauuaagaacuccugaaa

SEQ ID NO: 3870019 - RNA, 14 nt, Shigella flexneri 2a str. 2457T
auuucauuaauauc

SEQ ID NO: 3870020 - RNA, 15 nt, Shigella flexneri 2a str. 2457T
auuuccaagauuaaa

SEQ ID NO: 3870021 - RNA, 21 nt, Shigella flexneri 2a str. 2457T
auuuccacccggccgucacga

SEQ ID NO: 3870022 - RNA, 13 nt, Shigella flexneri 2a str. 2457T
auuuccaccgcua

SEQ ID NO: 3870023 - RNA, 16 nt, Shigella flexneri 2a str. 2457T
auuuccaggagauuaa

SEQ ID NO: 3870024 - RNA, 17 nt, Shigella flexneri 2a str. 2457T
auuuccagggccucucc

SEQ ID NO: 3870025 - RNA, 13 nt, Shigella flexneri 2a str. 2457T
auuuccaguuugc

SEQ ID NO: 3870026 - RNA, 17 nt, Shigella flexneri 2a str. 2457T
auuuccaguuugcguuc

SEQ ID NO: 3870027 - RNA, 17 nt, Shigella flexneri 2a str. 2457T
auuuccauaaauugcug

SEQ ID NO: 3870028 - RNA, 15 nt, Shigella flexneri 2a str. 2457T
auuuccauaccuaaa

SEQ ID NO: 3870029 - RNA, 23 nt, Shigella flexneri 2a str. 2457T
auuuccauaccuaaaaaauccca

SEQ ID NO: 3870030 - RNA, 21 nt, Shigella flexneri 2a str. 2457T
auuuccaucuccagcugcucg

SEQ ID NO: 3870031 - RNA, 20 nt, Shigella flexneri 2a str. 2457T
auuuccauugcucuggcaaa

SEQ ID NO: 3870032 - RNA, 15 nt, Shigella flexneri 2a str. 2457T
auuuccauuuuugac

SEQ ID NO: 3870033 - RNA, 19 nt, Shigella flexneri 2a str. 2457T
auuucccaacuguuugccg

SEQ ID NO: 3870034 - RNA, 22 nt, Shigella flexneri 2a str. 2457T
auuucccaccacuauuguugaa

SEQ ID NO: 3870035 - RNA, 20 nt, Shigella flexneri 2a str. 2457T
auuucccagauagcaacagc

SEQ ID NO: 3870036 - RNA, 19 nt, Shigella flexneri 2a str. 2457T
auuucccagcaagaaccau

SEQ ID NO: 3870037 - RNA, 15 nt, Shigella flexneri 2a str. 2457T
auuucccggccacgc

SEQ ID NO: 3870038 - RNA, 14 nt, Shigella flexneri 2a str. 2457T
auuucccugacaaa

SEQ ID NO: 3870039 - RNA, 18 nt, Shigella flexneri 2a str. 2457T
auuuccgaaacgcaccuc

SEQ ID NO: 3870040 - RNA, 17 nt, Shigella flexneri 2a str. 2457T
auuuccgcgcaaucgcc

SEQ ID NO: 3870041 - RNA, 13 nt, Shigella flexneri 2a str. 2457T
auuuccguuugcg

SEQ ID NO: 3870042 - RNA, 14 nt, Shigella flexneri 2a str. 2457T
auuuccugagcacu

SEQ ID NO: 3870043 - RNA, 16 nt, Shigella flexneri 2a str. 2457T
auuuccugagcacugg

SEQ ID NO: 3870044 - RNA, 22 nt, Shigella flexneri 2a str. 2457T
auuuccugccagaccuuaucac

SEQ ID NO: 3870045 - RNA, 15 nt, Shigella flexneri 2a str. 2457T
auuuccuguaacacu

SEQ ID NO: 3870046 - RNA, 15 nt, Shigella flexneri 2a str. 2457T
auuuccuucagcagc

SEQ ID NO: 3870047 - RNA, 21 nt, Shigella flexneri 2a str. 2457T
auuuccuuccuuggauauuuu

SEQ ID NO: 3870048 - RNA, 17 nt, Shigella flexneri 2a str. 2457T
auuuccuucgcuuuaau

SEQ ID NO: 3870049 - RNA, 20 nt, Shigella flexneri 2a str. 2457T
auuucgaagaaaccgaugac

SEQ ID NO: 3870050 - RNA, 15 nt, Shigella flexneri 2a str. 2457T
auuucgaauuuucca

SEQ ID NO: 3870051 - RNA, 14 nt, Shigella flexneri 2a str. 2457T
auuucgcugcccau

SEQ ID NO: 3870052 - RNA, 16 nt, Shigella flexneri 2a str. 2457T
auuucggcauuuuugg

SEQ ID NO: 3870053 - RNA, 17 nt, Shigella flexneri 2a str. 2457T
auuucggcgugcgcgcc

SEQ ID NO: 3870054 - RNA, 22 nt, Shigella flexneri 2a str. 2457T
auuucguccauguuggagauaa

SEQ ID NO: 3870055 - RNA, 16 nt, Shigella flexneri 2a str. 2457T
auuucgucuucaucaa

SEQ ID NO: 3870056 - RNA, 13 nt, Shigella flexneri 2a str. 2457T
auuucguuguguc

SEQ ID NO: 3870057 - RNA, 18 nt, Shigella flexneri 2a str. 2457T
auuucguugugucgccag

SEQ ID NO: 3870058 - RNA, 18 nt, Shigella flexneri 2a str. 2457T
auuucucguuggucauca

SEQ ID NO: 3870059 - RNA, 20 nt, Shigella flexneri 2a str. 2457T
auuucucguuggucaucacu

SEQ ID NO: 3870060 - RNA, 17 nt, Shigella flexneri 2a str. 2457T
auuucugacugagcugg

SEQ ID NO: 3870061 - RNA, 16 nt, Shigella flexneri 2a str. 2457T
auuucugauuguuaac

SEQ ID NO: 3870062 - RNA, 19 nt, Shigella flexneri 2a str. 2457T
auuucugccuugaguuuuu

SEQ ID NO: 3870063 - RNA, 21 nt, Shigella flexneri 2a str. 2457T
auuucugccuugaguuuuuca

SEQ ID NO: 3870064 - RNA, 16 nt, Shigella flexneri 2a str. 2457T
auuucugcuucguuaa

SEQ ID NO: 3870065 - RNA, 19 nt, Shigella flexneri 2a str. 2457T
auuucuguauuacagaggu

SEQ ID NO: 3870066 - RNA, 19 nt, Shigella flexneri 2a str. 2457T
auuucuucaccagccugca

SEQ ID NO: 3870067 - RNA, 21 nt, Shigella flexneri 2a str. 2457T
auuucuucauacuaccuggac

SEQ ID NO: 3870068 - RNA, 22 nt, Shigella flexneri 2a str. 2457T
auuucuucaucgguauaaccaa

SEQ ID NO: 3870069 - RNA, 22 nt, Shigella flexneri 2a str. 2457T
auuucuuccagcguuucaagug

SEQ ID NO: 3870070 - RNA, 13 nt, Shigella flexneri 2a str. 2457T
auuucuucugguu

SEQ ID NO: 3870071 - RNA, 13 nt, Shigella flexneri 2a str. 2457T
auuucuuuauccg

SEQ ID NO: 3870072 - RNA, 22 nt, Shigella flexneri 2a str. 2457T
auuucuuuguagaugauuuuuu

SEQ ID NO: 3870073 - RNA, 15 nt, Shigella flexneri 2a str. 2457T
auuugaaaccgucuu

SEQ ID NO: 3870074 - RNA, 16 nt, Shigella flexneri 2a str. 2457T
auuugaucaaauacuu

SEQ ID NO: 3870075 - RNA, 16 nt, Shigella flexneri 2a str. 2457T
auuugauugccggaug

SEQ ID NO: 3870076 - RNA, 17 nt, Shigella flexneri 2a str. 2457T
auuugcauacccagaac

SEQ ID NO: 3870077 - RNA, 13 nt, Shigella flexneri 2a str. 2457T
auuugccaaacgc

SEQ ID NO: 3870078 - RNA, 18 nt, Shigella flexneri 2a str. 2457T
auuugcgccgcaucgcca

SEQ ID NO: 3870079 - RNA, 19 nt, Shigella flexneri 2a str. 2457T
auuugcgccgcaucgccag

SEQ ID NO: 3870080 - RNA, 22 nt, Shigella flexneri 2a str. 2457T
auuugcggaaguaguucaucaa

SEQ ID NO: 3870081 - RNA, 20 nt, Shigella flexneri 2a str. 2457T
auuugcuucaauacgcucca

SEQ ID NO: 3870082 - RNA, 20 nt, Shigella flexneri 2a str. 2457T
auuugcuuguuucauuacuc

SEQ ID NO: 3870083 - RNA, 18 nt, Shigella flexneri 2a str. 2457T
auuugcuuuucauacaau

SEQ ID NO: 3870084 - RNA, 21 nt, Shigella flexneri 2a str. 2457T
auuugcuuuucauacaaucgg

SEQ ID NO: 3870085 - RNA, 21 nt, Shigella flexneri 2a str. 2457T
auuuggcauaucgccguacau

SEQ ID NO: 3870086 - RNA, 16 nt, Shigella flexneri 2a str. 2457T
auuugguggggcuugc

SEQ ID NO: 3870087 - RNA, 16 nt, Shigella flexneri 2a str. 2457T
auuuguaggccggaua

SEQ ID NO: 3870088 - RNA, 14 nt, Shigella flexneri 2a str. 2457T
caaaacauacccag

SEQ ID NO: 3870089 - RNA, 20 nt, Shigella flexneri 2a str. 2457T
caaaacauacccaguuucau

SEQ ID NO: 3870090 - RNA, 22 nt, Shigella flexneri 2a str. 2457T
caaaaccgauuaauugccgcca

SEQ ID NO: 3870091 - RNA, 20 nt, Shigella flexneri 2a str. 2457T
caaaaccguucgaacuggau

SEQ ID NO: 3870092 - RNA, 14 nt, Shigella flexneri 2a str. 2457T
caaaaccucuucca

SEQ ID NO: 3870093 - RNA, 18 nt, Shigella flexneri 2a str. 2457T
caaaacgugcagcugccu

SEQ ID NO: 3870094 - RNA, 21 nt, Shigella flexneri 2a str. 2457T
caaaacguggccuccaaaaaa

SEQ ID NO: 3870095 - RNA, 19 nt, Shigella flexneri 2a str. 2457T
caaaacuggugguaagaau

SEQ ID NO: 3870096 - RNA, 14 nt, Shigella flexneri 2a str. 2457T
caaaagaacacgac

SEQ ID NO: 3870097 - RNA, 16 nt, Shigella flexneri 2a str. 2457T
caaaagauaaagccac

SEQ ID NO: 3870098 - RNA, 18 nt, Shigella flexneri 2a str. 2457T
caaaagaugagaaaaauc

SEQ ID NO: 3870099 - RNA, 18 nt, Shigella flexneri 2a str. 2457T
caaaagauuauugcuuga

SEQ ID NO: 3870100 - RNA, 18 nt, Shigella flexneri 2a str. 2457T
caaaagcaauaauuucaa

SEQ ID NO: 3870101 - RNA, 19 nt, Shigella flexneri 2a str. 2457T
caaaagccccggaauucuc

SEQ ID NO: 3870102 - RNA, 18 nt, Shigella flexneri 2a str. 2457T
caaaaggcgaaaccuccg

SEQ ID NO: 3870103 - RNA, 14 nt, Shigella flexneri 2a str. 2457T
caaaagggagcuau

SEQ ID NO: 3870104 - RNA, 15 nt, Shigella flexneri 2a str. 2457T
caaaauaauaaauua

SEQ ID NO: 3870105 - RNA, 20 nt, Shigella flexneri 2a str. 2457T
caaaauacguucucaccucu

SEQ ID NO: 3870106 - RNA, 14 nt, Shigella flexneri 2a str. 2457T
caaaauacuguuua

SEQ ID NO: 3870107 - RNA, 16 nt, Shigella flexneri 2a str. 2457T
caaaauacuguuuauc

SEQ ID NO: 3870108 - RNA, 22 nt, Shigella flexneri 2a str. 2457T
caaaauacuguuuaucuuccca

SEQ ID NO: 3870109 - RNA, 23 nt, Shigella flexneri 2a str. 2457T
caaaauacuguuuaucuucccag

SEQ ID NO: 3870110 - RNA, 17 nt, Shigella flexneri 2a str. 2457T
caaaauagguaucguaa

SEQ ID NO: 3870111 - RNA, 19 nt, Shigella flexneri 2a str. 2457T
caaaauagucaucucuucc

SEQ ID NO: 3870112 - RNA, 13 nt, Shigella flexneri 2a str. 2457T
caaaaucaaaaua

SEQ ID NO: 3870113 - RNA, 15 nt, Shigella flexneri 2a str. 2457T
caaaaucaaaauaau

SEQ ID NO: 3870114 - RNA, 11 nt, Shigella flexneri 2a str. 2457T
caaaaucauca

SEQ ID NO: 3870115 - RNA, 19 nt, Shigella flexneri 2a str. 2457T
caaaaucggcaacaugacu

SEQ ID NO: 3870116 - RNA, 12 nt, Shigella flexneri 2a str. 2457T
caaaaucuauug

SEQ ID NO: 3870117 - RNA, 18 nt, Shigella flexneri 2a str. 2457T
caaaaucuauugcaacau

SEQ ID NO: 3870118 - RNA, 17 nt, Shigella flexneri 2a str. 2457T
caaaaucuuaaagaugc

SEQ ID NO: 3870119 - RNA, 20 nt, Shigella flexneri 2a str. 2457T
caaaaucuucguuaucccag

SEQ ID NO: 3870120 - RNA, 22 nt, Shigella flexneri 2a str. 2457T
caaaaugagcucuaucucccug

SEQ ID NO: 3870121 - RNA, 13 nt, Shigella flexneri 2a str. 2457T
caaaaugccugau

SEQ ID NO: 3870122 - RNA, 19 nt, Shigella flexneri 2a str. 2457T
caaaauggguauauuugcc

SEQ ID NO: 3870123 - RNA, 17 nt, Shigella flexneri 2a str. 2457T
caaaauguuaucgggca

SEQ ID NO: 3870124 - RNA, 22 nt, Shigella flexneri 2a str. 2457T
caaaauguugucauuacaacaa

SEQ ID NO: 3870125 - RNA, 24 nt, Shigella flexneri 2a str. 2457T
caaaauguugucauuacaacaagg

SEQ ID NO: 3870126 - RNA, 16 nt, Shigella flexneri 2a str. 2457T
caaaauuagaaaggga

SEQ ID NO: 3870127 - RNA, 14 nt, Shigella flexneri 2a str. 2457T
caaaauuaucacaa

SEQ ID NO: 3870128 - RNA, 12 nt, Shigella flexneri 2a str. 2457T
caaaauuauucc

SEQ ID NO: 3870129 - RNA, 14 nt, Shigella flexneri 2a str. 2457T
caaaauucugcuga

SEQ ID NO: 3870130 - RNA, 19 nt, Shigella flexneri 2a str. 2457T
caaaauugcuguuacgcca

SEQ ID NO: 3870131 - RNA, 21 nt, Shigella flexneri 2a str. 2457T
caaaauuuagcaaauuuuuaa

SEQ ID NO: 3870132 - RNA, 15 nt, Shigella flexneri 2a str. 2457T
caaacaaaagggcga

SEQ ID NO: 3870133 - RNA, 15 nt, Shigella flexneri 2a str. 2457T
caaacaacgccucgu

SEQ ID NO: 3870134 - RNA, 14 nt, Shigella flexneri 2a str. 2457T
caaacaauuuucau

SEQ ID NO: 3870135 - RNA, 19 nt, Shigella flexneri 2a str. 2457T
caaacaauuuucauugaaa

SEQ ID NO: 3870136 - RNA, 15 nt, Shigella flexneri 2a str. 2457T
caaacacaucaauga

SEQ ID NO: 3870137 - RNA, 12 nt, Shigella flexneri 2a str. 2457T
caaacaccagcg

SEQ ID NO: 3870138 - RNA, 15 nt, Shigella flexneri 2a str. 2457T
caaacaccagcgaau

SEQ ID NO: 3870139 - RNA, 21 nt, Shigella flexneri 2a str. 2457T
caaacacgccgacgggucagc

SEQ ID NO: 3870140 - RNA, 16 nt, Shigella flexneri 2a str. 2457T
caaacagcagaacgac

SEQ ID NO: 3870141 - RNA, 19 nt, Shigella flexneri 2a str. 2457T
caaacagcgcaaaacgcag

SEQ ID NO: 3870142 - RNA, 15 nt, Shigella flexneri 2a str. 2457T
caaacagcgccagau

SEQ ID NO: 3870143 - RNA, 16 nt, Shigella flexneri 2a str. 2457T
caaacaggaacaccag

SEQ ID NO: 3870144 - RNA, 19 nt, Shigella flexneri 2a str. 2457T
caaacaggaacaccagcau

SEQ ID NO: 3870145 - RNA, 11 nt, Shigella flexneri 2a str. 2457T
caaacaggcug

SEQ ID NO: 3870146 - RNA, 21 nt, Shigella flexneri 2a str. 2457T
caaacagggcaauuaaaaauu

SEQ ID NO: 3870147 - RNA, 23 nt, Shigella flexneri 2a str. 2457T
caaacagucacuuucgagcaauu

SEQ ID NO: 3870148 - RNA, 17 nt, Shigella flexneri 2a str. 2457T
caaacagucgcccgacc

SEQ ID NO: 3870149 - RNA, 18 nt, Shigella flexneri 2a str. 2457T
caaacaguucugcagcgu

SEQ ID NO: 3870150 - RNA, 21 nt, Shigella flexneri 2a str. 2457T
caaacaguuucugcagcucca

SEQ ID NO: 3870151 - RNA, 12 nt, Shigella flexneri 2a str. 2457T
caaacaucaucc

SEQ ID NO: 3870152 - RNA, 17 nt, Shigella flexneri 2a str. 2457T
caaacaucggcuuauuc

SEQ ID NO: 3870153 - RNA, 20 nt, Shigella flexneri 2a str. 2457T
caaacaugccaacaaaaucu

SEQ ID NO: 3870154 - RNA, 19 nt, Shigella flexneri 2a str. 2457T
caaacauugcugccagaaa

SEQ ID NO: 3870155 - RNA, 15 nt, Shigella flexneri 2a str. 2457T
caaaccaacgcuguc

SEQ ID NO: 3870156 - RNA, 22 nt, Shigella flexneri 2a str. 2457T
caaacccagggccaacuggcaa

SEQ ID NO: 3870157 - RNA, 16 nt, Shigella flexneri 2a str. 2457T
caaacccgccagacca

SEQ ID NO: 3870158 - RNA, 15 nt, Shigella flexneri 2a str. 2457T
caaacccugagcggu

SEQ ID NO: 3870159 - RNA, 14 nt, Shigella flexneri 2a str. 2457T
caaacccugaguga

SEQ ID NO: 3870160 - RNA, 18 nt, Shigella flexneri 2a str. 2457T
caaaccugcgggaugguu

SEQ ID NO: 3870161 - RNA, 17 nt, Shigella flexneri 2a str. 2457T
caaacgacgagcgcugg

SEQ ID NO: 3870162 - RNA, 23 nt, Shigella flexneri 2a str. 2457T
caaacgacgggccaguuucauag

SEQ ID NO: 3870163 - RNA, 15 nt, Shigella flexneri 2a str. 2457T
caaacgauaaaagug

SEQ ID NO: 3870164 - RNA, 17 nt, Shigella flexneri 2a str. 2457T
caaacgauucaaaagau

SEQ ID NO: 3870165 - RNA, 18 nt, Shigella flexneri 2a str. 2457T
caaacgcaaaacugccug

SEQ ID NO: 3870166 - RNA, 20 nt, Shigella flexneri 2a str. 2457T
caaacgcaacauugccugau

SEQ ID NO: 3870167 - RNA, 15 nt, Shigella flexneri 2a str. 2457T
caaacgcaucgccaa

SEQ ID NO: 3870168 - RNA, 16 nt, Shigella flexneri 2a str. 2457T
caaacgccagauacau

SEQ ID NO: 3870169 - RNA, 16 nt, Shigella flexneri 2a str. 2457T
caaacgcccguccauc

SEQ ID NO: 3870170 - RNA, 17 nt, Shigella flexneri 2a str. 2457T
caaacgcucccugccag

SEQ ID NO: 3870171 - RNA, 18 nt, Shigella flexneri 2a str. 2457T
caaacgcucccugccagu

SEQ ID NO: 3870172 - RNA, 19 nt, Shigella flexneri 2a str. 2457T
caaacgcucccugccaguc

SEQ ID NO: 3870173 - RNA, 15 nt, Shigella flexneri 2a str. 2457T
caaacgcuggugagu

SEQ ID NO: 3870174 - RNA, 15 nt, Shigella flexneri 2a str. 2457T
caaacggcuggaaca

SEQ ID NO: 3870175 - RNA, 14 nt, Shigella flexneri 2a str. 2457T
caaacgguugauaa

SEQ ID NO: 3870176 - RNA, 14 nt, Shigella flexneri 2a str. 2457T
caaacgguuguagc

SEQ ID NO: 3870177 - RNA, 20 nt, Shigella flexneri 2a str. 2457T
caaacguaaaacugccugau

SEQ ID NO: 3870178 - RNA, 21 nt, Shigella flexneri 2a str. 2457T
caaacgucgcaucugaccaga

SEQ ID NO: 3870179 - RNA, 20 nt, Shigella flexneri 2a str. 2457T
caaacguggucgccagcauu

SEQ ID NO: 3870180 - RNA, 13 nt, Shigella flexneri 2a str. 2457T
caaacuaucccag

SEQ ID NO: 3870181 - RNA, 17 nt, Shigella flexneri 2a str. 2457T
caaacuaucuguguaau

SEQ ID NO: 3870182 - RNA, 20 nt, Shigella flexneri 2a str. 2457T
caaacucaauuaccaacuca

SEQ ID NO: 3870183 - RNA, 13 nt, Shigella flexneri 2a str. 2457T
caaacuccgcgac

SEQ ID NO: 3870184 - RNA, 21 nt, Shigella flexneri 2a str. 2457T
caaacucgcgcaggcugacau

SEQ ID NO: 3870185 - RNA, 23 nt, Shigella flexneri 2a str. 2457T
caaacucggcuucgcuaagauac

SEQ ID NO: 3870186 - RNA, 19 nt, Shigella flexneri 2a str. 2457T
caaacugaguggaguccag

SEQ ID NO: 3870187 - RNA, 21 nt, Shigella flexneri 2a str. 2457T
caaacugauuuagcaucagcg

SEQ ID NO: 3870188 - RNA, 22 nt, Shigella flexneri 2a str. 2457T
caaacugcgcgagcgucauaua

SEQ ID NO: 3870189 - RNA, 17 nt, Shigella flexneri 2a str. 2457T
caaacugcucguucagc

SEQ ID NO: 3870190 - RNA, 19 nt, Shigella flexneri 2a str. 2457T
caaacugcucguucagcac

SEQ ID NO: 3870191 - RNA, 21 nt, Shigella flexneri 2a str. 2457T
caaacugcucguucagcacuu

SEQ ID NO: 3870192 - RNA, 19 nt, Shigella flexneri 2a str. 2457T
caaacugguauugagcgac

SEQ ID NO: 3870193 - RNA, 22 nt, Shigella flexneri 2a str. 2457T
caaacugguauugagcgaccgc

SEQ ID NO: 3870194 - RNA, 12 nt, Shigella flexneri 2a str. 2457T
caaacuuaugca

SEQ ID NO: 3870195 - RNA, 18 nt, Shigella flexneri 2a str. 2457T
caaacuuaugcugcgcca

SEQ ID NO: 3870196 - RNA, 16 nt, Shigella flexneri 2a str. 2457T
caaacuucgucacagc

SEQ ID NO: 3870197 - RNA, 19 nt, Shigella flexneri 2a str. 2457T
caaacuucucgccaucaaa

SEQ ID NO: 3870198 - RNA, 13 nt, Shigella flexneri 2a str. 2457T
caaacuucuucag

SEQ ID NO: 3870199 - RNA, 21 nt, Shigella flexneri 2a str. 2457T
caaacuugaacuuaucaucag

SEQ ID NO: 3870200 - RNA, 17 nt, Shigella flexneri 2a str. 2457T
caaagaaauccacaaau

SEQ ID NO: 3870201 - RNA, 17 nt, Shigella flexneri 2a str. 2457T
caaagacaauuuaccga

SEQ ID NO: 3870202 - RNA, 18 nt, Shigella flexneri 2a str. 2457T
caaagacguuaaaaaagg

SEQ ID NO: 3870203 - RNA, 15 nt, Shigella flexneri 2a str. 2457T
caaagagagaagcca

SEQ ID NO: 3870204 - RNA, 20 nt, Shigella flexneri 2a str. 2457T
caaagauaaaauaaccaucu

SEQ ID NO: 3870205 - RNA, 18 nt, Shigella flexneri 2a str. 2457T
caaagaugaugucacagc

SEQ ID NO: 3870206 - RNA, 20 nt, Shigella flexneri 2a str. 2457T
caaagaugucaccauuggca

SEQ ID NO: 3870207 - RNA, 21 nt, Shigella flexneri 2a str. 2457T
caaagauuguuggcaaaaaaa

SEQ ID NO: 3870208 - RNA, 23 nt, Shigella flexneri 2a str. 2457T
caaagauuguuggcaaaaaaauu

SEQ ID NO: 3870209 - RNA, 14 nt, Shigella flexneri 2a str. 2457T
caaagcacgccagg

SEQ ID NO: 3870210 - RNA, 13 nt, Shigella flexneri 2a str. 2457T
caaagcacgcugu

SEQ ID NO: 3870211 - RNA, 23 nt, Shigella flexneri 2a str. 2457T
caaagcaggcgauuuacuggcag

SEQ ID NO: 3870212 - RNA, 19 nt, Shigella flexneri 2a str. 2457T
caaagcaugaugcgcgacc

SEQ ID NO: 3870213 - RNA, 21 nt, Shigella flexneri 2a str. 2457T
caaagcauucguaaugaaugu

SEQ ID NO: 3870214 - RNA, 23 nt, Shigella flexneri 2a str. 2457T
caaagcccacgccaucauaccca

SEQ ID NO: 3870215 - RNA, 14 nt, Shigella flexneri 2a str. 2457T
caaagccuuucacu

SEQ ID NO: 3870216 - RNA, 19 nt, Shigella flexneri 2a str. 2457T
caaagcgcacuuugccaga

SEQ ID NO: 3870217 - RNA, 23 nt, Shigella flexneri 2a str. 2457T
caaagcgcacuuugucaaaaauc

SEQ ID NO: 3870218 - RNA, 21 nt, Shigella flexneri 2a str. 2457T
caaagcucauugcggcaacaa

SEQ ID NO: 3870219 - RNA, 23 nt, Shigella flexneri 2a str. 2457T
caaagcucuuuugacgcccccaa

SEQ ID NO: 3870220 - RNA, 15 nt, Shigella flexneri 2a str. 2457T
caaagcugcuuuucc

SEQ ID NO: 3870221 - RNA, 17 nt, Shigella flexneri 2a str. 2457T
caaagcuguaucccagc

SEQ ID NO: 3870222 - RNA, 16 nt, Shigella flexneri 2a str. 2457T
caaagcugucaccaau

SEQ ID NO: 3870223 - RNA, 19 nt, Shigella flexneri 2a str. 2457T
caaaggccagcaaucccca

SEQ ID NO: 3870224 - RNA, 14 nt, Shigella flexneri 2a str. 2457T
caaaggccagccag

SEQ ID NO: 3870225 - RNA, 17 nt, Shigella flexneri 2a str. 2457T
caaaggcgaguucaauc

SEQ ID NO: 3870226 - RNA, 23 nt, Shigella flexneri 2a str. 2457T
caaaggcuuugacuaacacuuca

SEQ ID NO: 3870227 - RNA, 13 nt, Shigella flexneri 2a str. 2457T
caaagggcaaagu

SEQ ID NO: 3870228 - RNA, 16 nt, Shigella flexneri 2a str. 2457T
caaagggcaaagucag

SEQ ID NO: 3870229 - RNA, 17 nt, Shigella flexneri 2a str. 2457T
caaagguaauggucagu

SEQ ID NO: 3870230 - RNA, 21 nt, Shigella flexneri 2a str. 2457T
caaaguaccaucguccagcag

SEQ ID NO: 3870231 - RNA, 14 nt, Shigella flexneri 2a str. 2457T
caaagucuccuuug

SEQ ID NO: 3870232 - RNA, 19 nt, Shigella flexneri 2a str. 2457T
caaagugaauacagaacag

SEQ ID NO: 3870233 - RNA, 13 nt, Shigella flexneri 2a str. 2457T
caaagugccccca

SEQ ID NO: 3870234 - RNA, 14 nt, Shigella flexneri 2a str. 2457T
caaagugcccccaa

SEQ ID NO: 3870235 - RNA, 20 nt, Shigella flexneri 2a str. 2457T
caaagugccuguguuuaugc

SEQ ID NO: 3870236 - RNA, 18 nt, Shigella flexneri 2a str. 2457T
caaagugcgcguuuuuua

SEQ ID NO: 3870237 - RNA, 23 nt, Shigella flexneri 2a str. 2457T
caaaguugcauuagcacaaaccc

SEQ ID NO: 3870238 - RNA, 13 nt, Shigella flexneri 2a str. 2457T
caaaguuugcacc

SEQ ID NO: 3870239 - RNA, 18 nt, Shigella flexneri 2a str. 2457T
caaauaaacgaaucugca

SEQ ID NO: 3870240 - RNA, 12 nt, Shigella flexneri 2a str. 2457T
caaauaaauacc

SEQ ID NO: 3870241 - RNA, 19 nt, Shigella flexneri 2a str. 2457T
caaauaaauagauccagga

SEQ ID NO: 3870242 - RNA, 18 nt, Shigella flexneri 2a str. 2457T
caaauaacguaaaaaccc

SEQ ID NO: 3870243 - RNA, 14 nt, Shigella flexneri 2a str. 2457T
caaauaauuccugc

SEQ ID NO: 3870244 - RNA, 17 nt, Shigella flexneri 2a str. 2457T
caaauacccaaaaaaua

SEQ ID NO: 3870245 - RNA, 20 nt, Shigella flexneri 2a str. 2457T
caaauacccaaaaaauagca

SEQ ID NO: 3870246 - RNA, 22 nt, Shigella flexneri 2a str. 2457T
caaauaccggacacacuucauu

SEQ ID NO: 3870247 - RNA, 16 nt, Shigella flexneri 2a str. 2457T
caaauacugacuggca

SEQ ID NO: 3870248 - RNA, 14 nt, Shigella flexneri 2a str. 2457T
caaauacuucaaua

SEQ ID NO: 3870249 - RNA, 20 nt, Shigella flexneri 2a str. 2457T
caaauacuuuuuccaguaga

SEQ ID NO: 3870250 - RNA, 15 nt, Shigella flexneri 2a str. 2457T
caaauagacacaaga

SEQ ID NO: 3870251 - RNA, 16 nt, Shigella flexneri 2a str. 2457T
caaauagccagcagag

SEQ ID NO: 3870252 - RNA, 15 nt, Shigella flexneri 2a str. 2457T
caaauagccugccag

SEQ ID NO: 3870253 - RNA, 15 nt, Shigella flexneri 2a str. 2457T
caaauauuaauaaua

SEQ ID NO: 3870254 - RNA, 15 nt, Shigella flexneri 2a str. 2457T
caaauauucugccca

SEQ ID NO: 3870255 - RNA, 15 nt, Shigella flexneri 2a str. 2457T
caaauauuucuuuau

SEQ ID NO: 3870256 - RNA, 17 nt, Shigella flexneri 2a str. 2457T
caaaucaaauaauuacu

SEQ ID NO: 3870257 - RNA, 17 nt, Shigella flexneri 2a str. 2457T
caaaucaaugguguuau

SEQ ID NO: 3870258 - RNA, 22 nt, Shigella flexneri 2a str. 2457T
caaaucaccauauucagcagca

SEQ ID NO: 3870259 - RNA, 19 nt, Shigella flexneri 2a str. 2457T
caaaucacuauuaaagaaa

SEQ ID NO: 3870260 - RNA, 20 nt, Shigella flexneri 2a str. 2457T
caaaucauccagaccgcuca

SEQ ID NO: 3870261 - RNA, 12 nt, Shigella flexneri 2a str. 2457T
caaauccagcgc

SEQ ID NO: 3870262 - RNA, 14 nt, Shigella flexneri 2a str. 2457T
caaauccagcgcca

SEQ ID NO: 3870263 - RNA, 17 nt, Shigella flexneri 2a str. 2457T
caaauccagcgccacau

SEQ ID NO: 3870264 - RNA, 14 nt, Shigella flexneri 2a str. 2457T
caaauccggccagc

SEQ ID NO: 3870265 - RNA, 18 nt, Shigella flexneri 2a str. 2457T
caaauccggccagcgccg

SEQ ID NO: 3870266 - RNA, 16 nt, Shigella flexneri 2a str. 2457T
caaauccuuccagcuc

SEQ ID NO: 3870267 - RNA, 14 nt, Shigella flexneri 2a str. 2457T
caaaucgaaaucaa

SEQ ID NO: 3870268 - RNA, 18 nt, Shigella flexneri 2a str. 2457T
caaaucgcccagcaaaua

SEQ ID NO: 3870269 - RNA, 12 nt, Shigella flexneri 2a str. 2457T
caaaucgcggca

SEQ ID NO: 3870270 - RNA, 18 nt, Shigella flexneri 2a str. 2457T
caaaucgucgguguccac

SEQ ID NO: 3870271 - RNA, 23 nt, Shigella flexneri 2a str. 2457T
caaaucgucgguguccacuuccg

SEQ ID NO: 3870272 - RNA, 15 nt, Shigella flexneri 2a str. 2457T
caaaucuuauaugau

SEQ ID NO: 3870273 - RNA, 14 nt, Shigella flexneri 2a str. 2457T
caaaugaacaccaa

SEQ ID NO: 3870274 - RNA, 17 nt, Shigella flexneri 2a str. 2457T
caaaugcagcauugccu

SEQ ID NO: 3870275 - RNA, 17 nt, Shigella flexneri 2a str. 2457T
caaaugccagauaagac

SEQ ID NO: 3870276 - RNA, 18 nt, Shigella flexneri 2a str. 2457T
caaaugccagauaagaca

SEQ ID NO: 3870277 - RNA, 15 nt, Shigella flexneri 2a str. 2457T
caaaugcgccgccaa

SEQ ID NO: 3870278 - RNA, 13 nt, Shigella flexneri 2a str. 2457T
caaauggcauccu

SEQ ID NO: 3870279 - RNA, 11 nt, Shigella flexneri 2a str. 2457T
caaauggcgcu

SEQ ID NO: 3870280 - RNA, 15 nt, Shigella flexneri 2a str. 2457T
caaaugucaccagcc

SEQ ID NO: 3870281 - RNA, 16 nt, Shigella flexneri 2a str. 2457T
caaaugucaccagccg

SEQ ID NO: 3870282 - RNA, 17 nt, Shigella flexneri 2a str. 2457T
caaaugucaccagccga

SEQ ID NO: 3870283 - RNA, 23 nt, Shigella flexneri 2a str. 2457T
caaccaugguuucgaacgccagu

SEQ ID NO: 3870284 - RNA, 13 nt, Shigella flexneri 2a str. 2457T
caacccacacauu

SEQ ID NO: 3870285 - RNA, 14 nt, Shigella flexneri 2a str. 2457T
caacccagaagaaa

SEQ ID NO: 3870286 - RNA, 20 nt, Shigella flexneri 2a str. 2457T
caacccgcucuggauaauca

SEQ ID NO: 3870287 - RNA, 16 nt, Shigella flexneri 2a str. 2457T
caacccggcgaaagag

SEQ ID NO: 3870288 - RNA, 17 nt, Shigella flexneri 2a str. 2457T
caacccggcgaaagagc

SEQ ID NO: 3870289 - RNA, 20 nt, Shigella flexneri 2a str. 2457T
caacccggcgaaagagcugg

SEQ ID NO: 3870290 - RNA, 22 nt, Shigella flexneri 2a str. 2457T
caacccuaaagcacccagcaau

SEQ ID NO: 3870291 - RNA, 12 nt, Shigella flexneri 2a str. 2457T
caacccugcccu

SEQ ID NO: 3870292 - RNA, 13 nt, Shigella flexneri 2a str. 2457T
caacccuugacgc

SEQ ID NO: 3870293 - RNA, 16 nt, Shigella flexneri 2a str. 2457T
caaccgaacccagcag

SEQ ID NO: 3870294 - RNA, 19 nt, Shigella flexneri 2a str. 2457T
caaccgaacccagcagguc

SEQ ID NO: 3870295 - RNA, 15 nt, Shigella flexneri 2a str. 2457T
caaccgaagaaguaa

SEQ ID NO: 3870296 - RNA, 17 nt, Shigella flexneri 2a str. 2457T
caaccgauaucuuuccg

SEQ ID NO: 3870297 - RNA, 13 nt, Shigella flexneri 2a str. 2457T
caaccgccaccga

SEQ ID NO: 3870298 - RNA, 14 nt, Shigella flexneri 2a str. 2457T
caaccgcgacuggg

SEQ ID NO: 3870299 - RNA, 17 nt, Shigella flexneri 2a str. 2457T
caaccgcgguacgccau

SEQ ID NO: 3870300 - RNA, 17 nt, Shigella flexneri 2a str. 2457T
caaccggcgggaaaaau

SEQ ID NO: 3870301 - RNA, 19 nt, Shigella flexneri 2a str. 2457T
caaccguaaacgaucaucg

SEQ ID NO: 3870302 - RNA, 18 nt, Shigella flexneri 2a str. 2457T
caaccgucaacguucagc

SEQ ID NO: 3870303 - RNA, 23 nt, Shigella flexneri 2a str. 2457T
caaccgucaacguucagcaucug

SEQ ID NO: 3870304 - RNA, 20 nt, Shigella flexneri 2a str. 2457T
caaccgucguggucgugauc

SEQ ID NO: 3870305 - RNA, 21 nt, Shigella flexneri 2a str. 2457T
caaccguggcguaaaucaucg

SEQ ID NO: 3870306 - RNA, 17 nt, Shigella flexneri 2a str. 2457T
caaccguucggaaaaau

SEQ ID NO: 3870307 - RNA, 21 nt, Shigella flexneri 2a str. 2457T
caaccguugccgaacguaggc

SEQ ID NO: 3870308 - RNA, 14 nt, Shigella flexneri 2a str. 2457T
caaccucuucuuuu

SEQ ID NO: 3870309 - RNA, 19 nt, Shigella flexneri 2a str. 2457T
caaccugcacgaaaccacu

SEQ ID NO: 3870310 - RNA, 20 nt, Shigella flexneri 2a str. 2457T
caaccugcacguuaucagac

SEQ ID NO: 3870311 - RNA, 13 nt, Shigella flexneri 2a str. 2457T
caaccugcuggaa

SEQ ID NO: 3870312 - RNA, 18 nt, Shigella flexneri 2a str. 2457T
caaccuuauuuccagaua

SEQ ID NO: 3870313 - RNA, 20 nt, Shigella flexneri 2a str. 2457T
caaccuucuucuuucaguac

SEQ ID NO: 3870314 - RNA, 21 nt, Shigella flexneri 2a str. 2457T
caaccuucuucuuucaguacg

SEQ ID NO: 3870315 - RNA, 21 nt, Shigella flexneri 2a str. 2457T
caaccuuuuccauugccgcag

SEQ ID NO: 3870316 - RNA, 13 nt, Shigella flexneri 2a str. 2457T
caacgaagaaaac

SEQ ID NO: 3870317 - RNA, 14 nt, Shigella flexneri 2a str. 2457T
caacgaagaaaacg

SEQ ID NO: 3870318 - RNA, 18 nt, Shigella flexneri 2a str. 2457T
caacgacauacucagcgc

SEQ ID NO: 3870319 - RNA, 22 nt, Shigella flexneri 2a str. 2457T
caacgacauacucagcgccugc

SEQ ID NO: 3870320 - RNA, 14 nt, Shigella flexneri 2a str. 2457T
caacgaccagaaau

SEQ ID NO: 3870321 - RNA, 23 nt, Shigella flexneri 2a str. 2457T
caacgacgcugaugucagcacuu

SEQ ID NO: 3870322 - RNA, 18 nt, Shigella flexneri 2a str. 2457T
caacgagccaauaaaaau

SEQ ID NO: 3870323 - RNA, 16 nt, Shigella flexneri 2a str. 2457T
caacgauucaagaaac

SEQ ID NO: 3870324 - RNA, 20 nt, Shigella flexneri 2a str. 2457T
caacgcaaacgcccguccau

SEQ ID NO: 3870325 - RNA, 13 nt, Shigella flexneri 2a str. 2457T
caacgcaaagaga

SEQ ID NO: 3870326 - RNA, 22 nt, Shigella flexneri 2a str. 2457T
caacgcaauauccgccacuucu

SEQ ID NO: 3870327 - RNA, 16 nt, Shigella flexneri 2a str. 2457T
caacgcaauccccucu

SEQ ID NO: 3870328 - RNA, 18 nt, Shigella flexneri 2a str. 2457T
caacgcaucgcugcgcuu

SEQ ID NO: 3870329 - RNA, 14 nt, Shigella flexneri 2a str. 2457T
caacgccagcagca

SEQ ID NO: 3870330 - RNA, 16 nt, Shigella flexneri 2a str. 2457T
caacgccagcagcagc

SEQ ID NO: 3870331 - RNA, 14 nt, Shigella flexneri 2a str. 2457T
caacgccaucgcca

SEQ ID NO: 3870332 - RNA, 12 nt, Shigella flexneri 2a str. 2457T
caacgcccagcg

SEQ ID NO: 3870333 - RNA, 16 nt, Shigella flexneri 2a str. 2457T
caacgccccuucugcc

SEQ ID NO: 3870334 - RNA, 19 nt, Shigella flexneri 2a str. 2457T
caacgccgcauagcgacag

SEQ ID NO: 3870335 - RNA, 18 nt, Shigella flexneri 2a str. 2457T
caacgccuuugucgggca

SEQ ID NO: 3870336 - RNA, 16 nt, Shigella flexneri 2a str. 2457T
caacgcgcggaacuga

SEQ ID NO: 3870337 - RNA, 14 nt, Shigella flexneri 2a str. 2457T
caacgcgcggugau

SEQ ID NO: 3870338 - RNA, 18 nt, Shigella flexneri 2a str. 2457T
caacgcgcgugaaguggc

SEQ ID NO: 3870339 - RNA, 15 nt, Shigella flexneri 2a str. 2457T
caacgcggcacagca

SEQ ID NO: 3870340 - RNA, 15 nt, Shigella flexneri 2a str. 2457T
caacgcggcggugau

SEQ ID NO: 3870341 - RNA, 20 nt, Shigella flexneri 2a str. 2457T
caacgcguuuuuucgauauc

SEQ ID NO: 3870342 - RNA, 14 nt, Shigella flexneri 2a str. 2457T
caacgcugaauggc

SEQ ID NO: 3870343 - RNA, 11 nt, Shigella flexneri 2a str. 2457T
caacgcugucc

SEQ ID NO: 3870344 - RNA, 20 nt, Shigella flexneri 2a str. 2457T
caacgcuucauugcugaagu

SEQ ID NO: 3870345 - RNA, 19 nt, Shigella flexneri 2a str. 2457T
caacggaacgaaaaaaauc

SEQ ID NO: 3870346 - RNA, 20 nt, Shigella flexneri 2a str. 2457T
caacggaacgaaaaaaauca

SEQ ID NO: 3870347 - RNA, 20 nt, Shigella flexneri 2a str. 2457T
caacggaccaauaaacgcca

SEQ ID NO: 3870348 - RNA, 14 nt, Shigella flexneri 2a str. 2457T
caacggagcaccgu

SEQ ID NO: 3870349 - RNA, 23 nt, Shigella flexneri 2a str. 2457T
caacggaggauuuuucgcgaccg

SEQ ID NO: 3870350 - RNA, 16 nt, Shigella flexneri 2a str. 2457T
caacggaugugacgga

SEQ ID NO: 3870351 - RNA, 19 nt, Shigella flexneri 2a str. 2457T
caacggcgaaagcuggcac

SEQ ID NO: 3870352 - RNA, 23 nt, Shigella flexneri 2a str. 2457T
caacggcgaaagcuggcacuggg

SEQ ID NO: 3870353 - RNA, 18 nt, Shigella flexneri 2a str. 2457T
caacggcggaucaccgcg

SEQ ID NO: 3870354 - RNA, 18 nt, Shigella flexneri 2a str. 2457T
caacggcggcuuguacgc

SEQ ID NO: 3870355 - RNA, 22 nt, Shigella flexneri 2a str. 2457T
caacggcugcuucggucagcac

SEQ ID NO: 3870356 - RNA, 23 nt, Shigella flexneri 2a str. 2457T
caacgguuaacaguuuguuuagc

SEQ ID NO: 3870357 - RNA, 18 nt, Shigella flexneri 2a str. 2457T
caacgguugauggcaguc

SEQ ID NO: 3870358 - RNA, 18 nt, Shigella flexneri 2a str. 2457T
caacgguuugaaugaaag

SEQ ID NO: 3870359 - RNA, 13 nt, Shigella flexneri 2a str. 2457T
caacguaacaaaa

SEQ ID NO: 3870360 - RNA, 14 nt, Shigella flexneri 2a str. 2457T
caacguaacacuuu

SEQ ID NO: 3870361 - RNA, 17 nt, Shigella flexneri 2a str. 2457T
caacguagccugccauu

SEQ ID NO: 3870362 - RNA, 18 nt, Shigella flexneri 2a str. 2457T
caacguagcguuaaaacu

SEQ ID NO: 3870363 - RNA, 17 nt, Shigella flexneri 2a str. 2457T
caacguaggcacauucg

SEQ ID NO: 3870364 - RNA, 19 nt, Shigella flexneri 2a str. 2457T
caacguccauaaugcgugc

SEQ ID NO: 3870365 - RNA, 22 nt, Shigella flexneri 2a str. 2457T
caacgucuucccgagacauucc

SEQ ID NO: 3870366 - RNA, 17 nt, Shigella flexneri 2a str. 2457T
caacguggaacaaauag

SEQ ID NO: 3870367 - RNA, 18 nt, Shigella flexneri 2a str. 2457T
caacguuucgcugugauu

SEQ ID NO: 3870368 - RNA, 19 nt, Shigella flexneri 2a str. 2457T
caacuacuccaacccggca

SEQ ID NO: 3870369 - RNA, 12 nt, Shigella flexneri 2a str. 2457T
caacucacgauu

SEQ ID NO: 3870370 - RNA, 16 nt, Shigella flexneri 2a str. 2457T
caacucacgccccaga

SEQ ID NO: 3870371 - RNA, 13 nt, Shigella flexneri 2a str. 2457T
caacucaucgccg

SEQ ID NO: 3870372 - RNA, 18 nt, Shigella flexneri 2a str. 2457T
caacucauuuacagaaac

SEQ ID NO: 3870373 - RNA, 19 nt, Shigella flexneri 2a str. 2457T
caacucauuuacagaaacu

SEQ ID NO: 3870374 - RNA, 18 nt, Shigella flexneri 2a str. 2457T
caacuccacuucaccgcg

SEQ ID NO: 3870375 - RNA, 16 nt, Shigella flexneri 2a str. 2457T
caacucccuauaguag

SEQ ID NO: 3870376 - RNA, 13 nt, Shigella flexneri 2a str. 2457T
caacuccgccagc

SEQ ID NO: 3870377 - RNA, 19 nt, Shigella flexneri 2a str. 2457T
caacuccgccagcaacuga

SEQ ID NO: 3870378 - RNA, 17 nt, Shigella flexneri 2a str. 2457T
caacuccgucgcggugu

SEQ ID NO: 3870379 - RNA, 13 nt, Shigella flexneri 2a str. 2457T
caacucgcguucu

SEQ ID NO: 3870380 - RNA, 22 nt, Shigella flexneri 2a str. 2457T
caaggccguauggcgagcagga

SEQ ID NO: 3870381 - RNA, 20 nt, Shigella flexneri 2a str. 2457T
caaggcgaggggaccgcccc

SEQ ID NO: 3870382 - RNA, 21 nt, Shigella flexneri 2a str. 2457T
caaggcgaggggaccgccccu

SEQ ID NO: 3870383 - RNA, 22 nt, Shigella flexneri 2a str. 2457T
caaggcgaggggaccgccccug

SEQ ID NO: 3870384 - RNA, 20 nt, Shigella flexneri 2a str. 2457T
caaggcgcggguuucaacau

SEQ ID NO: 3870385 - RNA, 21 nt, Shigella flexneri 2a str. 2457T
caaggcgcggguuucaacauu

SEQ ID NO: 3870386 - RNA, 16 nt, Shigella flexneri 2a str. 2457T
caaggcuauucagcag

SEQ ID NO: 3870387 - RNA, 16 nt, Shigella flexneri 2a str. 2457T
caagguacgaaaaaaa

SEQ ID NO: 3870388 - RNA, 14 nt, Shigella flexneri 2a str. 2457T
caagguauugcacg

SEQ ID NO: 3870389 - RNA, 20 nt, Shigella flexneri 2a str. 2457T
caaggugauugccuuuuucg

SEQ ID NO: 3870390 - RNA, 17 nt, Shigella flexneri 2a str. 2457T
caaguaacugacaccga

SEQ ID NO: 3870391 - RNA, 12 nt, Shigella flexneri 2a str. 2457T
caaguacggcaa

SEQ ID NO: 3870392 - RNA, 12 nt, Shigella flexneri 2a str. 2457T
caaguaucuauu

SEQ ID NO: 3870393 - RNA, 13 nt, Shigella flexneri 2a str. 2457T
caaguaucuauuc

SEQ ID NO: 3870394 - RNA, 19 nt, Shigella flexneri 2a str. 2457T
caaguauucacucugcugu

SEQ ID NO: 3870395 - RNA, 20 nt, Shigella flexneri 2a str. 2457T
caagucgugaaaucugaaau

SEQ ID NO: 3870396 - RNA, 15 nt, Shigella flexneri 2a str. 2457T
caagugagucggcuu

SEQ ID NO: 3870397 - RNA, 20 nt, Shigella flexneri 2a str. 2457T
caagugagucggcuuuuuug

SEQ ID NO: 3870398 - RNA, 21 nt, Shigella flexneri 2a str. 2457T
caagugcuuucaucaaaaaau

SEQ ID NO: 3870399 - RNA, 23 nt, Shigella flexneri 2a str. 2457T
caaguucgaacgccgccaguacg

SEQ ID NO: 3870400 - RNA, 15 nt, Shigella flexneri 2a str. 2457T
caaguugauuuuucg

SEQ ID NO: 3870401 - RNA, 16 nt, Shigella flexneri 2a str. 2457T
caaguuuugucaguuc

SEQ ID NO: 3870402 - RNA, 17 nt, Shigella flexneri 2a str. 2457T
caaguuuuuaggcauga

SEQ ID NO: 3870403 - RNA, 14 nt, Shigella flexneri 2a str. 2457T
caauaaauugcgau

SEQ ID NO: 3870404 - RNA, 20 nt, Shigella flexneri 2a str. 2457T
caauaacaggauuuucuaau

SEQ ID NO: 3870405 - RNA, 18 nt, Shigella flexneri 2a str. 2457T
caauaaccaucagcucug

SEQ ID NO: 3870406 - RNA, 18 nt, Shigella flexneri 2a str. 2457T
caauaacccgcuguaaau

SEQ ID NO: 3870407 - RNA, 12 nt, Shigella flexneri 2a str. 2457T
caauaacgccau

SEQ ID NO: 3870408 - RNA, 18 nt, Shigella flexneri 2a str. 2457T
caauaacgugacggcuuu

SEQ ID NO: 3870409 - RNA, 14 nt, Shigella flexneri 2a str. 2457T
caauaacuccaucu

SEQ ID NO: 3870410 - RNA, 22 nt, Shigella flexneri 2a str. 2457T
caauaacucuuugaugaaacau

SEQ ID NO: 3870411 - RNA, 18 nt, Shigella flexneri 2a str. 2457T
caauaagcgcagccaaaa

SEQ ID NO: 3870412 - RNA, 13 nt, Shigella flexneri 2a str. 2457T
caauaaucaccgu

SEQ ID NO: 3870413 - RNA, 21 nt, Shigella flexneri 2a str. 2457T
caauaaucucuacaccaacgc

SEQ ID NO: 3870414 - RNA, 22 nt, Shigella flexneri 2a str. 2457T
caauaaucucuuuacccagcgg

SEQ ID NO: 3870415 - RNA, 23 nt, Shigella flexneri 2a str. 2457T
caauaaucucuuuacccagcgga

SEQ ID NO: 3870416 - RNA, 19 nt, Shigella flexneri 2a str. 2457T
caauaauggaaccuaacgc

SEQ ID NO: 3870417 - RNA, 16 nt, Shigella flexneri 2a str. 2457T
caauaauuaaucuggu

SEQ ID NO: 3870418 - RNA, 18 nt, Shigella flexneri 2a str. 2457T
caauaauuuuuucgccaa

SEQ ID NO: 3870419 - RNA, 18 nt, Shigella flexneri 2a str. 2457T
caauacaaccccuuagga

SEQ ID NO: 3870420 - RNA, 16 nt, Shigella flexneri 2a str. 2457T
caauacaccuccggcu

SEQ ID NO: 3870421 - RNA, 12 nt, Shigella flexneri 2a str. 2457T
caauacagccag

SEQ ID NO: 3870422 - RNA, 12 nt, Shigella flexneri 2a str. 2457T
caauacauagaa

SEQ ID NO: 3870423 - RNA, 13 nt, Shigella flexneri 2a str. 2457T
caauacaucuuuu

SEQ ID NO: 3870424 - RNA, 22 nt, Shigella flexneri 2a str. 2457T
caauaccauggcucaccagcag

SEQ ID NO: 3870425 - RNA, 16 nt, Shigella flexneri 2a str. 2457T
caauacccgcaacaau

SEQ ID NO: 3870426 - RNA, 20 nt, Shigella flexneri 2a str. 2457T
caauacccguccacacggca

SEQ ID NO: 3870427 - RNA, 15 nt, Shigella flexneri 2a str. 2457T
caauacccugaccca

SEQ ID NO: 3870428 - RNA, 22 nt, Shigella flexneri 2a str. 2457T
caauaccgcccaccaccagcga

SEQ ID NO: 3870429 - RNA, 17 nt, Shigella flexneri 2a str. 2457T
caauaccgccugacggu

SEQ ID NO: 3870430 - RNA, 16 nt, Shigella flexneri 2a str. 2457T
caauaccgccugcaaa

SEQ ID NO: 3870431 - RNA, 19 nt, Shigella flexneri 2a str. 2457T
caauaccgccugcaaauaa

SEQ ID NO: 3870432 - RNA, 20 nt, Shigella flexneri 2a str. 2457T
caauaccgccugcaaauaaa

SEQ ID NO: 3870433 - RNA, 23 nt, Shigella flexneri 2a str. 2457T
caauaccgucugcgccgagggaa

SEQ ID NO: 3870434 - RNA, 17 nt, Shigella flexneri 2a str. 2457T
caauaccuucugcgccc

SEQ ID NO: 3870435 - RNA, 22 nt, Shigella flexneri 2a str. 2457T
caauaccuucugcgcccgcccg

SEQ ID NO: 3870436 - RNA, 20 nt, Shigella flexneri 2a str. 2457T
caauacgauccugagcagcc

SEQ ID NO: 3870437 - RNA, 14 nt, Shigella flexneri 2a str. 2457T
caauacgauuaacg

SEQ ID NO: 3870438 - RNA, 16 nt, Shigella flexneri 2a str. 2457T
caauacgcauaugcau

SEQ ID NO: 3870439 - RNA, 17 nt, Shigella flexneri 2a str. 2457T
caauacgcgaggcgcua

SEQ ID NO: 3870440 - RNA, 16 nt, Shigella flexneri 2a str. 2457T
caauacuuaaccccag

SEQ ID NO: 3870441 - RNA, 21 nt, Shigella flexneri 2a str. 2457T
caauacuuucacaaaaauaau

SEQ ID NO: 3870442 - RNA, 18 nt, Shigella flexneri 2a str. 2457T
caauagcaacugauuuau

SEQ ID NO: 3870443 - RNA, 18 nt, Shigella flexneri 2a str. 2457T
caauagcgccugcugcug

SEQ ID NO: 3870444 - RNA, 15 nt, Shigella flexneri 2a str. 2457T
caauaguaaccagac

SEQ ID NO: 3870445 - RNA, 22 nt, Shigella flexneri 2a str. 2457T
caauagucaucgucgcggucgc

SEQ ID NO: 3870446 - RNA, 16 nt, Shigella flexneri 2a str. 2457T
caauagucguguuauc

SEQ ID NO: 3870447 - RNA, 18 nt, Shigella flexneri 2a str. 2457T
caauaguguugccgccac

SEQ ID NO: 3870448 - RNA, 18 nt, Shigella flexneri 2a str. 2457T
caauauauugaauuugca

SEQ ID NO: 3870449 - RNA, 19 nt, Shigella flexneri 2a str. 2457T
caauauauugcaaucaucu

SEQ ID NO: 3870450 - RNA, 13 nt, Shigella flexneri 2a str. 2457T
caauaucaaauaa

SEQ ID NO: 3870451 - RNA, 15 nt, Shigella flexneri 2a str. 2457T
caauaucaucauuug

SEQ ID NO: 3870452 - RNA, 17 nt, Shigella flexneri 2a str. 2457T
caauaucauuacgccag

SEQ ID NO: 3870453 - RNA, 15 nt, Shigella flexneri 2a str. 2457T
caauauccaacaggu

SEQ ID NO: 3870454 - RNA, 14 nt, Shigella flexneri 2a str. 2457T
caauauccauuugu

SEQ ID NO: 3870455 - RNA, 20 nt, Shigella flexneri 2a str. 2457T
caauauccugcgcuuccugc

SEQ ID NO: 3870456 - RNA, 21 nt, Shigella flexneri 2a str. 2457T
caauauccugcgcuuccugca

SEQ ID NO: 3870457 - RNA, 16 nt, Shigella flexneri 2a str. 2457T
caauaucuuccuggcg

SEQ ID NO: 3870458 - RNA, 19 nt, Shigella flexneri 2a str. 2457T
caauaugucguuauauaaa

SEQ ID NO: 3870459 - RNA, 12 nt, Shigella flexneri 2a str. 2457T
caauauuaacuc

SEQ ID NO: 3870460 - RNA, 15 nt, Shigella flexneri 2a str. 2457T
caauauuuucaaucu

SEQ ID NO: 3870461 - RNA, 17 nt, Shigella flexneri 2a str. 2457T
caauauuuucaaucugg

SEQ ID NO: 3870462 - RNA, 16 nt, Shigella flexneri 2a str. 2457T
caaucaaacucaauua

SEQ ID NO: 3870463 - RNA, 16 nt, Shigella flexneri 2a str. 2457T
caaucaaauagccugc

SEQ ID NO: 3870464 - RNA, 18 nt, Shigella flexneri 2a str. 2457T
caaucaaauauucugccc

SEQ ID NO: 3870465 - RNA, 15 nt, Shigella flexneri 2a str. 2457T
caaucaauaacagcg

SEQ ID NO: 3870466 - RNA, 13 nt, Shigella flexneri 2a str. 2457T
caaucacaaaaag

SEQ ID NO: 3870467 - RNA, 21 nt, Shigella flexneri 2a str. 2457T
caaucaccacacgaauuccaa

SEQ ID NO: 3870468 - RNA, 16 nt, Shigella flexneri 2a str. 2457T
caaucaccaccagcgg

SEQ ID NO: 3870469 - RNA, 12 nt, Shigella flexneri 2a str. 2457T
caaucaccagau

SEQ ID NO: 3870470 - RNA, 15 nt, Shigella flexneri 2a str. 2457T
caaucaccaugccgu

SEQ ID NO: 3870471 - RNA, 19 nt, Shigella flexneri 2a str. 2457T
caaucacccccaccccggc

SEQ ID NO: 3870472 - RNA, 15 nt, Shigella flexneri 2a str. 2457T
caaucaccgccagcg

SEQ ID NO: 3870473 - RNA, 19 nt, Shigella flexneri 2a str. 2457T
caaucaccgccagcggcgu

SEQ ID NO: 3870474 - RNA, 14 nt, Shigella flexneri 2a str. 2457T
caaucaccguuucu

SEQ ID NO: 3870475 - RNA, 12 nt, Shigella flexneri 2a str. 2457T
caaucacgcccg

SEQ ID NO: 3870476 - RNA, 20 nt, Shigella flexneri 2a str. 2457T
caaucacgucgcccaccgcg

SEQ ID NO: 3870477 - RNA, 23 nt, Shigella flexneri 2a str. 2457T
caauggggugacagguuuaaaca

SEQ ID NO: 3870478 - RNA, 13 nt, Shigella flexneri 2a str. 2457T
caauggguaacgg

SEQ ID NO: 3870479 - RNA, 16 nt, Shigella flexneri 2a str. 2457T
caauggguaacggcag

SEQ ID NO: 3870480 - RNA, 15 nt, Shigella flexneri 2a str. 2457T
caauggucagccaca

SEQ ID NO: 3870481 - RNA, 17 nt, Shigella flexneri 2a str. 2457T
caauggucccuugcugg

SEQ ID NO: 3870482 - RNA, 13 nt, Shigella flexneri 2a str. 2457T
caauggugaacug

SEQ ID NO: 3870483 - RNA, 22 nt, Shigella flexneri 2a str. 2457T
caauguaaggugcaucggggaa

SEQ ID NO: 3870484 - RNA, 16 nt, Shigella flexneri 2a str. 2457T
caauguaauacgcuca

SEQ ID NO: 3870485 - RNA, 14 nt, Shigella flexneri 2a str. 2457T
caauguagcgcugc

SEQ ID NO: 3870486 - RNA, 19 nt, Shigella flexneri 2a str. 2457T
caaugucauggcagucuua

SEQ ID NO: 3870487 - RNA, 20 nt, Shigella flexneri 2a str. 2457T
caaugugcuccauuguuagc

SEQ ID NO: 3870488 - RNA, 15 nt, Shigella flexneri 2a str. 2457T
caauguuauccggcu

SEQ ID NO: 3870489 - RNA, 14 nt, Shigella flexneri 2a str. 2457T
caauguuucucugg

SEQ ID NO: 3870490 - RNA, 20 nt, Shigella flexneri 2a str. 2457T
caauguuucucuggcgcgcu

SEQ ID NO: 3870491 - RNA, 11 nt, Shigella flexneri 2a str. 2457T
caauuaaauaa

SEQ ID NO: 3870492 - RNA, 13 nt, Shigella flexneri 2a str. 2457T
caauuaacaacac

SEQ ID NO: 3870493 - RNA, 15 nt, Shigella flexneri 2a str. 2457T
caauuaacgguaaua

SEQ ID NO: 3870494 - RNA, 17 nt, Shigella flexneri 2a str. 2457T
caauuaauaacacauau

SEQ ID NO: 3870495 - RNA, 19 nt, Shigella flexneri 2a str. 2457T
caauuaaugcaccaacaaa

SEQ ID NO: 3870496 - RNA, 21 nt, Shigella flexneri 2a str. 2457T
caauuaaugcaccaacaaaua

SEQ ID NO: 3870497 - RNA, 22 nt, Shigella flexneri 2a str. 2457T
caauuaaugcaccaacaaauag

SEQ ID NO: 3870498 - RNA, 17 nt, Shigella flexneri 2a str. 2457T
caauuaauucuccgcuc

SEQ ID NO: 3870499 - RNA, 14 nt, Shigella flexneri 2a str. 2457T
caauuaauugugaa

SEQ ID NO: 3870500 - RNA, 15 nt, Shigella flexneri 2a str. 2457T
caauuacaugcuggu

SEQ ID NO: 3870501 - RNA, 17 nt, Shigella flexneri 2a str. 2457T
caauuaccgccaccagg

SEQ ID NO: 3870502 - RNA, 22 nt, Shigella flexneri 2a str. 2457T
caauuaccuuccacaauggcau

SEQ ID NO: 3870503 - RNA, 19 nt, Shigella flexneri 2a str. 2457T
caauuacgccgagcgccag

SEQ ID NO: 3870504 - RNA, 20 nt, Shigella flexneri 2a str. 2457T
caauuacgccgagcgccagc

SEQ ID NO: 3870505 - RNA, 21 nt, Shigella flexneri 2a str. 2457T
caauuacugcauugaauuucu

SEQ ID NO: 3870506 - RNA, 23 nt, Shigella flexneri 2a str. 2457T
caauuagugggauucaccaaucg

SEQ ID NO: 3870507 - RNA, 15 nt, Shigella flexneri 2a str. 2457T
caauuauaauacgcu

SEQ ID NO: 3870508 - RNA, 23 nt, Shigella flexneri 2a str. 2457T
caauuauaguaucguuaaauucu

SEQ ID NO: 3870509 - RNA, 22 nt, Shigella flexneri 2a str. 2457T
caauuauuaaccuggucgcuga

SEQ ID NO: 3870510 - RNA, 20 nt, Shigella flexneri 2a str. 2457T
caauucaauuaauucuccgc

SEQ ID NO: 3870511 - RNA, 19 nt, Shigella flexneri 2a str. 2457T
caauucacgaauauuuccc

SEQ ID NO: 3870512 - RNA, 17 nt, Shigella flexneri 2a str. 2457T
caauucaguacguucac

SEQ ID NO: 3870513 - RNA, 15 nt, Shigella flexneri 2a str. 2457T
caauucauuccuuga

SEQ ID NO: 3870514 - RNA, 17 nt, Shigella flexneri 2a str. 2457T
caauuccagcaagccac

SEQ ID NO: 3870515 - RNA, 20 nt, Shigella flexneri 2a str. 2457T
caauuccagcaagccacugg

SEQ ID NO: 3870516 - RNA, 14 nt, Shigella flexneri 2a str. 2457T
caauuccagcgcca

SEQ ID NO: 3870517 - RNA, 15 nt, Shigella flexneri 2a str. 2457T
caauuccuauuuugu

SEQ ID NO: 3870518 - RNA, 23 nt, Shigella flexneri 2a str. 2457T
caauucgcguaguaaagccuuca

SEQ ID NO: 3870519 - RNA, 15 nt, Shigella flexneri 2a str. 2457T
caauucuaaauguuc

SEQ ID NO: 3870520 - RNA, 16 nt, Shigella flexneri 2a str. 2457T
caauucucucuucagc

SEQ ID NO: 3870521 - RNA, 13 nt, Shigella flexneri 2a str. 2457T
caauucuuucucg

SEQ ID NO: 3870522 - RNA, 14 nt, Shigella flexneri 2a str. 2457T
caauugacaguuua

SEQ ID NO: 3870523 - RNA, 17 nt, Shigella flexneri 2a str. 2457T
caauugacaguuuauuu

SEQ ID NO: 3870524 - RNA, 15 nt, Shigella flexneri 2a str. 2457T
caauugaccaguaau

SEQ ID NO: 3870525 - RNA, 16 nt, Shigella flexneri 2a str. 2457T
caauugaccaguaaua

SEQ ID NO: 3870526 - RNA, 17 nt, Shigella flexneri 2a str. 2457T
caauugccccccauaac

SEQ ID NO: 3870527 - RNA, 18 nt, Shigella flexneri 2a str. 2457T
caauugccgccagcucac

SEQ ID NO: 3870528 - RNA, 23 nt, Shigella flexneri 2a str. 2457T
caauugcggcaggucaucgugcg

SEQ ID NO: 3870529 - RNA, 16 nt, Shigella flexneri 2a str. 2457T
caauugcgggccaaag

SEQ ID NO: 3870530 - RNA, 21 nt, Shigella flexneri 2a str. 2457T
caauuggccugauaagacagc

SEQ ID NO: 3870531 - RNA, 18 nt, Shigella flexneri 2a str. 2457T
caauuggcgcaucaugcc

SEQ ID NO: 3870532 - RNA, 21 nt, Shigella flexneri 2a str. 2457T
caauuuaccgaccucaacaaa

SEQ ID NO: 3870533 - RNA, 14 nt, Shigella flexneri 2a str. 2457T
caauuucacguuca

SEQ ID NO: 3870534 - RNA, 21 nt, Shigella flexneri 2a str. 2457T
caauuucccgcucauagccac

SEQ ID NO: 3870535 - RNA, 22 nt, Shigella flexneri 2a str. 2457T
caauuucuucugguuucaguaa

SEQ ID NO: 3870536 - RNA, 16 nt, Shigella flexneri 2a str. 2457T
caauuugcccaccggu

SEQ ID NO: 3870537 - RNA, 19 nt, Shigella flexneri 2a str. 2457T
caauuuuaccuagcacugu

SEQ ID NO: 3870538 - RNA, 17 nt, Shigella flexneri 2a str. 2457T
caauuuuuaccgccguc

SEQ ID NO: 3870539 - RNA, 16 nt, Shigella flexneri 2a str. 2457T
cacaaaaaccgcugau

SEQ ID NO: 3870540 - RNA, 13 nt, Shigella flexneri 2a str. 2457T
cacaaaaauaauu

SEQ ID NO: 3870541 - RNA, 19 nt, Shigella flexneri 2a str. 2457T
cacaaaacacucuucaaca

SEQ ID NO: 3870542 - RNA, 13 nt, Shigella flexneri 2a str. 2457T
cacaaaaccugcc

SEQ ID NO: 3870543 - RNA, 19 nt, Shigella flexneri 2a str. 2457T
cacaaaacggauguuucuu

SEQ ID NO: 3870544 - RNA, 13 nt, Shigella flexneri 2a str. 2457T
cacaaaagacgau

SEQ ID NO: 3870545 - RNA, 14 nt, Shigella flexneri 2a str. 2457T
cacaaaagacgaua

SEQ ID NO: 3870546 - RNA, 23 nt, Shigella flexneri 2a str. 2457T
cacaaaaucacgucgauuuuuaa

SEQ ID NO: 3870547 - RNA, 14 nt, Shigella flexneri 2a str. 2457T
cacaaaaucaugag

SEQ ID NO: 3870548 - RNA, 14 nt, Shigella flexneri 2a str. 2457T
cacaaacagcgccu

SEQ ID NO: 3870549 - RNA, 20 nt, Shigella flexneri 2a str. 2457T
cacaaacgaauuaucacucu

SEQ ID NO: 3870550 - RNA, 21 nt, Shigella flexneri 2a str. 2457T
cacaaagcuguaucccagccc

SEQ ID NO: 3870551 - RNA, 19 nt, Shigella flexneri 2a str. 2457T
cacaaaggcgcgaagcugg

SEQ ID NO: 3870552 - RNA, 19 nt, Shigella flexneri 2a str. 2457T
cacaaaggcuugcugcauu

SEQ ID NO: 3870553 - RNA, 16 nt, Shigella flexneri 2a str. 2457T
cacaaauaaaaaauga

SEQ ID NO: 3870554 - RNA, 18 nt, Shigella flexneri 2a str. 2457T
cacaaauacgcuuuuucc

SEQ ID NO: 3870555 - RNA, 17 nt, Shigella flexneri 2a str. 2457T
cacaaauggcaaugacu

SEQ ID NO: 3870556 - RNA, 12 nt, Shigella flexneri 2a str. 2457T
cacaacaggcua

SEQ ID NO: 3870557 - RNA, 20 nt, Shigella flexneri 2a str. 2457T
cacaaccaccguuuuuucug

SEQ ID NO: 3870558 - RNA, 14 nt, Shigella flexneri 2a str. 2457T
cacaaccacuuugu

SEQ ID NO: 3870559 - RNA, 16 nt, Shigella flexneri 2a str. 2457T
cacaaccccggcaaau

SEQ ID NO: 3870560 - RNA, 20 nt, Shigella flexneri 2a str. 2457T
cacaacgcuuucaacaaccu

SEQ ID NO: 3870561 - RNA, 11 nt, Shigella flexneri 2a str. 2457T
cacaagacugu

SEQ ID NO: 3870562 - RNA, 22 nt, Shigella flexneri 2a str. 2457T
cacaagccaggacgcaguccag

SEQ ID NO: 3870563 - RNA, 16 nt, Shigella flexneri 2a str. 2457T
cacaagcuaccagccc

SEQ ID NO: 3870564 - RNA, 13 nt, Shigella flexneri 2a str. 2457T
cacaagcuccggc

SEQ ID NO: 3870565 - RNA, 20 nt, Shigella flexneri 2a str. 2457T
cacaaguaaaaggagauaaa

SEQ ID NO: 3870566 - RNA, 22 nt, Shigella flexneri 2a str. 2457T
cacaaguugucccauacuugca

SEQ ID NO: 3870567 - RNA, 19 nt, Shigella flexneri 2a str. 2457T
cacaaguuguuuacaguau

SEQ ID NO: 3870568 - RNA, 14 nt, Shigella flexneri 2a str. 2457T
cacaauaauuuuau

SEQ ID NO: 3870569 - RNA, 11 nt, Shigella flexneri 2a str. 2457T
cacaauaccuu

SEQ ID NO: 3870570 - RNA, 16 nt, Shigella flexneri 2a str. 2457T
cacaauagaaauauug

SEQ ID NO: 3870571 - RNA, 15 nt, Shigella flexneri 2a str. 2457T
cacaaucaaauccug

SEQ ID NO: 3870572 - RNA, 19 nt, Shigella flexneri 2a str. 2457T
cacaaucagacgcaggcgc

SEQ ID NO: 3870573 - RNA, 16 nt, Shigella flexneri 2a str. 2457T
cacaaucagccagaac

SEQ ID NO: 3870574 - RNA, 17 nt, Shigella flexneri 2a str. 2457T
cacaaucccuuaguaac

SEQ ID NO: 3870575 - RNA, 14 nt, Shigella flexneri 2a str. 2457T
cacaucaucaucgc

SEQ ID NO: 3870576 - RNA, 17 nt, Shigella flexneri 2a str. 2457T
cacaucauccggcaccu

SEQ ID NO: 3870577 - RNA, 16 nt, Shigella flexneri 2a str. 2457T
cacaucauuacaacgc

SEQ ID NO: 3870578 - RNA, 14 nt, Shigella flexneri 2a str. 2457T
cacauccaguacgc

SEQ ID NO: 3870579 - RNA, 16 nt, Shigella flexneri 2a str. 2457T
cacauccaguggcaga

SEQ ID NO: 3870580 - RNA, 18 nt, Shigella flexneri 2a str. 2457T
cacaucccagcagagauc

SEQ ID NO: 3870581 - RNA, 21 nt, Shigella flexneri 2a str. 2457T
cacauccggccaguaagcagu

SEQ ID NO: 3870582 - RNA, 22 nt, Shigella flexneri 2a str. 2457T
cacauccguggguugccagagg

SEQ ID NO: 3870583 - RNA, 15 nt, Shigella flexneri 2a str. 2457T
cacaucgcugugcug

SEQ ID NO: 3870584 - RNA, 20 nt, Shigella flexneri 2a str. 2457T
cacaucuucaauccacgguu

SEQ ID NO: 3870585 - RNA, 15 nt, Shigella flexneri 2a str. 2457T
cacaugaugauggcu

SEQ ID NO: 3870586 - RNA, 23 nt, Shigella flexneri 2a str. 2457T
cacaugaugauggcuaucaagau

SEQ ID NO: 3870587 - RNA, 14 nt, Shigella flexneri 2a str. 2457T
cacaugcaacguca

SEQ ID NO: 3870588 - RNA, 22 nt, Shigella flexneri 2a str. 2457T
cacaugcaacgucaucaccggc

SEQ ID NO: 3870589 - RNA, 19 nt, Shigella flexneri 2a str. 2457T
cacaugcaagucgaacggu

SEQ ID NO: 3870590 - RNA, 13 nt, Shigella flexneri 2a str. 2457T
cacaugcugacau

SEQ ID NO: 3870591 - RNA, 18 nt, Shigella flexneri 2a str. 2457T
cacaugcuggaaccacag

SEQ ID NO: 3870592 - RNA, 10 nt, Shigella flexneri 2a str. 2457T
cacauguugc

SEQ ID NO: 3870593 - RNA, 18 nt, Shigella flexneri 2a str. 2457T
cacauguuuauaacuucc

SEQ ID NO: 3870594 - RNA, 16 nt, Shigella flexneri 2a str. 2457T
cacauuagauaaaaau

SEQ ID NO: 3870595 - RNA, 17 nt, Shigella flexneri 2a str. 2457T
cacauuaucucaacaca

SEQ ID NO: 3870596 - RNA, 16 nt, Shigella flexneri 2a str. 2457T
cacauuccagaugugc

SEQ ID NO: 3870597 - RNA, 16 nt, Shigella flexneri 2a str. 2457T
cacauucgacaacgcc

SEQ ID NO: 3870598 - RNA, 20 nt, Shigella flexneri 2a str. 2457T
cacauugucggcaucguaau

SEQ ID NO: 3870599 - RNA, 11 nt, Shigella flexneri 2a str. 2457T
cacauuucacu

SEQ ID NO: 3870600 - RNA, 22 nt, Shigella flexneri 2a str. 2457T
cacauuucagaaaguauauaaa

SEQ ID NO: 3870601 - RNA, 11 nt, Shigella flexneri 2a str. 2457T
cacauuuuuaa

SEQ ID NO: 3870602 - RNA, 19 nt, Shigella flexneri 2a str. 2457T
caccaaaaccacagaaccu

SEQ ID NO: 3870603 - RNA, 14 nt, Shigella flexneri 2a str. 2457T
caccaaacagacca

SEQ ID NO: 3870604 - RNA, 15 nt, Shigella flexneri 2a str. 2457T
caccaaacagaccau

SEQ ID NO: 3870605 - RNA, 22 nt, Shigella flexneri 2a str. 2457T
caccaaacgggcaagccagcau

SEQ ID NO: 3870606 - RNA, 18 nt, Shigella flexneri 2a str. 2457T
caccaaacugauuuagca

SEQ ID NO: 3870607 - RNA, 23 nt, Shigella flexneri 2a str. 2457T
caccaaagaugucaccauuggca

SEQ ID NO: 3870608 - RNA, 14 nt, Shigella flexneri 2a str. 2457T
caccaaaggcacaa

SEQ ID NO: 3870609 - RNA, 16 nt, Shigella flexneri 2a str. 2457T
caccaaagggcaaagu

SEQ ID NO: 3870610 - RNA, 21 nt, Shigella flexneri 2a str. 2457T
caccaaaguguuccaucgcgu

SEQ ID NO: 3870611 - RNA, 13 nt, Shigella flexneri 2a str. 2457T
caccaacaaauag

SEQ ID NO: 3870612 - RNA, 17 nt, Shigella flexneri 2a str. 2457T
caccaacaucaugccag

SEQ ID NO: 3870613 - RNA, 14 nt, Shigella flexneri 2a str. 2457T
caccaaccgcggua

SEQ ID NO: 3870614 - RNA, 16 nt, Shigella flexneri 2a str. 2457T
caccaacgauuuuuuc

SEQ ID NO: 3870615 - RNA, 20 nt, Shigella flexneri 2a str. 2457T
caccaacgauuuuuuccgca

SEQ ID NO: 3870616 - RNA, 17 nt, Shigella flexneri 2a str. 2457T
caccaacuccacuucac

SEQ ID NO: 3870617 - RNA, 15 nt, Shigella flexneri 2a str. 2457T
caccaaggaacugug

SEQ ID NO: 3870618 - RNA, 18 nt, Shigella flexneri 2a str. 2457T
caccaauacgcauaugca

SEQ ID NO: 3870619 - RNA, 15 nt, Shigella flexneri 2a str. 2457T
caccaauagcccaug

SEQ ID NO: 3870620 - RNA, 13 nt, Shigella flexneri 2a str. 2457T
caccaauauugac

SEQ ID NO: 3870621 - RNA, 12 nt, Shigella flexneri 2a str. 2457T
caccaaucagaa

SEQ ID NO: 3870622 - RNA, 12 nt, Shigella flexneri 2a str. 2457T
caccaaucggca

SEQ ID NO: 3870623 - RNA, 11 nt, Shigella flexneri 2a str. 2457T
caccaaugacg

SEQ ID NO: 3870624 - RNA, 18 nt, Shigella flexneri 2a str. 2457T
caccaauggcuggccugg

SEQ ID NO: 3870625 - RNA, 23 nt, Shigella flexneri 2a str. 2457T
caccaauguaggccugauaagac

SEQ ID NO: 3870626 - RNA, 13 nt, Shigella flexneri 2a str. 2457T
caccacaauugac

SEQ ID NO: 3870627 - RNA, 14 nt, Shigella flexneri 2a str. 2457T
caccacacaaccga

SEQ ID NO: 3870628 - RNA, 19 nt, Shigella flexneri 2a str. 2457T
caccacagacaaucgccag

SEQ ID NO: 3870629 - RNA, 12 nt, Shigella flexneri 2a str. 2457T
caccacaggccu

SEQ ID NO: 3870630 - RNA, 12 nt, Shigella flexneri 2a str. 2457T
caccaccaaaaa

SEQ ID NO: 3870631 - RNA, 17 nt, Shigella flexneri 2a str. 2457T
caccaccaaaaacgcca

SEQ ID NO: 3870632 - RNA, 15 nt, Shigella flexneri 2a str. 2457T
caccaccaaagguua

SEQ ID NO: 3870633 - RNA, 13 nt, Shigella flexneri 2a str. 2457T
caccaccagcacc

SEQ ID NO: 3870634 - RNA, 13 nt, Shigella flexneri 2a str. 2457T
caccaccagcagc

SEQ ID NO: 3870635 - RNA, 14 nt, Shigella flexneri 2a str. 2457T
caccaccagcagcu

SEQ ID NO: 3870636 - RNA, 14 nt, Shigella flexneri 2a str. 2457T
caccaccagcgaaa

SEQ ID NO: 3870637 - RNA, 12 nt, Shigella flexneri 2a str. 2457T
caccacccagcg

SEQ ID NO: 3870638 - RNA, 22 nt, Shigella flexneri 2a str. 2457T
caccacccguacuucugaccag

SEQ ID NO: 3870639 - RNA, 22 nt, Shigella flexneri 2a str. 2457T
caccaccgacggacccgccggc

SEQ ID NO: 3870640 - RNA, 17 nt, Shigella flexneri 2a str. 2457T
caccaccgauccugaag

SEQ ID NO: 3870641 - RNA, 20 nt, Shigella flexneri 2a str. 2457T
caccaccgcaguaaucggcg

SEQ ID NO: 3870642 - RNA, 19 nt, Shigella flexneri 2a str. 2457T
caccaccuggcuugccggg

SEQ ID NO: 3870643 - RNA, 13 nt, Shigella flexneri 2a str. 2457T
caccaccugggug

SEQ ID NO: 3870644 - RNA, 22 nt, Shigella flexneri 2a str. 2457T
caccaccugggugagcgucauc

SEQ ID NO: 3870645 - RNA, 22 nt, Shigella flexneri 2a str. 2457T
caccacgacaccuuucacgccg

SEQ ID NO: 3870646 - RNA, 14 nt, Shigella flexneri 2a str. 2457T
caccacgccaagaa

SEQ ID NO: 3870647 - RNA, 15 nt, Shigella flexneri 2a str. 2457T
caccacgcuccauca

SEQ ID NO: 3870648 - RNA, 19 nt, Shigella flexneri 2a str. 2457T
caccacgcugagagaagca

SEQ ID NO: 3870649 - RNA, 19 nt, Shigella flexneri 2a str. 2457T
caccacgcuguagccgccg

SEQ ID NO: 3870650 - RNA, 18 nt, Shigella flexneri 2a str. 2457T
caccacuccccuccugca

SEQ ID NO: 3870651 - RNA, 12 nt, Shigella flexneri 2a str. 2457T
caccacuccuca

SEQ ID NO: 3870652 - RNA, 23 nt, Shigella flexneri 2a str. 2457T
caccacugcgcauaauccacuuu

SEQ ID NO: 3870653 - RNA, 18 nt, Shigella flexneri 2a str. 2457T
caccagaaacaauaagua

SEQ ID NO: 3870654 - RNA, 11 nt, Shigella flexneri 2a str. 2457T
caccagaauac

SEQ ID NO: 3870655 - RNA, 20 nt, Shigella flexneri 2a str. 2457T
caccagaaucaaucccauca

SEQ ID NO: 3870656 - RNA, 14 nt, Shigella flexneri 2a str. 2457T
caccagaaucgcca

SEQ ID NO: 3870657 - RNA, 17 nt, Shigella flexneri 2a str. 2457T
caccagaaucgccagca

SEQ ID NO: 3870658 - RNA, 20 nt, Shigella flexneri 2a str. 2457T
caccagaaucgccagcaucg

SEQ ID NO: 3870659 - RNA, 23 nt, Shigella flexneri 2a str. 2457T
caccagacaauggcccgccgcau

SEQ ID NO: 3870660 - RNA, 19 nt, Shigella flexneri 2a str. 2457T
caccagacaucccagugca

SEQ ID NO: 3870661 - RNA, 17 nt, Shigella flexneri 2a str. 2457T
caccagauggcuuucca

SEQ ID NO: 3870662 - RNA, 16 nt, Shigella flexneri 2a str. 2457T
caccagcaaauccagc

SEQ ID NO: 3870663 - RNA, 16 nt, Shigella flexneri 2a str. 2457T
caccagcaacaagcca

SEQ ID NO: 3870664 - RNA, 18 nt, Shigella flexneri 2a str. 2457T
caccagcaacaagccagu

SEQ ID NO: 3870665 - RNA, 21 nt, Shigella flexneri 2a str. 2457T
caccagcaauaaugccagucc

SEQ ID NO: 3870666 - RNA, 14 nt, Shigella flexneri 2a str. 2457T
caccagcaccagcg

SEQ ID NO: 3870667 - RNA, 22 nt, Shigella flexneri 2a str. 2457T
caccagcacuucacugacauug

SEQ ID NO: 3870668 - RNA, 22 nt, Shigella flexneri 2a str. 2457T
caccagcaguaaaccacccacc

SEQ ID NO: 3870669 - RNA, 16 nt, Shigella flexneri 2a str. 2457T
caccagccaccgcguu

SEQ ID NO: 3870670 - RNA, 23 nt, Shigella flexneri 2a str. 2457T
caccagccauuaaccagccacug

SEQ ID NO: 3870671 - RNA, 15 nt, Shigella flexneri 2a str. 2457T
caccagcgaaaguaa

SEQ ID NO: 3870672 - RNA, 23 nt, Shigella flexneri 2a str. 2457T
caccagcgaaaguaacaccaucc

SEQ ID NO: 3870673 - RNA, 13 nt, Shigella flexneri 2a str. 2457T
caccgcaccgccc

SEQ ID NO: 3870674 - RNA, 17 nt, Shigella flexneri 2a str. 2457T
caccgcaccuaaaaauu

SEQ ID NO: 3870675 - RNA, 21 nt, Shigella flexneri 2a str. 2457T
caccgcaccuguaauacggcu

SEQ ID NO: 3870676 - RNA, 19 nt, Shigella flexneri 2a str. 2457T
caccgcagagaucgccccg

SEQ ID NO: 3870677 - RNA, 18 nt, Shigella flexneri 2a str. 2457T
caccgcagcaucgucauc

SEQ ID NO: 3870678 - RNA, 12 nt, Shigella flexneri 2a str. 2457T
caccgcagccgc

SEQ ID NO: 3870679 - RNA, 14 nt, Shigella flexneri 2a str. 2457T
caccgcaguaaucg

SEQ ID NO: 3870680 - RNA, 15 nt, Shigella flexneri 2a str. 2457T
caccgcaucaauauu

SEQ ID NO: 3870681 - RNA, 14 nt, Shigella flexneri 2a str. 2457T
caccgccaaagaua

SEQ ID NO: 3870682 - RNA, 23 nt, Shigella flexneri 2a str. 2457T
caccgccaaagauaaaauaacca

SEQ ID NO: 3870683 - RNA, 20 nt, Shigella flexneri 2a str. 2457T
caccgcccuccgguccgccg

SEQ ID NO: 3870684 - RNA, 15 nt, Shigella flexneri 2a str. 2457T
caccgccgauaccga

SEQ ID NO: 3870685 - RNA, 15 nt, Shigella flexneri 2a str. 2457T
caccgccgccgccac

SEQ ID NO: 3870686 - RNA, 22 nt, Shigella flexneri 2a str. 2457T
caccgccguuaccuucggcccc

SEQ ID NO: 3870687 - RNA, 19 nt, Shigella flexneri 2a str. 2457T
caccgcgaauuuuuucgca

SEQ ID NO: 3870688 - RNA, 21 nt, Shigella flexneri 2a str. 2457T
caccgcgacaaucagguaagc

SEQ ID NO: 3870689 - RNA, 19 nt, Shigella flexneri 2a str. 2457T
caccgcgaucuuccacgcc

SEQ ID NO: 3870690 - RNA, 21 nt, Shigella flexneri 2a str. 2457T
caccgcgugagaacaccaccu

SEQ ID NO: 3870691 - RNA, 22 nt, Shigella flexneri 2a str. 2457T
caccgcguucagcagcucauca

SEQ ID NO: 3870692 - RNA, 23 nt, Shigella flexneri 2a str. 2457T
caccgcguuccacggggacucca

SEQ ID NO: 3870693 - RNA, 20 nt, Shigella flexneri 2a str. 2457T
caccgcuucacucccugccc

SEQ ID NO: 3870694 - RNA, 23 nt, Shigella flexneri 2a str. 2457T
caccggaacaacccagcggauga

SEQ ID NO: 3870695 - RNA, 20 nt, Shigella flexneri 2a str. 2457T
caccggaaccgucgcgccag

SEQ ID NO: 3870696 - RNA, 22 nt, Shigella flexneri 2a str. 2457T
caccggaauaaugaugucucug

SEQ ID NO: 3870697 - RNA, 13 nt, Shigella flexneri 2a str. 2457T
caccggaccagac

SEQ ID NO: 3870698 - RNA, 18 nt, Shigella flexneri 2a str. 2457T
caccggacggacuuccag

SEQ ID NO: 3870699 - RNA, 19 nt, Shigella flexneri 2a str. 2457T
caccggauaauuccggcuu

SEQ ID NO: 3870700 - RNA, 13 nt, Shigella flexneri 2a str. 2457T
caccggcaccacu

SEQ ID NO: 3870701 - RNA, 17 nt, Shigella flexneri 2a str. 2457T
caccggcgacccgcgac

SEQ ID NO: 3870702 - RNA, 19 nt, Shigella flexneri 2a str. 2457T
caccgggcagacgugacca

SEQ ID NO: 3870703 - RNA, 15 nt, Shigella flexneri 2a str. 2457T
caccgggccgaugcg

SEQ ID NO: 3870704 - RNA, 20 nt, Shigella flexneri 2a str. 2457T
caccggggacaggcgggcca

SEQ ID NO: 3870705 - RNA, 16 nt, Shigella flexneri 2a str. 2457T
caccggguaccagaau

SEQ ID NO: 3870706 - RNA, 14 nt, Shigella flexneri 2a str. 2457T
caccgggugcagac

SEQ ID NO: 3870707 - RNA, 22 nt, Shigella flexneri 2a str. 2457T
caccgguacaaacaucauccag

SEQ ID NO: 3870708 - RNA, 22 nt, Shigella flexneri 2a str. 2457T
caccguaacgaacacggaucag

SEQ ID NO: 3870709 - RNA, 18 nt, Shigella flexneri 2a str. 2457T
caccguaauaguuucuga

SEQ ID NO: 3870710 - RNA, 18 nt, Shigella flexneri 2a str. 2457T
caccguaccaucguaagc

SEQ ID NO: 3870711 - RNA, 17 nt, Shigella flexneri 2a str. 2457T
caccguauugcgccggu

SEQ ID NO: 3870712 - RNA, 20 nt, Shigella flexneri 2a str. 2457T
caccguauugcgccgguuua

SEQ ID NO: 3870713 - RNA, 17 nt, Shigella flexneri 2a str. 2457T
caccgucaaacacagca

SEQ ID NO: 3870714 - RNA, 18 nt, Shigella flexneri 2a str. 2457T
caccgucaaacacagcac

SEQ ID NO: 3870715 - RNA, 15 nt, Shigella flexneri 2a str. 2457T
caccgucacuucuuc

SEQ ID NO: 3870716 - RNA, 20 nt, Shigella flexneri 2a str. 2457T
caccgucagcguacaggacg

SEQ ID NO: 3870717 - RNA, 22 nt, Shigella flexneri 2a str. 2457T
caccgucaucgacaaaaacccu

SEQ ID NO: 3870718 - RNA, 18 nt, Shigella flexneri 2a str. 2457T
caccgugauccgccgcug

SEQ ID NO: 3870719 - RNA, 15 nt, Shigella flexneri 2a str. 2457T
caccguguucaugac

SEQ ID NO: 3870720 - RNA, 21 nt, Shigella flexneri 2a str. 2457T
caccguguucaugaccgugau

SEQ ID NO: 3870721 - RNA, 22 nt, Shigella flexneri 2a str. 2457T
caccguguucaugaccgugauc

SEQ ID NO: 3870722 - RNA, 12 nt, Shigella flexneri 2a str. 2457T
caccguuaaaua

SEQ ID NO: 3870723 - RNA, 16 nt, Shigella flexneri 2a str. 2457T
caccguuuaggcguca

SEQ ID NO: 3870724 - RNA, 21 nt, Shigella flexneri 2a str. 2457T
caccguuucuacaagcagaga

SEQ ID NO: 3870725 - RNA, 23 nt, Shigella flexneri 2a str. 2457T
caccguuucuacaagcagagaga

SEQ ID NO: 3870726 - RNA, 20 nt, Shigella flexneri 2a str. 2457T
caccguuucuuugccgagga

SEQ ID NO: 3870727 - RNA, 21 nt, Shigella flexneri 2a str. 2457T
caccguuuuugccgaugucuc

SEQ ID NO: 3870728 - RNA, 18 nt, Shigella flexneri 2a str. 2457T
caccucaguacccgcguu

SEQ ID NO: 3870729 - RNA, 15 nt, Shigella flexneri 2a str. 2457T
caccucaucaccaca

SEQ ID NO: 3870730 - RNA, 20 nt, Shigella flexneri 2a str. 2457T
caccucaucaccacagacaa

SEQ ID NO: 3870731 - RNA, 21 nt, Shigella flexneri 2a str. 2457T
caccucaucaccacagacaaa

SEQ ID NO: 3870732 - RNA, 12 nt, Shigella flexneri 2a str. 2457T
caccucaucaga

SEQ ID NO: 3870733 - RNA, 20 nt, Shigella flexneri 2a str. 2457T
caccucccgucgcccacacc

SEQ ID NO: 3870734 - RNA, 21 nt, Shigella flexneri 2a str. 2457T
caccucccgucgcccacacca

SEQ ID NO: 3870735 - RNA, 15 nt, Shigella flexneri 2a str. 2457T
caccucucgcccgcu

SEQ ID NO: 3870736 - RNA, 19 nt, Shigella flexneri 2a str. 2457T
caccucugucgaugcgcuc

SEQ ID NO: 3870737 - RNA, 14 nt, Shigella flexneri 2a str. 2457T
caccucuuuuucca

SEQ ID NO: 3870738 - RNA, 23 nt, Shigella flexneri 2a str. 2457T
caccucuuuuuccacuuccacca

SEQ ID NO: 3870739 - RNA, 19 nt, Shigella flexneri 2a str. 2457T
caccugauccagcucuucu

SEQ ID NO: 3870740 - RNA, 19 nt, Shigella flexneri 2a str. 2457T
caccugauugaccgccagc

SEQ ID NO: 3870741 - RNA, 23 nt, Shigella flexneri 2a str. 2457T
caccugauugaccgccagcgcca

SEQ ID NO: 3870742 - RNA, 20 nt, Shigella flexneri 2a str. 2457T
caccugcacaccaaccgcuu

SEQ ID NO: 3870743 - RNA, 14 nt, Shigella flexneri 2a str. 2457T
caccugcacaugca

SEQ ID NO: 3870744 - RNA, 15 nt, Shigella flexneri 2a str. 2457T
caccugcacaugcaa

SEQ ID NO: 3870745 - RNA, 20 nt, Shigella flexneri 2a str. 2457T
caccugcgcaggcauucaga

SEQ ID NO: 3870746 - RNA, 22 nt, Shigella flexneri 2a str. 2457T
caccugcucgucauccgccagu

SEQ ID NO: 3870747 - RNA, 14 nt, Shigella flexneri 2a str. 2457T
caccugcugauuau

SEQ ID NO: 3870748 - RNA, 12 nt, Shigella flexneri 2a str. 2457T
caccugcuggac

SEQ ID NO: 3870749 - RNA, 21 nt, Shigella flexneri 2a str. 2457T
caccuggcgcauuaacggcaa

SEQ ID NO: 3870750 - RNA, 11 nt, Shigella flexneri 2a str. 2457T
caccuggcgcu

SEQ ID NO: 3870751 - RNA, 16 nt, Shigella flexneri 2a str. 2457T
caccuggggcuugcca

SEQ ID NO: 3870752 - RNA, 17 nt, Shigella flexneri 2a str. 2457T
caccuggggcuugccag

SEQ ID NO: 3870753 - RNA, 16 nt, Shigella flexneri 2a str. 2457T
caccuguaccagcccg

SEQ ID NO: 3870754 - RNA, 23 nt, Shigella flexneri 2a str. 2457T
caccuguaguguguugcaauaca

SEQ ID NO: 3870755 - RNA, 22 nt, Shigella flexneri 2a str. 2457T
caccuguugccauuucugcugc

SEQ ID NO: 3870756 - RNA, 19 nt, Shigella flexneri 2a str. 2457T
caccuguugcgcgucgccc

SEQ ID NO: 3870757 - RNA, 22 nt, Shigella flexneri 2a str. 2457T
caccuuacggcacuccucuuca

SEQ ID NO: 3870758 - RNA, 14 nt, Shigella flexneri 2a str. 2457T
caccuucuggcgac

SEQ ID NO: 3870759 - RNA, 12 nt, Shigella flexneri 2a str. 2457T
caccuuuaaccu

SEQ ID NO: 3870760 - RNA, 19 nt, Shigella flexneri 2a str. 2457T
caccuuucacgccgaagug

SEQ ID NO: 3870761 - RNA, 18 nt, Shigella flexneri 2a str. 2457T
cacgaaaccgacugccau

SEQ ID NO: 3870762 - RNA, 22 nt, Shigella flexneri 2a str. 2457T
cacgaacacagugguuuuaacg

SEQ ID NO: 3870763 - RNA, 16 nt, Shigella flexneri 2a str. 2457T
cacgaaccagagacag

SEQ ID NO: 3870764 - RNA, 18 nt, Shigella flexneri 2a str. 2457T
cacgaaccguaaaagccu

SEQ ID NO: 3870765 - RNA, 21 nt, Shigella flexneri 2a str. 2457T
cacgaaccgucccucgccccu

SEQ ID NO: 3870766 - RNA, 13 nt, Shigella flexneri 2a str. 2457T
cacgaagcauugc

SEQ ID NO: 3870767 - RNA, 15 nt, Shigella flexneri 2a str. 2457T
cacgaaggugcauug

SEQ ID NO: 3870768 - RNA, 13 nt, Shigella flexneri 2a str. 2457T
cacgaauauuucc

SEQ ID NO: 3870769 - RNA, 15 nt, Shigella flexneri 2a str. 2457T
cacgaauucaacgcg

SEQ ID NO: 3870770 - RNA, 14 nt, Shigella flexneri 2a str. 2457T
cacgguauuugcca

SEQ ID NO: 3870771 - RNA, 23 nt, Shigella flexneri 2a str. 2457T
cacggugaagaagcggaaaucac

SEQ ID NO: 3870772 - RNA, 13 nt, Shigella flexneri 2a str. 2457T
cacggugucggua

SEQ ID NO: 3870773 - RNA, 14 nt, Shigella flexneri 2a str. 2457T
cacggugucgguau

SEQ ID NO: 3870774 - RNA, 22 nt, Shigella flexneri 2a str. 2457T
cacgguuacggccuucggucag

SEQ ID NO: 3870775 - RNA, 13 nt, Shigella flexneri 2a str. 2457T
cacgguucuccac

SEQ ID NO: 3870776 - RNA, 13 nt, Shigella flexneri 2a str. 2457T
cacguaccacggc

SEQ ID NO: 3870777 - RNA, 14 nt, Shigella flexneri 2a str. 2457T
cacguaccacggca

SEQ ID NO: 3870778 - RNA, 15 nt, Shigella flexneri 2a str. 2457T
cacguaccagaugca

SEQ ID NO: 3870779 - RNA, 19 nt, Shigella flexneri 2a str. 2457T
cacguaccagaugcaucac

SEQ ID NO: 3870780 - RNA, 14 nt, Shigella flexneri 2a str. 2457T
cacguaccaugcgc

SEQ ID NO: 3870781 - RNA, 15 nt, Shigella flexneri 2a str. 2457T
cacguaggccggaua

SEQ ID NO: 3870782 - RNA, 17 nt, Shigella flexneri 2a str. 2457T
cacgucaggaucgugcg

SEQ ID NO: 3870783 - RNA, 16 nt, Shigella flexneri 2a str. 2457T
cacgucaucacguccc

SEQ ID NO: 3870784 - RNA, 15 nt, Shigella flexneri 2a str. 2457T
cacgucaucagcaau

SEQ ID NO: 3870785 - RNA, 20 nt, Shigella flexneri 2a str. 2457T
cacguccacggugaggcgau

SEQ ID NO: 3870786 - RNA, 20 nt, Shigella flexneri 2a str. 2457T
cacguccgguggcauccgca

SEQ ID NO: 3870787 - RNA, 14 nt, Shigella flexneri 2a str. 2457T
cacgucguucgggc

SEQ ID NO: 3870788 - RNA, 13 nt, Shigella flexneri 2a str. 2457T
cacguucacccau

SEQ ID NO: 3870789 - RNA, 17 nt, Shigella flexneri 2a str. 2457T
cacguucaucccacucu

SEQ ID NO: 3870790 - RNA, 17 nt, Shigella flexneri 2a str. 2457T
cacguuccccagaugcg

SEQ ID NO: 3870791 - RNA, 18 nt, Shigella flexneri 2a str. 2457T
cacguugccguaugcgcc

SEQ ID NO: 3870792 - RNA, 14 nt, Shigella flexneri 2a str. 2457T
cacguugcugcggc

SEQ ID NO: 3870793 - RNA, 20 nt, Shigella flexneri 2a str. 2457T
cacguugcugcggcguuccc

SEQ ID NO: 3870794 - RNA, 20 nt, Shigella flexneri 2a str. 2457T
cacguugucagcaaccugcu

SEQ ID NO: 3870795 - RNA, 16 nt, Shigella flexneri 2a str. 2457T
cacguuuaacacgcuc

SEQ ID NO: 3870796 - RNA, 16 nt, Shigella flexneri 2a str. 2457T
cacguuuucucaaguc

SEQ ID NO: 3870797 - RNA, 20 nt, Shigella flexneri 2a str. 2457T
cacuaaacccgaccacuucc

SEQ ID NO: 3870798 - RNA, 16 nt, Shigella flexneri 2a str. 2457T
cacuaacagaacaaua

SEQ ID NO: 3870799 - RNA, 15 nt, Shigella flexneri 2a str. 2457T
cacuaacgcauugaa

SEQ ID NO: 3870800 - RNA, 20 nt, Shigella flexneri 2a str. 2457T
cacuaacgcauugaacucuu

SEQ ID NO: 3870801 - RNA, 21 nt, Shigella flexneri 2a str. 2457T
cacuaacgcauugaacucuuc

SEQ ID NO: 3870802 - RNA, 18 nt, Shigella flexneri 2a str. 2457T
cacuaacgcgucuuaucu

SEQ ID NO: 3870803 - RNA, 22 nt, Shigella flexneri 2a str. 2457T
cacuaagaauguccauuauuuc

SEQ ID NO: 3870804 - RNA, 21 nt, Shigella flexneri 2a str. 2457T
cacuaccauuuguucuuuuuu

SEQ ID NO: 3870805 - RNA, 15 nt, Shigella flexneri 2a str. 2457T
cacuacccauauuua

SEQ ID NO: 3870806 - RNA, 16 nt, Shigella flexneri 2a str. 2457T
cacuaccggaacccac

SEQ ID NO: 3870807 - RNA, 16 nt, Shigella flexneri 2a str. 2457T
cacuaccguaauagug

SEQ ID NO: 3870808 - RNA, 23 nt, Shigella flexneri 2a str. 2457T
cacuagguuuucgucguacugac

SEQ ID NO: 3870809 - RNA, 20 nt, Shigella flexneri 2a str. 2457T
cacuauacaaccagauaacc

SEQ ID NO: 3870810 - RNA, 20 nt, Shigella flexneri 2a str. 2457T
cacuaucccaacaacucuuc

SEQ ID NO: 3870811 - RNA, 17 nt, Shigella flexneri 2a str. 2457T
cacuaucgaaaguuuac

SEQ ID NO: 3870812 - RNA, 12 nt, Shigella flexneri 2a str. 2457T
cacuaucgcuga

SEQ ID NO: 3870813 - RNA, 15 nt, Shigella flexneri 2a str. 2457T
cacuauuauauucug

SEQ ID NO: 3870814 - RNA, 18 nt, Shigella flexneri 2a str. 2457T
cacuauucgccagcacgg

SEQ ID NO: 3870815 - RNA, 18 nt, Shigella flexneri 2a str. 2457T
cacucaacaaccagaagg

SEQ ID NO: 3870816 - RNA, 14 nt, Shigella flexneri 2a str. 2457T
cacucacccgcuag

SEQ ID NO: 3870817 - RNA, 11 nt, Shigella flexneri 2a str. 2457T
cacucaccgca

SEQ ID NO: 3870818 - RNA, 15 nt, Shigella flexneri 2a str. 2457T
cacucaccgccguua

SEQ ID NO: 3870819 - RNA, 16 nt, Shigella flexneri 2a str. 2457T
cacucaucacuccccg

SEQ ID NO: 3870820 - RNA, 17 nt, Shigella flexneri 2a str. 2457T
cacucaucgcaucgccu

SEQ ID NO: 3870821 - RNA, 21 nt, Shigella flexneri 2a str. 2457T
cacucaucuuauugaucaucc

SEQ ID NO: 3870822 - RNA, 22 nt, Shigella flexneri 2a str. 2457T
cacucaugauccuggauuuccu

SEQ ID NO: 3870823 - RNA, 16 nt, Shigella flexneri 2a str. 2457T
cacuccagccagagcc

SEQ ID NO: 3870824 - RNA, 14 nt, Shigella flexneri 2a str. 2457T
cacuccauccagca

SEQ ID NO: 3870825 - RNA, 17 nt, Shigella flexneri 2a str. 2457T
cacuccccgcaacagug

SEQ ID NO: 3870826 - RNA, 23 nt, Shigella flexneri 2a str. 2457T
cacucccggauaaaucuccauuu

SEQ ID NO: 3870827 - RNA, 16 nt, Shigella flexneri 2a str. 2457T
cacuccggccagagca

SEQ ID NO: 3870828 - RNA, 21 nt, Shigella flexneri 2a str. 2457T
cacuccgguaauaucgcgcag

SEQ ID NO: 3870829 - RNA, 16 nt, Shigella flexneri 2a str. 2457T
cacucgccccgagaaa

SEQ ID NO: 3870830 - RNA, 17 nt, Shigella flexneri 2a str. 2457T
cacucgcccugaccugc

SEQ ID NO: 3870831 - RNA, 22 nt, Shigella flexneri 2a str. 2457T
cacucgcugcagguauugcuuc

SEQ ID NO: 3870832 - RNA, 17 nt, Shigella flexneri 2a str. 2457T
cacucgcuguggcagcg

SEQ ID NO: 3870833 - RNA, 19 nt, Shigella flexneri 2a str. 2457T
cacucggggcuuuucucua

SEQ ID NO: 3870834 - RNA, 15 nt, Shigella flexneri 2a str. 2457T
cacucggugucguua

SEQ ID NO: 3870835 - RNA, 16 nt, Shigella flexneri 2a str. 2457T
cacucguaagaggcgu

SEQ ID NO: 3870836 - RNA, 17 nt, Shigella flexneri 2a str. 2457T
cacucgugcgucgcauc

SEQ ID NO: 3870837 - RNA, 22 nt, Shigella flexneri 2a str. 2457T
cacucgugcgucgcauccggca

SEQ ID NO: 3870838 - RNA, 19 nt, Shigella flexneri 2a str. 2457T
cacucuacauguguucagc

SEQ ID NO: 3870839 - RNA, 22 nt, Shigella flexneri 2a str. 2457T
cacucucaccacgcuccaucau

SEQ ID NO: 3870840 - RNA, 20 nt, Shigella flexneri 2a str. 2457T
cacucuccaggaaacccggg

SEQ ID NO: 3870841 - RNA, 15 nt, Shigella flexneri 2a str. 2457T
cacucugaaaacgcu

SEQ ID NO: 3870842 - RNA, 17 nt, Shigella flexneri 2a str. 2457T
cacucugaaaacgcugu

SEQ ID NO: 3870843 - RNA, 12 nt, Shigella flexneri 2a str. 2457T
cacucugacgga

SEQ ID NO: 3870844 - RNA, 22 nt, Shigella flexneri 2a str. 2457T
cacucugccguaccaucgccag

SEQ ID NO: 3870845 - RNA, 12 nt, Shigella flexneri 2a str. 2457T
cacucuucaaca

SEQ ID NO: 3870846 - RNA, 16 nt, Shigella flexneri 2a str. 2457T
cacucuuuauugagau

SEQ ID NO: 3870847 - RNA, 15 nt, Shigella flexneri 2a str. 2457T
cacucuuucagcacc

SEQ ID NO: 3870848 - RNA, 14 nt, Shigella flexneri 2a str. 2457T
cacugaaagccgca

SEQ ID NO: 3870849 - RNA, 20 nt, Shigella flexneri 2a str. 2457T
cacugaaccgaaauggcugc

SEQ ID NO: 3870850 - RNA, 21 nt, Shigella flexneri 2a str. 2457T
cacugaauagugccacaccag

SEQ ID NO: 3870851 - RNA, 20 nt, Shigella flexneri 2a str. 2457T
cacugaaugccggaugcggc

SEQ ID NO: 3870852 - RNA, 14 nt, Shigella flexneri 2a str. 2457T
cacugacaccagca

SEQ ID NO: 3870853 - RNA, 16 nt, Shigella flexneri 2a str. 2457T
cacugacgggaaacuc

SEQ ID NO: 3870854 - RNA, 20 nt, Shigella flexneri 2a str. 2457T
cacugagucagcccaacaaa

SEQ ID NO: 3870855 - RNA, 21 nt, Shigella flexneri 2a str. 2457T
cacugauauggugguaacuac

SEQ ID NO: 3870856 - RNA, 16 nt, Shigella flexneri 2a str. 2457T
cacugaugacaggcua

SEQ ID NO: 3870857 - RNA, 22 nt, Shigella flexneri 2a str. 2457T
cacugcaaauacccaaaaaaua

SEQ ID NO: 3870858 - RNA, 15 nt, Shigella flexneri 2a str. 2457T
cacugcaacagcugu

SEQ ID NO: 3870859 - RNA, 15 nt, Shigella flexneri 2a str. 2457T
cacugcaucaaugcc

SEQ ID NO: 3870860 - RNA, 20 nt, Shigella flexneri 2a str. 2457T
cacugccagaauagccgcag

SEQ ID NO: 3870861 - RNA, 13 nt, Shigella flexneri 2a str. 2457T
cacugccagauuc

SEQ ID NO: 3870862 - RNA, 19 nt, Shigella flexneri 2a str. 2457T
cacugcccacgcgcacgcu

SEQ ID NO: 3870863 - RNA, 17 nt, Shigella flexneri 2a str. 2457T
cacugccguacagacag

SEQ ID NO: 3870864 - RNA, 16 nt, Shigella flexneri 2a str. 2457T
cacugccguacaggca

SEQ ID NO: 3870865 - RNA, 17 nt, Shigella flexneri 2a str. 2457T
cacugccguacaggcag

SEQ ID NO: 3870866 - RNA, 21 nt, Shigella flexneri 2a str. 2457T
cacugccugucacggcgcaug

SEQ ID NO: 3870867 - RNA, 13 nt, Shigella flexneri 2a str. 2457T
cacugcgagaaaa

SEQ ID NO: 3870868 - RNA, 14 nt, Shigella flexneri 2a str. 2457T
cagaaagucauggc

SEQ ID NO: 3870869 - RNA, 23 nt, Shigella flexneri 2a str. 2457T
cagaaaguuuuucaacaccauga

SEQ ID NO: 3870870 - RNA, 16 nt, Shigella flexneri 2a str. 2457T
cagaaauaaaaccggu

SEQ ID NO: 3870871 - RNA, 17 nt, Shigella flexneri 2a str. 2457T
cagaaauagaaagugac

SEQ ID NO: 3870872 - RNA, 13 nt, Shigella flexneri 2a str. 2457T
cagaaaucagcuu

SEQ ID NO: 3870873 - RNA, 16 nt, Shigella flexneri 2a str. 2457T
cagaaaucggccuucc

SEQ ID NO: 3870874 - RNA, 17 nt, Shigella flexneri 2a str. 2457T
cagaaaucggccuucca

SEQ ID NO: 3870875 - RNA, 12 nt, Shigella flexneri 2a str. 2457T
cagaaaugccag

SEQ ID NO: 3870876 - RNA, 20 nt, Shigella flexneri 2a str. 2457T
cagaaaugccaguaacucau

SEQ ID NO: 3870877 - RNA, 14 nt, Shigella flexneri 2a str. 2457T
cagaaauggcccaa

SEQ ID NO: 3870878 - RNA, 20 nt, Shigella flexneri 2a str. 2457T
cagaaaugguaaagaaggca

SEQ ID NO: 3870879 - RNA, 20 nt, Shigella flexneri 2a str. 2457T
cagaaauggucggugaccug

SEQ ID NO: 3870880 - RNA, 18 nt, Shigella flexneri 2a str. 2457T
cagaaauucguaauccau

SEQ ID NO: 3870881 - RNA, 21 nt, Shigella flexneri 2a str. 2457T
cagaaauugaccccagccagu

SEQ ID NO: 3870882 - RNA, 18 nt, Shigella flexneri 2a str. 2457T
cagaaauuuggcuccucu

SEQ ID NO: 3870883 - RNA, 19 nt, Shigella flexneri 2a str. 2457T
cagaaauuuggcuccucug

SEQ ID NO: 3870884 - RNA, 12 nt, Shigella flexneri 2a str. 2457T
cagaacaacccg

SEQ ID NO: 3870885 - RNA, 20 nt, Shigella flexneri 2a str. 2457T
cagaacacgcucccagcaga

SEQ ID NO: 3870886 - RNA, 22 nt, Shigella flexneri 2a str. 2457T
cagaacacuguuaccgcugcug

SEQ ID NO: 3870887 - RNA, 14 nt, Shigella flexneri 2a str. 2457T
cagaacagugccau

SEQ ID NO: 3870888 - RNA, 20 nt, Shigella flexneri 2a str. 2457T
cagaaccagggaaaaaagcc

SEQ ID NO: 3870889 - RNA, 16 nt, Shigella flexneri 2a str. 2457T
cagaaccgccaucaug

SEQ ID NO: 3870890 - RNA, 15 nt, Shigella flexneri 2a str. 2457T
cagaaccgcuucuuc

SEQ ID NO: 3870891 - RNA, 17 nt, Shigella flexneri 2a str. 2457T
cagaacgaccaguucac

SEQ ID NO: 3870892 - RNA, 21 nt, Shigella flexneri 2a str. 2457T
cagaacgcgccuuaaaaacca

SEQ ID NO: 3870893 - RNA, 21 nt, Shigella flexneri 2a str. 2457T
cagaacgguucuugaaaauca

SEQ ID NO: 3870894 - RNA, 17 nt, Shigella flexneri 2a str. 2457T
cagaacuaaaagauggc

SEQ ID NO: 3870895 - RNA, 17 nt, Shigella flexneri 2a str. 2457T
cagaacuacccgguucg

SEQ ID NO: 3870896 - RNA, 13 nt, Shigella flexneri 2a str. 2457T
cagaacuucgcua

SEQ ID NO: 3870897 - RNA, 22 nt, Shigella flexneri 2a str. 2457T
cagaacuucgcuaacaaucuca

SEQ ID NO: 3870898 - RNA, 23 nt, Shigella flexneri 2a str. 2457T
cagaacuucugguaacagcggac

SEQ ID NO: 3870899 - RNA, 17 nt, Shigella flexneri 2a str. 2457T
cagaagacgcuccagug

SEQ ID NO: 3870900 - RNA, 23 nt, Shigella flexneri 2a str. 2457T
cagaagacgcuccaguguggcca

SEQ ID NO: 3870901 - RNA, 18 nt, Shigella flexneri 2a str. 2457T
cagaagaugcguucaccu

SEQ ID NO: 3870902 - RNA, 16 nt, Shigella flexneri 2a str. 2457T
cagaagcacugccaga

SEQ ID NO: 3870903 - RNA, 23 nt, Shigella flexneri 2a str. 2457T
cagaagcaugaacauugcugcug

SEQ ID NO: 3870904 - RNA, 20 nt, Shigella flexneri 2a str. 2457T
cagaagcauuuuacauccug

SEQ ID NO: 3870905 - RNA, 22 nt, Shigella flexneri 2a str. 2457T
cagaagcauuuuacauccugau

SEQ ID NO: 3870906 - RNA, 23 nt, Shigella flexneri 2a str. 2457T
cagaagcauuuuacauccugaua

SEQ ID NO: 3870907 - RNA, 21 nt, Shigella flexneri 2a str. 2457T
cagaagcgcagaucgaacacg

SEQ ID NO: 3870908 - RNA, 13 nt, Shigella flexneri 2a str. 2457T
cagaagcugcagg

SEQ ID NO: 3870909 - RNA, 20 nt, Shigella flexneri 2a str. 2457T
cagaagcugcaggaccauac

SEQ ID NO: 3870910 - RNA, 19 nt, Shigella flexneri 2a str. 2457T
cagaaggagcuaauaauga

SEQ ID NO: 3870911 - RNA, 18 nt, Shigella flexneri 2a str. 2457T
cagaaggauaauuaaucu

SEQ ID NO: 3870912 - RNA, 13 nt, Shigella flexneri 2a str. 2457T
cagaaggccagga

SEQ ID NO: 3870913 - RNA, 20 nt, Shigella flexneri 2a str. 2457T
cagaaggccgcaguaaagcg

SEQ ID NO: 3870914 - RNA, 22 nt, Shigella flexneri 2a str. 2457T
cagaaggccgcaguaaagcgca

SEQ ID NO: 3870915 - RNA, 15 nt, Shigella flexneri 2a str. 2457T
cagaaguugcaccca

SEQ ID NO: 3870916 - RNA, 17 nt, Shigella flexneri 2a str. 2457T
cagaaguugcacccagu

SEQ ID NO: 3870917 - RNA, 20 nt, Shigella flexneri 2a str. 2457T
cagaaguugcucaagcugaa

SEQ ID NO: 3870918 - RNA, 15 nt, Shigella flexneri 2a str. 2457T
cagaauaacggcaga

SEQ ID NO: 3870919 - RNA, 22 nt, Shigella flexneri 2a str. 2457T
cagaauaacggcagaagcugca

SEQ ID NO: 3870920 - RNA, 21 nt, Shigella flexneri 2a str. 2457T
cagaauaacgugaucgaacau

SEQ ID NO: 3870921 - RNA, 18 nt, Shigella flexneri 2a str. 2457T
cagaauaccuugcugcuc

SEQ ID NO: 3870922 - RNA, 21 nt, Shigella flexneri 2a str. 2457T
cagaauaccuugcugcuccag

SEQ ID NO: 3870923 - RNA, 23 nt, Shigella flexneri 2a str. 2457T
cagaauaccuugcugcuccagcg

SEQ ID NO: 3870924 - RNA, 15 nt, Shigella flexneri 2a str. 2457T
cagaauacgcugaaa

SEQ ID NO: 3870925 - RNA, 17 nt, Shigella flexneri 2a str. 2457T
cagaauagcgccgccaa

SEQ ID NO: 3870926 - RNA, 17 nt, Shigella flexneri 2a str. 2457T
cagaauauacggaauga

SEQ ID NO: 3870927 - RNA, 23 nt, Shigella flexneri 2a str. 2457T
cagaauaucguucaagagacugc

SEQ ID NO: 3870928 - RNA, 19 nt, Shigella flexneri 2a str. 2457T
cagaauauucgaaaucugu

SEQ ID NO: 3870929 - RNA, 21 nt, Shigella flexneri 2a str. 2457T
cagaauauugccgaagaccag

SEQ ID NO: 3870930 - RNA, 14 nt, Shigella flexneri 2a str. 2457T
cagaauauuugauu

SEQ ID NO: 3870931 - RNA, 17 nt, Shigella flexneri 2a str. 2457T
cagaaucaaucccauca

SEQ ID NO: 3870932 - RNA, 19 nt, Shigella flexneri 2a str. 2457T
cagaaucaaucccaucagg

SEQ ID NO: 3870933 - RNA, 16 nt, Shigella flexneri 2a str. 2457T
cagaaucacgccaaca

SEQ ID NO: 3870934 - RNA, 18 nt, Shigella flexneri 2a str. 2457T
cagaaucacgccaacaaa

SEQ ID NO: 3870935 - RNA, 22 nt, Shigella flexneri 2a str. 2457T
cagaaucagguugaugcgagua

SEQ ID NO: 3870936 - RNA, 14 nt, Shigella flexneri 2a str. 2457T
cagaauccaggaaa

SEQ ID NO: 3870937 - RNA, 17 nt, Shigella flexneri 2a str. 2457T
cagaauccaggaaagcc

SEQ ID NO: 3870938 - RNA, 20 nt, Shigella flexneri 2a str. 2457T
cagaaucgccagcaucggca

SEQ ID NO: 3870939 - RNA, 15 nt, Shigella flexneri 2a str. 2457T
cagaaucgcgcccca

SEQ ID NO: 3870940 - RNA, 17 nt, Shigella flexneri 2a str. 2457T
cagaaucgggcugagau

SEQ ID NO: 3870941 - RNA, 13 nt, Shigella flexneri 2a str. 2457T
cagaaucguaaag

SEQ ID NO: 3870942 - RNA, 23 nt, Shigella flexneri 2a str. 2457T
cagaaucuaagaucccugccauu

SEQ ID NO: 3870943 - RNA, 17 nt, Shigella flexneri 2a str. 2457T
cagaaucuucuucucag

SEQ ID NO: 3870944 - RNA, 19 nt, Shigella flexneri 2a str. 2457T
cagaaucuucuucucagcc

SEQ ID NO: 3870945 - RNA, 14 nt, Shigella flexneri 2a str. 2457T
cagaaugaugccgc

SEQ ID NO: 3870946 - RNA, 14 nt, Shigella flexneri 2a str. 2457T
cagaaugccccauu

SEQ ID NO: 3870947 - RNA, 16 nt, Shigella flexneri 2a str. 2457T
cagaauuacuggcaga

SEQ ID NO: 3870948 - RNA, 19 nt, Shigella flexneri 2a str. 2457T
cagaauuucgacuuuuuuc

SEQ ID NO: 3870949 - RNA, 14 nt, Shigella flexneri 2a str. 2457T
cagaauuugaggaa

SEQ ID NO: 3870950 - RNA, 15 nt, Shigella flexneri 2a str. 2457T
cagaauuugaggaag

SEQ ID NO: 3870951 - RNA, 17 nt, Shigella flexneri 2a str. 2457T
cagaauuugaggaagcu

SEQ ID NO: 3870952 - RNA, 20 nt, Shigella flexneri 2a str. 2457T
cagacaaaaagaauacgcaa

SEQ ID NO: 3870953 - RNA, 20 nt, Shigella flexneri 2a str. 2457T
cagacaaaauccugccagcg

SEQ ID NO: 3870954 - RNA, 14 nt, Shigella flexneri 2a str. 2457T
cagacaaaugaaca

SEQ ID NO: 3870955 - RNA, 19 nt, Shigella flexneri 2a str. 2457T
cagacaaaugaacaccaaa

SEQ ID NO: 3870956 - RNA, 19 nt, Shigella flexneri 2a str. 2457T
cagacaaaugucacugcuu

SEQ ID NO: 3870957 - RNA, 15 nt, Shigella flexneri 2a str. 2457T
cagacaacccacaca

SEQ ID NO: 3870958 - RNA, 17 nt, Shigella flexneri 2a str. 2457T
cagacaaccgcucaaca

SEQ ID NO: 3870959 - RNA, 13 nt, Shigella flexneri 2a str. 2457T
cagacaacgcuuc

SEQ ID NO: 3870960 - RNA, 22 nt, Shigella flexneri 2a str. 2457T
cagacaagaaguuccagggcag

SEQ ID NO: 3870961 - RNA, 19 nt, Shigella flexneri 2a str. 2457T
cagacaaucacaucacugc

SEQ ID NO: 3870962 - RNA, 17 nt, Shigella flexneri 2a str. 2457T
cagacaauuuguuggcg

SEQ ID NO: 3870963 - RNA, 21 nt, Shigella flexneri 2a str. 2457T
cagacacaguucuucaaaaau

SEQ ID NO: 3870964 - RNA, 22 nt, Shigella flexneri 2a str. 2457T
cagacacauaaugaugccgucu

SEQ ID NO: 3870965 - RNA, 19 nt, Shigella flexneri 2a str. 2457T
cagagauuugcuccagcga

SEQ ID NO: 3870966 - RNA, 21 nt, Shigella flexneri 2a str. 2457T
cagagcaaaaaucgacagcag

SEQ ID NO: 3870967 - RNA, 16 nt, Shigella flexneri 2a str. 2457T
cagagcaaucaccaga

SEQ ID NO: 3870968 - RNA, 21 nt, Shigella flexneri 2a str. 2457T
cagagcacuguuacugucggc

SEQ ID NO: 3870969 - RNA, 13 nt, Shigella flexneri 2a str. 2457T
cagagcagcaaca

SEQ ID NO: 3870970 - RNA, 15 nt, Shigella flexneri 2a str. 2457T
cagagcagcaacaag

SEQ ID NO: 3870971 - RNA, 23 nt, Shigella flexneri 2a str. 2457T
cagagcaucaguuaacggcacca

SEQ ID NO: 3870972 - RNA, 23 nt, Shigella flexneri 2a str. 2457T
cagagcaucgguaucuucccagc

SEQ ID NO: 3870973 - RNA, 15 nt, Shigella flexneri 2a str. 2457T
cagagcguuacgccc

SEQ ID NO: 3870974 - RNA, 12 nt, Shigella flexneri 2a str. 2457T
cagagcuacaaa

SEQ ID NO: 3870975 - RNA, 15 nt, Shigella flexneri 2a str. 2457T
cagagcugcguuuga

SEQ ID NO: 3870976 - RNA, 23 nt, Shigella flexneri 2a str. 2457T
cagagcugcguuugaaauaccag

SEQ ID NO: 3870977 - RNA, 19 nt, Shigella flexneri 2a str. 2457T
cagaggaaucgcuguugag

SEQ ID NO: 3870978 - RNA, 22 nt, Shigella flexneri 2a str. 2457T
cagaggaaucgcuguugaggca

SEQ ID NO: 3870979 - RNA, 14 nt, Shigella flexneri 2a str. 2457T
cagaggagccauca

SEQ ID NO: 3870980 - RNA, 18 nt, Shigella flexneri 2a str. 2457T
cagagggcaaauucuuca

SEQ ID NO: 3870981 - RNA, 20 nt, Shigella flexneri 2a str. 2457T
cagaggggaaguuuucggau

SEQ ID NO: 3870982 - RNA, 19 nt, Shigella flexneri 2a str. 2457T
cagaguauuuccagcucaa

SEQ ID NO: 3870983 - RNA, 13 nt, Shigella flexneri 2a str. 2457T
cagagucauuucu

SEQ ID NO: 3870984 - RNA, 17 nt, Shigella flexneri 2a str. 2457T
cagagugaaaaugccuc

SEQ ID NO: 3870985 - RNA, 18 nt, Shigella flexneri 2a str. 2457T
cagagugaaaaugccuca

SEQ ID NO: 3870986 - RNA, 21 nt, Shigella flexneri 2a str. 2457T
cagaguggauuaucuucaccg

SEQ ID NO: 3870987 - RNA, 15 nt, Shigella flexneri 2a str. 2457T
cagaguugccacccg

SEQ ID NO: 3870988 - RNA, 17 nt, Shigella flexneri 2a str. 2457T
cagaguugccacccggc

SEQ ID NO: 3870989 - RNA, 12 nt, Shigella flexneri 2a str. 2457T
cagaguugcuga

SEQ ID NO: 3870990 - RNA, 11 nt, Shigella flexneri 2a str. 2457T
cagauaaaaua

SEQ ID NO: 3870991 - RNA, 20 nt, Shigella flexneri 2a str. 2457T
cagauaaaaugcgaaaaaaa

SEQ ID NO: 3870992 - RNA, 15 nt, Shigella flexneri 2a str. 2457T
cagauaaaucacgcu

SEQ ID NO: 3870993 - RNA, 18 nt, Shigella flexneri 2a str. 2457T
cagauaaaucacgcuuca

SEQ ID NO: 3870994 - RNA, 14 nt, Shigella flexneri 2a str. 2457T
cagauaacaccaua

SEQ ID NO: 3870995 - RNA, 23 nt, Shigella flexneri 2a str. 2457T
cagauaacccaggggucaguucc

SEQ ID NO: 3870996 - RNA, 14 nt, Shigella flexneri 2a str. 2457T
cagauaagacacua

SEQ ID NO: 3870997 - RNA, 14 nt, Shigella flexneri 2a str. 2457T
cagauaagacacug

SEQ ID NO: 3870998 - RNA, 23 nt, Shigella flexneri 2a str. 2457T
cagauaagacgcguuagugucuu

SEQ ID NO: 3870999 - RNA, 18 nt, Shigella flexneri 2a str. 2457T
cagauaauauuuaucuuc

SEQ ID NO: 3871000 - RNA, 13 nt, Shigella flexneri 2a str. 2457T
cagauaaucaccu

SEQ ID NO: 3871001 - RNA, 15 nt, Shigella flexneri 2a str. 2457T
cagauaaucaccugc

SEQ ID NO: 3871002 - RNA, 21 nt, Shigella flexneri 2a str. 2457T
cagauaauccccaaugaccuu

SEQ ID NO: 3871003 - RNA, 14 nt, Shigella flexneri 2a str. 2457T
cagauaaugagaaa

SEQ ID NO: 3871004 - RNA, 21 nt, Shigella flexneri 2a str. 2457T
cagauaaugcccgaugaccuu

SEQ ID NO: 3871005 - RNA, 17 nt, Shigella flexneri 2a str. 2457T
cagauaauggaaucgcu

SEQ ID NO: 3871006 - RNA, 22 nt, Shigella flexneri 2a str. 2457T
cagauaauggcuguugaaugcc

SEQ ID NO: 3871007 - RNA, 22 nt, Shigella flexneri 2a str. 2457T
cagauacaaaaaaggccgcagg

SEQ ID NO: 3871008 - RNA, 16 nt, Shigella flexneri 2a str. 2457T
cagauacaaccaaucg

SEQ ID NO: 3871009 - RNA, 14 nt, Shigella flexneri 2a str. 2457T
cagauaccacauca

SEQ ID NO: 3871010 - RNA, 20 nt, Shigella flexneri 2a str. 2457T
cagauacgauguuguagcau

SEQ ID NO: 3871011 - RNA, 22 nt, Shigella flexneri 2a str. 2457T
cagauacugaugaacgcgcagg

SEQ ID NO: 3871012 - RNA, 23 nt, Shigella flexneri 2a str. 2457T
cagauagagcgccugcagacggc

SEQ ID NO: 3871013 - RNA, 15 nt, Shigella flexneri 2a str. 2457T
cagauagcaacagca

SEQ ID NO: 3871014 - RNA, 13 nt, Shigella flexneri 2a str. 2457T
cagauagccaggu

SEQ ID NO: 3871015 - RNA, 13 nt, Shigella flexneri 2a str. 2457T
cagauagcccgga

SEQ ID NO: 3871016 - RNA, 14 nt, Shigella flexneri 2a str. 2457T
cagauaguuaccgu

SEQ ID NO: 3871017 - RNA, 23 nt, Shigella flexneri 2a str. 2457T
cagauaguucgcgaucgcgccag

SEQ ID NO: 3871018 - RNA, 16 nt, Shigella flexneri 2a str. 2457T
cagauaguugauuaau

SEQ ID NO: 3871019 - RNA, 18 nt, Shigella flexneri 2a str. 2457T
cagauaguugauuaauuu

SEQ ID NO: 3871020 - RNA, 21 nt, Shigella flexneri 2a str. 2457T
cagauaucccgccagcaccag

SEQ ID NO: 3871021 - RNA, 21 nt, Shigella flexneri 2a str. 2457T
cagauauucguucagauaggc

SEQ ID NO: 3871022 - RNA, 21 nt, Shigella flexneri 2a str. 2457T
cagaucacgcagcaagccguc

SEQ ID NO: 3871023 - RNA, 13 nt, Shigella flexneri 2a str. 2457T
cagaucagccacu

SEQ ID NO: 3871024 - RNA, 17 nt, Shigella flexneri 2a str. 2457T
cagaucagccacuuccu

SEQ ID NO: 3871025 - RNA, 14 nt, Shigella flexneri 2a str. 2457T
cagaucauccaucg

SEQ ID NO: 3871026 - RNA, 13 nt, Shigella flexneri 2a str. 2457T
cagaucauccugc

SEQ ID NO: 3871027 - RNA, 22 nt, Shigella flexneri 2a str. 2457T
cagaucccaauucauuccugga

SEQ ID NO: 3871028 - RNA, 23 nt, Shigella flexneri 2a str. 2457T
cagaucccguugaaggguauugc

SEQ ID NO: 3871029 - RNA, 15 nt, Shigella flexneri 2a str. 2457T
cagaucccuucaccu

SEQ ID NO: 3871030 - RNA, 22 nt, Shigella flexneri 2a str. 2457T
cagauccgccaguuuguagcca

SEQ ID NO: 3871031 - RNA, 18 nt, Shigella flexneri 2a str. 2457T
cagauccgccauuucucc

SEQ ID NO: 3871032 - RNA, 20 nt, Shigella flexneri 2a str. 2457T
cagauccgccauuucuccuc

SEQ ID NO: 3871033 - RNA, 18 nt, Shigella flexneri 2a str. 2457T
cagaucgaucauauuucc

SEQ ID NO: 3871034 - RNA, 20 nt, Shigella flexneri 2a str. 2457T
cagaucgccccggucaucaa

SEQ ID NO: 3871035 - RNA, 15 nt, Shigella flexneri 2a str. 2457T
cagaucgcggcccac

SEQ ID NO: 3871036 - RNA, 14 nt, Shigella flexneri 2a str. 2457T
cagaucggcagggc

SEQ ID NO: 3871037 - RNA, 16 nt, Shigella flexneri 2a str. 2457T
cagaucgguugccaua

SEQ ID NO: 3871038 - RNA, 17 nt, Shigella flexneri 2a str. 2457T
cagaucgugcaucuccu

SEQ ID NO: 3871039 - RNA, 19 nt, Shigella flexneri 2a str. 2457T
cagaucguugaacccggca

SEQ ID NO: 3871040 - RNA, 13 nt, Shigella flexneri 2a str. 2457T
cagaucguuuucc

SEQ ID NO: 3871041 - RNA, 16 nt, Shigella flexneri 2a str. 2457T
cagaucguuuuccugc

SEQ ID NO: 3871042 - RNA, 22 nt, Shigella flexneri 2a str. 2457T
cagaucuaauguuggugugaca

SEQ ID NO: 3871043 - RNA, 18 nt, Shigella flexneri 2a str. 2457T
cagaucugccuguccggc

SEQ ID NO: 3871044 - RNA, 22 nt, Shigella flexneri 2a str. 2457T
cagaucuuccgaggcguuuucu

SEQ ID NO: 3871045 - RNA, 20 nt, Shigella flexneri 2a str. 2457T
cagaugaacgagucaacgcu

SEQ ID NO: 3871046 - RNA, 23 nt, Shigella flexneri 2a str. 2457T
cagaugaacgagucaacgcuuca

SEQ ID NO: 3871047 - RNA, 19 nt, Shigella flexneri 2a str. 2457T
cagaugaagcuggcaaagu

SEQ ID NO: 3871048 - RNA, 15 nt, Shigella flexneri 2a str. 2457T
cagaugaauagcgca

SEQ ID NO: 3871049 - RNA, 22 nt, Shigella flexneri 2a str. 2457T
cagaugauuagucuuuaucugc

SEQ ID NO: 3871050 - RNA, 22 nt, Shigella flexneri 2a str. 2457T
cagaugcaggauuucuucacca

SEQ ID NO: 3871051 - RNA, 14 nt, Shigella flexneri 2a str. 2457T
cagaugcaucaccg

SEQ ID NO: 3871052 - RNA, 23 nt, Shigella flexneri 2a str. 2457T
cagaugcgcgguugccugcugug

SEQ ID NO: 3871053 - RNA, 13 nt, Shigella flexneri 2a str. 2457T
cagaugcgcuuca

SEQ ID NO: 3871054 - RNA, 15 nt, Shigella flexneri 2a str. 2457T
cagaugcgcuucaag

SEQ ID NO: 3871055 - RNA, 18 nt, Shigella flexneri 2a str. 2457T
cagaugcgucuucugcag

SEQ ID NO: 3871056 - RNA, 20 nt, Shigella flexneri 2a str. 2457T
cagauggccaauaacccgcu

SEQ ID NO: 3871057 - RNA, 23 nt, Shigella flexneri 2a str. 2457T
cagauggggauagcgcugcugca

SEQ ID NO: 3871058 - RNA, 18 nt, Shigella flexneri 2a str. 2457T
cagauguaaacuuuuucg

SEQ ID NO: 3871059 - RNA, 16 nt, Shigella flexneri 2a str. 2457T
cagauguaaugagaac

SEQ ID NO: 3871060 - RNA, 20 nt, Shigella flexneri 2a str. 2457T
cagaugugcaccuuuuccac

SEQ ID NO: 3871061 - RNA, 16 nt, Shigella flexneri 2a str. 2457T
cagauguuccgccauu

SEQ ID NO: 3871062 - RNA, 15 nt, Shigella flexneri 2a str. 2457T
cagcacuaugacugc

SEQ ID NO: 3871063 - RNA, 14 nt, Shigella flexneri 2a str. 2457T
cagcacugauaauc

SEQ ID NO: 3871064 - RNA, 18 nt, Shigella flexneri 2a str. 2457T
cagcacugauuuuuucca

SEQ ID NO: 3871065 - RNA, 23 nt, Shigella flexneri 2a str. 2457T
cagcacugauuuuuuccaacagg

SEQ ID NO: 3871066 - RNA, 18 nt, Shigella flexneri 2a str. 2457T
cagcacugccgcaucgua

SEQ ID NO: 3871067 - RNA, 19 nt, Shigella flexneri 2a str. 2457T
cagcacuuaucucuuccgc

SEQ ID NO: 3871068 - RNA, 20 nt, Shigella flexneri 2a str. 2457T
cagcacuucacccaucgcca

SEQ ID NO: 3871069 - RNA, 17 nt, Shigella flexneri 2a str. 2457T
cagcacuuccagcuccg

SEQ ID NO: 3871070 - RNA, 20 nt, Shigella flexneri 2a str. 2457T
cagcacuucgccaucugcca

SEQ ID NO: 3871071 - RNA, 23 nt, Shigella flexneri 2a str. 2457T
cagcacuucgccaucugccagac

SEQ ID NO: 3871072 - RNA, 14 nt, Shigella flexneri 2a str. 2457T
cagcagaacaucag

SEQ ID NO: 3871073 - RNA, 17 nt, Shigella flexneri 2a str. 2457T
cagcagaacgaccagcg

SEQ ID NO: 3871074 - RNA, 16 nt, Shigella flexneri 2a str. 2457T
cagcagacagccuacc

SEQ ID NO: 3871075 - RNA, 20 nt, Shigella flexneri 2a str. 2457T
cagcagacagccuaccagac

SEQ ID NO: 3871076 - RNA, 20 nt, Shigella flexneri 2a str. 2457T
cagcagagaaaauaucccgu

SEQ ID NO: 3871077 - RNA, 15 nt, Shigella flexneri 2a str. 2457T
cagcagagcaaaaau

SEQ ID NO: 3871078 - RNA, 19 nt, Shigella flexneri 2a str. 2457T
cagcagagcaaucaccaga

SEQ ID NO: 3871079 - RNA, 16 nt, Shigella flexneri 2a str. 2457T
cagcagagcaugguua

SEQ ID NO: 3871080 - RNA, 21 nt, Shigella flexneri 2a str. 2457T
cagcagauaucccgccagcac

SEQ ID NO: 3871081 - RNA, 21 nt, Shigella flexneri 2a str. 2457T
cagcagauauugccccacacc

SEQ ID NO: 3871082 - RNA, 22 nt, Shigella flexneri 2a str. 2457T
cagcagauauugccccacaccg

SEQ ID NO: 3871083 - RNA, 22 nt, Shigella flexneri 2a str. 2457T
cagcagauggcagugcgccaua

SEQ ID NO: 3871084 - RNA, 17 nt, Shigella flexneri 2a str. 2457T
cagcagauuaaccgcuu

SEQ ID NO: 3871085 - RNA, 18 nt, Shigella flexneri 2a str. 2457T
cagcagauugcgaauaug

SEQ ID NO: 3871086 - RNA, 14 nt, Shigella flexneri 2a str. 2457T
cagcagcaagauau

SEQ ID NO: 3871087 - RNA, 20 nt, Shigella flexneri 2a str. 2457T
cagcagcaaugcaggcaccu

SEQ ID NO: 3871088 - RNA, 14 nt, Shigella flexneri 2a str. 2457T
cagcagcagacagc

SEQ ID NO: 3871089 - RNA, 16 nt, Shigella flexneri 2a str. 2457T
cagcagcagacagccu

SEQ ID NO: 3871090 - RNA, 23 nt, Shigella flexneri 2a str. 2457T
cagcagcagacagccuaccagac

SEQ ID NO: 3871091 - RNA, 11 nt, Shigella flexneri 2a str. 2457T
cagcagcagag

SEQ ID NO: 3871092 - RNA, 12 nt, Shigella flexneri 2a str. 2457T
cagcagcagagc

SEQ ID NO: 3871093 - RNA, 21 nt, Shigella flexneri 2a str. 2457T
cagcagcagccgguauccagc

SEQ ID NO: 3871094 - RNA, 11 nt, Shigella flexneri 2a str. 2457T
cagcagcagcg

SEQ ID NO: 3871095 - RNA, 18 nt, Shigella flexneri 2a str. 2457T
cagcagccacaccaauca

SEQ ID NO: 3871096 - RNA, 18 nt, Shigella flexneri 2a str. 2457T
cagcagccgguauccagc

SEQ ID NO: 3871097 - RNA, 23 nt, Shigella flexneri 2a str. 2457T
cagcagccugcgcuucuuuuuac

SEQ ID NO: 3871098 - RNA, 19 nt, Shigella flexneri 2a str. 2457T
cagcagcgaaucagcccag

SEQ ID NO: 3871099 - RNA, 13 nt, Shigella flexneri 2a str. 2457T
cagcagcgcaauu

SEQ ID NO: 3871100 - RNA, 13 nt, Shigella flexneri 2a str. 2457T
cagcagcgccgca

SEQ ID NO: 3871101 - RNA, 13 nt, Shigella flexneri 2a str. 2457T
cagcagcgccgcg

SEQ ID NO: 3871102 - RNA, 16 nt, Shigella flexneri 2a str. 2457T
cagcagcggagaaaug

SEQ ID NO: 3871103 - RNA, 18 nt, Shigella flexneri 2a str. 2457T
cagcagcggcucggucag

SEQ ID NO: 3871104 - RNA, 19 nt, Shigella flexneri 2a str. 2457T
cagcagcucaucaagcugu

SEQ ID NO: 3871105 - RNA, 17 nt, Shigella flexneri 2a str. 2457T
cagcaggauggcuggcc

SEQ ID NO: 3871106 - RNA, 22 nt, Shigella flexneri 2a str. 2457T
cagcaggauguuccggcaaagu

SEQ ID NO: 3871107 - RNA, 23 nt, Shigella flexneri 2a str. 2457T
cagcaggauuugcgguagcgggc

SEQ ID NO: 3871108 - RNA, 15 nt, Shigella flexneri 2a str. 2457T
cagcaggcagaucca

SEQ ID NO: 3871109 - RNA, 12 nt, Shigella flexneri 2a str. 2457T
cagcagggccug

SEQ ID NO: 3871110 - RNA, 14 nt, Shigella flexneri 2a str. 2457T
cagcagggccugaa

SEQ ID NO: 3871111 - RNA, 16 nt, Shigella flexneri 2a str. 2457T
cagcagggccugaagg

SEQ ID NO: 3871112 - RNA, 13 nt, Shigella flexneri 2a str. 2457T
cagcaggugucca

SEQ ID NO: 3871113 - RNA, 14 nt, Shigella flexneri 2a str. 2457T
cagcaguaaaccgc

SEQ ID NO: 3871114 - RNA, 16 nt, Shigella flexneri 2a str. 2457T
cagcaguaaaccgcuc

SEQ ID NO: 3871115 - RNA, 21 nt, Shigella flexneri 2a str. 2457T
cagcaguacgccgagaauaaa

SEQ ID NO: 3871116 - RNA, 16 nt, Shigella flexneri 2a str. 2457T
cagcaguauuaacgcc

SEQ ID NO: 3871117 - RNA, 22 nt, Shigella flexneri 2a str. 2457T
cagcaguauuaacgccauauca

SEQ ID NO: 3871118 - RNA, 23 nt, Shigella flexneri 2a str. 2457T
cagcaguccagcgcgaacgugac

SEQ ID NO: 3871119 - RNA, 13 nt, Shigella flexneri 2a str. 2457T
cagcaguucacgc

SEQ ID NO: 3871120 - RNA, 17 nt, Shigella flexneri 2a str. 2457T
cagcaguucacgcagcu

SEQ ID NO: 3871121 - RNA, 14 nt, Shigella flexneri 2a str. 2457T
cagcaguugccagu

SEQ ID NO: 3871122 - RNA, 18 nt, Shigella flexneri 2a str. 2457T
cagcaguugugugccagu

SEQ ID NO: 3871123 - RNA, 21 nt, Shigella flexneri 2a str. 2457T
cagcaguuuuaccgacgcgcu

SEQ ID NO: 3871124 - RNA, 13 nt, Shigella flexneri 2a str. 2457T
cagcauaaaaaua

SEQ ID NO: 3871125 - RNA, 15 nt, Shigella flexneri 2a str. 2457T
cagcauaaucaccag

SEQ ID NO: 3871126 - RNA, 20 nt, Shigella flexneri 2a str. 2457T
cagcauaaucaccaguaccg

SEQ ID NO: 3871127 - RNA, 17 nt, Shigella flexneri 2a str. 2457T
cagcauaaucaccauca

SEQ ID NO: 3871128 - RNA, 15 nt, Shigella flexneri 2a str. 2457T
cagcauaccuuccag

SEQ ID NO: 3871129 - RNA, 15 nt, Shigella flexneri 2a str. 2457T
cagcauacgucgaua

SEQ ID NO: 3871130 - RNA, 17 nt, Shigella flexneri 2a str. 2457T
cagcauaguacgggcaa

SEQ ID NO: 3871131 - RNA, 19 nt, Shigella flexneri 2a str. 2457T
cagcauauaggaggccucg

SEQ ID NO: 3871132 - RNA, 21 nt, Shigella flexneri 2a str. 2457T
cagcauauaguuuugcauggc

SEQ ID NO: 3871133 - RNA, 15 nt, Shigella flexneri 2a str. 2457T
cagcaucacgcccgc

SEQ ID NO: 3871134 - RNA, 22 nt, Shigella flexneri 2a str. 2457T
cagcaucauaccuccgcaauau

SEQ ID NO: 3871135 - RNA, 14 nt, Shigella flexneri 2a str. 2457T
cagcaucaucgcaa

SEQ ID NO: 3871136 - RNA, 13 nt, Shigella flexneri 2a str. 2457T
cagcaucccaccu

SEQ ID NO: 3871137 - RNA, 14 nt, Shigella flexneri 2a str. 2457T
cagcaucgaccagg

SEQ ID NO: 3871138 - RNA, 19 nt, Shigella flexneri 2a str. 2457T
cagcaucggcagcgccagc

SEQ ID NO: 3871139 - RNA, 22 nt, Shigella flexneri 2a str. 2457T
cagcaucggugaggaucaccag

SEQ ID NO: 3871140 - RNA, 19 nt, Shigella flexneri 2a str. 2457T
cagcaucgucaucagcucc

SEQ ID NO: 3871141 - RNA, 17 nt, Shigella flexneri 2a str. 2457T
cagcaucgucaucauuc

SEQ ID NO: 3871142 - RNA, 18 nt, Shigella flexneri 2a str. 2457T
cagcaucguccgccagcc

SEQ ID NO: 3871143 - RNA, 11 nt, Shigella flexneri 2a str. 2457T
cagcaucuccu

SEQ ID NO: 3871144 - RNA, 16 nt, Shigella flexneri 2a str. 2457T
cagcaucucgcgcucu

SEQ ID NO: 3871145 - RNA, 21 nt, Shigella flexneri 2a str. 2457T
cagcaucucgcgcucuucuuc

SEQ ID NO: 3871146 - RNA, 15 nt, Shigella flexneri 2a str. 2457T
cagcaugaaacgcca

SEQ ID NO: 3871147 - RNA, 16 nt, Shigella flexneri 2a str. 2457T
cagcaugaccaccggg

SEQ ID NO: 3871148 - RNA, 20 nt, Shigella flexneri 2a str. 2457T
cagcaugacguccuguacug

SEQ ID NO: 3871149 - RNA, 13 nt, Shigella flexneri 2a str. 2457T
cagcaugcacccu

SEQ ID NO: 3871150 - RNA, 15 nt, Shigella flexneri 2a str. 2457T
cagcaugcacccuca

SEQ ID NO: 3871151 - RNA, 16 nt, Shigella flexneri 2a str. 2457T
cagcaugcacccucaa

SEQ ID NO: 3871152 - RNA, 13 nt, Shigella flexneri 2a str. 2457T
cagcauggcaaua

SEQ ID NO: 3871153 - RNA, 17 nt, Shigella flexneri 2a str. 2457T
cagcauguagaugccgg

SEQ ID NO: 3871154 - RNA, 20 nt, Shigella flexneri 2a str. 2457T
cagcaugugguuaccaucaa

SEQ ID NO: 3871155 - RNA, 15 nt, Shigella flexneri 2a str. 2457T
cagcauuagcaaugc

SEQ ID NO: 3871156 - RNA, 15 nt, Shigella flexneri 2a str. 2457T
cagcauuccagauac

SEQ ID NO: 3871157 - RNA, 17 nt, Shigella flexneri 2a str. 2457T
cagcauucccgccagcg

SEQ ID NO: 3871158 - RNA, 20 nt, Shigella flexneri 2a str. 2457T
cagcauucccgccagcggcc

SEQ ID NO: 3871159 - RNA, 21 nt, Shigella flexneri 2a str. 2457T
cagcauuccggcauuuaaagg

SEQ ID NO: 3871160 - RNA, 14 nt, Shigella flexneri 2a str. 2457T
cagccucugccgcg

SEQ ID NO: 3871161 - RNA, 22 nt, Shigella flexneri 2a str. 2457T
cagccugaccgcacaccccggc

SEQ ID NO: 3871162 - RNA, 20 nt, Shigella flexneri 2a str. 2457T
cagccugauacaggaaggcc

SEQ ID NO: 3871163 - RNA, 21 nt, Shigella flexneri 2a str. 2457T
cagccuggcggaaagccagaa

SEQ ID NO: 3871164 - RNA, 15 nt, Shigella flexneri 2a str. 2457T
cagccuuaaacucaa

SEQ ID NO: 3871165 - RNA, 13 nt, Shigella flexneri 2a str. 2457T
cagccuucgccac

SEQ ID NO: 3871166 - RNA, 12 nt, Shigella flexneri 2a str. 2457T
cagccuucuuca

SEQ ID NO: 3871167 - RNA, 19 nt, Shigella flexneri 2a str. 2457T
cagccuucuucauccagcg

SEQ ID NO: 3871168 - RNA, 16 nt, Shigella flexneri 2a str. 2457T
cagccuugcggcaacg

SEQ ID NO: 3871169 - RNA, 18 nt, Shigella flexneri 2a str. 2457T
cagccuuucaauaccgcc

SEQ ID NO: 3871170 - RNA, 16 nt, Shigella flexneri 2a str. 2457T
cagccuuuccggcaau

SEQ ID NO: 3871171 - RNA, 13 nt, Shigella flexneri 2a str. 2457T
cagccuuucucag

SEQ ID NO: 3871172 - RNA, 12 nt, Shigella flexneri 2a str. 2457T
cagccuuuuucu

SEQ ID NO: 3871173 - RNA, 13 nt, Shigella flexneri 2a str. 2457T
cagccuuuuucuc

SEQ ID NO: 3871174 - RNA, 20 nt, Shigella flexneri 2a str. 2457T
cagcgaaaaagucccuuccc

SEQ ID NO: 3871175 - RNA, 22 nt, Shigella flexneri 2a str. 2457T
cagcgaaaaagucccuucccag

SEQ ID NO: 3871176 - RNA, 19 nt, Shigella flexneri 2a str. 2457T
cagcgaaaaucaaccauac

SEQ ID NO: 3871177 - RNA, 22 nt, Shigella flexneri 2a str. 2457T
cagcgaaaguaacaccauccau

SEQ ID NO: 3871178 - RNA, 18 nt, Shigella flexneri 2a str. 2457T
cagcgaaauacagguccc

SEQ ID NO: 3871179 - RNA, 22 nt, Shigella flexneri 2a str. 2457T
cagcgaaauacagguccccgcu

SEQ ID NO: 3871180 - RNA, 20 nt, Shigella flexneri 2a str. 2457T
cagcgaaaucaccgccacca

SEQ ID NO: 3871181 - RNA, 16 nt, Shigella flexneri 2a str. 2457T
cagcgaaaucgccuuu

SEQ ID NO: 3871182 - RNA, 15 nt, Shigella flexneri 2a str. 2457T
cagcgaacaccagca

SEQ ID NO: 3871183 - RNA, 22 nt, Shigella flexneri 2a str. 2457T
cagcgaaccuuccaucgcaucu

SEQ ID NO: 3871184 - RNA, 13 nt, Shigella flexneri 2a str. 2457T
cagcgaagagauc

SEQ ID NO: 3871185 - RNA, 24 nt, Shigella flexneri 2a str. 2457T
cagcgaagcauucagacacgccgc

SEQ ID NO: 3871186 - RNA, 22 nt, Shigella flexneri 2a str. 2457T
cagcgaagccagcucccacagu

SEQ ID NO: 3871187 - RNA, 18 nt, Shigella flexneri 2a str. 2457T
cagcgaagcccacgccgc

SEQ ID NO: 3871188 - RNA, 13 nt, Shigella flexneri 2a str. 2457T
cagcgaaucagcc

SEQ ID NO: 3871189 - RNA, 15 nt, Shigella flexneri 2a str. 2457T
cagcgaauccguucu

SEQ ID NO: 3871190 - RNA, 16 nt, Shigella flexneri 2a str. 2457T
cagcgaauggguugua

SEQ ID NO: 3871191 - RNA, 15 nt, Shigella flexneri 2a str. 2457T
cagcgaauuccaguu

SEQ ID NO: 3871192 - RNA, 13 nt, Shigella flexneri 2a str. 2457T
cagcgacagacga

SEQ ID NO: 3871193 - RNA, 18 nt, Shigella flexneri 2a str. 2457T
cagcgacaggaacgccgc

SEQ ID NO: 3871194 - RNA, 16 nt, Shigella flexneri 2a str. 2457T
cagcgacagggccagg

SEQ ID NO: 3871195 - RNA, 17 nt, Shigella flexneri 2a str. 2457T
cagcgacugcgggcgca

SEQ ID NO: 3871196 - RNA, 21 nt, Shigella flexneri 2a str. 2457T
cagcgacugucuuucaggcag

SEQ ID NO: 3871197 - RNA, 20 nt, Shigella flexneri 2a str. 2457T
cagcgagaagucggcuuuua

SEQ ID NO: 3871198 - RNA, 18 nt, Shigella flexneri 2a str. 2457T
cagcgagauaacgcugau

SEQ ID NO: 3871199 - RNA, 15 nt, Shigella flexneri 2a str. 2457T
cagcgagcggcggau

SEQ ID NO: 3871200 - RNA, 22 nt, Shigella flexneri 2a str. 2457T
cagcgagcuggcgcugauaaau

SEQ ID NO: 3871201 - RNA, 12 nt, Shigella flexneri 2a str. 2457T
cagcgaguugau

SEQ ID NO: 3871202 - RNA, 17 nt, Shigella flexneri 2a str. 2457T
cagcgaguuuuucaguc

SEQ ID NO: 3871203 - RNA, 13 nt, Shigella flexneri 2a str. 2457T
cagcgauaaaaau

SEQ ID NO: 3871204 - RNA, 14 nt, Shigella flexneri 2a str. 2457T
cagcgaucagcauu

SEQ ID NO: 3871205 - RNA, 16 nt, Shigella flexneri 2a str. 2457T
cagcgaucuguuucuu

SEQ ID NO: 3871206 - RNA, 20 nt, Shigella flexneri 2a str. 2457T
cagcgaugacuguacagauc

SEQ ID NO: 3871207 - RNA, 17 nt, Shigella flexneri 2a str. 2457T
cagcgaugaugagcgau

SEQ ID NO: 3871208 - RNA, 22 nt, Shigella flexneri 2a str. 2457T
cagcgaugcuuugcgcuuuucu

SEQ ID NO: 3871209 - RNA, 21 nt, Shigella flexneri 2a str. 2457T
cagcgauucaacaguagccuc

SEQ ID NO: 3871210 - RNA, 14 nt, Shigella flexneri 2a str. 2457T
cagcgauuccaguu

SEQ ID NO: 3871211 - RNA, 18 nt, Shigella flexneri 2a str. 2457T
cagcgauugucagcuggu

SEQ ID NO: 3871212 - RNA, 15 nt, Shigella flexneri 2a str. 2457T
cagcgauuugcggaa

SEQ ID NO: 3871213 - RNA, 23 nt, Shigella flexneri 2a str. 2457T
cagcgauuuuggguuccacuucu

SEQ ID NO: 3871214 - RNA, 14 nt, Shigella flexneri 2a str. 2457T
cagcgcaaaacgca

SEQ ID NO: 3871215 - RNA, 22 nt, Shigella flexneri 2a str. 2457T
cagcgcaauaccgauaucgcca

SEQ ID NO: 3871216 - RNA, 19 nt, Shigella flexneri 2a str. 2457T
cagcgcaauuaacgcccca

SEQ ID NO: 3871217 - RNA, 23 nt, Shigella flexneri 2a str. 2457T
cagcgcagaaccguaaacagaua

SEQ ID NO: 3871218 - RNA, 20 nt, Shigella flexneri 2a str. 2457T
cagcgcagacaaucacauca

SEQ ID NO: 3871219 - RNA, 15 nt, Shigella flexneri 2a str. 2457T
cagcgcagcacccag

SEQ ID NO: 3871220 - RNA, 13 nt, Shigella flexneri 2a str. 2457T
cagcgcaggaaag

SEQ ID NO: 3871221 - RNA, 20 nt, Shigella flexneri 2a str. 2457T
cagcgcaggcagguuaauga

SEQ ID NO: 3871222 - RNA, 22 nt, Shigella flexneri 2a str. 2457T
cagcgcagugacauucaccuca

SEQ ID NO: 3871223 - RNA, 20 nt, Shigella flexneri 2a str. 2457T
cagcgcauagcuaauccccu

SEQ ID NO: 3871224 - RNA, 14 nt, Shigella flexneri 2a str. 2457T
cagcgcaucagaca

SEQ ID NO: 3871225 - RNA, 14 nt, Shigella flexneri 2a str. 2457T
cagcgcaucaggca

SEQ ID NO: 3871226 - RNA, 15 nt, Shigella flexneri 2a str. 2457T
cagcgcaucugccgg

SEQ ID NO: 3871227 - RNA, 14 nt, Shigella flexneri 2a str. 2457T
cagcgcauucggca

SEQ ID NO: 3871228 - RNA, 12 nt, Shigella flexneri 2a str. 2457T
cagcgcauugcu

SEQ ID NO: 3871229 - RNA, 14 nt, Shigella flexneri 2a str. 2457T
cagcgcauugcuaa

SEQ ID NO: 3871230 - RNA, 14 nt, Shigella flexneri 2a str. 2457T
cagcgccaacgcac

SEQ ID NO: 3871231 - RNA, 22 nt, Shigella flexneri 2a str. 2457T
cagcgccaacggugaaaaacca

SEQ ID NO: 3871232 - RNA, 21 nt, Shigella flexneri 2a str. 2457T
cagcgccacauaagaucaucg

SEQ ID NO: 3871233 - RNA, 17 nt, Shigella flexneri 2a str. 2457T
cagcgccacauccggcu

SEQ ID NO: 3871234 - RNA, 18 nt, Shigella flexneri 2a str. 2457T
cagcgccaccaccagcac

SEQ ID NO: 3871235 - RNA, 15 nt, Shigella flexneri 2a str. 2457T
cagcgccagaaggga

SEQ ID NO: 3871236 - RNA, 17 nt, Shigella flexneri 2a str. 2457T
cagcgccagacaaacca

SEQ ID NO: 3871237 - RNA, 15 nt, Shigella flexneri 2a str. 2457T
cagcgccagauagcc

SEQ ID NO: 3871238 - RNA, 14 nt, Shigella flexneri 2a str. 2457T
cagcgccaguugcu

SEQ ID NO: 3871239 - RNA, 13 nt, Shigella flexneri 2a str. 2457T
cagcgccaucccu

SEQ ID NO: 3871240 - RNA, 21 nt, Shigella flexneri 2a str. 2457T
cagcgccauuguguuaucccg

SEQ ID NO: 3871241 - RNA, 14 nt, Shigella flexneri 2a str. 2457T
cagcgcccaacacu

SEQ ID NO: 3871242 - RNA, 19 nt, Shigella flexneri 2a str. 2457T
cagcgccgacagcagcccu

SEQ ID NO: 3871243 - RNA, 21 nt, Shigella flexneri 2a str. 2457T
cagcgccgccagaaucaccuc

SEQ ID NO: 3871244 - RNA, 18 nt, Shigella flexneri 2a str. 2457T
cagcgccgcgccacuacu

SEQ ID NO: 3871245 - RNA, 23 nt, Shigella flexneri 2a str. 2457T
cagcgccgcuuuccaggcugugu

SEQ ID NO: 3871246 - RNA, 17 nt, Shigella flexneri 2a str. 2457T
cagcgccugauacagcc

SEQ ID NO: 3871247 - RNA, 19 nt, Shigella flexneri 2a str. 2457T
cagcgccugauacagccaa

SEQ ID NO: 3871248 - RNA, 14 nt, Shigella flexneri 2a str. 2457T
cagcgccugaugga

SEQ ID NO: 3871249 - RNA, 13 nt, Shigella flexneri 2a str. 2457T
cagcgccugcugc

SEQ ID NO: 3871250 - RNA, 15 nt, Shigella flexneri 2a str. 2457T
cagcgccugcugcac

SEQ ID NO: 3871251 - RNA, 13 nt, Shigella flexneri 2a str. 2457T
cagcgcgcagaac

SEQ ID NO: 3871252 - RNA, 17 nt, Shigella flexneri 2a str. 2457T
cagcgcgcauucagcag

SEQ ID NO: 3871253 - RNA, 18 nt, Shigella flexneri 2a str. 2457T
cagcgcgccagccaccac

SEQ ID NO: 3871254 - RNA, 19 nt, Shigella flexneri 2a str. 2457T
cagcgcgccugaaugccac

SEQ ID NO: 3871255 - RNA, 16 nt, Shigella flexneri 2a str. 2457T
cagcgcgcuaucggca

SEQ ID NO: 3871256 - RNA, 22 nt, Shigella flexneri 2a str. 2457T
cagcgcggaaaggaucacaaua

SEQ ID NO: 3871257 - RNA, 22 nt, Shigella flexneri 2a str. 2457T
cagcgcggaagggaugaaauag

SEQ ID NO: 3871258 - RNA, 13 nt, Shigella flexneri 2a str. 2457T
caggauuuccagc

SEQ ID NO: 3871259 - RNA, 19 nt, Shigella flexneri 2a str. 2457T
caggauuuccagcucaaag

SEQ ID NO: 3871260 - RNA, 23 nt, Shigella flexneri 2a str. 2457T
caggcaacaacaaccgaugaacu

SEQ ID NO: 3871261 - RNA, 16 nt, Shigella flexneri 2a str. 2457T
caggcaacagggaaau

SEQ ID NO: 3871262 - RNA, 16 nt, Shigella flexneri 2a str. 2457T
caggcaacgacccgaa

SEQ ID NO: 3871263 - RNA, 22 nt, Shigella flexneri 2a str. 2457T
caggcaagccgcuaacagcagc

SEQ ID NO: 3871264 - RNA, 20 nt, Shigella flexneri 2a str. 2457T
caggcaaguagcgccauacu

SEQ ID NO: 3871265 - RNA, 18 nt, Shigella flexneri 2a str. 2457T
caggcaaucagcaaucgc

SEQ ID NO: 3871266 - RNA, 17 nt, Shigella flexneri 2a str. 2457T
caggcacaccgccgccg

SEQ ID NO: 3871267 - RNA, 14 nt, Shigella flexneri 2a str. 2457T
caggcaccagcccc

SEQ ID NO: 3871268 - RNA, 17 nt, Shigella flexneri 2a str. 2457T
caggcaccagccccugg

SEQ ID NO: 3871269 - RNA, 14 nt, Shigella flexneri 2a str. 2457T
caggcaccuucggg

SEQ ID NO: 3871270 - RNA, 15 nt, Shigella flexneri 2a str. 2457T
caggcagcuuagaaa

SEQ ID NO: 3871271 - RNA, 15 nt, Shigella flexneri 2a str. 2457T
caggcaguaaaccgu

SEQ ID NO: 3871272 - RNA, 20 nt, Shigella flexneri 2a str. 2457T
caggcagucugcgcccuggg

SEQ ID NO: 3871273 - RNA, 18 nt, Shigella flexneri 2a str. 2457T
caggcaguuuauccagcc

SEQ ID NO: 3871274 - RNA, 14 nt, Shigella flexneri 2a str. 2457T
caggcauauucgcg

SEQ ID NO: 3871275 - RNA, 16 nt, Shigella flexneri 2a str. 2457T
caggcauauucgcgcu

SEQ ID NO: 3871276 - RNA, 18 nt, Shigella flexneri 2a str. 2457T
caggcaucacgucggcgu

SEQ ID NO: 3871277 - RNA, 23 nt, Shigella flexneri 2a str. 2457T
caggcaucacuuuaccgguuuca

SEQ ID NO: 3871278 - RNA, 16 nt, Shigella flexneri 2a str. 2457T
caggcaucggugcugg

SEQ ID NO: 3871279 - RNA, 13 nt, Shigella flexneri 2a str. 2457T
caggcaucgugca

SEQ ID NO: 3871280 - RNA, 18 nt, Shigella flexneri 2a str. 2457T
caggcaucgugcaccaau

SEQ ID NO: 3871281 - RNA, 22 nt, Shigella flexneri 2a str. 2457T
caggcauuaaauccugaaacca

SEQ ID NO: 3871282 - RNA, 18 nt, Shigella flexneri 2a str. 2457T
caggcauuugcuccagac

SEQ ID NO: 3871283 - RNA, 16 nt, Shigella flexneri 2a str. 2457T
caggcauuuuuaucac

SEQ ID NO: 3871284 - RNA, 15 nt, Shigella flexneri 2a str. 2457T
caggccaaaaaacag

SEQ ID NO: 3871285 - RNA, 20 nt, Shigella flexneri 2a str. 2457T
caggccaaaaaacagccccu

SEQ ID NO: 3871286 - RNA, 14 nt, Shigella flexneri 2a str. 2457T
caggccaacagucu

SEQ ID NO: 3871287 - RNA, 12 nt, Shigella flexneri 2a str. 2457T
caggccagcagc

SEQ ID NO: 3871288 - RNA, 17 nt, Shigella flexneri 2a str. 2457T
caggccaggauuacgcu

SEQ ID NO: 3871289 - RNA, 16 nt, Shigella flexneri 2a str. 2457T
caggccaucagcagcg

SEQ ID NO: 3871290 - RNA, 17 nt, Shigella flexneri 2a str. 2457T
caggcccaacuguugau

SEQ ID NO: 3871291 - RNA, 14 nt, Shigella flexneri 2a str. 2457T
caggcccgcauaga

SEQ ID NO: 3871292 - RNA, 13 nt, Shigella flexneri 2a str. 2457T
caggcccugcugu

SEQ ID NO: 3871293 - RNA, 13 nt, Shigella flexneri 2a str. 2457T
caggccgccugca

SEQ ID NO: 3871294 - RNA, 13 nt, Shigella flexneri 2a str. 2457T
caggccgcgcagu

SEQ ID NO: 3871295 - RNA, 18 nt, Shigella flexneri 2a str. 2457T
caggccggagccagccgu

SEQ ID NO: 3871296 - RNA, 16 nt, Shigella flexneri 2a str. 2457T
caggccuaacacaugc

SEQ ID NO: 3871297 - RNA, 20 nt, Shigella flexneri 2a str. 2457T
caggccuacaaaaucuugca

SEQ ID NO: 3871298 - RNA, 17 nt, Shigella flexneri 2a str. 2457T
caggccuacaaguccgu

SEQ ID NO: 3871299 - RNA, 18 nt, Shigella flexneri 2a str. 2457T
caggccuacaaguccguu

SEQ ID NO: 3871300 - RNA, 23 nt, Shigella flexneri 2a str. 2457T
caggccuacagcauauaaugcaa

SEQ ID NO: 3871301 - RNA, 22 nt, Shigella flexneri 2a str. 2457T
caggccuacaugauuucugcaa

SEQ ID NO: 3871302 - RNA, 23 nt, Shigella flexneri 2a str. 2457T
caggccuaccgguguuucgacga

SEQ ID NO: 3871303 - RNA, 18 nt, Shigella flexneri 2a str. 2457T
caggccuacgugaggcau

SEQ ID NO: 3871304 - RNA, 22 nt, Shigella flexneri 2a str. 2457T
caggccugauaagacgcgcagc

SEQ ID NO: 3871305 - RNA, 18 nt, Shigella flexneri 2a str. 2457T
caggcgaaacccgcugcc

SEQ ID NO: 3871306 - RNA, 16 nt, Shigella flexneri 2a str. 2457T
caggcgaaggccucuc

SEQ ID NO: 3871307 - RNA, 18 nt, Shigella flexneri 2a str. 2457T
caggcgagaucggcaggc

SEQ ID NO: 3871308 - RNA, 18 nt, Shigella flexneri 2a str. 2457T
caggcgagucgagauccc

SEQ ID NO: 3871309 - RNA, 15 nt, Shigella flexneri 2a str. 2457T
caggcgaugccaguc

SEQ ID NO: 3871310 - RNA, 17 nt, Shigella flexneri 2a str. 2457T
caggcgauuuacuggca

SEQ ID NO: 3871311 - RNA, 22 nt, Shigella flexneri 2a str. 2457T
caggcgcgaauggaaagcccgc

SEQ ID NO: 3871312 - RNA, 13 nt, Shigella flexneri 2a str. 2457T
caggcgcgccugg

SEQ ID NO: 3871313 - RNA, 14 nt, Shigella flexneri 2a str. 2457T
caggcgcgccuggu

SEQ ID NO: 3871314 - RNA, 15 nt, Shigella flexneri 2a str. 2457T
caggcgcgugaaugc

SEQ ID NO: 3871315 - RNA, 15 nt, Shigella flexneri 2a str. 2457T
caggcgcugaaagaa

SEQ ID NO: 3871316 - RNA, 16 nt, Shigella flexneri 2a str. 2457T
caggcgcuguaugccu

SEQ ID NO: 3871317 - RNA, 13 nt, Shigella flexneri 2a str. 2457T
caggcgcuuggcu

SEQ ID NO: 3871318 - RNA, 16 nt, Shigella flexneri 2a str. 2457T
caggcggcgaagcuga

SEQ ID NO: 3871319 - RNA, 16 nt, Shigella flexneri 2a str. 2457T
caggcggcuucgcauc

SEQ ID NO: 3871320 - RNA, 20 nt, Shigella flexneri 2a str. 2457T
caggcguaacacucgugcgu

SEQ ID NO: 3871321 - RNA, 15 nt, Shigella flexneri 2a str. 2457T
caggcguucugccug

SEQ ID NO: 3871322 - RNA, 15 nt, Shigella flexneri 2a str. 2457T
caggcguuuacccuu

SEQ ID NO: 3871323 - RNA, 20 nt, Shigella flexneri 2a str. 2457T
caggcguuuacccuucgcac

SEQ ID NO: 3871324 - RNA, 20 nt, Shigella flexneri 2a str. 2457T
caggcguuuguaacccacca

SEQ ID NO: 3871325 - RNA, 22 nt, Shigella flexneri 2a str. 2457T
caggcguuuguaacccaccaug

SEQ ID NO: 3871326 - RNA, 22 nt, Shigella flexneri 2a str. 2457T
caggcuaccgcagugaaauuuc

SEQ ID NO: 3871327 - RNA, 14 nt, Shigella flexneri 2a str. 2457T
caggcuacucccag

SEQ ID NO: 3871328 - RNA, 16 nt, Shigella flexneri 2a str. 2457T
caggcuacucccagua

SEQ ID NO: 3871329 - RNA, 17 nt, Shigella flexneri 2a str. 2457T
caggcuaucgaacaugc

SEQ ID NO: 3871330 - RNA, 23 nt, Shigella flexneri 2a str. 2457T
caggcucagaagacgcuccagug

SEQ ID NO: 3871331 - RNA, 22 nt, Shigella flexneri 2a str. 2457T
caggcucauaccuuccacuuuc

SEQ ID NO: 3871332 - RNA, 16 nt, Shigella flexneri 2a str. 2457T
caggcucgccgccgcu

SEQ ID NO: 3871333 - RNA, 17 nt, Shigella flexneri 2a str. 2457T
caggcucgccgccgcug

SEQ ID NO: 3871334 - RNA, 21 nt, Shigella flexneri 2a str. 2457T
caggcucgccgccgcuggcgu

SEQ ID NO: 3871335 - RNA, 18 nt, Shigella flexneri 2a str. 2457T
caggcucugacuggcgcu

SEQ ID NO: 3871336 - RNA, 14 nt, Shigella flexneri 2a str. 2457T
caggcucugguguu

SEQ ID NO: 3871337 - RNA, 23 nt, Shigella flexneri 2a str. 2457T
caggcugaacaacaguuuuaucu

SEQ ID NO: 3871338 - RNA, 19 nt, Shigella flexneri 2a str. 2457T
caggcugcaaagucugggc

SEQ ID NO: 3871339 - RNA, 17 nt, Shigella flexneri 2a str. 2457T
caggcugcgaguccugu

SEQ ID NO: 3871340 - RNA, 23 nt, Shigella flexneri 2a str. 2457T
caggcugguaacagugcaccgga

SEQ ID NO: 3871341 - RNA, 12 nt, Shigella flexneri 2a str. 2457T
caggcuguguuu

SEQ ID NO: 3871342 - RNA, 23 nt, Shigella flexneri 2a str. 2457T
caggcuguuaaggaaauccugcc

SEQ ID NO: 3871343 - RNA, 13 nt, Shigella flexneri 2a str. 2457T
caggcuucaacac

SEQ ID NO: 3871344 - RNA, 22 nt, Shigella flexneri 2a str. 2457T
caggcuugcugaugcacgcaga

SEQ ID NO: 3871345 - RNA, 20 nt, Shigella flexneri 2a str. 2457T
caggcuuuauucugacgcca

SEQ ID NO: 3871346 - RNA, 17 nt, Shigella flexneri 2a str. 2457T
caggcuuuuaacaccug

SEQ ID NO: 3871347 - RNA, 23 nt, Shigella flexneri 2a str. 2457T
cagggaaaugacggucaucaccu

SEQ ID NO: 3871348 - RNA, 19 nt, Shigella flexneri 2a str. 2457T
cagggaaugugaugaaaaa

SEQ ID NO: 3871349 - RNA, 19 nt, Shigella flexneri 2a str. 2457T
cagggacgagucgucgaua

SEQ ID NO: 3871350 - RNA, 20 nt, Shigella flexneri 2a str. 2457T
cagggacgagucgucgauau

SEQ ID NO: 3871351 - RNA, 21 nt, Shigella flexneri 2a str. 2457T
cagggaguacguggaggaugg

SEQ ID NO: 3871352 - RNA, 16 nt, Shigella flexneri 2a str. 2457T
cagggagucuugcugg

SEQ ID NO: 3871353 - RNA, 17 nt, Shigella flexneri 2a str. 2457T
cagggagucuugcugga

SEQ ID NO: 3871354 - RNA, 16 nt, Shigella flexneri 2a str. 2457T
cagggauaaagccccc

SEQ ID NO: 3871355 - RNA, 23 nt, Shigella flexneri 2a str. 2457T
caguaccgccgccauaaacagca

SEQ ID NO: 3871356 - RNA, 21 nt, Shigella flexneri 2a str. 2457T
caguaccuccuucacaguggc

SEQ ID NO: 3871357 - RNA, 17 nt, Shigella flexneri 2a str. 2457T
caguacgcgcccgccgc

SEQ ID NO: 3871358 - RNA, 19 nt, Shigella flexneri 2a str. 2457T
caguacgcgcccgccgcug

SEQ ID NO: 3871359 - RNA, 23 nt, Shigella flexneri 2a str. 2457T
caguacggcagcaaucgaccagg

SEQ ID NO: 3871360 - RNA, 23 nt, Shigella flexneri 2a str. 2457T
caguacggcuucgaucaggaacu

SEQ ID NO: 3871361 - RNA, 21 nt, Shigella flexneri 2a str. 2457T
caguacggucgugcgguuuca

SEQ ID NO: 3871362 - RNA, 16 nt, Shigella flexneri 2a str. 2457T
caguagacucaagcag

SEQ ID NO: 3871363 - RNA, 18 nt, Shigella flexneri 2a str. 2457T
caguagccaugcauaaug

SEQ ID NO: 3871364 - RNA, 23 nt, Shigella flexneri 2a str. 2457T
caguagccaugcauaaugcagcc

SEQ ID NO: 3871365 - RNA, 19 nt, Shigella flexneri 2a str. 2457T
caguagcgcaaucaccacc

SEQ ID NO: 3871366 - RNA, 21 nt, Shigella flexneri 2a str. 2457T
caguagugguaacgcacacau

SEQ ID NO: 3871367 - RNA, 17 nt, Shigella flexneri 2a str. 2457T
caguauaacgaaacggg

SEQ ID NO: 3871368 - RNA, 14 nt, Shigella flexneri 2a str. 2457T
caguauacgccaca

SEQ ID NO: 3871369 - RNA, 15 nt, Shigella flexneri 2a str. 2457T
caguauacgccacau

SEQ ID NO: 3871370 - RNA, 15 nt, Shigella flexneri 2a str. 2457T
caguaugaaugacag

SEQ ID NO: 3871371 - RNA, 15 nt, Shigella flexneri 2a str. 2457T
caguaugaucuugcc

SEQ ID NO: 3871372 - RNA, 19 nt, Shigella flexneri 2a str. 2457T
caguauuaucugggcugcc

SEQ ID NO: 3871373 - RNA, 19 nt, Shigella flexneri 2a str. 2457T
caguauucaggucagcggc

SEQ ID NO: 3871374 - RNA, 15 nt, Shigella flexneri 2a str. 2457T
caguauugccaugca

SEQ ID NO: 3871375 - RNA, 15 nt, Shigella flexneri 2a str. 2457T
cagucaaucauccau

SEQ ID NO: 3871376 - RNA, 22 nt, Shigella flexneri 2a str. 2457T
cagucacaccagcgauguaacc

SEQ ID NO: 3871377 - RNA, 21 nt, Shigella flexneri 2a str. 2457T
cagucacaccgcgcgucccug

SEQ ID NO: 3871378 - RNA, 16 nt, Shigella flexneri 2a str. 2457T
cagucaccagcaucag

SEQ ID NO: 3871379 - RNA, 17 nt, Shigella flexneri 2a str. 2457T
cagucaccugcccuccg

SEQ ID NO: 3871380 - RNA, 22 nt, Shigella flexneri 2a str. 2457T
cagucacgacaaagacaucaaa

SEQ ID NO: 3871381 - RNA, 23 nt, Shigella flexneri 2a str. 2457T
cagucacggcgcgguugcggguu

SEQ ID NO: 3871382 - RNA, 16 nt, Shigella flexneri 2a str. 2457T
cagucacuacgcgacc

SEQ ID NO: 3871383 - RNA, 14 nt, Shigella flexneri 2a str. 2457T
cagucacuucaaau

SEQ ID NO: 3871384 - RNA, 16 nt, Shigella flexneri 2a str. 2457T
cagucacuuuuuuccg

SEQ ID NO: 3871385 - RNA, 12 nt, Shigella flexneri 2a str. 2457T
cagucagucuca

SEQ ID NO: 3871386 - RNA, 17 nt, Shigella flexneri 2a str. 2457T
cagucagucucaaggga

SEQ ID NO: 3871387 - RNA, 17 nt, Shigella flexneri 2a str. 2457T
cagucauaaccagucca

SEQ ID NO: 3871388 - RNA, 19 nt, Shigella flexneri 2a str. 2457T
cagucauaaccaguccauu

SEQ ID NO: 3871389 - RNA, 16 nt, Shigella flexneri 2a str. 2457T
caguccaccugaccug

SEQ ID NO: 3871390 - RNA, 19 nt, Shigella flexneri 2a str. 2457T
caguccaccugaccugcga

SEQ ID NO: 3871391 - RNA, 16 nt, Shigella flexneri 2a str. 2457T
caguccacgguugguu

SEQ ID NO: 3871392 - RNA, 13 nt, Shigella flexneri 2a str. 2457T
caguccagcgccu

SEQ ID NO: 3871393 - RNA, 12 nt, Shigella flexneri 2a str. 2457T
caguccaucggc

SEQ ID NO: 3871394 - RNA, 18 nt, Shigella flexneri 2a str. 2457T
caguccauuaccgauaga

SEQ ID NO: 3871395 - RNA, 14 nt, Shigella flexneri 2a str. 2457T
cagucccaguucau

SEQ ID NO: 3871396 - RNA, 17 nt, Shigella flexneri 2a str. 2457T
caguccccucgccccuc

SEQ ID NO: 3871397 - RNA, 17 nt, Shigella flexneri 2a str. 2457T
cagucccgcgacaaucg

SEQ ID NO: 3871398 - RNA, 15 nt, Shigella flexneri 2a str. 2457T
caguccgccuucaac

SEQ ID NO: 3871399 - RNA, 21 nt, Shigella flexneri 2a str. 2457T
caguccgcucgccgcagagau

SEQ ID NO: 3871400 - RNA, 17 nt, Shigella flexneri 2a str. 2457T
cagucgcaaaccuggca

SEQ ID NO: 3871401 - RNA, 16 nt, Shigella flexneri 2a str. 2457T
cagucgcacgccuggc

SEQ ID NO: 3871402 - RNA, 12 nt, Shigella flexneri 2a str. 2457T
cagucgcccccg

SEQ ID NO: 3871403 - RNA, 21 nt, Shigella flexneri 2a str. 2457T
cagucgcgcaauugccagaca

SEQ ID NO: 3871404 - RNA, 18 nt, Shigella flexneri 2a str. 2457T
cagucgcugaaguuucuu

SEQ ID NO: 3871405 - RNA, 13 nt, Shigella flexneri 2a str. 2457T
cagucgcugacac

SEQ ID NO: 3871406 - RNA, 15 nt, Shigella flexneri 2a str. 2457T
cagucggcguaaucc

SEQ ID NO: 3871407 - RNA, 13 nt, Shigella flexneri 2a str. 2457T
cagucggcuuucu

SEQ ID NO: 3871408 - RNA, 21 nt, Shigella flexneri 2a str. 2457T
cagucggcuuucucauuuuuu

SEQ ID NO: 3871409 - RNA, 17 nt, Shigella flexneri 2a str. 2457T
cagucgggguguugcgu

SEQ ID NO: 3871410 - RNA, 16 nt, Shigella flexneri 2a str. 2457T
cagucgucaucccagu

SEQ ID NO: 3871411 - RNA, 22 nt, Shigella flexneri 2a str. 2457T
cagucgugcgguaguuucuccc

SEQ ID NO: 3871412 - RNA, 19 nt, Shigella flexneri 2a str. 2457T
cagucguucaaccacuuca

SEQ ID NO: 3871413 - RNA, 16 nt, Shigella flexneri 2a str. 2457T
cagucuagcccgaugg

SEQ ID NO: 3871414 - RNA, 14 nt, Shigella flexneri 2a str. 2457T
cagucucaaaccgg

SEQ ID NO: 3871415 - RNA, 23 nt, Shigella flexneri 2a str. 2457T
cagucucaaaccggcuccagaua

SEQ ID NO: 3871416 - RNA, 21 nt, Shigella flexneri 2a str. 2457T
cagucugcgcccugggcuuca

SEQ ID NO: 3871417 - RNA, 23 nt, Shigella flexneri 2a str. 2457T
cagucuggacaaagagcuuucau

SEQ ID NO: 3871418 - RNA, 12 nt, Shigella flexneri 2a str. 2457T
cagucuggagca

SEQ ID NO: 3871419 - RNA, 14 nt, Shigella flexneri 2a str. 2457T
cagucuggagcaaa

SEQ ID NO: 3871420 - RNA, 16 nt, Shigella flexneri 2a str. 2457T
cagucuucaucauccu

SEQ ID NO: 3871421 - RNA, 19 nt, Shigella flexneri 2a str. 2457T
cagucuucaucauccucuu

SEQ ID NO: 3871422 - RNA, 23 nt, Shigella flexneri 2a str. 2457T
cagucuuccaucacaaagugggg

SEQ ID NO: 3871423 - RNA, 15 nt, Shigella flexneri 2a str. 2457T
cagucuucccagccc

SEQ ID NO: 3871424 - RNA, 12 nt, Shigella flexneri 2a str. 2457T
cagucuuccggc

SEQ ID NO: 3871425 - RNA, 22 nt, Shigella flexneri 2a str. 2457T
cagucuuugccguuggcggcgu

SEQ ID NO: 3871426 - RNA, 11 nt, Shigella flexneri 2a str. 2457T
cagugaaccca

SEQ ID NO: 3871427 - RNA, 21 nt, Shigella flexneri 2a str. 2457T
cagugaacgcccccucacccu

SEQ ID NO: 3871428 - RNA, 21 nt, Shigella flexneri 2a str. 2457T
cagugaauuucacuucgccaa

SEQ ID NO: 3871429 - RNA, 21 nt, Shigella flexneri 2a str. 2457T
cagugacaaauuccgaacaaa

SEQ ID NO: 3871430 - RNA, 16 nt, Shigella flexneri 2a str. 2457T
cagugacauucaccuc

SEQ ID NO: 3871431 - RNA, 20 nt, Shigella flexneri 2a str. 2457T
cagugacccgcagccagcac

SEQ ID NO: 3871432 - RNA, 20 nt, Shigella flexneri 2a str. 2457T
cagugaccgaaccuguuuuc

SEQ ID NO: 3871433 - RNA, 17 nt, Shigella flexneri 2a str. 2457T
cagugacuuccguaccg

SEQ ID NO: 3871434 - RNA, 20 nt, Shigella flexneri 2a str. 2457T
cagugacuuccgucccagcc

SEQ ID NO: 3871435 - RNA, 18 nt, Shigella flexneri 2a str. 2457T
cagugacuucugccagcu

SEQ ID NO: 3871436 - RNA, 15 nt, Shigella flexneri 2a str. 2457T
cagugagaagccacc

SEQ ID NO: 3871437 - RNA, 19 nt, Shigella flexneri 2a str. 2457T
cagugaguccuguuucgga

SEQ ID NO: 3871438 - RNA, 22 nt, Shigella flexneri 2a str. 2457T
cagugauauauuuuuaaauaua

SEQ ID NO: 3871439 - RNA, 14 nt, Shigella flexneri 2a str. 2457T
cagugauucauagu

SEQ ID NO: 3871440 - RNA, 17 nt, Shigella flexneri 2a str. 2457T
cagugauuuuugcugaa

SEQ ID NO: 3871441 - RNA, 15 nt, Shigella flexneri 2a str. 2457T
cagugcaaaugccag

SEQ ID NO: 3871442 - RNA, 16 nt, Shigella flexneri 2a str. 2457T
cagugcaccggacacu

SEQ ID NO: 3871443 - RNA, 22 nt, Shigella flexneri 2a str. 2457T
cagugcacgaaccagagacaga

SEQ ID NO: 3871444 - RNA, 18 nt, Shigella flexneri 2a str. 2457T
cagugcagcgccuuuugu

SEQ ID NO: 3871445 - RNA, 14 nt, Shigella flexneri 2a str. 2457T
cagugcauccagca

SEQ ID NO: 3871446 - RNA, 15 nt, Shigella flexneri 2a str. 2457T
cagugccaaagccag

SEQ ID NO: 3871447 - RNA, 14 nt, Shigella flexneri 2a str. 2457T
cagugccaguucuu

SEQ ID NO: 3871448 - RNA, 20 nt, Shigella flexneri 2a str. 2457T
cagugccauuaacaggccaa

SEQ ID NO: 3871449 - RNA, 19 nt, Shigella flexneri 2a str. 2457T
cagugccgaaaugucuucc

SEQ ID NO: 3871450 - RNA, 17 nt, Shigella flexneri 2a str. 2457T
cagugccgcauccugca

SEQ ID NO: 3871451 - RNA, 20 nt, Shigella flexneri 2a str. 2457T
cagugccgcauccugcacca

SEQ ID NO: 3871452 - RNA, 21 nt, Shigella flexneri 2a str. 2457T
caguuuuugcaaucagauaaa

SEQ ID NO: 3871453 - RNA, 12 nt, Shigella flexneri 2a str. 2457T
cauaaaaaaacg

SEQ ID NO: 3871454 - RNA, 21 nt, Shigella flexneri 2a str. 2457T
cauaaaaaagaagccuccguu

SEQ ID NO: 3871455 - RNA, 22 nt, Shigella flexneri 2a str. 2457T
cauaaaaaugcccgauaagcaa

SEQ ID NO: 3871456 - RNA, 12 nt, Shigella flexneri 2a str. 2457T
cauaaaaccagc

SEQ ID NO: 3871457 - RNA, 14 nt, Shigella flexneri 2a str. 2457T
cauaaaaucacagg

SEQ ID NO: 3871458 - RNA, 15 nt, Shigella flexneri 2a str. 2457T
cauaaacaccagcaa

SEQ ID NO: 3871459 - RNA, 13 nt, Shigella flexneri 2a str. 2457T
cauaaacagcagg

SEQ ID NO: 3871460 - RNA, 15 nt, Shigella flexneri 2a str. 2457T
cauaaaccacagacc

SEQ ID NO: 3871461 - RNA, 22 nt, Shigella flexneri 2a str. 2457T
cauaaagaaaucaccugccgga

SEQ ID NO: 3871462 - RNA, 22 nt, Shigella flexneri 2a str. 2457T
cauaaagccugcuucaaacgcu

SEQ ID NO: 3871463 - RNA, 17 nt, Shigella flexneri 2a str. 2457T
cauaaagcgguuuucaa

SEQ ID NO: 3871464 - RNA, 18 nt, Shigella flexneri 2a str. 2457T
cauaaagcgguuuucaaa

SEQ ID NO: 3871465 - RNA, 16 nt, Shigella flexneri 2a str. 2457T
cauaaagucuuucuua

SEQ ID NO: 3871466 - RNA, 17 nt, Shigella flexneri 2a str. 2457T
cauaaauacuccauaac

SEQ ID NO: 3871467 - RNA, 11 nt, Shigella flexneri 2a str. 2457T
cauaaaucaau

SEQ ID NO: 3871468 - RNA, 16 nt, Shigella flexneri 2a str. 2457T
cauaaaucagaucgac

SEQ ID NO: 3871469 - RNA, 15 nt, Shigella flexneri 2a str. 2457T
cauaaauugcagcga

SEQ ID NO: 3871470 - RNA, 20 nt, Shigella flexneri 2a str. 2457T
cauaaauuucacgucacgcu

SEQ ID NO: 3871471 - RNA, 22 nt, Shigella flexneri 2a str. 2457T
cauaaauuucugccauuuugcu

SEQ ID NO: 3871472 - RNA, 21 nt, Shigella flexneri 2a str. 2457T
cauaacacagguaacuuaaau

SEQ ID NO: 3871473 - RNA, 23 nt, Shigella flexneri 2a str. 2457T
cauaaccaauaacaggauuuucu

SEQ ID NO: 3871474 - RNA, 14 nt, Shigella flexneri 2a str. 2457T
cauaaccaguccau

SEQ ID NO: 3871475 - RNA, 18 nt, Shigella flexneri 2a str. 2457T
cauaaccugugcaccaga

SEQ ID NO: 3871476 - RNA, 21 nt, Shigella flexneri 2a str. 2457T
cauaacgccaauucauuccuu

SEQ ID NO: 3871477 - RNA, 14 nt, Shigella flexneri 2a str. 2457T
cauaacgccugcuc

SEQ ID NO: 3871478 - RNA, 15 nt, Shigella flexneri 2a str. 2457T
cauaacuccccgaga

SEQ ID NO: 3871479 - RNA, 13 nt, Shigella flexneri 2a str. 2457T
cauaacugccgga

SEQ ID NO: 3871480 - RNA, 19 nt, Shigella flexneri 2a str. 2457T
cauaacugccggaugcggc

SEQ ID NO: 3871481 - RNA, 20 nt, Shigella flexneri 2a str. 2457T
cauaagagauggaaugagca

SEQ ID NO: 3871482 - RNA, 19 nt, Shigella flexneri 2a str. 2457T
cauaauaagcuuuuucugc

SEQ ID NO: 3871483 - RNA, 15 nt, Shigella flexneri 2a str. 2457T
cauaauaugaccuga

SEQ ID NO: 3871484 - RNA, 20 nt, Shigella flexneri 2a str. 2457T
cauaauauucauuacaccaa

SEQ ID NO: 3871485 - RNA, 14 nt, Shigella flexneri 2a str. 2457T
cauaaucagacgac

SEQ ID NO: 3871486 - RNA, 13 nt, Shigella flexneri 2a str. 2457T
cauaaugcagcca

SEQ ID NO: 3871487 - RNA, 15 nt, Shigella flexneri 2a str. 2457T
cauaaugcugacaaa

SEQ ID NO: 3871488 - RNA, 22 nt, Shigella flexneri 2a str. 2457T
cauaaugguggaguggcccagg

SEQ ID NO: 3871489 - RNA, 13 nt, Shigella flexneri 2a str. 2457T
cauaauguccugc

SEQ ID NO: 3871490 - RNA, 22 nt, Shigella flexneri 2a str. 2457T
cauaauuaaacgcgcgcuggaa

SEQ ID NO: 3871491 - RNA, 16 nt, Shigella flexneri 2a str. 2457T
cauaauuugugacgau

SEQ ID NO: 3871492 - RNA, 13 nt, Shigella flexneri 2a str. 2457T
cauacaacgccau

SEQ ID NO: 3871493 - RNA, 22 nt, Shigella flexneri 2a str. 2457T
cauacagaucgugcaucuccug

SEQ ID NO: 3871494 - RNA, 21 nt, Shigella flexneri 2a str. 2457T
cauacagcggccagccauccg

SEQ ID NO: 3871495 - RNA, 19 nt, Shigella flexneri 2a str. 2457T
cauacagcuuuuacagcca

SEQ ID NO: 3871496 - RNA, 20 nt, Shigella flexneri 2a str. 2457T
cauacagcuuuuacagccaa

SEQ ID NO: 3871497 - RNA, 18 nt, Shigella flexneri 2a str. 2457T
cauacaguggaucgacgc

SEQ ID NO: 3871498 - RNA, 12 nt, Shigella flexneri 2a str. 2457T
cauacauccucu

SEQ ID NO: 3871499 - RNA, 15 nt, Shigella flexneri 2a str. 2457T
cauacauccucucuu

SEQ ID NO: 3871500 - RNA, 14 nt, Shigella flexneri 2a str. 2457T
cauaccacagcaaa

SEQ ID NO: 3871501 - RNA, 15 nt, Shigella flexneri 2a str. 2457T
cauaccaccgacgug

SEQ ID NO: 3871502 - RNA, 21 nt, Shigella flexneri 2a str. 2457T
cauaccacuuccagcagacca

SEQ ID NO: 3871503 - RNA, 15 nt, Shigella flexneri 2a str. 2457T
cauaccauccggcau

SEQ ID NO: 3871504 - RNA, 16 nt, Shigella flexneri 2a str. 2457T
cauaccccacauaguu

SEQ ID NO: 3871505 - RNA, 21 nt, Shigella flexneri 2a str. 2457T
cauacccgcaacauacugccc

SEQ ID NO: 3871506 - RNA, 22 nt, Shigella flexneri 2a str. 2457T
cauacccgccagugcugaaggu

SEQ ID NO: 3871507 - RNA, 20 nt, Shigella flexneri 2a str. 2457T
cauaccgugguacguuaaag

SEQ ID NO: 3871508 - RNA, 15 nt, Shigella flexneri 2a str. 2457T
cauaccuaaaaaauc

SEQ ID NO: 3871509 - RNA, 16 nt, Shigella flexneri 2a str. 2457T
cauaccuaaaaaaucc

SEQ ID NO: 3871510 - RNA, 14 nt, Shigella flexneri 2a str. 2457T
cauaccuaaaagca

SEQ ID NO: 3871511 - RNA, 23 nt, Shigella flexneri 2a str. 2457T
cauaccuaaaagcacgccagaca

SEQ ID NO: 3871512 - RNA, 17 nt, Shigella flexneri 2a str. 2457T
cauaccuaccugcaguu

SEQ ID NO: 3871513 - RNA, 18 nt, Shigella flexneri 2a str. 2457T
cauaccuccgcaauaugc

SEQ ID NO: 3871514 - RNA, 13 nt, Shigella flexneri 2a str. 2457T
cauaccugagugg

SEQ ID NO: 3871515 - RNA, 17 nt, Shigella flexneri 2a str. 2457T
cauaccugaguggcaau

SEQ ID NO: 3871516 - RNA, 22 nt, Shigella flexneri 2a str. 2457T
cauaccuuccacuuucacgccc

SEQ ID NO: 3871517 - RNA, 17 nt, Shigella flexneri 2a str. 2457T
cauaccuuccagcgcgu

SEQ ID NO: 3871518 - RNA, 21 nt, Shigella flexneri 2a str. 2457T
cauacgacgugccgcagcuuc

SEQ ID NO: 3871519 - RNA, 16 nt, Shigella flexneri 2a str. 2457T
cauacgcaaaaaacau

SEQ ID NO: 3871520 - RNA, 19 nt, Shigella flexneri 2a str. 2457T
cauacgcguaaaacagcca

SEQ ID NO: 3871521 - RNA, 20 nt, Shigella flexneri 2a str. 2457T
cauacgcguaaaacagccag

SEQ ID NO: 3871522 - RNA, 20 nt, Shigella flexneri 2a str. 2457T
cauacggcacuuucaucgcg

SEQ ID NO: 3871523 - RNA, 16 nt, Shigella flexneri 2a str. 2457T
cauacguacaaacgcu

SEQ ID NO: 3871524 - RNA, 15 nt, Shigella flexneri 2a str. 2457T
cauacguugcauaaa

SEQ ID NO: 3871525 - RNA, 15 nt, Shigella flexneri 2a str. 2457T
cauacguuucaccag

SEQ ID NO: 3871526 - RNA, 19 nt, Shigella flexneri 2a str. 2457T
cauacucgaggcauuggca

SEQ ID NO: 3871527 - RNA, 17 nt, Shigella flexneri 2a str. 2457T
cauacucuuucccggca

SEQ ID NO: 3871528 - RNA, 14 nt, Shigella flexneri 2a str. 2457T
cauacucuuugaca

SEQ ID NO: 3871529 - RNA, 18 nt, Shigella flexneri 2a str. 2457T
cauacugacaaacugcgc

SEQ ID NO: 3871530 - RNA, 19 nt, Shigella flexneri 2a str. 2457T
cauacugcccgagcgccau

SEQ ID NO: 3871531 - RNA, 19 nt, Shigella flexneri 2a str. 2457T
cauacugccgaccaucugu

SEQ ID NO: 3871532 - RNA, 21 nt, Shigella flexneri 2a str. 2457T
cauacugggggcacugaaagc

SEQ ID NO: 3871533 - RNA, 14 nt, Shigella flexneri 2a str. 2457T
cauacuuauuauga

SEQ ID NO: 3871534 - RNA, 22 nt, Shigella flexneri 2a str. 2457T
cauagaaaaagaauugcagaua

SEQ ID NO: 3871535 - RNA, 17 nt, Shigella flexneri 2a str. 2457T
cauagauaccuucuuga

SEQ ID NO: 3871536 - RNA, 22 nt, Shigella flexneri 2a str. 2457T
cauagaucuaaaugccacugaa

SEQ ID NO: 3871537 - RNA, 23 nt, Shigella flexneri 2a str. 2457T
cauagauuaauuucccaccacua

SEQ ID NO: 3871538 - RNA, 22 nt, Shigella flexneri 2a str. 2457T
cauagcaaccgcgacugggagg

SEQ ID NO: 3871539 - RNA, 12 nt, Shigella flexneri 2a str. 2457T
cauagcacacuu

SEQ ID NO: 3871540 - RNA, 19 nt, Shigella flexneri 2a str. 2457T
cauagcagcacaccacauc

SEQ ID NO: 3871541 - RNA, 20 nt, Shigella flexneri 2a str. 2457T
cauagcgucccaguaacguc

SEQ ID NO: 3871542 - RNA, 14 nt, Shigella flexneri 2a str. 2457T
cauagguucuuuua

SEQ ID NO: 3871543 - RNA, 17 nt, Shigella flexneri 2a str. 2457T
cauagguucuuuuaaau

SEQ ID NO: 3871544 - RNA, 13 nt, Shigella flexneri 2a str. 2457T
cauaguaagcaga

SEQ ID NO: 3871545 - RNA, 14 nt, Shigella flexneri 2a str. 2457T
cauaguagccagcc

SEQ ID NO: 3871546 - RNA, 17 nt, Shigella flexneri 2a str. 2457T
cauaguagccagccaga

SEQ ID NO: 3871547 - RNA, 19 nt, Shigella flexneri 2a str. 2457T
cauaguagccagccagaau

SEQ ID NO: 3871548 - RNA, 20 nt, Shigella flexneri 2a str. 2457T
cauagucacuaccuguuuaa

SEQ ID NO: 3871549 - RNA, 14 nt, Shigella flexneri 2a str. 2457T
caucacgcaaaugu

SEQ ID NO: 3871550 - RNA, 15 nt, Shigella flexneri 2a str. 2457T
caucacgcgcaucug

SEQ ID NO: 3871551 - RNA, 16 nt, Shigella flexneri 2a str. 2457T
caucacggcagccuga

SEQ ID NO: 3871552 - RNA, 19 nt, Shigella flexneri 2a str. 2457T
caucacgguugagggcaaa

SEQ ID NO: 3871553 - RNA, 13 nt, Shigella flexneri 2a str. 2457T
caucacgucccgu

SEQ ID NO: 3871554 - RNA, 14 nt, Shigella flexneri 2a str. 2457T
caucacgucggcgu

SEQ ID NO: 3871555 - RNA, 17 nt, Shigella flexneri 2a str. 2457T
caucacuccauccagca

SEQ ID NO: 3871556 - RNA, 16 nt, Shigella flexneri 2a str. 2457T
caucacugcaaauacc

SEQ ID NO: 3871557 - RNA, 23 nt, Shigella flexneri 2a str. 2457T
caucacugcaaauacccaaaaaa

SEQ ID NO: 3871558 - RNA, 18 nt, Shigella flexneri 2a str. 2457T
caucacuuuugaaaucaa

SEQ ID NO: 3871559 - RNA, 15 nt, Shigella flexneri 2a str. 2457T
caucagaaaugccag

SEQ ID NO: 3871560 - RNA, 13 nt, Shigella flexneri 2a str. 2457T
caucagaacguaa

SEQ ID NO: 3871561 - RNA, 21 nt, Shigella flexneri 2a str. 2457T
caucagaagauggugaauggu

SEQ ID NO: 3871562 - RNA, 14 nt, Shigella flexneri 2a str. 2457T
caucagaggaauga

SEQ ID NO: 3871563 - RNA, 22 nt, Shigella flexneri 2a str. 2457T
caucagaucguugaacccggca

SEQ ID NO: 3871564 - RNA, 16 nt, Shigella flexneri 2a str. 2457T
caucagcagaaucgca

SEQ ID NO: 3871565 - RNA, 18 nt, Shigella flexneri 2a str. 2457T
caucagcauaaucaccag

SEQ ID NO: 3871566 - RNA, 23 nt, Shigella flexneri 2a str. 2457T
caucagcaucggugaggaucacc

SEQ ID NO: 3871567 - RNA, 15 nt, Shigella flexneri 2a str. 2457T
caucagcaugacaaa

SEQ ID NO: 3871568 - RNA, 18 nt, Shigella flexneri 2a str. 2457T
caucagcaugacaaaaaa

SEQ ID NO: 3871569 - RNA, 22 nt, Shigella flexneri 2a str. 2457T
caucagcaugacaaaaaagcca

SEQ ID NO: 3871570 - RNA, 20 nt, Shigella flexneri 2a str. 2457T
caucagcgauucauugagua

SEQ ID NO: 3871571 - RNA, 21 nt, Shigella flexneri 2a str. 2457T
caucagcgauucauugaguaa

SEQ ID NO: 3871572 - RNA, 13 nt, Shigella flexneri 2a str. 2457T
caucagcgccaac

SEQ ID NO: 3871573 - RNA, 13 nt, Shigella flexneri 2a str. 2457T
caucagcgccacc

SEQ ID NO: 3871574 - RNA, 15 nt, Shigella flexneri 2a str. 2457T
caucagcgccaccag

SEQ ID NO: 3871575 - RNA, 18 nt, Shigella flexneri 2a str. 2457T
caucagcgccaccagcgc

SEQ ID NO: 3871576 - RNA, 14 nt, Shigella flexneri 2a str. 2457T
caucagcgccuuac

SEQ ID NO: 3871577 - RNA, 19 nt, Shigella flexneri 2a str. 2457T
caucagcgguacucgcgca

SEQ ID NO: 3871578 - RNA, 15 nt, Shigella flexneri 2a str. 2457T
caucagcgucgguuu

SEQ ID NO: 3871579 - RNA, 23 nt, Shigella flexneri 2a str. 2457T
caucagcugccagggcacugaua

SEQ ID NO: 3871580 - RNA, 11 nt, Shigella flexneri 2a str. 2457T
caucaggaaac

SEQ ID NO: 3871581 - RNA, 21 nt, Shigella flexneri 2a str. 2457T
caucaggacgaauacaagaga

SEQ ID NO: 3871582 - RNA, 20 nt, Shigella flexneri 2a str. 2457T
caucaggaugacaaacuuga

SEQ ID NO: 3871583 - RNA, 22 nt, Shigella flexneri 2a str. 2457T
caucaggcaaucucugguuugu

SEQ ID NO: 3871584 - RNA, 21 nt, Shigella flexneri 2a str. 2457T
caucaggcagauacaaccaau

SEQ ID NO: 3871585 - RNA, 21 nt, Shigella flexneri 2a str. 2457T
caucaggcaucgugcaccaau

SEQ ID NO: 3871586 - RNA, 13 nt, Shigella flexneri 2a str. 2457T
caucaggcaucug

SEQ ID NO: 3871587 - RNA, 17 nt, Shigella flexneri 2a str. 2457T
caucaggccuacaaaau

SEQ ID NO: 3871588 - RNA, 23 nt, Shigella flexneri 2a str. 2457T
caucaggcguucgcggcggcacu

SEQ ID NO: 3871589 - RNA, 18 nt, Shigella flexneri 2a str. 2457T
caucaggcuaaucgccag

SEQ ID NO: 3871590 - RNA, 12 nt, Shigella flexneri 2a str. 2457T
caucagggcgcu

SEQ ID NO: 3871591 - RNA, 16 nt, Shigella flexneri 2a str. 2457T
caucagugaacccaua

SEQ ID NO: 3871592 - RNA, 22 nt, Shigella flexneri 2a str. 2457T
caucaguugcaccugauccagc

SEQ ID NO: 3871593 - RNA, 19 nt, Shigella flexneri 2a str. 2457T
caucauaaauaagaugcga

SEQ ID NO: 3871594 - RNA, 15 nt, Shigella flexneri 2a str. 2457T
caucauaaccugcuc

SEQ ID NO: 3871595 - RNA, 13 nt, Shigella flexneri 2a str. 2457T
caucauaagacuu

SEQ ID NO: 3871596 - RNA, 14 nt, Shigella flexneri 2a str. 2457T
caucauaauaauug

SEQ ID NO: 3871597 - RNA, 22 nt, Shigella flexneri 2a str. 2457T
caucauacccaacguaacaaaa

SEQ ID NO: 3871598 - RNA, 12 nt, Shigella flexneri 2a str. 2457T
caucaucagaaa

SEQ ID NO: 3871599 - RNA, 16 nt, Shigella flexneri 2a str. 2457T
caucaucagaaaugcc

SEQ ID NO: 3871600 - RNA, 22 nt, Shigella flexneri 2a str. 2457T
caucaucagaaaugccaguaac

SEQ ID NO: 3871601 - RNA, 20 nt, Shigella flexneri 2a str. 2457T
caucaucaggaacaucccuu

SEQ ID NO: 3871602 - RNA, 15 nt, Shigella flexneri 2a str. 2457T
caucaucgcagauuu

SEQ ID NO: 3871603 - RNA, 14 nt, Shigella flexneri 2a str. 2457T
caucaucgcuuuca

SEQ ID NO: 3871604 - RNA, 20 nt, Shigella flexneri 2a str. 2457T
caucaucgguaccgccagca

SEQ ID NO: 3871605 - RNA, 22 nt, Shigella flexneri 2a str. 2457T
caucaucuggcugugauccauu

SEQ ID NO: 3871606 - RNA, 17 nt, Shigella flexneri 2a str. 2457T
caucaugcacuccgcug

SEQ ID NO: 3871607 - RNA, 23 nt, Shigella flexneri 2a str. 2457T
caucaugcucagaugccugaugc

SEQ ID NO: 3871608 - RNA, 22 nt, Shigella flexneri 2a str. 2457T
caucauggcgaugagaaucagu

SEQ ID NO: 3871609 - RNA, 20 nt, Shigella flexneri 2a str. 2457T
caucaugguuugcauccaca

SEQ ID NO: 3871610 - RNA, 20 nt, Shigella flexneri 2a str. 2457T
caucaugucgcccacgccag

SEQ ID NO: 3871611 - RNA, 14 nt, Shigella flexneri 2a str. 2457T
caucauucccgccc

SEQ ID NO: 3871612 - RNA, 22 nt, Shigella flexneri 2a str. 2457T
caucauucccuacgcgauaaaa

SEQ ID NO: 3871613 - RNA, 17 nt, Shigella flexneri 2a str. 2457T
caucauuuaaaaagaaa

SEQ ID NO: 3871614 - RNA, 18 nt, Shigella flexneri 2a str. 2457T
cauccaaaucgcccagca

SEQ ID NO: 3871615 - RNA, 19 nt, Shigella flexneri 2a str. 2457T
cauccaaaucgcccagcaa

SEQ ID NO: 3871616 - RNA, 14 nt, Shigella flexneri 2a str. 2457T
cauccaacaauagu

SEQ ID NO: 3871617 - RNA, 22 nt, Shigella flexneri 2a str. 2457T
cauccaacaauagugccgcacu

SEQ ID NO: 3871618 - RNA, 13 nt, Shigella flexneri 2a str. 2457T
cauccacauucga

SEQ ID NO: 3871619 - RNA, 18 nt, Shigella flexneri 2a str. 2457T
cauccacauucgaaugcc

SEQ ID NO: 3871620 - RNA, 20 nt, Shigella flexneri 2a str. 2457T
cauccacauucgaaugccgu

SEQ ID NO: 3871621 - RNA, 17 nt, Shigella flexneri 2a str. 2457T
cauccaccagcaugaaa

SEQ ID NO: 3871622 - RNA, 17 nt, Shigella flexneri 2a str. 2457T
cauccagacugcucagc

SEQ ID NO: 3871623 - RNA, 15 nt, Shigella flexneri 2a str. 2457T
cauccagcacuugca

SEQ ID NO: 3871624 - RNA, 14 nt, Shigella flexneri 2a str. 2457T
cauccagcagacgc

SEQ ID NO: 3871625 - RNA, 14 nt, Shigella flexneri 2a str. 2457T
cauccagcagcccu

SEQ ID NO: 3871626 - RNA, 11 nt, Shigella flexneri 2a str. 2457T
cauccagcagu

SEQ ID NO: 3871627 - RNA, 20 nt, Shigella flexneri 2a str. 2457T
cauccagcguuaccggcuuc

SEQ ID NO: 3871628 - RNA, 13 nt, Shigella flexneri 2a str. 2457T
cauccagcucgug

SEQ ID NO: 3871629 - RNA, 20 nt, Shigella flexneri 2a str. 2457T
cauccagcuuuuagaucacu

SEQ ID NO: 3871630 - RNA, 22 nt, Shigella flexneri 2a str. 2457T
cauccagcuuuuagaucacuca

SEQ ID NO: 3871631 - RNA, 21 nt, Shigella flexneri 2a str. 2457T
cauccagcuuuuuaaucgcca

SEQ ID NO: 3871632 - RNA, 22 nt, Shigella flexneri 2a str. 2457T
cauccagcuuuuuaaucgccau

SEQ ID NO: 3871633 - RNA, 23 nt, Shigella flexneri 2a str. 2457T
cauccagcuuuuuaaucgccauc

SEQ ID NO: 3871634 - RNA, 17 nt, Shigella flexneri 2a str. 2457T
cauccaggaacuccaga

SEQ ID NO: 3871635 - RNA, 20 nt, Shigella flexneri 2a str. 2457T
cauccaggugaaaaauaaaa

SEQ ID NO: 3871636 - RNA, 23 nt, Shigella flexneri 2a str. 2457T
cauccaggugaaaaauaaaagcg

SEQ ID NO: 3871637 - RNA, 19 nt, Shigella flexneri 2a str. 2457T
cauccaguacgccuucacg

SEQ ID NO: 3871638 - RNA, 16 nt, Shigella flexneri 2a str. 2457T
cauccauuacaucacg

SEQ ID NO: 3871639 - RNA, 17 nt, Shigella flexneri 2a str. 2457T
cauccauugcauaaaca

SEQ ID NO: 3871640 - RNA, 14 nt, Shigella flexneri 2a str. 2457T
cauccauuuuucac

SEQ ID NO: 3871641 - RNA, 20 nt, Shigella flexneri 2a str. 2457T
caucccaacuguagugauca

SEQ ID NO: 3871642 - RNA, 15 nt, Shigella flexneri 2a str. 2457T
caucccagacaccgc

SEQ ID NO: 3871643 - RNA, 15 nt, Shigella flexneri 2a str. 2457T
caucccagcagagau

SEQ ID NO: 3871644 - RNA, 22 nt, Shigella flexneri 2a str. 2457T
caucccaggccaaauccuucca

SEQ ID NO: 3871645 - RNA, 17 nt, Shigella flexneri 2a str. 2457T
caucccaguggauaucg

SEQ ID NO: 3871646 - RNA, 15 nt, Shigella flexneri 2a str. 2457T
caucgcuugaaaagg

SEQ ID NO: 3871647 - RNA, 14 nt, Shigella flexneri 2a str. 2457T
caucgcuuuccagg

SEQ ID NO: 3871648 - RNA, 15 nt, Shigella flexneri 2a str. 2457T
caucgcuuuccaggu

SEQ ID NO: 3871649 - RNA, 17 nt, Shigella flexneri 2a str. 2457T
caucggcaaucauuccc

SEQ ID NO: 3871650 - RNA, 15 nt, Shigella flexneri 2a str. 2457T
caucggcagcgccag

SEQ ID NO: 3871651 - RNA, 13 nt, Shigella flexneri 2a str. 2457T
caucggcaucaaa

SEQ ID NO: 3871652 - RNA, 14 nt, Shigella flexneri 2a str. 2457T
caucggcgcuggcg

SEQ ID NO: 3871653 - RNA, 20 nt, Shigella flexneri 2a str. 2457T
caucggcggugaccagcagc

SEQ ID NO: 3871654 - RNA, 21 nt, Shigella flexneri 2a str. 2457T
caucgggaagaggaucugcuc

SEQ ID NO: 3871655 - RNA, 22 nt, Shigella flexneri 2a str. 2457T
caucgggaagaggaucugcucu

SEQ ID NO: 3871656 - RNA, 19 nt, Shigella flexneri 2a str. 2457T
caucgggcagcaucgccag

SEQ ID NO: 3871657 - RNA, 15 nt, Shigella flexneri 2a str. 2457T
caucgggggaagcug

SEQ ID NO: 3871658 - RNA, 13 nt, Shigella flexneri 2a str. 2457T
caucggguaacgg

SEQ ID NO: 3871659 - RNA, 15 nt, Shigella flexneri 2a str. 2457T
caucgguauaaccaa

SEQ ID NO: 3871660 - RNA, 19 nt, Shigella flexneri 2a str. 2457T
caucgguauaaccaaauga

SEQ ID NO: 3871661 - RNA, 16 nt, Shigella flexneri 2a str. 2457T
caucgguaucuuccca

SEQ ID NO: 3871662 - RNA, 19 nt, Shigella flexneri 2a str. 2457T
caucggugaggaucaccag

SEQ ID NO: 3871663 - RNA, 12 nt, Shigella flexneri 2a str. 2457T
caucggugcgcu

SEQ ID NO: 3871664 - RNA, 17 nt, Shigella flexneri 2a str. 2457T
caucguaagcgccagga

SEQ ID NO: 3871665 - RNA, 23 nt, Shigella flexneri 2a str. 2457T
caucguaauacccuugcagacga

SEQ ID NO: 3871666 - RNA, 21 nt, Shigella flexneri 2a str. 2457T
caucguacuguguuguacagu

SEQ ID NO: 3871667 - RNA, 21 nt, Shigella flexneri 2a str. 2457T
caucguaguuuuugcccauca

SEQ ID NO: 3871668 - RNA, 15 nt, Shigella flexneri 2a str. 2457T
caucguauuucagac

SEQ ID NO: 3871669 - RNA, 16 nt, Shigella flexneri 2a str. 2457T
caucguauuucagacc

SEQ ID NO: 3871670 - RNA, 14 nt, Shigella flexneri 2a str. 2457T
caucgucacugaua

SEQ ID NO: 3871671 - RNA, 20 nt, Shigella flexneri 2a str. 2457T
caucgucggccuuaaugccc

SEQ ID NO: 3871672 - RNA, 23 nt, Shigella flexneri 2a str. 2457T
caucgucggccuuaaugcccacg

SEQ ID NO: 3871673 - RNA, 13 nt, Shigella flexneri 2a str. 2457T
caucgugauaaac

SEQ ID NO: 3871674 - RNA, 12 nt, Shigella flexneri 2a str. 2457T
caucgugcacca

SEQ ID NO: 3871675 - RNA, 13 nt, Shigella flexneri 2a str. 2457T
caucgugcaccaa

SEQ ID NO: 3871676 - RNA, 19 nt, Shigella flexneri 2a str. 2457T
caucgugcucgcuuuccau

SEQ ID NO: 3871677 - RNA, 21 nt, Shigella flexneri 2a str. 2457T
caucguguugaugcuccuggc

SEQ ID NO: 3871678 - RNA, 15 nt, Shigella flexneri 2a str. 2457T
caucguuacgauugg

SEQ ID NO: 3871679 - RNA, 20 nt, Shigella flexneri 2a str. 2457T
caucguugacauuugcuuuu

SEQ ID NO: 3871680 - RNA, 22 nt, Shigella flexneri 2a str. 2457T
caucuaaccauuauuaaauuua

SEQ ID NO: 3871681 - RNA, 17 nt, Shigella flexneri 2a str. 2457T
caucuacgcucucuuca

SEQ ID NO: 3871682 - RNA, 21 nt, Shigella flexneri 2a str. 2457T
caucuauagugaggcuauucc

SEQ ID NO: 3871683 - RNA, 12 nt, Shigella flexneri 2a str. 2457T
caucuauuauug

SEQ ID NO: 3871684 - RNA, 20 nt, Shigella flexneri 2a str. 2457T
caucucaacuuucuuggcac

SEQ ID NO: 3871685 - RNA, 22 nt, Shigella flexneri 2a str. 2457T
caucucaggcaguacgcggcgg

SEQ ID NO: 3871686 - RNA, 19 nt, Shigella flexneri 2a str. 2457T
caucuccacagucaggcug

SEQ ID NO: 3871687 - RNA, 14 nt, Shigella flexneri 2a str. 2457T
caucuccagcugcu

SEQ ID NO: 3871688 - RNA, 24 nt, Shigella flexneri 2a str. 2457T
caucucccacgcggcaacggcuuc

SEQ ID NO: 3871689 - RNA, 15 nt, Shigella flexneri 2a str. 2457T
caucucgcucaaaaa

SEQ ID NO: 3871690 - RNA, 19 nt, Shigella flexneri 2a str. 2457T
caucucgcucaaaaaucca

SEQ ID NO: 3871691 - RNA, 20 nt, Shigella flexneri 2a str. 2457T
caucucugcaacgucuuccc

SEQ ID NO: 3871692 - RNA, 22 nt, Shigella flexneri 2a str. 2457T
caucucugcaacgucuucccga

SEQ ID NO: 3871693 - RNA, 19 nt, Shigella flexneri 2a str. 2457T
caucucuuccggcaccaca

SEQ ID NO: 3871694 - RNA, 13 nt, Shigella flexneri 2a str. 2457T
caucucuucuucc

SEQ ID NO: 3871695 - RNA, 14 nt, Shigella flexneri 2a str. 2457T
caucucuucuuccg

SEQ ID NO: 3871696 - RNA, 22 nt, Shigella flexneri 2a str. 2457T
caucucuucuuccggcaccauu

SEQ ID NO: 3871697 - RNA, 23 nt, Shigella flexneri 2a str. 2457T
caucugaaacucgcguaaaucca

SEQ ID NO: 3871698 - RNA, 13 nt, Shigella flexneri 2a str. 2457T
caucugaccagau

SEQ ID NO: 3871699 - RNA, 23 nt, Shigella flexneri 2a str. 2457T
caucugaguugccaucaucacca

SEQ ID NO: 3871700 - RNA, 19 nt, Shigella flexneri 2a str. 2457T
caucugcauucaacuggau

SEQ ID NO: 3871701 - RNA, 23 nt, Shigella flexneri 2a str. 2457T
caucugcauucaacuggauaaaa

SEQ ID NO: 3871702 - RNA, 14 nt, Shigella flexneri 2a str. 2457T
caucugccccauug

SEQ ID NO: 3871703 - RNA, 17 nt, Shigella flexneri 2a str. 2457T
caucugccggaaccagc

SEQ ID NO: 3871704 - RNA, 22 nt, Shigella flexneri 2a str. 2457T
caucugccggaaccagccagga

SEQ ID NO: 3871705 - RNA, 15 nt, Shigella flexneri 2a str. 2457T
caucugccuuauuga

SEQ ID NO: 3871706 - RNA, 20 nt, Shigella flexneri 2a str. 2457T
caucugcguggcgcgcguca

SEQ ID NO: 3871707 - RNA, 21 nt, Shigella flexneri 2a str. 2457T
caucugcguggcgcgcgucac

SEQ ID NO: 3871708 - RNA, 12 nt, Shigella flexneri 2a str. 2457T
caucugcuucaa

SEQ ID NO: 3871709 - RNA, 17 nt, Shigella flexneri 2a str. 2457T
caucuguaggccagaua

SEQ ID NO: 3871710 - RNA, 21 nt, Shigella flexneri 2a str. 2457T
caucuguucugccguccagcc

SEQ ID NO: 3871711 - RNA, 21 nt, Shigella flexneri 2a str. 2457T
caucuguugugccacauccag

SEQ ID NO: 3871712 - RNA, 20 nt, Shigella flexneri 2a str. 2457T
caucuguuucgaucagcaau

SEQ ID NO: 3871713 - RNA, 19 nt, Shigella flexneri 2a str. 2457T
caucuuauccagcaaccag

SEQ ID NO: 3871714 - RNA, 15 nt, Shigella flexneri 2a str. 2457T
caucuucaacugcca

SEQ ID NO: 3871715 - RNA, 17 nt, Shigella flexneri 2a str. 2457T
caucuucaacugccaug

SEQ ID NO: 3871716 - RNA, 18 nt, Shigella flexneri 2a str. 2457T
caucuucacuguccgcca

SEQ ID NO: 3871717 - RNA, 14 nt, Shigella flexneri 2a str. 2457T
caucuucaucaucc

SEQ ID NO: 3871718 - RNA, 18 nt, Shigella flexneri 2a str. 2457T
caucuuccaccuggaacc

SEQ ID NO: 3871719 - RNA, 20 nt, Shigella flexneri 2a str. 2457T
caucuuccaguugcacgcca

SEQ ID NO: 3871720 - RNA, 21 nt, Shigella flexneri 2a str. 2457T
caucuuccaguugcacgccac

SEQ ID NO: 3871721 - RNA, 22 nt, Shigella flexneri 2a str. 2457T
caucuucggcguuguaagguua

SEQ ID NO: 3871722 - RNA, 15 nt, Shigella flexneri 2a str. 2457T
caucuucuccagcga

SEQ ID NO: 3871723 - RNA, 12 nt, Shigella flexneri 2a str. 2457T
caucuucuucac

SEQ ID NO: 3871724 - RNA, 14 nt, Shigella flexneri 2a str. 2457T
caucuugauaccaa

SEQ ID NO: 3871725 - RNA, 21 nt, Shigella flexneri 2a str. 2457T
caucuuguucauagugccuga

SEQ ID NO: 3871726 - RNA, 15 nt, Shigella flexneri 2a str. 2457T
caucuuugaaaucac

SEQ ID NO: 3871727 - RNA, 17 nt, Shigella flexneri 2a str. 2457T
caugaaaaaacuggcua

SEQ ID NO: 3871728 - RNA, 22 nt, Shigella flexneri 2a str. 2457T
caugaaaaaacuggcuacccug

SEQ ID NO: 3871729 - RNA, 17 nt, Shigella flexneri 2a str. 2457T
caugaaagcgaugcuga

SEQ ID NO: 3871730 - RNA, 19 nt, Shigella flexneri 2a str. 2457T
caugaaagcgaugcugaug

SEQ ID NO: 3871731 - RNA, 13 nt, Shigella flexneri 2a str. 2457T
caugaaaugaaaa

SEQ ID NO: 3871732 - RNA, 20 nt, Shigella flexneri 2a str. 2457T
caugaacaccuucucaggcc

SEQ ID NO: 3871733 - RNA, 15 nt, Shigella flexneri 2a str. 2457T
caugaauauauaauu

SEQ ID NO: 3871734 - RNA, 15 nt, Shigella flexneri 2a str. 2457T
caugaauucgacuuu

SEQ ID NO: 3871735 - RNA, 18 nt, Shigella flexneri 2a str. 2457T
caugaauucgacuuucuc

SEQ ID NO: 3871736 - RNA, 13 nt, Shigella flexneri 2a str. 2457T
caugacagcgccc

SEQ ID NO: 3871737 - RNA, 18 nt, Shigella flexneri 2a str. 2457T
caugaccgcuccgccauc

SEQ ID NO: 3871738 - RNA, 15 nt, Shigella flexneri 2a str. 2457T
caugaccuuucaguu

SEQ ID NO: 3871739 - RNA, 17 nt, Shigella flexneri 2a str. 2457T
caugacgaggagcugca

SEQ ID NO: 3871740 - RNA, 19 nt, Shigella flexneri 2a str. 2457T
caugacgcgcaucacgaca

SEQ ID NO: 3871741 - RNA, 16 nt, Shigella flexneri 2a str. 2457T
caugacguccuguacu

SEQ ID NO: 3871742 - RNA, 16 nt, Shigella flexneri 2a str. 2457T
caugacuacacuaaac

SEQ ID NO: 3871743 - RNA, 17 nt, Shigella flexneri 2a str. 2457T
cauguaacgaugcauga

SEQ ID NO: 3871744 - RNA, 20 nt, Shigella flexneri 2a str. 2457T
cauguacgcguucaaucaaa

SEQ ID NO: 3871745 - RNA, 18 nt, Shigella flexneri 2a str. 2457T
cauguagccgcuuuuucu

SEQ ID NO: 3871746 - RNA, 20 nt, Shigella flexneri 2a str. 2457T
cauguagccgcuuuuucugc

SEQ ID NO: 3871747 - RNA, 12 nt, Shigella flexneri 2a str. 2457T
cauguccagcuu

SEQ ID NO: 3871748 - RNA, 20 nt, Shigella flexneri 2a str. 2457T
caugucgguuguacaaaaaa

SEQ ID NO: 3871749 - RNA, 22 nt, Shigella flexneri 2a str. 2457T
caugucgguuguacaaaaaaug

SEQ ID NO: 3871750 - RNA, 19 nt, Shigella flexneri 2a str. 2457T
caugucugccgcaggaaag

SEQ ID NO: 3871751 - RNA, 21 nt, Shigella flexneri 2a str. 2457T
cauguggcggcgcgaggcgaa

SEQ ID NO: 3871752 - RNA, 18 nt, Shigella flexneri 2a str. 2457T
cauguuccugccagucuu

SEQ ID NO: 3871753 - RNA, 22 nt, Shigella flexneri 2a str. 2457T
cauguuccugccagucuuccgc

SEQ ID NO: 3871754 - RNA, 20 nt, Shigella flexneri 2a str. 2457T
cauguucuaugaagaacugg

SEQ ID NO: 3871755 - RNA, 20 nt, Shigella flexneri 2a str. 2457T
cauuaaaacugauacgucau

SEQ ID NO: 3871756 - RNA, 14 nt, Shigella flexneri 2a str. 2457T
cauuaaaccagugc

SEQ ID NO: 3871757 - RNA, 14 nt, Shigella flexneri 2a str. 2457T
cauuaaacgccguu

SEQ ID NO: 3871758 - RNA, 19 nt, Shigella flexneri 2a str. 2457T
cauuaaaguaggccagaua

SEQ ID NO: 3871759 - RNA, 15 nt, Shigella flexneri 2a str. 2457T
cauuaaaguuaucgc

SEQ ID NO: 3871760 - RNA, 16 nt, Shigella flexneri 2a str. 2457T
cauuaacaggccaaau

SEQ ID NO: 3871761 - RNA, 18 nt, Shigella flexneri 2a str. 2457T
cauuaacaggugucacau

SEQ ID NO: 3871762 - RNA, 15 nt, Shigella flexneri 2a str. 2457T
cauuaaccaaccacc

SEQ ID NO: 3871763 - RNA, 15 nt, Shigella flexneri 2a str. 2457T
cauuaaccagccacu

SEQ ID NO: 3871764 - RNA, 22 nt, Shigella flexneri 2a str. 2457T
cauuaaccagccacugcgccau

SEQ ID NO: 3871765 - RNA, 22 nt, Shigella flexneri 2a str. 2457T
cauuaaccgugcgggcaucauc

SEQ ID NO: 3871766 - RNA, 19 nt, Shigella flexneri 2a str. 2457T
cauuaaccguuuacgucau

SEQ ID NO: 3871767 - RNA, 16 nt, Shigella flexneri 2a str. 2457T
cauuaacgugaucaaa

SEQ ID NO: 3871768 - RNA, 15 nt, Shigella flexneri 2a str. 2457T
cauuaagccacgguu

SEQ ID NO: 3871769 - RNA, 19 nt, Shigella flexneri 2a str. 2457T
cauuaagggugaucagccc

SEQ ID NO: 3871770 - RNA, 17 nt, Shigella flexneri 2a str. 2457T
cauuaaggucauaucuu

SEQ ID NO: 3871771 - RNA, 21 nt, Shigella flexneri 2a str. 2457T
cauuaaucgauaaaccagcaa

SEQ ID NO: 3871772 - RNA, 16 nt, Shigella flexneri 2a str. 2457T
cauuaaucugcucggc

SEQ ID NO: 3871773 - RNA, 20 nt, Shigella flexneri 2a str. 2457T
cauuaaugcacuuccagcgg

SEQ ID NO: 3871774 - RNA, 23 nt, Shigella flexneri 2a str. 2457T
cauuaaugccguuauacaucgcu

SEQ ID NO: 3871775 - RNA, 18 nt, Shigella flexneri 2a str. 2457T
cauuaauuuccugauggc

SEQ ID NO: 3871776 - RNA, 12 nt, Shigella flexneri 2a str. 2457T
cauuacaacaag

SEQ ID NO: 3871777 - RNA, 14 nt, Shigella flexneri 2a str. 2457T
cauuacaaccgcug

SEQ ID NO: 3871778 - RNA, 17 nt, Shigella flexneri 2a str. 2457T
cauuacaagaaucaugc

SEQ ID NO: 3871779 - RNA, 18 nt, Shigella flexneri 2a str. 2457T
cauuacaagaaucaugcc

SEQ ID NO: 3871780 - RNA, 13 nt, Shigella flexneri 2a str. 2457T
cauuacaagcccg

SEQ ID NO: 3871781 - RNA, 16 nt, Shigella flexneri 2a str. 2457T
cauuacaagcccgcug

SEQ ID NO: 3871782 - RNA, 18 nt, Shigella flexneri 2a str. 2457T
cauuacaagcccgcugcc

SEQ ID NO: 3871783 - RNA, 19 nt, Shigella flexneri 2a str. 2457T
cauuacaccaauaccgccc

SEQ ID NO: 3871784 - RNA, 11 nt, Shigella flexneri 2a str. 2457T
cauuaccgcga

SEQ ID NO: 3871785 - RNA, 14 nt, Shigella flexneri 2a str. 2457T
cauuaccugacagc

SEQ ID NO: 3871786 - RNA, 20 nt, Shigella flexneri 2a str. 2457T
cauuacguccaucacaauca

SEQ ID NO: 3871787 - RNA, 14 nt, Shigella flexneri 2a str. 2457T
cauuacucguccuu

SEQ ID NO: 3871788 - RNA, 19 nt, Shigella flexneri 2a str. 2457T
cauuacuguauacgggcuu

SEQ ID NO: 3871789 - RNA, 11 nt, Shigella flexneri 2a str. 2457T
cauuagcccaa

SEQ ID NO: 3871790 - RNA, 14 nt, Shigella flexneri 2a str. 2457T
cauuagugauuaac

SEQ ID NO: 3871791 - RNA, 19 nt, Shigella flexneri 2a str. 2457T
cauuagugauuaacgcuug

SEQ ID NO: 3871792 - RNA, 20 nt, Shigella flexneri 2a str. 2457T
cauuauaaauucuggccacu

SEQ ID NO: 3871793 - RNA, 14 nt, Shigella flexneri 2a str. 2457T
cauuaucaaagaug

SEQ ID NO: 3871794 - RNA, 13 nt, Shigella flexneri 2a str. 2457T
cauuaucaccaaa

SEQ ID NO: 3871795 - RNA, 14 nt, Shigella flexneri 2a str. 2457T
cauuaucagagauu

SEQ ID NO: 3871796 - RNA, 12 nt, Shigella flexneri 2a str. 2457T
cauuauccagcg

SEQ ID NO: 3871797 - RNA, 23 nt, Shigella flexneri 2a str. 2457T
cauuaugcuggaaucaauaauua

SEQ ID NO: 3871798 - RNA, 20 nt, Shigella flexneri 2a str. 2457T
cauuauuaaacagacaguaa

SEQ ID NO: 3871799 - RNA, 14 nt, Shigella flexneri 2a str. 2457T
cauuauugcgcaca

SEQ ID NO: 3871800 - RNA, 22 nt, Shigella flexneri 2a str. 2457T
cauuauugucgguggcgggcaa

SEQ ID NO: 3871801 - RNA, 17 nt, Shigella flexneri 2a str. 2457T
cauucaaacgauuuuuu

SEQ ID NO: 3871802 - RNA, 20 nt, Shigella flexneri 2a str. 2457T
cauucacaaacagcgccugu

SEQ ID NO: 3871803 - RNA, 14 nt, Shigella flexneri 2a str. 2457T
cauucaccaagcaa

SEQ ID NO: 3871804 - RNA, 15 nt, Shigella flexneri 2a str. 2457T
cauucaccagcccac

SEQ ID NO: 3871805 - RNA, 19 nt, Shigella flexneri 2a str. 2457T
cauucaccagcccacaugc

SEQ ID NO: 3871806 - RNA, 14 nt, Shigella flexneri 2a str. 2457T
cauucaccaguuga

SEQ ID NO: 3871807 - RNA, 20 nt, Shigella flexneri 2a str. 2457T
cauucacgcugucggcacug

SEQ ID NO: 3871808 - RNA, 21 nt, Shigella flexneri 2a str. 2457T
cauucacgcugucggcacuga

SEQ ID NO: 3871809 - RNA, 21 nt, Shigella flexneri 2a str. 2457T
cauucaggccgccgucaucac

SEQ ID NO: 3871810 - RNA, 20 nt, Shigella flexneri 2a str. 2457T
cauucagugcaaaugccaga

SEQ ID NO: 3871811 - RNA, 21 nt, Shigella flexneri 2a str. 2457T
cauucaguuaccugaaugcuc

SEQ ID NO: 3871812 - RNA, 16 nt, Shigella flexneri 2a str. 2457T
cauucaucgccuucuu

SEQ ID NO: 3871813 - RNA, 19 nt, Shigella flexneri 2a str. 2457T
cauucaugcgaauacaccc

SEQ ID NO: 3871814 - RNA, 21 nt, Shigella flexneri 2a str. 2457T
cauucauuuuuuguggcuucu

SEQ ID NO: 3871815 - RNA, 18 nt, Shigella flexneri 2a str. 2457T
cauuccaccgaaacuuuu

SEQ ID NO: 3871816 - RNA, 22 nt, Shigella flexneri 2a str. 2457T
cauuccacuguucguaccugaa

SEQ ID NO: 3871817 - RNA, 13 nt, Shigella flexneri 2a str. 2457T
cauuccaguaauu

SEQ ID NO: 3871818 - RNA, 21 nt, Shigella flexneri 2a str. 2457T
cauucccagcgcguucuggua

SEQ ID NO: 3871819 - RNA, 18 nt, Shigella flexneri 2a str. 2457T
cauucccccuuugaccag

SEQ ID NO: 3871820 - RNA, 18 nt, Shigella flexneri 2a str. 2457T
cauucccuacgcgauaaa

SEQ ID NO: 3871821 - RNA, 21 nt, Shigella flexneri 2a str. 2457T
cauucccuggcggaagagcac

SEQ ID NO: 3871822 - RNA, 19 nt, Shigella flexneri 2a str. 2457T
cauuccgcaugauucugag

SEQ ID NO: 3871823 - RNA, 19 nt, Shigella flexneri 2a str. 2457T
cauuccggaguuuaugagg

SEQ ID NO: 3871824 - RNA, 22 nt, Shigella flexneri 2a str. 2457T
cauuccggaguuuaugaggcac

SEQ ID NO: 3871825 - RNA, 17 nt, Shigella flexneri 2a str. 2457T
cauuccggccaucgccu

SEQ ID NO: 3871826 - RNA, 23 nt, Shigella flexneri 2a str. 2457T
cauuccgggaaacgaaccauaaa

SEQ ID NO: 3871827 - RNA, 16 nt, Shigella flexneri 2a str. 2457T
cauucgcaguugcagu

SEQ ID NO: 3871828 - RNA, 21 nt, Shigella flexneri 2a str. 2457T
cauucgcaguugcaguaccag

SEQ ID NO: 3871829 - RNA, 19 nt, Shigella flexneri 2a str. 2457T
cauucgccgguuccagcuu

SEQ ID NO: 3871830 - RNA, 16 nt, Shigella flexneri 2a str. 2457T
cauucgcgaugcugau

SEQ ID NO: 3871831 - RNA, 16 nt, Shigella flexneri 2a str. 2457T
cauucgcgguuuuaca

SEQ ID NO: 3871832 - RNA, 20 nt, Shigella flexneri 2a str. 2457T
cauucggauugcuauuuaac

SEQ ID NO: 3871833 - RNA, 16 nt, Shigella flexneri 2a str. 2457T
cauucgguugccagcg

SEQ ID NO: 3871834 - RNA, 17 nt, Shigella flexneri 2a str. 2457T
cauucgguuuucaaucg

SEQ ID NO: 3871835 - RNA, 15 nt, Shigella flexneri 2a str. 2457T
cauucgucuccuggc

SEQ ID NO: 3871836 - RNA, 17 nt, Shigella flexneri 2a str. 2457T
cauucgucuccuggccg

SEQ ID NO: 3871837 - RNA, 12 nt, Shigella flexneri 2a str. 2457T
cauucucacucc

SEQ ID NO: 3871838 - RNA, 13 nt, Shigella flexneri 2a str. 2457T
cauucucacucca

SEQ ID NO: 3871839 - RNA, 16 nt, Shigella flexneri 2a str. 2457T
cauucucacuccagcc

SEQ ID NO: 3871840 - RNA, 18 nt, Shigella flexneri 2a str. 2457T
cauuuuggacaaugcagu

SEQ ID NO: 3871841 - RNA, 22 nt, Shigella flexneri 2a str. 2457T
cauuuuuacuccuuagcaacag

SEQ ID NO: 3871842 - RNA, 16 nt, Shigella flexneri 2a str. 2457T
cauuuuucagacguuc

SEQ ID NO: 3871843 - RNA, 19 nt, Shigella flexneri 2a str. 2457T
cauuuuucagcguucccca

SEQ ID NO: 3871844 - RNA, 23 nt, Shigella flexneri 2a str. 2457T
cauuuuuuagcgccagccagaug

SEQ ID NO: 3871845 - RNA, 20 nt, Shigella flexneri 2a str. 2457T
cauuuuuucacauguucauu

SEQ ID NO: 3871846 - RNA, 22 nt, Shigella flexneri 2a str. 2457T
cauuuuuucacauguucauuua

SEQ ID NO: 3871847 - RNA, 22 nt, Shigella flexneri 2a str. 2457T
cauuuuuuugcauuacugcuau

SEQ ID NO: 3871848 - RNA, 14 nt, Shigella flexneri 2a str. 2457T
ccaaaacagcgaca

SEQ ID NO: 3871849 - RNA, 13 nt, Shigella flexneri 2a str. 2457T
ccaaaagguccuu

SEQ ID NO: 3871850 - RNA, 20 nt, Shigella flexneri 2a str. 2457T
ccaaaauaacuuaaugucau

SEQ ID NO: 3871851 - RNA, 18 nt, Shigella flexneri 2a str. 2457T
ccaaaauaauaaauuaac

SEQ ID NO: 3871852 - RNA, 11 nt, Shigella flexneri 2a str. 2457T
ccaaaaugccu

SEQ ID NO: 3871853 - RNA, 16 nt, Shigella flexneri 2a str. 2457T
ccaaaccgacugccug

SEQ ID NO: 3871854 - RNA, 15 nt, Shigella flexneri 2a str. 2457T
ccaaacgcucccugc

SEQ ID NO: 3871855 - RNA, 19 nt, Shigella flexneri 2a str. 2457T
ccaaacuggaacugaaagg

SEQ ID NO: 3871856 - RNA, 19 nt, Shigella flexneri 2a str. 2457T
ccaaacuuaugcagcugcu

SEQ ID NO: 3871857 - RNA, 22 nt, Shigella flexneri 2a str. 2457T
ccaaacuuaugcagcugcucga

SEQ ID NO: 3871858 - RNA, 13 nt, Shigella flexneri 2a str. 2457T
ccaaagaaaucag

SEQ ID NO: 3871859 - RNA, 15 nt, Shigella flexneri 2a str. 2457T
ccaaagcaccacucc

SEQ ID NO: 3871860 - RNA, 18 nt, Shigella flexneri 2a str. 2457T
ccaaagcaccacuccuca

SEQ ID NO: 3871861 - RNA, 22 nt, Shigella flexneri 2a str. 2457T
ccaaaguacggacgcggcauuu

SEQ ID NO: 3871862 - RNA, 13 nt, Shigella flexneri 2a str. 2457T
ccaaauaaaauaa

SEQ ID NO: 3871863 - RNA, 18 nt, Shigella flexneri 2a str. 2457T
ccaaauauccgcgcuaag

SEQ ID NO: 3871864 - RNA, 20 nt, Shigella flexneri 2a str. 2457T
ccaaauaucuuauagacuaa

SEQ ID NO: 3871865 - RNA, 12 nt, Shigella flexneri 2a str. 2457T
ccaaauauuucu

SEQ ID NO: 3871866 - RNA, 20 nt, Shigella flexneri 2a str. 2457T
ccaaaucauccagacugcuc

SEQ ID NO: 3871867 - RNA, 15 nt, Shigella flexneri 2a str. 2457T
ccaaauccagcgcca

SEQ ID NO: 3871868 - RNA, 19 nt, Shigella flexneri 2a str. 2457T
ccaaauccuuccagcucca

SEQ ID NO: 3871869 - RNA, 19 nt, Shigella flexneri 2a str. 2457T
ccaaaucgccauauccgca

SEQ ID NO: 3871870 - RNA, 17 nt, Shigella flexneri 2a str. 2457T
ccaaaucgcccagcaaa

SEQ ID NO: 3871871 - RNA, 18 nt, Shigella flexneri 2a str. 2457T
ccaaaucgcccagcaaau

SEQ ID NO: 3871872 - RNA, 23 nt, Shigella flexneri 2a str. 2457T
ccaaaucgcccagcaaauacgua

SEQ ID NO: 3871873 - RNA, 18 nt, Shigella flexneri 2a str. 2457T
ccaaaucugauuaauauu

SEQ ID NO: 3871874 - RNA, 15 nt, Shigella flexneri 2a str. 2457T
ccaaaucuuuucugc

SEQ ID NO: 3871875 - RNA, 16 nt, Shigella flexneri 2a str. 2457T
ccaaaugucaccagcc

SEQ ID NO: 3871876 - RNA, 15 nt, Shigella flexneri 2a str. 2457T
ccaaauuuaaacgac

SEQ ID NO: 3871877 - RNA, 20 nt, Shigella flexneri 2a str. 2457T
ccaaauuuaaacgacaauac

SEQ ID NO: 3871878 - RNA, 22 nt, Shigella flexneri 2a str. 2457T
ccaacaaauggaaggucacgcc

SEQ ID NO: 3871879 - RNA, 14 nt, Shigella flexneri 2a str. 2457T
ccaacaauaaaauu

SEQ ID NO: 3871880 - RNA, 17 nt, Shigella flexneri 2a str. 2457T
ccaacaccuaccggcug

SEQ ID NO: 3871881 - RNA, 19 nt, Shigella flexneri 2a str. 2457T
ccaacacuuccccggacgc

SEQ ID NO: 3871882 - RNA, 15 nt, Shigella flexneri 2a str. 2457T
ccaacagcagccaca

SEQ ID NO: 3871883 - RNA, 16 nt, Shigella flexneri 2a str. 2457T
ccaacagcagccacac

SEQ ID NO: 3871884 - RNA, 22 nt, Shigella flexneri 2a str. 2457T
ccaacaucgaaaacgccaccgc

SEQ ID NO: 3871885 - RNA, 21 nt, Shigella flexneri 2a str. 2457T
ccaacauucgagaagcccaua

SEQ ID NO: 3871886 - RNA, 20 nt, Shigella flexneri 2a str. 2457T
ccaaccacaugaucauucac

SEQ ID NO: 3871887 - RNA, 23 nt, Shigella flexneri 2a str. 2457T
ccaaccacggaguugaccagcuc

SEQ ID NO: 3871888 - RNA, 21 nt, Shigella flexneri 2a str. 2457T
ccaaccaugccgcccagaagc

SEQ ID NO: 3871889 - RNA, 23 nt, Shigella flexneri 2a str. 2457T
ccaaccgcggcacguuccugcau

SEQ ID NO: 3871890 - RNA, 21 nt, Shigella flexneri 2a str. 2457T
ccaaccguggcguaaaucauc

SEQ ID NO: 3871891 - RNA, 14 nt, Shigella flexneri 2a str. 2457T
ccaaccuugcgccu

SEQ ID NO: 3871892 - RNA, 12 nt, Shigella flexneri 2a str. 2457T
ccaacgcagcaa

SEQ ID NO: 3871893 - RNA, 15 nt, Shigella flexneri 2a str. 2457T
ccaacgcagcaacau

SEQ ID NO: 3871894 - RNA, 19 nt, Shigella flexneri 2a str. 2457T
ccaacgcgccaccgaccag

SEQ ID NO: 3871895 - RNA, 20 nt, Shigella flexneri 2a str. 2457T
ccaacggcacgauaaauggc

SEQ ID NO: 3871896 - RNA, 15 nt, Shigella flexneri 2a str. 2457T
ccaacggccuugcgg

SEQ ID NO: 3871897 - RNA, 20 nt, Shigella flexneri 2a str. 2457T
ccaacggcgaaagcuggcac

SEQ ID NO: 3871898 - RNA, 13 nt, Shigella flexneri 2a str. 2457T
ccaacggcgagcc

SEQ ID NO: 3871899 - RNA, 17 nt, Shigella flexneri 2a str. 2457T
ccaacggugaaaaacca

SEQ ID NO: 3871900 - RNA, 20 nt, Shigella flexneri 2a str. 2457T
ccaacguuucgcugugauua

SEQ ID NO: 3871901 - RNA, 21 nt, Shigella flexneri 2a str. 2457T
ccaacguuucuggaaguaauc

SEQ ID NO: 3871902 - RNA, 22 nt, Shigella flexneri 2a str. 2457T
ccaacuccacuucaccgcgaau

SEQ ID NO: 3871903 - RNA, 15 nt, Shigella flexneri 2a str. 2457T
ccaacugauccugac

SEQ ID NO: 3871904 - RNA, 18 nt, Shigella flexneri 2a str. 2457T
ccaacugauuuucaucuu

SEQ ID NO: 3871905 - RNA, 15 nt, Shigella flexneri 2a str. 2457T
ccaacugccugaugc

SEQ ID NO: 3871906 - RNA, 22 nt, Shigella flexneri 2a str. 2457T
ccaacuggcaaaagauaaagcc

SEQ ID NO: 3871907 - RNA, 23 nt, Shigella flexneri 2a str. 2457T
ccaacuggcaaaagauaaagcca

SEQ ID NO: 3871908 - RNA, 21 nt, Shigella flexneri 2a str. 2457T
ccaacuguugauccaggagcu

SEQ ID NO: 3871909 - RNA, 23 nt, Shigella flexneri 2a str. 2457T
ccaacuuaccgccggugcaugau

SEQ ID NO: 3871910 - RNA, 19 nt, Shigella flexneri 2a str. 2457T
ccaacuugcccaggugugu

SEQ ID NO: 3871911 - RNA, 15 nt, Shigella flexneri 2a str. 2457T
ccaagaaacaccaga

SEQ ID NO: 3871912 - RNA, 18 nt, Shigella flexneri 2a str. 2457T
ccaagaccaauccgccag

SEQ ID NO: 3871913 - RNA, 14 nt, Shigella flexneri 2a str. 2457T
ccaagauagaacca

SEQ ID NO: 3871914 - RNA, 19 nt, Shigella flexneri 2a str. 2457T
ccaagcagcgcgcagaaca

SEQ ID NO: 3871915 - RNA, 17 nt, Shigella flexneri 2a str. 2457T
ccaagcgcggcaggcau

SEQ ID NO: 3871916 - RNA, 15 nt, Shigella flexneri 2a str. 2457T
ccaagcggcucaugc

SEQ ID NO: 3871917 - RNA, 15 nt, Shigella flexneri 2a str. 2457T
ccaagcuccagcauc

SEQ ID NO: 3871918 - RNA, 20 nt, Shigella flexneri 2a str. 2457T
ccaagcuucgggauggcgau

SEQ ID NO: 3871919 - RNA, 22 nt, Shigella flexneri 2a str. 2457T
ccaaggcgaggggaccgccccu

SEQ ID NO: 3871920 - RNA, 15 nt, Shigella flexneri 2a str. 2457T
ccaagggcggcgaga

SEQ ID NO: 3871921 - RNA, 14 nt, Shigella flexneri 2a str. 2457T
ccaaguaauagaac

SEQ ID NO: 3871922 - RNA, 19 nt, Shigella flexneri 2a str. 2457T
ccaaguucgaacgccgcca

SEQ ID NO: 3871923 - RNA, 14 nt, Shigella flexneri 2a str. 2457T
ccaauaaacgccag

SEQ ID NO: 3871924 - RNA, 14 nt, Shigella flexneri 2a str. 2457T
ccaauaaaugccac

SEQ ID NO: 3871925 - RNA, 19 nt, Shigella flexneri 2a str. 2457T
ccaauaauccccaauacga

SEQ ID NO: 3871926 - RNA, 14 nt, Shigella flexneri 2a str. 2457T
ccaauaccaaaauc

SEQ ID NO: 3871927 - RNA, 22 nt, Shigella flexneri 2a str. 2457T
ccaauaccgcccaccaccagcg

SEQ ID NO: 3871928 - RNA, 16 nt, Shigella flexneri 2a str. 2457T
ccaauacgauuaacgc

SEQ ID NO: 3871929 - RNA, 20 nt, Shigella flexneri 2a str. 2457T
ccaauacgauuaacgccaga

SEQ ID NO: 3871930 - RNA, 18 nt, Shigella flexneri 2a str. 2457T
ccaauagaaagugacagc

SEQ ID NO: 3871931 - RNA, 14 nt, Shigella flexneri 2a str. 2457T
ccaauagccgcgcc

SEQ ID NO: 3871932 - RNA, 16 nt, Shigella flexneri 2a str. 2457T
ccaauagucaucgucg

SEQ ID NO: 3871933 - RNA, 22 nt, Shigella flexneri 2a str. 2457T
ccaauaguuccacuauuucaau

SEQ ID NO: 3871934 - RNA, 21 nt, Shigella flexneri 2a str. 2457T
ccaauauaauuccauucacca

SEQ ID NO: 3871935 - RNA, 19 nt, Shigella flexneri 2a str. 2457T
ccaauauagacaaaguaac

SEQ ID NO: 3871936 - RNA, 19 nt, Shigella flexneri 2a str. 2457T
ccaaucaccgccagcaagg

SEQ ID NO: 3871937 - RNA, 13 nt, Shigella flexneri 2a str. 2457T
ccaccgaccaggc

SEQ ID NO: 3871938 - RNA, 15 nt, Shigella flexneri 2a str. 2457T
ccaccgaugcacagc

SEQ ID NO: 3871939 - RNA, 16 nt, Shigella flexneri 2a str. 2457T
ccaccgaugcacagca

SEQ ID NO: 3871940 - RNA, 20 nt, Shigella flexneri 2a str. 2457T
ccaccgaugcacagcacgcu

SEQ ID NO: 3871941 - RNA, 23 nt, Shigella flexneri 2a str. 2457T
ccaccgauuuucagccaucaucc

SEQ ID NO: 3871942 - RNA, 16 nt, Shigella flexneri 2a str. 2457T
ccaccgauuuugagaa

SEQ ID NO: 3871943 - RNA, 15 nt, Shigella flexneri 2a str. 2457T
ccaccgcaaaguggg

SEQ ID NO: 3871944 - RNA, 14 nt, Shigella flexneri 2a str. 2457T
ccaccgcaaucgcc

SEQ ID NO: 3871945 - RNA, 12 nt, Shigella flexneri 2a str. 2457T
ccaccgccagcg

SEQ ID NO: 3871946 - RNA, 16 nt, Shigella flexneri 2a str. 2457T
ccaccgcccagagaau

SEQ ID NO: 3871947 - RNA, 12 nt, Shigella flexneri 2a str. 2457T
ccaccgcccguu

SEQ ID NO: 3871948 - RNA, 22 nt, Shigella flexneri 2a str. 2457T
ccaccgcgcguuugaucgacag

SEQ ID NO: 3871949 - RNA, 16 nt, Shigella flexneri 2a str. 2457T
ccaccgcucaucgccc

SEQ ID NO: 3871950 - RNA, 19 nt, Shigella flexneri 2a str. 2457T
ccaccggacggacuuccag

SEQ ID NO: 3871951 - RNA, 18 nt, Shigella flexneri 2a str. 2457T
ccaccggcaaucugcugg

SEQ ID NO: 3871952 - RNA, 16 nt, Shigella flexneri 2a str. 2457T
ccaccgguuuauuauu

SEQ ID NO: 3871953 - RNA, 21 nt, Shigella flexneri 2a str. 2457T
ccaccgucgggcugacguuaa

SEQ ID NO: 3871954 - RNA, 14 nt, Shigella flexneri 2a str. 2457T
ccaccguuauccug

SEQ ID NO: 3871955 - RNA, 18 nt, Shigella flexneri 2a str. 2457T
ccaccguuucuacaagca

SEQ ID NO: 3871956 - RNA, 15 nt, Shigella flexneri 2a str. 2457T
ccaccuacaccggca

SEQ ID NO: 3871957 - RNA, 18 nt, Shigella flexneri 2a str. 2457T
ccaccucauuaagaugca

SEQ ID NO: 3871958 - RNA, 19 nt, Shigella flexneri 2a str. 2457T
ccaccucauuaagaugcau

SEQ ID NO: 3871959 - RNA, 14 nt, Shigella flexneri 2a str. 2457T
ccaccuccacgccc

SEQ ID NO: 3871960 - RNA, 22 nt, Shigella flexneri 2a str. 2457T
ccaccucccgucgcccacacca

SEQ ID NO: 3871961 - RNA, 23 nt, Shigella flexneri 2a str. 2457T
ccaccugaaauggucgccccgga

SEQ ID NO: 3871962 - RNA, 22 nt, Shigella flexneri 2a str. 2457T
ccaccugcucgucauccgccag

SEQ ID NO: 3871963 - RNA, 20 nt, Shigella flexneri 2a str. 2457T
ccacgaaaccgacugccaug

SEQ ID NO: 3871964 - RNA, 12 nt, Shigella flexneri 2a str. 2457T
ccacgaaacugc

SEQ ID NO: 3871965 - RNA, 17 nt, Shigella flexneri 2a str. 2457T
ccacgacaccuuucacg

SEQ ID NO: 3871966 - RNA, 12 nt, Shigella flexneri 2a str. 2457T
ccacgaccgcag

SEQ ID NO: 3871967 - RNA, 23 nt, Shigella flexneri 2a str. 2457T
ccacgaccucaaaggccgacagc

SEQ ID NO: 3871968 - RNA, 16 nt, Shigella flexneri 2a str. 2457T
ccacgacguguuccug

SEQ ID NO: 3871969 - RNA, 18 nt, Shigella flexneri 2a str. 2457T
ccacgcacagaacaaaau

SEQ ID NO: 3871970 - RNA, 16 nt, Shigella flexneri 2a str. 2457T
ccacgccacaauacug

SEQ ID NO: 3871971 - RNA, 19 nt, Shigella flexneri 2a str. 2457T
ccacgccgcugucuaccag

SEQ ID NO: 3871972 - RNA, 20 nt, Shigella flexneri 2a str. 2457T
ccacgccguuuuuacccagc

SEQ ID NO: 3871973 - RNA, 12 nt, Shigella flexneri 2a str. 2457T
ccacgccugccg

SEQ ID NO: 3871974 - RNA, 18 nt, Shigella flexneri 2a str. 2457T
ccacgccugccgccagca

SEQ ID NO: 3871975 - RNA, 19 nt, Shigella flexneri 2a str. 2457T
ccacgccugccgccagcau

SEQ ID NO: 3871976 - RNA, 16 nt, Shigella flexneri 2a str. 2457T
ccacgcgauacuuuuu

SEQ ID NO: 3871977 - RNA, 17 nt, Shigella flexneri 2a str. 2457T
ccacgcgauacuuuuuc

SEQ ID NO: 3871978 - RNA, 15 nt, Shigella flexneri 2a str. 2457T
ccacgcuccaucaug

SEQ ID NO: 3871979 - RNA, 16 nt, Shigella flexneri 2a str. 2457T
ccacgcugagagaagc

SEQ ID NO: 3871980 - RNA, 22 nt, Shigella flexneri 2a str. 2457T
ccacgcugcaucgccaaucugc

SEQ ID NO: 3871981 - RNA, 17 nt, Shigella flexneri 2a str. 2457T
ccacgcuguagccgccg

SEQ ID NO: 3871982 - RNA, 16 nt, Shigella flexneri 2a str. 2457T
ccacgcuuaacaaccc

SEQ ID NO: 3871983 - RNA, 15 nt, Shigella flexneri 2a str. 2457T
ccacggcaugaaagc

SEQ ID NO: 3871984 - RNA, 17 nt, Shigella flexneri 2a str. 2457T
ccacggcgcagcuucac

SEQ ID NO: 3871985 - RNA, 18 nt, Shigella flexneri 2a str. 2457T
ccacggcggugucgccag

SEQ ID NO: 3871986 - RNA, 13 nt, Shigella flexneri 2a str. 2457T
ccacggcuccagc

SEQ ID NO: 3871987 - RNA, 14 nt, Shigella flexneri 2a str. 2457T
ccacggcuccagca

SEQ ID NO: 3871988 - RNA, 21 nt, Shigella flexneri 2a str. 2457T
ccacgguucuccacucugcca

SEQ ID NO: 3871989 - RNA, 14 nt, Shigella flexneri 2a str. 2457T
ccacgucacucuuu

SEQ ID NO: 3871990 - RNA, 19 nt, Shigella flexneri 2a str. 2457T
ccacguuaguguggccagu

SEQ ID NO: 3871991 - RNA, 14 nt, Shigella flexneri 2a str. 2457T
ccacguuccccaga

SEQ ID NO: 3871992 - RNA, 16 nt, Shigella flexneri 2a str. 2457T
ccacguuccccagaug

SEQ ID NO: 3871993 - RNA, 23 nt, Shigella flexneri 2a str. 2457T
ccacguucugaucuuucuucagc

SEQ ID NO: 3871994 - RNA, 15 nt, Shigella flexneri 2a str. 2457T
ccacuacucugaccc

SEQ ID NO: 3871995 - RNA, 19 nt, Shigella flexneri 2a str. 2457T
ccacuaucgccaucaggca

SEQ ID NO: 3871996 - RNA, 18 nt, Shigella flexneri 2a str. 2457T
ccacuauuauggcgcagg

SEQ ID NO: 3871997 - RNA, 22 nt, Shigella flexneri 2a str. 2457T
ccacuccgguaauaucgcgcag

SEQ ID NO: 3871998 - RNA, 14 nt, Shigella flexneri 2a str. 2457T
ccacucugaccuga

SEQ ID NO: 3871999 - RNA, 15 nt, Shigella flexneri 2a str. 2457T
ccacucuuucagcac

SEQ ID NO: 3872000 - RNA, 22 nt, Shigella flexneri 2a str. 2457T
ccacugaauagugccacaccag

SEQ ID NO: 3872001 - RNA, 15 nt, Shigella flexneri 2a str. 2457T
ccacugcaaaucacc

SEQ ID NO: 3872002 - RNA, 14 nt, Shigella flexneri 2a str. 2457T
ccacugcgccgcuc

SEQ ID NO: 3872003 - RNA, 22 nt, Shigella flexneri 2a str. 2457T
ccacuggugagcgguguugccg

SEQ ID NO: 3872004 - RNA, 15 nt, Shigella flexneri 2a str. 2457T
ccacugucaaaucca

SEQ ID NO: 3872005 - RNA, 21 nt, Shigella flexneri 2a str. 2457T
ccacuuaauaagaagaaaccg

SEQ ID NO: 3872006 - RNA, 14 nt, Shigella flexneri 2a str. 2457T
ccacuucauccgga

SEQ ID NO: 3872007 - RNA, 13 nt, Shigella flexneri 2a str. 2457T
ccacuucaugccc

SEQ ID NO: 3872008 - RNA, 21 nt, Shigella flexneri 2a str. 2457T
ccacuuccaccacuuccugcu

SEQ ID NO: 3872009 - RNA, 18 nt, Shigella flexneri 2a str. 2457T
ccacuuccaccagcggcu

SEQ ID NO: 3872010 - RNA, 23 nt, Shigella flexneri 2a str. 2457T
ccacuuccgcgucaaucugcccg

SEQ ID NO: 3872011 - RNA, 20 nt, Shigella flexneri 2a str. 2457T
ccacuuccggcaacaaugcc

SEQ ID NO: 3872012 - RNA, 22 nt, Shigella flexneri 2a str. 2457T
ccacuuccugccaguuuuuccg

SEQ ID NO: 3872013 - RNA, 13 nt, Shigella flexneri 2a str. 2457T
ccacuugcagcuc

SEQ ID NO: 3872014 - RNA, 15 nt, Shigella flexneri 2a str. 2457T
ccacuuuacgggcaa

SEQ ID NO: 3872015 - RNA, 13 nt, Shigella flexneri 2a str. 2457T
ccacuuuccucau

SEQ ID NO: 3872016 - RNA, 15 nt, Shigella flexneri 2a str. 2457T
ccacuuugcaguucc

SEQ ID NO: 3872017 - RNA, 17 nt, Shigella flexneri 2a str. 2457T
ccacuuugcaguuccug

SEQ ID NO: 3872018 - RNA, 13 nt, Shigella flexneri 2a str. 2457T
ccacuuugcgcuc

SEQ ID NO: 3872019 - RNA, 16 nt, Shigella flexneri 2a str. 2457T
ccacuuugcgcuccug

SEQ ID NO: 3872020 - RNA, 18 nt, Shigella flexneri 2a str. 2457T
ccacuuuuaaaucgccaa

SEQ ID NO: 3872021 - RNA, 18 nt, Shigella flexneri 2a str. 2457T
ccagaaaaccuggcgcag

SEQ ID NO: 3872022 - RNA, 16 nt, Shigella flexneri 2a str. 2457T
ccagaaaagagacgcu

SEQ ID NO: 3872023 - RNA, 21 nt, Shigella flexneri 2a str. 2457T
ccagaaaagagacgcugaaaa

SEQ ID NO: 3872024 - RNA, 15 nt, Shigella flexneri 2a str. 2457T
ccagaaacaauaagu

SEQ ID NO: 3872025 - RNA, 17 nt, Shigella flexneri 2a str. 2457T
ccagaaacgccaccauu

SEQ ID NO: 3872026 - RNA, 19 nt, Shigella flexneri 2a str. 2457T
ccagaaacucugcggcauc

SEQ ID NO: 3872027 - RNA, 15 nt, Shigella flexneri 2a str. 2457T
ccagaaagugaguuu

SEQ ID NO: 3872028 - RNA, 17 nt, Shigella flexneri 2a str. 2457T
ccagaaaucggccuucc

SEQ ID NO: 3872029 - RNA, 20 nt, Shigella flexneri 2a str. 2457T
ccagaaaucggccuuccaua

SEQ ID NO: 3872030 - RNA, 19 nt, Shigella flexneri 2a str. 2457T
ccagaaauggcccaaaagg

SEQ ID NO: 3872031 - RNA, 20 nt, Shigella flexneri 2a str. 2457T
ccagaaauggcccaaaaggc

SEQ ID NO: 3872032 - RNA, 12 nt, Shigella flexneri 2a str. 2457T
ccagaacaaccc

SEQ ID NO: 3872033 - RNA, 21 nt, Shigella flexneri 2a str. 2457T
ccagaacacgcucccagcaga

SEQ ID NO: 3872034 - RNA, 19 nt, Shigella flexneri 2a str. 2457T
ccagaacacuguuaccgcu

SEQ ID NO: 3872035 - RNA, 23 nt, Shigella flexneri 2a str. 2457T
ccagcaauuuacgcuuuucuucc

SEQ ID NO: 3872036 - RNA, 15 nt, Shigella flexneri 2a str. 2457T
ccagcacaaaguggc

SEQ ID NO: 3872037 - RNA, 22 nt, Shigella flexneri 2a str. 2457T
ccagcacaaaguggcggcuacc

SEQ ID NO: 3872038 - RNA, 22 nt, Shigella flexneri 2a str. 2457T
ccagcacacugguucccaacaa

SEQ ID NO: 3872039 - RNA, 20 nt, Shigella flexneri 2a str. 2457T
ccagcacaucaucaaagcca

SEQ ID NO: 3872040 - RNA, 17 nt, Shigella flexneri 2a str. 2457T
ccagcaccacuuccggc

SEQ ID NO: 3872041 - RNA, 12 nt, Shigella flexneri 2a str. 2457T
ccagcaccagca

SEQ ID NO: 3872042 - RNA, 12 nt, Shigella flexneri 2a str. 2457T
ccagcaccagcu

SEQ ID NO: 3872043 - RNA, 13 nt, Shigella flexneri 2a str. 2457T
ccagcaccaguac

SEQ ID NO: 3872044 - RNA, 16 nt, Shigella flexneri 2a str. 2457T
ccagcaccgcagagau

SEQ ID NO: 3872045 - RNA, 16 nt, Shigella flexneri 2a str. 2457T
ccagcaccgcgacaau

SEQ ID NO: 3872046 - RNA, 20 nt, Shigella flexneri 2a str. 2457T
ccagcacggauaccgcacgc

SEQ ID NO: 3872047 - RNA, 23 nt, Shigella flexneri 2a str. 2457T
ccagcacggugaagaagcggaaa

SEQ ID NO: 3872048 - RNA, 14 nt, Shigella flexneri 2a str. 2457T
ccagcacugccgca

SEQ ID NO: 3872049 - RNA, 14 nt, Shigella flexneri 2a str. 2457T
ccagcagaccagca

SEQ ID NO: 3872050 - RNA, 18 nt, Shigella flexneri 2a str. 2457T
ccagcagagaucuuucac

SEQ ID NO: 3872051 - RNA, 18 nt, Shigella flexneri 2a str. 2457T
ccagcagauauugcccca

SEQ ID NO: 3872052 - RNA, 16 nt, Shigella flexneri 2a str. 2457T
ccagcagauggcagug

SEQ ID NO: 3872053 - RNA, 22 nt, Shigella flexneri 2a str. 2457T
ccagcagcagagcaaucaccag

SEQ ID NO: 3872054 - RNA, 13 nt, Shigella flexneri 2a str. 2457T
ccagcagcagcgg

SEQ ID NO: 3872055 - RNA, 20 nt, Shigella flexneri 2a str. 2457T
ccagcagcgaaucagcccag

SEQ ID NO: 3872056 - RNA, 22 nt, Shigella flexneri 2a str. 2457T
ccagcagcgaaucagcccagcc

SEQ ID NO: 3872057 - RNA, 16 nt, Shigella flexneri 2a str. 2457T
ccagcagcgccgcgcc

SEQ ID NO: 3872058 - RNA, 17 nt, Shigella flexneri 2a str. 2457T
ccagcagcggucggcuu

SEQ ID NO: 3872059 - RNA, 20 nt, Shigella flexneri 2a str. 2457T
ccagcagcugcguggcgcuu

SEQ ID NO: 3872060 - RNA, 13 nt, Shigella flexneri 2a str. 2457T
ccagcagcugcuc

SEQ ID NO: 3872061 - RNA, 14 nt, Shigella flexneri 2a str. 2457T
ccagcagcugcucc

SEQ ID NO: 3872062 - RNA, 18 nt, Shigella flexneri 2a str. 2457T
ccagcagcugcucccagc

SEQ ID NO: 3872063 - RNA, 21 nt, Shigella flexneri 2a str. 2457T
ccagcagcugcucccagcgca

SEQ ID NO: 3872064 - RNA, 19 nt, Shigella flexneri 2a str. 2457T
ccagcaggauguuccggca

SEQ ID NO: 3872065 - RNA, 17 nt, Shigella flexneri 2a str. 2457T
ccagcaggccgucgcgc

SEQ ID NO: 3872066 - RNA, 18 nt, Shigella flexneri 2a str. 2457T
ccagcagggcaaacagca

SEQ ID NO: 3872067 - RNA, 16 nt, Shigella flexneri 2a str. 2457T
ccagcagguuuaacca

SEQ ID NO: 3872068 - RNA, 23 nt, Shigella flexneri 2a str. 2457T
ccagcagguuuaaccaucaggca

SEQ ID NO: 3872069 - RNA, 16 nt, Shigella flexneri 2a str. 2457T
ccagcaguaaaccacc

SEQ ID NO: 3872070 - RNA, 23 nt, Shigella flexneri 2a str. 2457T
ccagcaguaaaccacccaccagc

SEQ ID NO: 3872071 - RNA, 18 nt, Shigella flexneri 2a str. 2457T
ccagcagugacucacgaa

SEQ ID NO: 3872072 - RNA, 12 nt, Shigella flexneri 2a str. 2457T
ccagcagugccg

SEQ ID NO: 3872073 - RNA, 22 nt, Shigella flexneri 2a str. 2457T
ccagcaguucgcccgcuucauc

SEQ ID NO: 3872074 - RNA, 12 nt, Shigella flexneri 2a str. 2457T
ccagcaguuucu

SEQ ID NO: 3872075 - RNA, 17 nt, Shigella flexneri 2a str. 2457T
ccagcauaaucaccauc

SEQ ID NO: 3872076 - RNA, 15 nt, Shigella flexneri 2a str. 2457T
ccagcauaccuucca

SEQ ID NO: 3872077 - RNA, 21 nt, Shigella flexneri 2a str. 2457T
ccagcauaguacgggcaauuu

SEQ ID NO: 3872078 - RNA, 17 nt, Shigella flexneri 2a str. 2457T
ccagcaucccggcagcc

SEQ ID NO: 3872079 - RNA, 13 nt, Shigella flexneri 2a str. 2457T
ccagcauccggca

SEQ ID NO: 3872080 - RNA, 17 nt, Shigella flexneri 2a str. 2457T
ccagcaucgaccaggau

SEQ ID NO: 3872081 - RNA, 16 nt, Shigella flexneri 2a str. 2457T
ccagcaucgcaacaug

SEQ ID NO: 3872082 - RNA, 18 nt, Shigella flexneri 2a str. 2457T
ccagcaucgcauccggca

SEQ ID NO: 3872083 - RNA, 12 nt, Shigella flexneri 2a str. 2457T
ccagcaucggca

SEQ ID NO: 3872084 - RNA, 17 nt, Shigella flexneri 2a str. 2457T
ccagcaucggcagcgcc

SEQ ID NO: 3872085 - RNA, 17 nt, Shigella flexneri 2a str. 2457T
ccagcaugaaacgccag

SEQ ID NO: 3872086 - RNA, 16 nt, Shigella flexneri 2a str. 2457T
ccagcauggcaauaac

SEQ ID NO: 3872087 - RNA, 11 nt, Shigella flexneri 2a str. 2457T
ccagcauuucu

SEQ ID NO: 3872088 - RNA, 14 nt, Shigella flexneri 2a str. 2457T
ccagcauuucuucc

SEQ ID NO: 3872089 - RNA, 14 nt, Shigella flexneri 2a str. 2457T
ccagccaacgcccu

SEQ ID NO: 3872090 - RNA, 15 nt, Shigella flexneri 2a str. 2457T
ccagccagacgccag

SEQ ID NO: 3872091 - RNA, 22 nt, Shigella flexneri 2a str. 2457T
ccagccagacgccagccacagg

SEQ ID NO: 3872092 - RNA, 12 nt, Shigella flexneri 2a str. 2457T
ccagccagagcc

SEQ ID NO: 3872093 - RNA, 12 nt, Shigella flexneri 2a str. 2457T
ccagccagcaga

SEQ ID NO: 3872094 - RNA, 13 nt, Shigella flexneri 2a str. 2457T
ccagccaggaauc

SEQ ID NO: 3872095 - RNA, 14 nt, Shigella flexneri 2a str. 2457T
ccagccagguguug

SEQ ID NO: 3872096 - RNA, 22 nt, Shigella flexneri 2a str. 2457T
ccagccagguguugauccacgg

SEQ ID NO: 3872097 - RNA, 23 nt, Shigella flexneri 2a str. 2457T
ccagccaguauugccaugcacgc

SEQ ID NO: 3872098 - RNA, 13 nt, Shigella flexneri 2a str. 2457T
ccagccaguucaa

SEQ ID NO: 3872099 - RNA, 21 nt, Shigella flexneri 2a str. 2457T
ccagccauuaaccagccacug

SEQ ID NO: 3872100 - RNA, 19 nt, Shigella flexneri 2a str. 2457T
ccagcccaugaaucagcaa

SEQ ID NO: 3872101 - RNA, 20 nt, Shigella flexneri 2a str. 2457T
ccagccccagaauucacgca

SEQ ID NO: 3872102 - RNA, 13 nt, Shigella flexneri 2a str. 2457T
ccagcccuuuuga

SEQ ID NO: 3872103 - RNA, 11 nt, Shigella flexneri 2a str. 2457T
ccagccgagcc

SEQ ID NO: 3872104 - RNA, 14 nt, Shigella flexneri 2a str. 2457T
ccagccggacugga

SEQ ID NO: 3872105 - RNA, 22 nt, Shigella flexneri 2a str. 2457T
ccagccugaacgagaaaagcca

SEQ ID NO: 3872106 - RNA, 20 nt, Shigella flexneri 2a str. 2457T
ccagccuguuccagacgcug

SEQ ID NO: 3872107 - RNA, 20 nt, Shigella flexneri 2a str. 2457T
ccagccuucuucauccagcg

SEQ ID NO: 3872108 - RNA, 20 nt, Shigella flexneri 2a str. 2457T
ccagcgaaccguugaggaug

SEQ ID NO: 3872109 - RNA, 13 nt, Shigella flexneri 2a str. 2457T
ccagcgaagccag

SEQ ID NO: 3872110 - RNA, 15 nt, Shigella flexneri 2a str. 2457T
ccagcgaauccagca

SEQ ID NO: 3872111 - RNA, 13 nt, Shigella flexneri 2a str. 2457T
ccagcgacuccag

SEQ ID NO: 3872112 - RNA, 14 nt, Shigella flexneri 2a str. 2457T
ccagcgagagagcg

SEQ ID NO: 3872113 - RNA, 17 nt, Shigella flexneri 2a str. 2457T
ccagcgauaccggugca

SEQ ID NO: 3872114 - RNA, 22 nt, Shigella flexneri 2a str. 2457T
ccagcgaugacuguacagaucc

SEQ ID NO: 3872115 - RNA, 17 nt, Shigella flexneri 2a str. 2457T
ccagcgauuuaucggca

SEQ ID NO: 3872116 - RNA, 20 nt, Shigella flexneri 2a str. 2457T
ccagcgcacaguuauaaaau

SEQ ID NO: 3872117 - RNA, 17 nt, Shigella flexneri 2a str. 2457T
ccagcgcagacaccaga

SEQ ID NO: 3872118 - RNA, 13 nt, Shigella flexneri 2a str. 2457T
ccagcgcauggcg

SEQ ID NO: 3872119 - RNA, 18 nt, Shigella flexneri 2a str. 2457T
ccagcgccaccaccagca

SEQ ID NO: 3872120 - RNA, 16 nt, Shigella flexneri 2a str. 2457T
ccagcgccaguaauuc

SEQ ID NO: 3872121 - RNA, 15 nt, Shigella flexneri 2a str. 2457T
ccagcgccaucucuu

SEQ ID NO: 3872122 - RNA, 20 nt, Shigella flexneri 2a str. 2457T
ccagcgccaucucuucggca

SEQ ID NO: 3872123 - RNA, 18 nt, Shigella flexneri 2a str. 2457T
ccagcgccgacagcagcc

SEQ ID NO: 3872124 - RNA, 13 nt, Shigella flexneri 2a str. 2457T
ccagcgccgccag

SEQ ID NO: 3872125 - RNA, 21 nt, Shigella flexneri 2a str. 2457T
ccagcgccgccuccucagaaa

SEQ ID NO: 3872126 - RNA, 13 nt, Shigella flexneri 2a str. 2457T
ccagcgccgcgcc

SEQ ID NO: 3872127 - RNA, 20 nt, Shigella flexneri 2a str. 2457T
ccagcgcgaugcaggccacc

SEQ ID NO: 3872128 - RNA, 22 nt, Shigella flexneri 2a str. 2457T
ccagcgcgccuucauucaggcc

SEQ ID NO: 3872129 - RNA, 22 nt, Shigella flexneri 2a str. 2457T
ccagcgcggcgauaaugcccag

SEQ ID NO: 3872130 - RNA, 14 nt, Shigella flexneri 2a str. 2457T
ccagcgcguucugu

SEQ ID NO: 3872131 - RNA, 15 nt, Shigella flexneri 2a str. 2457T
ccagcggaauaacgc

SEQ ID NO: 3872132 - RNA, 20 nt, Shigella flexneri 2a str. 2457T
ccagcggaauucccgcuucu

SEQ ID NO: 3872133 - RNA, 23 nt, Shigella flexneri 2a str. 2457T
ccaguaacucauugccaguccua

SEQ ID NO: 3872134 - RNA, 19 nt, Shigella flexneri 2a str. 2457T
ccaguaaggcaucuucuuc

SEQ ID NO: 3872135 - RNA, 21 nt, Shigella flexneri 2a str. 2457T
ccaguaaucuggccaaugccu

SEQ ID NO: 3872136 - RNA, 14 nt, Shigella flexneri 2a str. 2457T
ccaguaaugcgccc

SEQ ID NO: 3872137 - RNA, 13 nt, Shigella flexneri 2a str. 2457T
ccaguaauucagc

SEQ ID NO: 3872138 - RNA, 14 nt, Shigella flexneri 2a str. 2457T
ccaguacaugaagc

SEQ ID NO: 3872139 - RNA, 16 nt, Shigella flexneri 2a str. 2457T
ccaguacaugaagcac

SEQ ID NO: 3872140 - RNA, 14 nt, Shigella flexneri 2a str. 2457T
ccaguaccagcagc

SEQ ID NO: 3872141 - RNA, 17 nt, Shigella flexneri 2a str. 2457T
ccaguaccagcagcgcc

SEQ ID NO: 3872142 - RNA, 17 nt, Shigella flexneri 2a str. 2457T
ccaguaccgccaccacc

SEQ ID NO: 3872143 - RNA, 24 nt, Shigella flexneri 2a str. 2457T
ccaguaccgccaccaccagacgca

SEQ ID NO: 3872144 - RNA, 19 nt, Shigella flexneri 2a str. 2457T
ccaguaccgccagugcagc

SEQ ID NO: 3872145 - RNA, 15 nt, Shigella flexneri 2a str. 2457T
ccaguaccgccgcca

SEQ ID NO: 3872146 - RNA, 15 nt, Shigella flexneri 2a str. 2457T
ccaguacgccaaucu

SEQ ID NO: 3872147 - RNA, 18 nt, Shigella flexneri 2a str. 2457T
ccaguacgcccacgccag

SEQ ID NO: 3872148 - RNA, 16 nt, Shigella flexneri 2a str. 2457T
ccaguacgccuucacg

SEQ ID NO: 3872149 - RNA, 13 nt, Shigella flexneri 2a str. 2457T
ccaguagacagca

SEQ ID NO: 3872150 - RNA, 16 nt, Shigella flexneri 2a str. 2457T
ccaguaucugacagca

SEQ ID NO: 3872151 - RNA, 21 nt, Shigella flexneri 2a str. 2457T
ccaguaucuuauagaaagcaa

SEQ ID NO: 3872152 - RNA, 23 nt, Shigella flexneri 2a str. 2457T
ccaguaugcauguaaaucaagcg

SEQ ID NO: 3872153 - RNA, 23 nt, Shigella flexneri 2a str. 2457T
ccaguauugccaugcacgcaaga

SEQ ID NO: 3872154 - RNA, 17 nt, Shigella flexneri 2a str. 2457T
ccagucagaaagugcca

SEQ ID NO: 3872155 - RNA, 22 nt, Shigella flexneri 2a str. 2457T
ccagucagcucucagccagcug

SEQ ID NO: 3872156 - RNA, 12 nt, Shigella flexneri 2a str. 2457T
ccagucagguac

SEQ ID NO: 3872157 - RNA, 12 nt, Shigella flexneri 2a str. 2457T
ccaguccaccca

SEQ ID NO: 3872158 - RNA, 15 nt, Shigella flexneri 2a str. 2457T
ccaguccagcugccg

SEQ ID NO: 3872159 - RNA, 14 nt, Shigella flexneri 2a str. 2457T
ccaguccaucggca

SEQ ID NO: 3872160 - RNA, 16 nt, Shigella flexneri 2a str. 2457T
ccagucccaguucaug

SEQ ID NO: 3872161 - RNA, 13 nt, Shigella flexneri 2a str. 2457T
ccagucccuuuca

SEQ ID NO: 3872162 - RNA, 12 nt, Shigella flexneri 2a str. 2457T
ccaguccuccgg

SEQ ID NO: 3872163 - RNA, 22 nt, Shigella flexneri 2a str. 2457T
ccagucguaguggaucagcaaa

SEQ ID NO: 3872164 - RNA, 17 nt, Shigella flexneri 2a str. 2457T
ccagugaauacugcgcg

SEQ ID NO: 3872165 - RNA, 23 nt, Shigella flexneri 2a str. 2457T
ccagugaauuucacuucgccaac

SEQ ID NO: 3872166 - RNA, 23 nt, Shigella flexneri 2a str. 2457T
ccagugaggaugcgggucaggcc

SEQ ID NO: 3872167 - RNA, 21 nt, Shigella flexneri 2a str. 2457T
ccagugaugcgcaggguaacg

SEQ ID NO: 3872168 - RNA, 18 nt, Shigella flexneri 2a str. 2457T
ccagugauuuuugcugaa

SEQ ID NO: 3872169 - RNA, 15 nt, Shigella flexneri 2a str. 2457T
ccagugcagcgaagu

SEQ ID NO: 3872170 - RNA, 13 nt, Shigella flexneri 2a str. 2457T
ccagugcagcgcc

SEQ ID NO: 3872171 - RNA, 22 nt, Shigella flexneri 2a str. 2457T
ccagugccacacgcucuuccag

SEQ ID NO: 3872172 - RNA, 21 nt, Shigella flexneri 2a str. 2457T
ccagugcccgaccacuucaug

SEQ ID NO: 3872173 - RNA, 22 nt, Shigella flexneri 2a str. 2457T
ccagugcccgaccacuucaugc

SEQ ID NO: 3872174 - RNA, 18 nt, Shigella flexneri 2a str. 2457T
ccagugccgcccaccacu

SEQ ID NO: 3872175 - RNA, 12 nt, Shigella flexneri 2a str. 2457T
ccagugccgccu

SEQ ID NO: 3872176 - RNA, 19 nt, Shigella flexneri 2a str. 2457T
ccagugccggaugauucac

SEQ ID NO: 3872177 - RNA, 19 nt, Shigella flexneri 2a str. 2457T
ccagugccguuccagccag

SEQ ID NO: 3872178 - RNA, 17 nt, Shigella flexneri 2a str. 2457T
ccagugcguacccagcg

SEQ ID NO: 3872179 - RNA, 12 nt, Shigella flexneri 2a str. 2457T
ccagugcuccac

SEQ ID NO: 3872180 - RNA, 21 nt, Shigella flexneri 2a str. 2457T
ccagugcucccucggugccgc

SEQ ID NO: 3872181 - RNA, 15 nt, Shigella flexneri 2a str. 2457T
ccaguggcagcaauu

SEQ ID NO: 3872182 - RNA, 14 nt, Shigella flexneri 2a str. 2457T
ccagugguuucgcc

SEQ ID NO: 3872183 - RNA, 23 nt, Shigella flexneri 2a str. 2457T
ccaguuacccagcggauaaagca

SEQ ID NO: 3872184 - RNA, 15 nt, Shigella flexneri 2a str. 2457T
ccaguuaucaagcca

SEQ ID NO: 3872185 - RNA, 21 nt, Shigella flexneri 2a str. 2457T
ccaguucaacgcccgcuuuca

SEQ ID NO: 3872186 - RNA, 22 nt, Shigella flexneri 2a str. 2457T
ccaguucaacgcccgcuuucac

SEQ ID NO: 3872187 - RNA, 16 nt, Shigella flexneri 2a str. 2457T
ccaguucacgaauauu

SEQ ID NO: 3872188 - RNA, 22 nt, Shigella flexneri 2a str. 2457T
ccaguucacgcgauuucucauc

SEQ ID NO: 3872189 - RNA, 21 nt, Shigella flexneri 2a str. 2457T
ccaguucauguucgacaugcu

SEQ ID NO: 3872190 - RNA, 17 nt, Shigella flexneri 2a str. 2457T
ccaguuccacuucugca

SEQ ID NO: 3872191 - RNA, 12 nt, Shigella flexneri 2a str. 2457T
ccaguucccccu

SEQ ID NO: 3872192 - RNA, 18 nt, Shigella flexneri 2a str. 2457T
ccaguucgauauccaguc

SEQ ID NO: 3872193 - RNA, 20 nt, Shigella flexneri 2a str. 2457T
ccaguucgauuucccagcga

SEQ ID NO: 3872194 - RNA, 13 nt, Shigella flexneri 2a str. 2457T
ccaguucuacaau

SEQ ID NO: 3872195 - RNA, 18 nt, Shigella flexneri 2a str. 2457T
ccaguucuacaaucugcc

SEQ ID NO: 3872196 - RNA, 21 nt, Shigella flexneri 2a str. 2457T
ccaguucuuccaguuccggca

SEQ ID NO: 3872197 - RNA, 14 nt, Shigella flexneri 2a str. 2457T
ccaguugaccugcg

SEQ ID NO: 3872198 - RNA, 18 nt, Shigella flexneri 2a str. 2457T
ccaguugcuuauccagca

SEQ ID NO: 3872199 - RNA, 16 nt, Shigella flexneri 2a str. 2457T
ccaguuguucgcgcac

SEQ ID NO: 3872200 - RNA, 18 nt, Shigella flexneri 2a str. 2457T
ccaguuuacugucugcuu

SEQ ID NO: 3872201 - RNA, 12 nt, Shigella flexneri 2a str. 2457T
ccaguuucacag

SEQ ID NO: 3872202 - RNA, 13 nt, Shigella flexneri 2a str. 2457T
ccaguuucacagg

SEQ ID NO: 3872203 - RNA, 22 nt, Shigella flexneri 2a str. 2457T
ccaguuucaugauauguuuuaa

SEQ ID NO: 3872204 - RNA, 14 nt, Shigella flexneri 2a str. 2457T
ccaguuucggacgc

SEQ ID NO: 3872205 - RNA, 19 nt, Shigella flexneri 2a str. 2457T
ccaguuucggacgcggcac

SEQ ID NO: 3872206 - RNA, 17 nt, Shigella flexneri 2a str. 2457T
ccaguuuguucagcugc

SEQ ID NO: 3872207 - RNA, 15 nt, Shigella flexneri 2a str. 2457T
ccaguuuucggauuu

SEQ ID NO: 3872208 - RNA, 18 nt, Shigella flexneri 2a str. 2457T
ccaguuuuuacgcccgug

SEQ ID NO: 3872209 - RNA, 24 nt, Shigella flexneri 2a str. 2457T
ccaguuuuuucgcuugaucuuccu

SEQ ID NO: 3872210 - RNA, 16 nt, Shigella flexneri 2a str. 2457T
ccauaaaaaagaagcc

SEQ ID NO: 3872211 - RNA, 12 nt, Shigella flexneri 2a str. 2457T
ccauaaagacgu

SEQ ID NO: 3872212 - RNA, 22 nt, Shigella flexneri 2a str. 2457T
ccauaaagacguuaacuacaau

SEQ ID NO: 3872213 - RNA, 17 nt, Shigella flexneri 2a str. 2457T
ccauaaagggaauaaau

SEQ ID NO: 3872214 - RNA, 22 nt, Shigella flexneri 2a str. 2457T
ccauaaauugcuguaaauucuc

SEQ ID NO: 3872215 - RNA, 22 nt, Shigella flexneri 2a str. 2457T
ccauaacgccugcuccagugca

SEQ ID NO: 3872216 - RNA, 22 nt, Shigella flexneri 2a str. 2457T
ccauaagauugcauagcggcga

SEQ ID NO: 3872217 - RNA, 15 nt, Shigella flexneri 2a str. 2457T
ccauaagcccagaac

SEQ ID NO: 3872218 - RNA, 21 nt, Shigella flexneri 2a str. 2457T
ccauaagcccagaacaaauaa

SEQ ID NO: 3872219 - RNA, 23 nt, Shigella flexneri 2a str. 2457T
ccauaagcccagaacaaauaaau

SEQ ID NO: 3872220 - RNA, 20 nt, Shigella flexneri 2a str. 2457T
ccauaagccugauaagcguu

SEQ ID NO: 3872221 - RNA, 18 nt, Shigella flexneri 2a str. 2457T
ccauaaucucaucagcgu

SEQ ID NO: 3872222 - RNA, 15 nt, Shigella flexneri 2a str. 2457T
ccauaauggacguuu

SEQ ID NO: 3872223 - RNA, 13 nt, Shigella flexneri 2a str. 2457T
ccauacagcagca

SEQ ID NO: 3872224 - RNA, 19 nt, Shigella flexneri 2a str. 2457T
ccauacaguguccaaccaa

SEQ ID NO: 3872225 - RNA, 14 nt, Shigella flexneri 2a str. 2457T
ccauaccaugcacc

SEQ ID NO: 3872226 - RNA, 15 nt, Shigella flexneri 2a str. 2457T
ccauaccugcacaaa

SEQ ID NO: 3872227 - RNA, 22 nt, Shigella flexneri 2a str. 2457T
ccauaccugcacaaauagccag

SEQ ID NO: 3872228 - RNA, 17 nt, Shigella flexneri 2a str. 2457T
ccauacguuugccuuuc

SEQ ID NO: 3872229 - RNA, 23 nt, Shigella flexneri 2a str. 2457T
ccauacucuuucccggcaaucac

SEQ ID NO: 3872230 - RNA, 18 nt, Shigella flexneri 2a str. 2457T
ccaugagaagcugaaauc

SEQ ID NO: 3872231 - RNA, 17 nt, Shigella flexneri 2a str. 2457T
ccaugauaguguccauu

SEQ ID NO: 3872232 - RNA, 21 nt, Shigella flexneri 2a str. 2457T
ccaugauauuggcaucgccag

SEQ ID NO: 3872233 - RNA, 14 nt, Shigella flexneri 2a str. 2457T
ccaugaugacaaca

SEQ ID NO: 3872234 - RNA, 23 nt, Shigella flexneri 2a str. 2457T
ccaugauuucguagacugcagcg

SEQ ID NO: 3872235 - RNA, 21 nt, Shigella flexneri 2a str. 2457T
ccaugcaauuaccgccaccag

SEQ ID NO: 3872236 - RNA, 17 nt, Shigella flexneri 2a str. 2457T
ccaugcaccaacccuaa

SEQ ID NO: 3872237 - RNA, 21 nt, Shigella flexneri 2a str. 2457T
ccaugcacgauauaccgugcu

SEQ ID NO: 3872238 - RNA, 15 nt, Shigella flexneri 2a str. 2457T
ccaugcacugcaacg

SEQ ID NO: 3872239 - RNA, 18 nt, Shigella flexneri 2a str. 2457T
ccaugcauaaugcagcca

SEQ ID NO: 3872240 - RNA, 22 nt, Shigella flexneri 2a str. 2457T
ccaugccaucugccagcaagcg

SEQ ID NO: 3872241 - RNA, 23 nt, Shigella flexneri 2a str. 2457T
ccaugccggaugcgccagcaucc

SEQ ID NO: 3872242 - RNA, 15 nt, Shigella flexneri 2a str. 2457T
ccaugccguucuggg

SEQ ID NO: 3872243 - RNA, 21 nt, Shigella flexneri 2a str. 2457T
ccaugccuuguuugaucaucg

SEQ ID NO: 3872244 - RNA, 15 nt, Shigella flexneri 2a str. 2457T
ccaugcgcaucaucg

SEQ ID NO: 3872245 - RNA, 13 nt, Shigella flexneri 2a str. 2457T
ccaugcggcaucu

SEQ ID NO: 3872246 - RNA, 21 nt, Shigella flexneri 2a str. 2457T
ccaugcguugucgccauccag

SEQ ID NO: 3872247 - RNA, 18 nt, Shigella flexneri 2a str. 2457T
ccaugcuaauagcugcgc

SEQ ID NO: 3872248 - RNA, 19 nt, Shigella flexneri 2a str. 2457T
ccaugcugucggcugccag

SEQ ID NO: 3872249 - RNA, 23 nt, Shigella flexneri 2a str. 2457T
ccaugcugugcgccacagacaua

SEQ ID NO: 3872250 - RNA, 16 nt, Shigella flexneri 2a str. 2457T
ccaugcuucaauuucc

SEQ ID NO: 3872251 - RNA, 19 nt, Shigella flexneri 2a str. 2457T
ccauggacauacgcaccuu

SEQ ID NO: 3872252 - RNA, 14 nt, Shigella flexneri 2a str. 2457T
ccauggacgcguca

SEQ ID NO: 3872253 - RNA, 12 nt, Shigella flexneri 2a str. 2457T
ccauggauuacc

SEQ ID NO: 3872254 - RNA, 18 nt, Shigella flexneri 2a str. 2457T
ccauggcucaccagcagc

SEQ ID NO: 3872255 - RNA, 20 nt, Shigella flexneri 2a str. 2457T
ccauggcucaccagcagcgg

SEQ ID NO: 3872256 - RNA, 16 nt, Shigella flexneri 2a str. 2457T
ccauguugcuggaaga

SEQ ID NO: 3872257 - RNA, 23 nt, Shigella flexneri 2a str. 2457T
ccauguuuaauucacgcaggcga

SEQ ID NO: 3872258 - RNA, 13 nt, Shigella flexneri 2a str. 2457T
ccauuaaaagaau

SEQ ID NO: 3872259 - RNA, 12 nt, Shigella flexneri 2a str. 2457T
ccauuaaacacc

SEQ ID NO: 3872260 - RNA, 19 nt, Shigella flexneri 2a str. 2457T
ccauuaaacgcaguaagcg

SEQ ID NO: 3872261 - RNA, 14 nt, Shigella flexneri 2a str. 2457T
ccauuaaccagcca

SEQ ID NO: 3872262 - RNA, 16 nt, Shigella flexneri 2a str. 2457T
ccauuaaccagccacu

SEQ ID NO: 3872263 - RNA, 21 nt, Shigella flexneri 2a str. 2457T
ccauuaaggcugaugaagcaa

SEQ ID NO: 3872264 - RNA, 14 nt, Shigella flexneri 2a str. 2457T
ccauuaccgccacu

SEQ ID NO: 3872265 - RNA, 19 nt, Shigella flexneri 2a str. 2457T
ccauuauccgucagccacu

SEQ ID NO: 3872266 - RNA, 15 nt, Shigella flexneri 2a str. 2457T
ccauuauucaacgca

SEQ ID NO: 3872267 - RNA, 13 nt, Shigella flexneri 2a str. 2457T
ccauuauuucaau

SEQ ID NO: 3872268 - RNA, 22 nt, Shigella flexneri 2a str. 2457T
ccauucacacuccagucccagu

SEQ ID NO: 3872269 - RNA, 19 nt, Shigella flexneri 2a str. 2457T
ccauuccggccaucgccug

SEQ ID NO: 3872270 - RNA, 17 nt, Shigella flexneri 2a str. 2457T
ccauuccguuucuccac

SEQ ID NO: 3872271 - RNA, 22 nt, Shigella flexneri 2a str. 2457T
ccauucuggauaaucaaugaca

SEQ ID NO: 3872272 - RNA, 16 nt, Shigella flexneri 2a str. 2457T
ccauugacguuccuuu

SEQ ID NO: 3872273 - RNA, 18 nt, Shigella flexneri 2a str. 2457T
ccauugacguuccuuucu

SEQ ID NO: 3872274 - RNA, 22 nt, Shigella flexneri 2a str. 2457T
ccauugagaaagcccuggcgca

SEQ ID NO: 3872275 - RNA, 18 nt, Shigella flexneri 2a str. 2457T
ccauugcaucaucgacau

SEQ ID NO: 3872276 - RNA, 18 nt, Shigella flexneri 2a str. 2457T
ccauugccgccucugccg

SEQ ID NO: 3872277 - RNA, 15 nt, Shigella flexneri 2a str. 2457T
ccauugggccacuca

SEQ ID NO: 3872278 - RNA, 18 nt, Shigella flexneri 2a str. 2457T
ccauuguuagcaacgaca

SEQ ID NO: 3872279 - RNA, 23 nt, Shigella flexneri 2a str. 2457T
ccauuguuguuggauccccugcc

SEQ ID NO: 3872280 - RNA, 22 nt, Shigella flexneri 2a str. 2457T
ccauuuauccagcggcagccau

SEQ ID NO: 3872281 - RNA, 17 nt, Shigella flexneri 2a str. 2457T
ccauuucggcgugcugu

SEQ ID NO: 3872282 - RNA, 12 nt, Shigella flexneri 2a str. 2457T
ccauuugccacu

SEQ ID NO: 3872283 - RNA, 21 nt, Shigella flexneri 2a str. 2457T
ccauuugugcauagcacacuu

SEQ ID NO: 3872284 - RNA, 23 nt, Shigella flexneri 2a str. 2457T
cccaaaaaaucaacgacaaaaau

SEQ ID NO: 3872285 - RNA, 13 nt, Shigella flexneri 2a str. 2457T
cccaaaaggcagc

SEQ ID NO: 3872286 - RNA, 15 nt, Shigella flexneri 2a str. 2457T
cccaacaacagcgcg

SEQ ID NO: 3872287 - RNA, 17 nt, Shigella flexneri 2a str. 2457T
cccaacaacagcgcgcu

SEQ ID NO: 3872288 - RNA, 22 nt, Shigella flexneri 2a str. 2457T
cccaaccgauaaccacgcucag

SEQ ID NO: 3872289 - RNA, 16 nt, Shigella flexneri 2a str. 2457T
cccaacgaugguguca

SEQ ID NO: 3872290 - RNA, 23 nt, Shigella flexneri 2a str. 2457T
cccaacgcaaagagagaagccag

SEQ ID NO: 3872291 - RNA, 15 nt, Shigella flexneri 2a str. 2457T
cccaacgcagcaaca

SEQ ID NO: 3872292 - RNA, 20 nt, Shigella flexneri 2a str. 2457T
cccaacgcgccaccgaccag

SEQ ID NO: 3872293 - RNA, 15 nt, Shigella flexneri 2a str. 2457T
cccaacguaacaaaa

SEQ ID NO: 3872294 - RNA, 16 nt, Shigella flexneri 2a str. 2457T
cccaacugccugaugc

SEQ ID NO: 3872295 - RNA, 20 nt, Shigella flexneri 2a str. 2457T
cccaauccaguacaugaagc

SEQ ID NO: 3872296 - RNA, 11 nt, Shigella flexneri 2a str. 2457T
cccaaugaccu

SEQ ID NO: 3872297 - RNA, 22 nt, Shigella flexneri 2a str. 2457T
cccaauguagccgcacgcuggc

SEQ ID NO: 3872298 - RNA, 13 nt, Shigella flexneri 2a str. 2457T
cccacaacgaccu

SEQ ID NO: 3872299 - RNA, 11 nt, Shigella flexneri 2a str. 2457T
cccacacauuu

SEQ ID NO: 3872300 - RNA, 15 nt, Shigella flexneri 2a str. 2457T
cccacagaaacaaua

SEQ ID NO: 3872301 - RNA, 20 nt, Shigella flexneri 2a str. 2457T
cccacagacccagguagaca

SEQ ID NO: 3872302 - RNA, 22 nt, Shigella flexneri 2a str. 2457T
cccacagcucuugcuccacaag

SEQ ID NO: 3872303 - RNA, 20 nt, Shigella flexneri 2a str. 2457T
cccacaguuucagccccauc

SEQ ID NO: 3872304 - RNA, 15 nt, Shigella flexneri 2a str. 2457T
cccacauccaugugg

SEQ ID NO: 3872305 - RNA, 21 nt, Shigella flexneri 2a str. 2457T
cccacauguugcgcuucacca

SEQ ID NO: 3872306 - RNA, 12 nt, Shigella flexneri 2a str. 2457T
cccaccaccagc

SEQ ID NO: 3872307 - RNA, 13 nt, Shigella flexneri 2a str. 2457T
cccaccagccacg

SEQ ID NO: 3872308 - RNA, 14 nt, Shigella flexneri 2a str. 2457T
cccaccagcugaug

SEQ ID NO: 3872309 - RNA, 19 nt, Shigella flexneri 2a str. 2457T
cccaccccagcagcagccg

SEQ ID NO: 3872310 - RNA, 13 nt, Shigella flexneri 2a str. 2457T
cccaccgcaauaa

SEQ ID NO: 3872311 - RNA, 13 nt, Shigella flexneri 2a str. 2457T
cccaccgcagccc

SEQ ID NO: 3872312 - RNA, 19 nt, Shigella flexneri 2a str. 2457T
cccacgauguauccggcaa

SEQ ID NO: 3872313 - RNA, 15 nt, Shigella flexneri 2a str. 2457T
cccacgccagccugc

SEQ ID NO: 3872314 - RNA, 18 nt, Shigella flexneri 2a str. 2457T
cccacgccgcccagagaa

SEQ ID NO: 3872315 - RNA, 19 nt, Shigella flexneri 2a str. 2457T
cccacgccgcccagagaac

SEQ ID NO: 3872316 - RNA, 20 nt, Shigella flexneri 2a str. 2457T
cccacggauagauuuuuaau

SEQ ID NO: 3872317 - RNA, 20 nt, Shigella flexneri 2a str. 2457T
cccacggcggugucgccaga

SEQ ID NO: 3872318 - RNA, 21 nt, Shigella flexneri 2a str. 2457T
cccacggcggugucgccagaa

SEQ ID NO: 3872319 - RNA, 12 nt, Shigella flexneri 2a str. 2457T
cccacggcuacc

SEQ ID NO: 3872320 - RNA, 20 nt, Shigella flexneri 2a str. 2457T
cccacgucagaccaaaacgc

SEQ ID NO: 3872321 - RNA, 22 nt, Shigella flexneri 2a str. 2457T
cccacgucaucugucauaacac

SEQ ID NO: 3872322 - RNA, 12 nt, Shigella flexneri 2a str. 2457T
cccacuccagcu

SEQ ID NO: 3872323 - RNA, 13 nt, Shigella flexneri 2a str. 2457T
cccacucgccccg

SEQ ID NO: 3872324 - RNA, 19 nt, Shigella flexneri 2a str. 2457T
cccacugcucaaucaucac

SEQ ID NO: 3872325 - RNA, 19 nt, Shigella flexneri 2a str. 2457T
cccacuuucaggccagcgg

SEQ ID NO: 3872326 - RNA, 16 nt, Shigella flexneri 2a str. 2457T
cccacuuucugcgcaa

SEQ ID NO: 3872327 - RNA, 12 nt, Shigella flexneri 2a str. 2457T
cccccacagcuc

SEQ ID NO: 3872328 - RNA, 14 nt, Shigella flexneri 2a str. 2457T
cccccaguaaauga

SEQ ID NO: 3872329 - RNA, 19 nt, Shigella flexneri 2a str. 2457T
cccccauugaaacgagugg

SEQ ID NO: 3872330 - RNA, 18 nt, Shigella flexneri 2a str. 2457T
cccccauugggccacuca

SEQ ID NO: 3872331 - RNA, 16 nt, Shigella flexneri 2a str. 2457T
cccccgggccuccccu

SEQ ID NO: 3872332 - RNA, 23 nt, Shigella flexneri 2a str. 2457T
cccccgucaccggcacaaagcug

SEQ ID NO: 3872333 - RNA, 20 nt, Shigella flexneri 2a str. 2457T
cccccguuuuguugucaggu

SEQ ID NO: 3872334 - RNA, 13 nt, Shigella flexneri 2a str. 2457T
cccccuuccugcu

SEQ ID NO: 3872335 - RNA, 23 nt, Shigella flexneri 2a str. 2457T
cccccuuugaccagccagucagu

SEQ ID NO: 3872336 - RNA, 18 nt, Shigella flexneri 2a str. 2457T
ccccgagaaauacuggcu

SEQ ID NO: 3872337 - RNA, 12 nt, Shigella flexneri 2a str. 2457T
ccccgcuccggc

SEQ ID NO: 3872338 - RNA, 14 nt, Shigella flexneri 2a str. 2457T
ccccgcuuccugca

SEQ ID NO: 3872339 - RNA, 17 nt, Shigella flexneri 2a str. 2457T
ccccgcuucgcccgcca

SEQ ID NO: 3872340 - RNA, 18 nt, Shigella flexneri 2a str. 2457T
ccccggcagugcuuucau

SEQ ID NO: 3872341 - RNA, 16 nt, Shigella flexneri 2a str. 2457T
ccccggcaugauugag

SEQ ID NO: 3872342 - RNA, 21 nt, Shigella flexneri 2a str. 2457T
ccccggcgaucccagagcggg

SEQ ID NO: 3872343 - RNA, 17 nt, Shigella flexneri 2a str. 2457T
ccccgggccuccccuga

SEQ ID NO: 3872344 - RNA, 18 nt, Shigella flexneri 2a str. 2457T
ccccgggcggccucuuca

SEQ ID NO: 3872345 - RNA, 22 nt, Shigella flexneri 2a str. 2457T
ccccgguuuuucuggcaccugu

SEQ ID NO: 3872346 - RNA, 17 nt, Shigella flexneri 2a str. 2457T
ccccgucagcaaaauac

SEQ ID NO: 3872347 - RNA, 22 nt, Shigella flexneri 2a str. 2457T
ccccgucucccgaugccagcac

SEQ ID NO: 3872348 - RNA, 19 nt, Shigella flexneri 2a str. 2457T
ccccgugaugaacugcggu

SEQ ID NO: 3872349 - RNA, 14 nt, Shigella flexneri 2a str. 2457T
ccccguucugccag

SEQ ID NO: 3872350 - RNA, 15 nt, Shigella flexneri 2a str. 2457T
ccccuccacauucag

SEQ ID NO: 3872351 - RNA, 12 nt, Shigella flexneri 2a str. 2457T
ccccuccagcga

SEQ ID NO: 3872352 - RNA, 19 nt, Shigella flexneri 2a str. 2457T
ccccucuaacucuucugaa

SEQ ID NO: 3872353 - RNA, 13 nt, Shigella flexneri 2a str. 2457T
ccccucuucagcc

SEQ ID NO: 3872354 - RNA, 19 nt, Shigella flexneri 2a str. 2457T
ccccugacgcuuaucuucu

SEQ ID NO: 3872355 - RNA, 23 nt, Shigella flexneri 2a str. 2457T
ccccugcgccagcgcgcguugcu

SEQ ID NO: 3872356 - RNA, 13 nt, Shigella flexneri 2a str. 2457T
ccccuuccugcug

SEQ ID NO: 3872357 - RNA, 17 nt, Shigella flexneri 2a str. 2457T
ccccuuucgaaaucauu

SEQ ID NO: 3872358 - RNA, 15 nt, Shigella flexneri 2a str. 2457T
ccccuuugaccagcc

SEQ ID NO: 3872359 - RNA, 22 nt, Shigella flexneri 2a str. 2457T
cccgaaaccgacuuacuuauuu

SEQ ID NO: 3872360 - RNA, 12 nt, Shigella flexneri 2a str. 2457T
cccgaagacgug

SEQ ID NO: 3872361 - RNA, 19 nt, Shigella flexneri 2a str. 2457T
cccgaagggcgaagcgcgc

SEQ ID NO: 3872362 - RNA, 13 nt, Shigella flexneri 2a str. 2457T
cccgaccaaugca

SEQ ID NO: 3872363 - RNA, 16 nt, Shigella flexneri 2a str. 2457T
cccgacuccagcagug

SEQ ID NO: 3872364 - RNA, 13 nt, Shigella flexneri 2a str. 2457T
cccgagaaaaaua

SEQ ID NO: 3872365 - RNA, 14 nt, Shigella flexneri 2a str. 2457T
cccgagcacaugca

SEQ ID NO: 3872366 - RNA, 16 nt, Shigella flexneri 2a str. 2457T
cccgagcucaauacaa

SEQ ID NO: 3872367 - RNA, 14 nt, Shigella flexneri 2a str. 2457T
cccgauaaccgcaa

SEQ ID NO: 3872368 - RNA, 15 nt, Shigella flexneri 2a str. 2457T
cccgauaagggagca

SEQ ID NO: 3872369 - RNA, 13 nt, Shigella flexneri 2a str. 2457T
cccgaugaccuug

SEQ ID NO: 3872370 - RNA, 23 nt, Shigella flexneri 2a str. 2457T
cccgaugaccuugucaugcagcu

SEQ ID NO: 3872371 - RNA, 18 nt, Shigella flexneri 2a str. 2457T
cccgauucggucauggua

SEQ ID NO: 3872372 - RNA, 13 nt, Shigella flexneri 2a str. 2457T
cccgcaagcugcg

SEQ ID NO: 3872373 - RNA, 20 nt, Shigella flexneri 2a str. 2457T
cccgcaaguccccaguaauc

SEQ ID NO: 3872374 - RNA, 13 nt, Shigella flexneri 2a str. 2457T
cccgcagcaaccg

SEQ ID NO: 3872375 - RNA, 18 nt, Shigella flexneri 2a str. 2457T
cccgcagccagcacugcc

SEQ ID NO: 3872376 - RNA, 16 nt, Shigella flexneri 2a str. 2457T
cccgcauuuacucuca

SEQ ID NO: 3872377 - RNA, 22 nt, Shigella flexneri 2a str. 2457T
cccgccaaaccacuauuauggc

SEQ ID NO: 3872378 - RNA, 14 nt, Shigella flexneri 2a str. 2457T
cccgccaccggcuu

SEQ ID NO: 3872379 - RNA, 15 nt, Shigella flexneri 2a str. 2457T
cccgccagcaccagc

SEQ ID NO: 3872380 - RNA, 19 nt, Shigella flexneri 2a str. 2457T
cccgccagcacgaccgcca

SEQ ID NO: 3872381 - RNA, 18 nt, Shigella flexneri 2a str. 2457T
cccgccaucaucccuaca

SEQ ID NO: 3872382 - RNA, 13 nt, Shigella flexneri 2a str. 2457T
cccgcccaaucga

SEQ ID NO: 3872383 - RNA, 15 nt, Shigella flexneri 2a str. 2457T
cccgccccugacagg

SEQ ID NO: 3872384 - RNA, 19 nt, Shigella flexneri 2a str. 2457T
cccgccgaucagcgcggaa

SEQ ID NO: 3872385 - RNA, 15 nt, Shigella flexneri 2a str. 2457T
cccgccgccauccug

SEQ ID NO: 3872386 - RNA, 14 nt, Shigella flexneri 2a str. 2457T
cccgccgccgccau

SEQ ID NO: 3872387 - RNA, 12 nt, Shigella flexneri 2a str. 2457T
cccgccggcgua

SEQ ID NO: 3872388 - RNA, 17 nt, Shigella flexneri 2a str. 2457T
cccgccguugccgcagc

SEQ ID NO: 3872389 - RNA, 15 nt, Shigella flexneri 2a str. 2457T
cccgccugauagacc

SEQ ID NO: 3872390 - RNA, 21 nt, Shigella flexneri 2a str. 2457T
cccgccuguugcgucgccgcc

SEQ ID NO: 3872391 - RNA, 20 nt, Shigella flexneri 2a str. 2457T
cccgcgaacggggcugccag

SEQ ID NO: 3872392 - RNA, 13 nt, Shigella flexneri 2a str. 2457T
cccgcgaccacca

SEQ ID NO: 3872393 - RNA, 15 nt, Shigella flexneri 2a str. 2457T
cccgcgaccaccagc

SEQ ID NO: 3872394 - RNA, 14 nt, Shigella flexneri 2a str. 2457T
cccgcgaucgccug

SEQ ID NO: 3872395 - RNA, 17 nt, Shigella flexneri 2a str. 2457T
cccgcgccauauaauac

SEQ ID NO: 3872396 - RNA, 18 nt, Shigella flexneri 2a str. 2457T
cccgcgucguucaucgca

SEQ ID NO: 3872397 - RNA, 20 nt, Shigella flexneri 2a str. 2457T
cccgcucgaaguuuuccuca

SEQ ID NO: 3872398 - RNA, 20 nt, Shigella flexneri 2a str. 2457T
cccgcugccgcagauauucc

SEQ ID NO: 3872399 - RNA, 21 nt, Shigella flexneri 2a str. 2457T
cccgcugguuaacgcaccaau

SEQ ID NO: 3872400 - RNA, 18 nt, Shigella flexneri 2a str. 2457T
cccgcuuccugcagcgug

SEQ ID NO: 3872401 - RNA, 12 nt, Shigella flexneri 2a str. 2457T
cccgcuucgccc

SEQ ID NO: 3872402 - RNA, 16 nt, Shigella flexneri 2a str. 2457T
cccgcuucgcccgcca

SEQ ID NO: 3872403 - RNA, 21 nt, Shigella flexneri 2a str. 2457T
cccgcuucguuuucagcuucg

SEQ ID NO: 3872404 - RNA, 14 nt, Shigella flexneri 2a str. 2457T
cccggaacgggaga

SEQ ID NO: 3872405 - RNA, 17 nt, Shigella flexneri 2a str. 2457T
cccggaacuugccgggc

SEQ ID NO: 3872406 - RNA, 23 nt, Shigella flexneri 2a str. 2457T
cccggaagccaccacgccaagaa

SEQ ID NO: 3872407 - RNA, 12 nt, Shigella flexneri 2a str. 2457T
cccggagcagca

SEQ ID NO: 3872408 - RNA, 17 nt, Shigella flexneri 2a str. 2457T
cccggauauccacccgc

SEQ ID NO: 3872409 - RNA, 19 nt, Shigella flexneri 2a str. 2457T
cccggauuuggcaaaugca

SEQ ID NO: 3872410 - RNA, 23 nt, Shigella flexneri 2a str. 2457T
cccggcaaaauagaguguuccuc

SEQ ID NO: 3872411 - RNA, 20 nt, Shigella flexneri 2a str. 2457T
cccggcaacaaauucacgcc

SEQ ID NO: 3872412 - RNA, 18 nt, Shigella flexneri 2a str. 2457T
cccggcaaucaccgccag

SEQ ID NO: 3872413 - RNA, 21 nt, Shigella flexneri 2a str. 2457T
cccggcaccaaucaccgccag

SEQ ID NO: 3872414 - RNA, 12 nt, Shigella flexneri 2a str. 2457T
cccggcagagaa

SEQ ID NO: 3872415 - RNA, 15 nt, Shigella flexneri 2a str. 2457T
cccggcagagaaaau

SEQ ID NO: 3872416 - RNA, 16 nt, Shigella flexneri 2a str. 2457T
cccggccugcucccga

SEQ ID NO: 3872417 - RNA, 15 nt, Shigella flexneri 2a str. 2457T
cccggcgcagcgcgc

SEQ ID NO: 3872418 - RNA, 20 nt, Shigella flexneri 2a str. 2457T
cccggcgcauggccgggguu

SEQ ID NO: 3872419 - RNA, 18 nt, Shigella flexneri 2a str. 2457T
cccggcgcggugcuggau

SEQ ID NO: 3872420 - RNA, 13 nt, Shigella flexneri 2a str. 2457T
cccggcggccgga

SEQ ID NO: 3872421 - RNA, 18 nt, Shigella flexneri 2a str. 2457T
cccggcggccggaugaca

SEQ ID NO: 3872422 - RNA, 20 nt, Shigella flexneri 2a str. 2457T
cccggcggcgcgccaggcgc

SEQ ID NO: 3872423 - RNA, 16 nt, Shigella flexneri 2a str. 2457T
cccggcgguauaccau

SEQ ID NO: 3872424 - RNA, 15 nt, Shigella flexneri 2a str. 2457T
cccggcucauccccu

SEQ ID NO: 3872425 - RNA, 16 nt, Shigella flexneri 2a str. 2457T
cccuucuuucacuuca

SEQ ID NO: 3872426 - RNA, 23 nt, Shigella flexneri 2a str. 2457T
cccuugaugcagauucggguuca

SEQ ID NO: 3872427 - RNA, 22 nt, Shigella flexneri 2a str. 2457T
cccuugauguggcggauggcga

SEQ ID NO: 3872428 - RNA, 14 nt, Shigella flexneri 2a str. 2457T
cccuugcucaauga

SEQ ID NO: 3872429 - RNA, 16 nt, Shigella flexneri 2a str. 2457T
cccuuggggagagggu

SEQ ID NO: 3872430 - RNA, 13 nt, Shigella flexneri 2a str. 2457T
cccuuucugcauc

SEQ ID NO: 3872431 - RNA, 17 nt, Shigella flexneri 2a str. 2457T
ccgaaaaaagucauuac

SEQ ID NO: 3872432 - RNA, 18 nt, Shigella flexneri 2a str. 2457T
ccgaaaaaccgggugcag

SEQ ID NO: 3872433 - RNA, 14 nt, Shigella flexneri 2a str. 2457T
ccgaaaaaccugac

SEQ ID NO: 3872434 - RNA, 12 nt, Shigella flexneri 2a str. 2457T
ccgaaaaaggau

SEQ ID NO: 3872435 - RNA, 21 nt, Shigella flexneri 2a str. 2457T
ccgaacaaaacagcgaguuca

SEQ ID NO: 3872436 - RNA, 14 nt, Shigella flexneri 2a str. 2457T
ccgaacagaucacg

SEQ ID NO: 3872437 - RNA, 19 nt, Shigella flexneri 2a str. 2457T
ccgaaccagugcuccaccu

SEQ ID NO: 3872438 - RNA, 14 nt, Shigella flexneri 2a str. 2457T
ccgaaccgggcgcg

SEQ ID NO: 3872439 - RNA, 16 nt, Shigella flexneri 2a str. 2457T
ccgaaccgggcgcgag

SEQ ID NO: 3872440 - RNA, 18 nt, Shigella flexneri 2a str. 2457T
ccgaagaagaaguuuauu

SEQ ID NO: 3872441 - RNA, 12 nt, Shigella flexneri 2a str. 2457T
ccgaagacaucg

SEQ ID NO: 3872442 - RNA, 18 nt, Shigella flexneri 2a str. 2457T
ccgaagacgugcgccaca

SEQ ID NO: 3872443 - RNA, 12 nt, Shigella flexneri 2a str. 2457T
ccgaagaggaac

SEQ ID NO: 3872444 - RNA, 21 nt, Shigella flexneri 2a str. 2457T
ccgaagcccaucaguacacca

SEQ ID NO: 3872445 - RNA, 20 nt, Shigella flexneri 2a str. 2457T
ccgaagccguuagucaucau

SEQ ID NO: 3872446 - RNA, 19 nt, Shigella flexneri 2a str. 2457T
ccgaaugaccgccccugcg

SEQ ID NO: 3872447 - RNA, 13 nt, Shigella flexneri 2a str. 2457T
ccgaauucaaauc

SEQ ID NO: 3872448 - RNA, 17 nt, Shigella flexneri 2a str. 2457T
ccgacaaauaccaccgu

SEQ ID NO: 3872449 - RNA, 15 nt, Shigella flexneri 2a str. 2457T
ccgacaacgucauuc

SEQ ID NO: 3872450 - RNA, 18 nt, Shigella flexneri 2a str. 2457T
ccgacaaucccgcccgca

SEQ ID NO: 3872451 - RNA, 13 nt, Shigella flexneri 2a str. 2457T
ccgacaaugccac

SEQ ID NO: 3872452 - RNA, 17 nt, Shigella flexneri 2a str. 2457T
ccgacaaugccacaaac

SEQ ID NO: 3872453 - RNA, 13 nt, Shigella flexneri 2a str. 2457T
ccgacagcaggcu

SEQ ID NO: 3872454 - RNA, 12 nt, Shigella flexneri 2a str. 2457T
ccgacaucacgg

SEQ ID NO: 3872455 - RNA, 17 nt, Shigella flexneri 2a str. 2457T
ccgacauuucugcugcc

SEQ ID NO: 3872456 - RNA, 13 nt, Shigella flexneri 2a str. 2457T
ccgaccacuucca

SEQ ID NO: 3872457 - RNA, 16 nt, Shigella flexneri 2a str. 2457T
ccgaccaucgccagcu

SEQ ID NO: 3872458 - RNA, 15 nt, Shigella flexneri 2a str. 2457T
ccgaccgcaaggaag

SEQ ID NO: 3872459 - RNA, 22 nt, Shigella flexneri 2a str. 2457T
ccgaccgcaaggaagccugaca

SEQ ID NO: 3872460 - RNA, 23 nt, Shigella flexneri 2a str. 2457T
ccgacgagaaaugucggcccgca

SEQ ID NO: 3872461 - RNA, 18 nt, Shigella flexneri 2a str. 2457T
ccgacgauaccgccgcac

SEQ ID NO: 3872462 - RNA, 20 nt, Shigella flexneri 2a str. 2457T
ccgacgauuugugcacgugc

SEQ ID NO: 3872463 - RNA, 14 nt, Shigella flexneri 2a str. 2457T
ccgacgccaguucu

SEQ ID NO: 3872464 - RNA, 19 nt, Shigella flexneri 2a str. 2457T
ccgacgcuugaagcacacg

SEQ ID NO: 3872465 - RNA, 16 nt, Shigella flexneri 2a str. 2457T
ccgacgugcagcaucg

SEQ ID NO: 3872466 - RNA, 23 nt, Shigella flexneri 2a str. 2457T
ccgacgugguuaacgaccagcgg

SEQ ID NO: 3872467 - RNA, 19 nt, Shigella flexneri 2a str. 2457T
ccgacuucaauaacgguag

SEQ ID NO: 3872468 - RNA, 23 nt, Shigella flexneri 2a str. 2457T
ccgacuuuaucgcgcaaaaaauc

SEQ ID NO: 3872469 - RNA, 22 nt, Shigella flexneri 2a str. 2457T
ccgagaaaaauagcauuaaugc

SEQ ID NO: 3872470 - RNA, 14 nt, Shigella flexneri 2a str. 2457T
ccgagaagcagcaa

SEQ ID NO: 3872471 - RNA, 16 nt, Shigella flexneri 2a str. 2457T
ccgagaagcagcaaca

SEQ ID NO: 3872472 - RNA, 18 nt, Shigella flexneri 2a str. 2457T
ccgagaauggacaccagc

SEQ ID NO: 3872473 - RNA, 11 nt, Shigella flexneri 2a str. 2457T
ccgagcaaacc

SEQ ID NO: 3872474 - RNA, 14 nt, Shigella flexneri 2a str. 2457T
ccgagcacaugcag

SEQ ID NO: 3872475 - RNA, 11 nt, Shigella flexneri 2a str. 2457T
ccgagcagcca

SEQ ID NO: 3872476 - RNA, 13 nt, Shigella flexneri 2a str. 2457T
ccgagcagccacu

SEQ ID NO: 3872477 - RNA, 14 nt, Shigella flexneri 2a str. 2457T
ccgagcagccacug

SEQ ID NO: 3872478 - RNA, 13 nt, Shigella flexneri 2a str. 2457T
ccgagcaguugcu

SEQ ID NO: 3872479 - RNA, 15 nt, Shigella flexneri 2a str. 2457T
ccgagccgguugccu

SEQ ID NO: 3872480 - RNA, 15 nt, Shigella flexneri 2a str. 2457T
ccgagcgccaccauc

SEQ ID NO: 3872481 - RNA, 20 nt, Shigella flexneri 2a str. 2457T
ccgagcgccaccaucgauac

SEQ ID NO: 3872482 - RNA, 13 nt, Shigella flexneri 2a str. 2457T
ccgagcgccagcc

SEQ ID NO: 3872483 - RNA, 14 nt, Shigella flexneri 2a str. 2457T
ccgagcguggcgau

SEQ ID NO: 3872484 - RNA, 23 nt, Shigella flexneri 2a str. 2457T
ccgagcuuaugcaauagcgccug

SEQ ID NO: 3872485 - RNA, 18 nt, Shigella flexneri 2a str. 2457T
ccgaggauacagccgaag

SEQ ID NO: 3872486 - RNA, 16 nt, Shigella flexneri 2a str. 2457T
ccgaggcauucagcca

SEQ ID NO: 3872487 - RNA, 13 nt, Shigella flexneri 2a str. 2457T
ccgaggcgcuggc

SEQ ID NO: 3872488 - RNA, 23 nt, Shigella flexneri 2a str. 2457T
ccgaggggcugacgcaacugguc

SEQ ID NO: 3872489 - RNA, 20 nt, Shigella flexneri 2a str. 2457T
ccgaguggcauuucgccaaa

SEQ ID NO: 3872490 - RNA, 20 nt, Shigella flexneri 2a str. 2457T
ccgaguuguugagguucgga

SEQ ID NO: 3872491 - RNA, 23 nt, Shigella flexneri 2a str. 2457T
ccgauaaaacgguuuauccccaa

SEQ ID NO: 3872492 - RNA, 19 nt, Shigella flexneri 2a str. 2457T
ccgauaaaggucgacagca

SEQ ID NO: 3872493 - RNA, 21 nt, Shigella flexneri 2a str. 2457T
ccgauaaaggucgacagcagc

SEQ ID NO: 3872494 - RNA, 13 nt, Shigella flexneri 2a str. 2457T
ccgauaaccacgc

SEQ ID NO: 3872495 - RNA, 17 nt, Shigella flexneri 2a str. 2457T
ccgauaaccgcaaaacc

SEQ ID NO: 3872496 - RNA, 21 nt, Shigella flexneri 2a str. 2457T
ccgauaaucaacgcgccgcca

SEQ ID NO: 3872497 - RNA, 17 nt, Shigella flexneri 2a str. 2457T
ccgauaauuccucccgu

SEQ ID NO: 3872498 - RNA, 14 nt, Shigella flexneri 2a str. 2457T
ccgauacggacagu

SEQ ID NO: 3872499 - RNA, 21 nt, Shigella flexneri 2a str. 2457T
ccgauacggacaguauaacga

SEQ ID NO: 3872500 - RNA, 21 nt, Shigella flexneri 2a str. 2457T
ccgauauguucagaaagcgcc

SEQ ID NO: 3872501 - RNA, 18 nt, Shigella flexneri 2a str. 2457T
ccgaucaucaaaaaacac

SEQ ID NO: 3872502 - RNA, 14 nt, Shigella flexneri 2a str. 2457T
ccgaucaucaucca

SEQ ID NO: 3872503 - RNA, 13 nt, Shigella flexneri 2a str. 2457T
ccgaucgaagaga

SEQ ID NO: 3872504 - RNA, 19 nt, Shigella flexneri 2a str. 2457T
ccgaucgaagagacgcugg

SEQ ID NO: 3872505 - RNA, 20 nt, Shigella flexneri 2a str. 2457T
ccgaucggcuggcauuuuua

SEQ ID NO: 3872506 - RNA, 13 nt, Shigella flexneri 2a str. 2457T
ccgaugaacuggc

SEQ ID NO: 3872507 - RNA, 17 nt, Shigella flexneri 2a str. 2457T
ccgaugaccuugucaug

SEQ ID NO: 3872508 - RNA, 20 nt, Shigella flexneri 2a str. 2457T
ccgaugaguuaagaagaucg

SEQ ID NO: 3872509 - RNA, 22 nt, Shigella flexneri 2a str. 2457T
ccgaugaucaacagcaucaucg

SEQ ID NO: 3872510 - RNA, 17 nt, Shigella flexneri 2a str. 2457T
ccgaugauucccaguca

SEQ ID NO: 3872511 - RNA, 22 nt, Shigella flexneri 2a str. 2457T
ccgaugccagcacagaucgcac

SEQ ID NO: 3872512 - RNA, 18 nt, Shigella flexneri 2a str. 2457T
ccgaugcgcaaacuuauc

SEQ ID NO: 3872513 - RNA, 13 nt, Shigella flexneri 2a str. 2457T
ccgaugcgcgaac

SEQ ID NO: 3872514 - RNA, 18 nt, Shigella flexneri 2a str. 2457T
ccgauggcaaaagugaua

SEQ ID NO: 3872515 - RNA, 21 nt, Shigella flexneri 2a str. 2457T
ccgaugguagcagcgaagaga

SEQ ID NO: 3872516 - RNA, 18 nt, Shigella flexneri 2a str. 2457T
ccgauggucacggacagg

SEQ ID NO: 3872517 - RNA, 16 nt, Shigella flexneri 2a str. 2457T
ccgauggucagcuuca

SEQ ID NO: 3872518 - RNA, 17 nt, Shigella flexneri 2a str. 2457T
ccgauggucagcuucac

SEQ ID NO: 3872519 - RNA, 20 nt, Shigella flexneri 2a str. 2457T
ccgauuaaucuuccagauca

SEQ ID NO: 3872520 - RNA, 21 nt, Shigella flexneri 2a str. 2457T
ccgauuaaucuuccagaucac

SEQ ID NO: 3872521 - RNA, 18 nt, Shigella flexneri 2a str. 2457T
ccgauuaauugccgccag

SEQ ID NO: 3872522 - RNA, 17 nt, Shigella flexneri 2a str. 2457T
ccgauuacucagcaacu

SEQ ID NO: 3872523 - RNA, 17 nt, Shigella flexneri 2a str. 2457T
ccgccauuucuccuccg

SEQ ID NO: 3872524 - RNA, 17 nt, Shigella flexneri 2a str. 2457T
ccgcccaccaccagcga

SEQ ID NO: 3872525 - RNA, 12 nt, Shigella flexneri 2a str. 2457T
ccgcccagugcc

SEQ ID NO: 3872526 - RNA, 12 nt, Shigella flexneri 2a str. 2457T
ccgccccaggcc

SEQ ID NO: 3872527 - RNA, 13 nt, Shigella flexneri 2a str. 2457T
ccgcccccgggcc

SEQ ID NO: 3872528 - RNA, 19 nt, Shigella flexneri 2a str. 2457T
ccgcccccgggccuccccu

SEQ ID NO: 3872529 - RNA, 21 nt, Shigella flexneri 2a str. 2457T
ccgcccgauaaaacgguuuau

SEQ ID NO: 3872530 - RNA, 13 nt, Shigella flexneri 2a str. 2457T
ccgcccgcuauga

SEQ ID NO: 3872531 - RNA, 20 nt, Shigella flexneri 2a str. 2457T
ccgcccguuccaccgcguuu

SEQ ID NO: 3872532 - RNA, 19 nt, Shigella flexneri 2a str. 2457T
ccgcccguuuucuccagcg

SEQ ID NO: 3872533 - RNA, 20 nt, Shigella flexneri 2a str. 2457T
ccgcccguuuucuccagcgc

SEQ ID NO: 3872534 - RNA, 23 nt, Shigella flexneri 2a str. 2457T
ccgcccguuuucuccagcgccgc

SEQ ID NO: 3872535 - RNA, 21 nt, Shigella flexneri 2a str. 2457T
ccgcccuguuugguugccagc

SEQ ID NO: 3872536 - RNA, 20 nt, Shigella flexneri 2a str. 2457T
ccgccgaggauacagccgaa

SEQ ID NO: 3872537 - RNA, 17 nt, Shigella flexneri 2a str. 2457T
ccgccgauguugcauga

SEQ ID NO: 3872538 - RNA, 21 nt, Shigella flexneri 2a str. 2457T
ccgccgcacaauacauagaaa

SEQ ID NO: 3872539 - RNA, 14 nt, Shigella flexneri 2a str. 2457T
ccgccgcagccgca

SEQ ID NO: 3872540 - RNA, 13 nt, Shigella flexneri 2a str. 2457T
ccgccgccauccu

SEQ ID NO: 3872541 - RNA, 20 nt, Shigella flexneri 2a str. 2457T
ccgccgccauuugggcggcu

SEQ ID NO: 3872542 - RNA, 11 nt, Shigella flexneri 2a str. 2457T
ccgccgcccgg

SEQ ID NO: 3872543 - RNA, 19 nt, Shigella flexneri 2a str. 2457T
ccgccgcgaaccugugaaa

SEQ ID NO: 3872544 - RNA, 21 nt, Shigella flexneri 2a str. 2457T
ccgccgcuauuauaucgcucu

SEQ ID NO: 3872545 - RNA, 14 nt, Shigella flexneri 2a str. 2457T
ccgccgcuccucau

SEQ ID NO: 3872546 - RNA, 19 nt, Shigella flexneri 2a str. 2457T
ccgccgguagucaccgccc

SEQ ID NO: 3872547 - RNA, 21 nt, Shigella flexneri 2a str. 2457T
ccgccgguagucaccgcccag

SEQ ID NO: 3872548 - RNA, 16 nt, Shigella flexneri 2a str. 2457T
ccgccgguugccccgc

SEQ ID NO: 3872549 - RNA, 20 nt, Shigella flexneri 2a str. 2457T
ccgccgucgaugccccagua

SEQ ID NO: 3872550 - RNA, 17 nt, Shigella flexneri 2a str. 2457T
ccgccguguucuucggu

SEQ ID NO: 3872551 - RNA, 21 nt, Shigella flexneri 2a str. 2457T
ccgccguugccgcagcgaugg

SEQ ID NO: 3872552 - RNA, 22 nt, Shigella flexneri 2a str. 2457T
ccgccucaccgccauuugcauc

SEQ ID NO: 3872553 - RNA, 15 nt, Shigella flexneri 2a str. 2457T
ccgccucccuucgcu

SEQ ID NO: 3872554 - RNA, 21 nt, Shigella flexneri 2a str. 2457T
ccgccucgcggcagcagagaa

SEQ ID NO: 3872555 - RNA, 15 nt, Shigella flexneri 2a str. 2457T
ccgccuggcgcugcu

SEQ ID NO: 3872556 - RNA, 13 nt, Shigella flexneri 2a str. 2457T
ccgccuguugccc

SEQ ID NO: 3872557 - RNA, 15 nt, Shigella flexneri 2a str. 2457T
ccgccuguugcccuu

SEQ ID NO: 3872558 - RNA, 19 nt, Shigella flexneri 2a str. 2457T
ccgcgaaccggaccagcaa

SEQ ID NO: 3872559 - RNA, 21 nt, Shigella flexneri 2a str. 2457T
ccgcgaaccggaccagcaaca

SEQ ID NO: 3872560 - RNA, 18 nt, Shigella flexneri 2a str. 2457T
ccgcgaauuaugcagccu

SEQ ID NO: 3872561 - RNA, 16 nt, Shigella flexneri 2a str. 2457T
ccgcgacgacgacagg

SEQ ID NO: 3872562 - RNA, 19 nt, Shigella flexneri 2a str. 2457T
ccgcgacugggaggacagc

SEQ ID NO: 3872563 - RNA, 15 nt, Shigella flexneri 2a str. 2457T
ccgcgaguaaucaca

SEQ ID NO: 3872564 - RNA, 18 nt, Shigella flexneri 2a str. 2457T
ccgcgauaaaaauccugu

SEQ ID NO: 3872565 - RNA, 19 nt, Shigella flexneri 2a str. 2457T
ccgcgaucgccugcagggc

SEQ ID NO: 3872566 - RNA, 15 nt, Shigella flexneri 2a str. 2457T
ccgcgaucuuccacg

SEQ ID NO: 3872567 - RNA, 13 nt, Shigella flexneri 2a str. 2457T
ccgcgcaaaccac

SEQ ID NO: 3872568 - RNA, 13 nt, Shigella flexneri 2a str. 2457T
ccgcgcaauaugc

SEQ ID NO: 3872569 - RNA, 21 nt, Shigella flexneri 2a str. 2457T
ccgcgcaaucgcccagcgcgu

SEQ ID NO: 3872570 - RNA, 18 nt, Shigella flexneri 2a str. 2457T
ccgcgcacgucagccucg

SEQ ID NO: 3872571 - RNA, 21 nt, Shigella flexneri 2a str. 2457T
ccgcgcagggacacucgcuga

SEQ ID NO: 3872572 - RNA, 12 nt, Shigella flexneri 2a str. 2457T
ccgcgcaguucg

SEQ ID NO: 3872573 - RNA, 21 nt, Shigella flexneri 2a str. 2457T
ccgcgcauuacgcucacugca

SEQ ID NO: 3872574 - RNA, 15 nt, Shigella flexneri 2a str. 2457T
ccgcgccaaugccug

SEQ ID NO: 3872575 - RNA, 16 nt, Shigella flexneri 2a str. 2457T
ccgcgccacgcggagc

SEQ ID NO: 3872576 - RNA, 12 nt, Shigella flexneri 2a str. 2457T
ccgcgccagcgg

SEQ ID NO: 3872577 - RNA, 11 nt, Shigella flexneri 2a str. 2457T
ccgcgccgcgg

SEQ ID NO: 3872578 - RNA, 16 nt, Shigella flexneri 2a str. 2457T
ccgcgccgcugagaaa

SEQ ID NO: 3872579 - RNA, 22 nt, Shigella flexneri 2a str. 2457T
ccgcgccgugcaacugcggcgc

SEQ ID NO: 3872580 - RNA, 20 nt, Shigella flexneri 2a str. 2457T
ccgcgccuucgugcggcugc

SEQ ID NO: 3872581 - RNA, 23 nt, Shigella flexneri 2a str. 2457T
ccgcgcguuuuucuucagccccu

SEQ ID NO: 3872582 - RNA, 23 nt, Shigella flexneri 2a str. 2457T
ccgcgcucgaagcgggcgcgcag

SEQ ID NO: 3872583 - RNA, 22 nt, Shigella flexneri 2a str. 2457T
ccgcgcugcuguagcaguucca

SEQ ID NO: 3872584 - RNA, 15 nt, Shigella flexneri 2a str. 2457T
ccgcgcuugccgccg

SEQ ID NO: 3872585 - RNA, 16 nt, Shigella flexneri 2a str. 2457T
ccgcgcuuucuucuuc

SEQ ID NO: 3872586 - RNA, 14 nt, Shigella flexneri 2a str. 2457T
ccgcggaucacgcg

SEQ ID NO: 3872587 - RNA, 17 nt, Shigella flexneri 2a str. 2457T
ccgcggcucaggcgcac

SEQ ID NO: 3872588 - RNA, 21 nt, Shigella flexneri 2a str. 2457T
ccgcguaaacgugcggcugug

SEQ ID NO: 3872589 - RNA, 23 nt, Shigella flexneri 2a str. 2457T
ccgcguaaacgugcggcugugcg

SEQ ID NO: 3872590 - RNA, 14 nt, Shigella flexneri 2a str. 2457T
ccgcguaaucaaca

SEQ ID NO: 3872591 - RNA, 16 nt, Shigella flexneri 2a str. 2457T
ccgcguaccgcagcaa

SEQ ID NO: 3872592 - RNA, 16 nt, Shigella flexneri 2a str. 2457T
ccgcgugcgcggcagc

SEQ ID NO: 3872593 - RNA, 16 nt, Shigella flexneri 2a str. 2457T
ccgcguggacggucaa

SEQ ID NO: 3872594 - RNA, 14 nt, Shigella flexneri 2a str. 2457T
ccgcguggcgcaag

SEQ ID NO: 3872595 - RNA, 15 nt, Shigella flexneri 2a str. 2457T
ccgcuaacagcagca

SEQ ID NO: 3872596 - RNA, 20 nt, Shigella flexneri 2a str. 2457T
ccgcuaacugguggcaggaa

SEQ ID NO: 3872597 - RNA, 15 nt, Shigella flexneri 2a str. 2457T
ccgcuaccgcccuga

SEQ ID NO: 3872598 - RNA, 15 nt, Shigella flexneri 2a str. 2457T
ccgcuaucaguucag

SEQ ID NO: 3872599 - RNA, 21 nt, Shigella flexneri 2a str. 2457T
ccgcuaucgaggcucugauug

SEQ ID NO: 3872600 - RNA, 23 nt, Shigella flexneri 2a str. 2457T
ccgcuauuauaucgcucucuuua

SEQ ID NO: 3872601 - RNA, 22 nt, Shigella flexneri 2a str. 2457T
ccgcucaccugauacgcgccaa

SEQ ID NO: 3872602 - RNA, 13 nt, Shigella flexneri 2a str. 2457T
ccgcucccagcau

SEQ ID NO: 3872603 - RNA, 11 nt, Shigella flexneri 2a str. 2457T
ccgcucccugg

SEQ ID NO: 3872604 - RNA, 14 nt, Shigella flexneri 2a str. 2457T
ccgcuccgccaucu

SEQ ID NO: 3872605 - RNA, 23 nt, Shigella flexneri 2a str. 2457T
ccgcuccgccaucuucuugcagc

SEQ ID NO: 3872606 - RNA, 15 nt, Shigella flexneri 2a str. 2457T
ccgcucgaaguuuuc

SEQ ID NO: 3872607 - RNA, 18 nt, Shigella flexneri 2a str. 2457T
ccgcucgaaguuuuccuc

SEQ ID NO: 3872608 - RNA, 15 nt, Shigella flexneri 2a str. 2457T
ccgcucgucacauca

SEQ ID NO: 3872609 - RNA, 22 nt, Shigella flexneri 2a str. 2457T
ccgcucucaaucucuuuuucca

SEQ ID NO: 3872610 - RNA, 21 nt, Shigella flexneri 2a str. 2457T
ccgcucuucauacgcggcaga

SEQ ID NO: 3872611 - RNA, 14 nt, Shigella flexneri 2a str. 2457T
ccgcugagacgcgc

SEQ ID NO: 3872612 - RNA, 16 nt, Shigella flexneri 2a str. 2457T
ccgcugauuccugcaa

SEQ ID NO: 3872613 - RNA, 21 nt, Shigella flexneri 2a str. 2457T
ccgcugcuuaauuacugccuu

SEQ ID NO: 3872614 - RNA, 21 nt, Shigella flexneri 2a str. 2457T
ccgcugcuucucuucagccaa

SEQ ID NO: 3872615 - RNA, 21 nt, Shigella flexneri 2a str. 2457T
ccgcuggagcggggaacaccu

SEQ ID NO: 3872616 - RNA, 13 nt, Shigella flexneri 2a str. 2457T
ccgcuggccauuu

SEQ ID NO: 3872617 - RNA, 20 nt, Shigella flexneri 2a str. 2457T
ccgcuggccauuucugccag

SEQ ID NO: 3872618 - RNA, 19 nt, Shigella flexneri 2a str. 2457T
ccgcuguaaaugcugcucc

SEQ ID NO: 3872619 - RNA, 17 nt, Shigella flexneri 2a str. 2457T
ccgcuguaauugccgcu

SEQ ID NO: 3872620 - RNA, 19 nt, Shigella flexneri 2a str. 2457T
ccggcauucagugcaaaug

SEQ ID NO: 3872621 - RNA, 22 nt, Shigella flexneri 2a str. 2457T
ccggcauuuuuuagcgccagcc

SEQ ID NO: 3872622 - RNA, 15 nt, Shigella flexneri 2a str. 2457T
ccggccacagcgcca

SEQ ID NO: 3872623 - RNA, 16 nt, Shigella flexneri 2a str. 2457T
ccggccagcgccacca

SEQ ID NO: 3872624 - RNA, 17 nt, Shigella flexneri 2a str. 2457T
ccggccagcgccgcgcg

SEQ ID NO: 3872625 - RNA, 23 nt, Shigella flexneri 2a str. 2457T
ccggccaguaagcaguccagcgc

SEQ ID NO: 3872626 - RNA, 17 nt, Shigella flexneri 2a str. 2457T
ccggccuaucaacgucg

SEQ ID NO: 3872627 - RNA, 22 nt, Shigella flexneri 2a str. 2457T
ccggccugcacugcaggccgga

SEQ ID NO: 3872628 - RNA, 15 nt, Shigella flexneri 2a str. 2457T
ccggccuggauggcu

SEQ ID NO: 3872629 - RNA, 16 nt, Shigella flexneri 2a str. 2457T
ccggcgaaagagcugg

SEQ ID NO: 3872630 - RNA, 19 nt, Shigella flexneri 2a str. 2457T
ccggcgacacaucuaaugc

SEQ ID NO: 3872631 - RNA, 18 nt, Shigella flexneri 2a str. 2457T
ccggcgacuaacggaauu

SEQ ID NO: 3872632 - RNA, 14 nt, Shigella flexneri 2a str. 2457T
ccggcgcauccaug

SEQ ID NO: 3872633 - RNA, 17 nt, Shigella flexneri 2a str. 2457T
ccggcgcggugcuggau

SEQ ID NO: 3872634 - RNA, 23 nt, Shigella flexneri 2a str. 2457T
ccggcggcgcgccaggcgcugau

SEQ ID NO: 3872635 - RNA, 23 nt, Shigella flexneri 2a str. 2457T
ccggcguaccuuugccuuccagc

SEQ ID NO: 3872636 - RNA, 23 nt, Shigella flexneri 2a str. 2457T
ccggcguaugcccagggcaaugu

SEQ ID NO: 3872637 - RNA, 15 nt, Shigella flexneri 2a str. 2457T
ccggcguccaccugc

SEQ ID NO: 3872638 - RNA, 22 nt, Shigella flexneri 2a str. 2457T
ccggcguccaccugcgucgcgc

SEQ ID NO: 3872639 - RNA, 17 nt, Shigella flexneri 2a str. 2457T
ccggcgucccaucggca

SEQ ID NO: 3872640 - RNA, 13 nt, Shigella flexneri 2a str. 2457T
ccggcucccgcag

SEQ ID NO: 3872641 - RNA, 16 nt, Shigella flexneri 2a str. 2457T
ccggcucccgcagcca

SEQ ID NO: 3872642 - RNA, 22 nt, Shigella flexneri 2a str. 2457T
ccggcuccgguuaacgccgcgc

SEQ ID NO: 3872643 - RNA, 23 nt, Shigella flexneri 2a str. 2457T
ccggcugccggaugacagacucc

SEQ ID NO: 3872644 - RNA, 14 nt, Shigella flexneri 2a str. 2457T
ccggcuguuccagc

SEQ ID NO: 3872645 - RNA, 13 nt, Shigella flexneri 2a str. 2457T
ccggcuguuuauu

SEQ ID NO: 3872646 - RNA, 16 nt, Shigella flexneri 2a str. 2457T
ccggcuuaccgcuccg

SEQ ID NO: 3872647 - RNA, 23 nt, Shigella flexneri 2a str. 2457T
ccgggaagggguuuuccaguuca

SEQ ID NO: 3872648 - RNA, 21 nt, Shigella flexneri 2a str. 2457T
ccgggagggaaccuguucaac

SEQ ID NO: 3872649 - RNA, 14 nt, Shigella flexneri 2a str. 2457T
ccgggaucacauca

SEQ ID NO: 3872650 - RNA, 22 nt, Shigella flexneri 2a str. 2457T
ccgggaucaccgaaccagggcg

SEQ ID NO: 3872651 - RNA, 14 nt, Shigella flexneri 2a str. 2457T
ccgggcaaaaguca

SEQ ID NO: 3872652 - RNA, 14 nt, Shigella flexneri 2a str. 2457T
ccgggcacacuuag

SEQ ID NO: 3872653 - RNA, 16 nt, Shigella flexneri 2a str. 2457T
ccgggcaucagcagca

SEQ ID NO: 3872654 - RNA, 15 nt, Shigella flexneri 2a str. 2457T
ccgggccuccccuga

SEQ ID NO: 3872655 - RNA, 15 nt, Shigella flexneri 2a str. 2457T
ccgggcgauccggca

SEQ ID NO: 3872656 - RNA, 17 nt, Shigella flexneri 2a str. 2457T
ccgggcucccggcggua

SEQ ID NO: 3872657 - RNA, 21 nt, Shigella flexneri 2a str. 2457T
ccgggcugaugccgcguuggu

SEQ ID NO: 3872658 - RNA, 17 nt, Shigella flexneri 2a str. 2457T
ccgggcugguuuucagc

SEQ ID NO: 3872659 - RNA, 22 nt, Shigella flexneri 2a str. 2457T
ccgggcuguucacugugcuggu

SEQ ID NO: 3872660 - RNA, 19 nt, Shigella flexneri 2a str. 2457T
ccgggcuuccggcaauggc

SEQ ID NO: 3872661 - RNA, 17 nt, Shigella flexneri 2a str. 2457T
ccgggcuucucgcucga

SEQ ID NO: 3872662 - RNA, 18 nt, Shigella flexneri 2a str. 2457T
ccgggcuuggcaccauua

SEQ ID NO: 3872663 - RNA, 13 nt, Shigella flexneri 2a str. 2457T
ccgggcuuuccgc

SEQ ID NO: 3872664 - RNA, 21 nt, Shigella flexneri 2a str. 2457T
ccggggagauauuccccagac

SEQ ID NO: 3872665 - RNA, 20 nt, Shigella flexneri 2a str. 2457T
ccgggguucgaauccccgcc

SEQ ID NO: 3872666 - RNA, 15 nt, Shigella flexneri 2a str. 2457T
ccgggucauccagga

SEQ ID NO: 3872667 - RNA, 14 nt, Shigella flexneri 2a str. 2457T
ccgggugaacugcc

SEQ ID NO: 3872668 - RNA, 16 nt, Shigella flexneri 2a str. 2457T
ccgggugaacugccac

SEQ ID NO: 3872669 - RNA, 20 nt, Shigella flexneri 2a str. 2457T
ccggguuauugguauggucg

SEQ ID NO: 3872670 - RNA, 20 nt, Shigella flexneri 2a str. 2457T
ccgguaaagcaaugaagaac

SEQ ID NO: 3872671 - RNA, 18 nt, Shigella flexneri 2a str. 2457T
ccgguaaaucaccagcgu

SEQ ID NO: 3872672 - RNA, 13 nt, Shigella flexneri 2a str. 2457T
ccgguaauaaugc

SEQ ID NO: 3872673 - RNA, 15 nt, Shigella flexneri 2a str. 2457T
ccgguaauaaugcag

SEQ ID NO: 3872674 - RNA, 14 nt, Shigella flexneri 2a str. 2457T
ccgguaaucaggca

SEQ ID NO: 3872675 - RNA, 17 nt, Shigella flexneri 2a str. 2457T
ccgguacaaacaucauc

SEQ ID NO: 3872676 - RNA, 13 nt, Shigella flexneri 2a str. 2457T
ccgguacgccgcg

SEQ ID NO: 3872677 - RNA, 17 nt, Shigella flexneri 2a str. 2457T
ccgguacggaugcgaau

SEQ ID NO: 3872678 - RNA, 18 nt, Shigella flexneri 2a str. 2457T
ccgguagucaccgcccag

SEQ ID NO: 3872679 - RNA, 14 nt, Shigella flexneri 2a str. 2457T
ccgguaguuucagc

SEQ ID NO: 3872680 - RNA, 13 nt, Shigella flexneri 2a str. 2457T
ccgguauccagcg

SEQ ID NO: 3872681 - RNA, 13 nt, Shigella flexneri 2a str. 2457T
ccggucagcagca

SEQ ID NO: 3872682 - RNA, 18 nt, Shigella flexneri 2a str. 2457T
ccggucagcagcaccacc

SEQ ID NO: 3872683 - RNA, 22 nt, Shigella flexneri 2a str. 2457T
ccggucagccauugcuaccgcu

SEQ ID NO: 3872684 - RNA, 15 nt, Shigella flexneri 2a str. 2457T
ccggucgcgcgggaa

SEQ ID NO: 3872685 - RNA, 17 nt, Shigella flexneri 2a str. 2457T
ccggucgcuucuagugc

SEQ ID NO: 3872686 - RNA, 17 nt, Shigella flexneri 2a str. 2457T
ccggugaaucgcaauuu

SEQ ID NO: 3872687 - RNA, 16 nt, Shigella flexneri 2a str. 2457T
ccggugaccaucagca

SEQ ID NO: 3872688 - RNA, 14 nt, Shigella flexneri 2a str. 2457T
ccggugagcugcau

SEQ ID NO: 3872689 - RNA, 14 nt, Shigella flexneri 2a str. 2457T
ccggugcaucaaca

SEQ ID NO: 3872690 - RNA, 22 nt, Shigella flexneri 2a str. 2457T
ccggugccaaagucaucaaucg

SEQ ID NO: 3872691 - RNA, 18 nt, Shigella flexneri 2a str. 2457T
ccggugccgguuucacgu

SEQ ID NO: 3872692 - RNA, 14 nt, Shigella flexneri 2a str. 2457T
ccgguggaagggcu

SEQ ID NO: 3872693 - RNA, 22 nt, Shigella flexneri 2a str. 2457T
ccggugguuaacgaaucaaucg

SEQ ID NO: 3872694 - RNA, 13 nt, Shigella flexneri 2a str. 2457T
ccggugucgaugu

SEQ ID NO: 3872695 - RNA, 17 nt, Shigella flexneri 2a str. 2457T
ccgguuacgccaccagc

SEQ ID NO: 3872696 - RNA, 15 nt, Shigella flexneri 2a str. 2457T
ccgguucccagaccu

SEQ ID NO: 3872697 - RNA, 15 nt, Shigella flexneri 2a str. 2457T
ccgguuccugcaucg

SEQ ID NO: 3872698 - RNA, 23 nt, Shigella flexneri 2a str. 2457T
ccgguucgggaaauugcagagcu

SEQ ID NO: 3872699 - RNA, 18 nt, Shigella flexneri 2a str. 2457T
ccgguucgucauacucca

SEQ ID NO: 3872700 - RNA, 19 nt, Shigella flexneri 2a str. 2457T
ccgguucgucauacuccag

SEQ ID NO: 3872701 - RNA, 22 nt, Shigella flexneri 2a str. 2457T
ccgguucguugaucacuuucac

SEQ ID NO: 3872702 - RNA, 13 nt, Shigella flexneri 2a str. 2457T
ccgguugaccggc

SEQ ID NO: 3872703 - RNA, 19 nt, Shigella flexneri 2a str. 2457T
ccgguugcaguucugccau

SEQ ID NO: 3872704 - RNA, 22 nt, Shigella flexneri 2a str. 2457T
ccgguugccugaugcgacgcug

SEQ ID NO: 3872705 - RNA, 21 nt, Shigella flexneri 2a str. 2457T
ccgguuggcgacugaugaagu

SEQ ID NO: 3872706 - RNA, 16 nt, Shigella flexneri 2a str. 2457T
ccgguugucaggaagc

SEQ ID NO: 3872707 - RNA, 23 nt, Shigella flexneri 2a str. 2457T
ccgguugucaggaagccccagcu

SEQ ID NO: 3872708 - RNA, 15 nt, Shigella flexneri 2a str. 2457T
ccgguuucaaaacug

SEQ ID NO: 3872709 - RNA, 12 nt, Shigella flexneri 2a str. 2457T
ccgguuucgcca

SEQ ID NO: 3872710 - RNA, 20 nt, Shigella flexneri 2a str. 2457T
ccgguuugcgccgugcgaau

SEQ ID NO: 3872711 - RNA, 21 nt, Shigella flexneri 2a str. 2457T
ccgguuugcgccgugcgaaua

SEQ ID NO: 3872712 - RNA, 17 nt, Shigella flexneri 2a str. 2457T
ccgguuuggcauaacca

SEQ ID NO: 3872713 - RNA, 13 nt, Shigella flexneri 2a str. 2457T
ccgguuuuaaagc

SEQ ID NO: 3872714 - RNA, 18 nt, Shigella flexneri 2a str. 2457T
ccgguuuuacuuugccuu

SEQ ID NO: 3872715 - RNA, 21 nt, Shigella flexneri 2a str. 2457T
ccguaaccaccagcacugauu

SEQ ID NO: 3872716 - RNA, 19 nt, Shigella flexneri 2a str. 2457T
ccguaacgcccuucaggug

SEQ ID NO: 3872717 - RNA, 16 nt, Shigella flexneri 2a str. 2457T
ccguuucgcagguucc

SEQ ID NO: 3872718 - RNA, 21 nt, Shigella flexneri 2a str. 2457T
ccguuucgcagucgccagcaa

SEQ ID NO: 3872719 - RNA, 20 nt, Shigella flexneri 2a str. 2457T
ccguuucuacaagcagagag

SEQ ID NO: 3872720 - RNA, 23 nt, Shigella flexneri 2a str. 2457T
ccguuugccccggcugcgcgacg

SEQ ID NO: 3872721 - RNA, 19 nt, Shigella flexneri 2a str. 2457T
ccguuugcgucaguuuuug

SEQ ID NO: 3872722 - RNA, 20 nt, Shigella flexneri 2a str. 2457T
ccguuuggugguuuggcggc

SEQ ID NO: 3872723 - RNA, 20 nt, Shigella flexneri 2a str. 2457T
ccguuuuccagccuuuuucu

SEQ ID NO: 3872724 - RNA, 12 nt, Shigella flexneri 2a str. 2457T
ccguuuucucca

SEQ ID NO: 3872725 - RNA, 22 nt, Shigella flexneri 2a str. 2457T
ccguuuuuacccagcagcagcg

SEQ ID NO: 3872726 - RNA, 18 nt, Shigella flexneri 2a str. 2457T
ccguuuuuuaguuagcaa

SEQ ID NO: 3872727 - RNA, 17 nt, Shigella flexneri 2a str. 2457T
ccguuuuuugaaacagg

SEQ ID NO: 3872728 - RNA, 13 nt, Shigella flexneri 2a str. 2457T
ccguuuuuuuucu

SEQ ID NO: 3872729 - RNA, 18 nt, Shigella flexneri 2a str. 2457T
ccuaaaagcacgccagac

SEQ ID NO: 3872730 - RNA, 21 nt, Shigella flexneri 2a str. 2457T
ccuaaaagcacgccagacauc

SEQ ID NO: 3872731 - RNA, 20 nt, Shigella flexneri 2a str. 2457T
ccuaaagaagccgccagacc

SEQ ID NO: 3872732 - RNA, 22 nt, Shigella flexneri 2a str. 2457T
ccuaaaggcaaaaugccagccc

SEQ ID NO: 3872733 - RNA, 14 nt, Shigella flexneri 2a str. 2457T
ccuaaagggcggca

SEQ ID NO: 3872734 - RNA, 16 nt, Shigella flexneri 2a str. 2457T
ccuaaaguuguuuucu

SEQ ID NO: 3872735 - RNA, 17 nt, Shigella flexneri 2a str. 2457T
ccuaaauggaaaauugg

SEQ ID NO: 3872736 - RNA, 16 nt, Shigella flexneri 2a str. 2457T
ccuaacaauucgccag

SEQ ID NO: 3872737 - RNA, 14 nt, Shigella flexneri 2a str. 2457T
ccuaacauaaugca

SEQ ID NO: 3872738 - RNA, 13 nt, Shigella flexneri 2a str. 2457T
ccuaacaucaucc

SEQ ID NO: 3872739 - RNA, 15 nt, Shigella flexneri 2a str. 2457T
ccuaacauuuuacuu

SEQ ID NO: 3872740 - RNA, 14 nt, Shigella flexneri 2a str. 2457T
ccuaacccaacauu

SEQ ID NO: 3872741 - RNA, 18 nt, Shigella flexneri 2a str. 2457T
ccuaagccauuuaacuca

SEQ ID NO: 3872742 - RNA, 22 nt, Shigella flexneri 2a str. 2457T
ccuaauuccgcgcgaacgguaa

SEQ ID NO: 3872743 - RNA, 13 nt, Shigella flexneri 2a str. 2457T
ccuacaaaaucua

SEQ ID NO: 3872744 - RNA, 17 nt, Shigella flexneri 2a str. 2457T
ccuacaaacguugcuga

SEQ ID NO: 3872745 - RNA, 19 nt, Shigella flexneri 2a str. 2457T
ccuacaacuccguugaaau

SEQ ID NO: 3872746 - RNA, 18 nt, Shigella flexneri 2a str. 2457T
ccuacacauuaucucaac

SEQ ID NO: 3872747 - RNA, 22 nt, Shigella flexneri 2a str. 2457T
ccuacacauuaucucaacacac

SEQ ID NO: 3872748 - RNA, 17 nt, Shigella flexneri 2a str. 2457T
ccuacaggaaacgauuc

SEQ ID NO: 3872749 - RNA, 23 nt, Shigella flexneri 2a str. 2457T
ccuacauagucccugcaauagau

SEQ ID NO: 3872750 - RNA, 19 nt, Shigella flexneri 2a str. 2457T
ccuaccgccagguuucaau

SEQ ID NO: 3872751 - RNA, 17 nt, Shigella flexneri 2a str. 2457T
ccuaccugcaguucauc

SEQ ID NO: 3872752 - RNA, 18 nt, Shigella flexneri 2a str. 2457T
ccuaccugcaguucauca

SEQ ID NO: 3872753 - RNA, 17 nt, Shigella flexneri 2a str. 2457T
ccuacgugcgcaauaac

SEQ ID NO: 3872754 - RNA, 22 nt, Shigella flexneri 2a str. 2457T
ccuacgugcgcaauaacccaga

SEQ ID NO: 3872755 - RNA, 21 nt, Shigella flexneri 2a str. 2457T
ccuacgugguuuaugcaauau

SEQ ID NO: 3872756 - RNA, 21 nt, Shigella flexneri 2a str. 2457T
ccuacuuuuuaauucaggaaa

SEQ ID NO: 3872757 - RNA, 20 nt, Shigella flexneri 2a str. 2457T
ccuagaaggaacaacguauc

SEQ ID NO: 3872758 - RNA, 14 nt, Shigella flexneri 2a str. 2457T
ccuaggcauagaaa

SEQ ID NO: 3872759 - RNA, 22 nt, Shigella flexneri 2a str. 2457T
ccuagugcgguaaauuuuuuga

SEQ ID NO: 3872760 - RNA, 18 nt, Shigella flexneri 2a str. 2457T
ccuauauuccuuuaucau

SEQ ID NO: 3872761 - RNA, 16 nt, Shigella flexneri 2a str. 2457T
ccuaugcauaauccug

SEQ ID NO: 3872762 - RNA, 20 nt, Shigella flexneri 2a str. 2457T
ccuauguggaaacagugauu

SEQ ID NO: 3872763 - RNA, 17 nt, Shigella flexneri 2a str. 2457T
ccuauucgcaucgguga

SEQ ID NO: 3872764 - RNA, 12 nt, Shigella flexneri 2a str. 2457T
ccuauugcugcu

SEQ ID NO: 3872765 - RNA, 17 nt, Shigella flexneri 2a str. 2457T
ccuauuuuuacccaggc

SEQ ID NO: 3872766 - RNA, 23 nt, Shigella flexneri 2a str. 2457T
ccucaaacgagggguuuuuuguu

SEQ ID NO: 3872767 - RNA, 18 nt, Shigella flexneri 2a str. 2457T
ccucaaaggccgacagca

SEQ ID NO: 3872768 - RNA, 22 nt, Shigella flexneri 2a str. 2457T
ccucaaccauugaaacacuuaa

SEQ ID NO: 3872769 - RNA, 16 nt, Shigella flexneri 2a str. 2457T
ccucaaccccuuccug

SEQ ID NO: 3872770 - RNA, 17 nt, Shigella flexneri 2a str. 2457T
ccucaaccccuuccuga

SEQ ID NO: 3872771 - RNA, 17 nt, Shigella flexneri 2a str. 2457T
ccucacagcuaaucauc

SEQ ID NO: 3872772 - RNA, 16 nt, Shigella flexneri 2a str. 2457T
ccucacaugaguugcu

SEQ ID NO: 3872773 - RNA, 15 nt, Shigella flexneri 2a str. 2457T
ccucacccuaacccu

SEQ ID NO: 3872774 - RNA, 17 nt, Shigella flexneri 2a str. 2457T
ccucaccuuccacgcgg

SEQ ID NO: 3872775 - RNA, 22 nt, Shigella flexneri 2a str. 2457T
ccucacgaucacagcaguccag

SEQ ID NO: 3872776 - RNA, 10 nt, Shigella flexneri 2a str. 2457T
ccucagagcu

SEQ ID NO: 3872777 - RNA, 13 nt, Shigella flexneri 2a str. 2457T
ccucaggcaccuu

SEQ ID NO: 3872778 - RNA, 20 nt, Shigella flexneri 2a str. 2457T
ccucaguacccgcguucugg

SEQ ID NO: 3872779 - RNA, 22 nt, Shigella flexneri 2a str. 2457T
ccucaucgauauuaucuucauc

SEQ ID NO: 3872780 - RNA, 15 nt, Shigella flexneri 2a str. 2457T
ccuccaaaaaacaaa

SEQ ID NO: 3872781 - RNA, 18 nt, Shigella flexneri 2a str. 2457T
ccuccacauucagucccg

SEQ ID NO: 3872782 - RNA, 19 nt, Shigella flexneri 2a str. 2457T
ccuccacgauauccagcgu

SEQ ID NO: 3872783 - RNA, 14 nt, Shigella flexneri 2a str. 2457T
ccuccagcuccucg

SEQ ID NO: 3872784 - RNA, 22 nt, Shigella flexneri 2a str. 2457T
ccuccagcuccucgaguccuuc

SEQ ID NO: 3872785 - RNA, 15 nt, Shigella flexneri 2a str. 2457T
ccuccaugaaaauag

SEQ ID NO: 3872786 - RNA, 17 nt, Shigella flexneri 2a str. 2457T
ccuccauugaauuuuau

SEQ ID NO: 3872787 - RNA, 15 nt, Shigella flexneri 2a str. 2457T
ccucccagccauugu

SEQ ID NO: 3872788 - RNA, 17 nt, Shigella flexneri 2a str. 2457T
ccucccgguaggugagg

SEQ ID NO: 3872789 - RNA, 18 nt, Shigella flexneri 2a str. 2457T
ccucccguuucccugucu

SEQ ID NO: 3872790 - RNA, 14 nt, Shigella flexneri 2a str. 2457T
ccuccggcguacag

SEQ ID NO: 3872791 - RNA, 12 nt, Shigella flexneri 2a str. 2457T
ccuccugcagcg

SEQ ID NO: 3872792 - RNA, 13 nt, Shigella flexneri 2a str. 2457T
ccuccugcagcgu

SEQ ID NO: 3872793 - RNA, 17 nt, Shigella flexneri 2a str. 2457T
ccuccuguaccuucacg

SEQ ID NO: 3872794 - RNA, 14 nt, Shigella flexneri 2a str. 2457T
ccuccugucuuccc

SEQ ID NO: 3872795 - RNA, 21 nt, Shigella flexneri 2a str. 2457T
ccuccugucuucccugcugaa

SEQ ID NO: 3872796 - RNA, 22 nt, Shigella flexneri 2a str. 2457T
ccucgagaaauuuuuauuauuu

SEQ ID NO: 3872797 - RNA, 16 nt, Shigella flexneri 2a str. 2457T
ccucgaguccuuccag

SEQ ID NO: 3872798 - RNA, 15 nt, Shigella flexneri 2a str. 2457T
ccucgaucagagugg

SEQ ID NO: 3872799 - RNA, 17 nt, Shigella flexneri 2a str. 2457T
ccucgaucggcucuucc

SEQ ID NO: 3872800 - RNA, 17 nt, Shigella flexneri 2a str. 2457T
ccucgccccuccgggga

SEQ ID NO: 3872801 - RNA, 15 nt, Shigella flexneri 2a str. 2457T
ccucgccguuaauga

SEQ ID NO: 3872802 - RNA, 19 nt, Shigella flexneri 2a str. 2457T
ccucgcuggucagcgccag

SEQ ID NO: 3872803 - RNA, 19 nt, Shigella flexneri 2a str. 2457T
ccucggcuguaugaccuuu

SEQ ID NO: 3872804 - RNA, 18 nt, Shigella flexneri 2a str. 2457T
ccucgucccaaaagcucg

SEQ ID NO: 3872805 - RNA, 18 nt, Shigella flexneri 2a str. 2457T
ccucguuucgcccugccu

SEQ ID NO: 3872806 - RNA, 15 nt, Shigella flexneri 2a str. 2457T
ccucguuuugccgcc

SEQ ID NO: 3872807 - RNA, 18 nt, Shigella flexneri 2a str. 2457T
ccucuaacagaucaucca

SEQ ID NO: 3872808 - RNA, 18 nt, Shigella flexneri 2a str. 2457T
ccucuaucuguuugccag

SEQ ID NO: 3872809 - RNA, 23 nt, Shigella flexneri 2a str. 2457T
ccucucaugagcagaccaauaac

SEQ ID NO: 3872810 - RNA, 21 nt, Shigella flexneri 2a str. 2457T
ccucuccccgaaggggcgagg

SEQ ID NO: 3872811 - RNA, 22 nt, Shigella flexneri 2a str. 2457T
ccucucccgaaugaccgccccu

SEQ ID NO: 3872812 - RNA, 16 nt, Shigella flexneri 2a str. 2457T
ccucuccuguucucac

SEQ ID NO: 3872813 - RNA, 18 nt, Shigella flexneri 2a str. 2457T
ccucucuggccgcuucca

SEQ ID NO: 3872814 - RNA, 23 nt, Shigella flexneri 2a str. 2457T
ccugcauccgccauccaccagca

SEQ ID NO: 3872815 - RNA, 14 nt, Shigella flexneri 2a str. 2457T
ccugcaucgccuga

SEQ ID NO: 3872816 - RNA, 20 nt, Shigella flexneri 2a str. 2457T
ccugcauucgagccaagcgg

SEQ ID NO: 3872817 - RNA, 17 nt, Shigella flexneri 2a str. 2457T
ccugcauugacucgccu

SEQ ID NO: 3872818 - RNA, 12 nt, Shigella flexneri 2a str. 2457T
ccugccacauau

SEQ ID NO: 3872819 - RNA, 20 nt, Shigella flexneri 2a str. 2457T
ccugccagagcugaauauca

SEQ ID NO: 3872820 - RNA, 18 nt, Shigella flexneri 2a str. 2457T
ccugccagaugcagcggu

SEQ ID NO: 3872821 - RNA, 19 nt, Shigella flexneri 2a str. 2457T
ccugccagcgccgacagca

SEQ ID NO: 3872822 - RNA, 13 nt, Shigella flexneri 2a str. 2457T
ccugccaguccug

SEQ ID NO: 3872823 - RNA, 16 nt, Shigella flexneri 2a str. 2457T
ccugccaguuauagcg

SEQ ID NO: 3872824 - RNA, 21 nt, Shigella flexneri 2a str. 2457T
ccugccaguuauagcgcagac

SEQ ID NO: 3872825 - RNA, 19 nt, Shigella flexneri 2a str. 2457T
ccugccaucuggcaggcuu

SEQ ID NO: 3872826 - RNA, 16 nt, Shigella flexneri 2a str. 2457T
ccugccaugcgcaauc

SEQ ID NO: 3872827 - RNA, 18 nt, Shigella flexneri 2a str. 2457T
ccugcccgcgauccagcg

SEQ ID NO: 3872828 - RNA, 22 nt, Shigella flexneri 2a str. 2457T
ccugccgcaggacgggcaauuc

SEQ ID NO: 3872829 - RNA, 23 nt, Shigella flexneri 2a str. 2457T
ccugccgucugggcaaaaucauc

SEQ ID NO: 3872830 - RNA, 13 nt, Shigella flexneri 2a str. 2457T
ccugccugacgga

SEQ ID NO: 3872831 - RNA, 17 nt, Shigella flexneri 2a str. 2457T
ccugcgaacuguaauga

SEQ ID NO: 3872832 - RNA, 13 nt, Shigella flexneri 2a str. 2457T
ccugcgacaggga

SEQ ID NO: 3872833 - RNA, 13 nt, Shigella flexneri 2a str. 2457T
ccugcgcaggcau

SEQ ID NO: 3872834 - RNA, 12 nt, Shigella flexneri 2a str. 2457T
ccugcgccagcg

SEQ ID NO: 3872835 - RNA, 15 nt, Shigella flexneri 2a str. 2457T
ccugcgccagcgcgc

SEQ ID NO: 3872836 - RNA, 22 nt, Shigella flexneri 2a str. 2457T
ccugcgccagcgcgcguugcug

SEQ ID NO: 3872837 - RNA, 21 nt, Shigella flexneri 2a str. 2457T
ccugcgcccgcguuaccggca

SEQ ID NO: 3872838 - RNA, 16 nt, Shigella flexneri 2a str. 2457T
ccugcgcgcccgccgc

SEQ ID NO: 3872839 - RNA, 18 nt, Shigella flexneri 2a str. 2457T
ccugcgcggcaaugcgcc

SEQ ID NO: 3872840 - RNA, 14 nt, Shigella flexneri 2a str. 2457T
ccugcgcuuccagc

SEQ ID NO: 3872841 - RNA, 15 nt, Shigella flexneri 2a str. 2457T
ccugcggacagucac

SEQ ID NO: 3872842 - RNA, 22 nt, Shigella flexneri 2a str. 2457T
ccugcggcaccuaauaacucuc

SEQ ID NO: 3872843 - RNA, 13 nt, Shigella flexneri 2a str. 2457T
ccugcggccagca

SEQ ID NO: 3872844 - RNA, 15 nt, Shigella flexneri 2a str. 2457T
ccugcggccagcagc

SEQ ID NO: 3872845 - RNA, 18 nt, Shigella flexneri 2a str. 2457T
ccugcgggcauuucgcuu

SEQ ID NO: 3872846 - RNA, 22 nt, Shigella flexneri 2a str. 2457T
ccugcggguucuuaccggugac

SEQ ID NO: 3872847 - RNA, 18 nt, Shigella flexneri 2a str. 2457T
ccugcgguaagucccggc

SEQ ID NO: 3872848 - RNA, 14 nt, Shigella flexneri 2a str. 2457T
ccugcggugcagcc

SEQ ID NO: 3872849 - RNA, 14 nt, Shigella flexneri 2a str. 2457T
ccugcgugacuaaa

SEQ ID NO: 3872850 - RNA, 20 nt, Shigella flexneri 2a str. 2457T
ccugcgugacuaaaacccuu

SEQ ID NO: 3872851 - RNA, 22 nt, Shigella flexneri 2a str. 2457T
ccugcguucagcaguucugcca

SEQ ID NO: 3872852 - RNA, 18 nt, Shigella flexneri 2a str. 2457T
ccugcguuuguccgccgg

SEQ ID NO: 3872853 - RNA, 13 nt, Shigella flexneri 2a str. 2457T
ccugcucagcccg

SEQ ID NO: 3872854 - RNA, 13 nt, Shigella flexneri 2a str. 2457T
ccugcucaucagc

SEQ ID NO: 3872855 - RNA, 21 nt, Shigella flexneri 2a str. 2457T
ccugcuccagugcauccagca

SEQ ID NO: 3872856 - RNA, 18 nt, Shigella flexneri 2a str. 2457T
ccugcucgccacgucacu

SEQ ID NO: 3872857 - RNA, 16 nt, Shigella flexneri 2a str. 2457T
ccugcucgucauccgc

SEQ ID NO: 3872858 - RNA, 19 nt, Shigella flexneri 2a str. 2457T
ccugcucgucauccgccag

SEQ ID NO: 3872859 - RNA, 12 nt, Shigella flexneri 2a str. 2457T
ccugcucugcca

SEQ ID NO: 3872860 - RNA, 16 nt, Shigella flexneri 2a str. 2457T
ccugcucuuucagcac

SEQ ID NO: 3872861 - RNA, 19 nt, Shigella flexneri 2a str. 2457T
ccugcucuuucagcaccgc

SEQ ID NO: 3872862 - RNA, 16 nt, Shigella flexneri 2a str. 2457T
ccugcugaauccccuu

SEQ ID NO: 3872863 - RNA, 22 nt, Shigella flexneri 2a str. 2457T
ccugcugauggcgggaugugua

SEQ ID NO: 3872864 - RNA, 17 nt, Shigella flexneri 2a str. 2457T
ccugcugauuauccgca

SEQ ID NO: 3872865 - RNA, 16 nt, Shigella flexneri 2a str. 2457T
ccugcugcacgcccug

SEQ ID NO: 3872866 - RNA, 20 nt, Shigella flexneri 2a str. 2457T
ccugcugcacgcccugauaa

SEQ ID NO: 3872867 - RNA, 18 nt, Shigella flexneri 2a str. 2457T
ccugcugcacgucauacu

SEQ ID NO: 3872868 - RNA, 20 nt, Shigella flexneri 2a str. 2457T
ccugcuggaaaggccgcgaa

SEQ ID NO: 3872869 - RNA, 17 nt, Shigella flexneri 2a str. 2457T
ccugcuggacgcgccaa

SEQ ID NO: 3872870 - RNA, 12 nt, Shigella flexneri 2a str. 2457T
ccugcuggcagu

SEQ ID NO: 3872871 - RNA, 13 nt, Shigella flexneri 2a str. 2457T
ccugcuggguaaa

SEQ ID NO: 3872872 - RNA, 21 nt, Shigella flexneri 2a str. 2457T
ccugcuuaauaucccuuccuc

SEQ ID NO: 3872873 - RNA, 22 nt, Shigella flexneri 2a str. 2457T
ccugcuuccuuaaucccuggau

SEQ ID NO: 3872874 - RNA, 22 nt, Shigella flexneri 2a str. 2457T
ccugcuuugacaaagcucauug

SEQ ID NO: 3872875 - RNA, 22 nt, Shigella flexneri 2a str. 2457T
ccuggaaaaagugccccagcuu

SEQ ID NO: 3872876 - RNA, 13 nt, Shigella flexneri 2a str. 2457T
ccuggacagcucg

SEQ ID NO: 3872877 - RNA, 22 nt, Shigella flexneri 2a str. 2457T
ccuggacagcucguuaaucaga

SEQ ID NO: 3872878 - RNA, 14 nt, Shigella flexneri 2a str. 2457T
ccuggacuuuaaac

SEQ ID NO: 3872879 - RNA, 16 nt, Shigella flexneri 2a str. 2457T
ccuggaugacccggaa

SEQ ID NO: 3872880 - RNA, 22 nt, Shigella flexneri 2a str. 2457T
ccuggcaacccgggcucccggc

SEQ ID NO: 3872881 - RNA, 19 nt, Shigella flexneri 2a str. 2457T
ccuggcaauagcgcacgcc

SEQ ID NO: 3872882 - RNA, 16 nt, Shigella flexneri 2a str. 2457T
ccuggcaaugcgcugu

SEQ ID NO: 3872883 - RNA, 13 nt, Shigella flexneri 2a str. 2457T
ccuggcagcaccg

SEQ ID NO: 3872884 - RNA, 16 nt, Shigella flexneri 2a str. 2457T
ccuggcccaucgccag

SEQ ID NO: 3872885 - RNA, 20 nt, Shigella flexneri 2a str. 2457T
ccuggcgaugcccccagcag

SEQ ID NO: 3872886 - RNA, 14 nt, Shigella flexneri 2a str. 2457T
ccuggcgcuggcgu

SEQ ID NO: 3872887 - RNA, 20 nt, Shigella flexneri 2a str. 2457T
ccuggcggaagagcacacau

SEQ ID NO: 3872888 - RNA, 21 nt, Shigella flexneri 2a str. 2457T
ccuggcugauugauauccaga

SEQ ID NO: 3872889 - RNA, 14 nt, Shigella flexneri 2a str. 2457T
ccuggcugcagaau

SEQ ID NO: 3872890 - RNA, 13 nt, Shigella flexneri 2a str. 2457T
ccuggcugcccau

SEQ ID NO: 3872891 - RNA, 16 nt, Shigella flexneri 2a str. 2457T
ccuggcuugccagcca

SEQ ID NO: 3872892 - RNA, 23 nt, Shigella flexneri 2a str. 2457T
ccuggcuuggcuggcgugagccg

SEQ ID NO: 3872893 - RNA, 16 nt, Shigella flexneri 2a str. 2457T
ccugggcaauggugaa

SEQ ID NO: 3872894 - RNA, 23 nt, Shigella flexneri 2a str. 2457T
ccugggcaccgacguucagcgca

SEQ ID NO: 3872895 - RNA, 18 nt, Shigella flexneri 2a str. 2457T
ccugggcgaugcuggcag

SEQ ID NO: 3872896 - RNA, 15 nt, Shigella flexneri 2a str. 2457T
ccugggcgauuuccu

SEQ ID NO: 3872897 - RNA, 18 nt, Shigella flexneri 2a str. 2457T
ccugggcuucauccagca

SEQ ID NO: 3872898 - RNA, 23 nt, Shigella flexneri 2a str. 2457T
ccugguaaaaaaugauuuccugc

SEQ ID NO: 3872899 - RNA, 17 nt, Shigella flexneri 2a str. 2457T
ccuggugaauauuccuu

SEQ ID NO: 3872900 - RNA, 18 nt, Shigella flexneri 2a str. 2457T
ccugguuauuucacuuca

SEQ ID NO: 3872901 - RNA, 20 nt, Shigella flexneri 2a str. 2457T
ccugguugcuggauaagaug

SEQ ID NO: 3872902 - RNA, 22 nt, Shigella flexneri 2a str. 2457T
ccuguaaaaaaguaaugccugc

SEQ ID NO: 3872903 - RNA, 15 nt, Shigella flexneri 2a str. 2457T
ccuguaaacgaaaac

SEQ ID NO: 3872904 - RNA, 17 nt, Shigella flexneri 2a str. 2457T
ccuguaccuucagcggc

SEQ ID NO: 3872905 - RNA, 15 nt, Shigella flexneri 2a str. 2457T
ccuguauaaacuauc

SEQ ID NO: 3872906 - RNA, 21 nt, Shigella flexneri 2a str. 2457T
ccuguauuguuccacucuuuc

SEQ ID NO: 3872907 - RNA, 17 nt, Shigella flexneri 2a str. 2457T
ccugucagacuuaagcc

SEQ ID NO: 3872908 - RNA, 18 nt, Shigella flexneri 2a str. 2457T
ccugucgcuuugacugcu

SEQ ID NO: 3872909 - RNA, 20 nt, Shigella flexneri 2a str. 2457T
ccugucgcuuugacugcuuu

SEQ ID NO: 3872910 - RNA, 15 nt, Shigella flexneri 2a str. 2457T
ccugucucucagcac

SEQ ID NO: 3872911 - RNA, 22 nt, Shigella flexneri 2a str. 2457T
ccuuucaugguugucaccgcca

SEQ ID NO: 3872912 - RNA, 23 nt, Shigella flexneri 2a str. 2457T
ccuuucaugguugucaccgccag

SEQ ID NO: 3872913 - RNA, 16 nt, Shigella flexneri 2a str. 2457T
ccuuucccuauuuuuu

SEQ ID NO: 3872914 - RNA, 13 nt, Shigella flexneri 2a str. 2457T
ccuuuccggcaau

SEQ ID NO: 3872915 - RNA, 15 nt, Shigella flexneri 2a str. 2457T
ccuuucgaacccaac

SEQ ID NO: 3872916 - RNA, 13 nt, Shigella flexneri 2a str. 2457T
ccuuucggccaug

SEQ ID NO: 3872917 - RNA, 18 nt, Shigella flexneri 2a str. 2457T
ccuuucggcgcagucaca

SEQ ID NO: 3872918 - RNA, 21 nt, Shigella flexneri 2a str. 2457T
ccuuucguuaaauucuucuga

SEQ ID NO: 3872919 - RNA, 21 nt, Shigella flexneri 2a str. 2457T
ccuuucugaugcauaaaaaaa

SEQ ID NO: 3872920 - RNA, 18 nt, Shigella flexneri 2a str. 2457T
ccuuucuggacacagcgu

SEQ ID NO: 3872921 - RNA, 17 nt, Shigella flexneri 2a str. 2457T
ccuuucuuucuggaaau

SEQ ID NO: 3872922 - RNA, 16 nt, Shigella flexneri 2a str. 2457T
ccuuugaacaaccaga

SEQ ID NO: 3872923 - RNA, 21 nt, Shigella flexneri 2a str. 2457T
ccuuugaccagccagucagua

SEQ ID NO: 3872924 - RNA, 22 nt, Shigella flexneri 2a str. 2457T
ccuuuguaggccagauaagacg

SEQ ID NO: 3872925 - RNA, 16 nt, Shigella flexneri 2a str. 2457T
ccuuuuaccagcgccu

SEQ ID NO: 3872926 - RNA, 15 nt, Shigella flexneri 2a str. 2457T
ccuuuuauuuaaccg

SEQ ID NO: 3872927 - RNA, 16 nt, Shigella flexneri 2a str. 2457T
ccuuuucaccaugggc

SEQ ID NO: 3872928 - RNA, 23 nt, Shigella flexneri 2a str. 2457T
ccuuuucaguuggcugacaaagu

SEQ ID NO: 3872929 - RNA, 18 nt, Shigella flexneri 2a str. 2457T
ccuuuuccauugccgcag

SEQ ID NO: 3872930 - RNA, 22 nt, Shigella flexneri 2a str. 2457T
ccuuuucgccaccggcaaucug

SEQ ID NO: 3872931 - RNA, 14 nt, Shigella flexneri 2a str. 2457T
ccuuuugccagaua

SEQ ID NO: 3872932 - RNA, 15 nt, Shigella flexneri 2a str. 2457T
ccuuuugcccggcaa

SEQ ID NO: 3872933 - RNA, 20 nt, Shigella flexneri 2a str. 2457T
ccuuuuguuuguucuucucg

SEQ ID NO: 3872934 - RNA, 21 nt, Shigella flexneri 2a str. 2457T
ccuuuuguuuguucuucucga

SEQ ID NO: 3872935 - RNA, 15 nt, Shigella flexneri 2a str. 2457T
ccuuuuuacccaugg

SEQ ID NO: 3872936 - RNA, 20 nt, Shigella flexneri 2a str. 2457T
ccuuuuuauuuauucaaacc

SEQ ID NO: 3872937 - RNA, 22 nt, Shigella flexneri 2a str. 2457T
ccuuuuuauuuauucaaaccaa

SEQ ID NO: 3872938 - RNA, 15 nt, Shigella flexneri 2a str. 2457T
ccuuuuuuaaacauu

SEQ ID NO: 3872939 - RNA, 12 nt, Shigella flexneri 2a str. 2457T
cgaaaaaaagau

SEQ ID NO: 3872940 - RNA, 14 nt, Shigella flexneri 2a str. 2457T
cgaaaaaaauuacu

SEQ ID NO: 3872941 - RNA, 20 nt, Shigella flexneri 2a str. 2457T
cgaaaaaagucauuaccagc

SEQ ID NO: 3872942 - RNA, 15 nt, Shigella flexneri 2a str. 2457T
cgaaaaacucuccuc

SEQ ID NO: 3872943 - RNA, 20 nt, Shigella flexneri 2a str. 2457T
cgaaaaagucccuucccagc

SEQ ID NO: 3872944 - RNA, 14 nt, Shigella flexneri 2a str. 2457T
cgaaaaaugaauac

SEQ ID NO: 3872945 - RNA, 15 nt, Shigella flexneri 2a str. 2457T
cgaaaaaugcuggau

SEQ ID NO: 3872946 - RNA, 16 nt, Shigella flexneri 2a str. 2457T
cgaaaacaacuggcaa

SEQ ID NO: 3872947 - RNA, 18 nt, Shigella flexneri 2a str. 2457T
cgaaaaccacuccugacg

SEQ ID NO: 3872948 - RNA, 20 nt, Shigella flexneri 2a str. 2457T
cgaaacaaucguugccugau

SEQ ID NO: 3872949 - RNA, 16 nt, Shigella flexneri 2a str. 2457T
cgaaacaucaaaaagc

SEQ ID NO: 3872950 - RNA, 13 nt, Shigella flexneri 2a str. 2457T
cgaaaccacugca

SEQ ID NO: 3872951 - RNA, 17 nt, Shigella flexneri 2a str. 2457T
cgaaacccgcugccauc

SEQ ID NO: 3872952 - RNA, 21 nt, Shigella flexneri 2a str. 2457T
cgaaacgggcugauuucaccc

SEQ ID NO: 3872953 - RNA, 11 nt, Shigella flexneri 2a str. 2457T
cgaaagaaaag

SEQ ID NO: 3872954 - RNA, 17 nt, Shigella flexneri 2a str. 2457T
cgaaagaggcgcagaug

SEQ ID NO: 3872955 - RNA, 16 nt, Shigella flexneri 2a str. 2457T
cgaaagcagggcggca

SEQ ID NO: 3872956 - RNA, 13 nt, Shigella flexneri 2a str. 2457T
cgaaagcccauca

SEQ ID NO: 3872957 - RNA, 17 nt, Shigella flexneri 2a str. 2457T
cgaaagcgucagcuuuc

SEQ ID NO: 3872958 - RNA, 22 nt, Shigella flexneri 2a str. 2457T
cgaaauacagguccccgcuucg

SEQ ID NO: 3872959 - RNA, 19 nt, Shigella flexneri 2a str. 2457T
cgaaaucaccgccaccagc

SEQ ID NO: 3872960 - RNA, 12 nt, Shigella flexneri 2a str. 2457T
cgaaaucgccau

SEQ ID NO: 3872961 - RNA, 13 nt, Shigella flexneri 2a str. 2457T
cgaaaucgccauu

SEQ ID NO: 3872962 - RNA, 15 nt, Shigella flexneri 2a str. 2457T
cgaaaucgccuuugg

SEQ ID NO: 3872963 - RNA, 15 nt, Shigella flexneri 2a str. 2457T
cgaacaaaaaaagcg

SEQ ID NO: 3872964 - RNA, 13 nt, Shigella flexneri 2a str. 2457T
cgaacaccagcag

SEQ ID NO: 3872965 - RNA, 15 nt, Shigella flexneri 2a str. 2457T
cgaacaccagcagua

SEQ ID NO: 3872966 - RNA, 14 nt, Shigella flexneri 2a str. 2457T
cgaacagaccaaac

SEQ ID NO: 3872967 - RNA, 15 nt, Shigella flexneri 2a str. 2457T
cgaacagcugguuga

SEQ ID NO: 3872968 - RNA, 13 nt, Shigella flexneri 2a str. 2457T
cgaacauccggcu

SEQ ID NO: 3872969 - RNA, 14 nt, Shigella flexneri 2a str. 2457T
cgaacaugcggguc

SEQ ID NO: 3872970 - RNA, 24 nt, Shigella flexneri 2a str. 2457T
cgaaccagccguugucagucauca

SEQ ID NO: 3872971 - RNA, 13 nt, Shigella flexneri 2a str. 2457T
cgaaccaggaaga

SEQ ID NO: 3872972 - RNA, 16 nt, Shigella flexneri 2a str. 2457T
cgaaccaggaagaugu

SEQ ID NO: 3872973 - RNA, 13 nt, Shigella flexneri 2a str. 2457T
cgaaccagugcuc

SEQ ID NO: 3872974 - RNA, 17 nt, Shigella flexneri 2a str. 2457T
cgaaccagugcuccacc

SEQ ID NO: 3872975 - RNA, 15 nt, Shigella flexneri 2a str. 2457T
cgaaccauaaaauca

SEQ ID NO: 3872976 - RNA, 13 nt, Shigella flexneri 2a str. 2457T
cgaacccagcagg

SEQ ID NO: 3872977 - RNA, 22 nt, Shigella flexneri 2a str. 2457T
cgaaccggaaauccaggucagc

SEQ ID NO: 3872978 - RNA, 22 nt, Shigella flexneri 2a str. 2457T
cgaaccggaccagcaacaaaua

SEQ ID NO: 3872979 - RNA, 18 nt, Shigella flexneri 2a str. 2457T
cgaacgcguucacugccg

SEQ ID NO: 3872980 - RNA, 16 nt, Shigella flexneri 2a str. 2457T
cgaagaaaacauggcg

SEQ ID NO: 3872981 - RNA, 13 nt, Shigella flexneri 2a str. 2457T
cgaagaaagcaau

SEQ ID NO: 3872982 - RNA, 20 nt, Shigella flexneri 2a str. 2457T
cgaagaacauaaacagcgua

SEQ ID NO: 3872983 - RNA, 15 nt, Shigella flexneri 2a str. 2457T
cgaagaacugcugga

SEQ ID NO: 3872984 - RNA, 22 nt, Shigella flexneri 2a str. 2457T
cgaagaagugguucauguugcg

SEQ ID NO: 3872985 - RNA, 13 nt, Shigella flexneri 2a str. 2457T
cgaagacgugcgc

SEQ ID NO: 3872986 - RNA, 16 nt, Shigella flexneri 2a str. 2457T
cgaagagagcgccaga

SEQ ID NO: 3872987 - RNA, 17 nt, Shigella flexneri 2a str. 2457T
cgaagaggaacuguuau

SEQ ID NO: 3872988 - RNA, 20 nt, Shigella flexneri 2a str. 2457T
cgaagauaguuggcagcgcg

SEQ ID NO: 3872989 - RNA, 18 nt, Shigella flexneri 2a str. 2457T
cgaagauauucaucagcg

SEQ ID NO: 3872990 - RNA, 22 nt, Shigella flexneri 2a str. 2457T
cgaagauggcauacaacgccau

SEQ ID NO: 3872991 - RNA, 16 nt, Shigella flexneri 2a str. 2457T
cgaagcagucaacacc

SEQ ID NO: 3872992 - RNA, 18 nt, Shigella flexneri 2a str. 2457T
cgaagcauucagacacgc

SEQ ID NO: 3872993 - RNA, 14 nt, Shigella flexneri 2a str. 2457T
cgaagcauugcgcc

SEQ ID NO: 3872994 - RNA, 21 nt, Shigella flexneri 2a str. 2457T
cgaagcccaucaguacaccac

SEQ ID NO: 3872995 - RNA, 23 nt, Shigella flexneri 2a str. 2457T
cgaagcccaucaguacaccaccu

SEQ ID NO: 3872996 - RNA, 17 nt, Shigella flexneri 2a str. 2457T
cgaagcccucaaacaac

SEQ ID NO: 3872997 - RNA, 23 nt, Shigella flexneri 2a str. 2457T
cgaagcccucaaacaacacagcg

SEQ ID NO: 3872998 - RNA, 17 nt, Shigella flexneri 2a str. 2457T
cgaagccguauucugac

SEQ ID NO: 3872999 - RNA, 13 nt, Shigella flexneri 2a str. 2457T
cgaagcggcugcg

SEQ ID NO: 3873000 - RNA, 23 nt, Shigella flexneri 2a str. 2457T
cgaagcucucugcuauuccguua

SEQ ID NO: 3873001 - RNA, 22 nt, Shigella flexneri 2a str. 2457T
cgaagcuuucuugcagcucuug

SEQ ID NO: 3873002 - RNA, 19 nt, Shigella flexneri 2a str. 2457T
cgaaggaauuuuacagccc

SEQ ID NO: 3873003 - RNA, 20 nt, Shigella flexneri 2a str. 2457T
cgaaggugccugcccagccg

SEQ ID NO: 3873004 - RNA, 14 nt, Shigella flexneri 2a str. 2457T
cgaaguacgcggca

SEQ ID NO: 3873005 - RNA, 15 nt, Shigella flexneri 2a str. 2457T
cgaaguacgcggcaa

SEQ ID NO: 3873006 - RNA, 21 nt, Shigella flexneri 2a str. 2457T
cgaaguggacgaacaguucaa

SEQ ID NO: 3873007 - RNA, 20 nt, Shigella flexneri 2a str. 2457T
cgaaguuguagcuggcuucg

SEQ ID NO: 3873008 - RNA, 16 nt, Shigella flexneri 2a str. 2457T
cgaaguuuuccucagu

SEQ ID NO: 3873009 - RNA, 21 nt, Shigella flexneri 2a str. 2457T
cgacgagcgcuggugacaucg

SEQ ID NO: 3873010 - RNA, 19 nt, Shigella flexneri 2a str. 2457T
cgacgauaccgccgcacaa

SEQ ID NO: 3873011 - RNA, 15 nt, Shigella flexneri 2a str. 2457T
cgacgaugaucaagc

SEQ ID NO: 3873012 - RNA, 20 nt, Shigella flexneri 2a str. 2457T
cgacgcaaacgacgagcgcu

SEQ ID NO: 3873013 - RNA, 21 nt, Shigella flexneri 2a str. 2457T
cgacgccccggccuugccugu

SEQ ID NO: 3873014 - RNA, 13 nt, Shigella flexneri 2a str. 2457T
cgacgcgcggugg

SEQ ID NO: 3873015 - RNA, 23 nt, Shigella flexneri 2a str. 2457T
cgacgcgcuuuuacugcauucac

SEQ ID NO: 3873016 - RNA, 16 nt, Shigella flexneri 2a str. 2457T
cgacgcguaugucgau

SEQ ID NO: 3873017 - RNA, 19 nt, Shigella flexneri 2a str. 2457T
cgacgcguccaggcucgcc

SEQ ID NO: 3873018 - RNA, 13 nt, Shigella flexneri 2a str. 2457T
cgacgcucacgcg

SEQ ID NO: 3873019 - RNA, 18 nt, Shigella flexneri 2a str. 2457T
cgacggcgcacaggcaau

SEQ ID NO: 3873020 - RNA, 21 nt, Shigella flexneri 2a str. 2457T
cgacggcuggacaaaauacug

SEQ ID NO: 3873021 - RNA, 13 nt, Shigella flexneri 2a str. 2457T
cgacguaaaaaac

SEQ ID NO: 3873022 - RNA, 13 nt, Shigella flexneri 2a str. 2457T
cgacguaauuuag

SEQ ID NO: 3873023 - RNA, 14 nt, Shigella flexneri 2a str. 2457T
cgacguagcccggu

SEQ ID NO: 3873024 - RNA, 19 nt, Shigella flexneri 2a str. 2457T
cgacgucgauuucugggug

SEQ ID NO: 3873025 - RNA, 16 nt, Shigella flexneri 2a str. 2457T
cgacgugaccuuucag

SEQ ID NO: 3873026 - RNA, 18 nt, Shigella flexneri 2a str. 2457T
cgacguucugccaaacgc

SEQ ID NO: 3873027 - RNA, 22 nt, Shigella flexneri 2a str. 2457T
cgacguugauuuugucauggcg

SEQ ID NO: 3873028 - RNA, 13 nt, Shigella flexneri 2a str. 2457T
cgacuaaccugag

SEQ ID NO: 3873029 - RNA, 20 nt, Shigella flexneri 2a str. 2457T
cgacuacaggacaucuugaa

SEQ ID NO: 3873030 - RNA, 13 nt, Shigella flexneri 2a str. 2457T
cgacuacccgcgc

SEQ ID NO: 3873031 - RNA, 19 nt, Shigella flexneri 2a str. 2457T
cgacuacgggcaccaguaa

SEQ ID NO: 3873032 - RNA, 15 nt, Shigella flexneri 2a str. 2457T
cgacucaaaucacgc

SEQ ID NO: 3873033 - RNA, 16 nt, Shigella flexneri 2a str. 2457T
cgacucaaaucacgca

SEQ ID NO: 3873034 - RNA, 18 nt, Shigella flexneri 2a str. 2457T
cgacucaaaucacgcagu

SEQ ID NO: 3873035 - RNA, 19 nt, Shigella flexneri 2a str. 2457T
cgacucgcaauuauaauac

SEQ ID NO: 3873036 - RNA, 15 nt, Shigella flexneri 2a str. 2457T
cgacucucugagcca

SEQ ID NO: 3873037 - RNA, 17 nt, Shigella flexneri 2a str. 2457T
cgacugauaucugcccg

SEQ ID NO: 3873038 - RNA, 15 nt, Shigella flexneri 2a str. 2457T
cgacugcccgcgagc

SEQ ID NO: 3873039 - RNA, 21 nt, Shigella flexneri 2a str. 2457T
cgacugcgggcgcaagggcug

SEQ ID NO: 3873040 - RNA, 15 nt, Shigella flexneri 2a str. 2457T
cgacuucaucgccaa

SEQ ID NO: 3873041 - RNA, 12 nt, Shigella flexneri 2a str. 2457T
cgacuucauuca

SEQ ID NO: 3873042 - RNA, 18 nt, Shigella flexneri 2a str. 2457T
cgacuucgauguccgcuc

SEQ ID NO: 3873043 - RNA, 21 nt, Shigella flexneri 2a str. 2457T
cgacuucuucauucauccgcc

SEQ ID NO: 3873044 - RNA, 20 nt, Shigella flexneri 2a str. 2457T
cgacuugggcgauuuuugca

SEQ ID NO: 3873045 - RNA, 16 nt, Shigella flexneri 2a str. 2457T
cgacuuucucuucauc

SEQ ID NO: 3873046 - RNA, 22 nt, Shigella flexneri 2a str. 2457T
cgacuuuguuuuuaguuaaauc

SEQ ID NO: 3873047 - RNA, 13 nt, Shigella flexneri 2a str. 2457T
cgacuuuuuccug

SEQ ID NO: 3873048 - RNA, 17 nt, Shigella flexneri 2a str. 2457T
cgagaaaagccaaccug

SEQ ID NO: 3873049 - RNA, 13 nt, Shigella flexneri 2a str. 2457T
cgagaaaaugacg

SEQ ID NO: 3873050 - RNA, 21 nt, Shigella flexneri 2a str. 2457T
cgagaaacuucacaucaccau

SEQ ID NO: 3873051 - RNA, 22 nt, Shigella flexneri 2a str. 2457T
cgagaacacgguaaugacucca

SEQ ID NO: 3873052 - RNA, 19 nt, Shigella flexneri 2a str. 2457T
cgagaagcagcaacacaau

SEQ ID NO: 3873053 - RNA, 23 nt, Shigella flexneri 2a str. 2457T
cgagaagucggcuuuuagcgaca

SEQ ID NO: 3873054 - RNA, 14 nt, Shigella flexneri 2a str. 2457T
cgagaauaaaacag

SEQ ID NO: 3873055 - RNA, 23 nt, Shigella flexneri 2a str. 2457T
cgagaauaaaacaggcagcugcc

SEQ ID NO: 3873056 - RNA, 20 nt, Shigella flexneri 2a str. 2457T
cgagaaucagcgagacaaca

SEQ ID NO: 3873057 - RNA, 21 nt, Shigella flexneri 2a str. 2457T
cgagaauggacaccagcucag

SEQ ID NO: 3873058 - RNA, 21 nt, Shigella flexneri 2a str. 2457T
cgagaauuucucgugccacca

SEQ ID NO: 3873059 - RNA, 22 nt, Shigella flexneri 2a str. 2457T
cgagacgguuaaaaacagccag

SEQ ID NO: 3873060 - RNA, 21 nt, Shigella flexneri 2a str. 2457T
cgagagagaaaauaauccgcu

SEQ ID NO: 3873061 - RNA, 16 nt, Shigella flexneri 2a str. 2457T
cgagaguuacagcucu

SEQ ID NO: 3873062 - RNA, 19 nt, Shigella flexneri 2a str. 2457T
cgagauaaccccgcuugcu

SEQ ID NO: 3873063 - RNA, 23 nt, Shigella flexneri 2a str. 2457T
cgagauaaugguuuccagcaucg

SEQ ID NO: 3873064 - RNA, 13 nt, Shigella flexneri 2a str. 2457T
cgagauaauguuc

SEQ ID NO: 3873065 - RNA, 19 nt, Shigella flexneri 2a str. 2457T
cgagauacagguugccgau

SEQ ID NO: 3873066 - RNA, 16 nt, Shigella flexneri 2a str. 2457T
cgagauucuuaaaguc

SEQ ID NO: 3873067 - RNA, 22 nt, Shigella flexneri 2a str. 2457T
cgagcaaaucgcggcaguggcu

SEQ ID NO: 3873068 - RNA, 14 nt, Shigella flexneri 2a str. 2457T
cgagcaacgcagcg

SEQ ID NO: 3873069 - RNA, 22 nt, Shigella flexneri 2a str. 2457T
cgagcaauaaaaacuccgccgc

SEQ ID NO: 3873070 - RNA, 23 nt, Shigella flexneri 2a str. 2457T
cgagcaauagacaguucuuccug

SEQ ID NO: 3873071 - RNA, 21 nt, Shigella flexneri 2a str. 2457T
cgagcaaugagcuauguuuga

SEQ ID NO: 3873072 - RNA, 16 nt, Shigella flexneri 2a str. 2457T
cgagcacgacuuucuc

SEQ ID NO: 3873073 - RNA, 20 nt, Shigella flexneri 2a str. 2457T
cgagcacgccgccagugccg

SEQ ID NO: 3873074 - RNA, 18 nt, Shigella flexneri 2a str. 2457T
cgagcagagaaacgccag

SEQ ID NO: 3873075 - RNA, 23 nt, Shigella flexneri 2a str. 2457T
cgagcagagaaacgccagcagca

SEQ ID NO: 3873076 - RNA, 16 nt, Shigella flexneri 2a str. 2457T
cgagcagcacaaugcc

SEQ ID NO: 3873077 - RNA, 14 nt, Shigella flexneri 2a str. 2457T
cgagcaguacagcc

SEQ ID NO: 3873078 - RNA, 16 nt, Shigella flexneri 2a str. 2457T
cgagcaguacagccgc

SEQ ID NO: 3873079 - RNA, 22 nt, Shigella flexneri 2a str. 2457T
cgagcaguacagccgccagaca

SEQ ID NO: 3873080 - RNA, 19 nt, Shigella flexneri 2a str. 2457T
cgagcauccgauccuggac

SEQ ID NO: 3873081 - RNA, 18 nt, Shigella flexneri 2a str. 2457T
cgagcauugccagcauug

SEQ ID NO: 3873082 - RNA, 18 nt, Shigella flexneri 2a str. 2457T
cgagccauaaacugagcc

SEQ ID NO: 3873083 - RNA, 22 nt, Shigella flexneri 2a str. 2457T
cgagccguuccuaacaugccac

SEQ ID NO: 3873084 - RNA, 23 nt, Shigella flexneri 2a str. 2457T
cgagccguuccuaacaugccacu

SEQ ID NO: 3873085 - RNA, 22 nt, Shigella flexneri 2a str. 2457T
cgagccuguaccacaaccugca

SEQ ID NO: 3873086 - RNA, 17 nt, Shigella flexneri 2a str. 2457T
cgagcgacucgaaggcc

SEQ ID NO: 3873087 - RNA, 21 nt, Shigella flexneri 2a str. 2457T
cgagcgccguugcgcccauca

SEQ ID NO: 3873088 - RNA, 23 nt, Shigella flexneri 2a str. 2457T
cgagcgguaaaccguuaucaccu

SEQ ID NO: 3873089 - RNA, 21 nt, Shigella flexneri 2a str. 2457T
cgagcgucauauagccgccuu

SEQ ID NO: 3873090 - RNA, 13 nt, Shigella flexneri 2a str. 2457T
cgagcguggaacu

SEQ ID NO: 3873091 - RNA, 22 nt, Shigella flexneri 2a str. 2457T
cgagcuuauuuguugagcugga

SEQ ID NO: 3873092 - RNA, 23 nt, Shigella flexneri 2a str. 2457T
cgagcuuuccggcggucagcgcc

SEQ ID NO: 3873093 - RNA, 11 nt, Shigella flexneri 2a str. 2457T
cgaggaaaaua

SEQ ID NO: 3873094 - RNA, 15 nt, Shigella flexneri 2a str. 2457T
cgaggaacaucugag

SEQ ID NO: 3873095 - RNA, 22 nt, Shigella flexneri 2a str. 2457T
cgaggaacaucugaguugccau

SEQ ID NO: 3873096 - RNA, 19 nt, Shigella flexneri 2a str. 2457T
cgaggaagcuuucgcagua

SEQ ID NO: 3873097 - RNA, 22 nt, Shigella flexneri 2a str. 2457T
cgaggaaucguucauaccacgc

SEQ ID NO: 3873098 - RNA, 13 nt, Shigella flexneri 2a str. 2457T
cgaggacagcauc

SEQ ID NO: 3873099 - RNA, 12 nt, Shigella flexneri 2a str. 2457T
cgaggcaaagag

SEQ ID NO: 3873100 - RNA, 18 nt, Shigella flexneri 2a str. 2457T
cgaggccauauuucacau

SEQ ID NO: 3873101 - RNA, 20 nt, Shigella flexneri 2a str. 2457T
cgaggcgaacaugcgcuggu

SEQ ID NO: 3873102 - RNA, 15 nt, Shigella flexneri 2a str. 2457T
cgaggcgcuggcaga

SEQ ID NO: 3873103 - RNA, 16 nt, Shigella flexneri 2a str. 2457T
cgaggcgcuggcagaa

SEQ ID NO: 3873104 - RNA, 18 nt, Shigella flexneri 2a str. 2457T
cgaggcucugauugccuu

SEQ ID NO: 3873105 - RNA, 12 nt, Shigella flexneri 2a str. 2457T
cgaugccgacga

SEQ ID NO: 3873106 - RNA, 22 nt, Shigella flexneri 2a str. 2457T
cgaugcgcucgccaggaugggc

SEQ ID NO: 3873107 - RNA, 20 nt, Shigella flexneri 2a str. 2457T
cgaugcggcucagccagacg

SEQ ID NO: 3873108 - RNA, 18 nt, Shigella flexneri 2a str. 2457T
cgauggaaccguacagca

SEQ ID NO: 3873109 - RNA, 19 nt, Shigella flexneri 2a str. 2457T
cgauggaaccguacagcau

SEQ ID NO: 3873110 - RNA, 14 nt, Shigella flexneri 2a str. 2457T
cgauggcaucacca

SEQ ID NO: 3873111 - RNA, 21 nt, Shigella flexneri 2a str. 2457T
cgauggcgcagacuuaagauc

SEQ ID NO: 3873112 - RNA, 23 nt, Shigella flexneri 2a str. 2457T
cgaugggagcagccagccagacg

SEQ ID NO: 3873113 - RNA, 15 nt, Shigella flexneri 2a str. 2457T
cgauggucagcuuca

SEQ ID NO: 3873114 - RNA, 17 nt, Shigella flexneri 2a str. 2457T
cgauggugaugagcuga

SEQ ID NO: 3873115 - RNA, 16 nt, Shigella flexneri 2a str. 2457T
cgauggugguggggga

SEQ ID NO: 3873116 - RNA, 20 nt, Shigella flexneri 2a str. 2457T
cgaugguugcugucaacuga

SEQ ID NO: 3873117 - RNA, 23 nt, Shigella flexneri 2a str. 2457T
cgaugguugucacugcaucuucc

SEQ ID NO: 3873118 - RNA, 14 nt, Shigella flexneri 2a str. 2457T
cgauguaauucagc

SEQ ID NO: 3873119 - RNA, 17 nt, Shigella flexneri 2a str. 2457T
cgauguacuucaacaua

SEQ ID NO: 3873120 - RNA, 19 nt, Shigella flexneri 2a str. 2457T
cgauguacuucaacauaac

SEQ ID NO: 3873121 - RNA, 14 nt, Shigella flexneri 2a str. 2457T
cgauguauccggca

SEQ ID NO: 3873122 - RNA, 18 nt, Shigella flexneri 2a str. 2457T
cgaugucgcccacuuuca

SEQ ID NO: 3873123 - RNA, 18 nt, Shigella flexneri 2a str. 2457T
cgauguguggcaucgucc

SEQ ID NO: 3873124 - RNA, 18 nt, Shigella flexneri 2a str. 2457T
cgauguuguacaugcugc

SEQ ID NO: 3873125 - RNA, 14 nt, Shigella flexneri 2a str. 2457T
cgauguuugcugcg

SEQ ID NO: 3873126 - RNA, 16 nt, Shigella flexneri 2a str. 2457T
cgauguuuucugccuc

SEQ ID NO: 3873127 - RNA, 22 nt, Shigella flexneri 2a str. 2457T
cgauuaacgccagacucgccag

SEQ ID NO: 3873128 - RNA, 18 nt, Shigella flexneri 2a str. 2457T
cgauuaauugccgccaga

SEQ ID NO: 3873129 - RNA, 16 nt, Shigella flexneri 2a str. 2457T
cgauuaccauuucacc

SEQ ID NO: 3873130 - RNA, 15 nt, Shigella flexneri 2a str. 2457T
cgauuauccgccagu

SEQ ID NO: 3873131 - RNA, 13 nt, Shigella flexneri 2a str. 2457T
cgauuaucgucau

SEQ ID NO: 3873132 - RNA, 14 nt, Shigella flexneri 2a str. 2457T
cgauuauuuauucc

SEQ ID NO: 3873133 - RNA, 21 nt, Shigella flexneri 2a str. 2457T
cgauuauuuauucccgccaga

SEQ ID NO: 3873134 - RNA, 19 nt, Shigella flexneri 2a str. 2457T
cgauucaaaagaugagaaa

SEQ ID NO: 3873135 - RNA, 13 nt, Shigella flexneri 2a str. 2457T
cgauuccaguucg

SEQ ID NO: 3873136 - RNA, 15 nt, Shigella flexneri 2a str. 2457T
cgauucggcaaucac

SEQ ID NO: 3873137 - RNA, 16 nt, Shigella flexneri 2a str. 2457T
cgauucgguucaauac

SEQ ID NO: 3873138 - RNA, 21 nt, Shigella flexneri 2a str. 2457T
cgauucgguucaauacccacu

SEQ ID NO: 3873139 - RNA, 16 nt, Shigella flexneri 2a str. 2457T
cgauucucgccgcccu

SEQ ID NO: 3873140 - RNA, 19 nt, Shigella flexneri 2a str. 2457T
cgauugaucucguugauca

SEQ ID NO: 3873141 - RNA, 20 nt, Shigella flexneri 2a str. 2457T
cgauugucauucgccugacg

SEQ ID NO: 3873142 - RNA, 17 nt, Shigella flexneri 2a str. 2457T
cgauugucguguuaagc

SEQ ID NO: 3873143 - RNA, 19 nt, Shigella flexneri 2a str. 2457T
cgauugucguguuaagccg

SEQ ID NO: 3873144 - RNA, 13 nt, Shigella flexneri 2a str. 2457T
cgauugugcuggu

SEQ ID NO: 3873145 - RNA, 15 nt, Shigella flexneri 2a str. 2457T
cgauugugcugguga

SEQ ID NO: 3873146 - RNA, 15 nt, Shigella flexneri 2a str. 2457T
cgauuuacuggcaga

SEQ ID NO: 3873147 - RNA, 11 nt, Shigella flexneri 2a str. 2457T
cgauuucacaa

SEQ ID NO: 3873148 - RNA, 16 nt, Shigella flexneri 2a str. 2457T
cgauuucaucgcccag

SEQ ID NO: 3873149 - RNA, 15 nt, Shigella flexneri 2a str. 2457T
cgauuucucagcaga

SEQ ID NO: 3873150 - RNA, 21 nt, Shigella flexneri 2a str. 2457T
cgauuugcggucguaugcugg

SEQ ID NO: 3873151 - RNA, 17 nt, Shigella flexneri 2a str. 2457T
cgauuuggccgaagagg

SEQ ID NO: 3873152 - RNA, 19 nt, Shigella flexneri 2a str. 2457T
cgauuugucgccugcauca

SEQ ID NO: 3873153 - RNA, 22 nt, Shigella flexneri 2a str. 2457T
cgauuugugcacgugccagaug

SEQ ID NO: 3873154 - RNA, 14 nt, Shigella flexneri 2a str. 2457T
cgauuuuccuccau

SEQ ID NO: 3873155 - RNA, 22 nt, Shigella flexneri 2a str. 2457T
cgauuuuggguuccacuucugc

SEQ ID NO: 3873156 - RNA, 13 nt, Shigella flexneri 2a str. 2457T
cgauuuuguaaaa

SEQ ID NO: 3873157 - RNA, 16 nt, Shigella flexneri 2a str. 2457T
cgauuuuguaaaagaa

SEQ ID NO: 3873158 - RNA, 13 nt, Shigella flexneri 2a str. 2457T
cgcaaaaaacauu

SEQ ID NO: 3873159 - RNA, 22 nt, Shigella flexneri 2a str. 2457T
cgcaaaaaaucgccgagcugaa

SEQ ID NO: 3873160 - RNA, 18 nt, Shigella flexneri 2a str. 2457T
cgcaaaaccucuuccagc

SEQ ID NO: 3873161 - RNA, 18 nt, Shigella flexneri 2a str. 2457T
cgcaaaacguggccucca

SEQ ID NO: 3873162 - RNA, 18 nt, Shigella flexneri 2a str. 2457T
cgcaaaauaccagcaauu

SEQ ID NO: 3873163 - RNA, 16 nt, Shigella flexneri 2a str. 2457T
cgcaaaaucagcaauu

SEQ ID NO: 3873164 - RNA, 20 nt, Shigella flexneri 2a str. 2457T
cgcaaaaucagcaauuuuuc

SEQ ID NO: 3873165 - RNA, 18 nt, Shigella flexneri 2a str. 2457T
cgcaaaaucucacacuca

SEQ ID NO: 3873166 - RNA, 16 nt, Shigella flexneri 2a str. 2457T
cgcaaaauucacgcca

SEQ ID NO: 3873167 - RNA, 13 nt, Shigella flexneri 2a str. 2457T
cgcaaacaccagc

SEQ ID NO: 3873168 - RNA, 16 nt, Shigella flexneri 2a str. 2457T
cgcaaacaccagcgaa

SEQ ID NO: 3873169 - RNA, 14 nt, Shigella flexneri 2a str. 2457T
cgcaaacaggcgca

SEQ ID NO: 3873170 - RNA, 23 nt, Shigella flexneri 2a str. 2457T
cgcaaacaucggcuuauucauau

SEQ ID NO: 3873171 - RNA, 19 nt, Shigella flexneri 2a str. 2457T
cgcaaaccuggcaacaauc

SEQ ID NO: 3873172 - RNA, 16 nt, Shigella flexneri 2a str. 2457T
cgcaaacgcccgucca

SEQ ID NO: 3873173 - RNA, 23 nt, Shigella flexneri 2a str. 2457T
cgcaaacgcccguccaucaacaa

SEQ ID NO: 3873174 - RNA, 22 nt, Shigella flexneri 2a str. 2457T
cgcaaaggcuuuuuuauuugcu

SEQ ID NO: 3873175 - RNA, 19 nt, Shigella flexneri 2a str. 2457T
cgcaaaguagcggccugac

SEQ ID NO: 3873176 - RNA, 20 nt, Shigella flexneri 2a str. 2457T
cgcaaauauuucacccgcga

SEQ ID NO: 3873177 - RNA, 13 nt, Shigella flexneri 2a str. 2457T
cgcaacaaauaaa

SEQ ID NO: 3873178 - RNA, 23 nt, Shigella flexneri 2a str. 2457T
cgcaacauauuccgcaccugcca

SEQ ID NO: 3873179 - RNA, 13 nt, Shigella flexneri 2a str. 2457T
cgcaacaucgcaa

SEQ ID NO: 3873180 - RNA, 15 nt, Shigella flexneri 2a str. 2457T
cgcaacauugcgccu

SEQ ID NO: 3873181 - RNA, 16 nt, Shigella flexneri 2a str. 2457T
cgcaaccaacggccuu

SEQ ID NO: 3873182 - RNA, 23 nt, Shigella flexneri 2a str. 2457T
cgcaaccacaaaacacucuucaa

SEQ ID NO: 3873183 - RNA, 14 nt, Shigella flexneri 2a str. 2457T
cgcaaccagcguca

SEQ ID NO: 3873184 - RNA, 13 nt, Shigella flexneri 2a str. 2457T
cgcaacgacaccg

SEQ ID NO: 3873185 - RNA, 15 nt, Shigella flexneri 2a str. 2457T
cgcaacgacaccguu

SEQ ID NO: 3873186 - RNA, 20 nt, Shigella flexneri 2a str. 2457T
cgcaacgacaccguuaaaua

SEQ ID NO: 3873187 - RNA, 15 nt, Shigella flexneri 2a str. 2457T
cgcaacgguugcgga

SEQ ID NO: 3873188 - RNA, 20 nt, Shigella flexneri 2a str. 2457T
cgcaacgguugcggaaccca

SEQ ID NO: 3873189 - RNA, 16 nt, Shigella flexneri 2a str. 2457T
cgcaacuccagcuuag

SEQ ID NO: 3873190 - RNA, 21 nt, Shigella flexneri 2a str. 2457T
cgcaacugguccagccccuga

SEQ ID NO: 3873191 - RNA, 14 nt, Shigella flexneri 2a str. 2457T
cgcaacuuccccuc

SEQ ID NO: 3873192 - RNA, 20 nt, Shigella flexneri 2a str. 2457T
cgcaagccgaauaacggcuc

SEQ ID NO: 3873193 - RNA, 11 nt, Shigella flexneri 2a str. 2457T
cgcaagugauc

SEQ ID NO: 3873194 - RNA, 15 nt, Shigella flexneri 2a str. 2457T
cgcaauacagccagc

SEQ ID NO: 3873195 - RNA, 19 nt, Shigella flexneri 2a str. 2457T
cgcaauaccagcucgauca

SEQ ID NO: 3873196 - RNA, 18 nt, Shigella flexneri 2a str. 2457T
cgcaauacgcuuguacuu

SEQ ID NO: 3873197 - RNA, 14 nt, Shigella flexneri 2a str. 2457T
cgcaaucagcaccg

SEQ ID NO: 3873198 - RNA, 18 nt, Shigella flexneri 2a str. 2457T
cgcaaucagcaccgcgcg

SEQ ID NO: 3873199 - RNA, 12 nt, Shigella flexneri 2a str. 2457T
cgcaauccggaa

SEQ ID NO: 3873200 - RNA, 19 nt, Shigella flexneri 2a str. 2457T
cgcaaucgcccagcgcgua

SEQ ID NO: 3873201 - RNA, 14 nt, Shigella flexneri 2a str. 2457T
cgcaaucgccucca

SEQ ID NO: 3873202 - RNA, 20 nt, Shigella flexneri 2a str. 2457T
cgcaaugauaucgcuggcag

SEQ ID NO: 3873203 - RNA, 23 nt, Shigella flexneri 2a str. 2457T
cgcaguaaucggcgaaaccgcgc

SEQ ID NO: 3873204 - RNA, 21 nt, Shigella flexneri 2a str. 2457T
cgcaguaccagcaacgcuuca

SEQ ID NO: 3873205 - RNA, 13 nt, Shigella flexneri 2a str. 2457T
cgcagucaccagc

SEQ ID NO: 3873206 - RNA, 19 nt, Shigella flexneri 2a str. 2457T
cgcagucaugcgagaagca

SEQ ID NO: 3873207 - RNA, 13 nt, Shigella flexneri 2a str. 2457T
cgcagucuuccca

SEQ ID NO: 3873208 - RNA, 15 nt, Shigella flexneri 2a str. 2457T
cgcagucuuugccgu

SEQ ID NO: 3873209 - RNA, 16 nt, Shigella flexneri 2a str. 2457T
cgcagugagaagccac

SEQ ID NO: 3873210 - RNA, 21 nt, Shigella flexneri 2a str. 2457T
cgcagugagaagccaccgcgc

SEQ ID NO: 3873211 - RNA, 16 nt, Shigella flexneri 2a str. 2457T
cgcagugauugccgca

SEQ ID NO: 3873212 - RNA, 20 nt, Shigella flexneri 2a str. 2457T
cgcaguguaguucuggccuu

SEQ ID NO: 3873213 - RNA, 20 nt, Shigella flexneri 2a str. 2457T
cgcaguugcaacucgacugg

SEQ ID NO: 3873214 - RNA, 22 nt, Shigella flexneri 2a str. 2457T
cgcaguuucgaggcgaugggcg

SEQ ID NO: 3873215 - RNA, 18 nt, Shigella flexneri 2a str. 2457T
cgcauaacucaccaucaa

SEQ ID NO: 3873216 - RNA, 12 nt, Shigella flexneri 2a str. 2457T
cgcauaagccac

SEQ ID NO: 3873217 - RNA, 23 nt, Shigella flexneri 2a str. 2457T
cgcauacauugcguaaccaauca

SEQ ID NO: 3873218 - RNA, 17 nt, Shigella flexneri 2a str. 2457T
cgcauaccccaucagcg

SEQ ID NO: 3873219 - RNA, 19 nt, Shigella flexneri 2a str. 2457T
cgcauaccccaucagcgua

SEQ ID NO: 3873220 - RNA, 23 nt, Shigella flexneri 2a str. 2457T
cgcauagcuaauccccuccagcg

SEQ ID NO: 3873221 - RNA, 14 nt, Shigella flexneri 2a str. 2457T
cgcaucaauauuaa

SEQ ID NO: 3873222 - RNA, 15 nt, Shigella flexneri 2a str. 2457T
cgcaucagcuccggu

SEQ ID NO: 3873223 - RNA, 21 nt, Shigella flexneri 2a str. 2457T
cgcaucaggcaaugggcaaac

SEQ ID NO: 3873224 - RNA, 15 nt, Shigella flexneri 2a str. 2457T
cgcaucaggcaucgu

SEQ ID NO: 3873225 - RNA, 11 nt, Shigella flexneri 2a str. 2457T
cgcauccagaa

SEQ ID NO: 3873226 - RNA, 21 nt, Shigella flexneri 2a str. 2457T
cgcauccgacaaauguguuca

SEQ ID NO: 3873227 - RNA, 16 nt, Shigella flexneri 2a str. 2457T
cgcauccgacaucaac

SEQ ID NO: 3873228 - RNA, 15 nt, Shigella flexneri 2a str. 2457T
cgcauccgacauuug

SEQ ID NO: 3873229 - RNA, 23 nt, Shigella flexneri 2a str. 2457T
cgcauccgaucgcgcaucagcag

SEQ ID NO: 3873230 - RNA, 11 nt, Shigella flexneri 2a str. 2457T
cgcauccggca

SEQ ID NO: 3873231 - RNA, 13 nt, Shigella flexneri 2a str. 2457T
cgcauccggcaag

SEQ ID NO: 3873232 - RNA, 16 nt, Shigella flexneri 2a str. 2457T
cgcauccggcaauaag

SEQ ID NO: 3873233 - RNA, 16 nt, Shigella flexneri 2a str. 2457T
cgcauccggcaguaau

SEQ ID NO: 3873234 - RNA, 19 nt, Shigella flexneri 2a str. 2457T
cgcauccggcaugaacaaa

SEQ ID NO: 3873235 - RNA, 17 nt, Shigella flexneri 2a str. 2457T
cgcauccggcauuuuac

SEQ ID NO: 3873236 - RNA, 18 nt, Shigella flexneri 2a str. 2457T
cgcauccggcauuuugug

SEQ ID NO: 3873237 - RNA, 14 nt, Shigella flexneri 2a str. 2457T
cgcauccgggaugg

SEQ ID NO: 3873238 - RNA, 16 nt, Shigella flexneri 2a str. 2457T
cgcauccucuuuacgc

SEQ ID NO: 3873239 - RNA, 21 nt, Shigella flexneri 2a str. 2457T
cgcaucgacauauucaccauu

SEQ ID NO: 3873240 - RNA, 13 nt, Shigella flexneri 2a str. 2457T
cgcaucgggcgau

SEQ ID NO: 3873241 - RNA, 16 nt, Shigella flexneri 2a str. 2457T
cgcaucgggcgcuauc

SEQ ID NO: 3873242 - RNA, 16 nt, Shigella flexneri 2a str. 2457T
cgcaucgggggaagcu

SEQ ID NO: 3873243 - RNA, 18 nt, Shigella flexneri 2a str. 2457T
cgcaucuacgcgggucag

SEQ ID NO: 3873244 - RNA, 17 nt, Shigella flexneri 2a str. 2457T
cgcaucugaccagaugc

SEQ ID NO: 3873245 - RNA, 21 nt, Shigella flexneri 2a str. 2457T
cgcaucugccggaaccagcca

SEQ ID NO: 3873246 - RNA, 23 nt, Shigella flexneri 2a str. 2457T
cgcaucuguuucgaucagcaauu

SEQ ID NO: 3873247 - RNA, 15 nt, Shigella flexneri 2a str. 2457T
cgcaucuucgcccac

SEQ ID NO: 3873248 - RNA, 12 nt, Shigella flexneri 2a str. 2457T
cgcaucuucucc

SEQ ID NO: 3873249 - RNA, 13 nt, Shigella flexneri 2a str. 2457T
cgcaugacaugcg

SEQ ID NO: 3873250 - RNA, 21 nt, Shigella flexneri 2a str. 2457T
cgcaugcauuuucaauaacug

SEQ ID NO: 3873251 - RNA, 16 nt, Shigella flexneri 2a str. 2457T
cgcauggcauuuugca

SEQ ID NO: 3873252 - RNA, 23 nt, Shigella flexneri 2a str. 2457T
cgcauggccguuauccugaucaa

SEQ ID NO: 3873253 - RNA, 22 nt, Shigella flexneri 2a str. 2457T
cgcauggcugcgaaucgcuuca

SEQ ID NO: 3873254 - RNA, 22 nt, Shigella flexneri 2a str. 2457T
cgcauuaagccaugaaugaugu

SEQ ID NO: 3873255 - RNA, 22 nt, Shigella flexneri 2a str. 2457T
cgcauuaugcagccuuuuuuau

SEQ ID NO: 3873256 - RNA, 12 nt, Shigella flexneri 2a str. 2457T
cgcauucuggag

SEQ ID NO: 3873257 - RNA, 23 nt, Shigella flexneri 2a str. 2457T
cgcauugaacucuucuuccggca

SEQ ID NO: 3873258 - RNA, 13 nt, Shigella flexneri 2a str. 2457T
cgcauugcauuuc

SEQ ID NO: 3873259 - RNA, 16 nt, Shigella flexneri 2a str. 2457T
cgcauugcucacuucc

SEQ ID NO: 3873260 - RNA, 15 nt, Shigella flexneri 2a str. 2457T
cgcauuuacucucau

SEQ ID NO: 3873261 - RNA, 19 nt, Shigella flexneri 2a str. 2457T
cgcauuuuuucuucaguuc

SEQ ID NO: 3873262 - RNA, 22 nt, Shigella flexneri 2a str. 2457T
cgccaaaaagaaccugaacgcc

SEQ ID NO: 3873263 - RNA, 17 nt, Shigella flexneri 2a str. 2457T
cgccaaaacaucuucgg

SEQ ID NO: 3873264 - RNA, 21 nt, Shigella flexneri 2a str. 2457T
cgccaaaaggcaauucaauua

SEQ ID NO: 3873265 - RNA, 24 nt, Shigella flexneri 2a str. 2457T
cgccaaaccacuauuauggcgcag

SEQ ID NO: 3873266 - RNA, 16 nt, Shigella flexneri 2a str. 2457T
cgccaaacccaccagc

SEQ ID NO: 3873267 - RNA, 17 nt, Shigella flexneri 2a str. 2457T
cgccaaacggauacgaa

SEQ ID NO: 3873268 - RNA, 17 nt, Shigella flexneri 2a str. 2457T
cgccaaagaaaccgcgc

SEQ ID NO: 3873269 - RNA, 20 nt, Shigella flexneri 2a str. 2457T
cgccaaagaaaccgcgcgau

SEQ ID NO: 3873270 - RNA, 15 nt, Shigella flexneri 2a str. 2457T
cgccaacaaaagcaa

SEQ ID NO: 3873271 - RNA, 19 nt, Shigella flexneri 2a str. 2457T
cgccaacaaucucuuccag

SEQ ID NO: 3873272 - RNA, 16 nt, Shigella flexneri 2a str. 2457T
cgccaaccagcugacc

SEQ ID NO: 3873273 - RNA, 22 nt, Shigella flexneri 2a str. 2457T
cgccaaccgauaucuuuccggc

SEQ ID NO: 3873274 - RNA, 23 nt, Shigella flexneri 2a str. 2457T
cgccaaccguggcguaaaucauc

SEQ ID NO: 3873275 - RNA, 15 nt, Shigella flexneri 2a str. 2457T
cgccaacgcaccuga

SEQ ID NO: 3873276 - RNA, 16 nt, Shigella flexneri 2a str. 2457T
cgccaacgcccagcgc

SEQ ID NO: 3873277 - RNA, 16 nt, Shigella flexneri 2a str. 2457T
cgccaacuucaugacc

SEQ ID NO: 3873278 - RNA, 23 nt, Shigella flexneri 2a str. 2457T
cgccaacuucaugaccuuccagc

SEQ ID NO: 3873279 - RNA, 13 nt, Shigella flexneri 2a str. 2457T
cgccaagcagcgc

SEQ ID NO: 3873280 - RNA, 17 nt, Shigella flexneri 2a str. 2457T
cgccaagcagcgcgcag

SEQ ID NO: 3873281 - RNA, 17 nt, Shigella flexneri 2a str. 2457T
cgccaaguucgaacgcc

SEQ ID NO: 3873282 - RNA, 22 nt, Shigella flexneri 2a str. 2457T
cgccaaguuuuuucuucccaag

SEQ ID NO: 3873283 - RNA, 21 nt, Shigella flexneri 2a str. 2457T
cgccaauaaccggcacuucaa

SEQ ID NO: 3873284 - RNA, 22 nt, Shigella flexneri 2a str. 2457T
cgccaauuaaugcaccaacaaa

SEQ ID NO: 3873285 - RNA, 16 nt, Shigella flexneri 2a str. 2457T
cgccacaaacgccaga

SEQ ID NO: 3873286 - RNA, 15 nt, Shigella flexneri 2a str. 2457T
cgccacaaccagcgc

SEQ ID NO: 3873287 - RNA, 17 nt, Shigella flexneri 2a str. 2457T
cgccacaacgcaauaaa

SEQ ID NO: 3873288 - RNA, 19 nt, Shigella flexneri 2a str. 2457T
cgccacaauauuccggcau

SEQ ID NO: 3873289 - RNA, 13 nt, Shigella flexneri 2a str. 2457T
cgccacaaucuga

SEQ ID NO: 3873290 - RNA, 18 nt, Shigella flexneri 2a str. 2457T
cgccacaccacugcgcau

SEQ ID NO: 3873291 - RNA, 13 nt, Shigella flexneri 2a str. 2457T
cgccacagcaauu

SEQ ID NO: 3873292 - RNA, 22 nt, Shigella flexneri 2a str. 2457T
cgccacagcauucucggcccgg

SEQ ID NO: 3873293 - RNA, 23 nt, Shigella flexneri 2a str. 2457T
cgccacagcauucucggcccggc

SEQ ID NO: 3873294 - RNA, 21 nt, Shigella flexneri 2a str. 2457T
cgccacagccgagcgccacca

SEQ ID NO: 3873295 - RNA, 22 nt, Shigella flexneri 2a str. 2457T
cgccacauaagaucaucggcca

SEQ ID NO: 3873296 - RNA, 13 nt, Shigella flexneri 2a str. 2457T
cgccaccacaaaa

SEQ ID NO: 3873297 - RNA, 13 nt, Shigella flexneri 2a str. 2457T
cgccaccacaaca

SEQ ID NO: 3873298 - RNA, 15 nt, Shigella flexneri 2a str. 2457T
cgccaccacaacauu

SEQ ID NO: 3873299 - RNA, 16 nt, Shigella flexneri 2a str. 2457T
cgccaccacaacauuc

SEQ ID NO: 3873300 - RNA, 22 nt, Shigella flexneri 2a str. 2457T
cgccaccaccagacgcaacaga

SEQ ID NO: 3873301 - RNA, 13 nt, Shigella flexneri 2a str. 2457T
cgccaccacccug

SEQ ID NO: 3873302 - RNA, 22 nt, Shigella flexneri 2a str. 2457T
cgccaccaggaacgcgccaaga

SEQ ID NO: 3873303 - RNA, 15 nt, Shigella flexneri 2a str. 2457T
cgccacccagcgccg

SEQ ID NO: 3873304 - RNA, 18 nt, Shigella flexneri 2a str. 2457T
cgccacccagcgccgcca

SEQ ID NO: 3873305 - RNA, 19 nt, Shigella flexneri 2a str. 2457T
cgccacccagcgccgccau

SEQ ID NO: 3873306 - RNA, 14 nt, Shigella flexneri 2a str. 2457T
cgccaccccacgau

SEQ ID NO: 3873307 - RNA, 21 nt, Shigella flexneri 2a str. 2457T
cgccaccgaccaggcaaacca

SEQ ID NO: 3873308 - RNA, 15 nt, Shigella flexneri 2a str. 2457T
cgccaccgcaagcca

SEQ ID NO: 3873309 - RNA, 13 nt, Shigella flexneri 2a str. 2457T
cgccaccggcaau

SEQ ID NO: 3873310 - RNA, 21 nt, Shigella flexneri 2a str. 2457T
cgccaccggcuuucgcuucaa

SEQ ID NO: 3873311 - RNA, 19 nt, Shigella flexneri 2a str. 2457T
cgccaccguguucaugacc

SEQ ID NO: 3873312 - RNA, 14 nt, Shigella flexneri 2a str. 2457T
cgccaccucuuuca

SEQ ID NO: 3873313 - RNA, 18 nt, Shigella flexneri 2a str. 2457T
cgccaccucuuucaccaa

SEQ ID NO: 3873314 - RNA, 17 nt, Shigella flexneri 2a str. 2457T
cgccacgcggagcgccu

SEQ ID NO: 3873315 - RNA, 13 nt, Shigella flexneri 2a str. 2457T
cgccacggcauga

SEQ ID NO: 3873316 - RNA, 14 nt, Shigella flexneri 2a str. 2457T
cgccacgguguugu

SEQ ID NO: 3873317 - RNA, 19 nt, Shigella flexneri 2a str. 2457T
cgccacucugacggcgcau

SEQ ID NO: 3873318 - RNA, 15 nt, Shigella flexneri 2a str. 2457T
cgccacuuucacgcc

SEQ ID NO: 3873319 - RNA, 19 nt, Shigella flexneri 2a str. 2457T
cgccacuuucacgccgcca

SEQ ID NO: 3873320 - RNA, 20 nt, Shigella flexneri 2a str. 2457T
cgccagaaaaccuggcgcag

SEQ ID NO: 3873321 - RNA, 14 nt, Shigella flexneri 2a str. 2457T
cgccagaaagcagc

SEQ ID NO: 3873322 - RNA, 19 nt, Shigella flexneri 2a str. 2457T
cgccagaacacgcucccag

SEQ ID NO: 3873323 - RNA, 16 nt, Shigella flexneri 2a str. 2457T
cgccagaacagcuaca

SEQ ID NO: 3873324 - RNA, 22 nt, Shigella flexneri 2a str. 2457T
cgccagaacgacgacugccgcu

SEQ ID NO: 3873325 - RNA, 17 nt, Shigella flexneri 2a str. 2457T
cgccagaccaauagaaa

SEQ ID NO: 3873326 - RNA, 14 nt, Shigella flexneri 2a str. 2457T
cgccagaccagcua

SEQ ID NO: 3873327 - RNA, 21 nt, Shigella flexneri 2a str. 2457T
cgccagaccagcuaccacgcc

SEQ ID NO: 3873328 - RNA, 12 nt, Shigella flexneri 2a str. 2457T
cgccagaccuga

SEQ ID NO: 3873329 - RNA, 21 nt, Shigella flexneri 2a str. 2457T
cgccagacugaucaucgccca

SEQ ID NO: 3873330 - RNA, 22 nt, Shigella flexneri 2a str. 2457T
cgccagacugcgcuaccaggaa

SEQ ID NO: 3873331 - RNA, 17 nt, Shigella flexneri 2a str. 2457T
cgccagaggcgacaaac

SEQ ID NO: 3873332 - RNA, 20 nt, Shigella flexneri 2a str. 2457T
cgccagauacaucagcgaca

SEQ ID NO: 3873333 - RNA, 15 nt, Shigella flexneri 2a str. 2457T
cgccagaugcggcgu

SEQ ID NO: 3873334 - RNA, 13 nt, Shigella flexneri 2a str. 2457T
cgccagcaacaca

SEQ ID NO: 3873335 - RNA, 19 nt, Shigella flexneri 2a str. 2457T
cgccagcacgaccgccauu

SEQ ID NO: 3873336 - RNA, 20 nt, Shigella flexneri 2a str. 2457T
cgccagcagcagcgccaacg

SEQ ID NO: 3873337 - RNA, 20 nt, Shigella flexneri 2a str. 2457T
cgccagcagcagcguaccuc

SEQ ID NO: 3873338 - RNA, 15 nt, Shigella flexneri 2a str. 2457T
cgccagcagccauuc

SEQ ID NO: 3873339 - RNA, 19 nt, Shigella flexneri 2a str. 2457T
cgccagcagggcaaacagc

SEQ ID NO: 3873340 - RNA, 18 nt, Shigella flexneri 2a str. 2457T
cgccagcauucccgccag

SEQ ID NO: 3873341 - RNA, 19 nt, Shigella flexneri 2a str. 2457T
cgccagcauucccgccagc

SEQ ID NO: 3873342 - RNA, 12 nt, Shigella flexneri 2a str. 2457T
cgccagccacca

SEQ ID NO: 3873343 - RNA, 16 nt, Shigella flexneri 2a str. 2457T
cgccagccagccaagc

SEQ ID NO: 3873344 - RNA, 23 nt, Shigella flexneri 2a str. 2457T
cgccagccaguuuacccagcgaa

SEQ ID NO: 3873345 - RNA, 14 nt, Shigella flexneri 2a str. 2457T
cgccagccauucaa

SEQ ID NO: 3873346 - RNA, 14 nt, Shigella flexneri 2a str. 2457T
cgccagccgcaguu

SEQ ID NO: 3873347 - RNA, 16 nt, Shigella flexneri 2a str. 2457T
cgccagcgaagccagc

SEQ ID NO: 3873348 - RNA, 16 nt, Shigella flexneri 2a str. 2457T
cgccagcgaauuccag

SEQ ID NO: 3873349 - RNA, 22 nt, Shigella flexneri 2a str. 2457T
cgccagcgaauuccaguugauu

SEQ ID NO: 3873350 - RNA, 11 nt, Shigella flexneri 2a str. 2457T
cgccagcgcca

SEQ ID NO: 3873351 - RNA, 13 nt, Shigella flexneri 2a str. 2457T
cgccagcgcgcgu

SEQ ID NO: 3873352 - RNA, 13 nt, Shigella flexneri 2a str. 2457T
cgccagcggcagc

SEQ ID NO: 3873353 - RNA, 14 nt, Shigella flexneri 2a str. 2457T
cgccagcggcagcu

SEQ ID NO: 3873354 - RNA, 17 nt, Shigella flexneri 2a str. 2457T
cgccagcggcagcucgc

SEQ ID NO: 3873355 - RNA, 14 nt, Shigella flexneri 2a str. 2457T
cgccagcggcggca

SEQ ID NO: 3873356 - RNA, 13 nt, Shigella flexneri 2a str. 2457T
cgccagcgucuga

SEQ ID NO: 3873357 - RNA, 14 nt, Shigella flexneri 2a str. 2457T
cgccagcgugguca

SEQ ID NO: 3873358 - RNA, 19 nt, Shigella flexneri 2a str. 2457T
cgccagcguguggcgaugg

SEQ ID NO: 3873359 - RNA, 18 nt, Shigella flexneri 2a str. 2457T
cgccagcguuaucccauc

SEQ ID NO: 3873360 - RNA, 21 nt, Shigella flexneri 2a str. 2457T
cgccagcguugauguuccucc

SEQ ID NO: 3873361 - RNA, 19 nt, Shigella flexneri 2a str. 2457T
cgccagcuucgcuucccaa

SEQ ID NO: 3873362 - RNA, 23 nt, Shigella flexneri 2a str. 2457T
cgccaggaaccugugacagcagc

SEQ ID NO: 3873363 - RNA, 20 nt, Shigella flexneri 2a str. 2457T
cgccaggagacgcgcaaauc

SEQ ID NO: 3873364 - RNA, 16 nt, Shigella flexneri 2a str. 2457T
cgccaggccagccugg

SEQ ID NO: 3873365 - RNA, 19 nt, Shigella flexneri 2a str. 2457T
cgccagguaacgaagaugg

SEQ ID NO: 3873366 - RNA, 20 nt, Shigella flexneri 2a str. 2457T
cgccaggugaaauccggcau

SEQ ID NO: 3873367 - RNA, 22 nt, Shigella flexneri 2a str. 2457T
cgccagguguuuaaccaacaca

SEQ ID NO: 3873368 - RNA, 15 nt, Shigella flexneri 2a str. 2457T
cgccagguucaucaa

SEQ ID NO: 3873369 - RNA, 19 nt, Shigella flexneri 2a str. 2457T
cgccagguuucaauauccg

SEQ ID NO: 3873370 - RNA, 23 nt, Shigella flexneri 2a str. 2457T
cgccagguuuuagaucccacggc

SEQ ID NO: 3873371 - RNA, 23 nt, Shigella flexneri 2a str. 2457T
cgccaguaaucuggccaaugccu

SEQ ID NO: 3873372 - RNA, 16 nt, Shigella flexneri 2a str. 2457T
cgccaguaccagcagc

SEQ ID NO: 3873373 - RNA, 15 nt, Shigella flexneri 2a str. 2457T
cgccaguacgcgccc

SEQ ID NO: 3873374 - RNA, 11 nt, Shigella flexneri 2a str. 2457T
cgccagugauu

SEQ ID NO: 3873375 - RNA, 15 nt, Shigella flexneri 2a str. 2457T
cgccagugccaaagc

SEQ ID NO: 3873376 - RNA, 19 nt, Shigella flexneri 2a str. 2457T
cgccagugccaaagccagu

SEQ ID NO: 3873377 - RNA, 15 nt, Shigella flexneri 2a str. 2457T
cgccagugcgcccca

SEQ ID NO: 3873378 - RNA, 19 nt, Shigella flexneri 2a str. 2457T
cgccaguguuggcgucaga

SEQ ID NO: 3873379 - RNA, 15 nt, Shigella flexneri 2a str. 2457T
cgccaguuacugcca

SEQ ID NO: 3873380 - RNA, 15 nt, Shigella flexneri 2a str. 2457T
cgccaguucgauauc

SEQ ID NO: 3873381 - RNA, 15 nt, Shigella flexneri 2a str. 2457T
cgccaguucuuccag

SEQ ID NO: 3873382 - RNA, 19 nt, Shigella flexneri 2a str. 2457T
cgccaguucuuccaguucc

SEQ ID NO: 3873383 - RNA, 14 nt, Shigella flexneri 2a str. 2457T
cgccaguugcggcu

SEQ ID NO: 3873384 - RNA, 20 nt, Shigella flexneri 2a str. 2457T
cgccaguuuacugucugcuu

SEQ ID NO: 3873385 - RNA, 21 nt, Shigella flexneri 2a str. 2457T
cgccaguuuacugucugcuuc

SEQ ID NO: 3873386 - RNA, 16 nt, Shigella flexneri 2a str. 2457T
cgccaguuuuuauacu

SEQ ID NO: 3873387 - RNA, 20 nt, Shigella flexneri 2a str. 2457T
cgccaguuuuuucgcuugau

SEQ ID NO: 3873388 - RNA, 20 nt, Shigella flexneri 2a str. 2457T
cgccauaccaugcaccaacc

SEQ ID NO: 3873389 - RNA, 23 nt, Shigella flexneri 2a str. 2457T
cgccauauaauacgcaucgacau

SEQ ID NO: 3873390 - RNA, 16 nt, Shigella flexneri 2a str. 2457T
cgccauaucauucgac

SEQ ID NO: 3873391 - RNA, 13 nt, Shigella flexneri 2a str. 2457T
cgccauaucggca

SEQ ID NO: 3873392 - RNA, 12 nt, Shigella flexneri 2a str. 2457T
cgccauauuucu

SEQ ID NO: 3873393 - RNA, 18 nt, Shigella flexneri 2a str. 2457T
cgccaucaauaaccagcg

SEQ ID NO: 3873394 - RNA, 13 nt, Shigella flexneri 2a str. 2457T
cgccaucaggcag

SEQ ID NO: 3873395 - RNA, 22 nt, Shigella flexneri 2a str. 2457T
cgccaucagucgaccgacuuua

SEQ ID NO: 3873396 - RNA, 15 nt, Shigella flexneri 2a str. 2457T
cgccaucauacccaa

SEQ ID NO: 3873397 - RNA, 14 nt, Shigella flexneri 2a str. 2457T
cgccauccaccagc

SEQ ID NO: 3873398 - RNA, 17 nt, Shigella flexneri 2a str. 2457T
cgccgcgguacagcucg

SEQ ID NO: 3873399 - RNA, 19 nt, Shigella flexneri 2a str. 2457T
cgccgcguuugcgcagcca

SEQ ID NO: 3873400 - RNA, 20 nt, Shigella flexneri 2a str. 2457T
cgccgcguuugcgcagccag

SEQ ID NO: 3873401 - RNA, 13 nt, Shigella flexneri 2a str. 2457T
cgccgcuaccggc

SEQ ID NO: 3873402 - RNA, 19 nt, Shigella flexneri 2a str. 2457T
cgccgcugucuaccagcac

SEQ ID NO: 3873403 - RNA, 17 nt, Shigella flexneri 2a str. 2457T
cgccgcuugcuggcgcu

SEQ ID NO: 3873404 - RNA, 16 nt, Shigella flexneri 2a str. 2457T
cgccgcuuucgucugg

SEQ ID NO: 3873405 - RNA, 19 nt, Shigella flexneri 2a str. 2457T
cgccggaaauuugcagugc

SEQ ID NO: 3873406 - RNA, 14 nt, Shigella flexneri 2a str. 2457T
cgccggacauugcg

SEQ ID NO: 3873407 - RNA, 18 nt, Shigella flexneri 2a str. 2457T
cgccggaugacacaucac

SEQ ID NO: 3873408 - RNA, 22 nt, Shigella flexneri 2a str. 2457T
cgccgggaugauggcuuuggcg

SEQ ID NO: 3873409 - RNA, 18 nt, Shigella flexneri 2a str. 2457T
cgccgggaugcuggggcc

SEQ ID NO: 3873410 - RNA, 16 nt, Shigella flexneri 2a str. 2457T
cgccgggcuaaccgcu

SEQ ID NO: 3873411 - RNA, 14 nt, Shigella flexneri 2a str. 2457T
cgccgggguuaugu

SEQ ID NO: 3873412 - RNA, 16 nt, Shigella flexneri 2a str. 2457T
cgccggguucgacgcg

SEQ ID NO: 3873413 - RNA, 14 nt, Shigella flexneri 2a str. 2457T
cgccgguagucacc

SEQ ID NO: 3873414 - RNA, 14 nt, Shigella flexneri 2a str. 2457T
cgccggucacgccc

SEQ ID NO: 3873415 - RNA, 19 nt, Shigella flexneri 2a str. 2457T
cgccggugauuacaucgcg

SEQ ID NO: 3873416 - RNA, 17 nt, Shigella flexneri 2a str. 2457T
cgccgguuccagcuuca

SEQ ID NO: 3873417 - RNA, 19 nt, Shigella flexneri 2a str. 2457T
cgccgguugccccgcacgc

SEQ ID NO: 3873418 - RNA, 16 nt, Shigella flexneri 2a str. 2457T
cgccguaaaucccgcc

SEQ ID NO: 3873419 - RNA, 17 nt, Shigella flexneri 2a str. 2457T
cgccguaaaucccgcca

SEQ ID NO: 3873420 - RNA, 18 nt, Shigella flexneri 2a str. 2457T
cgccgucaucacgcaggc

SEQ ID NO: 3873421 - RNA, 17 nt, Shigella flexneri 2a str. 2457T
cgccgucgauggcgcag

SEQ ID NO: 3873422 - RNA, 14 nt, Shigella flexneri 2a str. 2457T
cgccgugaacgugg

SEQ ID NO: 3873423 - RNA, 18 nt, Shigella flexneri 2a str. 2457T
cgccgugcacaccgaaga

SEQ ID NO: 3873424 - RNA, 21 nt, Shigella flexneri 2a str. 2457T
cgccgugcacuucugcgguga

SEQ ID NO: 3873425 - RNA, 20 nt, Shigella flexneri 2a str. 2457T
cgccguuagcuucagccggg

SEQ ID NO: 3873426 - RNA, 23 nt, Shigella flexneri 2a str. 2457T
cgccguuuuuacccagcagcagc

SEQ ID NO: 3873427 - RNA, 19 nt, Shigella flexneri 2a str. 2457T
cgccguuuuuuuucuguca

SEQ ID NO: 3873428 - RNA, 17 nt, Shigella flexneri 2a str. 2457T
cgccuacggcauucugc

SEQ ID NO: 3873429 - RNA, 14 nt, Shigella flexneri 2a str. 2457T
cgccucaacccauu

SEQ ID NO: 3873430 - RNA, 20 nt, Shigella flexneri 2a str. 2457T
cgccucaacgccuaaugcca

SEQ ID NO: 3873431 - RNA, 14 nt, Shigella flexneri 2a str. 2457T
cgccucagccagaa

SEQ ID NO: 3873432 - RNA, 17 nt, Shigella flexneri 2a str. 2457T
cgccucccuucgcugcu

SEQ ID NO: 3873433 - RNA, 14 nt, Shigella flexneri 2a str. 2457T
cgccucgcgccagc

SEQ ID NO: 3873434 - RNA, 13 nt, Shigella flexneri 2a str. 2457T
cgccucggggcca

SEQ ID NO: 3873435 - RNA, 19 nt, Shigella flexneri 2a str. 2457T
cgccucguaaugcuccggc

SEQ ID NO: 3873436 - RNA, 12 nt, Shigella flexneri 2a str. 2457T
cgccucuucaua

SEQ ID NO: 3873437 - RNA, 11 nt, Shigella flexneri 2a str. 2457T
cgccucuucca

SEQ ID NO: 3873438 - RNA, 13 nt, Shigella flexneri 2a str. 2457T
cgccugaaaguau

SEQ ID NO: 3873439 - RNA, 17 nt, Shigella flexneri 2a str. 2457T
cgccugauagcccgcac

SEQ ID NO: 3873440 - RNA, 15 nt, Shigella flexneri 2a str. 2457T
cgccugaucgcgcag

SEQ ID NO: 3873441 - RNA, 15 nt, Shigella flexneri 2a str. 2457T
cgccugauucaauga

SEQ ID NO: 3873442 - RNA, 13 nt, Shigella flexneri 2a str. 2457T
cgccugcaaauaa

SEQ ID NO: 3873443 - RNA, 18 nt, Shigella flexneri 2a str. 2457T
cgccugcaccauugcugc

SEQ ID NO: 3873444 - RNA, 14 nt, Shigella flexneri 2a str. 2457T
cgccugcagggcuu

SEQ ID NO: 3873445 - RNA, 14 nt, Shigella flexneri 2a str. 2457T
cgccugcauacguu

SEQ ID NO: 3873446 - RNA, 14 nt, Shigella flexneri 2a str. 2457T
cgccugcaucucuu

SEQ ID NO: 3873447 - RNA, 13 nt, Shigella flexneri 2a str. 2457T
cgccugccugcag

SEQ ID NO: 3873448 - RNA, 18 nt, Shigella flexneri 2a str. 2457T
cgccugcgaguuuuaccu

SEQ ID NO: 3873449 - RNA, 14 nt, Shigella flexneri 2a str. 2457T
cgccugcggccagc

SEQ ID NO: 3873450 - RNA, 18 nt, Shigella flexneri 2a str. 2457T
cgccugcggccagcagcu

SEQ ID NO: 3873451 - RNA, 15 nt, Shigella flexneri 2a str. 2457T
cgccugcuucgucca

SEQ ID NO: 3873452 - RNA, 15 nt, Shigella flexneri 2a str. 2457T
cgccuggaccagcgg

SEQ ID NO: 3873453 - RNA, 16 nt, Shigella flexneri 2a str. 2457T
cgccuggaccagcggg

SEQ ID NO: 3873454 - RNA, 17 nt, Shigella flexneri 2a str. 2457T
cgccugguaccagcacc

SEQ ID NO: 3873455 - RNA, 16 nt, Shigella flexneri 2a str. 2457T
cgccuguguccuguug

SEQ ID NO: 3873456 - RNA, 14 nt, Shigella flexneri 2a str. 2457T
cgccuguuccagca

SEQ ID NO: 3873457 - RNA, 22 nt, Shigella flexneri 2a str. 2457T
cgccuguuuaccgcucaccgga

SEQ ID NO: 3873458 - RNA, 17 nt, Shigella flexneri 2a str. 2457T
cgccuuaaagcggcggu

SEQ ID NO: 3873459 - RNA, 14 nt, Shigella flexneri 2a str. 2457T
cgccuuauccggcc

SEQ ID NO: 3873460 - RNA, 15 nt, Shigella flexneri 2a str. 2457T
cgccuuauccggccu

SEQ ID NO: 3873461 - RNA, 17 nt, Shigella flexneri 2a str. 2457T
cgccuuauccggccuac

SEQ ID NO: 3873462 - RNA, 19 nt, Shigella flexneri 2a str. 2457T
cgccuuauccggccuacaa

SEQ ID NO: 3873463 - RNA, 16 nt, Shigella flexneri 2a str. 2457T
cgccuucacgguuauu

SEQ ID NO: 3873464 - RNA, 17 nt, Shigella flexneri 2a str. 2457T
cgccuucauucaggcca

SEQ ID NO: 3873465 - RNA, 22 nt, Shigella flexneri 2a str. 2457T
cgccuucauucaggccaaagcc

SEQ ID NO: 3873466 - RNA, 23 nt, Shigella flexneri 2a str. 2457T
cgccuuccacuucugcgucgaua

SEQ ID NO: 3873467 - RNA, 16 nt, Shigella flexneri 2a str. 2457T
cgccuucuacagcuuc

SEQ ID NO: 3873468 - RNA, 12 nt, Shigella flexneri 2a str. 2457T
cgccuucugcgc

SEQ ID NO: 3873469 - RNA, 17 nt, Shigella flexneri 2a str. 2457T
cgccuucugcgccgccu

SEQ ID NO: 3873470 - RNA, 15 nt, Shigella flexneri 2a str. 2457T
cgccuugcgcgcagu

SEQ ID NO: 3873471 - RNA, 17 nt, Shigella flexneri 2a str. 2457T
cgccuuguuccugcuug

SEQ ID NO: 3873472 - RNA, 20 nt, Shigella flexneri 2a str. 2457T
cgccuuuaaaucccgcuuca

SEQ ID NO: 3873473 - RNA, 22 nt, Shigella flexneri 2a str. 2457T
cgccuuuaauauuaacgccagc

SEQ ID NO: 3873474 - RNA, 18 nt, Shigella flexneri 2a str. 2457T
cgccuuucaguucaacgg

SEQ ID NO: 3873475 - RNA, 15 nt, Shigella flexneri 2a str. 2457T
cgccuuuuacgcauu

SEQ ID NO: 3873476 - RNA, 13 nt, Shigella flexneri 2a str. 2457T
cgccuuuuccagc

SEQ ID NO: 3873477 - RNA, 22 nt, Shigella flexneri 2a str. 2457T
cgccuuuucuuuauaaauuccu

SEQ ID NO: 3873478 - RNA, 19 nt, Shigella flexneri 2a str. 2457T
cgcgaaaguuaccgcgcca

SEQ ID NO: 3873479 - RNA, 13 nt, Shigella flexneri 2a str. 2457T
cgcgaaccuguga

SEQ ID NO: 3873480 - RNA, 17 nt, Shigella flexneri 2a str. 2457T
cgcgaacuaaacaacgc

SEQ ID NO: 3873481 - RNA, 15 nt, Shigella flexneri 2a str. 2457T
cgcgaagauucguau

SEQ ID NO: 3873482 - RNA, 12 nt, Shigella flexneri 2a str. 2457T
cgcgaagcuggu

SEQ ID NO: 3873483 - RNA, 16 nt, Shigella flexneri 2a str. 2457T
cgcgaauaguuuccgc

SEQ ID NO: 3873484 - RNA, 18 nt, Shigella flexneri 2a str. 2457T
cgcgaaucuccacgccuu

SEQ ID NO: 3873485 - RNA, 20 nt, Shigella flexneri 2a str. 2457T
cgcgacacaauccaugccaa

SEQ ID NO: 3873486 - RNA, 13 nt, Shigella flexneri 2a str. 2457T
cgcgaccaccagc

SEQ ID NO: 3873487 - RNA, 12 nt, Shigella flexneri 2a str. 2457T
cgcgaccagcgu

SEQ ID NO: 3873488 - RNA, 22 nt, Shigella flexneri 2a str. 2457T
cgcgacuuuaaucaccugccag

SEQ ID NO: 3873489 - RNA, 14 nt, Shigella flexneri 2a str. 2457T
cgcgacuuuuuccu

SEQ ID NO: 3873490 - RNA, 16 nt, Shigella flexneri 2a str. 2457T
cgcgacuuuuuccugc

SEQ ID NO: 3873491 - RNA, 16 nt, Shigella flexneri 2a str. 2457T
cgcgagcuuuccggcg

SEQ ID NO: 3873492 - RNA, 13 nt, Shigella flexneri 2a str. 2457T
cgcgaggcgcaua

SEQ ID NO: 3873493 - RNA, 14 nt, Shigella flexneri 2a str. 2457T
cgcgagguaacauc

SEQ ID NO: 3873494 - RNA, 15 nt, Shigella flexneri 2a str. 2457T
cgcgauacaccagau

SEQ ID NO: 3873495 - RNA, 15 nt, Shigella flexneri 2a str. 2457T
cgcgauaccacccgc

SEQ ID NO: 3873496 - RNA, 15 nt, Shigella flexneri 2a str. 2457T
cgcgauagccgcuuu

SEQ ID NO: 3873497 - RNA, 14 nt, Shigella flexneri 2a str. 2457T
cgcggugcgccgua

SEQ ID NO: 3873498 - RNA, 19 nt, Shigella flexneri 2a str. 2457T
cgcgguguugauacaggcg

SEQ ID NO: 3873499 - RNA, 22 nt, Shigella flexneri 2a str. 2457T
cgcgguugcggguuuucgcugc

SEQ ID NO: 3873500 - RNA, 16 nt, Shigella flexneri 2a str. 2457T
cgcguaaaacagccag

SEQ ID NO: 3873501 - RNA, 17 nt, Shigella flexneri 2a str. 2457T
cgcguaaaacagccagc

SEQ ID NO: 3873502 - RNA, 21 nt, Shigella flexneri 2a str. 2457T
cgcguaaaacagccagcgcug

SEQ ID NO: 3873503 - RNA, 22 nt, Shigella flexneri 2a str. 2457T
cgcguaaaacagccagcgcuga

SEQ ID NO: 3873504 - RNA, 21 nt, Shigella flexneri 2a str. 2457T
cgcguaaauaccuuccggcgu

SEQ ID NO: 3873505 - RNA, 21 nt, Shigella flexneri 2a str. 2457T
cgcguaaauuugcucaucgau

SEQ ID NO: 3873506 - RNA, 13 nt, Shigella flexneri 2a str. 2457T
cgcguaacugcug

SEQ ID NO: 3873507 - RNA, 17 nt, Shigella flexneri 2a str. 2457T
cgcguaaugcuucuacc

SEQ ID NO: 3873508 - RNA, 15 nt, Shigella flexneri 2a str. 2457T
cgcguaauggcagca

SEQ ID NO: 3873509 - RNA, 19 nt, Shigella flexneri 2a str. 2457T
cgcguaauggcagcauuca

SEQ ID NO: 3873510 - RNA, 16 nt, Shigella flexneri 2a str. 2457T
cgcguacacuuuccug

SEQ ID NO: 3873511 - RNA, 13 nt, Shigella flexneri 2a str. 2457T
cgcguaccgccga

SEQ ID NO: 3873512 - RNA, 22 nt, Shigella flexneri 2a str. 2457T
cgcgucaacagggcagacauuc

SEQ ID NO: 3873513 - RNA, 21 nt, Shigella flexneri 2a str. 2457T
cgcguccccugcaauauuuug

SEQ ID NO: 3873514 - RNA, 16 nt, Shigella flexneri 2a str. 2457T
cgcguccgcucgguca

SEQ ID NO: 3873515 - RNA, 22 nt, Shigella flexneri 2a str. 2457T
cgcgucgcgcacugcguggaga

SEQ ID NO: 3873516 - RNA, 19 nt, Shigella flexneri 2a str. 2457T
cgcgucggcgucagcgcca

SEQ ID NO: 3873517 - RNA, 16 nt, Shigella flexneri 2a str. 2457T
cgcgucgucaaccuga

SEQ ID NO: 3873518 - RNA, 22 nt, Shigella flexneri 2a str. 2457T
cgcgucuuaucaugccuacggg

SEQ ID NO: 3873519 - RNA, 16 nt, Shigella flexneri 2a str. 2457T
cgcgucuuauccggcc

SEQ ID NO: 3873520 - RNA, 18 nt, Shigella flexneri 2a str. 2457T
cgcgucuuaucuggccua

SEQ ID NO: 3873521 - RNA, 20 nt, Shigella flexneri 2a str. 2457T
cgcgugauugguuucaaaga

SEQ ID NO: 3873522 - RNA, 22 nt, Shigella flexneri 2a str. 2457T
cgcgugccuaacaauucgccag

SEQ ID NO: 3873523 - RNA, 11 nt, Shigella flexneri 2a str. 2457T
cgcguggaaca

SEQ ID NO: 3873524 - RNA, 14 nt, Shigella flexneri 2a str. 2457T
cgcguggccuggaa

SEQ ID NO: 3873525 - RNA, 15 nt, Shigella flexneri 2a str. 2457T
cgcguguuccagaga

SEQ ID NO: 3873526 - RNA, 17 nt, Shigella flexneri 2a str. 2457T
cgcguuacccauucaag

SEQ ID NO: 3873527 - RNA, 22 nt, Shigella flexneri 2a str. 2457T
cgcguuaucagcaacuggcaaa

SEQ ID NO: 3873528 - RNA, 13 nt, Shigella flexneri 2a str. 2457T
cgcguucacugcc

SEQ ID NO: 3873529 - RNA, 13 nt, Shigella flexneri 2a str. 2457T
cgcguucuguugc

SEQ ID NO: 3873530 - RNA, 22 nt, Shigella flexneri 2a str. 2457T
cgcguuguauaacguggugaaa

SEQ ID NO: 3873531 - RNA, 15 nt, Shigella flexneri 2a str. 2457T
cgcguuucugcgcuu

SEQ ID NO: 3873532 - RNA, 19 nt, Shigella flexneri 2a str. 2457T
cgcuaaaaaagguaacauu

SEQ ID NO: 3873533 - RNA, 17 nt, Shigella flexneri 2a str. 2457T
cgcuaaacaggaucugg

SEQ ID NO: 3873534 - RNA, 13 nt, Shigella flexneri 2a str. 2457T
cgcuaaaugccgc

SEQ ID NO: 3873535 - RNA, 13 nt, Shigella flexneri 2a str. 2457T
cgcuaaauguuua

SEQ ID NO: 3873536 - RNA, 14 nt, Shigella flexneri 2a str. 2457T
cgcuaacagcagca

SEQ ID NO: 3873537 - RNA, 22 nt, Shigella flexneri 2a str. 2457T
cgcuaacccgcagcuuaaugaa

SEQ ID NO: 3873538 - RNA, 16 nt, Shigella flexneri 2a str. 2457T
cgcuaacggugcacgc

SEQ ID NO: 3873539 - RNA, 15 nt, Shigella flexneri 2a str. 2457T
cgcuaagccugcuga

SEQ ID NO: 3873540 - RNA, 20 nt, Shigella flexneri 2a str. 2457T
cgcuaaggucaccaguucac

SEQ ID NO: 3873541 - RNA, 16 nt, Shigella flexneri 2a str. 2457T
cgcuaaucgcaccgac

SEQ ID NO: 3873542 - RNA, 19 nt, Shigella flexneri 2a str. 2457T
cgcuaauuuauucggucag

SEQ ID NO: 3873543 - RNA, 13 nt, Shigella flexneri 2a str. 2457T
cgcuacauaacgc

SEQ ID NO: 3873544 - RNA, 13 nt, Shigella flexneri 2a str. 2457T
cgcuacauccgac

SEQ ID NO: 3873545 - RNA, 14 nt, Shigella flexneri 2a str. 2457T
cgcuaccaccaaac

SEQ ID NO: 3873546 - RNA, 18 nt, Shigella flexneri 2a str. 2457T
cgcuaccaggaagcgacc

SEQ ID NO: 3873547 - RNA, 12 nt, Shigella flexneri 2a str. 2457T
cgcuaccgccga

SEQ ID NO: 3873548 - RNA, 13 nt, Shigella flexneri 2a str. 2457T
cgcuacgacguuc

SEQ ID NO: 3873549 - RNA, 18 nt, Shigella flexneri 2a str. 2457T
cgcuacgguggaaaaggc

SEQ ID NO: 3873550 - RNA, 21 nt, Shigella flexneri 2a str. 2457T
cgcuagccaacuuaccgccgg

SEQ ID NO: 3873551 - RNA, 21 nt, Shigella flexneri 2a str. 2457T
cgcuagcgucguggcaaaaug

SEQ ID NO: 3873552 - RNA, 20 nt, Shigella flexneri 2a str. 2457T
cgcuaguacccgaucacaac

SEQ ID NO: 3873553 - RNA, 15 nt, Shigella flexneri 2a str. 2457T
cgcuagugcauugag

SEQ ID NO: 3873554 - RNA, 21 nt, Shigella flexneri 2a str. 2457T
cgcuauaucgcugauaucaaa

SEQ ID NO: 3873555 - RNA, 20 nt, Shigella flexneri 2a str. 2457T
cgcuaucaauacuuuccagc

SEQ ID NO: 3873556 - RNA, 12 nt, Shigella flexneri 2a str. 2457T
cgcuaucagcgc

SEQ ID NO: 3873557 - RNA, 13 nt, Shigella flexneri 2a str. 2457T
cgcuauccagcgc

SEQ ID NO: 3873558 - RNA, 22 nt, Shigella flexneri 2a str. 2457T
cgcuaucggguacgggcgcgag

SEQ ID NO: 3873559 - RNA, 14 nt, Shigella flexneri 2a str. 2457T
cgcuauguuuauca

SEQ ID NO: 3873560 - RNA, 19 nt, Shigella flexneri 2a str. 2457T
cgcuauucgaaccaacacu

SEQ ID NO: 3873561 - RNA, 15 nt, Shigella flexneri 2a str. 2457T
cgcucaaugcgcuga

SEQ ID NO: 3873562 - RNA, 15 nt, Shigella flexneri 2a str. 2457T
cgcucaccggaugcg

SEQ ID NO: 3873563 - RNA, 15 nt, Shigella flexneri 2a str. 2457T
cgcucagcaauugca

SEQ ID NO: 3873564 - RNA, 16 nt, Shigella flexneri 2a str. 2457T
cgcucagcgccacauc

SEQ ID NO: 3873565 - RNA, 19 nt, Shigella flexneri 2a str. 2457T
cgcucaggguaccgauaga

SEQ ID NO: 3873566 - RNA, 13 nt, Shigella flexneri 2a str. 2457T
cgcucauaaccaa

SEQ ID NO: 3873567 - RNA, 15 nt, Shigella flexneri 2a str. 2457T
cgcucaucaggccua

SEQ ID NO: 3873568 - RNA, 12 nt, Shigella flexneri 2a str. 2457T
cgcucaucggca

SEQ ID NO: 3873569 - RNA, 14 nt, Shigella flexneri 2a str. 2457T
cgcucaucugcugc

SEQ ID NO: 3873570 - RNA, 17 nt, Shigella flexneri 2a str. 2457T
cgcucaucugcugcguu

SEQ ID NO: 3873571 - RNA, 20 nt, Shigella flexneri 2a str. 2457T
cgcucauuuucucuuucagc

SEQ ID NO: 3873572 - RNA, 12 nt, Shigella flexneri 2a str. 2457T
cgcuccacuuca

SEQ ID NO: 3873573 - RNA, 20 nt, Shigella flexneri 2a str. 2457T
cgcuccaggaguuccggguc

SEQ ID NO: 3873574 - RNA, 12 nt, Shigella flexneri 2a str. 2457T
cgcuccauucca

SEQ ID NO: 3873575 - RNA, 19 nt, Shigella flexneri 2a str. 2457T
cgcuccauugcccgcccga

SEQ ID NO: 3873576 - RNA, 13 nt, Shigella flexneri 2a str. 2457T
cgcucccugccag

SEQ ID NO: 3873577 - RNA, 17 nt, Shigella flexneri 2a str. 2457T
cgcucgaacagcugguu

SEQ ID NO: 3873578 - RNA, 17 nt, Shigella flexneri 2a str. 2457T
cgcucgaagcgggcgcg

SEQ ID NO: 3873579 - RNA, 16 nt, Shigella flexneri 2a str. 2457T
cgcucgcgccgcaucc

SEQ ID NO: 3873580 - RNA, 21 nt, Shigella flexneri 2a str. 2457T
cgcucggcaaagcgcugaaga

SEQ ID NO: 3873581 - RNA, 22 nt, Shigella flexneri 2a str. 2457T
cgcucggcagaugagacguuau

SEQ ID NO: 3873582 - RNA, 19 nt, Shigella flexneri 2a str. 2457T
cgcucggcgcaaucgccag

SEQ ID NO: 3873583 - RNA, 22 nt, Shigella flexneri 2a str. 2457T
cgcucguagguuucugccagcg

SEQ ID NO: 3873584 - RNA, 22 nt, Shigella flexneri 2a str. 2457T
cgcucguuaaaacgcgcggcgu

SEQ ID NO: 3873585 - RNA, 21 nt, Shigella flexneri 2a str. 2457T
cgcucuaaaaucaucacgcgg

SEQ ID NO: 3873586 - RNA, 20 nt, Shigella flexneri 2a str. 2457T
cgcucucccaguaaccacgc

SEQ ID NO: 3873587 - RNA, 16 nt, Shigella flexneri 2a str. 2457T
cgcucugcccaugcug

SEQ ID NO: 3873588 - RNA, 23 nt, Shigella flexneri 2a str. 2457T
cgcucuucaucgcuaaaauacug

SEQ ID NO: 3873589 - RNA, 21 nt, Shigella flexneri 2a str. 2457T
cgcucuucgaggccgcggcuc

SEQ ID NO: 3873590 - RNA, 17 nt, Shigella flexneri 2a str. 2457T
cgcucuugcucucauua

SEQ ID NO: 3873591 - RNA, 22 nt, Shigella flexneri 2a str. 2457T
cgcucuuguucuuccggcacac

SEQ ID NO: 3873592 - RNA, 15 nt, Shigella flexneri 2a str. 2457T
cgcucuuuaaaggcc

SEQ ID NO: 3873593 - RNA, 14 nt, Shigella flexneri 2a str. 2457T
cgcugaaaguucau

SEQ ID NO: 3873594 - RNA, 17 nt, Shigella flexneri 2a str. 2457T
cgcugaacgcaccuucc

SEQ ID NO: 3873595 - RNA, 16 nt, Shigella flexneri 2a str. 2457T
cgcuuuuucugcgcac

SEQ ID NO: 3873596 - RNA, 19 nt, Shigella flexneri 2a str. 2457T
cgcuuuuuuagguacaaag

SEQ ID NO: 3873597 - RNA, 17 nt, Shigella flexneri 2a str. 2457T
cgcuuuuuucagcgcca

SEQ ID NO: 3873598 - RNA, 19 nt, Shigella flexneri 2a str. 2457T
cggaaaauauuuaggucag

SEQ ID NO: 3873599 - RNA, 14 nt, Shigella flexneri 2a str. 2457T
cggaaacagugcug

SEQ ID NO: 3873600 - RNA, 17 nt, Shigella flexneri 2a str. 2457T
cggaaagcacaaaauca

SEQ ID NO: 3873601 - RNA, 21 nt, Shigella flexneri 2a str. 2457T
cggaaagcaccugcgcaggca

SEQ ID NO: 3873602 - RNA, 20 nt, Shigella flexneri 2a str. 2457T
cggaaaguuuaauugccauu

SEQ ID NO: 3873603 - RNA, 23 nt, Shigella flexneri 2a str. 2457T
cggaaaucacgauugcugccgau

SEQ ID NO: 3873604 - RNA, 13 nt, Shigella flexneri 2a str. 2457T
cggaaaucacgca

SEQ ID NO: 3873605 - RNA, 13 nt, Shigella flexneri 2a str. 2457T
cggaaaucuccag

SEQ ID NO: 3873606 - RNA, 15 nt, Shigella flexneri 2a str. 2457T
cggaaaucuccagau

SEQ ID NO: 3873607 - RNA, 23 nt, Shigella flexneri 2a str. 2457T
cggaaauuaccgcaccaccagca

SEQ ID NO: 3873608 - RNA, 15 nt, Shigella flexneri 2a str. 2457T
cggaacaacggcaaa

SEQ ID NO: 3873609 - RNA, 18 nt, Shigella flexneri 2a str. 2457T
cggaacacucuuccaguc

SEQ ID NO: 3873610 - RNA, 23 nt, Shigella flexneri 2a str. 2457T
cggaacaucugccccauugcuga

SEQ ID NO: 3873611 - RNA, 20 nt, Shigella flexneri 2a str. 2457T
cggaacccaccgcaauaacc

SEQ ID NO: 3873612 - RNA, 14 nt, Shigella flexneri 2a str. 2457T
cggaacccagcgcg

SEQ ID NO: 3873613 - RNA, 21 nt, Shigella flexneri 2a str. 2457T
cggaacccagcgcgauacgca

SEQ ID NO: 3873614 - RNA, 20 nt, Shigella flexneri 2a str. 2457T
cggaaccggauuuucaccau

SEQ ID NO: 3873615 - RNA, 15 nt, Shigella flexneri 2a str. 2457T
cggaacgaaaaaaau

SEQ ID NO: 3873616 - RNA, 16 nt, Shigella flexneri 2a str. 2457T
cggaacgaaaaaaauc

SEQ ID NO: 3873617 - RNA, 15 nt, Shigella flexneri 2a str. 2457T
cggaacugugcugcc

SEQ ID NO: 3873618 - RNA, 16 nt, Shigella flexneri 2a str. 2457T
cggaacugugcugccg

SEQ ID NO: 3873619 - RNA, 14 nt, Shigella flexneri 2a str. 2457T
cggaagagacuauu

SEQ ID NO: 3873620 - RNA, 17 nt, Shigella flexneri 2a str. 2457T
cggaagagacuauuucu

SEQ ID NO: 3873621 - RNA, 17 nt, Shigella flexneri 2a str. 2457T
cggaagcccgcugcuau

SEQ ID NO: 3873622 - RNA, 19 nt, Shigella flexneri 2a str. 2457T
cggaagcgagguauuuucu

SEQ ID NO: 3873623 - RNA, 19 nt, Shigella flexneri 2a str. 2457T
cggaagcuccaccaguucg

SEQ ID NO: 3873624 - RNA, 17 nt, Shigella flexneri 2a str. 2457T
cggaaggcauaacgacc

SEQ ID NO: 3873625 - RNA, 18 nt, Shigella flexneri 2a str. 2457T
cggaaguaccaauggcaa

SEQ ID NO: 3873626 - RNA, 22 nt, Shigella flexneri 2a str. 2457T
cggaauaaaugucacgucaucc

SEQ ID NO: 3873627 - RNA, 15 nt, Shigella flexneri 2a str. 2457T
cggaauggcaucuuc

SEQ ID NO: 3873628 - RNA, 16 nt, Shigella flexneri 2a str. 2457T
cggaauucccgcuucu

SEQ ID NO: 3873629 - RNA, 22 nt, Shigella flexneri 2a str. 2457T
cggaauugccgguacagccgga

SEQ ID NO: 3873630 - RNA, 11 nt, Shigella flexneri 2a str. 2457T
cggaauuucaa

SEQ ID NO: 3873631 - RNA, 20 nt, Shigella flexneri 2a str. 2457T
cggacaaaguuccugccgau

SEQ ID NO: 3873632 - RNA, 15 nt, Shigella flexneri 2a str. 2457T
cggacaaccagcuuc

SEQ ID NO: 3873633 - RNA, 17 nt, Shigella flexneri 2a str. 2457T
cggacaauaauaucuuu

SEQ ID NO: 3873634 - RNA, 18 nt, Shigella flexneri 2a str. 2457T
cggacaauaauaucuuuu

SEQ ID NO: 3873635 - RNA, 14 nt, Shigella flexneri 2a str. 2457T
cggacacacuucau

SEQ ID NO: 3873636 - RNA, 18 nt, Shigella flexneri 2a str. 2457T
cggacacuccuuccugaa

SEQ ID NO: 3873637 - RNA, 18 nt, Shigella flexneri 2a str. 2457T
cggacacugcuuacaggc

SEQ ID NO: 3873638 - RNA, 14 nt, Shigella flexneri 2a str. 2457T
cggacagaccugcg

SEQ ID NO: 3873639 - RNA, 15 nt, Shigella flexneri 2a str. 2457T
cggacagaucugccu

SEQ ID NO: 3873640 - RNA, 13 nt, Shigella flexneri 2a str. 2457T
cggaccagcaaca

SEQ ID NO: 3873641 - RNA, 14 nt, Shigella flexneri 2a str. 2457T
cggacccacacccc

SEQ ID NO: 3873642 - RNA, 14 nt, Shigella flexneri 2a str. 2457T
cggaccccacgcuc

SEQ ID NO: 3873643 - RNA, 19 nt, Shigella flexneri 2a str. 2457T
cggaccccacgcucucgca

SEQ ID NO: 3873644 - RNA, 14 nt, Shigella flexneri 2a str. 2457T
cggaccgcauucac

SEQ ID NO: 3873645 - RNA, 15 nt, Shigella flexneri 2a str. 2457T
cggaccgucuuuuuu

SEQ ID NO: 3873646 - RNA, 21 nt, Shigella flexneri 2a str. 2457T
cggaccugucggggccagcgc

SEQ ID NO: 3873647 - RNA, 17 nt, Shigella flexneri 2a str. 2457T
cggacgcccgccgacca

SEQ ID NO: 3873648 - RNA, 15 nt, Shigella flexneri 2a str. 2457T
cggacggacuuccag

SEQ ID NO: 3873649 - RNA, 18 nt, Shigella flexneri 2a str. 2457T
cggacguaaugauguaaa

SEQ ID NO: 3873650 - RNA, 22 nt, Shigella flexneri 2a str. 2457T
cggacguucgcccacuucuuuc

SEQ ID NO: 3873651 - RNA, 23 nt, Shigella flexneri 2a str. 2457T
cggacguuugccaugcauaucca

SEQ ID NO: 3873652 - RNA, 15 nt, Shigella flexneri 2a str. 2457T
cggacugaacgcggc

SEQ ID NO: 3873653 - RNA, 19 nt, Shigella flexneri 2a str. 2457T
cggacuuccagcggacgau

SEQ ID NO: 3873654 - RNA, 14 nt, Shigella flexneri 2a str. 2457T
cggagaacaggaau

SEQ ID NO: 3873655 - RNA, 22 nt, Shigella flexneri 2a str. 2457T
cggagacgguuauauuuacaaa

SEQ ID NO: 3873656 - RNA, 12 nt, Shigella flexneri 2a str. 2457T
cggagcaaccug

SEQ ID NO: 3873657 - RNA, 13 nt, Shigella flexneri 2a str. 2457T
cggagcaaugauc

SEQ ID NO: 3873658 - RNA, 20 nt, Shigella flexneri 2a str. 2457T
cggagcaccguauugacgcu

SEQ ID NO: 3873659 - RNA, 20 nt, Shigella flexneri 2a str. 2457T
cggagccagccguugcccgu

SEQ ID NO: 3873660 - RNA, 14 nt, Shigella flexneri 2a str. 2457T
cggagccauucccc

SEQ ID NO: 3873661 - RNA, 21 nt, Shigella flexneri 2a str. 2457T
cggagcucccaggcuccgcca

SEQ ID NO: 3873662 - RNA, 23 nt, Shigella flexneri 2a str. 2457T
cggagcucccaggcuccgccaga

SEQ ID NO: 3873663 - RNA, 19 nt, Shigella flexneri 2a str. 2457T
cggagcuucacccgcagca

SEQ ID NO: 3873664 - RNA, 13 nt, Shigella flexneri 2a str. 2457T
cggaggcccgccc

SEQ ID NO: 3873665 - RNA, 14 nt, Shigella flexneri 2a str. 2457T
cggaggcccgcccc

SEQ ID NO: 3873666 - RNA, 22 nt, Shigella flexneri 2a str. 2457T
cggaggggcggcucuccugcca

SEQ ID NO: 3873667 - RNA, 15 nt, Shigella flexneri 2a str. 2457T
cggagguuuuuuccu

SEQ ID NO: 3873668 - RNA, 16 nt, Shigella flexneri 2a str. 2457T
cggagguuuuuuccuc

SEQ ID NO: 3873669 - RNA, 15 nt, Shigella flexneri 2a str. 2457T
cggagugaaaauucu

SEQ ID NO: 3873670 - RNA, 22 nt, Shigella flexneri 2a str. 2457T
cggagugaaaauucuccggcgu

SEQ ID NO: 3873671 - RNA, 22 nt, Shigella flexneri 2a str. 2457T
cggaguugaccagcuccagcag

SEQ ID NO: 3873672 - RNA, 17 nt, Shigella flexneri 2a str. 2457T
cggauaaagcagagcag

SEQ ID NO: 3873673 - RNA, 14 nt, Shigella flexneri 2a str. 2457T
cggauaaagcugcc

SEQ ID NO: 3873674 - RNA, 19 nt, Shigella flexneri 2a str. 2457T
cggauaagaugcgccagca

SEQ ID NO: 3873675 - RNA, 14 nt, Shigella flexneri 2a str. 2457T
cggauaaggcauuu

SEQ ID NO: 3873676 - RNA, 21 nt, Shigella flexneri 2a str. 2457T
cggauaauggagccagaucug

SEQ ID NO: 3873677 - RNA, 16 nt, Shigella flexneri 2a str. 2457T
cggauaauucccaggc

SEQ ID NO: 3873678 - RNA, 16 nt, Shigella flexneri 2a str. 2457T
cggauaccaccagugc

SEQ ID NO: 3873679 - RNA, 14 nt, Shigella flexneri 2a str. 2457T
cggauagagcgcgg

SEQ ID NO: 3873680 - RNA, 22 nt, Shigella flexneri 2a str. 2457T
cggauagcguguuuuauaccuc

SEQ ID NO: 3873681 - RNA, 17 nt, Shigella flexneri 2a str. 2457T
cggauagcguucggcaa

SEQ ID NO: 3873682 - RNA, 16 nt, Shigella flexneri 2a str. 2457T
cggauaucgagaauca

SEQ ID NO: 3873683 - RNA, 19 nt, Shigella flexneri 2a str. 2457T
cggauaucuuucgccaugg

SEQ ID NO: 3873684 - RNA, 13 nt, Shigella flexneri 2a str. 2457T
cggaucaagaaag

SEQ ID NO: 3873685 - RNA, 16 nt, Shigella flexneri 2a str. 2457T
cggaucaagaaaguuc

SEQ ID NO: 3873686 - RNA, 16 nt, Shigella flexneri 2a str. 2457T
cggaucagcgucgccu

SEQ ID NO: 3873687 - RNA, 21 nt, Shigella flexneri 2a str. 2457T
cggaucagcgucgccuggugu

SEQ ID NO: 3873688 - RNA, 20 nt, Shigella flexneri 2a str. 2457T
cggaucaggcggcucaccug

SEQ ID NO: 3873689 - RNA, 18 nt, Shigella flexneri 2a str. 2457T
cggauccacaccugacga

SEQ ID NO: 3873690 - RNA, 17 nt, Shigella flexneri 2a str. 2457T
cggauccaugacgagga

SEQ ID NO: 3873691 - RNA, 16 nt, Shigella flexneri 2a str. 2457T
cggauccugagcaaac

SEQ ID NO: 3873692 - RNA, 19 nt, Shigella flexneri 2a str. 2457T
cggaucgaacuccgccccg

SEQ ID NO: 3873693 - RNA, 22 nt, Shigella flexneri 2a str. 2457T
cggcaggaagugauugccgaag

SEQ ID NO: 3873694 - RNA, 19 nt, Shigella flexneri 2a str. 2457T
cggcaggccuaacacaugc

SEQ ID NO: 3873695 - RNA, 17 nt, Shigella flexneri 2a str. 2457T
cggcaggguuugcgccc

SEQ ID NO: 3873696 - RNA, 17 nt, Shigella flexneri 2a str. 2457T
cggcagguugcagagca

SEQ ID NO: 3873697 - RNA, 16 nt, Shigella flexneri 2a str. 2457T
cggcaguaccugacca

SEQ ID NO: 3873698 - RNA, 23 nt, Shigella flexneri 2a str. 2457T
cggcagugacugccccaguuccu

SEQ ID NO: 3873699 - RNA, 11 nt, Shigella flexneri 2a str. 2457T
cggcagugcca

SEQ ID NO: 3873700 - RNA, 17 nt, Shigella flexneri 2a str. 2457T
cggcagugccaguucuu

SEQ ID NO: 3873701 - RNA, 16 nt, Shigella flexneri 2a str. 2457T
cggcauaaacaaagug

SEQ ID NO: 3873702 - RNA, 18 nt, Shigella flexneri 2a str. 2457T
cggcauaaagcugcggau

SEQ ID NO: 3873703 - RNA, 19 nt, Shigella flexneri 2a str. 2457T
cggcauaaccggaucgcca

SEQ ID NO: 3873704 - RNA, 11 nt, Shigella flexneri 2a str. 2457T
cggcauaauca

SEQ ID NO: 3873705 - RNA, 21 nt, Shigella flexneri 2a str. 2457T
cggcauagccaccuggcugcg

SEQ ID NO: 3873706 - RNA, 23 nt, Shigella flexneri 2a str. 2457T
cggcauagccaccuggcugcguu

SEQ ID NO: 3873707 - RNA, 14 nt, Shigella flexneri 2a str. 2457T
cggcauauaguggg

SEQ ID NO: 3873708 - RNA, 23 nt, Shigella flexneri 2a str. 2457T
cggcauauuaaccaugacgccga

SEQ ID NO: 3873709 - RNA, 13 nt, Shigella flexneri 2a str. 2457T
cggcaucaaccag

SEQ ID NO: 3873710 - RNA, 13 nt, Shigella flexneri 2a str. 2457T
cggcaucgccaua

SEQ ID NO: 3873711 - RNA, 22 nt, Shigella flexneri 2a str. 2457T
cggcaucgccgcuaucgcugau

SEQ ID NO: 3873712 - RNA, 18 nt, Shigella flexneri 2a str. 2457T
cggcaucgcuccacgcca

SEQ ID NO: 3873713 - RNA, 18 nt, Shigella flexneri 2a str. 2457T
cggcaucuucuccacgcc

SEQ ID NO: 3873714 - RNA, 21 nt, Shigella flexneri 2a str. 2457T
cggcaugaacaaagcgcaccu

SEQ ID NO: 3873715 - RNA, 16 nt, Shigella flexneri 2a str. 2457T
cggcaugacgccgggc

SEQ ID NO: 3873716 - RNA, 14 nt, Shigella flexneri 2a str. 2457T
cggcaugauaccga

SEQ ID NO: 3873717 - RNA, 24 nt, Shigella flexneri 2a str. 2457T
cggcauuacugguuugcagauaac

SEQ ID NO: 3873718 - RNA, 15 nt, Shigella flexneri 2a str. 2457T
cggcauucagugcaa

SEQ ID NO: 3873719 - RNA, 14 nt, Shigella flexneri 2a str. 2457T
cggcauuuccgcca

SEQ ID NO: 3873720 - RNA, 18 nt, Shigella flexneri 2a str. 2457T
cggcauuuuuuucaccaa

SEQ ID NO: 3873721 - RNA, 15 nt, Shigella flexneri 2a str. 2457T
cggccaaauauccgc

SEQ ID NO: 3873722 - RNA, 14 nt, Shigella flexneri 2a str. 2457T
cggccacagccagc

SEQ ID NO: 3873723 - RNA, 19 nt, Shigella flexneri 2a str. 2457T
cggccacagccagccaacg

SEQ ID NO: 3873724 - RNA, 14 nt, Shigella flexneri 2a str. 2457T
cggccacagcgcca

SEQ ID NO: 3873725 - RNA, 14 nt, Shigella flexneri 2a str. 2457T
cggccagcgggcgu

SEQ ID NO: 3873726 - RNA, 18 nt, Shigella flexneri 2a str. 2457T
cggccaguaaccuuucag

SEQ ID NO: 3873727 - RNA, 17 nt, Shigella flexneri 2a str. 2457T
cggccaguugcgcaacg

SEQ ID NO: 3873728 - RNA, 15 nt, Shigella flexneri 2a str. 2457T
cggccauauccagcc

SEQ ID NO: 3873729 - RNA, 15 nt, Shigella flexneri 2a str. 2457T
cggccauugaauauu

SEQ ID NO: 3873730 - RNA, 18 nt, Shigella flexneri 2a str. 2457T
cggcccaccuggcugagc

SEQ ID NO: 3873731 - RNA, 13 nt, Shigella flexneri 2a str. 2457T
cggcccagugagu

SEQ ID NO: 3873732 - RNA, 13 nt, Shigella flexneri 2a str. 2457T
cggccccgguucu

SEQ ID NO: 3873733 - RNA, 20 nt, Shigella flexneri 2a str. 2457T
cggccccgucucccgaugcc

SEQ ID NO: 3873734 - RNA, 15 nt, Shigella flexneri 2a str. 2457T
cggcccggcgacgac

SEQ ID NO: 3873735 - RNA, 17 nt, Shigella flexneri 2a str. 2457T
cggccggaugacagacu

SEQ ID NO: 3873736 - RNA, 22 nt, Shigella flexneri 2a str. 2457T
cggccuacaaaagcaauaauuu

SEQ ID NO: 3873737 - RNA, 19 nt, Shigella flexneri 2a str. 2457T
cggccuacaaaaucgugca

SEQ ID NO: 3873738 - RNA, 20 nt, Shigella flexneri 2a str. 2457T
cggccugcgcgaugaugcca

SEQ ID NO: 3873739 - RNA, 20 nt, Shigella flexneri 2a str. 2457T
cggccuugcggguaguccgc

SEQ ID NO: 3873740 - RNA, 12 nt, Shigella flexneri 2a str. 2457T
cggcgaaagagc

SEQ ID NO: 3873741 - RNA, 21 nt, Shigella flexneri 2a str. 2457T
cggcgaaagcuggcacuggga

SEQ ID NO: 3873742 - RNA, 19 nt, Shigella flexneri 2a str. 2457T
cggcgacgacgguuuccac

SEQ ID NO: 3873743 - RNA, 14 nt, Shigella flexneri 2a str. 2457T
cggcgacggcuggc

SEQ ID NO: 3873744 - RNA, 16 nt, Shigella flexneri 2a str. 2457T
cggcgacuggauaaug

SEQ ID NO: 3873745 - RNA, 20 nt, Shigella flexneri 2a str. 2457T
cggcgagauaaugcgauaac

SEQ ID NO: 3873746 - RNA, 21 nt, Shigella flexneri 2a str. 2457T
cggcgagaucuuuaucaauca

SEQ ID NO: 3873747 - RNA, 17 nt, Shigella flexneri 2a str. 2457T
cggcgagcaacgcagcg

SEQ ID NO: 3873748 - RNA, 13 nt, Shigella flexneri 2a str. 2457T
cggcgagccagcg

SEQ ID NO: 3873749 - RNA, 13 nt, Shigella flexneri 2a str. 2457T
cggcgauaccagu

SEQ ID NO: 3873750 - RNA, 15 nt, Shigella flexneri 2a str. 2457T
cggcgcaacauccgc

SEQ ID NO: 3873751 - RNA, 16 nt, Shigella flexneri 2a str. 2457T
cggcgcaacauccgcu

SEQ ID NO: 3873752 - RNA, 12 nt, Shigella flexneri 2a str. 2457T
cggcgcaaucgc

SEQ ID NO: 3873753 - RNA, 22 nt, Shigella flexneri 2a str. 2457T
cggcgcacaggcaauccagcuc

SEQ ID NO: 3873754 - RNA, 14 nt, Shigella flexneri 2a str. 2457T
cggcgcgauaucga

SEQ ID NO: 3873755 - RNA, 11 nt, Shigella flexneri 2a str. 2457T
cggcgcgcgcu

SEQ ID NO: 3873756 - RNA, 15 nt, Shigella flexneri 2a str. 2457T
cggcgcggugcugga

SEQ ID NO: 3873757 - RNA, 23 nt, Shigella flexneri 2a str. 2457T
cggcgcguugaugccgugcagca

SEQ ID NO: 3873758 - RNA, 22 nt, Shigella flexneri 2a str. 2457T
cggcgcguugccgagaaaaucg

SEQ ID NO: 3873759 - RNA, 17 nt, Shigella flexneri 2a str. 2457T
cggcgcuaauucaacgc

SEQ ID NO: 3873760 - RNA, 18 nt, Shigella flexneri 2a str. 2457T
cggcgcuaauucaacgcc

SEQ ID NO: 3873761 - RNA, 18 nt, Shigella flexneri 2a str. 2457T
cggcgcugacggucuggu

SEQ ID NO: 3873762 - RNA, 12 nt, Shigella flexneri 2a str. 2457T
cggcgcugaucu

SEQ ID NO: 3873763 - RNA, 23 nt, Shigella flexneri 2a str. 2457T
cggcgcugcaauuggucgcgcaa

SEQ ID NO: 3873764 - RNA, 13 nt, Shigella flexneri 2a str. 2457T
cggcgcuuucagc

SEQ ID NO: 3873765 - RNA, 17 nt, Shigella flexneri 2a str. 2457T
cggcggaaagggccgca

SEQ ID NO: 3873766 - RNA, 13 nt, Shigella flexneri 2a str. 2457T
cggcggcaaauau

SEQ ID NO: 3873767 - RNA, 16 nt, Shigella flexneri 2a str. 2457T
cggcggcgcggcgaaa

SEQ ID NO: 3873768 - RNA, 10 nt, Shigella flexneri 2a str. 2457T
cggcggcgga

SEQ ID NO: 3873769 - RNA, 18 nt, Shigella flexneri 2a str. 2457T
cggcgguaaaaucauccu

SEQ ID NO: 3873770 - RNA, 16 nt, Shigella flexneri 2a str. 2457T
cggcggugaccagcag

SEQ ID NO: 3873771 - RNA, 18 nt, Shigella flexneri 2a str. 2457T
cggcggugaccagcagca

SEQ ID NO: 3873772 - RNA, 23 nt, Shigella flexneri 2a str. 2457T
cggcggugaccagcagcauuuca

SEQ ID NO: 3873773 - RNA, 21 nt, Shigella flexneri 2a str. 2457T
cggcggugagaagaccgccgc

SEQ ID NO: 3873774 - RNA, 17 nt, Shigella flexneri 2a str. 2457T
cggcgguugacgccccu

SEQ ID NO: 3873775 - RNA, 15 nt, Shigella flexneri 2a str. 2457T
cggcguaaacgccuu

SEQ ID NO: 3873776 - RNA, 22 nt, Shigella flexneri 2a str. 2457T
cggcguaaacgccuuauccggc

SEQ ID NO: 3873777 - RNA, 16 nt, Shigella flexneri 2a str. 2457T
cggcguaaccgcccag

SEQ ID NO: 3873778 - RNA, 15 nt, Shigella flexneri 2a str. 2457T
cggcguacuggcaau

SEQ ID NO: 3873779 - RNA, 22 nt, Shigella flexneri 2a str. 2457T
cggcguacuggcaaucgccagc

SEQ ID NO: 3873780 - RNA, 22 nt, Shigella flexneri 2a str. 2457T
cggcgucaacaccgggugcaga

SEQ ID NO: 3873781 - RNA, 19 nt, Shigella flexneri 2a str. 2457T
cggcgucauaauccggcaa

SEQ ID NO: 3873782 - RNA, 21 nt, Shigella flexneri 2a str. 2457T
cggcgucauaauccggcaaca

SEQ ID NO: 3873783 - RNA, 19 nt, Shigella flexneri 2a str. 2457T
cggcgucaucgacaucaac

SEQ ID NO: 3873784 - RNA, 22 nt, Shigella flexneri 2a str. 2457T
cggcgucauuuuuucgacauca

SEQ ID NO: 3873785 - RNA, 16 nt, Shigella flexneri 2a str. 2457T
cggcguccaccugcgu

SEQ ID NO: 3873786 - RNA, 21 nt, Shigella flexneri 2a str. 2457T
cggcgucugguaucgcgccag

SEQ ID NO: 3873787 - RNA, 19 nt, Shigella flexneri 2a str. 2457T
cggcgucuuguugaacagg

SEQ ID NO: 3873788 - RNA, 22 nt, Shigella flexneri 2a str. 2457T
cggcgugaaugccuuauccgau

SEQ ID NO: 3873789 - RNA, 22 nt, Shigella flexneri 2a str. 2457T
cggcgugaaugcuuuauucggc

SEQ ID NO: 3873790 - RNA, 20 nt, Shigella flexneri 2a str. 2457T
cgggggccauguuuguauua

SEQ ID NO: 3873791 - RNA, 22 nt, Shigella flexneri 2a str. 2457T
cgggggcggcaaucgcugcuaa

SEQ ID NO: 3873792 - RNA, 15 nt, Shigella flexneri 2a str. 2457T
cggggguaaaaccgg

SEQ ID NO: 3873793 - RNA, 14 nt, Shigella flexneri 2a str. 2457T
cggggucgugcaga

SEQ ID NO: 3873794 - RNA, 17 nt, Shigella flexneri 2a str. 2457T
cggggugcaucgcccug

SEQ ID NO: 3873795 - RNA, 23 nt, Shigella flexneri 2a str. 2457T
cgggguuugcguuugcagcauug

SEQ ID NO: 3873796 - RNA, 20 nt, Shigella flexneri 2a str. 2457T
cggguaacggaccgcauuca

SEQ ID NO: 3873797 - RNA, 17 nt, Shigella flexneri 2a str. 2457T
cgggucaccugccaggg

SEQ ID NO: 3873798 - RNA, 14 nt, Shigella flexneri 2a str. 2457T
cgggucagcggggu

SEQ ID NO: 3873799 - RNA, 23 nt, Shigella flexneri 2a str. 2457T
cgggucauccaggaacuccagau

SEQ ID NO: 3873800 - RNA, 16 nt, Shigella flexneri 2a str. 2457T
cggguccgggcaucag

SEQ ID NO: 3873801 - RNA, 16 nt, Shigella flexneri 2a str. 2457T
cgggucguuuucaguu

SEQ ID NO: 3873802 - RNA, 20 nt, Shigella flexneri 2a str. 2457T
cgggugaagagauccaccag

SEQ ID NO: 3873803 - RNA, 12 nt, Shigella flexneri 2a str. 2457T
cgggugauuaaa

SEQ ID NO: 3873804 - RNA, 14 nt, Shigella flexneri 2a str. 2457T
cgggugcauuuuca

SEQ ID NO: 3873805 - RNA, 19 nt, Shigella flexneri 2a str. 2457T
cgggugcgacaggagccgc

SEQ ID NO: 3873806 - RNA, 19 nt, Shigella flexneri 2a str. 2457T
cggguggugcguaccaggc

SEQ ID NO: 3873807 - RNA, 20 nt, Shigella flexneri 2a str. 2457T
cggguuagguggcaccugac

SEQ ID NO: 3873808 - RNA, 20 nt, Shigella flexneri 2a str. 2457T
cggguugcgguuucaacugc

SEQ ID NO: 3873809 - RNA, 16 nt, Shigella flexneri 2a str. 2457T
cggguuggagcgcguc

SEQ ID NO: 3873810 - RNA, 19 nt, Shigella flexneri 2a str. 2457T
cggguuuaagcccggcauu

SEQ ID NO: 3873811 - RNA, 17 nt, Shigella flexneri 2a str. 2457T
cggguuuggccgggaag

SEQ ID NO: 3873812 - RNA, 22 nt, Shigella flexneri 2a str. 2457T
cggguuuucgcugccacaccau

SEQ ID NO: 3873813 - RNA, 21 nt, Shigella flexneri 2a str. 2457T
cggguuuuucgcgcgggcaga

SEQ ID NO: 3873814 - RNA, 18 nt, Shigella flexneri 2a str. 2457T
cgguaaaagcccauuauu

SEQ ID NO: 3873815 - RNA, 14 nt, Shigella flexneri 2a str. 2457T
cgguaaaaucaucc

SEQ ID NO: 3873816 - RNA, 20 nt, Shigella flexneri 2a str. 2457T
cgguaaaaucauccugcugc

SEQ ID NO: 3873817 - RNA, 18 nt, Shigella flexneri 2a str. 2457T
cgguaaaauggucagcca

SEQ ID NO: 3873818 - RNA, 13 nt, Shigella flexneri 2a str. 2457T
cgguaaacguggu

SEQ ID NO: 3873819 - RNA, 22 nt, Shigella flexneri 2a str. 2457T
cgguaaagaagagcggcaaacg

SEQ ID NO: 3873820 - RNA, 22 nt, Shigella flexneri 2a str. 2457T
cgguaaagccgugcugcugcca

SEQ ID NO: 3873821 - RNA, 14 nt, Shigella flexneri 2a str. 2457T
cgguaaauugcccc

SEQ ID NO: 3873822 - RNA, 16 nt, Shigella flexneri 2a str. 2457T
cgguaacaggaagcag

SEQ ID NO: 3873823 - RNA, 13 nt, Shigella flexneri 2a str. 2457T
cgguaacccuuca

SEQ ID NO: 3873824 - RNA, 20 nt, Shigella flexneri 2a str. 2457T
cgguaacguugcucaagggu

SEQ ID NO: 3873825 - RNA, 21 nt, Shigella flexneri 2a str. 2457T
cgguaaguucacgcagguuag

SEQ ID NO: 3873826 - RNA, 15 nt, Shigella flexneri 2a str. 2457T
cgguaaugacuccaa

SEQ ID NO: 3873827 - RNA, 22 nt, Shigella flexneri 2a str. 2457T
cgguacuucgauuucgccaccc

SEQ ID NO: 3873828 - RNA, 23 nt, Shigella flexneri 2a str. 2457T
cgguagauuauuucgcugcggau

SEQ ID NO: 3873829 - RNA, 15 nt, Shigella flexneri 2a str. 2457T
cgguagcagcuuuca

SEQ ID NO: 3873830 - RNA, 20 nt, Shigella flexneri 2a str. 2457T
cgguagcagcuuucagcagc

SEQ ID NO: 3873831 - RNA, 17 nt, Shigella flexneri 2a str. 2457T
cgguagcaugaaccauu

SEQ ID NO: 3873832 - RNA, 20 nt, Shigella flexneri 2a str. 2457T
cgguagcaugaaccauuauc

SEQ ID NO: 3873833 - RNA, 14 nt, Shigella flexneri 2a str. 2457T
cgguagccauuccc

SEQ ID NO: 3873834 - RNA, 20 nt, Shigella flexneri 2a str. 2457T
cgguagccccgcgaacgggg

SEQ ID NO: 3873835 - RNA, 15 nt, Shigella flexneri 2a str. 2457T
cgguagucaccgccc

SEQ ID NO: 3873836 - RNA, 17 nt, Shigella flexneri 2a str. 2457T
cgguaguggcaaccagc

SEQ ID NO: 3873837 - RNA, 17 nt, Shigella flexneri 2a str. 2457T
cgguaguuucagcggcg

SEQ ID NO: 3873838 - RNA, 16 nt, Shigella flexneri 2a str. 2457T
cgguaucaccacccag

SEQ ID NO: 3873839 - RNA, 20 nt, Shigella flexneri 2a str. 2457T
cgguaucaccacccagcggu

SEQ ID NO: 3873840 - RNA, 20 nt, Shigella flexneri 2a str. 2457T
cgguauuaaucugccagcgu

SEQ ID NO: 3873841 - RNA, 17 nt, Shigella flexneri 2a str. 2457T
cggucacaucgcugaca

SEQ ID NO: 3873842 - RNA, 22 nt, Shigella flexneri 2a str. 2457T
cggucagaaaauuauuuuaaau

SEQ ID NO: 3873843 - RNA, 12 nt, Shigella flexneri 2a str. 2457T
cggucagcagca

SEQ ID NO: 3873844 - RNA, 12 nt, Shigella flexneri 2a str. 2457T
cggucagccauu

SEQ ID NO: 3873845 - RNA, 22 nt, Shigella flexneri 2a str. 2457T
cggucauuacgcgguuuauuau

SEQ ID NO: 3873846 - RNA, 23 nt, Shigella flexneri 2a str. 2457T
cgguccgccguagccgguaaugg

SEQ ID NO: 3873847 - RNA, 19 nt, Shigella flexneri 2a str. 2457T
cggucgaggcaaccagcac

SEQ ID NO: 3873848 - RNA, 20 nt, Shigella flexneri 2a str. 2457T
cggucgaggcaaccagcacg

SEQ ID NO: 3873849 - RNA, 16 nt, Shigella flexneri 2a str. 2457T
cggucgaugcgcaacg

SEQ ID NO: 3873850 - RNA, 13 nt, Shigella flexneri 2a str. 2457T
cggucgcggaaca

SEQ ID NO: 3873851 - RNA, 15 nt, Shigella flexneri 2a str. 2457T
cggucgcugacgcca

SEQ ID NO: 3873852 - RNA, 17 nt, Shigella flexneri 2a str. 2457T
cggucgcugacgccaug

SEQ ID NO: 3873853 - RNA, 22 nt, Shigella flexneri 2a str. 2457T
cggucggaaaauuauuuuaaau

SEQ ID NO: 3873854 - RNA, 15 nt, Shigella flexneri 2a str. 2457T
cggucggcuucccug

SEQ ID NO: 3873855 - RNA, 20 nt, Shigella flexneri 2a str. 2457T
cggucuaaaucuuccgccgg

SEQ ID NO: 3873856 - RNA, 20 nt, Shigella flexneri 2a str. 2457T
cggucuaccgauccggcacc

SEQ ID NO: 3873857 - RNA, 19 nt, Shigella flexneri 2a str. 2457T
cggucuggauuuggcugcc

SEQ ID NO: 3873858 - RNA, 24 nt, Shigella flexneri 2a str. 2457T
cggugaaaaaccaaucucccagcc

SEQ ID NO: 3873859 - RNA, 12 nt, Shigella flexneri 2a str. 2457T
cggugaaagucc

SEQ ID NO: 3873860 - RNA, 19 nt, Shigella flexneri 2a str. 2457T
cggugaagcgcccugcaau

SEQ ID NO: 3873861 - RNA, 24 nt, Shigella flexneri 2a str. 2457T
cggugacacuuugcgccaucgcca

SEQ ID NO: 3873862 - RNA, 15 nt, Shigella flexneri 2a str. 2457T
cggugacagcgagcg

SEQ ID NO: 3873863 - RNA, 13 nt, Shigella flexneri 2a str. 2457T
cggugaccagcag

SEQ ID NO: 3873864 - RNA, 18 nt, Shigella flexneri 2a str. 2457T
cggugacgcaaccgcaaa

SEQ ID NO: 3873865 - RNA, 14 nt, Shigella flexneri 2a str. 2457T
cggugagcugcauc

SEQ ID NO: 3873866 - RNA, 12 nt, Shigella flexneri 2a str. 2457T
cggugauaaacc

SEQ ID NO: 3873867 - RNA, 18 nt, Shigella flexneri 2a str. 2457T
cggugauaaucaucccac

SEQ ID NO: 3873868 - RNA, 14 nt, Shigella flexneri 2a str. 2457T
cggugauacagcaa

SEQ ID NO: 3873869 - RNA, 20 nt, Shigella flexneri 2a str. 2457T
cggugauauacgucacuuca

SEQ ID NO: 3873870 - RNA, 21 nt, Shigella flexneri 2a str. 2457T
cggugauauacgucacuucau

SEQ ID NO: 3873871 - RNA, 13 nt, Shigella flexneri 2a str. 2457T
cggugaugaugcu

SEQ ID NO: 3873872 - RNA, 13 nt, Shigella flexneri 2a str. 2457T
cggugauuuccgc

SEQ ID NO: 3873873 - RNA, 22 nt, Shigella flexneri 2a str. 2457T
cggugauuuccgccgccagcag

SEQ ID NO: 3873874 - RNA, 18 nt, Shigella flexneri 2a str. 2457T
cggugcaaaugccagaua

SEQ ID NO: 3873875 - RNA, 14 nt, Shigella flexneri 2a str. 2457T
cggugcacuccgcc

SEQ ID NO: 3873876 - RNA, 18 nt, Shigella flexneri 2a str. 2457T
cggugccaaagucaucaa

SEQ ID NO: 3873877 - RNA, 23 nt, Shigella flexneri 2a str. 2457T
cggugccgcgauaccacccgcag

SEQ ID NO: 3873878 - RNA, 15 nt, Shigella flexneri 2a str. 2457T
cggugcgaacaauca

SEQ ID NO: 3873879 - RNA, 13 nt, Shigella flexneri 2a str. 2457T
cggugcgagcgcc

SEQ ID NO: 3873880 - RNA, 15 nt, Shigella flexneri 2a str. 2457T
cggugcgcagccgcg

SEQ ID NO: 3873881 - RNA, 22 nt, Shigella flexneri 2a str. 2457T
cggugcgggaguugaucgccaa

SEQ ID NO: 3873882 - RNA, 17 nt, Shigella flexneri 2a str. 2457T
cggugcgguaagcugcg

SEQ ID NO: 3873883 - RNA, 15 nt, Shigella flexneri 2a str. 2457T
cggugcguugucauc

SEQ ID NO: 3873884 - RNA, 21 nt, Shigella flexneri 2a str. 2457T
cggugcucaucagcccggcaa

SEQ ID NO: 3873885 - RNA, 15 nt, Shigella flexneri 2a str. 2457T
cggugcuccagugcg

SEQ ID NO: 3873886 - RNA, 13 nt, Shigella flexneri 2a str. 2457T
cggugcuggucug

SEQ ID NO: 3873887 - RNA, 16 nt, Shigella flexneri 2a str. 2457T
cguacccgccugauag

SEQ ID NO: 3873888 - RNA, 22 nt, Shigella flexneri 2a str. 2457T
cguaccgcagcaauggccggaa

SEQ ID NO: 3873889 - RNA, 21 nt, Shigella flexneri 2a str. 2457T
cguacgggcaaagcgacgcgc

SEQ ID NO: 3873890 - RNA, 19 nt, Shigella flexneri 2a str. 2457T
cguacgggucgggcugugu

SEQ ID NO: 3873891 - RNA, 16 nt, Shigella flexneri 2a str. 2457T
cguacguuaacagccu

SEQ ID NO: 3873892 - RNA, 16 nt, Shigella flexneri 2a str. 2457T
cguacucaccgcucac

SEQ ID NO: 3873893 - RNA, 14 nt, Shigella flexneri 2a str. 2457T
cguacuccaucucg

SEQ ID NO: 3873894 - RNA, 21 nt, Shigella flexneri 2a str. 2457T
cguacucugccacuacccgca

SEQ ID NO: 3873895 - RNA, 15 nt, Shigella flexneri 2a str. 2457T
cguacugcugaauga

SEQ ID NO: 3873896 - RNA, 16 nt, Shigella flexneri 2a str. 2457T
cguacuggcaaucgcc

SEQ ID NO: 3873897 - RNA, 18 nt, Shigella flexneri 2a str. 2457T
cguacuggcaaucgccag

SEQ ID NO: 3873898 - RNA, 21 nt, Shigella flexneri 2a str. 2457T
cguacuggcaaucgccagcgg

SEQ ID NO: 3873899 - RNA, 23 nt, Shigella flexneri 2a str. 2457T
cguacuggcaaucgccagcggca

SEQ ID NO: 3873900 - RNA, 16 nt, Shigella flexneri 2a str. 2457T
cguacuguuauccgcc

SEQ ID NO: 3873901 - RNA, 12 nt, Shigella flexneri 2a str. 2457T
cguacuuccuua

SEQ ID NO: 3873902 - RNA, 16 nt, Shigella flexneri 2a str. 2457T
cguacuugccaauacg

SEQ ID NO: 3873903 - RNA, 19 nt, Shigella flexneri 2a str. 2457T
cguagaagccauuaaacac

SEQ ID NO: 3873904 - RNA, 14 nt, Shigella flexneri 2a str. 2457T
cguagacugcagcg

SEQ ID NO: 3873905 - RNA, 13 nt, Shigella flexneri 2a str. 2457T
cguagcgcaucag

SEQ ID NO: 3873906 - RNA, 16 nt, Shigella flexneri 2a str. 2457T
cguagcguuuuuucau

SEQ ID NO: 3873907 - RNA, 21 nt, Shigella flexneri 2a str. 2457T
cguagcuggcggcaaugaaag

SEQ ID NO: 3873908 - RNA, 17 nt, Shigella flexneri 2a str. 2457T
cguagcuguucaggaga

SEQ ID NO: 3873909 - RNA, 20 nt, Shigella flexneri 2a str. 2457T
cguaggccagauaaggcguu

SEQ ID NO: 3873910 - RNA, 21 nt, Shigella flexneri 2a str. 2457T
cguaggccagcggcuccccgc

SEQ ID NO: 3873911 - RNA, 20 nt, Shigella flexneri 2a str. 2457T
cguaggccugauaagcguag

SEQ ID NO: 3873912 - RNA, 20 nt, Shigella flexneri 2a str. 2457T
cguaggcuggauaaggcguu

SEQ ID NO: 3873913 - RNA, 18 nt, Shigella flexneri 2a str. 2457T
cguagucugaccucuucu

SEQ ID NO: 3873914 - RNA, 19 nt, Shigella flexneri 2a str. 2457T
cguaguguggggaaugaua

SEQ ID NO: 3873915 - RNA, 18 nt, Shigella flexneri 2a str. 2457T
cguauaauaucuuuucuu

SEQ ID NO: 3873916 - RNA, 12 nt, Shigella flexneri 2a str. 2457T
cguauccaucac

SEQ ID NO: 3873917 - RNA, 21 nt, Shigella flexneri 2a str. 2457T
cguauccgaugaaucaccaca

SEQ ID NO: 3873918 - RNA, 14 nt, Shigella flexneri 2a str. 2457T
cguaugcccagcgc

SEQ ID NO: 3873919 - RNA, 17 nt, Shigella flexneri 2a str. 2457T
cguauggcgacaaggcg

SEQ ID NO: 3873920 - RNA, 23 nt, Shigella flexneri 2a str. 2457T
cguaugguugccgggcuggagag

SEQ ID NO: 3873921 - RNA, 18 nt, Shigella flexneri 2a str. 2457T
cguaugucgaucacccaa

SEQ ID NO: 3873922 - RNA, 17 nt, Shigella flexneri 2a str. 2457T
cguauguggugggcgaa

SEQ ID NO: 3873923 - RNA, 12 nt, Shigella flexneri 2a str. 2457T
cguauuaauucc

SEQ ID NO: 3873924 - RNA, 14 nt, Shigella flexneri 2a str. 2457T
cguauuaugcacac

SEQ ID NO: 3873925 - RNA, 22 nt, Shigella flexneri 2a str. 2457T
cguauucaacgaaggccugcau

SEQ ID NO: 3873926 - RNA, 18 nt, Shigella flexneri 2a str. 2457T
cguauucaacgguaaguu

SEQ ID NO: 3873927 - RNA, 23 nt, Shigella flexneri 2a str. 2457T
cguauuccgcguuacccauucaa

SEQ ID NO: 3873928 - RNA, 22 nt, Shigella flexneri 2a str. 2457T
cguauucggcaagcguaacgug

SEQ ID NO: 3873929 - RNA, 22 nt, Shigella flexneri 2a str. 2457T
cguauugagaucaccugcugga

SEQ ID NO: 3873930 - RNA, 22 nt, Shigella flexneri 2a str. 2457T
cguauugcgcagagaugcccau

SEQ ID NO: 3873931 - RNA, 14 nt, Shigella flexneri 2a str. 2457T
cguauugcgccggu

SEQ ID NO: 3873932 - RNA, 18 nt, Shigella flexneri 2a str. 2457T
cguauugguacauaacac

SEQ ID NO: 3873933 - RNA, 15 nt, Shigella flexneri 2a str. 2457T
cguauuucagcccca

SEQ ID NO: 3873934 - RNA, 18 nt, Shigella flexneri 2a str. 2457T
cgucaaaaaacuucuuca

SEQ ID NO: 3873935 - RNA, 13 nt, Shigella flexneri 2a str. 2457T
cgucaaaaucauc

SEQ ID NO: 3873936 - RNA, 14 nt, Shigella flexneri 2a str. 2457T
cgucaacagggcag

SEQ ID NO: 3873937 - RNA, 17 nt, Shigella flexneri 2a str. 2457T
cgucaaccugaccaaau

SEQ ID NO: 3873938 - RNA, 23 nt, Shigella flexneri 2a str. 2457T
cgucaacuuuguuagcgaauaaa

SEQ ID NO: 3873939 - RNA, 18 nt, Shigella flexneri 2a str. 2457T
cgucaagcgucgcaucag

SEQ ID NO: 3873940 - RNA, 17 nt, Shigella flexneri 2a str. 2457T
cgucaaggguugccgga

SEQ ID NO: 3873941 - RNA, 13 nt, Shigella flexneri 2a str. 2457T
cgucaaucugccc

SEQ ID NO: 3873942 - RNA, 20 nt, Shigella flexneri 2a str. 2457T
cgucaauuuguuccgccagc

SEQ ID NO: 3873943 - RNA, 21 nt, Shigella flexneri 2a str. 2457T
cgucaauuuguuccgccagcg

SEQ ID NO: 3873944 - RNA, 22 nt, Shigella flexneri 2a str. 2457T
cgucaauuuuaagcagaucggc

SEQ ID NO: 3873945 - RNA, 13 nt, Shigella flexneri 2a str. 2457T
cgucacaccuuca

SEQ ID NO: 3873946 - RNA, 23 nt, Shigella flexneri 2a str. 2457T
cgucacagcggcuuccaccgccg

SEQ ID NO: 3873947 - RNA, 19 nt, Shigella flexneri 2a str. 2457T
cgucacaggcacaccgccg

SEQ ID NO: 3873948 - RNA, 13 nt, Shigella flexneri 2a str. 2457T
cgucacaggccau

SEQ ID NO: 3873949 - RNA, 12 nt, Shigella flexneri 2a str. 2457T
cgucaccaccug

SEQ ID NO: 3873950 - RNA, 16 nt, Shigella flexneri 2a str. 2457T
cgucaccaccugggug

SEQ ID NO: 3873951 - RNA, 13 nt, Shigella flexneri 2a str. 2457T
cgucaccacuuca

SEQ ID NO: 3873952 - RNA, 14 nt, Shigella flexneri 2a str. 2457T
cgucaccacuucac

SEQ ID NO: 3873953 - RNA, 13 nt, Shigella flexneri 2a str. 2457T
cgucaccggaacc

SEQ ID NO: 3873954 - RNA, 14 nt, Shigella flexneri 2a str. 2457T
cgucaccugcccgg

SEQ ID NO: 3873955 - RNA, 15 nt, Shigella flexneri 2a str. 2457T
cgucaccuugccagu

SEQ ID NO: 3873956 - RNA, 16 nt, Shigella flexneri 2a str. 2457T
cgucacggacucggcg

SEQ ID NO: 3873957 - RNA, 23 nt, Shigella flexneri 2a str. 2457T
cgucacgguaauaacacucggcg

SEQ ID NO: 3873958 - RNA, 21 nt, Shigella flexneri 2a str. 2457T
cgucacuggugugucaucugc

SEQ ID NO: 3873959 - RNA, 16 nt, Shigella flexneri 2a str. 2457T
cgucacugguucaaag

SEQ ID NO: 3873960 - RNA, 23 nt, Shigella flexneri 2a str. 2457T
cgucagaaaaaucaauauuuuca

SEQ ID NO: 3873961 - RNA, 13 nt, Shigella flexneri 2a str. 2457T
cgucagaaacagu

SEQ ID NO: 3873962 - RNA, 21 nt, Shigella flexneri 2a str. 2457T
cgucagaccggcaaccagcac

SEQ ID NO: 3873963 - RNA, 17 nt, Shigella flexneri 2a str. 2457T
cgucagcaaaauacuga

SEQ ID NO: 3873964 - RNA, 23 nt, Shigella flexneri 2a str. 2457T
cgucagcaguucacgcagcuucu

SEQ ID NO: 3873965 - RNA, 16 nt, Shigella flexneri 2a str. 2457T
cgucagcauguuuaua

SEQ ID NO: 3873966 - RNA, 17 nt, Shigella flexneri 2a str. 2457T
cgucagccacuccacug

SEQ ID NO: 3873967 - RNA, 23 nt, Shigella flexneri 2a str. 2457T
cgucagccacuucuuccagcggc

SEQ ID NO: 3873968 - RNA, 15 nt, Shigella flexneri 2a str. 2457T
cgucagccagaaaga

SEQ ID NO: 3873969 - RNA, 15 nt, Shigella flexneri 2a str. 2457T
cgucagccugcucag

SEQ ID NO: 3873970 - RNA, 17 nt, Shigella flexneri 2a str. 2457T
cgucagcgaguugauca

SEQ ID NO: 3873971 - RNA, 20 nt, Shigella flexneri 2a str. 2457T
cgucagcgucgcaucuggca

SEQ ID NO: 3873972 - RNA, 16 nt, Shigella flexneri 2a str. 2457T
cgucagcucgcugcca

SEQ ID NO: 3873973 - RNA, 13 nt, Shigella flexneri 2a str. 2457T
cgucagcuuucag

SEQ ID NO: 3873974 - RNA, 14 nt, Shigella flexneri 2a str. 2457T
cgucaggagcugga

SEQ ID NO: 3873975 - RNA, 14 nt, Shigella flexneri 2a str. 2457T
cgucaggauaaacu

SEQ ID NO: 3873976 - RNA, 15 nt, Shigella flexneri 2a str. 2457T
cgucaggcaaccgcu

SEQ ID NO: 3873977 - RNA, 18 nt, Shigella flexneri 2a str. 2457T
cgucaggcgcgugaaugc

SEQ ID NO: 3873978 - RNA, 17 nt, Shigella flexneri 2a str. 2457T
cgucaguaaccgcuuuu

SEQ ID NO: 3873979 - RNA, 21 nt, Shigella flexneri 2a str. 2457T
cgucaguacauagccaucugc

SEQ ID NO: 3873980 - RNA, 18 nt, Shigella flexneri 2a str. 2457T
cgucagucacaccgcgcg

SEQ ID NO: 3873981 - RNA, 21 nt, Shigella flexneri 2a str. 2457T
cgucagucacaccgcgcgucc

SEQ ID NO: 3873982 - RNA, 20 nt, Shigella flexneri 2a str. 2457T
cgucagugucuuaucuggca

SEQ ID NO: 3873983 - RNA, 23 nt, Shigella flexneri 2a str. 2457T
cgucagugucuuaucuggcauuu

SEQ ID NO: 3873984 - RNA, 23 nt, Shigella flexneri 2a str. 2457T
cgugacgucucaaucaccaccag

SEQ ID NO: 3873985 - RNA, 15 nt, Shigella flexneri 2a str. 2457T
cgugacuaaaacccu

SEQ ID NO: 3873986 - RNA, 16 nt, Shigella flexneri 2a str. 2457T
cgugacuuccagcgua

SEQ ID NO: 3873987 - RNA, 16 nt, Shigella flexneri 2a str. 2457T
cgugagaacaccaccu

SEQ ID NO: 3873988 - RNA, 21 nt, Shigella flexneri 2a str. 2457T
cgugagcguauuggugaauug

SEQ ID NO: 3873989 - RNA, 11 nt, Shigella flexneri 2a str. 2457T
cgugagcuggg

SEQ ID NO: 3873990 - RNA, 20 nt, Shigella flexneri 2a str. 2457T
cgugagggaaacaacaccgu

SEQ ID NO: 3873991 - RNA, 14 nt, Shigella flexneri 2a str. 2457T
cgugagguaacaau

SEQ ID NO: 3873992 - RNA, 20 nt, Shigella flexneri 2a str. 2457T
cgugauccaccccugauuaa

SEQ ID NO: 3873993 - RNA, 20 nt, Shigella flexneri 2a str. 2457T
cgugaucgaacaucugcgug

SEQ ID NO: 3873994 - RNA, 22 nt, Shigella flexneri 2a str. 2457T
cgugaucgucuucaaccgcagu

SEQ ID NO: 3873995 - RNA, 15 nt, Shigella flexneri 2a str. 2457T
cgugaugcuugaugu

SEQ ID NO: 3873996 - RNA, 14 nt, Shigella flexneri 2a str. 2457T
cgugauugguuuca

SEQ ID NO: 3873997 - RNA, 20 nt, Shigella flexneri 2a str. 2457T
cgugauugucggugccggaa

SEQ ID NO: 3873998 - RNA, 23 nt, Shigella flexneri 2a str. 2457T
cgugauuguggcaaucauauuca

SEQ ID NO: 3873999 - RNA, 16 nt, Shigella flexneri 2a str. 2457T
cgugauuuagcaccga

SEQ ID NO: 3874000 - RNA, 20 nt, Shigella flexneri 2a str. 2457T
cgugcacgaacgguccccuc

SEQ ID NO: 3874001 - RNA, 16 nt, Shigella flexneri 2a str. 2457T
cgugcacugaaauuuu

SEQ ID NO: 3874002 - RNA, 21 nt, Shigella flexneri 2a str. 2457T
cgugcagaccgcugacggcag

SEQ ID NO: 3874003 - RNA, 20 nt, Shigella flexneri 2a str. 2457T
cgugcauagcagcacaccac

SEQ ID NO: 3874004 - RNA, 16 nt, Shigella flexneri 2a str. 2457T
cgugcauuucucacuu

SEQ ID NO: 3874005 - RNA, 16 nt, Shigella flexneri 2a str. 2457T
cgugccaccagugcag

SEQ ID NO: 3874006 - RNA, 12 nt, Shigella flexneri 2a str. 2457T
cgugccagaacu

SEQ ID NO: 3874007 - RNA, 19 nt, Shigella flexneri 2a str. 2457T
cgugccagaacugauaacg

SEQ ID NO: 3874008 - RNA, 13 nt, Shigella flexneri 2a str. 2457T
cgugccagagcau

SEQ ID NO: 3874009 - RNA, 13 nt, Shigella flexneri 2a str. 2457T
cgugccagauguu

SEQ ID NO: 3874010 - RNA, 23 nt, Shigella flexneri 2a str. 2457T
cgugccagauguuugaacugggc

SEQ ID NO: 3874011 - RNA, 11 nt, Shigella flexneri 2a str. 2457T
cgugccauaaa

SEQ ID NO: 3874012 - RNA, 15 nt, Shigella flexneri 2a str. 2457T
cgugccauuaauguc

SEQ ID NO: 3874013 - RNA, 19 nt, Shigella flexneri 2a str. 2457T
cgugcccaacugccugaug

SEQ ID NO: 3874014 - RNA, 22 nt, Shigella flexneri 2a str. 2457T
cgugcccacguucaugccgacg

SEQ ID NO: 3874015 - RNA, 13 nt, Shigella flexneri 2a str. 2457T
cgugccgccagca

SEQ ID NO: 3874016 - RNA, 23 nt, Shigella flexneri 2a str. 2457T
cgugcgaauaaugguaucgacac

SEQ ID NO: 3874017 - RNA, 14 nt, Shigella flexneri 2a str. 2457T
cgugcgcuuuuuag

SEQ ID NO: 3874018 - RNA, 19 nt, Shigella flexneri 2a str. 2457T
cgugcggccguuccauuca

SEQ ID NO: 3874019 - RNA, 16 nt, Shigella flexneri 2a str. 2457T
cgugcgggcacaggcg

SEQ ID NO: 3874020 - RNA, 17 nt, Shigella flexneri 2a str. 2457T
cgugcgggcaucaucuu

SEQ ID NO: 3874021 - RNA, 14 nt, Shigella flexneri 2a str. 2457T
cgugcguuuguagg

SEQ ID NO: 3874022 - RNA, 16 nt, Shigella flexneri 2a str. 2457T
cgugcuaacguuuagu

SEQ ID NO: 3874023 - RNA, 16 nt, Shigella flexneri 2a str. 2457T
cgugcucgaacauccc

SEQ ID NO: 3874024 - RNA, 19 nt, Shigella flexneri 2a str. 2457T
cgugcucgacagcgcuaau

SEQ ID NO: 3874025 - RNA, 15 nt, Shigella flexneri 2a str. 2457T
cgugcugcgcagacg

SEQ ID NO: 3874026 - RNA, 22 nt, Shigella flexneri 2a str. 2457T
cgugcugguggucagcagcuuu

SEQ ID NO: 3874027 - RNA, 15 nt, Shigella flexneri 2a str. 2457T
cgugcuguacagcag

SEQ ID NO: 3874028 - RNA, 17 nt, Shigella flexneri 2a str. 2457T
cgugcuguacagcagua

SEQ ID NO: 3874029 - RNA, 20 nt, Shigella flexneri 2a str. 2457T
cguggacggucaacugaugg

SEQ ID NO: 3874030 - RNA, 16 nt, Shigella flexneri 2a str. 2457T
cguggagagcagcauc

SEQ ID NO: 3874031 - RNA, 17 nt, Shigella flexneri 2a str. 2457T
cguggagcaacugcgcu

SEQ ID NO: 3874032 - RNA, 22 nt, Shigella flexneri 2a str. 2457T
cguggaucaagccccagcagga

SEQ ID NO: 3874033 - RNA, 20 nt, Shigella flexneri 2a str. 2457T
cguggauuuaaugccaaucu

SEQ ID NO: 3874034 - RNA, 20 nt, Shigella flexneri 2a str. 2457T
cguggcagggaaucagauuc

SEQ ID NO: 3874035 - RNA, 23 nt, Shigella flexneri 2a str. 2457T
cguggccaugagccaguucuucu

SEQ ID NO: 3874036 - RNA, 20 nt, Shigella flexneri 2a str. 2457T
cguggcccuaggcauagaaa

SEQ ID NO: 3874037 - RNA, 14 nt, Shigella flexneri 2a str. 2457T
cguggccuccaaaa

SEQ ID NO: 3874038 - RNA, 17 nt, Shigella flexneri 2a str. 2457T
cguggcgcagccgucau

SEQ ID NO: 3874039 - RNA, 13 nt, Shigella flexneri 2a str. 2457T
cguggcgcagugc

SEQ ID NO: 3874040 - RNA, 22 nt, Shigella flexneri 2a str. 2457T
cguggcggaaaucuuucauuuc

SEQ ID NO: 3874041 - RNA, 19 nt, Shigella flexneri 2a str. 2457T
cgugggauugccgcuucau

SEQ ID NO: 3874042 - RNA, 17 nt, Shigella flexneri 2a str. 2457T
cgugggcaauauuucgc

SEQ ID NO: 3874043 - RNA, 16 nt, Shigella flexneri 2a str. 2457T
cguggggucucugcaa

SEQ ID NO: 3874044 - RNA, 20 nt, Shigella flexneri 2a str. 2457T
cgugguaagaaggcccauga

SEQ ID NO: 3874045 - RNA, 19 nt, Shigella flexneri 2a str. 2457T
cgugguucauaugauucau

SEQ ID NO: 3874046 - RNA, 13 nt, Shigella flexneri 2a str. 2457T
cguguaggccuga

SEQ ID NO: 3874047 - RNA, 21 nt, Shigella flexneri 2a str. 2457T
cgugucauaacuggucaucaa

SEQ ID NO: 3874048 - RNA, 22 nt, Shigella flexneri 2a str. 2457T
cgugucggugcucaucagcccg

SEQ ID NO: 3874049 - RNA, 18 nt, Shigella flexneri 2a str. 2457T
cgugucuuaucaggccua

SEQ ID NO: 3874050 - RNA, 14 nt, Shigella flexneri 2a str. 2457T
cguguuaauuaccu

SEQ ID NO: 3874051 - RNA, 13 nt, Shigella flexneri 2a str. 2457T
cguguucaugacc

SEQ ID NO: 3874052 - RNA, 12 nt, Shigella flexneri 2a str. 2457T
cguguuccaguu

SEQ ID NO: 3874053 - RNA, 17 nt, Shigella flexneri 2a str. 2457T
cguguugaggaagcgca

SEQ ID NO: 3874054 - RNA, 22 nt, Shigella flexneri 2a str. 2457T
cguguugcaccgaguucuucac

SEQ ID NO: 3874055 - RNA, 19 nt, Shigella flexneri 2a str. 2457T
cguguugucagcucaucca

SEQ ID NO: 3874056 - RNA, 22 nt, Shigella flexneri 2a str. 2457T
cguguuuagcccuucacgcacc

SEQ ID NO: 3874057 - RNA, 12 nt, Shigella flexneri 2a str. 2457T
cguguuucagaa

SEQ ID NO: 3874058 - RNA, 18 nt, Shigella flexneri 2a str. 2457T
cguuaaaacuaaaaacag

SEQ ID NO: 3874059 - RNA, 15 nt, Shigella flexneri 2a str. 2457T
cguuaaccacuucag

SEQ ID NO: 3874060 - RNA, 23 nt, Shigella flexneri 2a str. 2457T
cguuaacguuuuucgcugucggu

SEQ ID NO: 3874061 - RNA, 20 nt, Shigella flexneri 2a str. 2457T
cguuaagaaaacggaagcuc

SEQ ID NO: 3874062 - RNA, 18 nt, Shigella flexneri 2a str. 2457T
cguuaagcuggaaaucaa

SEQ ID NO: 3874063 - RNA, 21 nt, Shigella flexneri 2a str. 2457T
cguuacccacaguuucauauc

SEQ ID NO: 3874064 - RNA, 15 nt, Shigella flexneri 2a str. 2457T
cguuacccagcacgg

SEQ ID NO: 3874065 - RNA, 22 nt, Shigella flexneri 2a str. 2457T
cguuaccguaccaaccgcaauu

SEQ ID NO: 3874066 - RNA, 16 nt, Shigella flexneri 2a str. 2457T
cguuacgccccaacac

SEQ ID NO: 3874067 - RNA, 19 nt, Shigella flexneri 2a str. 2457T
cguuacguaccacgcacag

SEQ ID NO: 3874068 - RNA, 12 nt, Shigella flexneri 2a str. 2457T
cguuacguacuu

SEQ ID NO: 3874069 - RNA, 22 nt, Shigella flexneri 2a str. 2457T
cguuagaaaacgccugcuccuc

SEQ ID NO: 3874070 - RNA, 20 nt, Shigella flexneri 2a str. 2457T
cguuagccagcgcaccagcg

SEQ ID NO: 3874071 - RNA, 20 nt, Shigella flexneri 2a str. 2457T
cguuagugucuuaucuggca

SEQ ID NO: 3874072 - RNA, 22 nt, Shigella flexneri 2a str. 2457T
cguuauacaucgcuuuccaggu

SEQ ID NO: 3874073 - RNA, 15 nt, Shigella flexneri 2a str. 2457T
cguuaugaucagcaa

SEQ ID NO: 3874074 - RNA, 16 nt, Shigella flexneri 2a str. 2457T
cguuauguaacaacug

SEQ ID NO: 3874075 - RNA, 15 nt, Shigella flexneri 2a str. 2457T
cguuaugucucccgc

SEQ ID NO: 3874076 - RNA, 16 nt, Shigella flexneri 2a str. 2457T
cguuauucagccugac

SEQ ID NO: 3874077 - RNA, 15 nt, Shigella flexneri 2a str. 2457T
cguucaaaacggcug

SEQ ID NO: 3874078 - RNA, 21 nt, Shigella flexneri 2a str. 2457T
cguucaaaacggcuggugauu

SEQ ID NO: 3874079 - RNA, 15 nt, Shigella flexneri 2a str. 2457T
cguucaaccacuuca

SEQ ID NO: 3874080 - RNA, 20 nt, Shigella flexneri 2a str. 2457T
cguucaagugcguucacccc

SEQ ID NO: 3874081 - RNA, 16 nt, Shigella flexneri 2a str. 2457T
cguuuuuugaaacagg

SEQ ID NO: 3874082 - RNA, 15 nt, Shigella flexneri 2a str. 2457T
cguuuuuuguacucu

SEQ ID NO: 3874083 - RNA, 12 nt, Shigella flexneri 2a str. 2457T
cuaaaaaauccc

SEQ ID NO: 3874084 - RNA, 13 nt, Shigella flexneri 2a str. 2457T
cuaaaaaaugacg

SEQ ID NO: 3874085 - RNA, 16 nt, Shigella flexneri 2a str. 2457T
cuaaaagcacgccaga

SEQ ID NO: 3874086 - RNA, 24 nt, Shigella flexneri 2a str. 2457T
cuaaaagcauagccccagcgcaga

SEQ ID NO: 3874087 - RNA, 14 nt, Shigella flexneri 2a str. 2457T
cuaaacaacgccgc

SEQ ID NO: 3874088 - RNA, 23 nt, Shigella flexneri 2a str. 2457T
cuaaaccagguauccaguuucug

SEQ ID NO: 3874089 - RNA, 23 nt, Shigella flexneri 2a str. 2457T
cuaaaccaucaggaugacaaacu

SEQ ID NO: 3874090 - RNA, 19 nt, Shigella flexneri 2a str. 2457T
cuaaacccgaccacuucca

SEQ ID NO: 3874091 - RNA, 11 nt, Shigella flexneri 2a str. 2457T
cuaaacgcugg

SEQ ID NO: 3874092 - RNA, 16 nt, Shigella flexneri 2a str. 2457T
cuaaacguuagcacga

SEQ ID NO: 3874093 - RNA, 17 nt, Shigella flexneri 2a str. 2457T
cuaaacguuuaaaaacu

SEQ ID NO: 3874094 - RNA, 18 nt, Shigella flexneri 2a str. 2457T
cuaaacguuuaaaaacuu

SEQ ID NO: 3874095 - RNA, 17 nt, Shigella flexneri 2a str. 2457T
cuaaagaagccgccaga

SEQ ID NO: 3874096 - RNA, 14 nt, Shigella flexneri 2a str. 2457T
cuaaagccugcuuu

SEQ ID NO: 3874097 - RNA, 19 nt, Shigella flexneri 2a str. 2457T
cuaaagccugcuuugacaa

SEQ ID NO: 3874098 - RNA, 18 nt, Shigella flexneri 2a str. 2457T
cuaaagccuuuugccagu

SEQ ID NO: 3874099 - RNA, 16 nt, Shigella flexneri 2a str. 2457T
cuaaaggcaaaaugcc

SEQ ID NO: 3874100 - RNA, 18 nt, Shigella flexneri 2a str. 2457T
cuaaaguacguaaaacaa

SEQ ID NO: 3874101 - RNA, 16 nt, Shigella flexneri 2a str. 2457T
cuaaaucacaccauug

SEQ ID NO: 3874102 - RNA, 22 nt, Shigella flexneri 2a str. 2457T
cuaaaucuggugcuuuuucaac

SEQ ID NO: 3874103 - RNA, 15 nt, Shigella flexneri 2a str. 2457T
cuaaaugcugcagcc

SEQ ID NO: 3874104 - RNA, 14 nt, Shigella flexneri 2a str. 2457T
cuaaauguucaaua

SEQ ID NO: 3874105 - RNA, 19 nt, Shigella flexneri 2a str. 2457T
cuaacaaucucaaccgcuu

SEQ ID NO: 3874106 - RNA, 19 nt, Shigella flexneri 2a str. 2457T
cuaacacaugcaagucgaa

SEQ ID NO: 3874107 - RNA, 20 nt, Shigella flexneri 2a str. 2457T
cuaacacugcguacagcgcg

SEQ ID NO: 3874108 - RNA, 15 nt, Shigella flexneri 2a str. 2457T
cuaacagaacaauaa

SEQ ID NO: 3874109 - RNA, 20 nt, Shigella flexneri 2a str. 2457T
cuaacagaacaauaauaacu

SEQ ID NO: 3874110 - RNA, 14 nt, Shigella flexneri 2a str. 2457T
cuaacagaucaucc

SEQ ID NO: 3874111 - RNA, 14 nt, Shigella flexneri 2a str. 2457T
cuaacagcaauccc

SEQ ID NO: 3874112 - RNA, 12 nt, Shigella flexneri 2a str. 2457T
cuaacagcagca

SEQ ID NO: 3874113 - RNA, 13 nt, Shigella flexneri 2a str. 2457T
cuaacaggcuuuu

SEQ ID NO: 3874114 - RNA, 12 nt, Shigella flexneri 2a str. 2457T
cuaacaucaucc

SEQ ID NO: 3874115 - RNA, 15 nt, Shigella flexneri 2a str. 2457T
cuaacauuuuacuua

SEQ ID NO: 3874116 - RNA, 23 nt, Shigella flexneri 2a str. 2457T
cuaaccauuauuaaauuuaauaa

SEQ ID NO: 3874117 - RNA, 22 nt, Shigella flexneri 2a str. 2457T
cuaacccgcagcuuaaugaacu

SEQ ID NO: 3874118 - RNA, 17 nt, Shigella flexneri 2a str. 2457T
cuaacccucuccccaag

SEQ ID NO: 3874119 - RNA, 15 nt, Shigella flexneri 2a str. 2457T
cuaaccgaauucaaa

SEQ ID NO: 3874120 - RNA, 15 nt, Shigella flexneri 2a str. 2457T
cuaaccgcuuuucca

SEQ ID NO: 3874121 - RNA, 18 nt, Shigella flexneri 2a str. 2457T
cuaaccgcuuuuccagca

SEQ ID NO: 3874122 - RNA, 22 nt, Shigella flexneri 2a str. 2457T
cuaaccugagagugauuaacug

SEQ ID NO: 3874123 - RNA, 16 nt, Shigella flexneri 2a str. 2457T
cuaacgaugccagcac

SEQ ID NO: 3874124 - RNA, 18 nt, Shigella flexneri 2a str. 2457T
cuaacgaugccagcaccg

SEQ ID NO: 3874125 - RNA, 18 nt, Shigella flexneri 2a str. 2457T
cuaacgcgucuuaucugg

SEQ ID NO: 3874126 - RNA, 14 nt, Shigella flexneri 2a str. 2457T
cuaacggaauugcc

SEQ ID NO: 3874127 - RNA, 19 nt, Shigella flexneri 2a str. 2457T
cuaacggugcacgcuuuau

SEQ ID NO: 3874128 - RNA, 18 nt, Shigella flexneri 2a str. 2457T
cuaacgucuaguaaagca

SEQ ID NO: 3874129 - RNA, 15 nt, Shigella flexneri 2a str. 2457T
cuaacguuuuuaaaa

SEQ ID NO: 3874130 - RNA, 20 nt, Shigella flexneri 2a str. 2457T
cuaacucauuuuuuaauaug

SEQ ID NO: 3874131 - RNA, 14 nt, Shigella flexneri 2a str. 2457T
cuaacugacuuccg

SEQ ID NO: 3874132 - RNA, 14 nt, Shigella flexneri 2a str. 2457T
cuaacuucuuuuuc

SEQ ID NO: 3874133 - RNA, 15 nt, Shigella flexneri 2a str. 2457T
cuaacuucuuuuucg

SEQ ID NO: 3874134 - RNA, 15 nt, Shigella flexneri 2a str. 2457T
cuaagcaggcuggcu

SEQ ID NO: 3874135 - RNA, 15 nt, Shigella flexneri 2a str. 2457T
cuaagccauuuaacu

SEQ ID NO: 3874136 - RNA, 24 nt, Shigella flexneri 2a str. 2457T
cuaagcgcacuuugucaucagucu

SEQ ID NO: 3874137 - RNA, 19 nt, Shigella flexneri 2a str. 2457T
cuaagcgccaccgucagug

SEQ ID NO: 3874138 - RNA, 16 nt, Shigella flexneri 2a str. 2457T
cuaaggcagccagaug

SEQ ID NO: 3874139 - RNA, 18 nt, Shigella flexneri 2a str. 2457T
cuaaguugaaucggcugc

SEQ ID NO: 3874140 - RNA, 13 nt, Shigella flexneri 2a str. 2457T
cuaauaauaagcc

SEQ ID NO: 3874141 - RNA, 17 nt, Shigella flexneri 2a str. 2457T
cuaauaauugccccuug

SEQ ID NO: 3874142 - RNA, 15 nt, Shigella flexneri 2a str. 2457T
cuaaucagcuuuucc

SEQ ID NO: 3874143 - RNA, 15 nt, Shigella flexneri 2a str. 2457T
cuaaucaucaucagu

SEQ ID NO: 3874144 - RNA, 23 nt, Shigella flexneri 2a str. 2457T
cuaaucaucuguugugccacauc

SEQ ID NO: 3874145 - RNA, 14 nt, Shigella flexneri 2a str. 2457T
cuaaucgagccgau

SEQ ID NO: 3874146 - RNA, 15 nt, Shigella flexneri 2a str. 2457T
cuaaucgcacaaaau

SEQ ID NO: 3874147 - RNA, 17 nt, Shigella flexneri 2a str. 2457T
cuaaucgcacaaaauca

SEQ ID NO: 3874148 - RNA, 23 nt, Shigella flexneri 2a str. 2457T
cuaaucguccgauuaaaaacccu

SEQ ID NO: 3874149 - RNA, 11 nt, Shigella flexneri 2a str. 2457T
cuaaucugaau

SEQ ID NO: 3874150 - RNA, 17 nt, Shigella flexneri 2a str. 2457T
cuaaucuugaaaccaga

SEQ ID NO: 3874151 - RNA, 16 nt, Shigella flexneri 2a str. 2457T
cuaaugauugccggac

SEQ ID NO: 3874152 - RNA, 15 nt, Shigella flexneri 2a str. 2457T
cuaaugccugagaca

SEQ ID NO: 3874153 - RNA, 15 nt, Shigella flexneri 2a str. 2457T
cuaauggugaacuga

SEQ ID NO: 3874154 - RNA, 15 nt, Shigella flexneri 2a str. 2457T
cuaauguauggcgau

SEQ ID NO: 3874155 - RNA, 20 nt, Shigella flexneri 2a str. 2457T
cuaauuuagugaccaaucau

SEQ ID NO: 3874156 - RNA, 18 nt, Shigella flexneri 2a str. 2457T
cuaauuuuuccagcauuu

SEQ ID NO: 3874157 - RNA, 20 nt, Shigella flexneri 2a str. 2457T
cuaauuuuucccucuucaau

SEQ ID NO: 3874158 - RNA, 18 nt, Shigella flexneri 2a str. 2457T
cuaauuuuuugcgccacu

SEQ ID NO: 3874159 - RNA, 22 nt, Shigella flexneri 2a str. 2457T
cuacaaaaccacacuucuucag

SEQ ID NO: 3874160 - RNA, 14 nt, Shigella flexneri 2a str. 2457T
cuacaaaaccugca

SEQ ID NO: 3874161 - RNA, 23 nt, Shigella flexneri 2a str. 2457T
cuacaaaaucgugcaaauucaau

SEQ ID NO: 3874162 - RNA, 14 nt, Shigella flexneri 2a str. 2457T
cuacaaaaucuauu

SEQ ID NO: 3874163 - RNA, 23 nt, Shigella flexneri 2a str. 2457T
cuacaaaaucuugcaaauucaau

SEQ ID NO: 3874164 - RNA, 23 nt, Shigella flexneri 2a str. 2457T
cuacaaaauuguguaaauucaau

SEQ ID NO: 3874165 - RNA, 18 nt, Shigella flexneri 2a str. 2457T
cuacaaacguugcugacu

SEQ ID NO: 3874166 - RNA, 15 nt, Shigella flexneri 2a str. 2457T
cuacaaauuugugca

SEQ ID NO: 3874167 - RNA, 13 nt, Shigella flexneri 2a str. 2457T
cuacaagcagaga

SEQ ID NO: 3874168 - RNA, 14 nt, Shigella flexneri 2a str. 2457T
cuacaagcagagag

SEQ ID NO: 3874169 - RNA, 18 nt, Shigella flexneri 2a str. 2457T
cuacaagcagagagacaa

SEQ ID NO: 3874170 - RNA, 20 nt, Shigella flexneri 2a str. 2457T
cuacaauauccucaagcguu

SEQ ID NO: 3874171 - RNA, 15 nt, Shigella flexneri 2a str. 2457T
cuacacacuggaucu

SEQ ID NO: 3874172 - RNA, 14 nt, Shigella flexneri 2a str. 2457T
cuacacccagcccc

SEQ ID NO: 3874173 - RNA, 15 nt, Shigella flexneri 2a str. 2457T
cuacacccagccccg

SEQ ID NO: 3874174 - RNA, 14 nt, Shigella flexneri 2a str. 2457T
cuacaccccagcgu

SEQ ID NO: 3874175 - RNA, 22 nt, Shigella flexneri 2a str. 2457T
cuacacgcuaccaaaaaaucaa

SEQ ID NO: 3874176 - RNA, 21 nt, Shigella flexneri 2a str. 2457T
cuacagaggaaucgcuguuga

SEQ ID NO: 3874177 - RNA, 14 nt, Shigella flexneri 2a str. 2457T
cuacagcauauaau

SEQ ID NO: 3874178 - RNA, 14 nt, Shigella flexneri 2a str. 2457T
cuacagccugguga

SEQ ID NO: 3874179 - RNA, 12 nt, Shigella flexneri 2a str. 2457T
cuauuccacgca

SEQ ID NO: 3874180 - RNA, 17 nt, Shigella flexneri 2a str. 2457T
cuauucuuauaaagaaa

SEQ ID NO: 3874181 - RNA, 12 nt, Shigella flexneri 2a str. 2457T
cuauugcaacau

SEQ ID NO: 3874182 - RNA, 13 nt, Shigella flexneri 2a str. 2457T
cuauugcgcuaaa

SEQ ID NO: 3874183 - RNA, 21 nt, Shigella flexneri 2a str. 2457T
cuauuguaguuggaugacauu

SEQ ID NO: 3874184 - RNA, 17 nt, Shigella flexneri 2a str. 2457T
cuauuguugauaaggaa

SEQ ID NO: 3874185 - RNA, 19 nt, Shigella flexneri 2a str. 2457T
cuauuuccaccucccccuu

SEQ ID NO: 3874186 - RNA, 14 nt, Shigella flexneri 2a str. 2457T
cuauuuccggcgac

SEQ ID NO: 3874187 - RNA, 19 nt, Shigella flexneri 2a str. 2457T
cuauuucgucgcuaacggu

SEQ ID NO: 3874188 - RNA, 14 nt, Shigella flexneri 2a str. 2457T
cuauuucuugugca

SEQ ID NO: 3874189 - RNA, 20 nt, Shigella flexneri 2a str. 2457T
cuauuuuccuauugcugcug

SEQ ID NO: 3874190 - RNA, 20 nt, Shigella flexneri 2a str. 2457T
cuauuuuuggaggugaaggu

SEQ ID NO: 3874191 - RNA, 19 nt, Shigella flexneri 2a str. 2457T
cucaaaacguccggcaaua

SEQ ID NO: 3874192 - RNA, 14 nt, Shigella flexneri 2a str. 2457T
cucaaaaucacugg

SEQ ID NO: 3874193 - RNA, 22 nt, Shigella flexneri 2a str. 2457T
cucaaacacgccgauaucgcug

SEQ ID NO: 3874194 - RNA, 16 nt, Shigella flexneri 2a str. 2457T
cucaaaccaauggcau

SEQ ID NO: 3874195 - RNA, 15 nt, Shigella flexneri 2a str. 2457T
cucaaaccauuuugc

SEQ ID NO: 3874196 - RNA, 17 nt, Shigella flexneri 2a str. 2457T
cucaaaccggcuccaga

SEQ ID NO: 3874197 - RNA, 18 nt, Shigella flexneri 2a str. 2457T
cucaaacuucgucacagc

SEQ ID NO: 3874198 - RNA, 23 nt, Shigella flexneri 2a str. 2457T
cucaaagccgucgagggccugaa

SEQ ID NO: 3874199 - RNA, 16 nt, Shigella flexneri 2a str. 2457T
cucaaaguaaucaagc

SEQ ID NO: 3874200 - RNA, 19 nt, Shigella flexneri 2a str. 2457T
cucaaaguaaucaagcccu

SEQ ID NO: 3874201 - RNA, 11 nt, Shigella flexneri 2a str. 2457T
cucaacaaaau

SEQ ID NO: 3874202 - RNA, 19 nt, Shigella flexneri 2a str. 2457T
cucaacaacgcucccggau

SEQ ID NO: 3874203 - RNA, 12 nt, Shigella flexneri 2a str. 2457T
cucaacaggccc

SEQ ID NO: 3874204 - RNA, 19 nt, Shigella flexneri 2a str. 2457T
cucaacccuuuuuuaaaca

SEQ ID NO: 3874205 - RNA, 17 nt, Shigella flexneri 2a str. 2457T
cucaaccgcuucuuucu

SEQ ID NO: 3874206 - RNA, 18 nt, Shigella flexneri 2a str. 2457T
cucaacgacugaaccggc

SEQ ID NO: 3874207 - RNA, 21 nt, Shigella flexneri 2a str. 2457T
cucaacgccuaaugccagcga

SEQ ID NO: 3874208 - RNA, 14 nt, Shigella flexneri 2a str. 2457T
cucaacuccccgca

SEQ ID NO: 3874209 - RNA, 21 nt, Shigella flexneri 2a str. 2457T
cucaacugacugacgugauga

SEQ ID NO: 3874210 - RNA, 23 nt, Shigella flexneri 2a str. 2457T
cucaacugccaguucccccugcc

SEQ ID NO: 3874211 - RNA, 13 nt, Shigella flexneri 2a str. 2457T
cucaagcgcgucg

SEQ ID NO: 3874212 - RNA, 22 nt, Shigella flexneri 2a str. 2457T
cucaagcguugcuucacgcggg

SEQ ID NO: 3874213 - RNA, 20 nt, Shigella flexneri 2a str. 2457T
cucaauaccugaugagaugc

SEQ ID NO: 3874214 - RNA, 15 nt, Shigella flexneri 2a str. 2457T
cucaauaucaucauu

SEQ ID NO: 3874215 - RNA, 16 nt, Shigella flexneri 2a str. 2457T
cucaauaucaucauuu

SEQ ID NO: 3874216 - RNA, 16 nt, Shigella flexneri 2a str. 2457T
cucaaucaacuccauu

SEQ ID NO: 3874217 - RNA, 20 nt, Shigella flexneri 2a str. 2457T
cucaauccgccaaaacaucu

SEQ ID NO: 3874218 - RNA, 22 nt, Shigella flexneri 2a str. 2457T
cucaauccgggcgauccggcaa

SEQ ID NO: 3874219 - RNA, 18 nt, Shigella flexneri 2a str. 2457T
cucaaucucuuuuuccac

SEQ ID NO: 3874220 - RNA, 20 nt, Shigella flexneri 2a str. 2457T
cucaaucugauagugaucca

SEQ ID NO: 3874221 - RNA, 19 nt, Shigella flexneri 2a str. 2457T
cucaaugacuucgcuuucg

SEQ ID NO: 3874222 - RNA, 21 nt, Shigella flexneri 2a str. 2457T
cucaaugagcaccuuuuuucu

SEQ ID NO: 3874223 - RNA, 19 nt, Shigella flexneri 2a str. 2457T
cucaaugagccggaccucu

SEQ ID NO: 3874224 - RNA, 21 nt, Shigella flexneri 2a str. 2457T
cucaaugagccggaccucuuu

SEQ ID NO: 3874225 - RNA, 18 nt, Shigella flexneri 2a str. 2457T
cucaaugguguuuuccac

SEQ ID NO: 3874226 - RNA, 20 nt, Shigella flexneri 2a str. 2457T
cucaaugguguuuuccaccg

SEQ ID NO: 3874227 - RNA, 14 nt, Shigella flexneri 2a str. 2457T
cucaaugucuguca

SEQ ID NO: 3874228 - RNA, 19 nt, Shigella flexneri 2a str. 2457T
cucaaugucugucauauua

SEQ ID NO: 3874229 - RNA, 19 nt, Shigella flexneri 2a str. 2457T
cucacaaucaucgcaucca

SEQ ID NO: 3874230 - RNA, 22 nt, Shigella flexneri 2a str. 2457T
cucacagaggucuuuucucguu

SEQ ID NO: 3874231 - RNA, 16 nt, Shigella flexneri 2a str. 2457T
cucacagaguauuucc

SEQ ID NO: 3874232 - RNA, 15 nt, Shigella flexneri 2a str. 2457T
cucacagcuaaucau

SEQ ID NO: 3874233 - RNA, 21 nt, Shigella flexneri 2a str. 2457T
cucacagggcucuuaagcacc

SEQ ID NO: 3874234 - RNA, 22 nt, Shigella flexneri 2a str. 2457T
cucacaucaugcgucaccaaca

SEQ ID NO: 3874235 - RNA, 15 nt, Shigella flexneri 2a str. 2457T
cucacaugaguugcu

SEQ ID NO: 3874236 - RNA, 21 nt, Shigella flexneri 2a str. 2457T
cucaccagacaucccagugca

SEQ ID NO: 3874237 - RNA, 21 nt, Shigella flexneri 2a str. 2457T
cucaccagauuauaagccagu

SEQ ID NO: 3874238 - RNA, 17 nt, Shigella flexneri 2a str. 2457T
cucaccagccgcgacau

SEQ ID NO: 3874239 - RNA, 14 nt, Shigella flexneri 2a str. 2457T
cucacccggaggaa

SEQ ID NO: 3874240 - RNA, 18 nt, Shigella flexneri 2a str. 2457T
cucacccggaggaaagca

SEQ ID NO: 3874241 - RNA, 13 nt, Shigella flexneri 2a str. 2457T
cucacccguacag

SEQ ID NO: 3874242 - RNA, 18 nt, Shigella flexneri 2a str. 2457T
cucaccgaugaucgccau

SEQ ID NO: 3874243 - RNA, 20 nt, Shigella flexneri 2a str. 2457T
cucaccgccauauuuaaaga

SEQ ID NO: 3874244 - RNA, 13 nt, Shigella flexneri 2a str. 2457T
cucaccggauaau

SEQ ID NO: 3874245 - RNA, 16 nt, Shigella flexneri 2a str. 2457T
cucaccggauaauucc

SEQ ID NO: 3874246 - RNA, 20 nt, Shigella flexneri 2a str. 2457T
cucaccgguaaagucagcgu

SEQ ID NO: 3874247 - RNA, 19 nt, Shigella flexneri 2a str. 2457T
cucaccuauguggaaacag

SEQ ID NO: 3874248 - RNA, 15 nt, Shigella flexneri 2a str. 2457T
cucaccuuccacgcg

SEQ ID NO: 3874249 - RNA, 21 nt, Shigella flexneri 2a str. 2457T
cucacgcagggugugcuccag

SEQ ID NO: 3874250 - RNA, 19 nt, Shigella flexneri 2a str. 2457T
cucacgccguuaacuucac

SEQ ID NO: 3874251 - RNA, 16 nt, Shigella flexneri 2a str. 2457T
cucacgcgcugccucu

SEQ ID NO: 3874252 - RNA, 23 nt, Shigella flexneri 2a str. 2457T
cucacgggcggcagguugaugau

SEQ ID NO: 3874253 - RNA, 18 nt, Shigella flexneri 2a str. 2457T
cucacuacggcucaguaa

SEQ ID NO: 3874254 - RNA, 21 nt, Shigella flexneri 2a str. 2457T
cucacuauccgccccauuuuu

SEQ ID NO: 3874255 - RNA, 14 nt, Shigella flexneri 2a str. 2457T
cucacucaccgcag

SEQ ID NO: 3874256 - RNA, 12 nt, Shigella flexneri 2a str. 2457T
cucacuccagcc

SEQ ID NO: 3874257 - RNA, 18 nt, Shigella flexneri 2a str. 2457T
cucacuccggccagagca

SEQ ID NO: 3874258 - RNA, 20 nt, Shigella flexneri 2a str. 2457T
cucacugcgaaguuuuuccg

SEQ ID NO: 3874259 - RNA, 15 nt, Shigella flexneri 2a str. 2457T
cucacuguucacuuu

SEQ ID NO: 3874260 - RNA, 18 nt, Shigella flexneri 2a str. 2457T
cucacuguucacuuuugc

SEQ ID NO: 3874261 - RNA, 22 nt, Shigella flexneri 2a str. 2457T
cucacuucgcuuacgccugcca

SEQ ID NO: 3874262 - RNA, 14 nt, Shigella flexneri 2a str. 2457T
cucacuuuucaccg

SEQ ID NO: 3874263 - RNA, 16 nt, Shigella flexneri 2a str. 2457T
cucagaagacgcucca

SEQ ID NO: 3874264 - RNA, 15 nt, Shigella flexneri 2a str. 2457T
cucagaaucacgcca

SEQ ID NO: 3874265 - RNA, 16 nt, Shigella flexneri 2a str. 2457T
cucagaccauauuccc

SEQ ID NO: 3874266 - RNA, 18 nt, Shigella flexneri 2a str. 2457T
cucagauaaaugcaaacg

SEQ ID NO: 3874267 - RNA, 19 nt, Shigella flexneri 2a str. 2457T
cucagauucagauuauguc

SEQ ID NO: 3874268 - RNA, 15 nt, Shigella flexneri 2a str. 2457T
cucagcaacuuccug

SEQ ID NO: 3874269 - RNA, 15 nt, Shigella flexneri 2a str. 2457T
cucagcagacugaua

SEQ ID NO: 3874270 - RNA, 16 nt, Shigella flexneri 2a str. 2457T
cucagcagacugauau

SEQ ID NO: 3874271 - RNA, 22 nt, Shigella flexneri 2a str. 2457T
cucagcauggaaauguuccggc

SEQ ID NO: 3874272 - RNA, 13 nt, Shigella flexneri 2a str. 2457T
cucagccagcugg

SEQ ID NO: 3874273 - RNA, 17 nt, Shigella flexneri 2a str. 2457T
cucagccagcuggcaga

SEQ ID NO: 3874274 - RNA, 15 nt, Shigella flexneri 2a str. 2457T
cucagcccacaucca

SEQ ID NO: 3874275 - RNA, 21 nt, Shigella flexneri 2a str. 2457T
cucagccgcacaccugcauuc

SEQ ID NO: 3874276 - RNA, 21 nt, Shigella flexneri 2a str. 2457T
cucgccccgagaaaaauagca

SEQ ID NO: 3874277 - RNA, 18 nt, Shigella flexneri 2a str. 2457T
cucgccccugcccuuuca

SEQ ID NO: 3874278 - RNA, 14 nt, Shigella flexneri 2a str. 2457T
cucgccgcagagau

SEQ ID NO: 3874279 - RNA, 15 nt, Shigella flexneri 2a str. 2457T
cucgccgcagagauc

SEQ ID NO: 3874280 - RNA, 17 nt, Shigella flexneri 2a str. 2457T
cucgccuaccauccaua

SEQ ID NO: 3874281 - RNA, 15 nt, Shigella flexneri 2a str. 2457T
cucgccuuucacacg

SEQ ID NO: 3874282 - RNA, 16 nt, Shigella flexneri 2a str. 2457T
cucgcgaaccgccugg

SEQ ID NO: 3874283 - RNA, 20 nt, Shigella flexneri 2a str. 2457T
cucgcgaaccgccuggcgcu

SEQ ID NO: 3874284 - RNA, 20 nt, Shigella flexneri 2a str. 2457T
cucgcgaaucuccacgccuu

SEQ ID NO: 3874285 - RNA, 14 nt, Shigella flexneri 2a str. 2457T
cucgcgccgcaucc

SEQ ID NO: 3874286 - RNA, 15 nt, Shigella flexneri 2a str. 2457T
cucgcgcucuucuuc

SEQ ID NO: 3874287 - RNA, 11 nt, Shigella flexneri 2a str. 2457T
cucgcggcgga

SEQ ID NO: 3874288 - RNA, 18 nt, Shigella flexneri 2a str. 2457T
cucgcguucuguugccgc

SEQ ID NO: 3874289 - RNA, 23 nt, Shigella flexneri 2a str. 2457T
cucgcuccauuccaucgccuggu

SEQ ID NO: 3874290 - RNA, 16 nt, Shigella flexneri 2a str. 2457T
cucgcucgagagagaa

SEQ ID NO: 3874291 - RNA, 17 nt, Shigella flexneri 2a str. 2457T
cucgcuggcgcucaagu

SEQ ID NO: 3874292 - RNA, 17 nt, Shigella flexneri 2a str. 2457T
cucgcuguggcagcguu

SEQ ID NO: 3874293 - RNA, 13 nt, Shigella flexneri 2a str. 2457T
cucgcuuuccauu

SEQ ID NO: 3874294 - RNA, 14 nt, Shigella flexneri 2a str. 2457T
cucggauaaggcuu

SEQ ID NO: 3874295 - RNA, 15 nt, Shigella flexneri 2a str. 2457T
cucggcaaagcgcug

SEQ ID NO: 3874296 - RNA, 20 nt, Shigella flexneri 2a str. 2457T
cucggcagaugagacguuau

SEQ ID NO: 3874297 - RNA, 12 nt, Shigella flexneri 2a str. 2457T
cucggcauggau

SEQ ID NO: 3874298 - RNA, 20 nt, Shigella flexneri 2a str. 2457T
cucggcgagcaacgcagcgg

SEQ ID NO: 3874299 - RNA, 21 nt, Shigella flexneri 2a str. 2457T
cucggcgcuaaucaugucugg

SEQ ID NO: 3874300 - RNA, 23 nt, Shigella flexneri 2a str. 2457T
cucggcugacgauaccaggugug

SEQ ID NO: 3874301 - RNA, 21 nt, Shigella flexneri 2a str. 2457T
cucgggaaggcccuuccccuu

SEQ ID NO: 3874302 - RNA, 20 nt, Shigella flexneri 2a str. 2457T
cucgguaaaacuaacgccag

SEQ ID NO: 3874303 - RNA, 18 nt, Shigella flexneri 2a str. 2457T
cucgguaaaaucaacgcc

SEQ ID NO: 3874304 - RNA, 20 nt, Shigella flexneri 2a str. 2457T
cucgguaaaaucaacgccgc

SEQ ID NO: 3874305 - RNA, 23 nt, Shigella flexneri 2a str. 2457T
cucggugaacgccugcgacgugg

SEQ ID NO: 3874306 - RNA, 12 nt, Shigella flexneri 2a str. 2457T
cucggugaccga

SEQ ID NO: 3874307 - RNA, 22 nt, Shigella flexneri 2a str. 2457T
cucggugucguuacgccgcaga

SEQ ID NO: 3874308 - RNA, 18 nt, Shigella flexneri 2a str. 2457T
cucgguugauucgcucug

SEQ ID NO: 3874309 - RNA, 17 nt, Shigella flexneri 2a str. 2457T
cucguaaugcuccggcu

SEQ ID NO: 3874310 - RNA, 19 nt, Shigella flexneri 2a str. 2457T
cucguagcugguaccuuga

SEQ ID NO: 3874311 - RNA, 18 nt, Shigella flexneri 2a str. 2457T
cucgucacaucaccaaca

SEQ ID NO: 3874312 - RNA, 20 nt, Shigella flexneri 2a str. 2457T
cucgucgcgacgaccaccca

SEQ ID NO: 3874313 - RNA, 21 nt, Shigella flexneri 2a str. 2457T
cucgucgcgacgaccacccac

SEQ ID NO: 3874314 - RNA, 12 nt, Shigella flexneri 2a str. 2457T
cucgucgcgcac

SEQ ID NO: 3874315 - RNA, 19 nt, Shigella flexneri 2a str. 2457T
cucgucgcgcacgcccauc

SEQ ID NO: 3874316 - RNA, 23 nt, Shigella flexneri 2a str. 2457T
cucgucggcgguuuucaucaucc

SEQ ID NO: 3874317 - RNA, 23 nt, Shigella flexneri 2a str. 2457T
cucgucguuguucuacgugcgcu

SEQ ID NO: 3874318 - RNA, 19 nt, Shigella flexneri 2a str. 2457T
cucguuaccccuucaucca

SEQ ID NO: 3874319 - RNA, 14 nt, Shigella flexneri 2a str. 2457T
cucguuauuggugg

SEQ ID NO: 3874320 - RNA, 19 nt, Shigella flexneri 2a str. 2457T
cucguugacgaccaggccg

SEQ ID NO: 3874321 - RNA, 22 nt, Shigella flexneri 2a str. 2457T
cucguugccugcgaagcucuuu

SEQ ID NO: 3874322 - RNA, 18 nt, Shigella flexneri 2a str. 2457T
cucguuucgcccugccuu

SEQ ID NO: 3874323 - RNA, 14 nt, Shigella flexneri 2a str. 2457T
cucuaaaaucauca

SEQ ID NO: 3874324 - RNA, 21 nt, Shigella flexneri 2a str. 2457T
cucuaacccguauaaauacug

SEQ ID NO: 3874325 - RNA, 13 nt, Shigella flexneri 2a str. 2457T
cucuaaucaggaa

SEQ ID NO: 3874326 - RNA, 16 nt, Shigella flexneri 2a str. 2457T
cucuacaauauccuca

SEQ ID NO: 3874327 - RNA, 17 nt, Shigella flexneri 2a str. 2457T
cucuacaauauccucaa

SEQ ID NO: 3874328 - RNA, 14 nt, Shigella flexneri 2a str. 2457T
cucuacaccaacgc

SEQ ID NO: 3874329 - RNA, 13 nt, Shigella flexneri 2a str. 2457T
cucuacagcgccc

SEQ ID NO: 3874330 - RNA, 16 nt, Shigella flexneri 2a str. 2457T
cucuacagcgcccgcc

SEQ ID NO: 3874331 - RNA, 22 nt, Shigella flexneri 2a str. 2457T
cucuauccgaucauuagcugga

SEQ ID NO: 3874332 - RNA, 17 nt, Shigella flexneri 2a str. 2457T
cucuauucuuaaaauag

SEQ ID NO: 3874333 - RNA, 13 nt, Shigella flexneri 2a str. 2457T
cucucaaaccccg

SEQ ID NO: 3874334 - RNA, 15 nt, Shigella flexneri 2a str. 2457T
cucucaucacuacag

SEQ ID NO: 3874335 - RNA, 17 nt, Shigella flexneri 2a str. 2457T
cucucaugucugccgca

SEQ ID NO: 3874336 - RNA, 22 nt, Shigella flexneri 2a str. 2457T
cucucccgaaugaccgccccug

SEQ ID NO: 3874337 - RNA, 14 nt, Shigella flexneri 2a str. 2457T
cucuccugccaguu

SEQ ID NO: 3874338 - RNA, 12 nt, Shigella flexneri 2a str. 2457T
cucuccuuuacc

SEQ ID NO: 3874339 - RNA, 18 nt, Shigella flexneri 2a str. 2457T
cucucgcauggggagacc

SEQ ID NO: 3874340 - RNA, 14 nt, Shigella flexneri 2a str. 2457T
cucucgggcaguaa

SEQ ID NO: 3874341 - RNA, 23 nt, Shigella flexneri 2a str. 2457T
cucucgucugccggaacugauga

SEQ ID NO: 3874342 - RNA, 11 nt, Shigella flexneri 2a str. 2457T
cucucugagcc

SEQ ID NO: 3874343 - RNA, 13 nt, Shigella flexneri 2a str. 2457T
cucucugagccag

SEQ ID NO: 3874344 - RNA, 13 nt, Shigella flexneri 2a str. 2457T
cucucugcuauuc

SEQ ID NO: 3874345 - RNA, 20 nt, Shigella flexneri 2a str. 2457T
cucucuggccgcuuccagca

SEQ ID NO: 3874346 - RNA, 11 nt, Shigella flexneri 2a str. 2457T
cucucuuucuc

SEQ ID NO: 3874347 - RNA, 16 nt, Shigella flexneri 2a str. 2457T
cucucuuucuccagcg

SEQ ID NO: 3874348 - RNA, 18 nt, Shigella flexneri 2a str. 2457T
cucucuuucucgcugaca

SEQ ID NO: 3874349 - RNA, 13 nt, Shigella flexneri 2a str. 2457T
cucugaaucgcua

SEQ ID NO: 3874350 - RNA, 21 nt, Shigella flexneri 2a str. 2457T
cucugacgcgcauacucuccu

SEQ ID NO: 3874351 - RNA, 15 nt, Shigella flexneri 2a str. 2457T
cucugauuacccuuc

SEQ ID NO: 3874352 - RNA, 14 nt, Shigella flexneri 2a str. 2457T
cucugcaaauauua

SEQ ID NO: 3874353 - RNA, 15 nt, Shigella flexneri 2a str. 2457T
cucugcaaauauuaa

SEQ ID NO: 3874354 - RNA, 18 nt, Shigella flexneri 2a str. 2457T
cucugcaacgucuucccg

SEQ ID NO: 3874355 - RNA, 19 nt, Shigella flexneri 2a str. 2457T
cucugcucccggcaaugcg

SEQ ID NO: 3874356 - RNA, 12 nt, Shigella flexneri 2a str. 2457T
cucugcugccac

SEQ ID NO: 3874357 - RNA, 13 nt, Shigella flexneri 2a str. 2457T
cucugcugccaca

SEQ ID NO: 3874358 - RNA, 21 nt, Shigella flexneri 2a str. 2457T
cucuggauuuauauaaauaua

SEQ ID NO: 3874359 - RNA, 13 nt, Shigella flexneri 2a str. 2457T
cucuggcaggcuu

SEQ ID NO: 3874360 - RNA, 14 nt, Shigella flexneri 2a str. 2457T
cucuggccgcuucc

SEQ ID NO: 3874361 - RNA, 13 nt, Shigella flexneri 2a str. 2457T
cucuggcgcugga

SEQ ID NO: 3874362 - RNA, 22 nt, Shigella flexneri 2a str. 2457T
cucugggcugaagaguaaaaaa

SEQ ID NO: 3874363 - RNA, 22 nt, Shigella flexneri 2a str. 2457T
cucugguccaacgguuaacagu

SEQ ID NO: 3874364 - RNA, 17 nt, Shigella flexneri 2a str. 2457T
cucuguaaacuccuuuc

SEQ ID NO: 3874365 - RNA, 13 nt, Shigella flexneri 2a str. 2457T
cucuguaauugga

SEQ ID NO: 3874366 - RNA, 23 nt, Shigella flexneri 2a str. 2457T
cucuguaauuggaguaucaccau

SEQ ID NO: 3874367 - RNA, 12 nt, Shigella flexneri 2a str. 2457T
cucuguucugcg

SEQ ID NO: 3874368 - RNA, 21 nt, Shigella flexneri 2a str. 2457T
cucuguuuucucacuggagga

SEQ ID NO: 3874369 - RNA, 16 nt, Shigella flexneri 2a str. 2457T
cucuuaccguaggcca

SEQ ID NO: 3874370 - RNA, 18 nt, Shigella flexneri 2a str. 2457T
cucuuacucuuucaauuu

SEQ ID NO: 3874371 - RNA, 18 nt, Shigella flexneri 2a str. 2457T
cucuucaaacgcuucugg

SEQ ID NO: 3874372 - RNA, 16 nt, Shigella flexneri 2a str. 2457T
cucuucaacacggcgc

SEQ ID NO: 3874373 - RNA, 16 nt, Shigella flexneri 2a str. 2457T
cucuucaacuucagca

SEQ ID NO: 3874374 - RNA, 15 nt, Shigella flexneri 2a str. 2457T
cucuucaauggucag

SEQ ID NO: 3874375 - RNA, 11 nt, Shigella flexneri 2a str. 2457T
cucuucacacc

SEQ ID NO: 3874376 - RNA, 18 nt, Shigella flexneri 2a str. 2457T
cucuucacgcccgcccca

SEQ ID NO: 3874377 - RNA, 17 nt, Shigella flexneri 2a str. 2457T
cucuucacugacuuuuc

SEQ ID NO: 3874378 - RNA, 18 nt, Shigella flexneri 2a str. 2457T
cucuucagcaucaaugac

SEQ ID NO: 3874379 - RNA, 18 nt, Shigella flexneri 2a str. 2457T
cucuucaucgcuaaaaua

SEQ ID NO: 3874380 - RNA, 19 nt, Shigella flexneri 2a str. 2457T
cucuucaucgcuaaaauac

SEQ ID NO: 3874381 - RNA, 15 nt, Shigella flexneri 2a str. 2457T
cucuucaugccucgu

SEQ ID NO: 3874382 - RNA, 20 nt, Shigella flexneri 2a str. 2457T
cucuucauuaaaccagugcc

SEQ ID NO: 3874383 - RNA, 14 nt, Shigella flexneri 2a str. 2457T
cucuucauuaccuu

SEQ ID NO: 3874384 - RNA, 22 nt, Shigella flexneri 2a str. 2457T
cucuuccaggcauuaaauccug

SEQ ID NO: 3874385 - RNA, 11 nt, Shigella flexneri 2a str. 2457T
cucuucccaga

SEQ ID NO: 3874386 - RNA, 15 nt, Shigella flexneri 2a str. 2457T
cucuucccagaccca

SEQ ID NO: 3874387 - RNA, 16 nt, Shigella flexneri 2a str. 2457T
cucuuccggcaccaca

SEQ ID NO: 3874388 - RNA, 14 nt, Shigella flexneri 2a str. 2457T
cucuuccggcgucg

SEQ ID NO: 3874389 - RNA, 17 nt, Shigella flexneri 2a str. 2457T
cucuuccggcucccgca

SEQ ID NO: 3874390 - RNA, 17 nt, Shigella flexneri 2a str. 2457T
cucuucgccugccugca

SEQ ID NO: 3874391 - RNA, 12 nt, Shigella flexneri 2a str. 2457T
cucuucuccuug

SEQ ID NO: 3874392 - RNA, 13 nt, Shigella flexneri 2a str. 2457T
cucuucuuccgcu

SEQ ID NO: 3874393 - RNA, 21 nt, Shigella flexneri 2a str. 2457T
cucuucuucgcgauaaaucag

SEQ ID NO: 3874394 - RNA, 22 nt, Shigella flexneri 2a str. 2457T
cucuugaaauggucgauaucga

SEQ ID NO: 3874395 - RNA, 18 nt, Shigella flexneri 2a str. 2457T
cucuuuaaaaagaaaccu

SEQ ID NO: 3874396 - RNA, 15 nt, Shigella flexneri 2a str. 2457T
cucuuuaaaaaguaa

SEQ ID NO: 3874397 - RNA, 18 nt, Shigella flexneri 2a str. 2457T
cucuuuaaaaaguaaaac

SEQ ID NO: 3874398 - RNA, 18 nt, Shigella flexneri 2a str. 2457T
cucuuuagcauucagagu

SEQ ID NO: 3874399 - RNA, 15 nt, Shigella flexneri 2a str. 2457T
cucuuuauugcaaac

SEQ ID NO: 3874400 - RNA, 13 nt, Shigella flexneri 2a str. 2457T
cucuuucauuuca

SEQ ID NO: 3874401 - RNA, 12 nt, Shigella flexneri 2a str. 2457T
cucuuuccacaa

SEQ ID NO: 3874402 - RNA, 23 nt, Shigella flexneri 2a str. 2457T
cucuuucccggcaaucaccgcca

SEQ ID NO: 3874403 - RNA, 18 nt, Shigella flexneri 2a str. 2457T
cucuuucuaugagaaaau

SEQ ID NO: 3874404 - RNA, 16 nt, Shigella flexneri 2a str. 2457T
cucuuucuucagcacg

SEQ ID NO: 3874405 - RNA, 16 nt, Shigella flexneri 2a str. 2457T
cucuuugaacagccag

SEQ ID NO: 3874406 - RNA, 19 nt, Shigella flexneri 2a str. 2457T
cucuuuuauuucugcuucg

SEQ ID NO: 3874407 - RNA, 20 nt, Shigella flexneri 2a str. 2457T
cucuuuugacgcccccaaac

SEQ ID NO: 3874408 - RNA, 21 nt, Shigella flexneri 2a str. 2457T
cucuuuuguuacuuauuucua

SEQ ID NO: 3874409 - RNA, 23 nt, Shigella flexneri 2a str. 2457T
cucuuuuuauuuacucuccugcg

SEQ ID NO: 3874410 - RNA, 19 nt, Shigella flexneri 2a str. 2457T
cugaaaaaaaauuacaaaa

SEQ ID NO: 3874411 - RNA, 21 nt, Shigella flexneri 2a str. 2457T
cugaaaaaaaauuacaaaaag

SEQ ID NO: 3874412 - RNA, 15 nt, Shigella flexneri 2a str. 2457T
cugaaaagaguagua

SEQ ID NO: 3874413 - RNA, 21 nt, Shigella flexneri 2a str. 2457T
cugaaaagaguaguaauugcu

SEQ ID NO: 3874414 - RNA, 14 nt, Shigella flexneri 2a str. 2457T
cugaaaauggcgcu

SEQ ID NO: 3874415 - RNA, 18 nt, Shigella flexneri 2a str. 2457T
cugaaaauuaacgggcag

SEQ ID NO: 3874416 - RNA, 18 nt, Shigella flexneri 2a str. 2457T
cugaaacucgaccagcag

SEQ ID NO: 3874417 - RNA, 20 nt, Shigella flexneri 2a str. 2457T
cugaaagaagcggugaaaaa

SEQ ID NO: 3874418 - RNA, 17 nt, Shigella flexneri 2a str. 2457T
cugaaagggcaaauaau

SEQ ID NO: 3874419 - RNA, 20 nt, Shigella flexneri 2a str. 2457T
cugaaaguggaaaaauaaca

SEQ ID NO: 3874420 - RNA, 21 nt, Shigella flexneri 2a str. 2457T
cugaaauagaauggcaucaga

SEQ ID NO: 3874421 - RNA, 12 nt, Shigella flexneri 2a str. 2457T
cugaacaaaaaa

SEQ ID NO: 3874422 - RNA, 14 nt, Shigella flexneri 2a str. 2457T
cugaacaagcaaga

SEQ ID NO: 3874423 - RNA, 17 nt, Shigella flexneri 2a str. 2457T
cugaacaagcaagagug

SEQ ID NO: 3874424 - RNA, 11 nt, Shigella flexneri 2a str. 2457T
cugaacagcuu

SEQ ID NO: 3874425 - RNA, 17 nt, Shigella flexneri 2a str. 2457T
cugaacagcuuuuuccu

SEQ ID NO: 3874426 - RNA, 16 nt, Shigella flexneri 2a str. 2457T
cugaacaggcaacaac

SEQ ID NO: 3874427 - RNA, 22 nt, Shigella flexneri 2a str. 2457T
cugaacauuuucuucugccagg

SEQ ID NO: 3874428 - RNA, 24 nt, Shigella flexneri 2a str. 2457T
cugaaccaucgacguccaaucagc

SEQ ID NO: 3874429 - RNA, 20 nt, Shigella flexneri 2a str. 2457T
cugaaccgacgacagauucc

SEQ ID NO: 3874430 - RNA, 17 nt, Shigella flexneri 2a str. 2457T
cugaacgagaaaagcca

SEQ ID NO: 3874431 - RNA, 23 nt, Shigella flexneri 2a str. 2457T
cugaacgugauuaaagaucucaa

SEQ ID NO: 3874432 - RNA, 22 nt, Shigella flexneri 2a str. 2457T
cugaacgugcucugcgccgccu

SEQ ID NO: 3874433 - RNA, 19 nt, Shigella flexneri 2a str. 2457T
cugaacguugcgcuucccg

SEQ ID NO: 3874434 - RNA, 20 nt, Shigella flexneri 2a str. 2457T
cugaacuaaagccuuuugcc

SEQ ID NO: 3874435 - RNA, 21 nt, Shigella flexneri 2a str. 2457T
cugaagaaaauggccagccag

SEQ ID NO: 3874436 - RNA, 23 nt, Shigella flexneri 2a str. 2457T
cugaagaaaauggccagccagca

SEQ ID NO: 3874437 - RNA, 15 nt, Shigella flexneri 2a str. 2457T
cugaagaucaacguc

SEQ ID NO: 3874438 - RNA, 14 nt, Shigella flexneri 2a str. 2457T
cugaagaugcugca

SEQ ID NO: 3874439 - RNA, 19 nt, Shigella flexneri 2a str. 2457T
cugaagcaguuucaccagc

SEQ ID NO: 3874440 - RNA, 14 nt, Shigella flexneri 2a str. 2457T
cugaaggcgcauug

SEQ ID NO: 3874441 - RNA, 15 nt, Shigella flexneri 2a str. 2457T
cugaaggcugccggg

SEQ ID NO: 3874442 - RNA, 17 nt, Shigella flexneri 2a str. 2457T
cugaauaaacucgcaaa

SEQ ID NO: 3874443 - RNA, 19 nt, Shigella flexneri 2a str. 2457T
cugaauaacaccagccaga

SEQ ID NO: 3874444 - RNA, 20 nt, Shigella flexneri 2a str. 2457T
cugaauaacaccagccagaa

SEQ ID NO: 3874445 - RNA, 19 nt, Shigella flexneri 2a str. 2457T
cugaauaacuggcgcgaca

SEQ ID NO: 3874446 - RNA, 11 nt, Shigella flexneri 2a str. 2457T
cugaauaaucg

SEQ ID NO: 3874447 - RNA, 12 nt, Shigella flexneri 2a str. 2457T
cugaauacgcug

SEQ ID NO: 3874448 - RNA, 17 nt, Shigella flexneri 2a str. 2457T
cugaauauccugacuuu

SEQ ID NO: 3874449 - RNA, 15 nt, Shigella flexneri 2a str. 2457T
cugaauaucuuucuc

SEQ ID NO: 3874450 - RNA, 23 nt, Shigella flexneri 2a str. 2457T
cugaauaugagucguaaacaacu

SEQ ID NO: 3874451 - RNA, 15 nt, Shigella flexneri 2a str. 2457T
cugaaucauucaggu

SEQ ID NO: 3874452 - RNA, 13 nt, Shigella flexneri 2a str. 2457T
cugaaugccggau

SEQ ID NO: 3874453 - RNA, 16 nt, Shigella flexneri 2a str. 2457T
cugaaugcucugaggc

SEQ ID NO: 3874454 - RNA, 15 nt, Shigella flexneri 2a str. 2457T
cugaauugugauggu

SEQ ID NO: 3874455 - RNA, 17 nt, Shigella flexneri 2a str. 2457T
cugaauugugaugguuu

SEQ ID NO: 3874456 - RNA, 12 nt, Shigella flexneri 2a str. 2457T
cugaauuuaucg

SEQ ID NO: 3874457 - RNA, 19 nt, Shigella flexneri 2a str. 2457T
cugaauuucagcgccugau

SEQ ID NO: 3874458 - RNA, 21 nt, Shigella flexneri 2a str. 2457T
cugaauuucagcgccugauac

SEQ ID NO: 3874459 - RNA, 15 nt, Shigella flexneri 2a str. 2457T
cugaauuucgccgca

SEQ ID NO: 3874460 - RNA, 12 nt, Shigella flexneri 2a str. 2457T
cugacaaaucag

SEQ ID NO: 3874461 - RNA, 13 nt, Shigella flexneri 2a str. 2457T
cugacaaaucaug

SEQ ID NO: 3874462 - RNA, 23 nt, Shigella flexneri 2a str. 2457T
cugacaaucgcugcggcaauaau

SEQ ID NO: 3874463 - RNA, 14 nt, Shigella flexneri 2a str. 2457T
cugacaauuugccc

SEQ ID NO: 3874464 - RNA, 18 nt, Shigella flexneri 2a str. 2457T
cugacacaggcagcaauc

SEQ ID NO: 3874465 - RNA, 15 nt, Shigella flexneri 2a str. 2457T
cugacaccaucaccc

SEQ ID NO: 3874466 - RNA, 21 nt, Shigella flexneri 2a str. 2457T
cugacacggaacaacggcaaa

SEQ ID NO: 3874467 - RNA, 21 nt, Shigella flexneri 2a str. 2457T
cugacacuauucgccagcacg

SEQ ID NO: 3874468 - RNA, 21 nt, Shigella flexneri 2a str. 2457T
cugacagaaguaaucuacugc

SEQ ID NO: 3874469 - RNA, 21 nt, Shigella flexneri 2a str. 2457T
cugacagauguaaacuuuuuc

SEQ ID NO: 3874470 - RNA, 14 nt, Shigella flexneri 2a str. 2457T
cugacagcaaauac

SEQ ID NO: 3874471 - RNA, 21 nt, Shigella flexneri 2a str. 2457T
cugacagcgcgucuuguacuu

SEQ ID NO: 3874472 - RNA, 17 nt, Shigella flexneri 2a str. 2457T
cugauaacgugcagcuu

SEQ ID NO: 3874473 - RNA, 18 nt, Shigella flexneri 2a str. 2457T
cugauaagacgcgccagc

SEQ ID NO: 3874474 - RNA, 20 nt, Shigella flexneri 2a str. 2457T
cugauaagacgcgccagcgu

SEQ ID NO: 3874475 - RNA, 21 nt, Shigella flexneri 2a str. 2457T
cugauaagacgcguaaagcgu

SEQ ID NO: 3874476 - RNA, 16 nt, Shigella flexneri 2a str. 2457T
cugauaaguuucggag

SEQ ID NO: 3874477 - RNA, 22 nt, Shigella flexneri 2a str. 2457T
cugauaauaaauaacagugccg

SEQ ID NO: 3874478 - RNA, 15 nt, Shigella flexneri 2a str. 2457T
cugauaauccacgcg

SEQ ID NO: 3874479 - RNA, 23 nt, Shigella flexneri 2a str. 2457T
cugauaauccagacuauuugaca

SEQ ID NO: 3874480 - RNA, 14 nt, Shigella flexneri 2a str. 2457T
cugauacaggaagg

SEQ ID NO: 3874481 - RNA, 23 nt, Shigella flexneri 2a str. 2457T
cugauacuccaugaguaacaguc

SEQ ID NO: 3874482 - RNA, 15 nt, Shigella flexneri 2a str. 2457T
cugauaggauuucug

SEQ ID NO: 3874483 - RNA, 15 nt, Shigella flexneri 2a str. 2457T
cugauaguuaaaauu

SEQ ID NO: 3874484 - RNA, 16 nt, Shigella flexneri 2a str. 2457T
cugauaucucaccaga

SEQ ID NO: 3874485 - RNA, 17 nt, Shigella flexneri 2a str. 2457T
cugauaucucaccagau

SEQ ID NO: 3874486 - RNA, 17 nt, Shigella flexneri 2a str. 2457T
cugauauggugguaacu

SEQ ID NO: 3874487 - RNA, 14 nt, Shigella flexneri 2a str. 2457T
cugauauucauauc

SEQ ID NO: 3874488 - RNA, 17 nt, Shigella flexneri 2a str. 2457T
cugaucaauauagauau

SEQ ID NO: 3874489 - RNA, 19 nt, Shigella flexneri 2a str. 2457T
cugauccagcucuucuuca

SEQ ID NO: 3874490 - RNA, 14 nt, Shigella flexneri 2a str. 2457T
cugauccaucgucu

SEQ ID NO: 3874491 - RNA, 19 nt, Shigella flexneri 2a str. 2457T
cugauccgcgcgguagaga

SEQ ID NO: 3874492 - RNA, 13 nt, Shigella flexneri 2a str. 2457T
cugauccgcuucg

SEQ ID NO: 3874493 - RNA, 12 nt, Shigella flexneri 2a str. 2457T
cugauccugcac

SEQ ID NO: 3874494 - RNA, 22 nt, Shigella flexneri 2a str. 2457T
cugaucgcgcaguaaauccgcc

SEQ ID NO: 3874495 - RNA, 15 nt, Shigella flexneri 2a str. 2457T
cugaucgugccagga

SEQ ID NO: 3874496 - RNA, 14 nt, Shigella flexneri 2a str. 2457T
cugaucuuucuuca

SEQ ID NO: 3874497 - RNA, 20 nt, Shigella flexneri 2a str. 2457T
cugaugaacgcgcaggucau

SEQ ID NO: 3874498 - RNA, 15 nt, Shigella flexneri 2a str. 2457T
cugaugaaugguugu

SEQ ID NO: 3874499 - RNA, 16 nt, Shigella flexneri 2a str. 2457T
cugaugacaaacacaa

SEQ ID NO: 3874500 - RNA, 18 nt, Shigella flexneri 2a str. 2457T
cugaugacaaacacaaaa

SEQ ID NO: 3874501 - RNA, 20 nt, Shigella flexneri 2a str. 2457T
cugaugacaaacacaaaacu

SEQ ID NO: 3874502 - RNA, 19 nt, Shigella flexneri 2a str. 2457T
cugaugacaagcguaugau

SEQ ID NO: 3874503 - RNA, 18 nt, Shigella flexneri 2a str. 2457T
cugaugacgcgcuagugc

SEQ ID NO: 3874504 - RNA, 12 nt, Shigella flexneri 2a str. 2457T
cugaugagcaaa

SEQ ID NO: 3874505 - RNA, 18 nt, Shigella flexneri 2a str. 2457T
cugaugagcaaaucgcgg

SEQ ID NO: 3874506 - RNA, 15 nt, Shigella flexneri 2a str. 2457T
cugaugauauuuuuc

SEQ ID NO: 3874507 - RNA, 16 nt, Shigella flexneri 2a str. 2457T
cugaugauauuuuucc

SEQ ID NO: 3874508 - RNA, 15 nt, Shigella flexneri 2a str. 2457T
cugaugcgacgcuga

SEQ ID NO: 3874509 - RNA, 22 nt, Shigella flexneri 2a str. 2457T
cugaugcgacgcugauagcguc

SEQ ID NO: 3874510 - RNA, 22 nt, Shigella flexneri 2a str. 2457T
cugaugcgacgcuggcgcgucu

SEQ ID NO: 3874511 - RNA, 22 nt, Shigella flexneri 2a str. 2457T
cugaugcgacgcuugcgcgucu

SEQ ID NO: 3874512 - RNA, 21 nt, Shigella flexneri 2a str. 2457T
cugaugcgcuaugcuuaucag

SEQ ID NO: 3874513 - RNA, 19 nt, Shigella flexneri 2a str. 2457T
cugaugcgcugggcaacaa

SEQ ID NO: 3874514 - RNA, 23 nt, Shigella flexneri 2a str. 2457T
cugaugcugugaauauucauuuc

SEQ ID NO: 3874515 - RNA, 19 nt, Shigella flexneri 2a str. 2457T
cugauggaagacauagcac

SEQ ID NO: 3874516 - RNA, 16 nt, Shigella flexneri 2a str. 2457T
cugauggacauucucc

SEQ ID NO: 3874517 - RNA, 21 nt, Shigella flexneri 2a str. 2457T
cugauggcggcugguuaaaua

SEQ ID NO: 3874518 - RNA, 18 nt, Shigella flexneri 2a str. 2457T
cugauggcgggaugugua

SEQ ID NO: 3874519 - RNA, 21 nt, Shigella flexneri 2a str. 2457T
cugaugguugugcuaacucau

SEQ ID NO: 3874520 - RNA, 20 nt, Shigella flexneri 2a str. 2457T
cugauguaaucaacuccgcc

SEQ ID NO: 3874521 - RNA, 13 nt, Shigella flexneri 2a str. 2457T
cugauguagucac

SEQ ID NO: 3874522 - RNA, 15 nt, Shigella flexneri 2a str. 2457T
cugaugucagcacuu

SEQ ID NO: 3874523 - RNA, 22 nt, Shigella flexneri 2a str. 2457T
cugaugucagcacuuccagcuc

SEQ ID NO: 3874524 - RNA, 22 nt, Shigella flexneri 2a str. 2457T
cugaugugauccaucaggucau

SEQ ID NO: 3874525 - RNA, 14 nt, Shigella flexneri 2a str. 2457T
cugaugugaugccc

SEQ ID NO: 3874526 - RNA, 17 nt, Shigella flexneri 2a str. 2457T
cugauguuguuucucuu

SEQ ID NO: 3874527 - RNA, 20 nt, Shigella flexneri 2a str. 2457T
cugauuaauuuucgcccguu

SEQ ID NO: 3874528 - RNA, 14 nt, Shigella flexneri 2a str. 2457T
cugauuacccuucg

SEQ ID NO: 3874529 - RNA, 18 nt, Shigella flexneri 2a str. 2457T
cugauuacccuucgcccu

SEQ ID NO: 3874530 - RNA, 17 nt, Shigella flexneri 2a str. 2457T
cugauuaccgugaauca

SEQ ID NO: 3874531 - RNA, 20 nt, Shigella flexneri 2a str. 2457T
cugauuacgcaccgggcagg

SEQ ID NO: 3874532 - RNA, 20 nt, Shigella flexneri 2a str. 2457T
cugauuauccgcaucacucc

SEQ ID NO: 3874533 - RNA, 22 nt, Shigella flexneri 2a str. 2457T
cugauuauccgcaucacuccac

SEQ ID NO: 3874534 - RNA, 19 nt, Shigella flexneri 2a str. 2457T
cugauucaaaaccgguucu

SEQ ID NO: 3874535 - RNA, 19 nt, Shigella flexneri 2a str. 2457T
cugauuccgguuggccugc

SEQ ID NO: 3874536 - RNA, 16 nt, Shigella flexneri 2a str. 2457T
cugauucgucaauauc

SEQ ID NO: 3874537 - RNA, 16 nt, Shigella flexneri 2a str. 2457T
cugauugaaauagcca

SEQ ID NO: 3874538 - RNA, 17 nt, Shigella flexneri 2a str. 2457T
cugauugaacuguggcg

SEQ ID NO: 3874539 - RNA, 23 nt, Shigella flexneri 2a str. 2457T
cugauugacgcguucgcuaaaga

SEQ ID NO: 3874540 - RNA, 13 nt, Shigella flexneri 2a str. 2457T
cugauugcauaau

SEQ ID NO: 3874541 - RNA, 15 nt, Shigella flexneri 2a str. 2457T
cugauugcugucggc

SEQ ID NO: 3874542 - RNA, 23 nt, Shigella flexneri 2a str. 2457T
cugauuuaaccaacaauaaaauu

SEQ ID NO: 3874543 - RNA, 15 nt, Shigella flexneri 2a str. 2457T
cugauuuauagauuu

SEQ ID NO: 3874544 - RNA, 15 nt, Shigella flexneri 2a str. 2457T
cugauuugcuucaau

SEQ ID NO: 3874545 - RNA, 15 nt, Shigella flexneri 2a str. 2457T
cugauuuucaucuuc

SEQ ID NO: 3874546 - RNA, 19 nt, Shigella flexneri 2a str. 2457T
cugcaaaauagccaaucau

SEQ ID NO: 3874547 - RNA, 20 nt, Shigella flexneri 2a str. 2457T
cugcaaaauagccaaucauu

SEQ ID NO: 3874548 - RNA, 11 nt, Shigella flexneri 2a str. 2457T
cugcaaaccau

SEQ ID NO: 3874549 - RNA, 15 nt, Shigella flexneri 2a str. 2457T
cugcaaacgacguau

SEQ ID NO: 3874550 - RNA, 16 nt, Shigella flexneri 2a str. 2457T
cugcaaagcauuuuuu

SEQ ID NO: 3874551 - RNA, 21 nt, Shigella flexneri 2a str. 2457T
cugcaaagcauuuuuucacau

SEQ ID NO: 3874552 - RNA, 14 nt, Shigella flexneri 2a str. 2457T
cugcaaauacccaa

SEQ ID NO: 3874553 - RNA, 16 nt, Shigella flexneri 2a str. 2457T
cugcaaauauuaauaa

SEQ ID NO: 3874554 - RNA, 17 nt, Shigella flexneri 2a str. 2457T
cugcaaauauuaauaau

SEQ ID NO: 3874555 - RNA, 16 nt, Shigella flexneri 2a str. 2457T
cugcaaaucgaucuca

SEQ ID NO: 3874556 - RNA, 20 nt, Shigella flexneri 2a str. 2457T
cugcaaaucgaucucaauga

SEQ ID NO: 3874557 - RNA, 14 nt, Shigella flexneri 2a str. 2457T
cugcaaauucaaua

SEQ ID NO: 3874558 - RNA, 14 nt, Shigella flexneri 2a str. 2457T
cugcaaauucaucg

SEQ ID NO: 3874559 - RNA, 13 nt, Shigella flexneri 2a str. 2457T
cugcaacagcugu

SEQ ID NO: 3874560 - RNA, 15 nt, Shigella flexneri 2a str. 2457T
cugcaacgucuccgg

SEQ ID NO: 3874561 - RNA, 15 nt, Shigella flexneri 2a str. 2457T
cugcaacgucuuccc

SEQ ID NO: 3874562 - RNA, 19 nt, Shigella flexneri 2a str. 2457T
cugcaagaggaaauaagca

SEQ ID NO: 3874563 - RNA, 18 nt, Shigella flexneri 2a str. 2457T
cugcaaggccauccgcug

SEQ ID NO: 3874564 - RNA, 20 nt, Shigella flexneri 2a str. 2457T
cugcaauaaaauaucuucca

SEQ ID NO: 3874565 - RNA, 15 nt, Shigella flexneri 2a str. 2457T
cugcaauaccgccgu

SEQ ID NO: 3874566 - RNA, 18 nt, Shigella flexneri 2a str. 2457T
cugcaaucuuuaacggcg

SEQ ID NO: 3874567 - RNA, 23 nt, Shigella flexneri 2a str. 2457T
cugcaaucuuuaacggcggcaaa

SEQ ID NO: 3874568 - RNA, 18 nt, Shigella flexneri 2a str. 2457T
cugcacaaauagccagca

SEQ ID NO: 3874569 - RNA, 17 nt, Shigella flexneri 2a str. 2457T
cugccggaaccagccag

SEQ ID NO: 3874570 - RNA, 16 nt, Shigella flexneri 2a str. 2457T
cugccggaacgugcau

SEQ ID NO: 3874571 - RNA, 13 nt, Shigella flexneri 2a str. 2457T
cugccggaagaga

SEQ ID NO: 3874572 - RNA, 17 nt, Shigella flexneri 2a str. 2457T
cugccggaccaucuucc

SEQ ID NO: 3874573 - RNA, 20 nt, Shigella flexneri 2a str. 2457T
cugccggacguucgcccacu

SEQ ID NO: 3874574 - RNA, 20 nt, Shigella flexneri 2a str. 2457T
cugccggaggaguaucugcu

SEQ ID NO: 3874575 - RNA, 21 nt, Shigella flexneri 2a str. 2457T
cugccggaggaguaucugcug

SEQ ID NO: 3874576 - RNA, 22 nt, Shigella flexneri 2a str. 2457T
cugccggaucagcgucgccugg

SEQ ID NO: 3874577 - RNA, 21 nt, Shigella flexneri 2a str. 2457T
cugccgggaagcucucuucca

SEQ ID NO: 3874578 - RNA, 15 nt, Shigella flexneri 2a str. 2457T
cugccggguucgcac

SEQ ID NO: 3874579 - RNA, 17 nt, Shigella flexneri 2a str. 2457T
cugccgguacuucacca

SEQ ID NO: 3874580 - RNA, 15 nt, Shigella flexneri 2a str. 2457T
cugccguacaggcag

SEQ ID NO: 3874581 - RNA, 16 nt, Shigella flexneri 2a str. 2457T
cugccguacaggcagc

SEQ ID NO: 3874582 - RNA, 17 nt, Shigella flexneri 2a str. 2457T
cugccguacaggcagcu

SEQ ID NO: 3874583 - RNA, 19 nt, Shigella flexneri 2a str. 2457T
cugccguacaggcagcuua

SEQ ID NO: 3874584 - RNA, 20 nt, Shigella flexneri 2a str. 2457T
cugccguacaggcagcuuag

SEQ ID NO: 3874585 - RNA, 14 nt, Shigella flexneri 2a str. 2457T
cugccguuaacccg

SEQ ID NO: 3874586 - RNA, 19 nt, Shigella flexneri 2a str. 2457T
cugccguuaacccgucugg

SEQ ID NO: 3874587 - RNA, 13 nt, Shigella flexneri 2a str. 2457T
cugccguugcugc

SEQ ID NO: 3874588 - RNA, 14 nt, Shigella flexneri 2a str. 2457T
cugccuccaugaaa

SEQ ID NO: 3874589 - RNA, 13 nt, Shigella flexneri 2a str. 2457T
cugccucgcagag

SEQ ID NO: 3874590 - RNA, 15 nt, Shigella flexneri 2a str. 2457T
cugccucgcagaguu

SEQ ID NO: 3874591 - RNA, 13 nt, Shigella flexneri 2a str. 2457T
cugccucugaaac

SEQ ID NO: 3874592 - RNA, 20 nt, Shigella flexneri 2a str. 2457T
cugccucugaaacgccaggc

SEQ ID NO: 3874593 - RNA, 17 nt, Shigella flexneri 2a str. 2457T
cugccugauccugggcu

SEQ ID NO: 3874594 - RNA, 15 nt, Shigella flexneri 2a str. 2457T
cugccugaugcgcuc

SEQ ID NO: 3874595 - RNA, 16 nt, Shigella flexneri 2a str. 2457T
cugccugcagcugcuc

SEQ ID NO: 3874596 - RNA, 19 nt, Shigella flexneri 2a str. 2457T
cugccugcggaaugagcga

SEQ ID NO: 3874597 - RNA, 21 nt, Shigella flexneri 2a str. 2457T
cugccugcugauaagacgcau

SEQ ID NO: 3874598 - RNA, 12 nt, Shigella flexneri 2a str. 2457T
cugccugcuggg

SEQ ID NO: 3874599 - RNA, 19 nt, Shigella flexneri 2a str. 2457T
cugccuguacggcagugaa

SEQ ID NO: 3874600 - RNA, 17 nt, Shigella flexneri 2a str. 2457T
cugccuuauccagcaga

SEQ ID NO: 3874601 - RNA, 18 nt, Shigella flexneri 2a str. 2457T
cugccuucacuuccggca

SEQ ID NO: 3874602 - RNA, 21 nt, Shigella flexneri 2a str. 2457T
cugccuugaguuuuucauccc

SEQ ID NO: 3874603 - RNA, 19 nt, Shigella flexneri 2a str. 2457T
cugcgaacgcaaucaaaua

SEQ ID NO: 3874604 - RNA, 17 nt, Shigella flexneri 2a str. 2457T
cugcgaaucgcuucauu

SEQ ID NO: 3874605 - RNA, 18 nt, Shigella flexneri 2a str. 2457T
cugcgaaucgcuucauuu

SEQ ID NO: 3874606 - RNA, 15 nt, Shigella flexneri 2a str. 2457T
cugcgacauauuccc

SEQ ID NO: 3874607 - RNA, 21 nt, Shigella flexneri 2a str. 2457T
cugcgaccggcguaacggcca

SEQ ID NO: 3874608 - RNA, 17 nt, Shigella flexneri 2a str. 2457T
cugcgacgcgcgguggu

SEQ ID NO: 3874609 - RNA, 19 nt, Shigella flexneri 2a str. 2457T
cugcgagauuccgccgcca

SEQ ID NO: 3874610 - RNA, 21 nt, Shigella flexneri 2a str. 2457T
cugcgagguuauccgccagcg

SEQ ID NO: 3874611 - RNA, 21 nt, Shigella flexneri 2a str. 2457T
cugcgauaguggaacaaagaa

SEQ ID NO: 3874612 - RNA, 20 nt, Shigella flexneri 2a str. 2457T
cugcgcaaagaugcgaugga

SEQ ID NO: 3874613 - RNA, 23 nt, Shigella flexneri 2a str. 2457T
cugcgcacacacgcccagcucaa

SEQ ID NO: 3874614 - RNA, 15 nt, Shigella flexneri 2a str. 2457T
cugcgcauaacugcc

SEQ ID NO: 3874615 - RNA, 16 nt, Shigella flexneri 2a str. 2457T
cugcgcauuucccagc

SEQ ID NO: 3874616 - RNA, 12 nt, Shigella flexneri 2a str. 2457T
cugcgccaauac

SEQ ID NO: 3874617 - RNA, 15 nt, Shigella flexneri 2a str. 2457T
cugcgccacuuccca

SEQ ID NO: 3874618 - RNA, 18 nt, Shigella flexneri 2a str. 2457T
cugcgccacuucccagcc

SEQ ID NO: 3874619 - RNA, 12 nt, Shigella flexneri 2a str. 2457T
cugcgccagacg

SEQ ID NO: 3874620 - RNA, 16 nt, Shigella flexneri 2a str. 2457T
cugcgccagcggcagu

SEQ ID NO: 3874621 - RNA, 22 nt, Shigella flexneri 2a str. 2457T
cugcgccaguugcuuauccagc

SEQ ID NO: 3874622 - RNA, 17 nt, Shigella flexneri 2a str. 2457T
cugcgcccagcgugcgu

SEQ ID NO: 3874623 - RNA, 18 nt, Shigella flexneri 2a str. 2457T
cugcgccccacaccacca

SEQ ID NO: 3874624 - RNA, 19 nt, Shigella flexneri 2a str. 2457T
cugcgccccacaccaccau

SEQ ID NO: 3874625 - RNA, 14 nt, Shigella flexneri 2a str. 2457T
cugcgcccgcagcg

SEQ ID NO: 3874626 - RNA, 15 nt, Shigella flexneri 2a str. 2457T
cugcgcccgccagca

SEQ ID NO: 3874627 - RNA, 20 nt, Shigella flexneri 2a str. 2457T
cugcgcccgcccgcuguaag

SEQ ID NO: 3874628 - RNA, 18 nt, Shigella flexneri 2a str. 2457T
cugcgcccugcagcuggu

SEQ ID NO: 3874629 - RNA, 17 nt, Shigella flexneri 2a str. 2457T
cugcgccgagcaauaaa

SEQ ID NO: 3874630 - RNA, 15 nt, Shigella flexneri 2a str. 2457T
cugcgccgccucugc

SEQ ID NO: 3874631 - RNA, 21 nt, Shigella flexneri 2a str. 2457T
cugcgcgaccaucggaucggc

SEQ ID NO: 3874632 - RNA, 21 nt, Shigella flexneri 2a str. 2457T
cugcgcgaccucuucugccug

SEQ ID NO: 3874633 - RNA, 15 nt, Shigella flexneri 2a str. 2457T
cugcgcgaugaugcc

SEQ ID NO: 3874634 - RNA, 19 nt, Shigella flexneri 2a str. 2457T
cugcgcgcuucgcccuucg

SEQ ID NO: 3874635 - RNA, 21 nt, Shigella flexneri 2a str. 2457T
cugcgcgucuuaucaggccug

SEQ ID NO: 3874636 - RNA, 19 nt, Shigella flexneri 2a str. 2457T
cugcgcgugaagcacguaa

SEQ ID NO: 3874637 - RNA, 21 nt, Shigella flexneri 2a str. 2457T
cugcgcuaaacaggaucuggu

SEQ ID NO: 3874638 - RNA, 14 nt, Shigella flexneri 2a str. 2457T
cugcgcugacucua

SEQ ID NO: 3874639 - RNA, 14 nt, Shigella flexneri 2a str. 2457T
cugcgcuggaacaa

SEQ ID NO: 3874640 - RNA, 19 nt, Shigella flexneri 2a str. 2457T
cugcgcuuacacacccggc

SEQ ID NO: 3874641 - RNA, 13 nt, Shigella flexneri 2a str. 2457T
cugcgcuuaucag

SEQ ID NO: 3874642 - RNA, 21 nt, Shigella flexneri 2a str. 2457T
cugcgcuuaucaggccugcaa

SEQ ID NO: 3874643 - RNA, 18 nt, Shigella flexneri 2a str. 2457T
cugcgcuuauccggccca

SEQ ID NO: 3874644 - RNA, 12 nt, Shigella flexneri 2a str. 2457T
cugcgcuuccag

SEQ ID NO: 3874645 - RNA, 14 nt, Shigella flexneri 2a str. 2457T
cugcgcuuccugca

SEQ ID NO: 3874646 - RNA, 21 nt, Shigella flexneri 2a str. 2457T
cugcggaauugccgguacagc

SEQ ID NO: 3874647 - RNA, 16 nt, Shigella flexneri 2a str. 2457T
cugcggacgcaccgcg

SEQ ID NO: 3874648 - RNA, 19 nt, Shigella flexneri 2a str. 2457T
cugcggauccugagcaaac

SEQ ID NO: 3874649 - RNA, 17 nt, Shigella flexneri 2a str. 2457T
cugcggcaagaucgcga

SEQ ID NO: 3874650 - RNA, 22 nt, Shigella flexneri 2a str. 2457T
cugcggcgaugaccgccacggu

SEQ ID NO: 3874651 - RNA, 16 nt, Shigella flexneri 2a str. 2457T
cugcggcgcgcaucuu

SEQ ID NO: 3874652 - RNA, 21 nt, Shigella flexneri 2a str. 2457T
cugcggcgcgcaucuucguua

SEQ ID NO: 3874653 - RNA, 16 nt, Shigella flexneri 2a str. 2457T
cugcggcgugggcgcu

SEQ ID NO: 3874654 - RNA, 23 nt, Shigella flexneri 2a str. 2457T
cugcggcgugggcgcuguugcac

SEQ ID NO: 3874655 - RNA, 17 nt, Shigella flexneri 2a str. 2457T
cugcgggaguugcucca

SEQ ID NO: 3874656 - RNA, 18 nt, Shigella flexneri 2a str. 2457T
cugcgggcgaccaaucaa

SEQ ID NO: 3874657 - RNA, 12 nt, Shigella flexneri 2a str. 2457T
cugcgggcgcaa

SEQ ID NO: 3874658 - RNA, 19 nt, Shigella flexneri 2a str. 2457T
cugcgggcgcaagggcugg

SEQ ID NO: 3874659 - RNA, 16 nt, Shigella flexneri 2a str. 2457T
cugcggguuagucugc

SEQ ID NO: 3874660 - RNA, 21 nt, Shigella flexneri 2a str. 2457T
cugcggguuagucugcauuuu

SEQ ID NO: 3874661 - RNA, 14 nt, Shigella flexneri 2a str. 2457T
cugcggguuggcuu

SEQ ID NO: 3874662 - RNA, 22 nt, Shigella flexneri 2a str. 2457T
cugcgguacggauagccgcccc

SEQ ID NO: 3874663 - RNA, 15 nt, Shigella flexneri 2a str. 2457T
cugcgguucagcuuu

SEQ ID NO: 3874664 - RNA, 13 nt, Shigella flexneri 2a str. 2457T
cugcguaauguuu

SEQ ID NO: 3874665 - RNA, 21 nt, Shigella flexneri 2a str. 2457T
cugcguaauguuuagagacgc

SEQ ID NO: 3874666 - RNA, 23 nt, Shigella flexneri 2a str. 2457T
cuggaauggaaacagcaccaucc

SEQ ID NO: 3874667 - RNA, 18 nt, Shigella flexneri 2a str. 2457T
cuggaauuccuuucccua

SEQ ID NO: 3874668 - RNA, 22 nt, Shigella flexneri 2a str. 2457T
cuggacaacauuccugcugacg

SEQ ID NO: 3874669 - RNA, 15 nt, Shigella flexneri 2a str. 2457T
cuggacaacuucuga

SEQ ID NO: 3874670 - RNA, 15 nt, Shigella flexneri 2a str. 2457T
cuggaccagcggguu

SEQ ID NO: 3874671 - RNA, 16 nt, Shigella flexneri 2a str. 2457T
cuggaccauauuagcc

SEQ ID NO: 3874672 - RNA, 22 nt, Shigella flexneri 2a str. 2457T
cuggacgguggagcaacaggga

SEQ ID NO: 3874673 - RNA, 20 nt, Shigella flexneri 2a str. 2457T
cuggacguugcguugcagca

SEQ ID NO: 3874674 - RNA, 22 nt, Shigella flexneri 2a str. 2457T
cuggacguugcguugcagcagg

SEQ ID NO: 3874675 - RNA, 21 nt, Shigella flexneri 2a str. 2457T
cuggacucccagaacaacccg

SEQ ID NO: 3874676 - RNA, 17 nt, Shigella flexneri 2a str. 2457T
cuggagagggugaccga

SEQ ID NO: 3874677 - RNA, 15 nt, Shigella flexneri 2a str. 2457T
cuggagcaggaacuu

SEQ ID NO: 3874678 - RNA, 12 nt, Shigella flexneri 2a str. 2457T
cuggagcuggac

SEQ ID NO: 3874679 - RNA, 15 nt, Shigella flexneri 2a str. 2457T
cuggagucgucacca

SEQ ID NO: 3874680 - RNA, 23 nt, Shigella flexneri 2a str. 2457T
cuggaguuaaauuaauaaucaca

SEQ ID NO: 3874681 - RNA, 19 nt, Shigella flexneri 2a str. 2457T
cuggaguuauagcuggauu

SEQ ID NO: 3874682 - RNA, 17 nt, Shigella flexneri 2a str. 2457T
cuggaguuccuggauga

SEQ ID NO: 3874683 - RNA, 12 nt, Shigella flexneri 2a str. 2457T
cuggauaaaauu

SEQ ID NO: 3874684 - RNA, 16 nt, Shigella flexneri 2a str. 2457T
cuggauagagcucauu

SEQ ID NO: 3874685 - RNA, 20 nt, Shigella flexneri 2a str. 2457T
cuggauagauauucuccagc

SEQ ID NO: 3874686 - RNA, 12 nt, Shigella flexneri 2a str. 2457T
cuggauccaguc

SEQ ID NO: 3874687 - RNA, 18 nt, Shigella flexneri 2a str. 2457T
cuggaucggcagucugcu

SEQ ID NO: 3874688 - RNA, 17 nt, Shigella flexneri 2a str. 2457T
cuggaucucucaugucu

SEQ ID NO: 3874689 - RNA, 13 nt, Shigella flexneri 2a str. 2457T
cuggaucugcggg

SEQ ID NO: 3874690 - RNA, 21 nt, Shigella flexneri 2a str. 2457T
cuggaugacccggaacuccug

SEQ ID NO: 3874691 - RNA, 14 nt, Shigella flexneri 2a str. 2457T
cuggaugucuggca

SEQ ID NO: 3874692 - RNA, 15 nt, Shigella flexneri 2a str. 2457T
cuggaugucuggcag

SEQ ID NO: 3874693 - RNA, 16 nt, Shigella flexneri 2a str. 2457T
cuggaugucuggcaga

SEQ ID NO: 3874694 - RNA, 17 nt, Shigella flexneri 2a str. 2457T
cuggauuaacgcugggg

SEQ ID NO: 3874695 - RNA, 16 nt, Shigella flexneri 2a str. 2457T
cuggauuuauauaaau

SEQ ID NO: 3874696 - RNA, 19 nt, Shigella flexneri 2a str. 2457T
cuggauuucaauaacucca

SEQ ID NO: 3874697 - RNA, 22 nt, Shigella flexneri 2a str. 2457T
cuggauuucaauaacuccaucu

SEQ ID NO: 3874698 - RNA, 23 nt, Shigella flexneri 2a str. 2457T
cuggauuucaauaacuccaucuu

SEQ ID NO: 3874699 - RNA, 22 nt, Shigella flexneri 2a str. 2457T
cuggauuuggcugccgagcaaa

SEQ ID NO: 3874700 - RNA, 13 nt, Shigella flexneri 2a str. 2457T
cuggcaaaaauaa

SEQ ID NO: 3874701 - RNA, 14 nt, Shigella flexneri 2a str. 2457T
cuggcaaaaauaag

SEQ ID NO: 3874702 - RNA, 15 nt, Shigella flexneri 2a str. 2457T
cuggcaaacgucagc

SEQ ID NO: 3874703 - RNA, 15 nt, Shigella flexneri 2a str. 2457T
cuggcaaaugacaua

SEQ ID NO: 3874704 - RNA, 16 nt, Shigella flexneri 2a str. 2457T
cuggcaacaauggcau

SEQ ID NO: 3874705 - RNA, 16 nt, Shigella flexneri 2a str. 2457T
cuggcaaucgccagcg

SEQ ID NO: 3874706 - RNA, 14 nt, Shigella flexneri 2a str. 2457T
cuggcacaacucgg

SEQ ID NO: 3874707 - RNA, 16 nt, Shigella flexneri 2a str. 2457T
cuggcacaugcauaaa

SEQ ID NO: 3874708 - RNA, 17 nt, Shigella flexneri 2a str. 2457T
cuggcaccgcagaucag

SEQ ID NO: 3874709 - RNA, 13 nt, Shigella flexneri 2a str. 2457T
cuggcacgaccug

SEQ ID NO: 3874710 - RNA, 14 nt, Shigella flexneri 2a str. 2457T
cuggcacgaccugg

SEQ ID NO: 3874711 - RNA, 18 nt, Shigella flexneri 2a str. 2457T
cuggcagaaaguucgcga

SEQ ID NO: 3874712 - RNA, 21 nt, Shigella flexneri 2a str. 2457T
cuggcagagaaagaaacgcca

SEQ ID NO: 3874713 - RNA, 19 nt, Shigella flexneri 2a str. 2457T
cuggcagauaaauuacugc

SEQ ID NO: 3874714 - RNA, 15 nt, Shigella flexneri 2a str. 2457T
cuggcagaugcgucu

SEQ ID NO: 3874715 - RNA, 19 nt, Shigella flexneri 2a str. 2457T
cuggcagcaagugcggcgc

SEQ ID NO: 3874716 - RNA, 20 nt, Shigella flexneri 2a str. 2457T
cuggcaguggugcggcugau

SEQ ID NO: 3874717 - RNA, 13 nt, Shigella flexneri 2a str. 2457T
cuggcaugaaugg

SEQ ID NO: 3874718 - RNA, 17 nt, Shigella flexneri 2a str. 2457T
cuggcauguugauacac

SEQ ID NO: 3874719 - RNA, 19 nt, Shigella flexneri 2a str. 2457T
cuggcauuuggcucucgau

SEQ ID NO: 3874720 - RNA, 13 nt, Shigella flexneri 2a str. 2457T
cuggccacuucug

SEQ ID NO: 3874721 - RNA, 18 nt, Shigella flexneri 2a str. 2457T
cuggccauuucugccagu

SEQ ID NO: 3874722 - RNA, 16 nt, Shigella flexneri 2a str. 2457T
cuggcccaugccaguu

SEQ ID NO: 3874723 - RNA, 22 nt, Shigella flexneri 2a str. 2457T
cuggccgaaaaaggaucaaccg

SEQ ID NO: 3874724 - RNA, 14 nt, Shigella flexneri 2a str. 2457T
cuggccgcuuccag

SEQ ID NO: 3874725 - RNA, 16 nt, Shigella flexneri 2a str. 2457T
cuggccguacccagcu

SEQ ID NO: 3874726 - RNA, 14 nt, Shigella flexneri 2a str. 2457T
cuggccgugcagac

SEQ ID NO: 3874727 - RNA, 15 nt, Shigella flexneri 2a str. 2457T
cuggccgugcagacc

SEQ ID NO: 3874728 - RNA, 14 nt, Shigella flexneri 2a str. 2457T
cuggcgaaccagga

SEQ ID NO: 3874729 - RNA, 17 nt, Shigella flexneri 2a str. 2457T
cuggcgaacgugcagga

SEQ ID NO: 3874730 - RNA, 17 nt, Shigella flexneri 2a str. 2457T
cuggcgaacucuuccgg

SEQ ID NO: 3874731 - RNA, 17 nt, Shigella flexneri 2a str. 2457T
cuggcgaaucaggaccg

SEQ ID NO: 3874732 - RNA, 15 nt, Shigella flexneri 2a str. 2457T
cuggcgacauuuucu

SEQ ID NO: 3874733 - RNA, 19 nt, Shigella flexneri 2a str. 2457T
cuggcgacgccucuauuaa

SEQ ID NO: 3874734 - RNA, 24 nt, Shigella flexneri 2a str. 2457T
cuggcgagcauuaauacaccgcug

SEQ ID NO: 3874735 - RNA, 20 nt, Shigella flexneri 2a str. 2457T
cuggcgcacguucugucgcu

SEQ ID NO: 3874736 - RNA, 12 nt, Shigella flexneri 2a str. 2457T
cuggcgcagcaa

SEQ ID NO: 3874737 - RNA, 11 nt, Shigella flexneri 2a str. 2457T
cuggcgcgcuc

SEQ ID NO: 3874738 - RNA, 18 nt, Shigella flexneri 2a str. 2457T
cuggcgcguuaucgacaa

SEQ ID NO: 3874739 - RNA, 15 nt, Shigella flexneri 2a str. 2457T
cuggcgcuaucaaua

SEQ ID NO: 3874740 - RNA, 22 nt, Shigella flexneri 2a str. 2457T
cuggcgcuggaugucuggcaga

SEQ ID NO: 3874741 - RNA, 23 nt, Shigella flexneri 2a str. 2457T
cuggcgcuguucgggaguugcag

SEQ ID NO: 3874742 - RNA, 18 nt, Shigella flexneri 2a str. 2457T
cuggcggagcucccaggc

SEQ ID NO: 3874743 - RNA, 15 nt, Shigella flexneri 2a str. 2457T
cuggcggaugugcug

SEQ ID NO: 3874744 - RNA, 14 nt, Shigella flexneri 2a str. 2457T
cuggcggcaauaac

SEQ ID NO: 3874745 - RNA, 17 nt, Shigella flexneri 2a str. 2457T
cuggcggcaaucgccag

SEQ ID NO: 3874746 - RNA, 14 nt, Shigella flexneri 2a str. 2457T
cuggcggcagcagg

SEQ ID NO: 3874747 - RNA, 12 nt, Shigella flexneri 2a str. 2457T
cuggcggcggcg

SEQ ID NO: 3874748 - RNA, 19 nt, Shigella flexneri 2a str. 2457T
cuggcgggaauaaaagcca

SEQ ID NO: 3874749 - RNA, 16 nt, Shigella flexneri 2a str. 2457T
cuggcguacagagggc

SEQ ID NO: 3874750 - RNA, 19 nt, Shigella flexneri 2a str. 2457T
cuggcguacagagggcagg

SEQ ID NO: 3874751 - RNA, 14 nt, Shigella flexneri 2a str. 2457T
cuggcguacccauc

SEQ ID NO: 3874752 - RNA, 15 nt, Shigella flexneri 2a str. 2457T
cuggcgucaaagcug

SEQ ID NO: 3874753 - RNA, 21 nt, Shigella flexneri 2a str. 2457T
cuggcgucuggcccaugccag

SEQ ID NO: 3874754 - RNA, 13 nt, Shigella flexneri 2a str. 2457T
cuggcgucugggc

SEQ ID NO: 3874755 - RNA, 15 nt, Shigella flexneri 2a str. 2457T
cuggcgucugggcgu

SEQ ID NO: 3874756 - RNA, 14 nt, Shigella flexneri 2a str. 2457T
cuggcguguuucau

SEQ ID NO: 3874757 - RNA, 14 nt, Shigella flexneri 2a str. 2457T
cuggcuaagaagcc

SEQ ID NO: 3874758 - RNA, 15 nt, Shigella flexneri 2a str. 2457T
cuggcucguggcuga

SEQ ID NO: 3874759 - RNA, 21 nt, Shigella flexneri 2a str. 2457T
cuggcugagcaaacaguucug

SEQ ID NO: 3874760 - RNA, 16 nt, Shigella flexneri 2a str. 2457T
cuggcugcauggcaau

SEQ ID NO: 3874761 - RNA, 17 nt, Shigella flexneri 2a str. 2457T
cuggcugcgcucugacu

SEQ ID NO: 3874762 - RNA, 15 nt, Shigella flexneri 2a str. 2457T
cuggcuggcaucuug

SEQ ID NO: 3874763 - RNA, 19 nt, Shigella flexneri 2a str. 2457T
cuggcugucgaucuccggc

SEQ ID NO: 3874764 - RNA, 22 nt, Shigella flexneri 2a str. 2457T
cuguaccaccagaaucgccagc

SEQ ID NO: 3874765 - RNA, 21 nt, Shigella flexneri 2a str. 2457T
cuguaccagcggcuuccagca

SEQ ID NO: 3874766 - RNA, 21 nt, Shigella flexneri 2a str. 2457T
cuguaccuucacgcgcuccag

SEQ ID NO: 3874767 - RNA, 23 nt, Shigella flexneri 2a str. 2457T
cuguaccuucacgcgcuccagga

SEQ ID NO: 3874768 - RNA, 14 nt, Shigella flexneri 2a str. 2457T
cuguacggcaguga

SEQ ID NO: 3874769 - RNA, 17 nt, Shigella flexneri 2a str. 2457T
cuguacuugagcccugg

SEQ ID NO: 3874770 - RNA, 16 nt, Shigella flexneri 2a str. 2457T
cuguacuuucaacagg

SEQ ID NO: 3874771 - RNA, 18 nt, Shigella flexneri 2a str. 2457T
cuguagagcuaccggcag

SEQ ID NO: 3874772 - RNA, 21 nt, Shigella flexneri 2a str. 2457T
cuguagagcuaccggcaggaa

SEQ ID NO: 3874773 - RNA, 19 nt, Shigella flexneri 2a str. 2457T
cuguagauaaaacacucuu

SEQ ID NO: 3874774 - RNA, 18 nt, Shigella flexneri 2a str. 2457T
cuguaggccagauaagac

SEQ ID NO: 3874775 - RNA, 19 nt, Shigella flexneri 2a str. 2457T
cuguaggccagauaagacg

SEQ ID NO: 3874776 - RNA, 16 nt, Shigella flexneri 2a str. 2457T
cuguaguacaaauuuu

SEQ ID NO: 3874777 - RNA, 18 nt, Shigella flexneri 2a str. 2457T
cuguaguacaaauuuuag

SEQ ID NO: 3874778 - RNA, 18 nt, Shigella flexneri 2a str. 2457T
cuguaguuguuaauguga

SEQ ID NO: 3874779 - RNA, 20 nt, Shigella flexneri 2a str. 2457T
cuguaucaggcugaaaaucu

SEQ ID NO: 3874780 - RNA, 20 nt, Shigella flexneri 2a str. 2457T
cuguaucaugcaguaccaga

SEQ ID NO: 3874781 - RNA, 16 nt, Shigella flexneri 2a str. 2457T
cuguaucgucacuggu

SEQ ID NO: 3874782 - RNA, 18 nt, Shigella flexneri 2a str. 2457T
cuguauggccuggaagcu

SEQ ID NO: 3874783 - RNA, 21 nt, Shigella flexneri 2a str. 2457T
cuguauuagcaucgcgauggc

SEQ ID NO: 3874784 - RNA, 16 nt, Shigella flexneri 2a str. 2457T
cuguauucuucagcga

SEQ ID NO: 3874785 - RNA, 11 nt, Shigella flexneri 2a str. 2457T
cugucaacugc

SEQ ID NO: 3874786 - RNA, 13 nt, Shigella flexneri 2a str. 2457T
cugucaauaaacg

SEQ ID NO: 3874787 - RNA, 17 nt, Shigella flexneri 2a str. 2457T
cugucagguaacaagcc

SEQ ID NO: 3874788 - RNA, 14 nt, Shigella flexneri 2a str. 2457T
cugucauauuaucu

SEQ ID NO: 3874789 - RNA, 19 nt, Shigella flexneri 2a str. 2457T
cuguccaaauccuucagca

SEQ ID NO: 3874790 - RNA, 15 nt, Shigella flexneri 2a str. 2457T
cuguccaccacgcug

SEQ ID NO: 3874791 - RNA, 15 nt, Shigella flexneri 2a str. 2457T
cuguccagcacgccg

SEQ ID NO: 3874792 - RNA, 16 nt, Shigella flexneri 2a str. 2457T
cuguccgcuucaccac

SEQ ID NO: 3874793 - RNA, 18 nt, Shigella flexneri 2a str. 2457T
cuguccgcuucaccaccg

SEQ ID NO: 3874794 - RNA, 19 nt, Shigella flexneri 2a str. 2457T
cuguccgcuucaccaccgc

SEQ ID NO: 3874795 - RNA, 19 nt, Shigella flexneri 2a str. 2457T
cuguccgggcacauuuuua

SEQ ID NO: 3874796 - RNA, 22 nt, Shigella flexneri 2a str. 2457T
cuguccucuucagcaucaauga

SEQ ID NO: 3874797 - RNA, 18 nt, Shigella flexneri 2a str. 2457T
cugucgaacgcuaugacg

SEQ ID NO: 3874798 - RNA, 23 nt, Shigella flexneri 2a str. 2457T
cugucgacaaagccgcaggcgug

SEQ ID NO: 3874799 - RNA, 16 nt, Shigella flexneri 2a str. 2457T
cugucgacuaaccuga

SEQ ID NO: 3874800 - RNA, 16 nt, Shigella flexneri 2a str. 2457T
cugucgauaaacucau

SEQ ID NO: 3874801 - RNA, 13 nt, Shigella flexneri 2a str. 2457T
cugucgcagccag

SEQ ID NO: 3874802 - RNA, 15 nt, Shigella flexneri 2a str. 2457T
cugucgcgcagcacu

SEQ ID NO: 3874803 - RNA, 20 nt, Shigella flexneri 2a str. 2457T
cugucggcaaaucaauagug

SEQ ID NO: 3874804 - RNA, 23 nt, Shigella flexneri 2a str. 2457T
cugucggcaagauacugcauaau

SEQ ID NO: 3874805 - RNA, 22 nt, Shigella flexneri 2a str. 2457T
cugucggcacugaccaccacca

SEQ ID NO: 3874806 - RNA, 17 nt, Shigella flexneri 2a str. 2457T
cugucgggaacacuuua

SEQ ID NO: 3874807 - RNA, 22 nt, Shigella flexneri 2a str. 2457T
cugucggggccagcgcauccau

SEQ ID NO: 3874808 - RNA, 19 nt, Shigella flexneri 2a str. 2457T
cugucggguaagcgccaca

SEQ ID NO: 3874809 - RNA, 20 nt, Shigella flexneri 2a str. 2457T
cugucggguaagcgccacaa

SEQ ID NO: 3874810 - RNA, 21 nt, Shigella flexneri 2a str. 2457T
cugucgggugcuuuuuucaau

SEQ ID NO: 3874811 - RNA, 20 nt, Shigella flexneri 2a str. 2457T
cugucgguuuguacucuucc

SEQ ID NO: 3874812 - RNA, 15 nt, Shigella flexneri 2a str. 2457T
cugucguaacugcgc

SEQ ID NO: 3874813 - RNA, 15 nt, Shigella flexneri 2a str. 2457T
cugucguccagacgc

SEQ ID NO: 3874814 - RNA, 20 nt, Shigella flexneri 2a str. 2457T
cugucguuaaugcgccaagc

SEQ ID NO: 3874815 - RNA, 16 nt, Shigella flexneri 2a str. 2457T
cugucuaauggugaac

SEQ ID NO: 3874816 - RNA, 14 nt, Shigella flexneri 2a str. 2457T
cugucuaccagcac

SEQ ID NO: 3874817 - RNA, 17 nt, Shigella flexneri 2a str. 2457T
cugucuccggcauccag

SEQ ID NO: 3874818 - RNA, 16 nt, Shigella flexneri 2a str. 2457T
cugucucucagcacac

SEQ ID NO: 3874819 - RNA, 15 nt, Shigella flexneri 2a str. 2457T
cugucugauaaaaaa

SEQ ID NO: 3874820 - RNA, 19 nt, Shigella flexneri 2a str. 2457T
cugucugaugauaaucaga

SEQ ID NO: 3874821 - RNA, 22 nt, Shigella flexneri 2a str. 2457T
cugucugcuucugccugggccu

SEQ ID NO: 3874822 - RNA, 19 nt, Shigella flexneri 2a str. 2457T
cugucuggcgucuccugcc

SEQ ID NO: 3874823 - RNA, 16 nt, Shigella flexneri 2a str. 2457T
cugucuguuauuuauu

SEQ ID NO: 3874824 - RNA, 13 nt, Shigella flexneri 2a str. 2457T
cugucuuaacgca

SEQ ID NO: 3874825 - RNA, 12 nt, Shigella flexneri 2a str. 2457T
cugucuuccugu

SEQ ID NO: 3874826 - RNA, 23 nt, Shigella flexneri 2a str. 2457T
cugugaacucaggcugccagauc

SEQ ID NO: 3874827 - RNA, 19 nt, Shigella flexneri 2a str. 2457T
cugugaagauggcuaacua

SEQ ID NO: 3874828 - RNA, 19 nt, Shigella flexneri 2a str. 2457T
cugugacagauuuugccag

SEQ ID NO: 3874829 - RNA, 14 nt, Shigella flexneri 2a str. 2457T
cugugacagcagcg

SEQ ID NO: 3874830 - RNA, 19 nt, Shigella flexneri 2a str. 2457T
cugugauuccgccaguucu

SEQ ID NO: 3874831 - RNA, 12 nt, Shigella flexneri 2a str. 2457T
cugugcaccaga

SEQ ID NO: 3874832 - RNA, 23 nt, Shigella flexneri 2a str. 2457T
cugugcauuuggcgcaucgguca

SEQ ID NO: 3874833 - RNA, 18 nt, Shigella flexneri 2a str. 2457T
cugugccacggcuuugca

SEQ ID NO: 3874834 - RNA, 19 nt, Shigella flexneri 2a str. 2457T
cugugccagcucgugcaga

SEQ ID NO: 3874835 - RNA, 13 nt, Shigella flexneri 2a str. 2457T
cugugccagugcc

SEQ ID NO: 3874836 - RNA, 14 nt, Shigella flexneri 2a str. 2457T
cugugccagugcca

SEQ ID NO: 3874837 - RNA, 17 nt, Shigella flexneri 2a str. 2457T
cugugcccguaaaaaau

SEQ ID NO: 3874838 - RNA, 19 nt, Shigella flexneri 2a str. 2457T
cugugccguaaaucccagu

SEQ ID NO: 3874839 - RNA, 19 nt, Shigella flexneri 2a str. 2457T
cugugcucugggccaugau

SEQ ID NO: 3874840 - RNA, 20 nt, Shigella flexneri 2a str. 2457T
cugugcucugggccaugauc

SEQ ID NO: 3874841 - RNA, 16 nt, Shigella flexneri 2a str. 2457T
cuguggauguuuuacu

SEQ ID NO: 3874842 - RNA, 17 nt, Shigella flexneri 2a str. 2457T
cuguggauucagcaccg

SEQ ID NO: 3874843 - RNA, 17 nt, Shigella flexneri 2a str. 2457T
cugugggguauuuccag

SEQ ID NO: 3874844 - RNA, 20 nt, Shigella flexneri 2a str. 2457T
cuguguaaacccagccgcgu

SEQ ID NO: 3874845 - RNA, 16 nt, Shigella flexneri 2a str. 2457T
cuguguggccugcuuu

SEQ ID NO: 3874846 - RNA, 14 nt, Shigella flexneri 2a str. 2457T
cugugugugcugau

SEQ ID NO: 3874847 - RNA, 17 nt, Shigella flexneri 2a str. 2457T
cuguguuuaugccggau

SEQ ID NO: 3874848 - RNA, 17 nt, Shigella flexneri 2a str. 2457T
cuguuaaggaaauccug

SEQ ID NO: 3874849 - RNA, 19 nt, Shigella flexneri 2a str. 2457T
cuguuaauguuguaagcuu

SEQ ID NO: 3874850 - RNA, 19 nt, Shigella flexneri 2a str. 2457T
cuguuacauaugcgcuggc

SEQ ID NO: 3874851 - RNA, 17 nt, Shigella flexneri 2a str. 2457T
cuguuacgccagaacag

SEQ ID NO: 3874852 - RNA, 15 nt, Shigella flexneri 2a str. 2457T
cuguuacucaacuga

SEQ ID NO: 3874853 - RNA, 20 nt, Shigella flexneri 2a str. 2457T
cuguuaucacuuaacccauu

SEQ ID NO: 3874854 - RNA, 13 nt, Shigella flexneri 2a str. 2457T
cuguucaaacauu

SEQ ID NO: 3874855 - RNA, 13 nt, Shigella flexneri 2a str. 2457T
cuguucagccuga

SEQ ID NO: 3874856 - RNA, 19 nt, Shigella flexneri 2a str. 2457T
cuguucaguacgaaauaac

SEQ ID NO: 3874857 - RNA, 11 nt, Shigella flexneri 2a str. 2457T
cuguuccagca

SEQ ID NO: 3874858 - RNA, 16 nt, Shigella flexneri 2a str. 2457T
cuguuccagcaaaucc

SEQ ID NO: 3874859 - RNA, 12 nt, Shigella flexneri 2a str. 2457T
cuguuccccuca

SEQ ID NO: 3874860 - RNA, 12 nt, Shigella flexneri 2a str. 2457T
cuguucccuucu

SEQ ID NO: 3874861 - RNA, 13 nt, Shigella flexneri 2a str. 2457T
cuuaucaggccua

SEQ ID NO: 3874862 - RNA, 21 nt, Shigella flexneri 2a str. 2457T
cuuaucaggccuacaacuccg

SEQ ID NO: 3874863 - RNA, 18 nt, Shigella flexneri 2a str. 2457T
cuuaucaggccuacaagu

SEQ ID NO: 3874864 - RNA, 19 nt, Shigella flexneri 2a str. 2457T
cuuaucaggccuacaaguc

SEQ ID NO: 3874865 - RNA, 20 nt, Shigella flexneri 2a str. 2457T
cuuaucaggccuaccaauaa

SEQ ID NO: 3874866 - RNA, 14 nt, Shigella flexneri 2a str. 2457T
cuuaucaggccugu

SEQ ID NO: 3874867 - RNA, 23 nt, Shigella flexneri 2a str. 2457T
cuuaucaggccuguggugauuca

SEQ ID NO: 3874868 - RNA, 13 nt, Shigella flexneri 2a str. 2457T
cuuauccagcaga

SEQ ID NO: 3874869 - RNA, 17 nt, Shigella flexneri 2a str. 2457T
cuuauccagccuacaaa

SEQ ID NO: 3874870 - RNA, 23 nt, Shigella flexneri 2a str. 2457T
cuuauccagccuacaaaaacuca

SEQ ID NO: 3874871 - RNA, 14 nt, Shigella flexneri 2a str. 2457T
cuuauccagcugcg

SEQ ID NO: 3874872 - RNA, 14 nt, Shigella flexneri 2a str. 2457T
cuuauccgaugguu

SEQ ID NO: 3874873 - RNA, 19 nt, Shigella flexneri 2a str. 2457T
cuuauccggccuacaaaau

SEQ ID NO: 3874874 - RNA, 22 nt, Shigella flexneri 2a str. 2457T
cuuauccggccuccauaagagu

SEQ ID NO: 3874875 - RNA, 19 nt, Shigella flexneri 2a str. 2457T
cuuauccggcuuaccgcuc

SEQ ID NO: 3874876 - RNA, 13 nt, Shigella flexneri 2a str. 2457T
cuuaucgaagagg

SEQ ID NO: 3874877 - RNA, 18 nt, Shigella flexneri 2a str. 2457T
cuuaucgcccugcuccag

SEQ ID NO: 3874878 - RNA, 23 nt, Shigella flexneri 2a str. 2457T
cuuaucgugccuacacauuaucu

SEQ ID NO: 3874879 - RNA, 14 nt, Shigella flexneri 2a str. 2457T
cuuaucguuauaua

SEQ ID NO: 3874880 - RNA, 11 nt, Shigella flexneri 2a str. 2457T
cuuaucuggca

SEQ ID NO: 3874881 - RNA, 18 nt, Shigella flexneri 2a str. 2457T
cuuaugccacgugagcuu

SEQ ID NO: 3874882 - RNA, 18 nt, Shigella flexneri 2a str. 2457T
cuuaugcccggcacguuu

SEQ ID NO: 3874883 - RNA, 18 nt, Shigella flexneri 2a str. 2457T
cuuaugcgccguuuuuuu

SEQ ID NO: 3874884 - RNA, 20 nt, Shigella flexneri 2a str. 2457T
cuuaugcugcgccaguugcu

SEQ ID NO: 3874885 - RNA, 22 nt, Shigella flexneri 2a str. 2457T
cuuauggcucgccauccaguga

SEQ ID NO: 3874886 - RNA, 13 nt, Shigella flexneri 2a str. 2457T
cuuaugguucacu

SEQ ID NO: 3874887 - RNA, 16 nt, Shigella flexneri 2a str. 2457T
cuuauuaacuucccac

SEQ ID NO: 3874888 - RNA, 19 nt, Shigella flexneri 2a str. 2457T
cuuauuaugaaugauaaaa

SEQ ID NO: 3874889 - RNA, 18 nt, Shigella flexneri 2a str. 2457T
cuuauucaaucucuucac

SEQ ID NO: 3874890 - RNA, 13 nt, Shigella flexneri 2a str. 2457T
cuuauugaagcuc

SEQ ID NO: 3874891 - RNA, 11 nt, Shigella flexneri 2a str. 2457T
cuuauuuacau

SEQ ID NO: 3874892 - RNA, 12 nt, Shigella flexneri 2a str. 2457T
cuucaaaaauaa

SEQ ID NO: 3874893 - RNA, 19 nt, Shigella flexneri 2a str. 2457T
cuucaaauagugccuggcu

SEQ ID NO: 3874894 - RNA, 17 nt, Shigella flexneri 2a str. 2457T
cuucaacacacugaaua

SEQ ID NO: 3874895 - RNA, 17 nt, Shigella flexneri 2a str. 2457T
cuucaacacaggccggc

SEQ ID NO: 3874896 - RNA, 13 nt, Shigella flexneri 2a str. 2457T
cuucaacaccccu

SEQ ID NO: 3874897 - RNA, 16 nt, Shigella flexneri 2a str. 2457T
cuucaacacuggcaaa

SEQ ID NO: 3874898 - RNA, 14 nt, Shigella flexneri 2a str. 2457T
cuucaaccacauuc

SEQ ID NO: 3874899 - RNA, 18 nt, Shigella flexneri 2a str. 2457T
cuucaaccgucaccagcc

SEQ ID NO: 3874900 - RNA, 23 nt, Shigella flexneri 2a str. 2457T
cuucaaccgucgcgcccuccugc

SEQ ID NO: 3874901 - RNA, 15 nt, Shigella flexneri 2a str. 2457T
cuucaaggcgcugca

SEQ ID NO: 3874902 - RNA, 20 nt, Shigella flexneri 2a str. 2457T
cuucaaguguggccgccagu

SEQ ID NO: 3874903 - RNA, 16 nt, Shigella flexneri 2a str. 2457T
cuucaauauuaaugcu

SEQ ID NO: 3874904 - RNA, 12 nt, Shigella flexneri 2a str. 2457T
cuucaaucaaua

SEQ ID NO: 3874905 - RNA, 11 nt, Shigella flexneri 2a str. 2457T
cuucaaucgcc

SEQ ID NO: 3874906 - RNA, 17 nt, Shigella flexneri 2a str. 2457T
cuucaaucgccaccaca

SEQ ID NO: 3874907 - RNA, 14 nt, Shigella flexneri 2a str. 2457T
cuucaauggucagc

SEQ ID NO: 3874908 - RNA, 19 nt, Shigella flexneri 2a str. 2457T
cuucaauggucagccacag

SEQ ID NO: 3874909 - RNA, 18 nt, Shigella flexneri 2a str. 2457T
cuucaauuuccugacguc

SEQ ID NO: 3874910 - RNA, 16 nt, Shigella flexneri 2a str. 2457T
cuucacaaaggcuugc

SEQ ID NO: 3874911 - RNA, 16 nt, Shigella flexneri 2a str. 2457T
cuucacaaucagcgcg

SEQ ID NO: 3874912 - RNA, 19 nt, Shigella flexneri 2a str. 2457T
cuucacacacuuuuauuaa

SEQ ID NO: 3874913 - RNA, 12 nt, Shigella flexneri 2a str. 2457T
cuucacacugau

SEQ ID NO: 3874914 - RNA, 12 nt, Shigella flexneri 2a str. 2457T
cuucacaggccg

SEQ ID NO: 3874915 - RNA, 16 nt, Shigella flexneri 2a str. 2457T
cuucacaguggcgagc

SEQ ID NO: 3874916 - RNA, 14 nt, Shigella flexneri 2a str. 2457T
cuucaccaaucaga

SEQ ID NO: 3874917 - RNA, 22 nt, Shigella flexneri 2a str. 2457T
cuucaccagcagcgucaacacu

SEQ ID NO: 3874918 - RNA, 14 nt, Shigella flexneri 2a str. 2457T
cuucaccagccugc

SEQ ID NO: 3874919 - RNA, 23 nt, Shigella flexneri 2a str. 2457T
cuucacccauugccgccucugcc

SEQ ID NO: 3874920 - RNA, 16 nt, Shigella flexneri 2a str. 2457T
cuucacccgcagcacg

SEQ ID NO: 3874921 - RNA, 20 nt, Shigella flexneri 2a str. 2457T
cuucaccugccggaagcccg

SEQ ID NO: 3874922 - RNA, 20 nt, Shigella flexneri 2a str. 2457T
cuucaccuucuuuacugccc

SEQ ID NO: 3874923 - RNA, 17 nt, Shigella flexneri 2a str. 2457T
cuucacgcccgccccag

SEQ ID NO: 3874924 - RNA, 20 nt, Shigella flexneri 2a str. 2457T
cuucacgcuuugcaggcugg

SEQ ID NO: 3874925 - RNA, 21 nt, Shigella flexneri 2a str. 2457T
cuucacgcuuugcaggcuggu

SEQ ID NO: 3874926 - RNA, 21 nt, Shigella flexneri 2a str. 2457T
cuucacggcugcuaauauuuu

SEQ ID NO: 3874927 - RNA, 20 nt, Shigella flexneri 2a str. 2457T
cuucacggcuuugucauuaa

SEQ ID NO: 3874928 - RNA, 19 nt, Shigella flexneri 2a str. 2457T
cuucacgguuacggccuuc

SEQ ID NO: 3874929 - RNA, 23 nt, Shigella flexneri 2a str. 2457T
cuucacguuuuucgaaaaucuca

SEQ ID NO: 3874930 - RNA, 17 nt, Shigella flexneri 2a str. 2457T
cuucacucucaccacgc

SEQ ID NO: 3874931 - RNA, 21 nt, Shigella flexneri 2a str. 2457T
cuucacucucaccacgcucca

SEQ ID NO: 3874932 - RNA, 13 nt, Shigella flexneri 2a str. 2457T
cuucacucucuuu

SEQ ID NO: 3874933 - RNA, 14 nt, Shigella flexneri 2a str. 2457T
cuucacucucuuuu

SEQ ID NO: 3874934 - RNA, 17 nt, Shigella flexneri 2a str. 2457T
cuucacugacauugccu

SEQ ID NO: 3874935 - RNA, 15 nt, Shigella flexneri 2a str. 2457T
cuucacugacuuuuc

SEQ ID NO: 3874936 - RNA, 15 nt, Shigella flexneri 2a str. 2457T
cuucacuucuuaccg

SEQ ID NO: 3874937 - RNA, 23 nt, Shigella flexneri 2a str. 2457T
cuucagaauauucgaaaucuguu

SEQ ID NO: 3874938 - RNA, 17 nt, Shigella flexneri 2a str. 2457T
cuucagauucagcgucg

SEQ ID NO: 3874939 - RNA, 21 nt, Shigella flexneri 2a str. 2457T
cuucagcaacuuguucacgcc

SEQ ID NO: 3874940 - RNA, 23 nt, Shigella flexneri 2a str. 2457T
cuucagcaacuuguucacgccau

SEQ ID NO: 3874941 - RNA, 14 nt, Shigella flexneri 2a str. 2457T
cuucagcaguucag

SEQ ID NO: 3874942 - RNA, 23 nt, Shigella flexneri 2a str. 2457T
cuucagccaguuuuucagcgcca

SEQ ID NO: 3874943 - RNA, 23 nt, Shigella flexneri 2a str. 2457T
cuucagccaucaaagauuguugg

SEQ ID NO: 3874944 - RNA, 17 nt, Shigella flexneri 2a str. 2457T
cuucagccgcaaaccug

SEQ ID NO: 3874945 - RNA, 22 nt, Shigella flexneri 2a str. 2457T
cuucagccgcaaaccuggcaac

SEQ ID NO: 3874946 - RNA, 22 nt, Shigella flexneri 2a str. 2457T
cuucagcgaagcccacgccgcc

SEQ ID NO: 3874947 - RNA, 22 nt, Shigella flexneri 2a str. 2457T
cuucagcgcuaccgccgaucuc

SEQ ID NO: 3874948 - RNA, 16 nt, Shigella flexneri 2a str. 2457T
cuucagcguaucccag

SEQ ID NO: 3874949 - RNA, 19 nt, Shigella flexneri 2a str. 2457T
cuucagcguccauccacag

SEQ ID NO: 3874950 - RNA, 21 nt, Shigella flexneri 2a str. 2457T
cuucaggauguacgucauccg

SEQ ID NO: 3874951 - RNA, 11 nt, Shigella flexneri 2a str. 2457T
cuucaggcaca

SEQ ID NO: 3874952 - RNA, 20 nt, Shigella flexneri 2a str. 2457T
cuucaggugcccaacauacu

SEQ ID NO: 3874953 - RNA, 23 nt, Shigella flexneri 2a str. 2457T
cuucagucaggcgauuguuuaga

SEQ ID NO: 3874954 - RNA, 15 nt, Shigella flexneri 2a str. 2457T
cuucagugccugugc

SEQ ID NO: 3874955 - RNA, 16 nt, Shigella flexneri 2a str. 2457T
cuucaguuccgcugca

SEQ ID NO: 3874956 - RNA, 19 nt, Shigella flexneri 2a str. 2457T
cuucaguugccugggugca

SEQ ID NO: 3874957 - RNA, 16 nt, Shigella flexneri 2a str. 2457T
cuucauagugcgcggu

SEQ ID NO: 3874958 - RNA, 19 nt, Shigella flexneri 2a str. 2457T
cuucgauauugacgaucuc

SEQ ID NO: 3874959 - RNA, 14 nt, Shigella flexneri 2a str. 2457T
cuucgauuuaaccc

SEQ ID NO: 3874960 - RNA, 12 nt, Shigella flexneri 2a str. 2457T
cuucgcaaaaaa

SEQ ID NO: 3874961 - RNA, 19 nt, Shigella flexneri 2a str. 2457T
cuucgcaaaaaaccauccc

SEQ ID NO: 3874962 - RNA, 14 nt, Shigella flexneri 2a str. 2457T
cuucgccaaugacc

SEQ ID NO: 3874963 - RNA, 23 nt, Shigella flexneri 2a str. 2457T
cuucgccauugaaaccgcugccu

SEQ ID NO: 3874964 - RNA, 21 nt, Shigella flexneri 2a str. 2457T
cuucgccgcccagccagccga

SEQ ID NO: 3874965 - RNA, 13 nt, Shigella flexneri 2a str. 2457T
cuucgccgccgcu

SEQ ID NO: 3874966 - RNA, 13 nt, Shigella flexneri 2a str. 2457T
cuucgccuccugu

SEQ ID NO: 3874967 - RNA, 16 nt, Shigella flexneri 2a str. 2457T
cuucgccugccugcag

SEQ ID NO: 3874968 - RNA, 18 nt, Shigella flexneri 2a str. 2457T
cuucgccugccugcagcu

SEQ ID NO: 3874969 - RNA, 22 nt, Shigella flexneri 2a str. 2457T
cuucgcggacaucguccagcuu

SEQ ID NO: 3874970 - RNA, 20 nt, Shigella flexneri 2a str. 2457T
cuucgcguaacugaagcauu

SEQ ID NO: 3874971 - RNA, 17 nt, Shigella flexneri 2a str. 2457T
cuucggcacugaccacu

SEQ ID NO: 3874972 - RNA, 19 nt, Shigella flexneri 2a str. 2457T
cuucggcggcguugcuuuu

SEQ ID NO: 3874973 - RNA, 16 nt, Shigella flexneri 2a str. 2457T
cuucggcgucuccacc

SEQ ID NO: 3874974 - RNA, 13 nt, Shigella flexneri 2a str. 2457T
cuucggucaccgu

SEQ ID NO: 3874975 - RNA, 14 nt, Shigella flexneri 2a str. 2457T
cuucggucagcacg

SEQ ID NO: 3874976 - RNA, 16 nt, Shigella flexneri 2a str. 2457T
cuucgguucaaguccc

SEQ ID NO: 3874977 - RNA, 23 nt, Shigella flexneri 2a str. 2457T
cuucgguuuuguugccgcccguu

SEQ ID NO: 3874978 - RNA, 13 nt, Shigella flexneri 2a str. 2457T
cuucgucccaguc

SEQ ID NO: 3874979 - RNA, 16 nt, Shigella flexneri 2a str. 2457T
cuucgucgucuucguc

SEQ ID NO: 3874980 - RNA, 22 nt, Shigella flexneri 2a str. 2457T
cuucguuaacgugucauaacug

SEQ ID NO: 3874981 - RNA, 12 nt, Shigella flexneri 2a str. 2457T
cuucguucaucu

SEQ ID NO: 3874982 - RNA, 19 nt, Shigella flexneri 2a str. 2457T
cuucguucaucucaaacac

SEQ ID NO: 3874983 - RNA, 17 nt, Shigella flexneri 2a str. 2457T
cuucguuuucagcuucg

SEQ ID NO: 3874984 - RNA, 19 nt, Shigella flexneri 2a str. 2457T
cuucuaacgacauuuucug

SEQ ID NO: 3874985 - RNA, 23 nt, Shigella flexneri 2a str. 2457T
cuucuaacgacauuuucugccca

SEQ ID NO: 3874986 - RNA, 22 nt, Shigella flexneri 2a str. 2457T
cuucuaccgucuguaaccagau

SEQ ID NO: 3874987 - RNA, 23 nt, Shigella flexneri 2a str. 2457T
cuucuaccuuaacgguaucuuuc

SEQ ID NO: 3874988 - RNA, 19 nt, Shigella flexneri 2a str. 2457T
cuucuagugcuugcacaac

SEQ ID NO: 3874989 - RNA, 13 nt, Shigella flexneri 2a str. 2457T
cuucuauaaugag

SEQ ID NO: 3874990 - RNA, 22 nt, Shigella flexneri 2a str. 2457T
cuucuauaaugagauauuuaau

SEQ ID NO: 3874991 - RNA, 13 nt, Shigella flexneri 2a str. 2457T
cuucuauauucug

SEQ ID NO: 3874992 - RNA, 12 nt, Shigella flexneri 2a str. 2457T
cuucuaugccag

SEQ ID NO: 3874993 - RNA, 13 nt, Shigella flexneri 2a str. 2457T
cuucucaaucccu

SEQ ID NO: 3874994 - RNA, 17 nt, Shigella flexneri 2a str. 2457T
cuucucaaucccuuucu

SEQ ID NO: 3874995 - RNA, 21 nt, Shigella flexneri 2a str. 2457T
cuucucacccggaggaaagca

SEQ ID NO: 3874996 - RNA, 15 nt, Shigella flexneri 2a str. 2457T
cuucucagauauaaa

SEQ ID NO: 3874997 - RNA, 19 nt, Shigella flexneri 2a str. 2457T
cuucucagcgguaaugguc

SEQ ID NO: 3874998 - RNA, 17 nt, Shigella flexneri 2a str. 2457T
cuucucaggccuacaaa

SEQ ID NO: 3874999 - RNA, 14 nt, Shigella flexneri 2a str. 2457T
cuucucauccuucc

SEQ ID NO: 3875000 - RNA, 19 nt, Shigella flexneri 2a str. 2457T
cuucucccagccgcccugc

SEQ ID NO: 3875001 - RNA, 17 nt, Shigella flexneri 2a str. 2457T
cuucuccggcauccuua

SEQ ID NO: 3875002 - RNA, 23 nt, Shigella flexneri 2a str. 2457T
cuucucgauaaaccauccugcuc

SEQ ID NO: 3875003 - RNA, 21 nt, Shigella flexneri 2a str. 2457T
cuucucgccagccucccagcc

SEQ ID NO: 3875004 - RNA, 22 nt, Shigella flexneri 2a str. 2457T
cuucucgcucgagagagaaaau

SEQ ID NO: 3875005 - RNA, 17 nt, Shigella flexneri 2a str. 2457T
cuucucgcucuuguucu

SEQ ID NO: 3875006 - RNA, 20 nt, Shigella flexneri 2a str. 2457T
cuucucgucaaucugcucca

SEQ ID NO: 3875007 - RNA, 16 nt, Shigella flexneri 2a str. 2457T
cuucucugaaaauuaa

SEQ ID NO: 3875008 - RNA, 17 nt, Shigella flexneri 2a str. 2457T
cuucugaucuacagccu

SEQ ID NO: 3875009 - RNA, 12 nt, Shigella flexneri 2a str. 2457T
cuucugccggag

SEQ ID NO: 3875010 - RNA, 16 nt, Shigella flexneri 2a str. 2457T
cuucugccuguccacc

SEQ ID NO: 3875011 - RNA, 20 nt, Shigella flexneri 2a str. 2457T
cuucugcuuucauucgguuu

SEQ ID NO: 3875012 - RNA, 20 nt, Shigella flexneri 2a str. 2457T
cuucuggcguacgcauucuc

SEQ ID NO: 3875013 - RNA, 14 nt, Shigella flexneri 2a str. 2457T
cuucuggcuacuga

SEQ ID NO: 3875014 - RNA, 23 nt, Shigella flexneri 2a str. 2457T
cuucuggugauaggcguugcggg

SEQ ID NO: 3875015 - RNA, 18 nt, Shigella flexneri 2a str. 2457T
cuucugguuauauuuccc

SEQ ID NO: 3875016 - RNA, 19 nt, Shigella flexneri 2a str. 2457T
cuucugguuauauuucccc

SEQ ID NO: 3875017 - RNA, 21 nt, Shigella flexneri 2a str. 2457T
cuucugguugcgaaaaaauca

SEQ ID NO: 3875018 - RNA, 18 nt, Shigella flexneri 2a str. 2457T
cuucugugauuccgccag

SEQ ID NO: 3875019 - RNA, 23 nt, Shigella flexneri 2a str. 2457T
cuucugugauuccgccaguucuu

SEQ ID NO: 3875020 - RNA, 16 nt, Shigella flexneri 2a str. 2457T
cuucuguuuuaccugc

SEQ ID NO: 3875021 - RNA, 18 nt, Shigella flexneri 2a str. 2457T
cuucuucaaccgucgcgc

SEQ ID NO: 3875022 - RNA, 15 nt, Shigella flexneri 2a str. 2457T
cuucuucaguuuuuc

SEQ ID NO: 3875023 - RNA, 20 nt, Shigella flexneri 2a str. 2457T
cuucuuccauaccgaccaug

SEQ ID NO: 3875024 - RNA, 23 nt, Shigella flexneri 2a str. 2457T
cuucuucguagggucacguucca

SEQ ID NO: 3875025 - RNA, 19 nt, Shigella flexneri 2a str. 2457T
cuucuucgucgucuucguc

SEQ ID NO: 3875026 - RNA, 14 nt, Shigella flexneri 2a str. 2457T
cuucuucucagcca

SEQ ID NO: 3875027 - RNA, 12 nt, Shigella flexneri 2a str. 2457T
cuucuucugucg

SEQ ID NO: 3875028 - RNA, 13 nt, Shigella flexneri 2a str. 2457T
cuucuuguaauuc

SEQ ID NO: 3875029 - RNA, 14 nt, Shigella flexneri 2a str. 2457T
cuucuuuaugaauc

SEQ ID NO: 3875030 - RNA, 13 nt, Shigella flexneri 2a str. 2457T
cuugaaaagguac

SEQ ID NO: 3875031 - RNA, 20 nt, Shigella flexneri 2a str. 2457T
cuugaaaauuauaucuuauu

SEQ ID NO: 3875032 - RNA, 16 nt, Shigella flexneri 2a str. 2457T
cuugaacuuaucauca

SEQ ID NO: 3875033 - RNA, 15 nt, Shigella flexneri 2a str. 2457T
cuugaagccuucgcc

SEQ ID NO: 3875034 - RNA, 13 nt, Shigella flexneri 2a str. 2457T
cuugaagggcugg

SEQ ID NO: 3875035 - RNA, 17 nt, Shigella flexneri 2a str. 2457T
cuugaccuuacggucag

SEQ ID NO: 3875036 - RNA, 17 nt, Shigella flexneri 2a str. 2457T
cuugacgccauuuuuua

SEQ ID NO: 3875037 - RNA, 21 nt, Shigella flexneri 2a str. 2457T
cuugacgcgucuuaucaggcc

SEQ ID NO: 3875038 - RNA, 23 nt, Shigella flexneri 2a str. 2457T
cuugacgcgucuuaucaggccua

SEQ ID NO: 3875039 - RNA, 18 nt, Shigella flexneri 2a str. 2457T
cuugacucgccugaaagu

SEQ ID NO: 3875040 - RNA, 18 nt, Shigella flexneri 2a str. 2457T
cuugacucuguagcggga

SEQ ID NO: 3875041 - RNA, 20 nt, Shigella flexneri 2a str. 2457T
cuugauacugaacaacuuaa

SEQ ID NO: 3875042 - RNA, 18 nt, Shigella flexneri 2a str. 2457T
cuugauagaacaaaagac

SEQ ID NO: 3875043 - RNA, 17 nt, Shigella flexneri 2a str. 2457T
cuugauauaaaucccag

SEQ ID NO: 3875044 - RNA, 13 nt, Shigella flexneri 2a str. 2457T
cuugaucuuccug

SEQ ID NO: 3875045 - RNA, 18 nt, Shigella flexneri 2a str. 2457T
cuugaucuuccugauaac

SEQ ID NO: 3875046 - RNA, 13 nt, Shigella flexneri 2a str. 2457T
cuugaugaaaaaa

SEQ ID NO: 3875047 - RNA, 13 nt, Shigella flexneri 2a str. 2457T
cuugauuauuucc

SEQ ID NO: 3875048 - RNA, 21 nt, Shigella flexneri 2a str. 2457T
cuugauuauuucccucguuuu

SEQ ID NO: 3875049 - RNA, 23 nt, Shigella flexneri 2a str. 2457T
cuugcaacuccggcgaaaauccc

SEQ ID NO: 3875050 - RNA, 23 nt, Shigella flexneri 2a str. 2457T
cuugcaauuuuuaccgccgucga

SEQ ID NO: 3875051 - RNA, 20 nt, Shigella flexneri 2a str. 2457T
cuugcaccggcgacauccca

SEQ ID NO: 3875052 - RNA, 15 nt, Shigella flexneri 2a str. 2457T
cuugcagcgucuuau

SEQ ID NO: 3875053 - RNA, 15 nt, Shigella flexneri 2a str. 2457T
cuugccagagcagca

SEQ ID NO: 3875054 - RNA, 18 nt, Shigella flexneri 2a str. 2457T
cuugccagauacgauguu

SEQ ID NO: 3875055 - RNA, 22 nt, Shigella flexneri 2a str. 2457T
cuuucacgccgaagugcgcgca

SEQ ID NO: 3875056 - RNA, 16 nt, Shigella flexneri 2a str. 2457T
cuuucacgcgcugacc

SEQ ID NO: 3875057 - RNA, 20 nt, Shigella flexneri 2a str. 2457T
cuuucacgucaggaucgugc

SEQ ID NO: 3875058 - RNA, 18 nt, Shigella flexneri 2a str. 2457T
cuuucacucaguguugga

SEQ ID NO: 3875059 - RNA, 18 nt, Shigella flexneri 2a str. 2457T
cuuucagaaucagguuga

SEQ ID NO: 3875060 - RNA, 18 nt, Shigella flexneri 2a str. 2457T
cuuucagagaagcaccgc

SEQ ID NO: 3875061 - RNA, 20 nt, Shigella flexneri 2a str. 2457T
cuuucagauguuccgccauu

SEQ ID NO: 3875062 - RNA, 15 nt, Shigella flexneri 2a str. 2457T
cuuucagcaccagcc

SEQ ID NO: 3875063 - RNA, 17 nt, Shigella flexneri 2a str. 2457T
cuuucagcaccagcccg

SEQ ID NO: 3875064 - RNA, 13 nt, Shigella flexneri 2a str. 2457T
cuuucagcacuua

SEQ ID NO: 3875065 - RNA, 21 nt, Shigella flexneri 2a str. 2457T
cuuucagcaguucagucagca

SEQ ID NO: 3875066 - RNA, 23 nt, Shigella flexneri 2a str. 2457T
cuuucagcgaaaaagucccuucc

SEQ ID NO: 3875067 - RNA, 16 nt, Shigella flexneri 2a str. 2457T
cuuucaggccgcgcag

SEQ ID NO: 3875068 - RNA, 14 nt, Shigella flexneri 2a str. 2457T
cuuucauacugccg

SEQ ID NO: 3875069 - RNA, 21 nt, Shigella flexneri 2a str. 2457T
cuuucauaugauaggcuucca

SEQ ID NO: 3875070 - RNA, 14 nt, Shigella flexneri 2a str. 2457T
cuuucaucaaaaaa

SEQ ID NO: 3875071 - RNA, 17 nt, Shigella flexneri 2a str. 2457T
cuuucaucaaaaaauga

SEQ ID NO: 3875072 - RNA, 20 nt, Shigella flexneri 2a str. 2457T
cuuucauuucaauaaauucc

SEQ ID NO: 3875073 - RNA, 18 nt, Shigella flexneri 2a str. 2457T
cuuuccaaaccucagagu

SEQ ID NO: 3875074 - RNA, 18 nt, Shigella flexneri 2a str. 2457T
cuuuccaacuguaccagc

SEQ ID NO: 3875075 - RNA, 14 nt, Shigella flexneri 2a str. 2457T
cuuuccaggcauca

SEQ ID NO: 3875076 - RNA, 20 nt, Shigella flexneri 2a str. 2457T
cuuuccaggcgugcuccuuc

SEQ ID NO: 3875077 - RNA, 18 nt, Shigella flexneri 2a str. 2457T
cuuuccagucuucuugcu

SEQ ID NO: 3875078 - RNA, 16 nt, Shigella flexneri 2a str. 2457T
cuuuccaucuuuccuc

SEQ ID NO: 3875079 - RNA, 17 nt, Shigella flexneri 2a str. 2457T
cuuuccaugccaucugc

SEQ ID NO: 3875080 - RNA, 19 nt, Shigella flexneri 2a str. 2457T
cuuuccaugccaucugcca

SEQ ID NO: 3875081 - RNA, 16 nt, Shigella flexneri 2a str. 2457T
cuuucccuuucgauaa

SEQ ID NO: 3875082 - RNA, 19 nt, Shigella flexneri 2a str. 2457T
cuuuccgcuggcgucuggg

SEQ ID NO: 3875083 - RNA, 13 nt, Shigella flexneri 2a str. 2457T
cuuuccuccuguc

SEQ ID NO: 3875084 - RNA, 13 nt, Shigella flexneri 2a str. 2457T
cuuuccugcugcg

SEQ ID NO: 3875085 - RNA, 22 nt, Shigella flexneri 2a str. 2457T
cuuuccuggucggcaaacugcu

SEQ ID NO: 3875086 - RNA, 18 nt, Shigella flexneri 2a str. 2457T
cuuuccuuaacuccucgc

SEQ ID NO: 3875087 - RNA, 21 nt, Shigella flexneri 2a str. 2457T
cuuucgaaaucauucgcaguu

SEQ ID NO: 3875088 - RNA, 23 nt, Shigella flexneri 2a str. 2457T
cuuucgacagcgauuccaguucg

SEQ ID NO: 3875089 - RNA, 18 nt, Shigella flexneri 2a str. 2457T
cuuucgagcaauuuuccu

SEQ ID NO: 3875090 - RNA, 17 nt, Shigella flexneri 2a str. 2457T
cuuucgaucagugaagg

SEQ ID NO: 3875091 - RNA, 16 nt, Shigella flexneri 2a str. 2457T
cuuucgcaauaaucau

SEQ ID NO: 3875092 - RNA, 18 nt, Shigella flexneri 2a str. 2457T
cuuucgcccagcguugca

SEQ ID NO: 3875093 - RNA, 17 nt, Shigella flexneri 2a str. 2457T
cuuucgcuuaacgccca

SEQ ID NO: 3875094 - RNA, 15 nt, Shigella flexneri 2a str. 2457T
cuuucgcuucaacca

SEQ ID NO: 3875095 - RNA, 19 nt, Shigella flexneri 2a str. 2457T
cuuucggaaagaucgccac

SEQ ID NO: 3875096 - RNA, 22 nt, Shigella flexneri 2a str. 2457T
cuuucggccaugggcgcgauaa

SEQ ID NO: 3875097 - RNA, 18 nt, Shigella flexneri 2a str. 2457T
cuuucguacgagcucuuc

SEQ ID NO: 3875098 - RNA, 19 nt, Shigella flexneri 2a str. 2457T
cuuucguggugagggcaaa

SEQ ID NO: 3875099 - RNA, 14 nt, Shigella flexneri 2a str. 2457T
cuuucguuaaauuc

SEQ ID NO: 3875100 - RNA, 16 nt, Shigella flexneri 2a str. 2457T
cuuucguuaaauucuu

SEQ ID NO: 3875101 - RNA, 14 nt, Shigella flexneri 2a str. 2457T
cuuucguuccggcu

SEQ ID NO: 3875102 - RNA, 19 nt, Shigella flexneri 2a str. 2457T
cuuucucccgaaaaaccug

SEQ ID NO: 3875103 - RNA, 21 nt, Shigella flexneri 2a str. 2457T
cuuucugaacugaacaaaaaa

SEQ ID NO: 3875104 - RNA, 23 nt, Shigella flexneri 2a str. 2457T
cuuucugagauucaauuauagua

SEQ ID NO: 3875105 - RNA, 20 nt, Shigella flexneri 2a str. 2457T
cuuucugagcggccuuuucc

SEQ ID NO: 3875106 - RNA, 23 nt, Shigella flexneri 2a str. 2457T
cuuucugcaauuaaggucggcuu

SEQ ID NO: 3875107 - RNA, 23 nt, Shigella flexneri 2a str. 2457T
cuuucugcccgcguuuccacgcu

SEQ ID NO: 3875108 - RNA, 15 nt, Shigella flexneri 2a str. 2457T
cuuucugcgcaaugc

SEQ ID NO: 3875109 - RNA, 16 nt, Shigella flexneri 2a str. 2457T
cuuucuggcacgaccu

SEQ ID NO: 3875110 - RNA, 18 nt, Shigella flexneri 2a str. 2457T
cuuucuggcaucacuucu

SEQ ID NO: 3875111 - RNA, 15 nt, Shigella flexneri 2a str. 2457T
cuuucugugcaucug

SEQ ID NO: 3875112 - RNA, 16 nt, Shigella flexneri 2a str. 2457T
cuuucuuaaauuaaga

SEQ ID NO: 3875113 - RNA, 11 nt, Shigella flexneri 2a str. 2457T
cuuucuucugg

SEQ ID NO: 3875114 - RNA, 16 nt, Shigella flexneri 2a str. 2457T
cuuucuuucuggaaau

SEQ ID NO: 3875115 - RNA, 21 nt, Shigella flexneri 2a str. 2457T
cuuugaaaauaacaucgccag

SEQ ID NO: 3875116 - RNA, 12 nt, Shigella flexneri 2a str. 2457T
cuuugaauaucu

SEQ ID NO: 3875117 - RNA, 14 nt, Shigella flexneri 2a str. 2457T
cuuugaauaucucc

SEQ ID NO: 3875118 - RNA, 16 nt, Shigella flexneri 2a str. 2457T
cuuugacaacaucauc

SEQ ID NO: 3875119 - RNA, 20 nt, Shigella flexneri 2a str. 2457T
cuuugacgucgaaacugaca

SEQ ID NO: 3875120 - RNA, 21 nt, Shigella flexneri 2a str. 2457T
cuuugacugcuuuuacaaaau

SEQ ID NO: 3875121 - RNA, 23 nt, Shigella flexneri 2a str. 2457T
cuuugagcaucaaacuuuuaaau

SEQ ID NO: 3875122 - RNA, 22 nt, Shigella flexneri 2a str. 2457T
cuuugaucgguugcugaacagc

SEQ ID NO: 3875123 - RNA, 23 nt, Shigella flexneri 2a str. 2457T
cuuugauguacgcugccgcuucu

SEQ ID NO: 3875124 - RNA, 16 nt, Shigella flexneri 2a str. 2457T
cuuugauuauuuuuuu

SEQ ID NO: 3875125 - RNA, 19 nt, Shigella flexneri 2a str. 2457T
cuuugauugaagaaaucag

SEQ ID NO: 3875126 - RNA, 13 nt, Shigella flexneri 2a str. 2457T
cuuugcaagcguu

SEQ ID NO: 3875127 - RNA, 17 nt, Shigella flexneri 2a str. 2457T
cuuugcagguucugcuc

SEQ ID NO: 3875128 - RNA, 20 nt, Shigella flexneri 2a str. 2457T
cuuugcaguuccugccagau

SEQ ID NO: 3875129 - RNA, 17 nt, Shigella flexneri 2a str. 2457T
cuuugccaaaaugcugg

SEQ ID NO: 3875130 - RNA, 21 nt, Shigella flexneri 2a str. 2457T
cuuugccacgguauuugccaa

SEQ ID NO: 3875131 - RNA, 15 nt, Shigella flexneri 2a str. 2457T
cuuugccccagcggg

SEQ ID NO: 3875132 - RNA, 24 nt, Shigella flexneri 2a str. 2457T
cuuugcccgcagauccagugcuca

SEQ ID NO: 3875133 - RNA, 17 nt, Shigella flexneri 2a str. 2457T
cuuugccgucagccacu

SEQ ID NO: 3875134 - RNA, 11 nt, Shigella flexneri 2a str. 2457T
cuuugccuggc

SEQ ID NO: 3875135 - RNA, 16 nt, Shigella flexneri 2a str. 2457T
cuuugccuggcggcag

SEQ ID NO: 3875136 - RNA, 21 nt, Shigella flexneri 2a str. 2457T
cuuugcgagucugcuccagaa

SEQ ID NO: 3875137 - RNA, 14 nt, Shigella flexneri 2a str. 2457T
cuuugcuacagccu

SEQ ID NO: 3875138 - RNA, 17 nt, Shigella flexneri 2a str. 2457T
cuuugcuacagccuggu

SEQ ID NO: 3875139 - RNA, 23 nt, Shigella flexneri 2a str. 2457T
cuuugcugauacuccaugaguaa

SEQ ID NO: 3875140 - RNA, 17 nt, Shigella flexneri 2a str. 2457T
cuuugcugauucucccu

SEQ ID NO: 3875141 - RNA, 14 nt, Shigella flexneri 2a str. 2457T
cuuugcuuccugag

SEQ ID NO: 3875142 - RNA, 14 nt, Shigella flexneri 2a str. 2457T
cuuuggcaaacuac

SEQ ID NO: 3875143 - RNA, 23 nt, Shigella flexneri 2a str. 2457T
cuuuggggaggggucguuuuuua

SEQ ID NO: 3875144 - RNA, 17 nt, Shigella flexneri 2a str. 2457T
cuuuggguugccgccaa

SEQ ID NO: 3875145 - RNA, 21 nt, Shigella flexneri 2a str. 2457T
cuuugucauuaaagccgccaa

SEQ ID NO: 3875146 - RNA, 22 nt, Shigella flexneri 2a str. 2457T
cuuugucgauaauauugagcac

SEQ ID NO: 3875147 - RNA, 15 nt, Shigella flexneri 2a str. 2457T
cuuugucgggcaggc

SEQ ID NO: 3875148 - RNA, 14 nt, Shigella flexneri 2a str. 2457T
cuuugucgguggac

SEQ ID NO: 3875149 - RNA, 15 nt, Shigella flexneri 2a str. 2457T
cuuuuaaauggaauc

SEQ ID NO: 3875150 - RNA, 22 nt, Shigella flexneri 2a str. 2457T
cuuuuaauaauucaaaaaccug

SEQ ID NO: 3875151 - RNA, 16 nt, Shigella flexneri 2a str. 2457T
cuuuuaaugcuuuaaa

SEQ ID NO: 3875152 - RNA, 20 nt, Shigella flexneri 2a str. 2457T
gaaauaucggcgucguugua

SEQ ID NO: 3875153 - RNA, 16 nt, Shigella flexneri 2a str. 2457T
gaaaucaccaccagca

SEQ ID NO: 3875154 - RNA, 20 nt, Shigella flexneri 2a str. 2457T
gaaaucaccgccaccagcgu

SEQ ID NO: 3875155 - RNA, 19 nt, Shigella flexneri 2a str. 2457T
gaaaucacgauugcugccg

SEQ ID NO: 3875156 - RNA, 20 nt, Shigella flexneri 2a str. 2457T
gaaaucagcagcuuugcccg

SEQ ID NO: 3875157 - RNA, 19 nt, Shigella flexneri 2a str. 2457T
gaaaucagcuuuggugaaa

SEQ ID NO: 3875158 - RNA, 20 nt, Shigella flexneri 2a str. 2457T
gaaaucaucaauaccagccc

SEQ ID NO: 3875159 - RNA, 16 nt, Shigella flexneri 2a str. 2457T
gaaauccaggucagca

SEQ ID NO: 3875160 - RNA, 22 nt, Shigella flexneri 2a str. 2457T
gaaauccggcaccugucagacu

SEQ ID NO: 3875161 - RNA, 14 nt, Shigella flexneri 2a str. 2457T
gaaauccugccgca

SEQ ID NO: 3875162 - RNA, 13 nt, Shigella flexneri 2a str. 2457T
gaaaucgaucauc

SEQ ID NO: 3875163 - RNA, 11 nt, Shigella flexneri 2a str. 2457T
gaaaucgccaa

SEQ ID NO: 3875164 - RNA, 17 nt, Shigella flexneri 2a str. 2457T
gaaaucguaaaaacgga

SEQ ID NO: 3875165 - RNA, 14 nt, Shigella flexneri 2a str. 2457T
gaaaucucacccgg

SEQ ID NO: 3875166 - RNA, 21 nt, Shigella flexneri 2a str. 2457T
gaaaucucacccgguacauca

SEQ ID NO: 3875167 - RNA, 23 nt, Shigella flexneri 2a str. 2457T
gaaaucucacccgguacaucaau

SEQ ID NO: 3875168 - RNA, 14 nt, Shigella flexneri 2a str. 2457T
gaaaucuccagaua

SEQ ID NO: 3875169 - RNA, 17 nt, Shigella flexneri 2a str. 2457T
gaaaucugaucguguaa

SEQ ID NO: 3875170 - RNA, 13 nt, Shigella flexneri 2a str. 2457T
gaaaucuuccggc

SEQ ID NO: 3875171 - RNA, 14 nt, Shigella flexneri 2a str. 2457T
gaaaugaaaaaaua

SEQ ID NO: 3875172 - RNA, 15 nt, Shigella flexneri 2a str. 2457T
gaaaugaaaaaauag

SEQ ID NO: 3875173 - RNA, 21 nt, Shigella flexneri 2a str. 2457T
gaaaugagauauuucagagcu

SEQ ID NO: 3875174 - RNA, 18 nt, Shigella flexneri 2a str. 2457T
gaaaugccaaauauuucu

SEQ ID NO: 3875175 - RNA, 18 nt, Shigella flexneri 2a str. 2457T
gaaaugccaguaacucau

SEQ ID NO: 3875176 - RNA, 21 nt, Shigella flexneri 2a str. 2457T
gaaauggcccaaaaggcagcg

SEQ ID NO: 3875177 - RNA, 16 nt, Shigella flexneri 2a str. 2457T
gaaaugggugacaucg

SEQ ID NO: 3875178 - RNA, 23 nt, Shigella flexneri 2a str. 2457T
gaaauguugaauugccgggugca

SEQ ID NO: 3875179 - RNA, 19 nt, Shigella flexneri 2a str. 2457T
gaaauguuugcaauaaaga

SEQ ID NO: 3875180 - RNA, 13 nt, Shigella flexneri 2a str. 2457T
gaaauuaccgcaa

SEQ ID NO: 3875181 - RNA, 18 nt, Shigella flexneri 2a str. 2457T
gaaauuaccgcaccacca

SEQ ID NO: 3875182 - RNA, 19 nt, Shigella flexneri 2a str. 2457T
gaaauuauuucuuuuacau

SEQ ID NO: 3875183 - RNA, 13 nt, Shigella flexneri 2a str. 2457T
gaaauucacuguc

SEQ ID NO: 3875184 - RNA, 19 nt, Shigella flexneri 2a str. 2457T
gaaauucagcaguuuuugc

SEQ ID NO: 3875185 - RNA, 21 nt, Shigella flexneri 2a str. 2457T
gaaauucagcaguuuuugcaa

SEQ ID NO: 3875186 - RNA, 18 nt, Shigella flexneri 2a str. 2457T
gaaauuccagcggcagga

SEQ ID NO: 3875187 - RNA, 15 nt, Shigella flexneri 2a str. 2457T
gaaauucgccagaca

SEQ ID NO: 3875188 - RNA, 20 nt, Shigella flexneri 2a str. 2457T
gaaauugcgaauuccuucac

SEQ ID NO: 3875189 - RNA, 19 nt, Shigella flexneri 2a str. 2457T
gaaauuguuuuugauuuug

SEQ ID NO: 3875190 - RNA, 15 nt, Shigella flexneri 2a str. 2457T
gaaauuuccugagca

SEQ ID NO: 3875191 - RNA, 21 nt, Shigella flexneri 2a str. 2457T
gaaauuucucgccaacaagcc

SEQ ID NO: 3875192 - RNA, 16 nt, Shigella flexneri 2a str. 2457T
gaaauuucuuccucgu

SEQ ID NO: 3875193 - RNA, 12 nt, Shigella flexneri 2a str. 2457T
gaacaaaacagc

SEQ ID NO: 3875194 - RNA, 14 nt, Shigella flexneri 2a str. 2457T
gaacaaaaucuuaa

SEQ ID NO: 3875195 - RNA, 19 nt, Shigella flexneri 2a str. 2457T
gaacaaaauguuuaugccu

SEQ ID NO: 3875196 - RNA, 15 nt, Shigella flexneri 2a str. 2457T
gaacaaacugccgcg

SEQ ID NO: 3875197 - RNA, 14 nt, Shigella flexneri 2a str. 2457T
gaacaaagcugauu

SEQ ID NO: 3875198 - RNA, 22 nt, Shigella flexneri 2a str. 2457T
gaacaacccggcgaaagagcug

SEQ ID NO: 3875199 - RNA, 23 nt, Shigella flexneri 2a str. 2457T
gaacaacccuaaagcacccagca

SEQ ID NO: 3875200 - RNA, 16 nt, Shigella flexneri 2a str. 2457T
gaacaacguaucuugc

SEQ ID NO: 3875201 - RNA, 14 nt, Shigella flexneri 2a str. 2457T
gaacaacugcauua

SEQ ID NO: 3875202 - RNA, 13 nt, Shigella flexneri 2a str. 2457T
gaacaagcaagag

SEQ ID NO: 3875203 - RNA, 22 nt, Shigella flexneri 2a str. 2457T
gaacaaggcuuuaauauccggu

SEQ ID NO: 3875204 - RNA, 24 nt, Shigella flexneri 2a str. 2457T
gaacaagguggugaggccagagca

SEQ ID NO: 3875205 - RNA, 17 nt, Shigella flexneri 2a str. 2457T
gaacaaucacccccacc

SEQ ID NO: 3875206 - RNA, 14 nt, Shigella flexneri 2a str. 2457T
gaacaccaccugcc

SEQ ID NO: 3875207 - RNA, 22 nt, Shigella flexneri 2a str. 2457T
gaacaccaccugccagagcuga

SEQ ID NO: 3875208 - RNA, 12 nt, Shigella flexneri 2a str. 2457T
gaacaccagcag

SEQ ID NO: 3875209 - RNA, 23 nt, Shigella flexneri 2a str. 2457T
gaacacccgacgugcagcaucga

SEQ ID NO: 3875210 - RNA, 19 nt, Shigella flexneri 2a str. 2457T
gaacaccgacauugccagc

SEQ ID NO: 3875211 - RNA, 22 nt, Shigella flexneri 2a str. 2457T
gaacacgacauacaccgcagcc

SEQ ID NO: 3875212 - RNA, 17 nt, Shigella flexneri 2a str. 2457T
gaacacuucuucugucg

SEQ ID NO: 3875213 - RNA, 15 nt, Shigella flexneri 2a str. 2457T
gaacagaagaaagca

SEQ ID NO: 3875214 - RNA, 14 nt, Shigella flexneri 2a str. 2457T
gaacagaccacauu

SEQ ID NO: 3875215 - RNA, 13 nt, Shigella flexneri 2a str. 2457T
gaacagaccagca

SEQ ID NO: 3875216 - RNA, 15 nt, Shigella flexneri 2a str. 2457T
gaacagaccagcacc

SEQ ID NO: 3875217 - RNA, 19 nt, Shigella flexneri 2a str. 2457T
gaacagaggcagcuugauu

SEQ ID NO: 3875218 - RNA, 13 nt, Shigella flexneri 2a str. 2457T
gaacagcagcggu

SEQ ID NO: 3875219 - RNA, 15 nt, Shigella flexneri 2a str. 2457T
gaacagcaguuguuu

SEQ ID NO: 3875220 - RNA, 17 nt, Shigella flexneri 2a str. 2457T
gaacagccagaagcccg

SEQ ID NO: 3875221 - RNA, 16 nt, Shigella flexneri 2a str. 2457T
gaacagcgccagacaa

SEQ ID NO: 3875222 - RNA, 18 nt, Shigella flexneri 2a str. 2457T
gaacagcuuuuuccugcg

SEQ ID NO: 3875223 - RNA, 17 nt, Shigella flexneri 2a str. 2457T
gaacaggccgacuggca

SEQ ID NO: 3875224 - RNA, 13 nt, Shigella flexneri 2a str. 2457T
gaacaggcgcagg

SEQ ID NO: 3875225 - RNA, 14 nt, Shigella flexneri 2a str. 2457T
gaacagugccaugc

SEQ ID NO: 3875226 - RNA, 14 nt, Shigella flexneri 2a str. 2457T
gaacaguucaacgc

SEQ ID NO: 3875227 - RNA, 15 nt, Shigella flexneri 2a str. 2457T
gaacaguucagcagc

SEQ ID NO: 3875228 - RNA, 16 nt, Shigella flexneri 2a str. 2457T
gaacaguucagcagca

SEQ ID NO: 3875229 - RNA, 22 nt, Shigella flexneri 2a str. 2457T
gaacaguucagcagcacuacac

SEQ ID NO: 3875230 - RNA, 23 nt, Shigella flexneri 2a str. 2457T
gaacaucugaguugccaucauca

SEQ ID NO: 3875231 - RNA, 15 nt, Shigella flexneri 2a str. 2457T
gaacauuuaccgcaa

SEQ ID NO: 3875232 - RNA, 17 nt, Shigella flexneri 2a str. 2457T
gaaccacaaugaagaaa

SEQ ID NO: 3875233 - RNA, 16 nt, Shigella flexneri 2a str. 2457T
gaaccacagauccgga

SEQ ID NO: 3875234 - RNA, 13 nt, Shigella flexneri 2a str. 2457T
gaaccacagcgcc

SEQ ID NO: 3875235 - RNA, 21 nt, Shigella flexneri 2a str. 2457T
gaaccaccgaugcacagcacg

SEQ ID NO: 3875236 - RNA, 16 nt, Shigella flexneri 2a str. 2457T
gaaccagagaaucugc

SEQ ID NO: 3875237 - RNA, 17 nt, Shigella flexneri 2a str. 2457T
gaaccagagaaucugcg

SEQ ID NO: 3875238 - RNA, 14 nt, Shigella flexneri 2a str. 2457T
gaaccagcggacaa

SEQ ID NO: 3875239 - RNA, 13 nt, Shigella flexneri 2a str. 2457T
gaaccaggcgcga

SEQ ID NO: 3875240 - RNA, 19 nt, Shigella flexneri 2a str. 2457T
gaaccagggaaaaaagccc

SEQ ID NO: 3875241 - RNA, 11 nt, Shigella flexneri 2a str. 2457T
gaaccaucggc

SEQ ID NO: 3875242 - RNA, 17 nt, Shigella flexneri 2a str. 2457T
gaaccaugucaucaauu

SEQ ID NO: 3875243 - RNA, 21 nt, Shigella flexneri 2a str. 2457T
gaaccauuauccgucagccac

SEQ ID NO: 3875244 - RNA, 19 nt, Shigella flexneri 2a str. 2457T
gaaccauuucgauagacuc

SEQ ID NO: 3875245 - RNA, 22 nt, Shigella flexneri 2a str. 2457T
gaacccaaccgugaggccaccg

SEQ ID NO: 3875246 - RNA, 19 nt, Shigella flexneri 2a str. 2457T
gaacccacgguacucauca

SEQ ID NO: 3875247 - RNA, 13 nt, Shigella flexneri 2a str. 2457T
gaacccagcaggu

SEQ ID NO: 3875248 - RNA, 21 nt, Shigella flexneri 2a str. 2457T
gaaccgauaguauggagcagg

SEQ ID NO: 3875249 - RNA, 14 nt, Shigella flexneri 2a str. 2457T
gaaccggaaaucca

SEQ ID NO: 3875250 - RNA, 18 nt, Shigella flexneri 2a str. 2457T
gaagacgcagcaugcauc

SEQ ID NO: 3875251 - RNA, 11 nt, Shigella flexneri 2a str. 2457T
gaagagcacac

SEQ ID NO: 3875252 - RNA, 13 nt, Shigella flexneri 2a str. 2457T
gaagaggaacaaa

SEQ ID NO: 3875253 - RNA, 14 nt, Shigella flexneri 2a str. 2457T
gaagaguaaaaaaa

SEQ ID NO: 3875254 - RNA, 17 nt, Shigella flexneri 2a str. 2457T
gaagaguaaaaaaaccg

SEQ ID NO: 3875255 - RNA, 13 nt, Shigella flexneri 2a str. 2457T
gaagauaccgaac

SEQ ID NO: 3875256 - RNA, 23 nt, Shigella flexneri 2a str. 2457T
gaagaucagaaauuuccugagca

SEQ ID NO: 3875257 - RNA, 18 nt, Shigella flexneri 2a str. 2457T
gaagaucguggagaacaa

SEQ ID NO: 3875258 - RNA, 19 nt, Shigella flexneri 2a str. 2457T
gaagaucguggagaacaau

SEQ ID NO: 3875259 - RNA, 14 nt, Shigella flexneri 2a str. 2457T
gaagaugaaaaacg

SEQ ID NO: 3875260 - RNA, 18 nt, Shigella flexneri 2a str. 2457T
gaagaugaauugagacgu

SEQ ID NO: 3875261 - RNA, 16 nt, Shigella flexneri 2a str. 2457T
gaagcaaaauaaccgg

SEQ ID NO: 3875262 - RNA, 17 nt, Shigella flexneri 2a str. 2457T
gaagcacacgacauccg

SEQ ID NO: 3875263 - RNA, 21 nt, Shigella flexneri 2a str. 2457T
gaagcacacgacauccgugca

SEQ ID NO: 3875264 - RNA, 22 nt, Shigella flexneri 2a str. 2457T
gaagcacugcaucaaugccgga

SEQ ID NO: 3875265 - RNA, 20 nt, Shigella flexneri 2a str. 2457T
gaagcaguuucaccagcagu

SEQ ID NO: 3875266 - RNA, 19 nt, Shigella flexneri 2a str. 2457T
gaagcauugcgccugcagg

SEQ ID NO: 3875267 - RNA, 18 nt, Shigella flexneri 2a str. 2457T
gaagccaccgcgccacga

SEQ ID NO: 3875268 - RNA, 19 nt, Shigella flexneri 2a str. 2457T
gaagccaccgcgccacgac

SEQ ID NO: 3875269 - RNA, 14 nt, Shigella flexneri 2a str. 2457T
gaagccagucacau

SEQ ID NO: 3875270 - RNA, 15 nt, Shigella flexneri 2a str. 2457T
gaagccagucacauc

SEQ ID NO: 3875271 - RNA, 17 nt, Shigella flexneri 2a str. 2457T
gaagccagucacaucag

SEQ ID NO: 3875272 - RNA, 13 nt, Shigella flexneri 2a str. 2457T
gaagccauccagc

SEQ ID NO: 3875273 - RNA, 22 nt, Shigella flexneri 2a str. 2457T
gaagcccaguaccgccagugca

SEQ ID NO: 3875274 - RNA, 16 nt, Shigella flexneri 2a str. 2457T
gaagcccucaaacaac

SEQ ID NO: 3875275 - RNA, 13 nt, Shigella flexneri 2a str. 2457T
gaagccgccagac

SEQ ID NO: 3875276 - RNA, 21 nt, Shigella flexneri 2a str. 2457T
gaagccuaccgggaugcugau

SEQ ID NO: 3875277 - RNA, 13 nt, Shigella flexneri 2a str. 2457T
gaagccugcgaug

SEQ ID NO: 3875278 - RNA, 15 nt, Shigella flexneri 2a str. 2457T
gaagcgaacaucgag

SEQ ID NO: 3875279 - RNA, 20 nt, Shigella flexneri 2a str. 2457T
gaagcgcaacgcaucaggca

SEQ ID NO: 3875280 - RNA, 13 nt, Shigella flexneri 2a str. 2457T
gaagcggaaauca

SEQ ID NO: 3875281 - RNA, 20 nt, Shigella flexneri 2a str. 2457T
gaagcgggggagucgcuggu

SEQ ID NO: 3875282 - RNA, 22 nt, Shigella flexneri 2a str. 2457T
gaagcgguagaauuucugacug

SEQ ID NO: 3875283 - RNA, 17 nt, Shigella flexneri 2a str. 2457T
gaagcguaaaucccagc

SEQ ID NO: 3875284 - RNA, 18 nt, Shigella flexneri 2a str. 2457T
gaagcugacaggcgcuga

SEQ ID NO: 3875285 - RNA, 16 nt, Shigella flexneri 2a str. 2457T
gaagcugaugauuggu

SEQ ID NO: 3875286 - RNA, 16 nt, Shigella flexneri 2a str. 2457T
gaagcugcaaguauuc

SEQ ID NO: 3875287 - RNA, 18 nt, Shigella flexneri 2a str. 2457T
gaagcuggauuaacgcug

SEQ ID NO: 3875288 - RNA, 22 nt, Shigella flexneri 2a str. 2457T
gaagcuggauuaacgcugggga

SEQ ID NO: 3875289 - RNA, 17 nt, Shigella flexneri 2a str. 2457T
gaagcuggcagaaguug

SEQ ID NO: 3875290 - RNA, 14 nt, Shigella flexneri 2a str. 2457T
gaagcuggcggcgg

SEQ ID NO: 3875291 - RNA, 18 nt, Shigella flexneri 2a str. 2457T
gaagcuggucagcaucgu

SEQ ID NO: 3875292 - RNA, 19 nt, Shigella flexneri 2a str. 2457T
gaaggaagacgcagcaugc

SEQ ID NO: 3875293 - RNA, 15 nt, Shigella flexneri 2a str. 2457T
gaaggaauuuuacag

SEQ ID NO: 3875294 - RNA, 22 nt, Shigella flexneri 2a str. 2457T
gaaggacucgaggagcuggagg

SEQ ID NO: 3875295 - RNA, 20 nt, Shigella flexneri 2a str. 2457T
gaaggcaaacuucucgccau

SEQ ID NO: 3875296 - RNA, 17 nt, Shigella flexneri 2a str. 2457T
gaaggcaagaaagcgua

SEQ ID NO: 3875297 - RNA, 22 nt, Shigella flexneri 2a str. 2457T
gaaggcacuggucgaugccgac

SEQ ID NO: 3875298 - RNA, 21 nt, Shigella flexneri 2a str. 2457T
gaaggcgauguucuggucacu

SEQ ID NO: 3875299 - RNA, 15 nt, Shigella flexneri 2a str. 2457T
gaaggcgcugacguu

SEQ ID NO: 3875300 - RNA, 16 nt, Shigella flexneri 2a str. 2457T
gaaggcuuauaaggaa

SEQ ID NO: 3875301 - RNA, 18 nt, Shigella flexneri 2a str. 2457T
gaaggcuucguaaguggc

SEQ ID NO: 3875302 - RNA, 20 nt, Shigella flexneri 2a str. 2457T
gaagggauugugcaggcgcu

SEQ ID NO: 3875303 - RNA, 17 nt, Shigella flexneri 2a str. 2457T
gaaggggccgaaaaaug

SEQ ID NO: 3875304 - RNA, 20 nt, Shigella flexneri 2a str. 2457T
gaaggugccucccguuuugc

SEQ ID NO: 3875305 - RNA, 20 nt, Shigella flexneri 2a str. 2457T
gaagguucaagacgaauacc

SEQ ID NO: 3875306 - RNA, 19 nt, Shigella flexneri 2a str. 2457T
gaagguugccauaucuucc

SEQ ID NO: 3875307 - RNA, 21 nt, Shigella flexneri 2a str. 2457T
gaagguuucugcauuauccag

SEQ ID NO: 3875308 - RNA, 21 nt, Shigella flexneri 2a str. 2457T
gaaguaauaaucaacgcaccg

SEQ ID NO: 3875309 - RNA, 18 nt, Shigella flexneri 2a str. 2457T
gaaguaccauugaagcaa

SEQ ID NO: 3875310 - RNA, 16 nt, Shigella flexneri 2a str. 2457T
gaaguagccuucauca

SEQ ID NO: 3875311 - RNA, 17 nt, Shigella flexneri 2a str. 2457T
gaaguaguugcugucga

SEQ ID NO: 3875312 - RNA, 21 nt, Shigella flexneri 2a str. 2457T
gaaguauggaaaucacccagc

SEQ ID NO: 3875313 - RNA, 14 nt, Shigella flexneri 2a str. 2457T
gaaguauucuuuua

SEQ ID NO: 3875314 - RNA, 17 nt, Shigella flexneri 2a str. 2457T
gaaguauuggugagucc

SEQ ID NO: 3875315 - RNA, 20 nt, Shigella flexneri 2a str. 2457T
gaagucaacgcucaggccga

SEQ ID NO: 3875316 - RNA, 23 nt, Shigella flexneri 2a str. 2457T
gaaguccacgcgguagcgggcag

SEQ ID NO: 3875317 - RNA, 21 nt, Shigella flexneri 2a str. 2457T
gaagucgcagaccaaacucuu

SEQ ID NO: 3875318 - RNA, 21 nt, Shigella flexneri 2a str. 2457T
gaagugaacguguaggccuga

SEQ ID NO: 3875319 - RNA, 20 nt, Shigella flexneri 2a str. 2457T
gaagugauccgccgcgcggu

SEQ ID NO: 3875320 - RNA, 23 nt, Shigella flexneri 2a str. 2457T
gaagugauccgccgcgcgguggg

SEQ ID NO: 3875321 - RNA, 16 nt, Shigella flexneri 2a str. 2457T
gaaguggacgaacagu

SEQ ID NO: 3875322 - RNA, 15 nt, Shigella flexneri 2a str. 2457T
gaaguggcguucagc

SEQ ID NO: 3875323 - RNA, 23 nt, Shigella flexneri 2a str. 2457T
gaagugguucauguugcgguggu

SEQ ID NO: 3875324 - RNA, 18 nt, Shigella flexneri 2a str. 2457T
gaaguuguccaugugcug

SEQ ID NO: 3875325 - RNA, 16 nt, Shigella flexneri 2a str. 2457T
gaaguuuaauucuuug

SEQ ID NO: 3875326 - RNA, 13 nt, Shigella flexneri 2a str. 2457T
gaaguuucagcgc

SEQ ID NO: 3875327 - RNA, 15 nt, Shigella flexneri 2a str. 2457T
gaaguuuuccucagu

SEQ ID NO: 3875328 - RNA, 18 nt, Shigella flexneri 2a str. 2457T
gaaguuuugucgcugauu

SEQ ID NO: 3875329 - RNA, 20 nt, Shigella flexneri 2a str. 2457T
gaauaaaacagaaaccgagg

SEQ ID NO: 3875330 - RNA, 16 nt, Shigella flexneri 2a str. 2457T
gaauaaaacaggcagc

SEQ ID NO: 3875331 - RNA, 12 nt, Shigella flexneri 2a str. 2457T
gaauaaaagcca

SEQ ID NO: 3875332 - RNA, 15 nt, Shigella flexneri 2a str. 2457T
gaauaacaccagcca

SEQ ID NO: 3875333 - RNA, 23 nt, Shigella flexneri 2a str. 2457T
gaauaacacccauaaaaaaaccc

SEQ ID NO: 3875334 - RNA, 17 nt, Shigella flexneri 2a str. 2457T
gaauaaccaguucccug

SEQ ID NO: 3875335 - RNA, 14 nt, Shigella flexneri 2a str. 2457T
gaauaaccauggca

SEQ ID NO: 3875336 - RNA, 13 nt, Shigella flexneri 2a str. 2457T
gaauaaccgguuc

SEQ ID NO: 3875337 - RNA, 18 nt, Shigella flexneri 2a str. 2457T
gaauaacuggcgcgacaa

SEQ ID NO: 3875338 - RNA, 15 nt, Shigella flexneri 2a str. 2457T
gaauaagcugcguga

SEQ ID NO: 3875339 - RNA, 13 nt, Shigella flexneri 2a str. 2457T
gaauaaucagaug

SEQ ID NO: 3875340 - RNA, 15 nt, Shigella flexneri 2a str. 2457T
gaauaauccgcccgg

SEQ ID NO: 3875341 - RNA, 17 nt, Shigella flexneri 2a str. 2457T
gaauaaugcaaaaaggc

SEQ ID NO: 3875342 - RNA, 18 nt, Shigella flexneri 2a str. 2457T
gaauacagaacagugcca

SEQ ID NO: 3875343 - RNA, 23 nt, Shigella flexneri 2a str. 2457T
gaauacagaacagugccaugcca

SEQ ID NO: 3875344 - RNA, 22 nt, Shigella flexneri 2a str. 2457T
gaauaccaacgaggagacugca

SEQ ID NO: 3875345 - RNA, 21 nt, Shigella flexneri 2a str. 2457T
gaauaccccauggagaaaaug

SEQ ID NO: 3875346 - RNA, 15 nt, Shigella flexneri 2a str. 2457T
gaauaccguaacgac

SEQ ID NO: 3875347 - RNA, 15 nt, Shigella flexneri 2a str. 2457T
gaauugcgagccugu

SEQ ID NO: 3875348 - RNA, 21 nt, Shigella flexneri 2a str. 2457T
gaauuguuuggacgaauuagc

SEQ ID NO: 3875349 - RNA, 15 nt, Shigella flexneri 2a str. 2457T
gaauuucagaaaacg

SEQ ID NO: 3875350 - RNA, 17 nt, Shigella flexneri 2a str. 2457T
gaauuucaucaccagcu

SEQ ID NO: 3875351 - RNA, 20 nt, Shigella flexneri 2a str. 2457T
gaauuuccuucgcuuccugu

SEQ ID NO: 3875352 - RNA, 18 nt, Shigella flexneri 2a str. 2457T
gaauuucucgugccacca

SEQ ID NO: 3875353 - RNA, 15 nt, Shigella flexneri 2a str. 2457T
gaauuugaugagaac

SEQ ID NO: 3875354 - RNA, 15 nt, Shigella flexneri 2a str. 2457T
gaauuuuccuucgga

SEQ ID NO: 3875355 - RNA, 21 nt, Shigella flexneri 2a str. 2457T
gaauuuuccuucggauuuccg

SEQ ID NO: 3875356 - RNA, 19 nt, Shigella flexneri 2a str. 2457T
gaauuuuuccguugcugau

SEQ ID NO: 3875357 - RNA, 22 nt, Shigella flexneri 2a str. 2457T
gaauuuuuuauagaccuuaauu

SEQ ID NO: 3875358 - RNA, 14 nt, Shigella flexneri 2a str. 2457T
gacaaaaauaccac

SEQ ID NO: 3875359 - RNA, 12 nt, Shigella flexneri 2a str. 2457T
gacaaaauccug

SEQ ID NO: 3875360 - RNA, 21 nt, Shigella flexneri 2a str. 2457T
gacaaacagcucgacaccaaa

SEQ ID NO: 3875361 - RNA, 20 nt, Shigella flexneri 2a str. 2457T
gacaaacaggaaguuucagc

SEQ ID NO: 3875362 - RNA, 22 nt, Shigella flexneri 2a str. 2457T
gacaaacgcuguaauuaccagc

SEQ ID NO: 3875363 - RNA, 15 nt, Shigella flexneri 2a str. 2457T
gacaaagacaucaaa

SEQ ID NO: 3875364 - RNA, 13 nt, Shigella flexneri 2a str. 2457T
gacaacaacauca

SEQ ID NO: 3875365 - RNA, 13 nt, Shigella flexneri 2a str. 2457T
gacaacaucaucu

SEQ ID NO: 3875366 - RNA, 18 nt, Shigella flexneri 2a str. 2457T
gacaaccagcuucaacga

SEQ ID NO: 3875367 - RNA, 21 nt, Shigella flexneri 2a str. 2457T
gacaaccugaccuuuuuucag

SEQ ID NO: 3875368 - RNA, 18 nt, Shigella flexneri 2a str. 2457T
gacaacgccauauaaauu

SEQ ID NO: 3875369 - RNA, 13 nt, Shigella flexneri 2a str. 2457T
gacaagaauacaa

SEQ ID NO: 3875370 - RNA, 19 nt, Shigella flexneri 2a str. 2457T
gacaagcguaugauugccu

SEQ ID NO: 3875371 - RNA, 17 nt, Shigella flexneri 2a str. 2457T
gacaagcgucgcaucag

SEQ ID NO: 3875372 - RNA, 13 nt, Shigella flexneri 2a str. 2457T
gacaagcuuacgu

SEQ ID NO: 3875373 - RNA, 14 nt, Shigella flexneri 2a str. 2457T
gacaaggcaucaga

SEQ ID NO: 3875374 - RNA, 13 nt, Shigella flexneri 2a str. 2457T
gacaauaaacggc

SEQ ID NO: 3875375 - RNA, 22 nt, Shigella flexneri 2a str. 2457T
gacaauaauaucuuuuuugcgu

SEQ ID NO: 3875376 - RNA, 15 nt, Shigella flexneri 2a str. 2457T
gacaaucaaccagca

SEQ ID NO: 3875377 - RNA, 16 nt, Shigella flexneri 2a str. 2457T
gacaaucaaccagcac

SEQ ID NO: 3875378 - RNA, 14 nt, Shigella flexneri 2a str. 2457T
gacaaucgccacuu

SEQ ID NO: 3875379 - RNA, 13 nt, Shigella flexneri 2a str. 2457T
gacaaucgccagu

SEQ ID NO: 3875380 - RNA, 13 nt, Shigella flexneri 2a str. 2457T
gacaauuuaccga

SEQ ID NO: 3875381 - RNA, 21 nt, Shigella flexneri 2a str. 2457T
gacaauuuaccgacgcugcuc

SEQ ID NO: 3875382 - RNA, 13 nt, Shigella flexneri 2a str. 2457T
gacaauuugccca

SEQ ID NO: 3875383 - RNA, 18 nt, Shigella flexneri 2a str. 2457T
gacaauuuguuggcgaaa

SEQ ID NO: 3875384 - RNA, 15 nt, Shigella flexneri 2a str. 2457T
gacacaacuggcgca

SEQ ID NO: 3875385 - RNA, 21 nt, Shigella flexneri 2a str. 2457T
gacacacgagaguuaguguua

SEQ ID NO: 3875386 - RNA, 12 nt, Shigella flexneri 2a str. 2457T
gacaccaaacag

SEQ ID NO: 3875387 - RNA, 13 nt, Shigella flexneri 2a str. 2457T
gacaccagaaugg

SEQ ID NO: 3875388 - RNA, 18 nt, Shigella flexneri 2a str. 2457T
gacaccagcucagugacc

SEQ ID NO: 3875389 - RNA, 17 nt, Shigella flexneri 2a str. 2457T
gacaccagucgugcggu

SEQ ID NO: 3875390 - RNA, 20 nt, Shigella flexneri 2a str. 2457T
gacaccauaacagaggccac

SEQ ID NO: 3875391 - RNA, 21 nt, Shigella flexneri 2a str. 2457T
gacaccauaacagaggccacc

SEQ ID NO: 3875392 - RNA, 18 nt, Shigella flexneri 2a str. 2457T
gacaccccacagcucuug

SEQ ID NO: 3875393 - RNA, 16 nt, Shigella flexneri 2a str. 2457T
gacaccccuucauuca

SEQ ID NO: 3875394 - RNA, 16 nt, Shigella flexneri 2a str. 2457T
gacaccgcccaacaga

SEQ ID NO: 3875395 - RNA, 18 nt, Shigella flexneri 2a str. 2457T
gacaccgcccaacagacg

SEQ ID NO: 3875396 - RNA, 18 nt, Shigella flexneri 2a str. 2457T
gacacgccuccuggcuca

SEQ ID NO: 3875397 - RNA, 16 nt, Shigella flexneri 2a str. 2457T
gacacgcgcgcauggu

SEQ ID NO: 3875398 - RNA, 22 nt, Shigella flexneri 2a str. 2457T
gacacgggaaaccaacuccagc

SEQ ID NO: 3875399 - RNA, 18 nt, Shigella flexneri 2a str. 2457T
gacacuaacgcgucuuau

SEQ ID NO: 3875400 - RNA, 13 nt, Shigella flexneri 2a str. 2457T
gacacuccuuccu

SEQ ID NO: 3875401 - RNA, 18 nt, Shigella flexneri 2a str. 2457T
gacacugaaugacgacgu

SEQ ID NO: 3875402 - RNA, 18 nt, Shigella flexneri 2a str. 2457T
gacacugccggaagagag

SEQ ID NO: 3875403 - RNA, 14 nt, Shigella flexneri 2a str. 2457T
gacacuucaagaau

SEQ ID NO: 3875404 - RNA, 21 nt, Shigella flexneri 2a str. 2457T
gacagaacucguucagcgcau

SEQ ID NO: 3875405 - RNA, 12 nt, Shigella flexneri 2a str. 2457T
gacagaauauaa

SEQ ID NO: 3875406 - RNA, 19 nt, Shigella flexneri 2a str. 2457T
gacagaccaaaacgugcag

SEQ ID NO: 3875407 - RNA, 19 nt, Shigella flexneri 2a str. 2457T
gacagaccugcgucaccac

SEQ ID NO: 3875408 - RNA, 23 nt, Shigella flexneri 2a str. 2457T
gacagacgacgacgcgcgcgggu

SEQ ID NO: 3875409 - RNA, 21 nt, Shigella flexneri 2a str. 2457T
gacagacuugacgccuuuacc

SEQ ID NO: 3875410 - RNA, 15 nt, Shigella flexneri 2a str. 2457T
gacagagaaagcaaa

SEQ ID NO: 3875411 - RNA, 22 nt, Shigella flexneri 2a str. 2457T
gacagagauucgguaaccaucc

SEQ ID NO: 3875412 - RNA, 15 nt, Shigella flexneri 2a str. 2457T
gacagaugcucgcca

SEQ ID NO: 3875413 - RNA, 14 nt, Shigella flexneri 2a str. 2457T
gacagauucaggcg

SEQ ID NO: 3875414 - RNA, 15 nt, Shigella flexneri 2a str. 2457T
gacagauucaugcug

SEQ ID NO: 3875415 - RNA, 20 nt, Shigella flexneri 2a str. 2457T
gacagauucaugcugcggcu

SEQ ID NO: 3875416 - RNA, 15 nt, Shigella flexneri 2a str. 2457T
gacagauuuugccag

SEQ ID NO: 3875417 - RNA, 19 nt, Shigella flexneri 2a str. 2457T
gacagauuuugccagcaug

SEQ ID NO: 3875418 - RNA, 22 nt, Shigella flexneri 2a str. 2457T
gacagauuuugccagcaugacu

SEQ ID NO: 3875419 - RNA, 18 nt, Shigella flexneri 2a str. 2457T
gacagcaaagugccccca

SEQ ID NO: 3875420 - RNA, 15 nt, Shigella flexneri 2a str. 2457T
gacagcaggcucaga

SEQ ID NO: 3875421 - RNA, 18 nt, Shigella flexneri 2a str. 2457T
gacagcagguugcgugca

SEQ ID NO: 3875422 - RNA, 18 nt, Shigella flexneri 2a str. 2457T
gacagcaucguccgccag

SEQ ID NO: 3875423 - RNA, 21 nt, Shigella flexneri 2a str. 2457T
gacagccauaaagaaaucacc

SEQ ID NO: 3875424 - RNA, 20 nt, Shigella flexneri 2a str. 2457T
gacagccauccgucauccau

SEQ ID NO: 3875425 - RNA, 20 nt, Shigella flexneri 2a str. 2457T
gacagcccggcauguuucaa

SEQ ID NO: 3875426 - RNA, 15 nt, Shigella flexneri 2a str. 2457T
gacagccucaagcac

SEQ ID NO: 3875427 - RNA, 19 nt, Shigella flexneri 2a str. 2457T
gacagcgauuaccauuuca

SEQ ID NO: 3875428 - RNA, 14 nt, Shigella flexneri 2a str. 2457T
gacagcgccgcuuu

SEQ ID NO: 3875429 - RNA, 18 nt, Shigella flexneri 2a str. 2457T
gacagcgccuuuucuuua

SEQ ID NO: 3875430 - RNA, 14 nt, Shigella flexneri 2a str. 2457T
gacagggaucucuu

SEQ ID NO: 3875431 - RNA, 22 nt, Shigella flexneri 2a str. 2457T
gacagggcgcgggcaacagaau

SEQ ID NO: 3875432 - RNA, 18 nt, Shigella flexneri 2a str. 2457T
gacagggugagcagggca

SEQ ID NO: 3875433 - RNA, 19 nt, Shigella flexneri 2a str. 2457T
gacagggugagcagggcac

SEQ ID NO: 3875434 - RNA, 17 nt, Shigella flexneri 2a str. 2457T
gacaggucagcgccugg

SEQ ID NO: 3875435 - RNA, 19 nt, Shigella flexneri 2a str. 2457T
gacaggucagcgccuggcu

SEQ ID NO: 3875436 - RNA, 22 nt, Shigella flexneri 2a str. 2457T
gacaggucagcgccuggcugca

SEQ ID NO: 3875437 - RNA, 14 nt, Shigella flexneri 2a str. 2457T
gacaggugaugcau

SEQ ID NO: 3875438 - RNA, 20 nt, Shigella flexneri 2a str. 2457T
gacaguaaucuaccccagug

SEQ ID NO: 3875439 - RNA, 14 nt, Shigella flexneri 2a str. 2457T
gacaguaucaucau

SEQ ID NO: 3875440 - RNA, 19 nt, Shigella flexneri 2a str. 2457T
gacaguaucaucauuauua

SEQ ID NO: 3875441 - RNA, 21 nt, Shigella flexneri 2a str. 2457T
gacaguaugguuacugucguu

SEQ ID NO: 3875442 - RNA, 15 nt, Shigella flexneri 2a str. 2457T
gacaguccccucgcc

SEQ ID NO: 3875443 - RNA, 20 nt, Shigella flexneri 2a str. 2457T
gacagugggauuaaaaagua

SEQ ID NO: 3875444 - RNA, 16 nt, Shigella flexneri 2a str. 2457T
gaccgauaaugauccc

SEQ ID NO: 3875445 - RNA, 17 nt, Shigella flexneri 2a str. 2457T
gaccgaugucgucccuu

SEQ ID NO: 3875446 - RNA, 15 nt, Shigella flexneri 2a str. 2457T
gaccgcaaccggccg

SEQ ID NO: 3875447 - RNA, 15 nt, Shigella flexneri 2a str. 2457T
gaccgccagcgccau

SEQ ID NO: 3875448 - RNA, 12 nt, Shigella flexneri 2a str. 2457T
gaccgccaggca

SEQ ID NO: 3875449 - RNA, 16 nt, Shigella flexneri 2a str. 2457T
gaccgcccgcuaugag

SEQ ID NO: 3875450 - RNA, 22 nt, Shigella flexneri 2a str. 2457T
gaccgccgauuuccugcgucgc

SEQ ID NO: 3875451 - RNA, 17 nt, Shigella flexneri 2a str. 2457T
gaccgccgccaaucacc

SEQ ID NO: 3875452 - RNA, 15 nt, Shigella flexneri 2a str. 2457T
gaccgcuccgccauc

SEQ ID NO: 3875453 - RNA, 18 nt, Shigella flexneri 2a str. 2457T
gaccggaaaagguguuca

SEQ ID NO: 3875454 - RNA, 22 nt, Shigella flexneri 2a str. 2457T
gaccggcaaucgcgccagaaca

SEQ ID NO: 3875455 - RNA, 20 nt, Shigella flexneri 2a str. 2457T
gaccggcgucgcauccggca

SEQ ID NO: 3875456 - RNA, 17 nt, Shigella flexneri 2a str. 2457T
gaccgucgccuucaacg

SEQ ID NO: 3875457 - RNA, 22 nt, Shigella flexneri 2a str. 2457T
gaccguuagcauauugcaggcu

SEQ ID NO: 3875458 - RNA, 18 nt, Shigella flexneri 2a str. 2457T
gaccguuccauucaaacg

SEQ ID NO: 3875459 - RNA, 15 nt, Shigella flexneri 2a str. 2457T
gaccguuuucaccag

SEQ ID NO: 3875460 - RNA, 18 nt, Shigella flexneri 2a str. 2457T
gaccuaaacguuuaaaaa

SEQ ID NO: 3875461 - RNA, 14 nt, Shigella flexneri 2a str. 2457T
gaccuaccaucucc

SEQ ID NO: 3875462 - RNA, 18 nt, Shigella flexneri 2a str. 2457T
gaccuacgcgcccgcgca

SEQ ID NO: 3875463 - RNA, 15 nt, Shigella flexneri 2a str. 2457T
gaccucaaaggccga

SEQ ID NO: 3875464 - RNA, 14 nt, Shigella flexneri 2a str. 2457T
gaccucaacaaaau

SEQ ID NO: 3875465 - RNA, 15 nt, Shigella flexneri 2a str. 2457T
gaccucacuuucugg

SEQ ID NO: 3875466 - RNA, 23 nt, Shigella flexneri 2a str. 2457T
gaccucuuaaugcaggcagcacu

SEQ ID NO: 3875467 - RNA, 22 nt, Shigella flexneri 2a str. 2457T
gaccucuucugccuguccacca

SEQ ID NO: 3875468 - RNA, 18 nt, Shigella flexneri 2a str. 2457T
gaccugaauuugcuccag

SEQ ID NO: 3875469 - RNA, 16 nt, Shigella flexneri 2a str. 2457T
gaccugacuguuccag

SEQ ID NO: 3875470 - RNA, 18 nt, Shigella flexneri 2a str. 2457T
gaccugacuguuccagca

SEQ ID NO: 3875471 - RNA, 15 nt, Shigella flexneri 2a str. 2457T
gaccugauacauagc

SEQ ID NO: 3875472 - RNA, 16 nt, Shigella flexneri 2a str. 2457T
gaccugauuuugcaac

SEQ ID NO: 3875473 - RNA, 19 nt, Shigella flexneri 2a str. 2457T
gaccugcaaauucaauaaa

SEQ ID NO: 3875474 - RNA, 13 nt, Shigella flexneri 2a str. 2457T
gaccugcagaaaa

SEQ ID NO: 3875475 - RNA, 15 nt, Shigella flexneri 2a str. 2457T
gaccugcgccugcac

SEQ ID NO: 3875476 - RNA, 18 nt, Shigella flexneri 2a str. 2457T
gaccugggaaauccaaca

SEQ ID NO: 3875477 - RNA, 17 nt, Shigella flexneri 2a str. 2457T
gaccuguaaaguacaau

SEQ ID NO: 3875478 - RNA, 20 nt, Shigella flexneri 2a str. 2457T
gaccuguaccuucagcggca

SEQ ID NO: 3875479 - RNA, 21 nt, Shigella flexneri 2a str. 2457T
gaccugucggggccagcgcau

SEQ ID NO: 3875480 - RNA, 23 nt, Shigella flexneri 2a str. 2457T
gaccugucggggccagcgcaucc

SEQ ID NO: 3875481 - RNA, 13 nt, Shigella flexneri 2a str. 2457T
gaccugugccagc

SEQ ID NO: 3875482 - RNA, 15 nt, Shigella flexneri 2a str. 2457T
gaccuguucuccugg

SEQ ID NO: 3875483 - RNA, 17 nt, Shigella flexneri 2a str. 2457T
gaccuuaucgaagaggg

SEQ ID NO: 3875484 - RNA, 17 nt, Shigella flexneri 2a str. 2457T
gaccuucugaauaauga

SEQ ID NO: 3875485 - RNA, 17 nt, Shigella flexneri 2a str. 2457T
gaccuugucaugcagcu

SEQ ID NO: 3875486 - RNA, 20 nt, Shigella flexneri 2a str. 2457T
gaccuuuacggcuugcgcgc

SEQ ID NO: 3875487 - RNA, 19 nt, Shigella flexneri 2a str. 2457T
gaccuuucaguuugccgcu

SEQ ID NO: 3875488 - RNA, 18 nt, Shigella flexneri 2a str. 2457T
gaccuuucgaacccaacc

SEQ ID NO: 3875489 - RNA, 13 nt, Shigella flexneri 2a str. 2457T
gaccuuuuuucag

SEQ ID NO: 3875490 - RNA, 17 nt, Shigella flexneri 2a str. 2457T
gacgaaaaaucaauaaa

SEQ ID NO: 3875491 - RNA, 15 nt, Shigella flexneri 2a str. 2457T
gacgaaagucugggc

SEQ ID NO: 3875492 - RNA, 16 nt, Shigella flexneri 2a str. 2457T
gacgaaauccccccgg

SEQ ID NO: 3875493 - RNA, 13 nt, Shigella flexneri 2a str. 2457T
gacgaaccggcac

SEQ ID NO: 3875494 - RNA, 12 nt, Shigella flexneri 2a str. 2457T
gacgaauaaucc

SEQ ID NO: 3875495 - RNA, 13 nt, Shigella flexneri 2a str. 2457T
gacgacaccaucu

SEQ ID NO: 3875496 - RNA, 22 nt, Shigella flexneri 2a str. 2457T
gacgacgccccggccuugccug

SEQ ID NO: 3875497 - RNA, 18 nt, Shigella flexneri 2a str. 2457T
gacgacguaccagcgucg

SEQ ID NO: 3875498 - RNA, 14 nt, Shigella flexneri 2a str. 2457T
gacgaggcgcuggc

SEQ ID NO: 3875499 - RNA, 23 nt, Shigella flexneri 2a str. 2457T
gacgauagauagagaaguaaccg

SEQ ID NO: 3875500 - RNA, 15 nt, Shigella flexneri 2a str. 2457T
gacgauugugcuggu

SEQ ID NO: 3875501 - RNA, 23 nt, Shigella flexneri 2a str. 2457T
gacgcagaccaaagucaaacugg

SEQ ID NO: 3875502 - RNA, 22 nt, Shigella flexneri 2a str. 2457T
gacgcaggaugcaauuguugag

SEQ ID NO: 3875503 - RNA, 21 nt, Shigella flexneri 2a str. 2457T
gacgcaggcgcgcuguggugu

SEQ ID NO: 3875504 - RNA, 22 nt, Shigella flexneri 2a str. 2457T
gacgcauccgaucgcgcaucag

SEQ ID NO: 3875505 - RNA, 14 nt, Shigella flexneri 2a str. 2457T
gacgcauugauaau

SEQ ID NO: 3875506 - RNA, 12 nt, Shigella flexneri 2a str. 2457T
gacgcauugcau

SEQ ID NO: 3875507 - RNA, 19 nt, Shigella flexneri 2a str. 2457T
gacgccacaaucugauaau

SEQ ID NO: 3875508 - RNA, 20 nt, Shigella flexneri 2a str. 2457T
gacgccacaaucugauaauc

SEQ ID NO: 3875509 - RNA, 17 nt, Shigella flexneri 2a str. 2457T
gacgccaccauucacca

SEQ ID NO: 3875510 - RNA, 16 nt, Shigella flexneri 2a str. 2457T
gacgccauucacuggc

SEQ ID NO: 3875511 - RNA, 21 nt, Shigella flexneri 2a str. 2457T
gacgccccggccuugccuguu

SEQ ID NO: 3875512 - RNA, 21 nt, Shigella flexneri 2a str. 2457T
gacgcccguuaaccgcucugc

SEQ ID NO: 3875513 - RNA, 18 nt, Shigella flexneri 2a str. 2457T
gacgcccugcgcugguga

SEQ ID NO: 3875514 - RNA, 21 nt, Shigella flexneri 2a str. 2457T
gacgccgccggugucgcaccu

SEQ ID NO: 3875515 - RNA, 15 nt, Shigella flexneri 2a str. 2457T
gacgcgacaagcguc

SEQ ID NO: 3875516 - RNA, 19 nt, Shigella flexneri 2a str. 2457T
gacgcgaccggcgucgcau

SEQ ID NO: 3875517 - RNA, 13 nt, Shigella flexneri 2a str. 2457T
gacgcgacucagc

SEQ ID NO: 3875518 - RNA, 14 nt, Shigella flexneri 2a str. 2457T
gacgcgauccgccg

SEQ ID NO: 3875519 - RNA, 17 nt, Shigella flexneri 2a str. 2457T
gacgcgcagcgucgcau

SEQ ID NO: 3875520 - RNA, 14 nt, Shigella flexneri 2a str. 2457T
gacgcgcagcuuca

SEQ ID NO: 3875521 - RNA, 13 nt, Shigella flexneri 2a str. 2457T
gacgcgcaucacg

SEQ ID NO: 3875522 - RNA, 17 nt, Shigella flexneri 2a str. 2457T
gacgcgcaucacgacaa

SEQ ID NO: 3875523 - RNA, 16 nt, Shigella flexneri 2a str. 2457T
gacgcgccaacaaaug

SEQ ID NO: 3875524 - RNA, 13 nt, Shigella flexneri 2a str. 2457T
gacgcgccagcac

SEQ ID NO: 3875525 - RNA, 14 nt, Shigella flexneri 2a str. 2457T
gacgcgccagcacc

SEQ ID NO: 3875526 - RNA, 17 nt, Shigella flexneri 2a str. 2457T
gacgcgcuauugccgua

SEQ ID NO: 3875527 - RNA, 20 nt, Shigella flexneri 2a str. 2457T
gacgcggcagcgucgcauca

SEQ ID NO: 3875528 - RNA, 22 nt, Shigella flexneri 2a str. 2457T
gacgcggcauuuuuacugcgcg

SEQ ID NO: 3875529 - RNA, 16 nt, Shigella flexneri 2a str. 2457T
gacgcgguaaaagccc

SEQ ID NO: 3875530 - RNA, 17 nt, Shigella flexneri 2a str. 2457T
gacgcgguaaaagccca

SEQ ID NO: 3875531 - RNA, 20 nt, Shigella flexneri 2a str. 2457T
gacgcgguagcacgucaucu

SEQ ID NO: 3875532 - RNA, 17 nt, Shigella flexneri 2a str. 2457T
gacgcgguauuggugaa

SEQ ID NO: 3875533 - RNA, 19 nt, Shigella flexneri 2a str. 2457T
gacgcgucaagcgucgcau

SEQ ID NO: 3875534 - RNA, 18 nt, Shigella flexneri 2a str. 2457T
gacgcgucagugucuuau

SEQ ID NO: 3875535 - RNA, 12 nt, Shigella flexneri 2a str. 2457T
gacgcgucuuau

SEQ ID NO: 3875536 - RNA, 19 nt, Shigella flexneri 2a str. 2457T
gacgcgucuuaucuggccu

SEQ ID NO: 3875537 - RNA, 23 nt, Shigella flexneri 2a str. 2457T
gacgcgugccuaacaauucgcca

SEQ ID NO: 3875538 - RNA, 13 nt, Shigella flexneri 2a str. 2457T
gacgcguuagcau

SEQ ID NO: 3875539 - RNA, 15 nt, Shigella flexneri 2a str. 2457T
gacgcuggucgcguc

SEQ ID NO: 3875540 - RNA, 20 nt, Shigella flexneri 2a str. 2457T
gacgcuguuccggcggcagg

SEQ ID NO: 3875541 - RNA, 13 nt, Shigella flexneri 2a str. 2457T
gacgcuuacggac

SEQ ID NO: 3875542 - RNA, 22 nt, Shigella flexneri 2a str. 2457T
gagaaaguaaaccaccaguccu

SEQ ID NO: 3875543 - RNA, 14 nt, Shigella flexneri 2a str. 2457T
gagaaauaccaccc

SEQ ID NO: 3875544 - RNA, 19 nt, Shigella flexneri 2a str. 2457T
gagaacaagauugccugau

SEQ ID NO: 3875545 - RNA, 17 nt, Shigella flexneri 2a str. 2457T
gagaacaaggcuuuaau

SEQ ID NO: 3875546 - RNA, 12 nt, Shigella flexneri 2a str. 2457T
gagaacgaugcu

SEQ ID NO: 3875547 - RNA, 22 nt, Shigella flexneri 2a str. 2457T
gagaacggacccgcgaucgccu

SEQ ID NO: 3875548 - RNA, 14 nt, Shigella flexneri 2a str. 2457T
gagaacggaguuga

SEQ ID NO: 3875549 - RNA, 17 nt, Shigella flexneri 2a str. 2457T
gagaacggcgcaccaga

SEQ ID NO: 3875550 - RNA, 14 nt, Shigella flexneri 2a str. 2457T
gagaacugaaccaa

SEQ ID NO: 3875551 - RNA, 19 nt, Shigella flexneri 2a str. 2457T
gagaacugcgccagacgcg

SEQ ID NO: 3875552 - RNA, 13 nt, Shigella flexneri 2a str. 2457T
gagaagcaccgcc

SEQ ID NO: 3875553 - RNA, 21 nt, Shigella flexneri 2a str. 2457T
gagaagcacguucaucccacu

SEQ ID NO: 3875554 - RNA, 16 nt, Shigella flexneri 2a str. 2457T
gagaagccaccgcgcc

SEQ ID NO: 3875555 - RNA, 14 nt, Shigella flexneri 2a str. 2457T
gagaagcgguuaaa

SEQ ID NO: 3875556 - RNA, 17 nt, Shigella flexneri 2a str. 2457T
gagaagcugcugccgcu

SEQ ID NO: 3875557 - RNA, 14 nt, Shigella flexneri 2a str. 2457T
gagaagcuggaagg

SEQ ID NO: 3875558 - RNA, 15 nt, Shigella flexneri 2a str. 2457T
gagaagcuggaaggg

SEQ ID NO: 3875559 - RNA, 22 nt, Shigella flexneri 2a str. 2457T
gagaagucggcuuuuagcgaca

SEQ ID NO: 3875560 - RNA, 16 nt, Shigella flexneri 2a str. 2457T
gagaauaaccaguucc

SEQ ID NO: 3875561 - RNA, 16 nt, Shigella flexneri 2a str. 2457T
gagaaucaguuuuuuc

SEQ ID NO: 3875562 - RNA, 18 nt, Shigella flexneri 2a str. 2457T
gagaaucgauaugucuuu

SEQ ID NO: 3875563 - RNA, 18 nt, Shigella flexneri 2a str. 2457T
gagaaucguacucaccag

SEQ ID NO: 3875564 - RNA, 19 nt, Shigella flexneri 2a str. 2457T
gagaauggggucagcaggu

SEQ ID NO: 3875565 - RNA, 15 nt, Shigella flexneri 2a str. 2457T
gagacaacaacauca

SEQ ID NO: 3875566 - RNA, 19 nt, Shigella flexneri 2a str. 2457T
gagacagccgaaaagguag

SEQ ID NO: 3875567 - RNA, 20 nt, Shigella flexneri 2a str. 2457T
gagacagcuuagacagcgcc

SEQ ID NO: 3875568 - RNA, 21 nt, Shigella flexneri 2a str. 2457T
gagacagcuuagacagcgccg

SEQ ID NO: 3875569 - RNA, 19 nt, Shigella flexneri 2a str. 2457T
gagacauuacguccaucac

SEQ ID NO: 3875570 - RNA, 23 nt, Shigella flexneri 2a str. 2457T
gagacauugugugaaaucagcac

SEQ ID NO: 3875571 - RNA, 13 nt, Shigella flexneri 2a str. 2457T
gagacgcagcguu

SEQ ID NO: 3875572 - RNA, 14 nt, Shigella flexneri 2a str. 2457T
gagacgcuggaagc

SEQ ID NO: 3875573 - RNA, 15 nt, Shigella flexneri 2a str. 2457T
gagagaacugcgcca

SEQ ID NO: 3875574 - RNA, 20 nt, Shigella flexneri 2a str. 2457T
gagagaagcacguucauccc

SEQ ID NO: 3875575 - RNA, 13 nt, Shigella flexneri 2a str. 2457T
gagagaagccaga

SEQ ID NO: 3875576 - RNA, 13 nt, Shigella flexneri 2a str. 2457T
gagagagaaaaua

SEQ ID NO: 3875577 - RNA, 15 nt, Shigella flexneri 2a str. 2457T
gagagcaugaaauga

SEQ ID NO: 3875578 - RNA, 16 nt, Shigella flexneri 2a str. 2457T
gagagcaugaaaugaa

SEQ ID NO: 3875579 - RNA, 18 nt, Shigella flexneri 2a str. 2457T
gagagcuuuucagccuga

SEQ ID NO: 3875580 - RNA, 15 nt, Shigella flexneri 2a str. 2457T
gagaggccuucgccu

SEQ ID NO: 3875581 - RNA, 22 nt, Shigella flexneri 2a str. 2457T
gagaggcugaaggcgcuccccu

SEQ ID NO: 3875582 - RNA, 19 nt, Shigella flexneri 2a str. 2457T
gagaguacugccgggaaga

SEQ ID NO: 3875583 - RNA, 16 nt, Shigella flexneri 2a str. 2457T
gagauaaccacguuca

SEQ ID NO: 3875584 - RNA, 15 nt, Shigella flexneri 2a str. 2457T
gagauaacguuuugc

SEQ ID NO: 3875585 - RNA, 15 nt, Shigella flexneri 2a str. 2457T
gagauacaucaccgc

SEQ ID NO: 3875586 - RNA, 22 nt, Shigella flexneri 2a str. 2457T
gagauaccaguugaucaaauaa

SEQ ID NO: 3875587 - RNA, 20 nt, Shigella flexneri 2a str. 2457T
gagauagaaugccaaguaau

SEQ ID NO: 3875588 - RNA, 21 nt, Shigella flexneri 2a str. 2457T
gagauagauuaguuguacauu

SEQ ID NO: 3875589 - RNA, 12 nt, Shigella flexneri 2a str. 2457T
gagauauucccc

SEQ ID NO: 3875590 - RNA, 16 nt, Shigella flexneri 2a str. 2457T
gagauauuccccagac

SEQ ID NO: 3875591 - RNA, 22 nt, Shigella flexneri 2a str. 2457T
gagaucgaccggguuagucugg

SEQ ID NO: 3875592 - RNA, 13 nt, Shigella flexneri 2a str. 2457T
gagaucgccgcug

SEQ ID NO: 3875593 - RNA, 18 nt, Shigella flexneri 2a str. 2457T
gagaucgcuuaacagaac

SEQ ID NO: 3875594 - RNA, 21 nt, Shigella flexneri 2a str. 2457T
gagaucguuggucgcgcacug

SEQ ID NO: 3875595 - RNA, 23 nt, Shigella flexneri 2a str. 2457T
gagaucguuggucgcgcacugcg

SEQ ID NO: 3875596 - RNA, 13 nt, Shigella flexneri 2a str. 2457T
gagaugcuggaga

SEQ ID NO: 3875597 - RNA, 23 nt, Shigella flexneri 2a str. 2457T
gagaugucgccucucgccgccgg

SEQ ID NO: 3875598 - RNA, 18 nt, Shigella flexneri 2a str. 2457T
gagauucgguaaccaucc

SEQ ID NO: 3875599 - RNA, 20 nt, Shigella flexneri 2a str. 2457T
gagauuuaugacaaacgcaa

SEQ ID NO: 3875600 - RNA, 18 nt, Shigella flexneri 2a str. 2457T
gagauuuuuccccaccuc

SEQ ID NO: 3875601 - RNA, 17 nt, Shigella flexneri 2a str. 2457T
gagcaaaccacaggccg

SEQ ID NO: 3875602 - RNA, 12 nt, Shigella flexneri 2a str. 2457T
gagcaaauaaaa

SEQ ID NO: 3875603 - RNA, 13 nt, Shigella flexneri 2a str. 2457T
gagcaaccaccug

SEQ ID NO: 3875604 - RNA, 13 nt, Shigella flexneri 2a str. 2457T
gagcaacugcgcu

SEQ ID NO: 3875605 - RNA, 21 nt, Shigella flexneri 2a str. 2457T
gagcaaugaucucaauaguuc

SEQ ID NO: 3875606 - RNA, 22 nt, Shigella flexneri 2a str. 2457T
gagcaaugcgcaucaaagccag

SEQ ID NO: 3875607 - RNA, 20 nt, Shigella flexneri 2a str. 2457T
gagcacacauuacgccagua

SEQ ID NO: 3875608 - RNA, 12 nt, Shigella flexneri 2a str. 2457T
gagcacaugcag

SEQ ID NO: 3875609 - RNA, 21 nt, Shigella flexneri 2a str. 2457T
gagcacgcaagguuucaguaa

SEQ ID NO: 3875610 - RNA, 15 nt, Shigella flexneri 2a str. 2457T
gagcacuauccgaca

SEQ ID NO: 3875611 - RNA, 19 nt, Shigella flexneri 2a str. 2457T
gagcacugcgcccgccagc

SEQ ID NO: 3875612 - RNA, 21 nt, Shigella flexneri 2a str. 2457T
gagcacugcgcccgccagcau

SEQ ID NO: 3875613 - RNA, 17 nt, Shigella flexneri 2a str. 2457T
gagcacuuuucugguca

SEQ ID NO: 3875614 - RNA, 21 nt, Shigella flexneri 2a str. 2457T
gagcagacuguaaaucugccg

SEQ ID NO: 3875615 - RNA, 17 nt, Shigella flexneri 2a str. 2457T
gagcagcagucaggcgc

SEQ ID NO: 3875616 - RNA, 14 nt, Shigella flexneri 2a str. 2457T
gagcagcauuaccu

SEQ ID NO: 3875617 - RNA, 19 nt, Shigella flexneri 2a str. 2457T
gagcagcauuccggcauuu

SEQ ID NO: 3875618 - RNA, 18 nt, Shigella flexneri 2a str. 2457T
gagcaggcguuaaaacag

SEQ ID NO: 3875619 - RNA, 21 nt, Shigella flexneri 2a str. 2457T
gagcaguagcgucgccagcag

SEQ ID NO: 3875620 - RNA, 13 nt, Shigella flexneri 2a str. 2457T
gagcauauuuagg

SEQ ID NO: 3875621 - RNA, 19 nt, Shigella flexneri 2a str. 2457T
gagcaucaguuaacggcac

SEQ ID NO: 3875622 - RNA, 16 nt, Shigella flexneri 2a str. 2457T
gagcaucgguaucuuc

SEQ ID NO: 3875623 - RNA, 17 nt, Shigella flexneri 2a str. 2457T
gagcaugcuccggccuu

SEQ ID NO: 3875624 - RNA, 18 nt, Shigella flexneri 2a str. 2457T
gagcaugguaacgcccca

SEQ ID NO: 3875625 - RNA, 19 nt, Shigella flexneri 2a str. 2457T
gagcauucccgccaucguu

SEQ ID NO: 3875626 - RNA, 17 nt, Shigella flexneri 2a str. 2457T
gagccaaacgcccagcu

SEQ ID NO: 3875627 - RNA, 22 nt, Shigella flexneri 2a str. 2457T
gagccaacguuucgcugugauu

SEQ ID NO: 3875628 - RNA, 20 nt, Shigella flexneri 2a str. 2457T
gagccaccuuaugagucaga

SEQ ID NO: 3875629 - RNA, 20 nt, Shigella flexneri 2a str. 2457T
gagccagucguuacaacgcu

SEQ ID NO: 3875630 - RNA, 21 nt, Shigella flexneri 2a str. 2457T
gagccauugcccgaugcgcaa

SEQ ID NO: 3875631 - RNA, 22 nt, Shigella flexneri 2a str. 2457T
gagcccaucacaauggcacaaa

SEQ ID NO: 3875632 - RNA, 22 nt, Shigella flexneri 2a str. 2457T
gagccgcuacggaagaugaaaa

SEQ ID NO: 3875633 - RNA, 14 nt, Shigella flexneri 2a str. 2457T
gagccgcuggcggu

SEQ ID NO: 3875634 - RNA, 17 nt, Shigella flexneri 2a str. 2457T
gagccugaauaaacgcc

SEQ ID NO: 3875635 - RNA, 19 nt, Shigella flexneri 2a str. 2457T
gagccugccaauggcaggc

SEQ ID NO: 3875636 - RNA, 23 nt, Shigella flexneri 2a str. 2457T
gagccuguuacauaugcgcuggc

SEQ ID NO: 3875637 - RNA, 17 nt, Shigella flexneri 2a str. 2457T
gagcgaauacuccccuu

SEQ ID NO: 3875638 - RNA, 22 nt, Shigella flexneri 2a str. 2457T
gagcgacaccucccagcgcggu

SEQ ID NO: 3875639 - RNA, 19 nt, Shigella flexneri 2a str. 2457T
gaguuaccagcggccggau

SEQ ID NO: 3875640 - RNA, 19 nt, Shigella flexneri 2a str. 2457T
gaguucaaagccgaagcug

SEQ ID NO: 3875641 - RNA, 20 nt, Shigella flexneri 2a str. 2457T
gaguucaaagccgaagcugu

SEQ ID NO: 3875642 - RNA, 17 nt, Shigella flexneri 2a str. 2457T
gaguucaccguaugacc

SEQ ID NO: 3875643 - RNA, 19 nt, Shigella flexneri 2a str. 2457T
gaguucccggcagggaagc

SEQ ID NO: 3875644 - RNA, 14 nt, Shigella flexneri 2a str. 2457T
gaguugaaaaccuc

SEQ ID NO: 3875645 - RNA, 15 nt, Shigella flexneri 2a str. 2457T
gaguugcaccagcaa

SEQ ID NO: 3875646 - RNA, 22 nt, Shigella flexneri 2a str. 2457T
gaguugcaccagcaacaagcca

SEQ ID NO: 3875647 - RNA, 19 nt, Shigella flexneri 2a str. 2457T
gaguugccaucaucaccag

SEQ ID NO: 3875648 - RNA, 22 nt, Shigella flexneri 2a str. 2457T
gaguugccaucaucaccagaau

SEQ ID NO: 3875649 - RNA, 17 nt, Shigella flexneri 2a str. 2457T
gaguuguucugcgacgc

SEQ ID NO: 3875650 - RNA, 16 nt, Shigella flexneri 2a str. 2457T
gaguuuuucaguccac

SEQ ID NO: 3875651 - RNA, 12 nt, Shigella flexneri 2a str. 2457T
gauaaaaaugaa

SEQ ID NO: 3875652 - RNA, 12 nt, Shigella flexneri 2a str. 2457T
gauaaaaccuuc

SEQ ID NO: 3875653 - RNA, 21 nt, Shigella flexneri 2a str. 2457T
gauaaaaccuuccucaccguu

SEQ ID NO: 3875654 - RNA, 14 nt, Shigella flexneri 2a str. 2457T
gauaaaacgacacc

SEQ ID NO: 3875655 - RNA, 21 nt, Shigella flexneri 2a str. 2457T
gauaaaacgcagucuucccag

SEQ ID NO: 3875656 - RNA, 14 nt, Shigella flexneri 2a str. 2457T
gauaaaacuucccg

SEQ ID NO: 3875657 - RNA, 16 nt, Shigella flexneri 2a str. 2457T
gauaaaagccaucccu

SEQ ID NO: 3875658 - RNA, 19 nt, Shigella flexneri 2a str. 2457T
gauaaaagccaucccugua

SEQ ID NO: 3875659 - RNA, 18 nt, Shigella flexneri 2a str. 2457T
gauaaaauacacuuuaau

SEQ ID NO: 3875660 - RNA, 13 nt, Shigella flexneri 2a str. 2457T
gauaaaauacuua

SEQ ID NO: 3875661 - RNA, 19 nt, Shigella flexneri 2a str. 2457T
gauaaacaguuucgccagg

SEQ ID NO: 3875662 - RNA, 15 nt, Shigella flexneri 2a str. 2457T
gauaaaccuccagca

SEQ ID NO: 3875663 - RNA, 16 nt, Shigella flexneri 2a str. 2457T
gauaaacggcaggaga

SEQ ID NO: 3875664 - RNA, 13 nt, Shigella flexneri 2a str. 2457T
gauaaagcugggu

SEQ ID NO: 3875665 - RNA, 15 nt, Shigella flexneri 2a str. 2457T
gauaaaggcggccca

SEQ ID NO: 3875666 - RNA, 12 nt, Shigella flexneri 2a str. 2457T
gauaaaggucga

SEQ ID NO: 3875667 - RNA, 14 nt, Shigella flexneri 2a str. 2457T
gauaaauauuauug

SEQ ID NO: 3875668 - RNA, 12 nt, Shigella flexneri 2a str. 2457T
gauaaaucucau

SEQ ID NO: 3875669 - RNA, 18 nt, Shigella flexneri 2a str. 2457T
gauaaaucuccauuucau

SEQ ID NO: 3875670 - RNA, 12 nt, Shigella flexneri 2a str. 2457T
gauaaauuacug

SEQ ID NO: 3875671 - RNA, 13 nt, Shigella flexneri 2a str. 2457T
gauaacaaaauaa

SEQ ID NO: 3875672 - RNA, 14 nt, Shigella flexneri 2a str. 2457T
gauaacaaaauaac

SEQ ID NO: 3875673 - RNA, 20 nt, Shigella flexneri 2a str. 2457T
gauaaccacguucauuucau

SEQ ID NO: 3875674 - RNA, 14 nt, Shigella flexneri 2a str. 2457T
gauaacccagcgca

SEQ ID NO: 3875675 - RNA, 17 nt, Shigella flexneri 2a str. 2457T
gauaacccggcggcgga

SEQ ID NO: 3875676 - RNA, 13 nt, Shigella flexneri 2a str. 2457T
gauaaccuuccag

SEQ ID NO: 3875677 - RNA, 13 nt, Shigella flexneri 2a str. 2457T
gauaaccuucuuc

SEQ ID NO: 3875678 - RNA, 22 nt, Shigella flexneri 2a str. 2457T
gauaacgccuagaaaucauuca

SEQ ID NO: 3875679 - RNA, 23 nt, Shigella flexneri 2a str. 2457T
gauaacgccuagaaaucauucaa

SEQ ID NO: 3875680 - RNA, 20 nt, Shigella flexneri 2a str. 2457T
gauaacggugcaacccgcca

SEQ ID NO: 3875681 - RNA, 23 nt, Shigella flexneri 2a str. 2457T
gauaacguguuccaguugcauac

SEQ ID NO: 3875682 - RNA, 21 nt, Shigella flexneri 2a str. 2457T
gauaacguugaugcaggcagu

SEQ ID NO: 3875683 - RNA, 16 nt, Shigella flexneri 2a str. 2457T
gauaacucaaaaauaa

SEQ ID NO: 3875684 - RNA, 15 nt, Shigella flexneri 2a str. 2457T
gauaagaacugacuu

SEQ ID NO: 3875685 - RNA, 13 nt, Shigella flexneri 2a str. 2457T
gauaagacgcgca

SEQ ID NO: 3875686 - RNA, 17 nt, Shigella flexneri 2a str. 2457T
gauaagaugcuacaaca

SEQ ID NO: 3875687 - RNA, 16 nt, Shigella flexneri 2a str. 2457T
gauaagccccaguucc

SEQ ID NO: 3875688 - RNA, 23 nt, Shigella flexneri 2a str. 2457T
gauaagcguagcgcaucaggcaa

SEQ ID NO: 3875689 - RNA, 18 nt, Shigella flexneri 2a str. 2457T
gauaaggcaacgccccuu

SEQ ID NO: 3875690 - RNA, 14 nt, Shigella flexneri 2a str. 2457T
gauaaguuaacccc

SEQ ID NO: 3875691 - RNA, 19 nt, Shigella flexneri 2a str. 2457T
gauaaguuaaccccaguaa

SEQ ID NO: 3875692 - RNA, 15 nt, Shigella flexneri 2a str. 2457T
gauaaguucaaguuu

SEQ ID NO: 3875693 - RNA, 15 nt, Shigella flexneri 2a str. 2457T
gauaauaauguguuc

SEQ ID NO: 3875694 - RNA, 22 nt, Shigella flexneri 2a str. 2457T
gauaauacacuaacagaacaau

SEQ ID NO: 3875695 - RNA, 14 nt, Shigella flexneri 2a str. 2457T
gauaauacgcguaa

SEQ ID NO: 3875696 - RNA, 16 nt, Shigella flexneri 2a str. 2457T
gauaauagcguuucag

SEQ ID NO: 3875697 - RNA, 20 nt, Shigella flexneri 2a str. 2457T
gauaauagguaaacauccgu

SEQ ID NO: 3875698 - RNA, 17 nt, Shigella flexneri 2a str. 2457T
gauaauauuuaucuucc

SEQ ID NO: 3875699 - RNA, 16 nt, Shigella flexneri 2a str. 2457T
gauaaucacaaugguc

SEQ ID NO: 3875700 - RNA, 16 nt, Shigella flexneri 2a str. 2457T
gauaaucagcgccagc

SEQ ID NO: 3875701 - RNA, 21 nt, Shigella flexneri 2a str. 2457T
gauaauccgguuuacccgcuu

SEQ ID NO: 3875702 - RNA, 21 nt, Shigella flexneri 2a str. 2457T
gauaaucguauucuggcuucg

SEQ ID NO: 3875703 - RNA, 16 nt, Shigella flexneri 2a str. 2457T
gauaaugaucccgacg

SEQ ID NO: 3875704 - RNA, 18 nt, Shigella flexneri 2a str. 2457T
gauaaugcccgaugaccu

SEQ ID NO: 3875705 - RNA, 20 nt, Shigella flexneri 2a str. 2457T
gauaaugguuuccagcaucg

SEQ ID NO: 3875706 - RNA, 20 nt, Shigella flexneri 2a str. 2457T
gauaauuagugcugcuggaa

SEQ ID NO: 3875707 - RNA, 15 nt, Shigella flexneri 2a str. 2457T
gauaauuauuauaau

SEQ ID NO: 3875708 - RNA, 15 nt, Shigella flexneri 2a str. 2457T
gauaauuuucuuauc

SEQ ID NO: 3875709 - RNA, 16 nt, Shigella flexneri 2a str. 2457T
gauaauuuuuucuucc

SEQ ID NO: 3875710 - RNA, 17 nt, Shigella flexneri 2a str. 2457T
gauaauuuuuucuucca

SEQ ID NO: 3875711 - RNA, 22 nt, Shigella flexneri 2a str. 2457T
gauacaacucgcuuaagccauc

SEQ ID NO: 3875712 - RNA, 23 nt, Shigella flexneri 2a str. 2457T
gauacaacugccgcgccugaauc

SEQ ID NO: 3875713 - RNA, 20 nt, Shigella flexneri 2a str. 2457T
gauacacaccgagcguggcg

SEQ ID NO: 3875714 - RNA, 19 nt, Shigella flexneri 2a str. 2457T
gauacagccaaaucaucag

SEQ ID NO: 3875715 - RNA, 14 nt, Shigella flexneri 2a str. 2457T
gauacaguuuuugc

SEQ ID NO: 3875716 - RNA, 13 nt, Shigella flexneri 2a str. 2457T
gauacaucagcga

SEQ ID NO: 3875717 - RNA, 18 nt, Shigella flexneri 2a str. 2457T
gauaccaaaaucggcaac

SEQ ID NO: 3875718 - RNA, 20 nt, Shigella flexneri 2a str. 2457T
gauaccaaaauggcgcagga

SEQ ID NO: 3875719 - RNA, 22 nt, Shigella flexneri 2a str. 2457T
gauaccaauguagccgcggauc

SEQ ID NO: 3875720 - RNA, 17 nt, Shigella flexneri 2a str. 2457T
gauaccagauuaauuau

SEQ ID NO: 3875721 - RNA, 19 nt, Shigella flexneri 2a str. 2457T
gauaccaucgcuucaugcc

SEQ ID NO: 3875722 - RNA, 13 nt, Shigella flexneri 2a str. 2457T
gauacccaucauc

SEQ ID NO: 3875723 - RNA, 23 nt, Shigella flexneri 2a str. 2457T
gauacccccucucgucugccgga

SEQ ID NO: 3875724 - RNA, 20 nt, Shigella flexneri 2a str. 2457T
gauacccgcgaggcgcauaa

SEQ ID NO: 3875725 - RNA, 18 nt, Shigella flexneri 2a str. 2457T
gauaccgccgcacaauac

SEQ ID NO: 3875726 - RNA, 22 nt, Shigella flexneri 2a str. 2457T
gauaccgccgccaugcuugaag

SEQ ID NO: 3875727 - RNA, 19 nt, Shigella flexneri 2a str. 2457T
gauaccgguaaucaggcaa

SEQ ID NO: 3875728 - RNA, 22 nt, Shigella flexneri 2a str. 2457T
gauaccggugcaccuucaagua

SEQ ID NO: 3875729 - RNA, 19 nt, Shigella flexneri 2a str. 2457T
gauaccguucagacggcag

SEQ ID NO: 3875730 - RNA, 22 nt, Shigella flexneri 2a str. 2457T
gauaccuaacacgaucagccau

SEQ ID NO: 3875731 - RNA, 16 nt, Shigella flexneri 2a str. 2457T
gauaccuaacauuuua

SEQ ID NO: 3875732 - RNA, 20 nt, Shigella flexneri 2a str. 2457T
gauacgaccguuccauucaa

SEQ ID NO: 3875733 - RNA, 17 nt, Shigella flexneri 2a str. 2457T
gauacgagagccggaag

SEQ ID NO: 3875734 - RNA, 20 nt, Shigella flexneri 2a str. 2457T
gauacgauuugucagcagcu

SEQ ID NO: 3875735 - RNA, 20 nt, Shigella flexneri 2a str. 2457T
gauacgguuuuuugaacaga

SEQ ID NO: 3875736 - RNA, 12 nt, Shigella flexneri 2a str. 2457T
gaucauccgccu

SEQ ID NO: 3875737 - RNA, 15 nt, Shigella flexneri 2a str. 2457T
gaucauuagcccaau

SEQ ID NO: 3875738 - RNA, 18 nt, Shigella flexneri 2a str. 2457T
gaucauuauuaaacagac

SEQ ID NO: 3875739 - RNA, 15 nt, Shigella flexneri 2a str. 2457T
gaucauucaccagcc

SEQ ID NO: 3875740 - RNA, 20 nt, Shigella flexneri 2a str. 2457T
gauccacaacgugggccugg

SEQ ID NO: 3875741 - RNA, 15 nt, Shigella flexneri 2a str. 2457T
gauccaccacgcugu

SEQ ID NO: 3875742 - RNA, 16 nt, Shigella flexneri 2a str. 2457T
gauccagcucuucuuc

SEQ ID NO: 3875743 - RNA, 18 nt, Shigella flexneri 2a str. 2457T
gauccagcucuucuucac

SEQ ID NO: 3875744 - RNA, 17 nt, Shigella flexneri 2a str. 2457T
gauccaggagcuccagg

SEQ ID NO: 3875745 - RNA, 14 nt, Shigella flexneri 2a str. 2457T
gauccagugcguau

SEQ ID NO: 3875746 - RNA, 16 nt, Shigella flexneri 2a str. 2457T
gauccaguuacccagc

SEQ ID NO: 3875747 - RNA, 21 nt, Shigella flexneri 2a str. 2457T
gauccauacucuuucccggca

SEQ ID NO: 3875748 - RNA, 22 nt, Shigella flexneri 2a str. 2457T
gauccauauuuugaaucggcgg

SEQ ID NO: 3875749 - RNA, 23 nt, Shigella flexneri 2a str. 2457T
gaucccacggcggugucgccaga

SEQ ID NO: 3875750 - RNA, 16 nt, Shigella flexneri 2a str. 2457T
gaucccagagcgggca

SEQ ID NO: 3875751 - RNA, 19 nt, Shigella flexneri 2a str. 2457T
gauccccgcuuccugcagc

SEQ ID NO: 3875752 - RNA, 18 nt, Shigella flexneri 2a str. 2457T
gauccgcacccgcacgcu

SEQ ID NO: 3875753 - RNA, 18 nt, Shigella flexneri 2a str. 2457T
gauccgggcauauuuccg

SEQ ID NO: 3875754 - RNA, 21 nt, Shigella flexneri 2a str. 2457T
gauccugauacagaccgcgca

SEQ ID NO: 3875755 - RNA, 15 nt, Shigella flexneri 2a str. 2457T
gauccugauccugca

SEQ ID NO: 3875756 - RNA, 22 nt, Shigella flexneri 2a str. 2457T
gauccugauuuaacaucuccac

SEQ ID NO: 3875757 - RNA, 15 nt, Shigella flexneri 2a str. 2457T
gauccugcacuuuca

SEQ ID NO: 3875758 - RNA, 21 nt, Shigella flexneri 2a str. 2457T
gauccugcacuuucagcacgu

SEQ ID NO: 3875759 - RNA, 14 nt, Shigella flexneri 2a str. 2457T
gauccuguucaucc

SEQ ID NO: 3875760 - RNA, 15 nt, Shigella flexneri 2a str. 2457T
gauccuuuuucccaa

SEQ ID NO: 3875761 - RNA, 17 nt, Shigella flexneri 2a str. 2457T
gaucgacagcgggugca

SEQ ID NO: 3875762 - RNA, 18 nt, Shigella flexneri 2a str. 2457T
gaucgacgcguccaggcu

SEQ ID NO: 3875763 - RNA, 15 nt, Shigella flexneri 2a str. 2457T
gaucgaucauauuuc

SEQ ID NO: 3875764 - RNA, 16 nt, Shigella flexneri 2a str. 2457T
gaucgcauggcggauc

SEQ ID NO: 3875765 - RNA, 14 nt, Shigella flexneri 2a str. 2457T
gaucgccaaagaaa

SEQ ID NO: 3875766 - RNA, 13 nt, Shigella flexneri 2a str. 2457T
gaucgccacugcu

SEQ ID NO: 3875767 - RNA, 14 nt, Shigella flexneri 2a str. 2457T
gaucgccacugcug

SEQ ID NO: 3875768 - RNA, 13 nt, Shigella flexneri 2a str. 2457T
gaucgccagcagg

SEQ ID NO: 3875769 - RNA, 13 nt, Shigella flexneri 2a str. 2457T
gaucgccauauuu

SEQ ID NO: 3875770 - RNA, 14 nt, Shigella flexneri 2a str. 2457T
gaucgccauauuuc

SEQ ID NO: 3875771 - RNA, 20 nt, Shigella flexneri 2a str. 2457T
gaucgccccggaagcaucaa

SEQ ID NO: 3875772 - RNA, 17 nt, Shigella flexneri 2a str. 2457T
gaucgccccggucauca

SEQ ID NO: 3875773 - RNA, 19 nt, Shigella flexneri 2a str. 2457T
gaucgccgcacuuucuccu

SEQ ID NO: 3875774 - RNA, 17 nt, Shigella flexneri 2a str. 2457T
gaucgccguaacgcccu

SEQ ID NO: 3875775 - RNA, 21 nt, Shigella flexneri 2a str. 2457T
gaucgccugcagggcuuucac

SEQ ID NO: 3875776 - RNA, 20 nt, Shigella flexneri 2a str. 2457T
gaucgccugguaccagcacc

SEQ ID NO: 3875777 - RNA, 21 nt, Shigella flexneri 2a str. 2457T
gaucgcuaaggguauagaagc

SEQ ID NO: 3875778 - RNA, 19 nt, Shigella flexneri 2a str. 2457T
gaucgcucaucugcugcgu

SEQ ID NO: 3875779 - RNA, 20 nt, Shigella flexneri 2a str. 2457T
gaucgcugaacgcaccuucc

SEQ ID NO: 3875780 - RNA, 19 nt, Shigella flexneri 2a str. 2457T
gaucgcugcccugcugguu

SEQ ID NO: 3875781 - RNA, 14 nt, Shigella flexneri 2a str. 2457T
gaucgcuucggucu

SEQ ID NO: 3875782 - RNA, 20 nt, Shigella flexneri 2a str. 2457T
gaucgcuuucgcuuucucuu

SEQ ID NO: 3875783 - RNA, 17 nt, Shigella flexneri 2a str. 2457T
gaucggaggcagcgucu

SEQ ID NO: 3875784 - RNA, 15 nt, Shigella flexneri 2a str. 2457T
gaucggcaggcaggu

SEQ ID NO: 3875785 - RNA, 15 nt, Shigella flexneri 2a str. 2457T
gaucgggcauuucca

SEQ ID NO: 3875786 - RNA, 19 nt, Shigella flexneri 2a str. 2457T
gaucguggugaugaucgug

SEQ ID NO: 3875787 - RNA, 20 nt, Shigella flexneri 2a str. 2457T
gaucgugugccaccagcgca

SEQ ID NO: 3875788 - RNA, 16 nt, Shigella flexneri 2a str. 2457T
gaucuaccgcuucccu

SEQ ID NO: 3875789 - RNA, 20 nt, Shigella flexneri 2a str. 2457T
gaucuaugucgcauccggca

SEQ ID NO: 3875790 - RNA, 20 nt, Shigella flexneri 2a str. 2457T
gaucucaagacaauuagugg

SEQ ID NO: 3875791 - RNA, 17 nt, Shigella flexneri 2a str. 2457T
gaucucuucgccugccu

SEQ ID NO: 3875792 - RNA, 17 nt, Shigella flexneri 2a str. 2457T
gaucugacugauaacgc

SEQ ID NO: 3875793 - RNA, 15 nt, Shigella flexneri 2a str. 2457T
gaucugauggaaaau

SEQ ID NO: 3875794 - RNA, 23 nt, Shigella flexneri 2a str. 2457T
gaucugccuguccggcauacuau

SEQ ID NO: 3875795 - RNA, 12 nt, Shigella flexneri 2a str. 2457T
gaucugcggguu

SEQ ID NO: 3875796 - RNA, 18 nt, Shigella flexneri 2a str. 2457T
gaucugcgucgcuuucca

SEQ ID NO: 3875797 - RNA, 17 nt, Shigella flexneri 2a str. 2457T
gaucuggcgcguuauca

SEQ ID NO: 3875798 - RNA, 16 nt, Shigella flexneri 2a str. 2457T
gaucuguugcuggcuu

SEQ ID NO: 3875799 - RNA, 14 nt, Shigella flexneri 2a str. 2457T
gaucuguuuaucac

SEQ ID NO: 3875800 - RNA, 17 nt, Shigella flexneri 2a str. 2457T
gaucuuuaucaaucacc

SEQ ID NO: 3875801 - RNA, 13 nt, Shigella flexneri 2a str. 2457T
gaucuuucacgcc

SEQ ID NO: 3875802 - RNA, 22 nt, Shigella flexneri 2a str. 2457T
gaugaaaaaaccagaaagggaa

SEQ ID NO: 3875803 - RNA, 15 nt, Shigella flexneri 2a str. 2457T
gaugaacaacccuaa

SEQ ID NO: 3875804 - RNA, 14 nt, Shigella flexneri 2a str. 2457T
gaugaaucaccaca

SEQ ID NO: 3875805 - RNA, 18 nt, Shigella flexneri 2a str. 2457T
gaugaaucaguaggugca

SEQ ID NO: 3875806 - RNA, 22 nt, Shigella flexneri 2a str. 2457T
gaugaauuugugaacagccugu

SEQ ID NO: 3875807 - RNA, 23 nt, Shigella flexneri 2a str. 2457T
gaugacagucuggaagccaguca

SEQ ID NO: 3875808 - RNA, 15 nt, Shigella flexneri 2a str. 2457T
gaugacaucgcagca

SEQ ID NO: 3875809 - RNA, 14 nt, Shigella flexneri 2a str. 2457T
gaugacaugcaaug

SEQ ID NO: 3875810 - RNA, 17 nt, Shigella flexneri 2a str. 2457T
gaugacgacgacuggcc

SEQ ID NO: 3875811 - RNA, 19 nt, Shigella flexneri 2a str. 2457T
gaugagaacggaguugagg

SEQ ID NO: 3875812 - RNA, 16 nt, Shigella flexneri 2a str. 2457T
gaugagaugcuggaga

SEQ ID NO: 3875813 - RNA, 16 nt, Shigella flexneri 2a str. 2457T
gaugaguuaagaagau

SEQ ID NO: 3875814 - RNA, 14 nt, Shigella flexneri 2a str. 2457T
gaugaguucaccgu

SEQ ID NO: 3875815 - RNA, 14 nt, Shigella flexneri 2a str. 2457T
gaugaguugaaaac

SEQ ID NO: 3875816 - RNA, 17 nt, Shigella flexneri 2a str. 2457T
gaugaucaagcgcacaa

SEQ ID NO: 3875817 - RNA, 20 nt, Shigella flexneri 2a str. 2457T
gaugaucauccggcuuuuuu

SEQ ID NO: 3875818 - RNA, 21 nt, Shigella flexneri 2a str. 2457T
gaugaucgcggcauuaccggc

SEQ ID NO: 3875819 - RNA, 14 nt, Shigella flexneri 2a str. 2457T
gaugaugauacuga

SEQ ID NO: 3875820 - RNA, 22 nt, Shigella flexneri 2a str. 2457T
gaugaugugaauggccagacac

SEQ ID NO: 3875821 - RNA, 13 nt, Shigella flexneri 2a str. 2457T
gaugcacagcacg

SEQ ID NO: 3875822 - RNA, 17 nt, Shigella flexneri 2a str. 2457T
gaugcaggcccagcggu

SEQ ID NO: 3875823 - RNA, 16 nt, Shigella flexneri 2a str. 2457T
gaugcauagcaaccgc

SEQ ID NO: 3875824 - RNA, 15 nt, Shigella flexneri 2a str. 2457T
gaugcaucagucacg

SEQ ID NO: 3875825 - RNA, 21 nt, Shigella flexneri 2a str. 2457T
gaugcaucgcauccgacauca

SEQ ID NO: 3875826 - RNA, 23 nt, Shigella flexneri 2a str. 2457T
gaugcaucggccucaacgucaaa

SEQ ID NO: 3875827 - RNA, 16 nt, Shigella flexneri 2a str. 2457T
gaugcaugauccggca

SEQ ID NO: 3875828 - RNA, 18 nt, Shigella flexneri 2a str. 2457T
gaugccagcgaagaagug

SEQ ID NO: 3875829 - RNA, 15 nt, Shigella flexneri 2a str. 2457T
gaugcccaugccaau

SEQ ID NO: 3875830 - RNA, 11 nt, Shigella flexneri 2a str. 2457T
gaugccccagu

SEQ ID NO: 3875831 - RNA, 13 nt, Shigella flexneri 2a str. 2457T
gaugcccccagca

SEQ ID NO: 3875832 - RNA, 13 nt, Shigella flexneri 2a str. 2457T
gaugccgccagac

SEQ ID NO: 3875833 - RNA, 19 nt, Shigella flexneri 2a str. 2457T
gaugccgccguagaaaaug

SEQ ID NO: 3875834 - RNA, 23 nt, Shigella flexneri 2a str. 2457T
gauuagccuucaugcgacgacgg

SEQ ID NO: 3875835 - RNA, 17 nt, Shigella flexneri 2a str. 2457T
gauuagucuuuaucugc

SEQ ID NO: 3875836 - RNA, 17 nt, Shigella flexneri 2a str. 2457T
gauuauauaauaugcau

SEQ ID NO: 3875837 - RNA, 15 nt, Shigella flexneri 2a str. 2457T
gauuauccaugccac

SEQ ID NO: 3875838 - RNA, 15 nt, Shigella flexneri 2a str. 2457T
gauuaucuucaccgu

SEQ ID NO: 3875839 - RNA, 16 nt, Shigella flexneri 2a str. 2457T
gauuaucuucgcacuu

SEQ ID NO: 3875840 - RNA, 14 nt, Shigella flexneri 2a str. 2457T
gauuaugaucgcca

SEQ ID NO: 3875841 - RNA, 15 nt, Shigella flexneri 2a str. 2457T
gauuaugaucgccac

SEQ ID NO: 3875842 - RNA, 22 nt, Shigella flexneri 2a str. 2457T
gauuauggaucaguguacuuau

SEQ ID NO: 3875843 - RNA, 16 nt, Shigella flexneri 2a str. 2457T
gauuaugucaucaucg

SEQ ID NO: 3875844 - RNA, 22 nt, Shigella flexneri 2a str. 2457T
gauuauuggacgguaaaaagaa

SEQ ID NO: 3875845 - RNA, 23 nt, Shigella flexneri 2a str. 2457T
gauuauuggacgguaaaaagaaa

SEQ ID NO: 3875846 - RNA, 18 nt, Shigella flexneri 2a str. 2457T
gauucaaaagaugagaaa

SEQ ID NO: 3875847 - RNA, 17 nt, Shigella flexneri 2a str. 2457T
gauucacauuuaaacaa

SEQ ID NO: 3875848 - RNA, 17 nt, Shigella flexneri 2a str. 2457T
gauucagauaaucccca

SEQ ID NO: 3875849 - RNA, 23 nt, Shigella flexneri 2a str. 2457T
gauucagauaauccccaaugacc

SEQ ID NO: 3875850 - RNA, 22 nt, Shigella flexneri 2a str. 2457T
gauucagcccgagguuauuuug

SEQ ID NO: 3875851 - RNA, 21 nt, Shigella flexneri 2a str. 2457T
gauucauacagcggccagcca

SEQ ID NO: 3875852 - RNA, 17 nt, Shigella flexneri 2a str. 2457T
gauucauauugccgugc

SEQ ID NO: 3875853 - RNA, 19 nt, Shigella flexneri 2a str. 2457T
gauucauccguuucccugu

SEQ ID NO: 3875854 - RNA, 16 nt, Shigella flexneri 2a str. 2457T
gauucaucucuucuuc

SEQ ID NO: 3875855 - RNA, 12 nt, Shigella flexneri 2a str. 2457T
gauucaugcugc

SEQ ID NO: 3875856 - RNA, 19 nt, Shigella flexneri 2a str. 2457T
gauucaugcugcggcuguc

SEQ ID NO: 3875857 - RNA, 13 nt, Shigella flexneri 2a str. 2457T
gauuccacucauu

SEQ ID NO: 3875858 - RNA, 15 nt, Shigella flexneri 2a str. 2457T
gauuccacucauuaa

SEQ ID NO: 3875859 - RNA, 14 nt, Shigella flexneri 2a str. 2457T
gauucccagucauc

SEQ ID NO: 3875860 - RNA, 17 nt, Shigella flexneri 2a str. 2457T
gauuccgguuggccugc

SEQ ID NO: 3875861 - RNA, 20 nt, Shigella flexneri 2a str. 2457T
gauuccugcgcuuccagcuc

SEQ ID NO: 3875862 - RNA, 15 nt, Shigella flexneri 2a str. 2457T
gauucgcccgcagcc

SEQ ID NO: 3875863 - RNA, 21 nt, Shigella flexneri 2a str. 2457T
gauucgccugaacaugcccuu

SEQ ID NO: 3875864 - RNA, 23 nt, Shigella flexneri 2a str. 2457T
gauucgucaauaucgagacgggc

SEQ ID NO: 3875865 - RNA, 17 nt, Shigella flexneri 2a str. 2457T
gauucguuuuucuucag

SEQ ID NO: 3875866 - RNA, 22 nt, Shigella flexneri 2a str. 2457T
gauucguuuuucuucagcagcc

SEQ ID NO: 3875867 - RNA, 15 nt, Shigella flexneri 2a str. 2457T
gauucugauccugca

SEQ ID NO: 3875868 - RNA, 17 nt, Shigella flexneri 2a str. 2457T
gauucuggugauugucu

SEQ ID NO: 3875869 - RNA, 23 nt, Shigella flexneri 2a str. 2457T
gauucuguguaaaugccuuucuc

SEQ ID NO: 3875870 - RNA, 16 nt, Shigella flexneri 2a str. 2457T
gauucuucgaugaugc

SEQ ID NO: 3875871 - RNA, 13 nt, Shigella flexneri 2a str. 2457T
gauugaagaaauc

SEQ ID NO: 3875872 - RNA, 17 nt, Shigella flexneri 2a str. 2457T
gauugaccgccagcgcc

SEQ ID NO: 3875873 - RNA, 13 nt, Shigella flexneri 2a str. 2457T
gauugauuuauca

SEQ ID NO: 3875874 - RNA, 16 nt, Shigella flexneri 2a str. 2457T
gauugauuuaucaggu

SEQ ID NO: 3875875 - RNA, 22 nt, Shigella flexneri 2a str. 2457T
gauugcaacaagaggcaauagu

SEQ ID NO: 3875876 - RNA, 22 nt, Shigella flexneri 2a str. 2457T
gauugcagacaaagugagcuuu

SEQ ID NO: 3875877 - RNA, 23 nt, Shigella flexneri 2a str. 2457T
gauugccagcauaaucaccauca

SEQ ID NO: 3875878 - RNA, 20 nt, Shigella flexneri 2a str. 2457T
gauugccccuguaauugccu

SEQ ID NO: 3875879 - RNA, 12 nt, Shigella flexneri 2a str. 2457T
gauugccgauau

SEQ ID NO: 3875880 - RNA, 19 nt, Shigella flexneri 2a str. 2457T
gauugccgauauaaaccau

SEQ ID NO: 3875881 - RNA, 23 nt, Shigella flexneri 2a str. 2457T
gauugccggggauuuuacugcuu

SEQ ID NO: 3875882 - RNA, 22 nt, Shigella flexneri 2a str. 2457T
gauugccguggauuuaaugcca

SEQ ID NO: 3875883 - RNA, 19 nt, Shigella flexneri 2a str. 2457T
gauugcgaauauguacuuu

SEQ ID NO: 3875884 - RNA, 18 nt, Shigella flexneri 2a str. 2457T
gauugcuccugcucauca

SEQ ID NO: 3875885 - RNA, 16 nt, Shigella flexneri 2a str. 2457T
gauugcuucaguugcc

SEQ ID NO: 3875886 - RNA, 17 nt, Shigella flexneri 2a str. 2457T
gauugcuucaguugccu

SEQ ID NO: 3875887 - RNA, 12 nt, Shigella flexneri 2a str. 2457T
gauugcuucugc

SEQ ID NO: 3875888 - RNA, 16 nt, Shigella flexneri 2a str. 2457T
gauuguauugauugcu

SEQ ID NO: 3875889 - RNA, 18 nt, Shigella flexneri 2a str. 2457T
gauugugugauacuucuu

SEQ ID NO: 3875890 - RNA, 14 nt, Shigella flexneri 2a str. 2457T
gauuguucgcaccg

SEQ ID NO: 3875891 - RNA, 14 nt, Shigella flexneri 2a str. 2457T
gauuuaacaucucc

SEQ ID NO: 3875892 - RNA, 20 nt, Shigella flexneri 2a str. 2457T
gauuuacuacguaauuucaa

SEQ ID NO: 3875893 - RNA, 14 nt, Shigella flexneri 2a str. 2457T
gauuuacuauuauu

SEQ ID NO: 3875894 - RNA, 14 nt, Shigella flexneri 2a str. 2457T
gauuuauaaaagaa

SEQ ID NO: 3875895 - RNA, 17 nt, Shigella flexneri 2a str. 2457T
gauuuaugauauuuuuu

SEQ ID NO: 3875896 - RNA, 21 nt, Shigella flexneri 2a str. 2457T
gauuuauguaccgucaucgcc

SEQ ID NO: 3875897 - RNA, 21 nt, Shigella flexneri 2a str. 2457T
gauuucaccaauuccgcagcg

SEQ ID NO: 3875898 - RNA, 17 nt, Shigella flexneri 2a str. 2457T
gauuucagcaccgcgcu

SEQ ID NO: 3875899 - RNA, 13 nt, Shigella flexneri 2a str. 2457T
gauuucaucgccc

SEQ ID NO: 3875900 - RNA, 11 nt, Shigella flexneri 2a str. 2457T
gauuucauuca

SEQ ID NO: 3875901 - RNA, 22 nt, Shigella flexneri 2a str. 2457T
gauuuccaagcgcggcaggcau

SEQ ID NO: 3875902 - RNA, 12 nt, Shigella flexneri 2a str. 2457T
gauuuccagcuc

SEQ ID NO: 3875903 - RNA, 22 nt, Shigella flexneri 2a str. 2457T
gauuuccguuaaccuaaagccu

SEQ ID NO: 3875904 - RNA, 13 nt, Shigella flexneri 2a str. 2457T
gauuuccuucagc

SEQ ID NO: 3875905 - RNA, 23 nt, Shigella flexneri 2a str. 2457T
gauuucgcaacgacaccguuaaa

SEQ ID NO: 3875906 - RNA, 17 nt, Shigella flexneri 2a str. 2457T
gauuucgccacccagcg

SEQ ID NO: 3875907 - RNA, 14 nt, Shigella flexneri 2a str. 2457T
gauuucuuuauccg

SEQ ID NO: 3875908 - RNA, 17 nt, Shigella flexneri 2a str. 2457T
gauuugcggaaguaguu

SEQ ID NO: 3875909 - RNA, 19 nt, Shigella flexneri 2a str. 2457T
gauuuuaauaaaucacgcu

SEQ ID NO: 3875910 - RNA, 15 nt, Shigella flexneri 2a str. 2457T
gauuuucaucuucuu

SEQ ID NO: 3875911 - RNA, 16 nt, Shigella flexneri 2a str. 2457T
gauuuugcaauaaugg

SEQ ID NO: 3875912 - RNA, 14 nt, Shigella flexneri 2a str. 2457T
gauuuugccagcau

SEQ ID NO: 3875913 - RNA, 15 nt, Shigella flexneri 2a str. 2457T
gauuuuguaaaagaa

SEQ ID NO: 3875914 - RNA, 24 nt, Shigella flexneri 2a str. 2457T
gauuuuucgugagagugaagccug

SEQ ID NO: 3875915 - RNA, 14 nt, Shigella flexneri 2a str. 2457T
gauuuuucugcucg

SEQ ID NO: 3875916 - RNA, 19 nt, Shigella flexneri 2a str. 2457T
gauuuuuuccaacaggcga

SEQ ID NO: 3875917 - RNA, 18 nt, Shigella flexneri 2a str. 2457T
gauuuuuugccagcacca

SEQ ID NO: 3875918 - RNA, 16 nt, Shigella flexneri 2a str. 2457T
gauuuuuuuauuuuuu

SEQ ID NO: 3875919 - RNA, 20 nt, Shigella flexneri 2a str. 2457T
gcaaaaaaacuugauacuga

SEQ ID NO: 3875920 - RNA, 16 nt, Shigella flexneri 2a str. 2457T
gcaaaaaaccaucccu

SEQ ID NO: 3875921 - RNA, 21 nt, Shigella flexneri 2a str. 2457T
gcaaaaaauugcgucaguauu

SEQ ID NO: 3875922 - RNA, 12 nt, Shigella flexneri 2a str. 2457T
gcaaaaacgcau

SEQ ID NO: 3875923 - RNA, 19 nt, Shigella flexneri 2a str. 2457T
gcaaaaaucgacagcagga

SEQ ID NO: 3875924 - RNA, 17 nt, Shigella flexneri 2a str. 2457T
gcaaaaaucggcaacau

SEQ ID NO: 3875925 - RNA, 21 nt, Shigella flexneri 2a str. 2457T
gcaaaaauucaauugcuagua

SEQ ID NO: 3875926 - RNA, 13 nt, Shigella flexneri 2a str. 2457T
gcaaaaauuugcg

SEQ ID NO: 3875927 - RNA, 13 nt, Shigella flexneri 2a str. 2457T
gcaaaacacccgc

SEQ ID NO: 3875928 - RNA, 18 nt, Shigella flexneri 2a str. 2457T
gcaaaauacugaacaggc

SEQ ID NO: 3875929 - RNA, 11 nt, Shigella flexneri 2a str. 2457T
gcaaaauaggu

SEQ ID NO: 3875930 - RNA, 22 nt, Shigella flexneri 2a str. 2457T
gcaaaauagguaucguaauuuu

SEQ ID NO: 3875931 - RNA, 15 nt, Shigella flexneri 2a str. 2457T
gcaaccagcaggcug

SEQ ID NO: 3875932 - RNA, 17 nt, Shigella flexneri 2a str. 2457T
gcaacccagaagaaagc

SEQ ID NO: 3875933 - RNA, 13 nt, Shigella flexneri 2a str. 2457T
gcaacccccacac

SEQ ID NO: 3875934 - RNA, 21 nt, Shigella flexneri 2a str. 2457T
gcaaccgcauccagauucuca

SEQ ID NO: 3875935 - RNA, 17 nt, Shigella flexneri 2a str. 2457T
gcaaccggaggucagua

SEQ ID NO: 3875936 - RNA, 14 nt, Shigella flexneri 2a str. 2457T
gcaaccggcgcggc

SEQ ID NO: 3875937 - RNA, 16 nt, Shigella flexneri 2a str. 2457T
gcaaccggcgcggcag

SEQ ID NO: 3875938 - RNA, 19 nt, Shigella flexneri 2a str. 2457T
gcaaccgguaaagaagagc

SEQ ID NO: 3875939 - RNA, 20 nt, Shigella flexneri 2a str. 2457T
gcaaccgucguggucgugau

SEQ ID NO: 3875940 - RNA, 23 nt, Shigella flexneri 2a str. 2457T
gcaaccuuuuccauugccgcaga

SEQ ID NO: 3875941 - RNA, 14 nt, Shigella flexneri 2a str. 2457T
gcaacgaaagguga

SEQ ID NO: 3875942 - RNA, 21 nt, Shigella flexneri 2a str. 2457T
gcaacgaaaggugaaguggug

SEQ ID NO: 3875943 - RNA, 21 nt, Shigella flexneri 2a str. 2457T
gcaacgacaccguuaaauaac

SEQ ID NO: 3875944 - RNA, 22 nt, Shigella flexneri 2a str. 2457T
gcaacgagacgguuaaaaacag

SEQ ID NO: 3875945 - RNA, 14 nt, Shigella flexneri 2a str. 2457T
gcaacgagugcauc

SEQ ID NO: 3875946 - RNA, 20 nt, Shigella flexneri 2a str. 2457T
gcaacgccccuucugccgca

SEQ ID NO: 3875947 - RNA, 20 nt, Shigella flexneri 2a str. 2457T
gcaacgccguaagcgcggag

SEQ ID NO: 3875948 - RNA, 16 nt, Shigella flexneri 2a str. 2457T
gcaacgccuaaacuaa

SEQ ID NO: 3875949 - RNA, 22 nt, Shigella flexneri 2a str. 2457T
gcaacgccuuugucgggcaggc

SEQ ID NO: 3875950 - RNA, 23 nt, Shigella flexneri 2a str. 2457T
gcaacgccuuugucgggcaggcu

SEQ ID NO: 3875951 - RNA, 15 nt, Shigella flexneri 2a str. 2457T
gcaacgcggcgguga

SEQ ID NO: 3875952 - RNA, 20 nt, Shigella flexneri 2a str. 2457T
gcaacgcuucaaccaacgca

SEQ ID NO: 3875953 - RNA, 17 nt, Shigella flexneri 2a str. 2457T
gcaacggacgaccgauu

SEQ ID NO: 3875954 - RNA, 15 nt, Shigella flexneri 2a str. 2457T
gcaacgucaguaacc

SEQ ID NO: 3875955 - RNA, 18 nt, Shigella flexneri 2a str. 2457T
gcaacgucaguaaccgcu

SEQ ID NO: 3875956 - RNA, 23 nt, Shigella flexneri 2a str. 2457T
gcaacgucggaaaccgcuuugcc

SEQ ID NO: 3875957 - RNA, 23 nt, Shigella flexneri 2a str. 2457T
gcaacgugacucaauggcauccg

SEQ ID NO: 3875958 - RNA, 16 nt, Shigella flexneri 2a str. 2457T
gcaacguugaccaguc

SEQ ID NO: 3875959 - RNA, 20 nt, Shigella flexneri 2a str. 2457T
gcaacguuguuccuuccagc

SEQ ID NO: 3875960 - RNA, 14 nt, Shigella flexneri 2a str. 2457T
gcaacuaccagcag

SEQ ID NO: 3875961 - RNA, 15 nt, Shigella flexneri 2a str. 2457T
gcaacuaccagcagu

SEQ ID NO: 3875962 - RNA, 19 nt, Shigella flexneri 2a str. 2457T
gcaacucauuuacagaaac

SEQ ID NO: 3875963 - RNA, 13 nt, Shigella flexneri 2a str. 2457T
gcaacuccagcuu

SEQ ID NO: 3875964 - RNA, 16 nt, Shigella flexneri 2a str. 2457T
gcaacucgaugcugcc

SEQ ID NO: 3875965 - RNA, 18 nt, Shigella flexneri 2a str. 2457T
gcaacugacugacuucaa

SEQ ID NO: 3875966 - RNA, 19 nt, Shigella flexneri 2a str. 2457T
gcaacugacugacuucaac

SEQ ID NO: 3875967 - RNA, 12 nt, Shigella flexneri 2a str. 2457T
gcaacugauuua

SEQ ID NO: 3875968 - RNA, 14 nt, Shigella flexneri 2a str. 2457T
gcaacugcgcggca

SEQ ID NO: 3875969 - RNA, 14 nt, Shigella flexneri 2a str. 2457T
gcaacugcgcugca

SEQ ID NO: 3875970 - RNA, 13 nt, Shigella flexneri 2a str. 2457T
gcaacugcggcgc

SEQ ID NO: 3875971 - RNA, 18 nt, Shigella flexneri 2a str. 2457T
gcaacugcugcgguugaa

SEQ ID NO: 3875972 - RNA, 16 nt, Shigella flexneri 2a str. 2457T
gcaacuggagcaggaa

SEQ ID NO: 3875973 - RNA, 15 nt, Shigella flexneri 2a str. 2457T
gcaacuguaacgcag

SEQ ID NO: 3875974 - RNA, 12 nt, Shigella flexneri 2a str. 2457T
gcaacuucucuu

SEQ ID NO: 3875975 - RNA, 18 nt, Shigella flexneri 2a str. 2457T
gcaacuucucuuucggca

SEQ ID NO: 3875976 - RNA, 22 nt, Shigella flexneri 2a str. 2457T
gcaacuuuagccgguuuuucaa

SEQ ID NO: 3875977 - RNA, 13 nt, Shigella flexneri 2a str. 2457T
gcaagaaauaccg

SEQ ID NO: 3875978 - RNA, 22 nt, Shigella flexneri 2a str. 2457T
gcaagaaauaccgaagaguaac

SEQ ID NO: 3875979 - RNA, 19 nt, Shigella flexneri 2a str. 2457T
gcaagaauaauaccgucca

SEQ ID NO: 3875980 - RNA, 14 nt, Shigella flexneri 2a str. 2457T
gcaagagcaaauaa

SEQ ID NO: 3875981 - RNA, 16 nt, Shigella flexneri 2a str. 2457T
gcaagagcaaauaaaa

SEQ ID NO: 3875982 - RNA, 21 nt, Shigella flexneri 2a str. 2457T
gcaagaggguuauuuguucag

SEQ ID NO: 3875983 - RNA, 15 nt, Shigella flexneri 2a str. 2457T
gcaagagugguuagc

SEQ ID NO: 3875984 - RNA, 16 nt, Shigella flexneri 2a str. 2457T
gcaagauuccagugcc

SEQ ID NO: 3875985 - RNA, 11 nt, Shigella flexneri 2a str. 2457T
gcaagcaaaug

SEQ ID NO: 3875986 - RNA, 15 nt, Shigella flexneri 2a str. 2457T
gcaagcaggucggcu

SEQ ID NO: 3875987 - RNA, 19 nt, Shigella flexneri 2a str. 2457T
gcaagcaggucggcucagc

SEQ ID NO: 3875988 - RNA, 15 nt, Shigella flexneri 2a str. 2457T
gcaagccagguuuug

SEQ ID NO: 3875989 - RNA, 20 nt, Shigella flexneri 2a str. 2457T
gcaagccgcuaacagcagca

SEQ ID NO: 3875990 - RNA, 13 nt, Shigella flexneri 2a str. 2457T
gcaagccugaaaa

SEQ ID NO: 3875991 - RNA, 17 nt, Shigella flexneri 2a str. 2457T
gcaagcgacucgguugc

SEQ ID NO: 3875992 - RNA, 18 nt, Shigella flexneri 2a str. 2457T
gcaagcgcugagacgcgc

SEQ ID NO: 3875993 - RNA, 15 nt, Shigella flexneri 2a str. 2457T
gcaagcggcgacuga

SEQ ID NO: 3875994 - RNA, 12 nt, Shigella flexneri 2a str. 2457T
gcaagcggcggc

SEQ ID NO: 3875995 - RNA, 18 nt, Shigella flexneri 2a str. 2457T
gcaagcggcggcaauggc

SEQ ID NO: 3875996 - RNA, 13 nt, Shigella flexneri 2a str. 2457T
gcaaggaaauaau

SEQ ID NO: 3875997 - RNA, 16 nt, Shigella flexneri 2a str. 2457T
gcaagggcaucguaau

SEQ ID NO: 3875998 - RNA, 15 nt, Shigella flexneri 2a str. 2457T
gcaagggccgcagcu

SEQ ID NO: 3875999 - RNA, 16 nt, Shigella flexneri 2a str. 2457T
gcaagggccgcagcuu

SEQ ID NO: 3876000 - RNA, 16 nt, Shigella flexneri 2a str. 2457T
gcaaggugaaagcaau

SEQ ID NO: 3876001 - RNA, 15 nt, Shigella flexneri 2a str. 2457T
gcaaguaauaauauc

SEQ ID NO: 3876002 - RNA, 16 nt, Shigella flexneri 2a str. 2457T
gcaaguccccaguaau

SEQ ID NO: 3876003 - RNA, 14 nt, Shigella flexneri 2a str. 2457T
gcaauaaaacaggg

SEQ ID NO: 3876004 - RNA, 17 nt, Shigella flexneri 2a str. 2457T
gcaauaaccaucagcuc

SEQ ID NO: 3876005 - RNA, 21 nt, Shigella flexneri 2a str. 2457T
gcaauaauagccccaaccgaa

SEQ ID NO: 3876006 - RNA, 22 nt, Shigella flexneri 2a str. 2457T
gcaauaauagccccaaccgaac

SEQ ID NO: 3876007 - RNA, 20 nt, Shigella flexneri 2a str. 2457T
gcaauaaucucuuuacccag

SEQ ID NO: 3876008 - RNA, 20 nt, Shigella flexneri 2a str. 2457T
gcaauacagccagccagcac

SEQ ID NO: 3876009 - RNA, 14 nt, Shigella flexneri 2a str. 2457T
gcaauaccaucacc

SEQ ID NO: 3876010 - RNA, 17 nt, Shigella flexneri 2a str. 2457T
gcaauacccugacccag

SEQ ID NO: 3876011 - RNA, 21 nt, Shigella flexneri 2a str. 2457T
gcaauaccuggcgcagcugcg

SEQ ID NO: 3876012 - RNA, 23 nt, Shigella flexneri 2a str. 2457T
gcaauacgcuugaagccuucgcc

SEQ ID NO: 3876013 - RNA, 14 nt, Shigella flexneri 2a str. 2457T
gcaauacguuucau

SEQ ID NO: 3876014 - RNA, 13 nt, Shigella flexneri 2a str. 2457T
gcaauagaauaag

SEQ ID NO: 3876015 - RNA, 20 nt, Shigella flexneri 2a str. 2457T
gcaauagauugaauuagcaa

SEQ ID NO: 3876016 - RNA, 15 nt, Shigella flexneri 2a str. 2457T
gcaauagcacugcuu

SEQ ID NO: 3876017 - RNA, 15 nt, Shigella flexneri 2a str. 2457T
gcaauagcgccugcu

SEQ ID NO: 3876018 - RNA, 22 nt, Shigella flexneri 2a str. 2457T
gcaauagcuucuuccacauugu

SEQ ID NO: 3876019 - RNA, 20 nt, Shigella flexneri 2a str. 2457T
gcaauauauugaauuugcau

SEQ ID NO: 3876020 - RNA, 14 nt, Shigella flexneri 2a str. 2457T
gcaauaucgcggca

SEQ ID NO: 3876021 - RNA, 16 nt, Shigella flexneri 2a str. 2457T
gcaauaucgcggcaca

SEQ ID NO: 3876022 - RNA, 17 nt, Shigella flexneri 2a str. 2457T
gcaauaugcggugccau

SEQ ID NO: 3876023 - RNA, 15 nt, Shigella flexneri 2a str. 2457T
gcaauauucuuuugc

SEQ ID NO: 3876024 - RNA, 19 nt, Shigella flexneri 2a str. 2457T
gcaauauuguagcaacucc

SEQ ID NO: 3876025 - RNA, 17 nt, Shigella flexneri 2a str. 2457T
gcaaucaaaaaaggcug

SEQ ID NO: 3876026 - RNA, 12 nt, Shigella flexneri 2a str. 2457T
gcaaucaccacc

SEQ ID NO: 3876027 - RNA, 14 nt, Shigella flexneri 2a str. 2457T
gcaaucaccgccag

SEQ ID NO: 3876028 - RNA, 20 nt, Shigella flexneri 2a str. 2457T
gcaaucacugccagaauagc

SEQ ID NO: 3876029 - RNA, 20 nt, Shigella flexneri 2a str. 2457T
gcacaguacgcgcccgccgc

SEQ ID NO: 3876030 - RNA, 22 nt, Shigella flexneri 2a str. 2457T
gcacaguuauaaaaugauacgc

SEQ ID NO: 3876031 - RNA, 16 nt, Shigella flexneri 2a str. 2457T
gcacauacugcaucag

SEQ ID NO: 3876032 - RNA, 15 nt, Shigella flexneri 2a str. 2457T
gcacauagcaccacc

SEQ ID NO: 3876033 - RNA, 23 nt, Shigella flexneri 2a str. 2457T
gcacauauucuggagcauggcug

SEQ ID NO: 3876034 - RNA, 13 nt, Shigella flexneri 2a str. 2457T
gcacauauuuuuc

SEQ ID NO: 3876035 - RNA, 22 nt, Shigella flexneri 2a str. 2457T
gcacaucaauuugcccaccggu

SEQ ID NO: 3876036 - RNA, 12 nt, Shigella flexneri 2a str. 2457T
gcacaucagcca

SEQ ID NO: 3876037 - RNA, 22 nt, Shigella flexneri 2a str. 2457T
gcacauccagauuuuucaguau

SEQ ID NO: 3876038 - RNA, 17 nt, Shigella flexneri 2a str. 2457T
gcacaugcauaaagcgg

SEQ ID NO: 3876039 - RNA, 12 nt, Shigella flexneri 2a str. 2457T
gcacaugcugac

SEQ ID NO: 3876040 - RNA, 20 nt, Shigella flexneri 2a str. 2457T
gcacauugauggcgcuuucg

SEQ ID NO: 3876041 - RNA, 22 nt, Shigella flexneri 2a str. 2457T
gcacauugccguaauggucugc

SEQ ID NO: 3876042 - RNA, 14 nt, Shigella flexneri 2a str. 2457T
gcacauuucaauca

SEQ ID NO: 3876043 - RNA, 17 nt, Shigella flexneri 2a str. 2457T
gcacauuucacucacgc

SEQ ID NO: 3876044 - RNA, 20 nt, Shigella flexneri 2a str. 2457T
gcacauuucccggccacgca

SEQ ID NO: 3876045 - RNA, 14 nt, Shigella flexneri 2a str. 2457T
gcaccaaagcguuu

SEQ ID NO: 3876046 - RNA, 13 nt, Shigella flexneri 2a str. 2457T
gcaccaacaaaua

SEQ ID NO: 3876047 - RNA, 21 nt, Shigella flexneri 2a str. 2457T
gcaccaacaaauagagauaga

SEQ ID NO: 3876048 - RNA, 22 nt, Shigella flexneri 2a str. 2457T
gcaccaacccuaacccaacauu

SEQ ID NO: 3876049 - RNA, 22 nt, Shigella flexneri 2a str. 2457T
gcaccaauagccgcgccgagcg

SEQ ID NO: 3876050 - RNA, 14 nt, Shigella flexneri 2a str. 2457T
gcaccaaucaccgc

SEQ ID NO: 3876051 - RNA, 18 nt, Shigella flexneri 2a str. 2457T
gcaccaaucaccgccagc

SEQ ID NO: 3876052 - RNA, 20 nt, Shigella flexneri 2a str. 2457T
gcaccaaucaccgccagcaa

SEQ ID NO: 3876053 - RNA, 18 nt, Shigella flexneri 2a str. 2457T
gcaccacauucugcaucg

SEQ ID NO: 3876054 - RNA, 19 nt, Shigella flexneri 2a str. 2457T
gcaccacauucugcaucgc

SEQ ID NO: 3876055 - RNA, 15 nt, Shigella flexneri 2a str. 2457T
gcaccaccagcagcu

SEQ ID NO: 3876056 - RNA, 16 nt, Shigella flexneri 2a str. 2457T
gcaccaccagcagcug

SEQ ID NO: 3876057 - RNA, 19 nt, Shigella flexneri 2a str. 2457T
gcaccaccagcagcugcuc

SEQ ID NO: 3876058 - RNA, 19 nt, Shigella flexneri 2a str. 2457T
gcaccaccauugagguuga

SEQ ID NO: 3876059 - RNA, 21 nt, Shigella flexneri 2a str. 2457T
gcaccacgacaccuuucacgc

SEQ ID NO: 3876060 - RNA, 14 nt, Shigella flexneri 2a str. 2457T
gcaccacuugcaga

SEQ ID NO: 3876061 - RNA, 15 nt, Shigella flexneri 2a str. 2457T
gcaccagaaacaaua

SEQ ID NO: 3876062 - RNA, 22 nt, Shigella flexneri 2a str. 2457T
gcaccagaauaccuugcugcuc

SEQ ID NO: 3876063 - RNA, 13 nt, Shigella flexneri 2a str. 2457T
gcaccagcaacaa

SEQ ID NO: 3876064 - RNA, 19 nt, Shigella flexneri 2a str. 2457T
gcaccagccccuggaaaaa

SEQ ID NO: 3876065 - RNA, 16 nt, Shigella flexneri 2a str. 2457T
gcaccagcggaaugca

SEQ ID NO: 3876066 - RNA, 15 nt, Shigella flexneri 2a str. 2457T
gcaccagcuccggca

SEQ ID NO: 3876067 - RNA, 22 nt, Shigella flexneri 2a str. 2457T
gcaccaggcaguuuauccagcc

SEQ ID NO: 3876068 - RNA, 23 nt, Shigella flexneri 2a str. 2457T
gcaccaggcaguuuauccagcca

SEQ ID NO: 3876069 - RNA, 12 nt, Shigella flexneri 2a str. 2457T
gcaccaguaacg

SEQ ID NO: 3876070 - RNA, 22 nt, Shigella flexneri 2a str. 2457T
gcaccagucgauggucgcguug

SEQ ID NO: 3876071 - RNA, 18 nt, Shigella flexneri 2a str. 2457T
gcaccaucaaaguuuuua

SEQ ID NO: 3876072 - RNA, 13 nt, Shigella flexneri 2a str. 2457T
gcaccaucccgcu

SEQ ID NO: 3876073 - RNA, 17 nt, Shigella flexneri 2a str. 2457T
gcaccaucccuaugcau

SEQ ID NO: 3876074 - RNA, 13 nt, Shigella flexneri 2a str. 2457T
gcaccaucucuua

SEQ ID NO: 3876075 - RNA, 20 nt, Shigella flexneri 2a str. 2457T
gcaccauugcugccgccagu

SEQ ID NO: 3876076 - RNA, 14 nt, Shigella flexneri 2a str. 2457T
gcacccagcaaucc

SEQ ID NO: 3876077 - RNA, 22 nt, Shigella flexneri 2a str. 2457T
gcacccauuuauccagcggcag

SEQ ID NO: 3876078 - RNA, 17 nt, Shigella flexneri 2a str. 2457T
gcaccccugauaaccgc

SEQ ID NO: 3876079 - RNA, 15 nt, Shigella flexneri 2a str. 2457T
gcacccgccagcgcg

SEQ ID NO: 3876080 - RNA, 21 nt, Shigella flexneri 2a str. 2457T
gcacccgccguuagccagcgc

SEQ ID NO: 3876081 - RNA, 18 nt, Shigella flexneri 2a str. 2457T
gcacccgcuucagugacu

SEQ ID NO: 3876082 - RNA, 20 nt, Shigella flexneri 2a str. 2457T
gcacccucaacaacagcgau

SEQ ID NO: 3876083 - RNA, 14 nt, Shigella flexneri 2a str. 2457T
gcaccgaagcccau

SEQ ID NO: 3876084 - RNA, 16 nt, Shigella flexneri 2a str. 2457T
gcaccgacaauccggu

SEQ ID NO: 3876085 - RNA, 22 nt, Shigella flexneri 2a str. 2457T
gcaccgacguucagcgcaacuu

SEQ ID NO: 3876086 - RNA, 14 nt, Shigella flexneri 2a str. 2457T
gcaccgacuggcuc

SEQ ID NO: 3876087 - RNA, 20 nt, Shigella flexneri 2a str. 2457T
gcaccgaggccaaaaccaca

SEQ ID NO: 3876088 - RNA, 21 nt, Shigella flexneri 2a str. 2457T
gcaccgauugccggaugcggc

SEQ ID NO: 3876089 - RNA, 23 nt, Shigella flexneri 2a str. 2457T
gcaccgcgcguuuaggcgcagga

SEQ ID NO: 3876090 - RNA, 17 nt, Shigella flexneri 2a str. 2457T
gcaccggacgcuuguca

SEQ ID NO: 3876091 - RNA, 16 nt, Shigella flexneri 2a str. 2457T
gcaccgugacaguaau

SEQ ID NO: 3876092 - RNA, 19 nt, Shigella flexneri 2a str. 2457T
gcaccuaauaacucuccuc

SEQ ID NO: 3876093 - RNA, 16 nt, Shigella flexneri 2a str. 2457T
gcaccugauccagcuc

SEQ ID NO: 3876094 - RNA, 15 nt, Shigella flexneri 2a str. 2457T
gcaccugccagcgcc

SEQ ID NO: 3876095 - RNA, 19 nt, Shigella flexneri 2a str. 2457T
gcaccugcggaaucaccgg

SEQ ID NO: 3876096 - RNA, 21 nt, Shigella flexneri 2a str. 2457T
gcaccuggcgcauuaacggca

SEQ ID NO: 3876097 - RNA, 21 nt, Shigella flexneri 2a str. 2457T
gcaccuggggcuugccagagc

SEQ ID NO: 3876098 - RNA, 13 nt, Shigella flexneri 2a str. 2457T
gcaccuguaccag

SEQ ID NO: 3876099 - RNA, 14 nt, Shigella flexneri 2a str. 2457T
gcaccuguaccagc

SEQ ID NO: 3876100 - RNA, 17 nt, Shigella flexneri 2a str. 2457T
gcaccuuaccucaggca

SEQ ID NO: 3876101 - RNA, 16 nt, Shigella flexneri 2a str. 2457T
gcaccuuuaccacucc

SEQ ID NO: 3876102 - RNA, 18 nt, Shigella flexneri 2a str. 2457T
gcaccuuuacgccaggca

SEQ ID NO: 3876103 - RNA, 13 nt, Shigella flexneri 2a str. 2457T
gcaccuuuuaugu

SEQ ID NO: 3876104 - RNA, 18 nt, Shigella flexneri 2a str. 2457T
gcacgaaccguaaaagcc

SEQ ID NO: 3876105 - RNA, 15 nt, Shigella flexneri 2a str. 2457T
gcacgaaccgucccu

SEQ ID NO: 3876106 - RNA, 21 nt, Shigella flexneri 2a str. 2457T
gcacgacuuucucuucaucua

SEQ ID NO: 3876107 - RNA, 23 nt, Shigella flexneri 2a str. 2457T
gcacgaguguuacgccugccgca

SEQ ID NO: 3876108 - RNA, 19 nt, Shigella flexneri 2a str. 2457T
gcacgauuuguaggccgga

SEQ ID NO: 3876109 - RNA, 20 nt, Shigella flexneri 2a str. 2457T
gcacgauuuuguaggccgga

SEQ ID NO: 3876110 - RNA, 17 nt, Shigella flexneri 2a str. 2457T
gcacgcaggccacgaau

SEQ ID NO: 3876111 - RNA, 17 nt, Shigella flexneri 2a str. 2457T
gcacgcagugagaagcc

SEQ ID NO: 3876112 - RNA, 20 nt, Shigella flexneri 2a str. 2457T
gcacgcucuucaucgcuaaa

SEQ ID NO: 3876113 - RNA, 12 nt, Shigella flexneri 2a str. 2457T
gcacgcuggaga

SEQ ID NO: 3876114 - RNA, 18 nt, Shigella flexneri 2a str. 2457T
gcacgcuugccugugcca

SEQ ID NO: 3876115 - RNA, 18 nt, Shigella flexneri 2a str. 2457T
gcacgcuuuucagugcca

SEQ ID NO: 3876116 - RNA, 22 nt, Shigella flexneri 2a str. 2457T
gcacggaaagcagcauacccac

SEQ ID NO: 3876117 - RNA, 13 nt, Shigella flexneri 2a str. 2457T
gcacggcauacuu

SEQ ID NO: 3876118 - RNA, 22 nt, Shigella flexneri 2a str. 2457T
gcacggucaggcuaaagaaaac

SEQ ID NO: 3876119 - RNA, 22 nt, Shigella flexneri 2a str. 2457T
gcacggugcaucuucacacuga

SEQ ID NO: 3876120 - RNA, 17 nt, Shigella flexneri 2a str. 2457T
gcacguacaugcagggc

SEQ ID NO: 3876121 - RNA, 22 nt, Shigella flexneri 2a str. 2457T
gcacguaccaugcgcaucaucg

SEQ ID NO: 3876122 - RNA, 19 nt, Shigella flexneri 2a str. 2457T
gcacgucaccgcagcaucg

SEQ ID NO: 3876123 - RNA, 15 nt, Shigella flexneri 2a str. 2457T
gcacgucaucugcac

SEQ ID NO: 3876124 - RNA, 17 nt, Shigella flexneri 2a str. 2457T
gcacgucuuugccgcgc

SEQ ID NO: 3876125 - RNA, 21 nt, Shigella flexneri 2a str. 2457T
gcacgucuuugccgcgcucuu

SEQ ID NO: 3876126 - RNA, 16 nt, Shigella flexneri 2a str. 2457T
gcagcaaacgauucaa

SEQ ID NO: 3876127 - RNA, 19 nt, Shigella flexneri 2a str. 2457T
gcagcaaauagccgagcgc

SEQ ID NO: 3876128 - RNA, 21 nt, Shigella flexneri 2a str. 2457T
gcagcaaauagccgagcgcgu

SEQ ID NO: 3876129 - RNA, 20 nt, Shigella flexneri 2a str. 2457T
gcagcaaccgguaaagaaga

SEQ ID NO: 3876130 - RNA, 14 nt, Shigella flexneri 2a str. 2457T
gcagcaagccaucg

SEQ ID NO: 3876131 - RNA, 19 nt, Shigella flexneri 2a str. 2457T
gcagcaagccaucguuaau

SEQ ID NO: 3876132 - RNA, 23 nt, Shigella flexneri 2a str. 2457T
gcagcaaggcuauucagcaguuc

SEQ ID NO: 3876133 - RNA, 17 nt, Shigella flexneri 2a str. 2457T
gcagcaaucgaccaggc

SEQ ID NO: 3876134 - RNA, 16 nt, Shigella flexneri 2a str. 2457T
gcagcaauggcacugu

SEQ ID NO: 3876135 - RNA, 15 nt, Shigella flexneri 2a str. 2457T
gcagcaauugucgca

SEQ ID NO: 3876136 - RNA, 12 nt, Shigella flexneri 2a str. 2457T
gcagcaccauca

SEQ ID NO: 3876137 - RNA, 15 nt, Shigella flexneri 2a str. 2457T
gcagcacccugaguu

SEQ ID NO: 3876138 - RNA, 19 nt, Shigella flexneri 2a str. 2457T
gcagcacccugaguuuuca

SEQ ID NO: 3876139 - RNA, 14 nt, Shigella flexneri 2a str. 2457T
gcagcaccgauccu

SEQ ID NO: 3876140 - RNA, 17 nt, Shigella flexneri 2a str. 2457T
gcagcacuacaccccag

SEQ ID NO: 3876141 - RNA, 18 nt, Shigella flexneri 2a str. 2457T
gcagcagagcaaucacca

SEQ ID NO: 3876142 - RNA, 21 nt, Shigella flexneri 2a str. 2457T
gcagcagccgguauccagcgc

SEQ ID NO: 3876143 - RNA, 19 nt, Shigella flexneri 2a str. 2457T
gcagcaggugcgccagcga

SEQ ID NO: 3876144 - RNA, 13 nt, Shigella flexneri 2a str. 2457T
gcagcaguugcca

SEQ ID NO: 3876145 - RNA, 21 nt, Shigella flexneri 2a str. 2457T
gcagcauaugcaaaaggcugg

SEQ ID NO: 3876146 - RNA, 16 nt, Shigella flexneri 2a str. 2457T
gcagcaucaugccgcu

SEQ ID NO: 3876147 - RNA, 15 nt, Shigella flexneri 2a str. 2457T
gcagcaucgccagga

SEQ ID NO: 3876148 - RNA, 17 nt, Shigella flexneri 2a str. 2457T
gcagcaucgcucaccca

SEQ ID NO: 3876149 - RNA, 13 nt, Shigella flexneri 2a str. 2457T
gcagcaugcaccc

SEQ ID NO: 3876150 - RNA, 13 nt, Shigella flexneri 2a str. 2457T
gcagcauggucag

SEQ ID NO: 3876151 - RNA, 14 nt, Shigella flexneri 2a str. 2457T
gcagcauggucagg

SEQ ID NO: 3876152 - RNA, 21 nt, Shigella flexneri 2a str. 2457T
gcagcauucgccgcauugucu

SEQ ID NO: 3876153 - RNA, 17 nt, Shigella flexneri 2a str. 2457T
gcagcauugcucaccgc

SEQ ID NO: 3876154 - RNA, 21 nt, Shigella flexneri 2a str. 2457T
gcagcauuucaaaacggucac

SEQ ID NO: 3876155 - RNA, 18 nt, Shigella flexneri 2a str. 2457T
gcagccaccacuugcagc

SEQ ID NO: 3876156 - RNA, 22 nt, Shigella flexneri 2a str. 2457T
gcagccaccacuugcagcucau

SEQ ID NO: 3876157 - RNA, 15 nt, Shigella flexneri 2a str. 2457T
gcagccaccgccagc

SEQ ID NO: 3876158 - RNA, 18 nt, Shigella flexneri 2a str. 2457T
gcagccagcacugccgca

SEQ ID NO: 3876159 - RNA, 19 nt, Shigella flexneri 2a str. 2457T
gcagccaucaccacgcuga

SEQ ID NO: 3876160 - RNA, 19 nt, Shigella flexneri 2a str. 2457T
gcagccaucugaugauauu

SEQ ID NO: 3876161 - RNA, 18 nt, Shigella flexneri 2a str. 2457T
gcagccccagagccugaa

SEQ ID NO: 3876162 - RNA, 21 nt, Shigella flexneri 2a str. 2457T
gcagccccagagccugaaggu

SEQ ID NO: 3876163 - RNA, 15 nt, Shigella flexneri 2a str. 2457T
gcagccccgccggga

SEQ ID NO: 3876164 - RNA, 18 nt, Shigella flexneri 2a str. 2457T
gcagcccguaagcaaaag

SEQ ID NO: 3876165 - RNA, 16 nt, Shigella flexneri 2a str. 2457T
gcagccgguauccagc

SEQ ID NO: 3876166 - RNA, 20 nt, Shigella flexneri 2a str. 2457T
gcagccuucauucaggcauu

SEQ ID NO: 3876167 - RNA, 18 nt, Shigella flexneri 2a str. 2457T
gcagcgaaggguauacgc

SEQ ID NO: 3876168 - RNA, 22 nt, Shigella flexneri 2a str. 2457T
gcagcgaugguacuucaaucgc

SEQ ID NO: 3876169 - RNA, 22 nt, Shigella flexneri 2a str. 2457T
gcagcgcaauuaacgccccaag

SEQ ID NO: 3876170 - RNA, 18 nt, Shigella flexneri 2a str. 2457T
gcagcgcagcgaguaaaa

SEQ ID NO: 3876171 - RNA, 16 nt, Shigella flexneri 2a str. 2457T
gcagcgcauuguuucu

SEQ ID NO: 3876172 - RNA, 21 nt, Shigella flexneri 2a str. 2457T
gcagcgccagcgaagccagcu

SEQ ID NO: 3876173 - RNA, 12 nt, Shigella flexneri 2a str. 2457T
gcagcgccgcgc

SEQ ID NO: 3876174 - RNA, 22 nt, Shigella flexneri 2a str. 2457T
gcagcgccuuuuguuuguucuu

SEQ ID NO: 3876175 - RNA, 23 nt, Shigella flexneri 2a str. 2457T
gcagcgcgcauucagcagcagca

SEQ ID NO: 3876176 - RNA, 18 nt, Shigella flexneri 2a str. 2457T
gcagcggcgaucgugagc

SEQ ID NO: 3876177 - RNA, 20 nt, Shigella flexneri 2a str. 2457T
gcagcggucggcuucccugc

SEQ ID NO: 3876178 - RNA, 14 nt, Shigella flexneri 2a str. 2457T
gcagcgucagcacc

SEQ ID NO: 3876179 - RNA, 16 nt, Shigella flexneri 2a str. 2457T
gcagcgucagcaccag

SEQ ID NO: 3876180 - RNA, 20 nt, Shigella flexneri 2a str. 2457T
gcagcgucgcaucaggcauu

SEQ ID NO: 3876181 - RNA, 20 nt, Shigella flexneri 2a str. 2457T
gcagcgugaguaugauacgu

SEQ ID NO: 3876182 - RNA, 19 nt, Shigella flexneri 2a str. 2457T
gcagcgugcucucaaauau

SEQ ID NO: 3876183 - RNA, 22 nt, Shigella flexneri 2a str. 2457T
gcagcguggugcugauacgcgc

SEQ ID NO: 3876184 - RNA, 12 nt, Shigella flexneri 2a str. 2457T
gcagcguuuauu

SEQ ID NO: 3876185 - RNA, 15 nt, Shigella flexneri 2a str. 2457T
gcagcguuuccagcc

SEQ ID NO: 3876186 - RNA, 21 nt, Shigella flexneri 2a str. 2457T
gcagcguuucgaacaggccga

SEQ ID NO: 3876187 - RNA, 20 nt, Shigella flexneri 2a str. 2457T
gcagcguuucgcgcgcgccu

SEQ ID NO: 3876188 - RNA, 15 nt, Shigella flexneri 2a str. 2457T
gcagcucacgcacga

SEQ ID NO: 3876189 - RNA, 13 nt, Shigella flexneri 2a str. 2457T
gcagcucaucaac

SEQ ID NO: 3876190 - RNA, 16 nt, Shigella flexneri 2a str. 2457T
gcagcucaucaagcug

SEQ ID NO: 3876191 - RNA, 23 nt, Shigella flexneri 2a str. 2457T
gcagcuccaguuucuuuugcgcc

SEQ ID NO: 3876192 - RNA, 18 nt, Shigella flexneri 2a str. 2457T
gcagcugcgcuucaauac

SEQ ID NO: 3876193 - RNA, 22 nt, Shigella flexneri 2a str. 2457T
gcagcugggcgagggcaaaccu

SEQ ID NO: 3876194 - RNA, 18 nt, Shigella flexneri 2a str. 2457T
gcagcuuaaucauaaugu

SEQ ID NO: 3876195 - RNA, 18 nt, Shigella flexneri 2a str. 2457T
gcagcuucacaaaggcuu

SEQ ID NO: 3876196 - RNA, 12 nt, Shigella flexneri 2a str. 2457T
gcagcuucacgg

SEQ ID NO: 3876197 - RNA, 22 nt, Shigella flexneri 2a str. 2457T
gcagcuucucgugaaacucacg

SEQ ID NO: 3876198 - RNA, 23 nt, Shigella flexneri 2a str. 2457T
gcagcuucucgugaaacucacgc

SEQ ID NO: 3876199 - RNA, 17 nt, Shigella flexneri 2a str. 2457T
gcagcuucuuauccagc

SEQ ID NO: 3876200 - RNA, 17 nt, Shigella flexneri 2a str. 2457T
gcagcuuucagcagcgg

SEQ ID NO: 3876201 - RNA, 23 nt, Shigella flexneri 2a str. 2457T
gcagcuuugcccgaucaucaaaa

SEQ ID NO: 3876202 - RNA, 20 nt, Shigella flexneri 2a str. 2457T
gcaggaaaagguaggccuga

SEQ ID NO: 3876203 - RNA, 20 nt, Shigella flexneri 2a str. 2457T
gcaggaaauacguaggccug

SEQ ID NO: 3876204 - RNA, 21 nt, Shigella flexneri 2a str. 2457T
gcaggaaauacguaggccuga

SEQ ID NO: 3876205 - RNA, 21 nt, Shigella flexneri 2a str. 2457T
gcaggaaauuauggaucacca

SEQ ID NO: 3876206 - RNA, 22 nt, Shigella flexneri 2a str. 2457T
gcaggaacugcucauaaacgcg

SEQ ID NO: 3876207 - RNA, 18 nt, Shigella flexneri 2a str. 2457T
gcaggaauguuguccagg

SEQ ID NO: 3876208 - RNA, 18 nt, Shigella flexneri 2a str. 2457T
gcaggacgcgcgcgccuu

SEQ ID NO: 3876209 - RNA, 14 nt, Shigella flexneri 2a str. 2457T
gcaggagcagcccc

SEQ ID NO: 3876210 - RNA, 21 nt, Shigella flexneri 2a str. 2457T
gcaggaucgacugcaaaccau

SEQ ID NO: 3876211 - RNA, 18 nt, Shigella flexneri 2a str. 2457T
gcaggaucuccagcuccc

SEQ ID NO: 3876212 - RNA, 23 nt, Shigella flexneri 2a str. 2457T
gcaggaugacaaaggugccgccc

SEQ ID NO: 3876213 - RNA, 20 nt, Shigella flexneri 2a str. 2457T
gcaggaugggcaacgcgcau

SEQ ID NO: 3876214 - RNA, 16 nt, Shigella flexneri 2a str. 2457T
gcaggauguuccggca

SEQ ID NO: 3876215 - RNA, 19 nt, Shigella flexneri 2a str. 2457T
gcaggauguuccggcaaag

SEQ ID NO: 3876216 - RNA, 19 nt, Shigella flexneri 2a str. 2457T
gcaggcaacagggaaauga

SEQ ID NO: 3876217 - RNA, 19 nt, Shigella flexneri 2a str. 2457T
gcaggcaucggugaugcuc

SEQ ID NO: 3876218 - RNA, 14 nt, Shigella flexneri 2a str. 2457T
gcaggcaucggugc

SEQ ID NO: 3876219 - RNA, 21 nt, Shigella flexneri 2a str. 2457T
gcaggccaacagucuuaaagg

SEQ ID NO: 3876220 - RNA, 13 nt, Shigella flexneri 2a str. 2457T
gcaggccggagac

SEQ ID NO: 3876221 - RNA, 15 nt, Shigella flexneri 2a str. 2457T
gcaggccguggauca

SEQ ID NO: 3876222 - RNA, 15 nt, Shigella flexneri 2a str. 2457T
gcaggccugauaagc

SEQ ID NO: 3876223 - RNA, 16 nt, Shigella flexneri 2a str. 2457T
gcauacaugcuuagca

SEQ ID NO: 3876224 - RNA, 17 nt, Shigella flexneri 2a str. 2457T
gcauacccagaacuauc

SEQ ID NO: 3876225 - RNA, 13 nt, Shigella flexneri 2a str. 2457T
gcauaccccuuca

SEQ ID NO: 3876226 - RNA, 13 nt, Shigella flexneri 2a str. 2457T
gcauaccuucaca

SEQ ID NO: 3876227 - RNA, 19 nt, Shigella flexneri 2a str. 2457T
gcauaccuucacagaaggc

SEQ ID NO: 3876228 - RNA, 24 nt, Shigella flexneri 2a str. 2457T
gcauaccuucacagaaggccagga

SEQ ID NO: 3876229 - RNA, 17 nt, Shigella flexneri 2a str. 2457T
gcauacggguaaaggcg

SEQ ID NO: 3876230 - RNA, 15 nt, Shigella flexneri 2a str. 2457T
gcauacggguuuucc

SEQ ID NO: 3876231 - RNA, 16 nt, Shigella flexneri 2a str. 2457T
gcauacggugaaaguc

SEQ ID NO: 3876232 - RNA, 16 nt, Shigella flexneri 2a str. 2457T
gcauacguuucaccag

SEQ ID NO: 3876233 - RNA, 15 nt, Shigella flexneri 2a str. 2457T
gcauacucuccucca

SEQ ID NO: 3876234 - RNA, 16 nt, Shigella flexneri 2a str. 2457T
gcauacucuccuccag

SEQ ID NO: 3876235 - RNA, 17 nt, Shigella flexneri 2a str. 2457T
gcauacugcgauugucg

SEQ ID NO: 3876236 - RNA, 18 nt, Shigella flexneri 2a str. 2457T
gcauacugcgugucguaa

SEQ ID NO: 3876237 - RNA, 23 nt, Shigella flexneri 2a str. 2457T
gcauacugcgugucguaagccac

SEQ ID NO: 3876238 - RNA, 14 nt, Shigella flexneri 2a str. 2457T
gcauacuuucauca

SEQ ID NO: 3876239 - RNA, 14 nt, Shigella flexneri 2a str. 2457T
gcauagaaaaagaa

SEQ ID NO: 3876240 - RNA, 17 nt, Shigella flexneri 2a str. 2457T
gcauagcagcacaccac

SEQ ID NO: 3876241 - RNA, 16 nt, Shigella flexneri 2a str. 2457T
gcauagcgcaauaaca

SEQ ID NO: 3876242 - RNA, 22 nt, Shigella flexneri 2a str. 2457T
gcauagcuaauccccuccagcg

SEQ ID NO: 3876243 - RNA, 17 nt, Shigella flexneri 2a str. 2457T
gcauaggcauuaaacau

SEQ ID NO: 3876244 - RNA, 23 nt, Shigella flexneri 2a str. 2457T
gcauaggcggcaaacaguuucug

SEQ ID NO: 3876245 - RNA, 14 nt, Shigella flexneri 2a str. 2457T
gcauauaaugcaac

SEQ ID NO: 3876246 - RNA, 18 nt, Shigella flexneri 2a str. 2457T
gcauauaccucagcagac

SEQ ID NO: 3876247 - RNA, 19 nt, Shigella flexneri 2a str. 2457T
gcauauagccaaagcacca

SEQ ID NO: 3876248 - RNA, 16 nt, Shigella flexneri 2a str. 2457T
gcauauaguuuugcau

SEQ ID NO: 3876249 - RNA, 13 nt, Shigella flexneri 2a str. 2457T
gcauauccggugc

SEQ ID NO: 3876250 - RNA, 18 nt, Shigella flexneri 2a str. 2457T
gcauaucguagccccagu

SEQ ID NO: 3876251 - RNA, 12 nt, Shigella flexneri 2a str. 2457T
gcauaucuucaa

SEQ ID NO: 3876252 - RNA, 17 nt, Shigella flexneri 2a str. 2457T
gcauaugcaaaaggcug

SEQ ID NO: 3876253 - RNA, 18 nt, Shigella flexneri 2a str. 2457T
gcauaugcgggcguuuug

SEQ ID NO: 3876254 - RNA, 21 nt, Shigella flexneri 2a str. 2457T
gcauauguuuacgcuggcgga

SEQ ID NO: 3876255 - RNA, 15 nt, Shigella flexneri 2a str. 2457T
gcaucaaagccaggc

SEQ ID NO: 3876256 - RNA, 13 nt, Shigella flexneri 2a str. 2457T
gcaucaauaauca

SEQ ID NO: 3876257 - RNA, 14 nt, Shigella flexneri 2a str. 2457T
gcaucaauaaucaa

SEQ ID NO: 3876258 - RNA, 17 nt, Shigella flexneri 2a str. 2457T
gcaucaauaaucaacgc

SEQ ID NO: 3876259 - RNA, 15 nt, Shigella flexneri 2a str. 2457T
gcaucaauaccgcgu

SEQ ID NO: 3876260 - RNA, 12 nt, Shigella flexneri 2a str. 2457T
gcaucaaucuuu

SEQ ID NO: 3876261 - RNA, 22 nt, Shigella flexneri 2a str. 2457T
gcaucacauccggcaauauuca

SEQ ID NO: 3876262 - RNA, 17 nt, Shigella flexneri 2a str. 2457T
gcaucacaucgcuggug

SEQ ID NO: 3876263 - RNA, 12 nt, Shigella flexneri 2a str. 2457T
gcaucaccagac

SEQ ID NO: 3876264 - RNA, 17 nt, Shigella flexneri 2a str. 2457T
gcaucacgacagcacca

SEQ ID NO: 3876265 - RNA, 23 nt, Shigella flexneri 2a str. 2457T
gcaucacuuucggugacagaaac

SEQ ID NO: 3876266 - RNA, 22 nt, Shigella flexneri 2a str. 2457T
gcaucagcaacacgcugcucau

SEQ ID NO: 3876267 - RNA, 17 nt, Shigella flexneri 2a str. 2457T
gcaucagcccaaagcag

SEQ ID NO: 3876268 - RNA, 19 nt, Shigella flexneri 2a str. 2457T
gcaucagcccaaagcagag

SEQ ID NO: 3876269 - RNA, 19 nt, Shigella flexneri 2a str. 2457T
gcaucagcgauucauugag

SEQ ID NO: 3876270 - RNA, 18 nt, Shigella flexneri 2a str. 2457T
gcaucaggcaacccagaa

SEQ ID NO: 3876271 - RNA, 13 nt, Shigella flexneri 2a str. 2457T
gcaucaggcaaug

SEQ ID NO: 3876272 - RNA, 13 nt, Shigella flexneri 2a str. 2457T
gcaucaggcaauu

SEQ ID NO: 3876273 - RNA, 19 nt, Shigella flexneri 2a str. 2457T
gcaucaggcuaaucgccag

SEQ ID NO: 3876274 - RNA, 18 nt, Shigella flexneri 2a str. 2457T
gcaucaguaugaaugaca

SEQ ID NO: 3876275 - RNA, 17 nt, Shigella flexneri 2a str. 2457T
gcaucaucgcuuugugc

SEQ ID NO: 3876276 - RNA, 18 nt, Shigella flexneri 2a str. 2457T
gcaucaugaauauauaau

SEQ ID NO: 3876277 - RNA, 14 nt, Shigella flexneri 2a str. 2457T
gcaucaugccaccc

SEQ ID NO: 3876278 - RNA, 13 nt, Shigella flexneri 2a str. 2457T
gcaucaugccgcu

SEQ ID NO: 3876279 - RNA, 21 nt, Shigella flexneri 2a str. 2457T
gcaucaugcucagaugccuga

SEQ ID NO: 3876280 - RNA, 16 nt, Shigella flexneri 2a str. 2457T
gcaucauggcauuuca

SEQ ID NO: 3876281 - RNA, 21 nt, Shigella flexneri 2a str. 2457T
gcaucaugucgcccacgccag

SEQ ID NO: 3876282 - RNA, 21 nt, Shigella flexneri 2a str. 2457T
gcauccagcguauucgugaca

SEQ ID NO: 3876283 - RNA, 15 nt, Shigella flexneri 2a str. 2457T
gcaucccaacucauu

SEQ ID NO: 3876284 - RNA, 16 nt, Shigella flexneri 2a str. 2457T
gcauccccgcccuucc

SEQ ID NO: 3876285 - RNA, 19 nt, Shigella flexneri 2a str. 2457T
gcaucccgguaucaaagcg

SEQ ID NO: 3876286 - RNA, 16 nt, Shigella flexneri 2a str. 2457T
gcauccgacacuggca

SEQ ID NO: 3876287 - RNA, 17 nt, Shigella flexneri 2a str. 2457T
gcauccgacauuugcac

SEQ ID NO: 3876288 - RNA, 14 nt, Shigella flexneri 2a str. 2457T
gcauccggcacucu

SEQ ID NO: 3876289 - RNA, 19 nt, Shigella flexneri 2a str. 2457T
gcauccggcaucaacaaag

SEQ ID NO: 3876290 - RNA, 14 nt, Shigella flexneri 2a str. 2457T
gcauccggcaugaa

SEQ ID NO: 3876291 - RNA, 19 nt, Shigella flexneri 2a str. 2457T
gcauccgggauggucagcg

SEQ ID NO: 3876292 - RNA, 18 nt, Shigella flexneri 2a str. 2457T
gcauccggucagacaacu

SEQ ID NO: 3876293 - RNA, 16 nt, Shigella flexneri 2a str. 2457T
gcauccggugauaggc

SEQ ID NO: 3876294 - RNA, 18 nt, Shigella flexneri 2a str. 2457T
gcauccugaucguccugc

SEQ ID NO: 3876295 - RNA, 14 nt, Shigella flexneri 2a str. 2457T
gcauccuugcuaac

SEQ ID NO: 3876296 - RNA, 23 nt, Shigella flexneri 2a str. 2457T
gcaucgacagcgccuuuucuuua

SEQ ID NO: 3876297 - RNA, 18 nt, Shigella flexneri 2a str. 2457T
gcaucgacaguuucaccu

SEQ ID NO: 3876298 - RNA, 21 nt, Shigella flexneri 2a str. 2457T
gcaucgacaguuucaccugcu

SEQ ID NO: 3876299 - RNA, 24 nt, Shigella flexneri 2a str. 2457T
gcaucgacggcggagucauucucc

SEQ ID NO: 3876300 - RNA, 19 nt, Shigella flexneri 2a str. 2457T
gcaucgauaucaaccaguu

SEQ ID NO: 3876301 - RNA, 21 nt, Shigella flexneri 2a str. 2457T
gcaucgaugguugcccugcug

SEQ ID NO: 3876302 - RNA, 20 nt, Shigella flexneri 2a str. 2457T
gcaucgcaaaccagacgcgc

SEQ ID NO: 3876303 - RNA, 14 nt, Shigella flexneri 2a str. 2457T
gcaucgcagcauca

SEQ ID NO: 3876304 - RNA, 12 nt, Shigella flexneri 2a str. 2457T
gcaucgcaucaa

SEQ ID NO: 3876305 - RNA, 16 nt, Shigella flexneri 2a str. 2457T
gcaucgccaaacaggc

SEQ ID NO: 3876306 - RNA, 20 nt, Shigella flexneri 2a str. 2457T
gcaucgccauaauaagcgcc

SEQ ID NO: 3876307 - RNA, 20 nt, Shigella flexneri 2a str. 2457T
gcaucgccgggcuaaccgcu

SEQ ID NO: 3876308 - RNA, 22 nt, Shigella flexneri 2a str. 2457T
gcaucgccgguaguuucagcgg

SEQ ID NO: 3876309 - RNA, 21 nt, Shigella flexneri 2a str. 2457T
gcaucgcgauuaugccgccga

SEQ ID NO: 3876310 - RNA, 14 nt, Shigella flexneri 2a str. 2457T
gcaucggcaaucac

SEQ ID NO: 3876311 - RNA, 23 nt, Shigella flexneri 2a str. 2457T
gcaucggcaaucacaucaccaua

SEQ ID NO: 3876312 - RNA, 14 nt, Shigella flexneri 2a str. 2457T
gcaucggcauaauc

SEQ ID NO: 3876313 - RNA, 13 nt, Shigella flexneri 2a str. 2457T
gcaucggcaucaa

SEQ ID NO: 3876314 - RNA, 20 nt, Shigella flexneri 2a str. 2457T
gcaucgggggaagcugaaag

SEQ ID NO: 3876315 - RNA, 21 nt, Shigella flexneri 2a str. 2457T
gcaucggucgaugaaagcgcc

SEQ ID NO: 3876316 - RNA, 23 nt, Shigella flexneri 2a str. 2457T
gcaucguauugguacauaacaca

SEQ ID NO: 3876317 - RNA, 22 nt, Shigella flexneri 2a str. 2457T
gcaucguccgccagccuacaga

SEQ ID NO: 3876318 - RNA, 21 nt, Shigella flexneri 2a str. 2457T
gcaucguccgucgaaagccca

SEQ ID NO: 3876319 - RNA, 15 nt, Shigella flexneri 2a str. 2457T
gcaucgugaauuuua

SEQ ID NO: 3876320 - RNA, 17 nt, Shigella flexneri 2a str. 2457T
gcaucuacgcucucuuc

SEQ ID NO: 3876321 - RNA, 19 nt, Shigella flexneri 2a str. 2457T
gcaucuacgcucucuucaa

SEQ ID NO: 3876322 - RNA, 15 nt, Shigella flexneri 2a str. 2457T
gcaucuccuguuuca

SEQ ID NO: 3876323 - RNA, 16 nt, Shigella flexneri 2a str. 2457T
gcaucucuacagcgcc

SEQ ID NO: 3876324 - RNA, 20 nt, Shigella flexneri 2a str. 2457T
gcaucugagcaugaugccug

SEQ ID NO: 3876325 - RNA, 17 nt, Shigella flexneri 2a str. 2457T
gcaucugauaagcccag

SEQ ID NO: 3876326 - RNA, 20 nt, Shigella flexneri 2a str. 2457T
gcaucuguuucgaucagcaa

SEQ ID NO: 3876327 - RNA, 21 nt, Shigella flexneri 2a str. 2457T
gcaucuguuucgaucagcaau

SEQ ID NO: 3876328 - RNA, 17 nt, Shigella flexneri 2a str. 2457T
gcaucuuauccagcaac

SEQ ID NO: 3876329 - RNA, 17 nt, Shigella flexneri 2a str. 2457T
gcaucuuccccugcgau

SEQ ID NO: 3876330 - RNA, 21 nt, Shigella flexneri 2a str. 2457T
gcaucuuccguggaacaaaau

SEQ ID NO: 3876331 - RNA, 20 nt, Shigella flexneri 2a str. 2457T
gcaucuucgcgccaauccag

SEQ ID NO: 3876332 - RNA, 17 nt, Shigella flexneri 2a str. 2457T
gcaucuucguuaacgcg

SEQ ID NO: 3876333 - RNA, 22 nt, Shigella flexneri 2a str. 2457T
gcaucuuguucauagugccuga

SEQ ID NO: 3876334 - RNA, 16 nt, Shigella flexneri 2a str. 2457T
gcaugaaagcgaugcu

SEQ ID NO: 3876335 - RNA, 13 nt, Shigella flexneri 2a str. 2457T
gcaugaaaugaaa

SEQ ID NO: 3876336 - RNA, 15 nt, Shigella flexneri 2a str. 2457T
gcaugaacauugcug

SEQ ID NO: 3876337 - RNA, 13 nt, Shigella flexneri 2a str. 2457T
gcaugacagcgcc

SEQ ID NO: 3876338 - RNA, 14 nt, Shigella flexneri 2a str. 2457T
gcaugacaggcaac

SEQ ID NO: 3876339 - RNA, 10 nt, Shigella flexneri 2a str. 2457T
gcaugauaag

SEQ ID NO: 3876340 - RNA, 15 nt, Shigella flexneri 2a str. 2457T
gcaugauaagacgcg

SEQ ID NO: 3876341 - RNA, 19 nt, Shigella flexneri 2a str. 2457T
gcaugauaccgauuacuca

SEQ ID NO: 3876342 - RNA, 15 nt, Shigella flexneri 2a str. 2457T
gcaugauagcccgga

SEQ ID NO: 3876343 - RNA, 21 nt, Shigella flexneri 2a str. 2457T
gcaugauagcccggauuucca

SEQ ID NO: 3876344 - RNA, 13 nt, Shigella flexneri 2a str. 2457T
gcaugauccggca

SEQ ID NO: 3876345 - RNA, 15 nt, Shigella flexneri 2a str. 2457T
gcaugaugccugaug

SEQ ID NO: 3876346 - RNA, 20 nt, Shigella flexneri 2a str. 2457T
gcaugauguaagaugaaaua

SEQ ID NO: 3876347 - RNA, 17 nt, Shigella flexneri 2a str. 2457T
gcaugauuucgucaucc

SEQ ID NO: 3876348 - RNA, 20 nt, Shigella flexneri 2a str. 2457T
gcaugauuuuguaggccgga

SEQ ID NO: 3876349 - RNA, 14 nt, Shigella flexneri 2a str. 2457T
gcaugcacccucaa

SEQ ID NO: 3876350 - RNA, 16 nt, Shigella flexneri 2a str. 2457T
gcaugcaucccgccgu

SEQ ID NO: 3876351 - RNA, 17 nt, Shigella flexneri 2a str. 2457T
gcaugccgguagaagcc

SEQ ID NO: 3876352 - RNA, 18 nt, Shigella flexneri 2a str. 2457T
gcaugccgguagaagcca

SEQ ID NO: 3876353 - RNA, 19 nt, Shigella flexneri 2a str. 2457T
gcaugccgguagaagccag

SEQ ID NO: 3876354 - RNA, 22 nt, Shigella flexneri 2a str. 2457T
gcaugccgguagaagccaguca

SEQ ID NO: 3876355 - RNA, 19 nt, Shigella flexneri 2a str. 2457T
gcaugcgaaugcagggccg

SEQ ID NO: 3876356 - RNA, 11 nt, Shigella flexneri 2a str. 2457T
gcaugcucagu

SEQ ID NO: 3876357 - RNA, 19 nt, Shigella flexneri 2a str. 2457T
gcaugcucccaaaaacgcg

SEQ ID NO: 3876358 - RNA, 15 nt, Shigella flexneri 2a str. 2457T
gcauggaaauguucc

SEQ ID NO: 3876359 - RNA, 16 nt, Shigella flexneri 2a str. 2457T
gcauggaucgccgcgg

SEQ ID NO: 3876360 - RNA, 17 nt, Shigella flexneri 2a str. 2457T
gcauggcaauaaccgcu

SEQ ID NO: 3876361 - RNA, 16 nt, Shigella flexneri 2a str. 2457T
gcauggcaccugcgga

SEQ ID NO: 3876362 - RNA, 14 nt, Shigella flexneri 2a str. 2457T
gcauggcgcuggca

SEQ ID NO: 3876363 - RNA, 14 nt, Shigella flexneri 2a str. 2457T
gcauggggagaccc

SEQ ID NO: 3876364 - RNA, 16 nt, Shigella flexneri 2a str. 2457T
gcauggggaucgugau

SEQ ID NO: 3876365 - RNA, 23 nt, Shigella flexneri 2a str. 2457T
gcauggggucagggcuucaaagu

SEQ ID NO: 3876366 - RNA, 14 nt, Shigella flexneri 2a str. 2457T
gcaugguaccgugu

SEQ ID NO: 3876367 - RNA, 14 nt, Shigella flexneri 2a str. 2457T
gcauguagaugccg

SEQ ID NO: 3876368 - RNA, 14 nt, Shigella flexneri 2a str. 2457T
gcauguggcggcgc

SEQ ID NO: 3876369 - RNA, 13 nt, Shigella flexneri 2a str. 2457T
gcauuaaauugug

SEQ ID NO: 3876370 - RNA, 14 nt, Shigella flexneri 2a str. 2457T
gcauuaacagccag

SEQ ID NO: 3876371 - RNA, 18 nt, Shigella flexneri 2a str. 2457T
gcauuaaggcaagaaaau

SEQ ID NO: 3876372 - RNA, 20 nt, Shigella flexneri 2a str. 2457T
gcauuaaggcaagaaaauua

SEQ ID NO: 3876373 - RNA, 16 nt, Shigella flexneri 2a str. 2457T
gcauuaauacaccgcu

SEQ ID NO: 3876374 - RNA, 17 nt, Shigella flexneri 2a str. 2457T
gcauuaauacaccgcug

SEQ ID NO: 3876375 - RNA, 18 nt, Shigella flexneri 2a str. 2457T
gcauuaaugcgcccagcg

SEQ ID NO: 3876376 - RNA, 13 nt, Shigella flexneri 2a str. 2457T
gcauuacaagaau

SEQ ID NO: 3876377 - RNA, 17 nt, Shigella flexneri 2a str. 2457T
gcauuacgcaauuguuc

SEQ ID NO: 3876378 - RNA, 17 nt, Shigella flexneri 2a str. 2457T
gcauuacgcucacugca

SEQ ID NO: 3876379 - RNA, 21 nt, Shigella flexneri 2a str. 2457T
gcauuacgcucacugcaaaac

SEQ ID NO: 3876380 - RNA, 13 nt, Shigella flexneri 2a str. 2457T
gcauuacugcuau

SEQ ID NO: 3876381 - RNA, 22 nt, Shigella flexneri 2a str. 2457T
gcauuacuuucggugacuucaa

SEQ ID NO: 3876382 - RNA, 19 nt, Shigella flexneri 2a str. 2457T
gcauuagcacaaacccagg

SEQ ID NO: 3876383 - RNA, 18 nt, Shigella flexneri 2a str. 2457T
gcauuaucacaucagcgc

SEQ ID NO: 3876384 - RNA, 17 nt, Shigella flexneri 2a str. 2457T
gcauuaucucuugccag

SEQ ID NO: 3876385 - RNA, 14 nt, Shigella flexneri 2a str. 2457T
gcauucacgccgca

SEQ ID NO: 3876386 - RNA, 15 nt, Shigella flexneri 2a str. 2457T
gcauucacgccgcau

SEQ ID NO: 3876387 - RNA, 23 nt, Shigella flexneri 2a str. 2457T
gcauucacgggcggcggcuuuca

SEQ ID NO: 3876388 - RNA, 17 nt, Shigella flexneri 2a str. 2457T
gcauucagcagcagcaa

SEQ ID NO: 3876389 - RNA, 20 nt, Shigella flexneri 2a str. 2457T
gcauucagugcaaaugccag

SEQ ID NO: 3876390 - RNA, 16 nt, Shigella flexneri 2a str. 2457T
gcauucggugcucaau

SEQ ID NO: 3876391 - RNA, 23 nt, Shigella flexneri 2a str. 2457T
gcauucgucguauagaucacuuu

SEQ ID NO: 3876392 - RNA, 18 nt, Shigella flexneri 2a str. 2457T
gcauucucacuccagcca

SEQ ID NO: 3876393 - RNA, 14 nt, Shigella flexneri 2a str. 2457T
gcauucucaucacc

SEQ ID NO: 3876394 - RNA, 13 nt, Shigella flexneri 2a str. 2457T
gcauucuggagcu

SEQ ID NO: 3876395 - RNA, 16 nt, Shigella flexneri 2a str. 2457T
gcauucuuuuucauua

SEQ ID NO: 3876396 - RNA, 13 nt, Shigella flexneri 2a str. 2457T
gcauugacaagcu

SEQ ID NO: 3876397 - RNA, 15 nt, Shigella flexneri 2a str. 2457T
gcauugacaagcuca

SEQ ID NO: 3876398 - RNA, 22 nt, Shigella flexneri 2a str. 2457T
gcauugacgauaucgauaaaga

SEQ ID NO: 3876399 - RNA, 19 nt, Shigella flexneri 2a str. 2457T
gcauugacgccaaaauaac

SEQ ID NO: 3876400 - RNA, 21 nt, Shigella flexneri 2a str. 2457T
gcauugcauuucgcuaccacc

SEQ ID NO: 3876401 - RNA, 20 nt, Shigella flexneri 2a str. 2457T
gcauugcucaccgccagcau

SEQ ID NO: 3876402 - RNA, 17 nt, Shigella flexneri 2a str. 2457T
gcauugcucccugcggc

SEQ ID NO: 3876403 - RNA, 22 nt, Shigella flexneri 2a str. 2457T
gcauugcuuugguggucaccau

SEQ ID NO: 3876404 - RNA, 14 nt, Shigella flexneri 2a str. 2457T
gcauuggacagauu

SEQ ID NO: 3876405 - RNA, 17 nt, Shigella flexneri 2a str. 2457T
gcauuggagacugauga

SEQ ID NO: 3876406 - RNA, 13 nt, Shigella flexneri 2a str. 2457T
gcauuggcaaauu

SEQ ID NO: 3876407 - RNA, 14 nt, Shigella flexneri 2a str. 2457T
gcauugguugcugg

SEQ ID NO: 3876408 - RNA, 17 nt, Shigella flexneri 2a str. 2457T
gcauuuaagaaaaaaga

SEQ ID NO: 3876409 - RNA, 17 nt, Shigella flexneri 2a str. 2457T
gcauuuaagcauuagca

SEQ ID NO: 3876410 - RNA, 11 nt, Shigella flexneri 2a str. 2457T
gcauuuacucu

SEQ ID NO: 3876411 - RNA, 20 nt, Shigella flexneri 2a str. 2457T
gcauuuauggugcuaguuau

SEQ ID NO: 3876412 - RNA, 16 nt, Shigella flexneri 2a str. 2457T
gcauuucauugagcgu

SEQ ID NO: 3876413 - RNA, 17 nt, Shigella flexneri 2a str. 2457T
gcauuucccagcaagaa

SEQ ID NO: 3876414 - RNA, 19 nt, Shigella flexneri 2a str. 2457T
gcauuuccgccaaucaaga

SEQ ID NO: 3876415 - RNA, 17 nt, Shigella flexneri 2a str. 2457T
gcauuuccgcugauuca

SEQ ID NO: 3876416 - RNA, 23 nt, Shigella flexneri 2a str. 2457T
gcauuucgguauaaauaaacccu

SEQ ID NO: 3876417 - RNA, 17 nt, Shigella flexneri 2a str. 2457T
gcauuucgucuucauca

SEQ ID NO: 3876418 - RNA, 17 nt, Shigella flexneri 2a str. 2457T
gccaccggcacauccag

SEQ ID NO: 3876419 - RNA, 13 nt, Shigella flexneri 2a str. 2457T
gccaccucuuuca

SEQ ID NO: 3876420 - RNA, 13 nt, Shigella flexneri 2a str. 2457T
gccaccugaucca

SEQ ID NO: 3876421 - RNA, 12 nt, Shigella flexneri 2a str. 2457T
gccaccugugca

SEQ ID NO: 3876422 - RNA, 14 nt, Shigella flexneri 2a str. 2457T
gccaccuuucuguu

SEQ ID NO: 3876423 - RNA, 22 nt, Shigella flexneri 2a str. 2457T
gccaccuuucuguuccauaauc

SEQ ID NO: 3876424 - RNA, 19 nt, Shigella flexneri 2a str. 2457T
gccacgaaacugcuggcuu

SEQ ID NO: 3876425 - RNA, 23 nt, Shigella flexneri 2a str. 2457T
gccacgaaucagcaccguagcgu

SEQ ID NO: 3876426 - RNA, 15 nt, Shigella flexneri 2a str. 2457T
gccacgccacgcugc

SEQ ID NO: 3876427 - RNA, 20 nt, Shigella flexneri 2a str. 2457T
gccacgccuguaccagcggc

SEQ ID NO: 3876428 - RNA, 13 nt, Shigella flexneri 2a str. 2457T
gccacgcgucguc

SEQ ID NO: 3876429 - RNA, 20 nt, Shigella flexneri 2a str. 2457T
gccacgcugccgcgcaggga

SEQ ID NO: 3876430 - RNA, 15 nt, Shigella flexneri 2a str. 2457T
gccacgcuucaaucu

SEQ ID NO: 3876431 - RNA, 18 nt, Shigella flexneri 2a str. 2457T
gccacgcuucaaucugau

SEQ ID NO: 3876432 - RNA, 16 nt, Shigella flexneri 2a str. 2457T
gccacggcaugaaagc

SEQ ID NO: 3876433 - RNA, 17 nt, Shigella flexneri 2a str. 2457T
gccacggcaugaaagcg

SEQ ID NO: 3876434 - RNA, 22 nt, Shigella flexneri 2a str. 2457T
gccacggcgaccguucgccagg

SEQ ID NO: 3876435 - RNA, 14 nt, Shigella flexneri 2a str. 2457T
gccacggcgcagcu

SEQ ID NO: 3876436 - RNA, 13 nt, Shigella flexneri 2a str. 2457T
gccacggcuccag

SEQ ID NO: 3876437 - RNA, 13 nt, Shigella flexneri 2a str. 2457T
gccacgguaaaac

SEQ ID NO: 3876438 - RNA, 15 nt, Shigella flexneri 2a str. 2457T
gccacgguaaaaccg

SEQ ID NO: 3876439 - RNA, 19 nt, Shigella flexneri 2a str. 2457T
gccacgguaucaagcccgc

SEQ ID NO: 3876440 - RNA, 15 nt, Shigella flexneri 2a str. 2457T
gccacgguauuugcc

SEQ ID NO: 3876441 - RNA, 13 nt, Shigella flexneri 2a str. 2457T
gccacgucaucag

SEQ ID NO: 3876442 - RNA, 13 nt, Shigella flexneri 2a str. 2457T
gccacgucauccg

SEQ ID NO: 3876443 - RNA, 22 nt, Shigella flexneri 2a str. 2457T
gccacucugacggcgcauccga

SEQ ID NO: 3876444 - RNA, 20 nt, Shigella flexneri 2a str. 2457T
gccacugcccgagaacagca

SEQ ID NO: 3876445 - RNA, 12 nt, Shigella flexneri 2a str. 2457T
gccacuggcgcg

SEQ ID NO: 3876446 - RNA, 21 nt, Shigella flexneri 2a str. 2457T
gccacugguuuuccugagcaa

SEQ ID NO: 3876447 - RNA, 19 nt, Shigella flexneri 2a str. 2457T
gccacuguuccggagaagc

SEQ ID NO: 3876448 - RNA, 18 nt, Shigella flexneri 2a str. 2457T
gccacuucguaaccagcc

SEQ ID NO: 3876449 - RNA, 15 nt, Shigella flexneri 2a str. 2457T
gccacuucuuccagc

SEQ ID NO: 3876450 - RNA, 18 nt, Shigella flexneri 2a str. 2457T
gccacuucuuccagcggc

SEQ ID NO: 3876451 - RNA, 20 nt, Shigella flexneri 2a str. 2457T
gccacuucuuccagcggcag

SEQ ID NO: 3876452 - RNA, 23 nt, Shigella flexneri 2a str. 2457T
gccacuucuuccagcggcaggcc

SEQ ID NO: 3876453 - RNA, 14 nt, Shigella flexneri 2a str. 2457T
gccacuuucggcag

SEQ ID NO: 3876454 - RNA, 19 nt, Shigella flexneri 2a str. 2457T
gccacuuugcaguuccugc

SEQ ID NO: 3876455 - RNA, 20 nt, Shigella flexneri 2a str. 2457T
gccacuuugcaguuccugcc

SEQ ID NO: 3876456 - RNA, 21 nt, Shigella flexneri 2a str. 2457T
gccacuuuucggcaaccgcau

SEQ ID NO: 3876457 - RNA, 13 nt, Shigella flexneri 2a str. 2457T
gccagaaagaacc

SEQ ID NO: 3876458 - RNA, 12 nt, Shigella flexneri 2a str. 2457T
gccagaaaucag

SEQ ID NO: 3876459 - RNA, 14 nt, Shigella flexneri 2a str. 2457T
gccagaaaucagcu

SEQ ID NO: 3876460 - RNA, 18 nt, Shigella flexneri 2a str. 2457T
gccagaaauccaggcccg

SEQ ID NO: 3876461 - RNA, 21 nt, Shigella flexneri 2a str. 2457T
gccagaaauccaggcccgcau

SEQ ID NO: 3876462 - RNA, 18 nt, Shigella flexneri 2a str. 2457T
gccagaaauggcccaaaa

SEQ ID NO: 3876463 - RNA, 20 nt, Shigella flexneri 2a str. 2457T
gccagaacacuguuaccgcu

SEQ ID NO: 3876464 - RNA, 19 nt, Shigella flexneri 2a str. 2457T
gccagaacagcuacagcau

SEQ ID NO: 3876465 - RNA, 21 nt, Shigella flexneri 2a str. 2457T
gccagaacagcuacagcauca

SEQ ID NO: 3876466 - RNA, 23 nt, Shigella flexneri 2a str. 2457T
gccagaacugauaacgcauuuca

SEQ ID NO: 3876467 - RNA, 13 nt, Shigella flexneri 2a str. 2457T
gccagaagcccgg

SEQ ID NO: 3876468 - RNA, 21 nt, Shigella flexneri 2a str. 2457T
gccagaauaacgugaucgaac

SEQ ID NO: 3876469 - RNA, 17 nt, Shigella flexneri 2a str. 2457T
gccagaauagccgcagc

SEQ ID NO: 3876470 - RNA, 21 nt, Shigella flexneri 2a str. 2457T
gccagaauagccgcagccauc

SEQ ID NO: 3876471 - RNA, 17 nt, Shigella flexneri 2a str. 2457T
gccagaauuuucucacc

SEQ ID NO: 3876472 - RNA, 20 nt, Shigella flexneri 2a str. 2457T
gccagaauuuucucacccgc

SEQ ID NO: 3876473 - RNA, 17 nt, Shigella flexneri 2a str. 2457T
gccagacaaaccacgcc

SEQ ID NO: 3876474 - RNA, 22 nt, Shigella flexneri 2a str. 2457T
gccagacaccccuucauucagg

SEQ ID NO: 3876475 - RNA, 18 nt, Shigella flexneri 2a str. 2457T
gccagacacuggaaacag

SEQ ID NO: 3876476 - RNA, 16 nt, Shigella flexneri 2a str. 2457T
gccagacauuauaaau

SEQ ID NO: 3876477 - RNA, 19 nt, Shigella flexneri 2a str. 2457T
gccagaccacugcgccgcu

SEQ ID NO: 3876478 - RNA, 17 nt, Shigella flexneri 2a str. 2457T
gccagacccauaaucag

SEQ ID NO: 3876479 - RNA, 22 nt, Shigella flexneri 2a str. 2457T
gccagaccuaccaucuccugca

SEQ ID NO: 3876480 - RNA, 19 nt, Shigella flexneri 2a str. 2457T
gccagaccuccguuuuucu

SEQ ID NO: 3876481 - RNA, 12 nt, Shigella flexneri 2a str. 2457T
gccagacgcuga

SEQ ID NO: 3876482 - RNA, 16 nt, Shigella flexneri 2a str. 2457T
gccagacgguaacccc

SEQ ID NO: 3876483 - RNA, 13 nt, Shigella flexneri 2a str. 2457T
gccagacugcgcu

SEQ ID NO: 3876484 - RNA, 16 nt, Shigella flexneri 2a str. 2457T
gccagagcagcaacaa

SEQ ID NO: 3876485 - RNA, 19 nt, Shigella flexneri 2a str. 2457T
gccagagcagcaacaagcc

SEQ ID NO: 3876486 - RNA, 16 nt, Shigella flexneri 2a str. 2457T
gccagagcccaucaca

SEQ ID NO: 3876487 - RNA, 15 nt, Shigella flexneri 2a str. 2457T
gccagaggagccauc

SEQ ID NO: 3876488 - RNA, 20 nt, Shigella flexneri 2a str. 2457T
gccagaggagccaucaccau

SEQ ID NO: 3876489 - RNA, 21 nt, Shigella flexneri 2a str. 2457T
gccagauaaauauuauuggca

SEQ ID NO: 3876490 - RNA, 15 nt, Shigella flexneri 2a str. 2457T
gccagauaagacacu

SEQ ID NO: 3876491 - RNA, 15 nt, Shigella flexneri 2a str. 2457T
gccagauaagacgcg

SEQ ID NO: 3876492 - RNA, 16 nt, Shigella flexneri 2a str. 2457T
gccagauaauggcugu

SEQ ID NO: 3876493 - RNA, 17 nt, Shigella flexneri 2a str. 2457T
gccagauaauggcuguu

SEQ ID NO: 3876494 - RNA, 16 nt, Shigella flexneri 2a str. 2457T
gccagauacaucagcg

SEQ ID NO: 3876495 - RNA, 18 nt, Shigella flexneri 2a str. 2457T
gccagauacaucagcgac

SEQ ID NO: 3876496 - RNA, 19 nt, Shigella flexneri 2a str. 2457T
gccagauacaucagcgaca

SEQ ID NO: 3876497 - RNA, 15 nt, Shigella flexneri 2a str. 2457T
gccagauagauugcg

SEQ ID NO: 3876498 - RNA, 16 nt, Shigella flexneri 2a str. 2457T
gccagauaguucgcga

SEQ ID NO: 3876499 - RNA, 23 nt, Shigella flexneri 2a str. 2457T
gccagauauugauucaucucuuc

SEQ ID NO: 3876500 - RNA, 14 nt, Shigella flexneri 2a str. 2457T
gccagaugcggcgu

SEQ ID NO: 3876501 - RNA, 21 nt, Shigella flexneri 2a str. 2457T
gccagaugcggcgugaacgcc

SEQ ID NO: 3876502 - RNA, 14 nt, Shigella flexneri 2a str. 2457T
gccagauggcaucc

SEQ ID NO: 3876503 - RNA, 18 nt, Shigella flexneri 2a str. 2457T
gccagauguugucucaga

SEQ ID NO: 3876504 - RNA, 15 nt, Shigella flexneri 2a str. 2457T
gccagauuugcugac

SEQ ID NO: 3876505 - RNA, 14 nt, Shigella flexneri 2a str. 2457T
gccagcaacacaua

SEQ ID NO: 3876506 - RNA, 17 nt, Shigella flexneri 2a str. 2457T
gccagcaacugacugac

SEQ ID NO: 3876507 - RNA, 22 nt, Shigella flexneri 2a str. 2457T
gccagcaacugacugacuucaa

SEQ ID NO: 3876508 - RNA, 22 nt, Shigella flexneri 2a str. 2457T
gccagcaagagcaaauaaaaca

SEQ ID NO: 3876509 - RNA, 18 nt, Shigella flexneri 2a str. 2457T
gccagcaaggcgcuaaaa

SEQ ID NO: 3876510 - RNA, 18 nt, Shigella flexneri 2a str. 2457T
gccagcaauccccagaca

SEQ ID NO: 3876511 - RNA, 21 nt, Shigella flexneri 2a str. 2457T
gccagcacagaucgcacuuaa

SEQ ID NO: 3876512 - RNA, 16 nt, Shigella flexneri 2a str. 2457T
gccagcacggcgcuga

SEQ ID NO: 3876513 - RNA, 15 nt, Shigella flexneri 2a str. 2457T
gccagcagagcaaaa

SEQ ID NO: 3876514 - RNA, 22 nt, Shigella flexneri 2a str. 2457T
gccagcagagggauaucuuccc

SEQ ID NO: 3876515 - RNA, 14 nt, Shigella flexneri 2a str. 2457T
gccauaauaaucau

SEQ ID NO: 3876516 - RNA, 19 nt, Shigella flexneri 2a str. 2457T
gccauaauaaucaucacgc

SEQ ID NO: 3876517 - RNA, 21 nt, Shigella flexneri 2a str. 2457T
gccauacccgccagugcugaa

SEQ ID NO: 3876518 - RNA, 22 nt, Shigella flexneri 2a str. 2457T
gccauacugacuaucaucgccg

SEQ ID NO: 3876519 - RNA, 19 nt, Shigella flexneri 2a str. 2457T
gccauauacgccaucgcca

SEQ ID NO: 3876520 - RNA, 16 nt, Shigella flexneri 2a str. 2457T
gccauauucgcuuuca

SEQ ID NO: 3876521 - RNA, 17 nt, Shigella flexneri 2a str. 2457T
gccauauuuaaagaaga

SEQ ID NO: 3876522 - RNA, 18 nt, Shigella flexneri 2a str. 2457T
gccauauuuaaagaagag

SEQ ID NO: 3876523 - RNA, 14 nt, Shigella flexneri 2a str. 2457T
gccaucaaauagcc

SEQ ID NO: 3876524 - RNA, 18 nt, Shigella flexneri 2a str. 2457T
gccaucaaauagccccug

SEQ ID NO: 3876525 - RNA, 22 nt, Shigella flexneri 2a str. 2457T
gccaucaacguaguaucguaau

SEQ ID NO: 3876526 - RNA, 20 nt, Shigella flexneri 2a str. 2457T
gccaucaaucacuuugcgcu

SEQ ID NO: 3876527 - RNA, 17 nt, Shigella flexneri 2a str. 2457T
gccaucaaugccgcaac

SEQ ID NO: 3876528 - RNA, 18 nt, Shigella flexneri 2a str. 2457T
gccaucaaugccgcaacu

SEQ ID NO: 3876529 - RNA, 14 nt, Shigella flexneri 2a str. 2457T
gccaucaauugcuc

SEQ ID NO: 3876530 - RNA, 16 nt, Shigella flexneri 2a str. 2457T
gccaucaauuuccggc

SEQ ID NO: 3876531 - RNA, 14 nt, Shigella flexneri 2a str. 2457T
gccaucacugacug

SEQ ID NO: 3876532 - RNA, 15 nt, Shigella flexneri 2a str. 2457T
gccaucacugacugc

SEQ ID NO: 3876533 - RNA, 14 nt, Shigella flexneri 2a str. 2457T
gccaucagcagcgg

SEQ ID NO: 3876534 - RNA, 15 nt, Shigella flexneri 2a str. 2457T
gccaucagugccagu

SEQ ID NO: 3876535 - RNA, 16 nt, Shigella flexneri 2a str. 2457T
gccaucaucaccagaa

SEQ ID NO: 3876536 - RNA, 17 nt, Shigella flexneri 2a str. 2457T
gccaucaucaccagaau

SEQ ID NO: 3876537 - RNA, 14 nt, Shigella flexneri 2a str. 2457T
gccauccagcagac

SEQ ID NO: 3876538 - RNA, 23 nt, Shigella flexneri 2a str. 2457T
gccauccauaauuacgcuguuca

SEQ ID NO: 3876539 - RNA, 17 nt, Shigella flexneri 2a str. 2457T
gccauccaucaacgcca

SEQ ID NO: 3876540 - RNA, 18 nt, Shigella flexneri 2a str. 2457T
gccaucccuaccgcccgc

SEQ ID NO: 3876541 - RNA, 22 nt, Shigella flexneri 2a str. 2457T
gccaucccuaccgcccgcgcgg

SEQ ID NO: 3876542 - RNA, 21 nt, Shigella flexneri 2a str. 2457T
gccauccgcgugacgcuggca

SEQ ID NO: 3876543 - RNA, 11 nt, Shigella flexneri 2a str. 2457T
gccauccggca

SEQ ID NO: 3876544 - RNA, 16 nt, Shigella flexneri 2a str. 2457T
gccauccgucauccau

SEQ ID NO: 3876545 - RNA, 19 nt, Shigella flexneri 2a str. 2457T
gccauccgucauccauacc

SEQ ID NO: 3876546 - RNA, 14 nt, Shigella flexneri 2a str. 2457T
gccauccguuucag

SEQ ID NO: 3876547 - RNA, 16 nt, Shigella flexneri 2a str. 2457T
gccauccuuacgcagc

SEQ ID NO: 3876548 - RNA, 22 nt, Shigella flexneri 2a str. 2457T
gccaucgccaggaacaacgaca

SEQ ID NO: 3876549 - RNA, 19 nt, Shigella flexneri 2a str. 2457T
gccaucgccugaucgccau

SEQ ID NO: 3876550 - RNA, 21 nt, Shigella flexneri 2a str. 2457T
gccaucgcgguuaaucggcag

SEQ ID NO: 3876551 - RNA, 20 nt, Shigella flexneri 2a str. 2457T
gccaucgcguugucauacga

SEQ ID NO: 3876552 - RNA, 19 nt, Shigella flexneri 2a str. 2457T
gccaucguuaauuaacgcg

SEQ ID NO: 3876553 - RNA, 23 nt, Shigella flexneri 2a str. 2457T
gccaucucugcaacgucuucccg

SEQ ID NO: 3876554 - RNA, 15 nt, Shigella flexneri 2a str. 2457T
gccaucugccagacc

SEQ ID NO: 3876555 - RNA, 15 nt, Shigella flexneri 2a str. 2457T
gccaucugccagcaa

SEQ ID NO: 3876556 - RNA, 21 nt, Shigella flexneri 2a str. 2457T
gccaucugccagcaagcgcac

SEQ ID NO: 3876557 - RNA, 18 nt, Shigella flexneri 2a str. 2457T
gccaugaccgcuccgcca

SEQ ID NO: 3876558 - RNA, 16 nt, Shigella flexneri 2a str. 2457T
gccaugcacgcaagaa

SEQ ID NO: 3876559 - RNA, 20 nt, Shigella flexneri 2a str. 2457T
gccaugcacgcaagaacgca

SEQ ID NO: 3876560 - RNA, 21 nt, Shigella flexneri 2a str. 2457T
gccaugcacgcaagaacgcau

SEQ ID NO: 3876561 - RNA, 12 nt, Shigella flexneri 2a str. 2457T
gccaugcauauc

SEQ ID NO: 3876562 - RNA, 17 nt, Shigella flexneri 2a str. 2457T
gccaugcccgugcugac

SEQ ID NO: 3876563 - RNA, 22 nt, Shigella flexneri 2a str. 2457T
gccaugcguuuuaccgccucgc

SEQ ID NO: 3876564 - RNA, 21 nt, Shigella flexneri 2a str. 2457T
gccauggcugcgauaguggaa

SEQ ID NO: 3876565 - RNA, 12 nt, Shigella flexneri 2a str. 2457T
gccauuaaacaa

SEQ ID NO: 3876566 - RNA, 16 nt, Shigella flexneri 2a str. 2457T
gccauucacucuuuaa

SEQ ID NO: 3876567 - RNA, 19 nt, Shigella flexneri 2a str. 2457T
gccauuccgggaaacgaac

SEQ ID NO: 3876568 - RNA, 19 nt, Shigella flexneri 2a str. 2457T
gccauugcccgaugcgcaa

SEQ ID NO: 3876569 - RNA, 23 nt, Shigella flexneri 2a str. 2457T
gccauugcccgaugcgcaaacuu

SEQ ID NO: 3876570 - RNA, 20 nt, Shigella flexneri 2a str. 2457T
gccauugccggugauugcaa

SEQ ID NO: 3876571 - RNA, 12 nt, Shigella flexneri 2a str. 2457T
gccauuggcuuu

SEQ ID NO: 3876572 - RNA, 13 nt, Shigella flexneri 2a str. 2457T
gccauuuaacgca

SEQ ID NO: 3876573 - RNA, 19 nt, Shigella flexneri 2a str. 2457T
gccauuuaacgcaucacga

SEQ ID NO: 3876574 - RNA, 14 nt, Shigella flexneri 2a str. 2457T
gccauuugauucac

SEQ ID NO: 3876575 - RNA, 12 nt, Shigella flexneri 2a str. 2457T
gccauuugccag

SEQ ID NO: 3876576 - RNA, 16 nt, Shigella flexneri 2a str. 2457T
gccauuugggcggcuu

SEQ ID NO: 3876577 - RNA, 18 nt, Shigella flexneri 2a str. 2457T
gccauuuugcacauucca

SEQ ID NO: 3876578 - RNA, 16 nt, Shigella flexneri 2a str. 2457T
gccauuuugcgcggca

SEQ ID NO: 3876579 - RNA, 15 nt, Shigella flexneri 2a str. 2457T
gccauuuuucagacg

SEQ ID NO: 3876580 - RNA, 15 nt, Shigella flexneri 2a str. 2457T
gcccaaaaggcagcg

SEQ ID NO: 3876581 - RNA, 20 nt, Shigella flexneri 2a str. 2457T
gcccaaaccacccagcagcg

SEQ ID NO: 3876582 - RNA, 18 nt, Shigella flexneri 2a str. 2457T
gcccaacaguagacaauu

SEQ ID NO: 3876583 - RNA, 22 nt, Shigella flexneri 2a str. 2457T
gcccaacgcauaaucuguuuca

SEQ ID NO: 3876584 - RNA, 15 nt, Shigella flexneri 2a str. 2457T
gcccaacuguugauc

SEQ ID NO: 3876585 - RNA, 20 nt, Shigella flexneri 2a str. 2457T
gcccaacuguugauccagga

SEQ ID NO: 3876586 - RNA, 23 nt, Shigella flexneri 2a str. 2457T
gcccaauacagcgcggaccccac

SEQ ID NO: 3876587 - RNA, 16 nt, Shigella flexneri 2a str. 2457T
gcccacaccagucagc

SEQ ID NO: 3876588 - RNA, 21 nt, Shigella flexneri 2a str. 2457T
gcccacaucaacucugcaaug

SEQ ID NO: 3876589 - RNA, 13 nt, Shigella flexneri 2a str. 2457T
gcccaccaccagc

SEQ ID NO: 3876590 - RNA, 16 nt, Shigella flexneri 2a str. 2457T
gcccaccaccagcgaa

SEQ ID NO: 3876591 - RNA, 22 nt, Shigella flexneri 2a str. 2457T
gcccaccauguucacugccgua

SEQ ID NO: 3876592 - RNA, 23 nt, Shigella flexneri 2a str. 2457T
gcccaccgacgcagucaugcgag

SEQ ID NO: 3876593 - RNA, 17 nt, Shigella flexneri 2a str. 2457T
gcccaccuacaccggca

SEQ ID NO: 3876594 - RNA, 18 nt, Shigella flexneri 2a str. 2457T
gcccaccugcggcaccua

SEQ ID NO: 3876595 - RNA, 13 nt, Shigella flexneri 2a str. 2457T
gcccacgccgccc

SEQ ID NO: 3876596 - RNA, 20 nt, Shigella flexneri 2a str. 2457T
gcccacggcguggcaucaau

SEQ ID NO: 3876597 - RNA, 17 nt, Shigella flexneri 2a str. 2457T
gcccacuuucugcgcaa

SEQ ID NO: 3876598 - RNA, 22 nt, Shigella flexneri 2a str. 2457T
gcccagaaaccaguuuuuacgc

SEQ ID NO: 3876599 - RNA, 15 nt, Shigella flexneri 2a str. 2457T
gcccagaacaaauaa

SEQ ID NO: 3876600 - RNA, 16 nt, Shigella flexneri 2a str. 2457T
gcccagacaaaugaac

SEQ ID NO: 3876601 - RNA, 10 nt, Shigella flexneri 2a str. 2457T
gcccagcaga

SEQ ID NO: 3876602 - RNA, 12 nt, Shigella flexneri 2a str. 2457T
gcccagccagcc

SEQ ID NO: 3876603 - RNA, 16 nt, Shigella flexneri 2a str. 2457T
gcccagcccccagcau

SEQ ID NO: 3876604 - RNA, 22 nt, Shigella flexneri 2a str. 2457T
gcccagccgaagggaaagagcg

SEQ ID NO: 3876605 - RNA, 15 nt, Shigella flexneri 2a str. 2457T
gcccagccgugaaug

SEQ ID NO: 3876606 - RNA, 20 nt, Shigella flexneri 2a str. 2457T
gcccagcgacugcgggcgca

SEQ ID NO: 3876607 - RNA, 13 nt, Shigella flexneri 2a str. 2457T
gcccagcgcagga

SEQ ID NO: 3876608 - RNA, 14 nt, Shigella flexneri 2a str. 2457T
gcccagcgcaucag

SEQ ID NO: 3876609 - RNA, 15 nt, Shigella flexneri 2a str. 2457T
gcccagcgcaucagg

SEQ ID NO: 3876610 - RNA, 19 nt, Shigella flexneri 2a str. 2457T
gcccagcgcaucaggcaau

SEQ ID NO: 3876611 - RNA, 22 nt, Shigella flexneri 2a str. 2457T
gcccagcgucagcauaaaaaua

SEQ ID NO: 3876612 - RNA, 23 nt, Shigella flexneri 2a str. 2457T
gcccgguuucgccacggcgcagc

SEQ ID NO: 3876613 - RNA, 23 nt, Shigella flexneri 2a str. 2457T
gcccguaccgucaaucuucacgc

SEQ ID NO: 3876614 - RNA, 16 nt, Shigella flexneri 2a str. 2457T
gcccguacgcuguggu

SEQ ID NO: 3876615 - RNA, 17 nt, Shigella flexneri 2a str. 2457T
gcccgucaugccgucgc

SEQ ID NO: 3876616 - RNA, 22 nt, Shigella flexneri 2a str. 2457T
gcccguccaucaacaagcgaau

SEQ ID NO: 3876617 - RNA, 20 nt, Shigella flexneri 2a str. 2457T
gcccguguuucugauacagc

SEQ ID NO: 3876618 - RNA, 19 nt, Shigella flexneri 2a str. 2457T
gcccguuaaccgcucugcg

SEQ ID NO: 3876619 - RNA, 21 nt, Shigella flexneri 2a str. 2457T
gcccguuaaccgcucugcgau

SEQ ID NO: 3876620 - RNA, 15 nt, Shigella flexneri 2a str. 2457T
gcccguugccaggac

SEQ ID NO: 3876621 - RNA, 22 nt, Shigella flexneri 2a str. 2457T
gcccguuucucuuaaaugcaca

SEQ ID NO: 3876622 - RNA, 21 nt, Shigella flexneri 2a str. 2457T
gcccguuuucaccuuacuucc

SEQ ID NO: 3876623 - RNA, 18 nt, Shigella flexneri 2a str. 2457T
gcccguuuucuccagcgc

SEQ ID NO: 3876624 - RNA, 21 nt, Shigella flexneri 2a str. 2457T
gcccguuuucuccagcgccgc

SEQ ID NO: 3876625 - RNA, 16 nt, Shigella flexneri 2a str. 2457T
gcccuauugauugucu

SEQ ID NO: 3876626 - RNA, 14 nt, Shigella flexneri 2a str. 2457T
gcccucaaacaaca

SEQ ID NO: 3876627 - RNA, 12 nt, Shigella flexneri 2a str. 2457T
gcccucacccgu

SEQ ID NO: 3876628 - RNA, 21 nt, Shigella flexneri 2a str. 2457T
gcccuccgguccgccguagcc

SEQ ID NO: 3876629 - RNA, 22 nt, Shigella flexneri 2a str. 2457T
gcccuccugauaacacagaggc

SEQ ID NO: 3876630 - RNA, 15 nt, Shigella flexneri 2a str. 2457T
gcccucgaucggcuc

SEQ ID NO: 3876631 - RNA, 17 nt, Shigella flexneri 2a str. 2457T
gcccucgccuuuuugcg

SEQ ID NO: 3876632 - RNA, 13 nt, Shigella flexneri 2a str. 2457T
gcccucucaaccg

SEQ ID NO: 3876633 - RNA, 16 nt, Shigella flexneri 2a str. 2457T
gcccugauggcgcgcc

SEQ ID NO: 3876634 - RNA, 17 nt, Shigella flexneri 2a str. 2457T
gcccugccaggucauca

SEQ ID NO: 3876635 - RNA, 17 nt, Shigella flexneri 2a str. 2457T
gcccugcccguugccag

SEQ ID NO: 3876636 - RNA, 14 nt, Shigella flexneri 2a str. 2457T
gcccugcgucgcac

SEQ ID NO: 3876637 - RNA, 13 nt, Shigella flexneri 2a str. 2457T
gcccugcuccagc

SEQ ID NO: 3876638 - RNA, 17 nt, Shigella flexneri 2a str. 2457T
gcccugcuccagcaacu

SEQ ID NO: 3876639 - RNA, 19 nt, Shigella flexneri 2a str. 2457T
gcccugcugguuagcggcc

SEQ ID NO: 3876640 - RNA, 17 nt, Shigella flexneri 2a str. 2457T
gcccuggacaacauucc

SEQ ID NO: 3876641 - RNA, 22 nt, Shigella flexneri 2a str. 2457T
gcccuggacaacauuccugcug

SEQ ID NO: 3876642 - RNA, 19 nt, Shigella flexneri 2a str. 2457T
gcccuggauuucaauaacu

SEQ ID NO: 3876643 - RNA, 17 nt, Shigella flexneri 2a str. 2457T
gcccuggcucguggcug

SEQ ID NO: 3876644 - RNA, 14 nt, Shigella flexneri 2a str. 2457T
gcccuggcucugca

SEQ ID NO: 3876645 - RNA, 22 nt, Shigella flexneri 2a str. 2457T
gcccugggcuucauccagcagu

SEQ ID NO: 3876646 - RNA, 19 nt, Shigella flexneri 2a str. 2457T
gcccuggguaccgagaaaa

SEQ ID NO: 3876647 - RNA, 17 nt, Shigella flexneri 2a str. 2457T
gcccugucgaggccaau

SEQ ID NO: 3876648 - RNA, 20 nt, Shigella flexneri 2a str. 2457T
gcccuguuugguugccagcc

SEQ ID NO: 3876649 - RNA, 22 nt, Shigella flexneri 2a str. 2457T
gcccuguuugguugccagccac

SEQ ID NO: 3876650 - RNA, 22 nt, Shigella flexneri 2a str. 2457T
gcccuuaauuacguuuccgcua

SEQ ID NO: 3876651 - RNA, 20 nt, Shigella flexneri 2a str. 2457T
gcccuucacccauugccgcc

SEQ ID NO: 3876652 - RNA, 12 nt, Shigella flexneri 2a str. 2457T
gcccuuccccuu

SEQ ID NO: 3876653 - RNA, 23 nt, Shigella flexneri 2a str. 2457T
gcccuucuuucacuucagcaacg

SEQ ID NO: 3876654 - RNA, 13 nt, Shigella flexneri 2a str. 2457T
gcccuugccaacg

SEQ ID NO: 3876655 - RNA, 15 nt, Shigella flexneri 2a str. 2457T
gcccuuugcgcauga

SEQ ID NO: 3876656 - RNA, 22 nt, Shigella flexneri 2a str. 2457T
gcccuuuguaggccagauaaga

SEQ ID NO: 3876657 - RNA, 22 nt, Shigella flexneri 2a str. 2457T
gcccuuuuucacgcuaaaagcg

SEQ ID NO: 3876658 - RNA, 21 nt, Shigella flexneri 2a str. 2457T
gcccuuuuuuugucuguuugc

SEQ ID NO: 3876659 - RNA, 22 nt, Shigella flexneri 2a str. 2457T
gccgaaaaaggaucaaccgaag

SEQ ID NO: 3876660 - RNA, 14 nt, Shigella flexneri 2a str. 2457T
gccgaaccagugcu

SEQ ID NO: 3876661 - RNA, 18 nt, Shigella flexneri 2a str. 2457T
gccgaaccagugcuccac

SEQ ID NO: 3876662 - RNA, 15 nt, Shigella flexneri 2a str. 2457T
gccgaacguaggcug

SEQ ID NO: 3876663 - RNA, 17 nt, Shigella flexneri 2a str. 2457T
gccgaacguaggcugga

SEQ ID NO: 3876664 - RNA, 18 nt, Shigella flexneri 2a str. 2457T
gccgaagaagaaguuuau

SEQ ID NO: 3876665 - RNA, 23 nt, Shigella flexneri 2a str. 2457T
gccgaagccguuagucaucauca

SEQ ID NO: 3876666 - RNA, 18 nt, Shigella flexneri 2a str. 2457T
gccgaagcgcaguuuaau

SEQ ID NO: 3876667 - RNA, 13 nt, Shigella flexneri 2a str. 2457T
gccgaauaacgcg

SEQ ID NO: 3876668 - RNA, 12 nt, Shigella flexneri 2a str. 2457T
gccgacagagcg

SEQ ID NO: 3876669 - RNA, 12 nt, Shigella flexneri 2a str. 2457T
gccgacauggca

SEQ ID NO: 3876670 - RNA, 13 nt, Shigella flexneri 2a str. 2457T
gccgaccagaccg

SEQ ID NO: 3876671 - RNA, 21 nt, Shigella flexneri 2a str. 2457T
gccgaccgcaaggaagccuga

SEQ ID NO: 3876672 - RNA, 19 nt, Shigella flexneri 2a str. 2457T
gccgacgccaguucucuuc

SEQ ID NO: 3876673 - RNA, 15 nt, Shigella flexneri 2a str. 2457T
gccgacggauugucg

SEQ ID NO: 3876674 - RNA, 13 nt, Shigella flexneri 2a str. 2457T
gccgacggucagg

SEQ ID NO: 3876675 - RNA, 19 nt, Shigella flexneri 2a str. 2457T
gccgagaauaaaacaggca

SEQ ID NO: 3876676 - RNA, 21 nt, Shigella flexneri 2a str. 2457T
gccgagaauaaaacaggcagc

SEQ ID NO: 3876677 - RNA, 17 nt, Shigella flexneri 2a str. 2457T
gccgagcaaaucgcggc

SEQ ID NO: 3876678 - RNA, 11 nt, Shigella flexneri 2a str. 2457T
gccgagcgcca

SEQ ID NO: 3876679 - RNA, 15 nt, Shigella flexneri 2a str. 2457T
gccgagcgccagcca

SEQ ID NO: 3876680 - RNA, 15 nt, Shigella flexneri 2a str. 2457T
gccgagcgcguuaaa

SEQ ID NO: 3876681 - RNA, 20 nt, Shigella flexneri 2a str. 2457T
gccgagcgggaucgccgcgu

SEQ ID NO: 3876682 - RNA, 15 nt, Shigella flexneri 2a str. 2457T
gccgaggcacagcag

SEQ ID NO: 3876683 - RNA, 22 nt, Shigella flexneri 2a str. 2457T
gccgagguuggcucaucaagca

SEQ ID NO: 3876684 - RNA, 16 nt, Shigella flexneri 2a str. 2457T
gccgaguaaaaaaaca

SEQ ID NO: 3876685 - RNA, 23 nt, Shigella flexneri 2a str. 2457T
gccgauaacaccgauuuuguaaa

SEQ ID NO: 3876686 - RNA, 21 nt, Shigella flexneri 2a str. 2457T
gccgauaaucaacgcgccgcc

SEQ ID NO: 3876687 - RNA, 20 nt, Shigella flexneri 2a str. 2457T
gccgauaccaucacaccucg

SEQ ID NO: 3876688 - RNA, 21 nt, Shigella flexneri 2a str. 2457T
gccgaucaauuucacaguaau

SEQ ID NO: 3876689 - RNA, 14 nt, Shigella flexneri 2a str. 2457T
gccgaucaucaucc

SEQ ID NO: 3876690 - RNA, 14 nt, Shigella flexneri 2a str. 2457T
gccgauccgcguca

SEQ ID NO: 3876691 - RNA, 23 nt, Shigella flexneri 2a str. 2457T
gccgaucucaccgaucaucacga

SEQ ID NO: 3876692 - RNA, 15 nt, Shigella flexneri 2a str. 2457T
gccgaugccgcugca

SEQ ID NO: 3876693 - RNA, 20 nt, Shigella flexneri 2a str. 2457T
gccgauggcaaaagugauau

SEQ ID NO: 3876694 - RNA, 17 nt, Shigella flexneri 2a str. 2457T
gccgauggcgcagacuu

SEQ ID NO: 3876695 - RNA, 14 nt, Shigella flexneri 2a str. 2457T
gccgauguugcaug

SEQ ID NO: 3876696 - RNA, 13 nt, Shigella flexneri 2a str. 2457T
gccgauuguauac

SEQ ID NO: 3876697 - RNA, 18 nt, Shigella flexneri 2a str. 2457T
gccgcaacuaccagcagu

SEQ ID NO: 3876698 - RNA, 19 nt, Shigella flexneri 2a str. 2457T
gccgcaacuuuagccgguu

SEQ ID NO: 3876699 - RNA, 18 nt, Shigella flexneri 2a str. 2457T
gccgcaaucaucgacccc

SEQ ID NO: 3876700 - RNA, 20 nt, Shigella flexneri 2a str. 2457T
gccgcacaauacauagaaac

SEQ ID NO: 3876701 - RNA, 21 nt, Shigella flexneri 2a str. 2457T
gccgcaccaggaucuuuuguc

SEQ ID NO: 3876702 - RNA, 16 nt, Shigella flexneri 2a str. 2457T
gccgcacuuaauauac

SEQ ID NO: 3876703 - RNA, 15 nt, Shigella flexneri 2a str. 2457T
gccgcagcaguugcc

SEQ ID NO: 3876704 - RNA, 14 nt, Shigella flexneri 2a str. 2457T
gccgcagccccaga

SEQ ID NO: 3876705 - RNA, 16 nt, Shigella flexneri 2a str. 2457T
gccgcagccccagagc

SEQ ID NO: 3876706 - RNA, 23 nt, Shigella flexneri 2a str. 2457T
gccgcagcggcgauuucuuuauc

SEQ ID NO: 3876707 - RNA, 18 nt, Shigella flexneri 2a str. 2457T
gccgcaggcuguuacccc

SEQ ID NO: 3876708 - RNA, 16 nt, Shigella flexneri 2a str. 2457T
gccgcaguaaagcgca

SEQ ID NO: 3876709 - RNA, 21 nt, Shigella flexneri 2a str. 2457T
gccggaugacagacuccgccu

SEQ ID NO: 3876710 - RNA, 20 nt, Shigella flexneri 2a str. 2457T
gccggaugacagacuccgcu

SEQ ID NO: 3876711 - RNA, 21 nt, Shigella flexneri 2a str. 2457T
gccggaugcgaugcugacgca

SEQ ID NO: 3876712 - RNA, 18 nt, Shigella flexneri 2a str. 2457T
gccggaugcgccagcauc

SEQ ID NO: 3876713 - RNA, 14 nt, Shigella flexneri 2a str. 2457T
gccggaugcggcgu

SEQ ID NO: 3876714 - RNA, 22 nt, Shigella flexneri 2a str. 2457T
gccggaugcggcguaaacgccu

SEQ ID NO: 3876715 - RNA, 22 nt, Shigella flexneri 2a str. 2457T
gccggaugcuguauguuccccu

SEQ ID NO: 3876716 - RNA, 16 nt, Shigella flexneri 2a str. 2457T
gccggaugucgcugcu

SEQ ID NO: 3876717 - RNA, 19 nt, Shigella flexneri 2a str. 2457T
gccggauguguugcauccg

SEQ ID NO: 3876718 - RNA, 21 nt, Shigella flexneri 2a str. 2457T
gccggauguguugcauccggc

SEQ ID NO: 3876719 - RNA, 20 nt, Shigella flexneri 2a str. 2457T
gccggauuugagaucggaaa

SEQ ID NO: 3876720 - RNA, 15 nt, Shigella flexneri 2a str. 2457T
gccggcacaggcauc

SEQ ID NO: 3876721 - RNA, 22 nt, Shigella flexneri 2a str. 2457T
gccggccagcgccaccaccagc

SEQ ID NO: 3876722 - RNA, 23 nt, Shigella flexneri 2a str. 2457T
gccggccccgucucccgaugcca

SEQ ID NO: 3876723 - RNA, 14 nt, Shigella flexneri 2a str. 2457T
gccgggcgcaguuu

SEQ ID NO: 3876724 - RNA, 22 nt, Shigella flexneri 2a str. 2457T
gccgggcuaaccgcuuuuccag

SEQ ID NO: 3876725 - RNA, 13 nt, Shigella flexneri 2a str. 2457T
gccgggcuggaga

SEQ ID NO: 3876726 - RNA, 17 nt, Shigella flexneri 2a str. 2457T
gccgguaaaucaccagc

SEQ ID NO: 3876727 - RNA, 15 nt, Shigella flexneri 2a str. 2457T
gccgguacagccgga

SEQ ID NO: 3876728 - RNA, 13 nt, Shigella flexneri 2a str. 2457T
gccgguauccagc

SEQ ID NO: 3876729 - RNA, 12 nt, Shigella flexneri 2a str. 2457T
gccggugauuac

SEQ ID NO: 3876730 - RNA, 17 nt, Shigella flexneri 2a str. 2457T
gccggugucauggcuga

SEQ ID NO: 3876731 - RNA, 12 nt, Shigella flexneri 2a str. 2457T
gccgguucccag

SEQ ID NO: 3876732 - RNA, 17 nt, Shigella flexneri 2a str. 2457T
gccgguugucaggaagc

SEQ ID NO: 3876733 - RNA, 23 nt, Shigella flexneri 2a str. 2457T
gccgguuucacuauuaccgaugu

SEQ ID NO: 3876734 - RNA, 17 nt, Shigella flexneri 2a str. 2457T
gccgguuugcgccgugc

SEQ ID NO: 3876735 - RNA, 18 nt, Shigella flexneri 2a str. 2457T
gccgguuuuaaagcaaaa

SEQ ID NO: 3876736 - RNA, 17 nt, Shigella flexneri 2a str. 2457T
gccgguuuugcaggaaa

SEQ ID NO: 3876737 - RNA, 18 nt, Shigella flexneri 2a str. 2457T
gccguaaaucccgccauu

SEQ ID NO: 3876738 - RNA, 14 nt, Shigella flexneri 2a str. 2457T
gccguaacugugcc

SEQ ID NO: 3876739 - RNA, 22 nt, Shigella flexneri 2a str. 2457T
gccguacggcguaccgccgcga

SEQ ID NO: 3876740 - RNA, 15 nt, Shigella flexneri 2a str. 2457T
gccguagagcaccgg

SEQ ID NO: 3876741 - RNA, 18 nt, Shigella flexneri 2a str. 2457T
gccguagagcaccggcgg

SEQ ID NO: 3876742 - RNA, 18 nt, Shigella flexneri 2a str. 2457T
gccguaguuccacauaaa

SEQ ID NO: 3876743 - RNA, 18 nt, Shigella flexneri 2a str. 2457T
gccguauaauaucuuuuc

SEQ ID NO: 3876744 - RNA, 19 nt, Shigella flexneri 2a str. 2457T
gccguauggcgagcaggag

SEQ ID NO: 3876745 - RNA, 20 nt, Shigella flexneri 2a str. 2457T
gccgucagccacuucuucca

SEQ ID NO: 3876746 - RNA, 22 nt, Shigella flexneri 2a str. 2457T
gccgucagccacuucuuccagc

SEQ ID NO: 3876747 - RNA, 14 nt, Shigella flexneri 2a str. 2457T
gccguccagccgga

SEQ ID NO: 3876748 - RNA, 14 nt, Shigella flexneri 2a str. 2457T
gccguccggcgcug

SEQ ID NO: 3876749 - RNA, 19 nt, Shigella flexneri 2a str. 2457T
gccguccugcguuucuucu

SEQ ID NO: 3876750 - RNA, 20 nt, Shigella flexneri 2a str. 2457T
gccgucgagggccugaaaaa

SEQ ID NO: 3876751 - RNA, 15 nt, Shigella flexneri 2a str. 2457T
gccgucgaugcccca

SEQ ID NO: 3876752 - RNA, 18 nt, Shigella flexneri 2a str. 2457T
gccgucgaugccccagua

SEQ ID NO: 3876753 - RNA, 22 nt, Shigella flexneri 2a str. 2457T
gccgucgaugucuggcugagca

SEQ ID NO: 3876754 - RNA, 17 nt, Shigella flexneri 2a str. 2457T
gccgucugccccgccgc

SEQ ID NO: 3876755 - RNA, 15 nt, Shigella flexneri 2a str. 2457T
gccgugacgaaucag

SEQ ID NO: 3876756 - RNA, 15 nt, Shigella flexneri 2a str. 2457T
gccgugacugggugc

SEQ ID NO: 3876757 - RNA, 20 nt, Shigella flexneri 2a str. 2457T
gccgugcacuucugcgguga

SEQ ID NO: 3876758 - RNA, 14 nt, Shigella flexneri 2a str. 2457T
gccgugcagcacgg

SEQ ID NO: 3876759 - RNA, 16 nt, Shigella flexneri 2a str. 2457T
gccgugcccaacugcc

SEQ ID NO: 3876760 - RNA, 18 nt, Shigella flexneri 2a str. 2457T
gccgugcugccagcgauu

SEQ ID NO: 3876761 - RNA, 14 nt, Shigella flexneri 2a str. 2457T
gccguggcaaccuu

SEQ ID NO: 3876762 - RNA, 17 nt, Shigella flexneri 2a str. 2457T
gccgugucggugcucau

SEQ ID NO: 3876763 - RNA, 21 nt, Shigella flexneri 2a str. 2457T
gccgugucggugcucaucagc

SEQ ID NO: 3876764 - RNA, 13 nt, Shigella flexneri 2a str. 2457T
gccgugugcaaua

SEQ ID NO: 3876765 - RNA, 22 nt, Shigella flexneri 2a str. 2457T
gccguuaccguaccaaccgcaa

SEQ ID NO: 3876766 - RNA, 20 nt, Shigella flexneri 2a str. 2457T
gccguuaccuucggccccau

SEQ ID NO: 3876767 - RNA, 13 nt, Shigella flexneri 2a str. 2457T
gccguucuucccg

SEQ ID NO: 3876768 - RNA, 16 nt, Shigella flexneri 2a str. 2457T
gccguugacgguuucc

SEQ ID NO: 3876769 - RNA, 16 nt, Shigella flexneri 2a str. 2457T
gccguuuaccgccauc

SEQ ID NO: 3876770 - RNA, 16 nt, Shigella flexneri 2a str. 2457T
gccguuugcugcauga

SEQ ID NO: 3876771 - RNA, 16 nt, Shigella flexneri 2a str. 2457T
gccguuuuagaaagcg

SEQ ID NO: 3876772 - RNA, 14 nt, Shigella flexneri 2a str. 2457T
gccguuuucaaagg

SEQ ID NO: 3876773 - RNA, 11 nt, Shigella flexneri 2a str. 2457T
gccguuuucuu

SEQ ID NO: 3876774 - RNA, 17 nt, Shigella flexneri 2a str. 2457T
gccguuuuuuugacggu

SEQ ID NO: 3876775 - RNA, 15 nt, Shigella flexneri 2a str. 2457T
gccuaacaccaucag

SEQ ID NO: 3876776 - RNA, 18 nt, Shigella flexneri 2a str. 2457T
gccuaacgacaaaucaua

SEQ ID NO: 3876777 - RNA, 17 nt, Shigella flexneri 2a str. 2457T
gccuaagccauuuaacu

SEQ ID NO: 3876778 - RNA, 14 nt, Shigella flexneri 2a str. 2457T
gccuacaaaaugug

SEQ ID NO: 3876779 - RNA, 23 nt, Shigella flexneri 2a str. 2457T
gccuacaaauucaauaaauugca

SEQ ID NO: 3876780 - RNA, 21 nt, Shigella flexneri 2a str. 2457T
gccuacacauuaucucaacac

SEQ ID NO: 3876781 - RNA, 19 nt, Shigella flexneri 2a str. 2457T
gccuacaggaaacgauucg

SEQ ID NO: 3876782 - RNA, 12 nt, Shigella flexneri 2a str. 2457T
gccuacaggauu

SEQ ID NO: 3876783 - RNA, 15 nt, Shigella flexneri 2a str. 2457T
gccuacgcguccccu

SEQ ID NO: 3876784 - RNA, 16 nt, Shigella flexneri 2a str. 2457T
gccuacgugaggcauc

SEQ ID NO: 3876785 - RNA, 13 nt, Shigella flexneri 2a str. 2457T
gccuagaugcuca

SEQ ID NO: 3876786 - RNA, 16 nt, Shigella flexneri 2a str. 2457T
gccuauggugaagcuu

SEQ ID NO: 3876787 - RNA, 21 nt, Shigella flexneri 2a str. 2457T
gccuauuaugacuccagcgcc

SEQ ID NO: 3876788 - RNA, 14 nt, Shigella flexneri 2a str. 2457T
gccuauuucgucgc

SEQ ID NO: 3876789 - RNA, 16 nt, Shigella flexneri 2a str. 2457T
gccucaaccauugaaa

SEQ ID NO: 3876790 - RNA, 20 nt, Shigella flexneri 2a str. 2457T
gccucaacgucaaaagaugc

SEQ ID NO: 3876791 - RNA, 18 nt, Shigella flexneri 2a str. 2457T
gccucaagaaugacgcca

SEQ ID NO: 3876792 - RNA, 14 nt, Shigella flexneri 2a str. 2457T
gccucaagcacccg

SEQ ID NO: 3876793 - RNA, 20 nt, Shigella flexneri 2a str. 2457T
gccucaagcacccgccgcua

SEQ ID NO: 3876794 - RNA, 22 nt, Shigella flexneri 2a str. 2457T
gccucacagggcucuuaagcac

SEQ ID NO: 3876795 - RNA, 17 nt, Shigella flexneri 2a str. 2457T
gccucagguaccagcau

SEQ ID NO: 3876796 - RNA, 21 nt, Shigella flexneri 2a str. 2457T
gccucauccauacggcagaga

SEQ ID NO: 3876797 - RNA, 14 nt, Shigella flexneri 2a str. 2457T
gccucccugccucc

SEQ ID NO: 3876798 - RNA, 16 nt, Shigella flexneri 2a str. 2457T
gccucgcuacgccagc

SEQ ID NO: 3876799 - RNA, 18 nt, Shigella flexneri 2a str. 2457T
gccucgguaagcaaagcg

SEQ ID NO: 3876800 - RNA, 15 nt, Shigella flexneri 2a str. 2457T
gccucguucuucccu

SEQ ID NO: 3876801 - RNA, 13 nt, Shigella flexneri 2a str. 2457T
gccucuauuaaaa

SEQ ID NO: 3876802 - RNA, 22 nt, Shigella flexneri 2a str. 2457T
gccucuccuuuaccacucucgg

SEQ ID NO: 3876803 - RNA, 15 nt, Shigella flexneri 2a str. 2457T
gccucucuggccgcu

SEQ ID NO: 3876804 - RNA, 21 nt, Shigella flexneri 2a str. 2457T
gccucucuggccgcuuccagc

SEQ ID NO: 3876805 - RNA, 15 nt, Shigella flexneri 2a str. 2457T
gccucucuucgcugc

SEQ ID NO: 3876806 - RNA, 12 nt, Shigella flexneri 2a str. 2457T
gccuucaggaau

SEQ ID NO: 3876807 - RNA, 17 nt, Shigella flexneri 2a str. 2457T
gccuucagguuuuucag

SEQ ID NO: 3876808 - RNA, 21 nt, Shigella flexneri 2a str. 2457T
gccuucagguuuuucagcugc

SEQ ID NO: 3876809 - RNA, 19 nt, Shigella flexneri 2a str. 2457T
gccuucaugcgacgacggu

SEQ ID NO: 3876810 - RNA, 17 nt, Shigella flexneri 2a str. 2457T
gccuucauucaggccaa

SEQ ID NO: 3876811 - RNA, 22 nt, Shigella flexneri 2a str. 2457T
gccuuccaccagauggcuuucc

SEQ ID NO: 3876812 - RNA, 15 nt, Shigella flexneri 2a str. 2457T
gccuuccagcgaugc

SEQ ID NO: 3876813 - RNA, 18 nt, Shigella flexneri 2a str. 2457T
gccuuccgcaaacaggcg

SEQ ID NO: 3876814 - RNA, 21 nt, Shigella flexneri 2a str. 2457T
gccuuccgcaaacaggcgcag

SEQ ID NO: 3876815 - RNA, 16 nt, Shigella flexneri 2a str. 2457T
gccuuccgucagcaaa

SEQ ID NO: 3876816 - RNA, 17 nt, Shigella flexneri 2a str. 2457T
gccuuccgucagcaaag

SEQ ID NO: 3876817 - RNA, 18 nt, Shigella flexneri 2a str. 2457T
gccuucggcgucuccacc

SEQ ID NO: 3876818 - RNA, 19 nt, Shigella flexneri 2a str. 2457T
gccuucggcgucuccaccu

SEQ ID NO: 3876819 - RNA, 19 nt, Shigella flexneri 2a str. 2457T
gccuucgugcggcugcauc

SEQ ID NO: 3876820 - RNA, 20 nt, Shigella flexneri 2a str. 2457T
gccuucuccggcuuacaaca

SEQ ID NO: 3876821 - RNA, 21 nt, Shigella flexneri 2a str. 2457T
gccuucugcgccgccucugcg

SEQ ID NO: 3876822 - RNA, 14 nt, Shigella flexneri 2a str. 2457T
gccuucuucaucca

SEQ ID NO: 3876823 - RNA, 16 nt, Shigella flexneri 2a str. 2457T
gccuucuucauccagc

SEQ ID NO: 3876824 - RNA, 21 nt, Shigella flexneri 2a str. 2457T
gccuucuucgcccacuuucug

SEQ ID NO: 3876825 - RNA, 22 nt, Shigella flexneri 2a str. 2457T
gccuucuucgcccacuuucugc

SEQ ID NO: 3876826 - RNA, 16 nt, Shigella flexneri 2a str. 2457T
gccuugcgcgcagugc

SEQ ID NO: 3876827 - RNA, 22 nt, Shigella flexneri 2a str. 2457T
gccuugcggaaauuccagcggc

SEQ ID NO: 3876828 - RNA, 21 nt, Shigella flexneri 2a str. 2457T
gccuuguuccugcuuggcgcg

SEQ ID NO: 3876829 - RNA, 14 nt, Shigella flexneri 2a str. 2457T
gccuuguuucuuca

SEQ ID NO: 3876830 - RNA, 14 nt, Shigella flexneri 2a str. 2457T
gccuuguuugauca

SEQ ID NO: 3876831 - RNA, 16 nt, Shigella flexneri 2a str. 2457T
gccuuuaccgccacag

SEQ ID NO: 3876832 - RNA, 17 nt, Shigella flexneri 2a str. 2457T
gccuuuaccgccacagc

SEQ ID NO: 3876833 - RNA, 17 nt, Shigella flexneri 2a str. 2457T
gccuuuauuaaugacau

SEQ ID NO: 3876834 - RNA, 23 nt, Shigella flexneri 2a str. 2457T
gccuuuccuccugucuucccugc

SEQ ID NO: 3876835 - RNA, 14 nt, Shigella flexneri 2a str. 2457T
gccuuucucagaga

SEQ ID NO: 3876836 - RNA, 22 nt, Shigella flexneri 2a str. 2457T
gccuuucuuaauauuuuccgug

SEQ ID NO: 3876837 - RNA, 21 nt, Shigella flexneri 2a str. 2457T
gccuuugaaaucgaacagguu

SEQ ID NO: 3876838 - RNA, 21 nt, Shigella flexneri 2a str. 2457T
gccuuuuaaugcgcuuccugc

SEQ ID NO: 3876839 - RNA, 21 nt, Shigella flexneri 2a str. 2457T
gccuuuuucagccgcaaacuc

SEQ ID NO: 3876840 - RNA, 16 nt, Shigella flexneri 2a str. 2457T
gccuuuuuucgccgca

SEQ ID NO: 3876841 - RNA, 22 nt, Shigella flexneri 2a str. 2457T
gccuuuuuuguacuccagcaga

SEQ ID NO: 3876842 - RNA, 23 nt, Shigella flexneri 2a str. 2457T
gcgaaaauugguagaccagagcu

SEQ ID NO: 3876843 - RNA, 17 nt, Shigella flexneri 2a str. 2457T
gcgaaacagggcuggaa

SEQ ID NO: 3876844 - RNA, 17 nt, Shigella flexneri 2a str. 2457T
gcgaaacgguguaaaaa

SEQ ID NO: 3876845 - RNA, 16 nt, Shigella flexneri 2a str. 2457T
gcgaaagcuggcacug

SEQ ID NO: 3876846 - RNA, 19 nt, Shigella flexneri 2a str. 2457T
gcgaaauugguagacgcac

SEQ ID NO: 3876847 - RNA, 20 nt, Shigella flexneri 2a str. 2457T
gcgaacagcacaucagccag

SEQ ID NO: 3876848 - RNA, 22 nt, Shigella flexneri 2a str. 2457T
gcgaacaucgagugcggcgagc

SEQ ID NO: 3876849 - RNA, 14 nt, Shigella flexneri 2a str. 2457T
gcgaaccaggaaga

SEQ ID NO: 3876850 - RNA, 15 nt, Shigella flexneri 2a str. 2457T
gcgaacgggauaaac

SEQ ID NO: 3876851 - RNA, 13 nt, Shigella flexneri 2a str. 2457T
gcgaacuaaacaa

SEQ ID NO: 3876852 - RNA, 14 nt, Shigella flexneri 2a str. 2457T
gcgaacuaaacaac

SEQ ID NO: 3876853 - RNA, 13 nt, Shigella flexneri 2a str. 2457T
gcgaacucuuccg

SEQ ID NO: 3876854 - RNA, 15 nt, Shigella flexneri 2a str. 2457T
gcgaagacuguagca

SEQ ID NO: 3876855 - RNA, 17 nt, Shigella flexneri 2a str. 2457T
gcgaagacuguagcagg

SEQ ID NO: 3876856 - RNA, 15 nt, Shigella flexneri 2a str. 2457T
gcgaagagaaagaac

SEQ ID NO: 3876857 - RNA, 17 nt, Shigella flexneri 2a str. 2457T
gcgaagcccacgccgcc

SEQ ID NO: 3876858 - RNA, 22 nt, Shigella flexneri 2a str. 2457T
gcgaagcgcauaccuucuugua

SEQ ID NO: 3876859 - RNA, 15 nt, Shigella flexneri 2a str. 2457T
gcgaaggccagaacc

SEQ ID NO: 3876860 - RNA, 14 nt, Shigella flexneri 2a str. 2457T
gcgaauaaaaaaag

SEQ ID NO: 3876861 - RNA, 22 nt, Shigella flexneri 2a str. 2457T
gcgaauaaaguagaaauuauuu

SEQ ID NO: 3876862 - RNA, 15 nt, Shigella flexneri 2a str. 2457T
gcgaauacuccccuu

SEQ ID NO: 3876863 - RNA, 14 nt, Shigella flexneri 2a str. 2457T
gcgaauagcgucua

SEQ ID NO: 3876864 - RNA, 22 nt, Shigella flexneri 2a str. 2457T
gcgaauaguuuccgcuucugcu

SEQ ID NO: 3876865 - RNA, 15 nt, Shigella flexneri 2a str. 2457T
gcgaauauggcggcg

SEQ ID NO: 3876866 - RNA, 13 nt, Shigella flexneri 2a str. 2457T
gcgaaucaaccgc

SEQ ID NO: 3876867 - RNA, 17 nt, Shigella flexneri 2a str. 2457T
gcgaaucacguugccgu

SEQ ID NO: 3876868 - RNA, 15 nt, Shigella flexneri 2a str. 2457T
gcgaauccagcaugc

SEQ ID NO: 3876869 - RNA, 20 nt, Shigella flexneri 2a str. 2457T
gcgaaucgcuucauuuacau

SEQ ID NO: 3876870 - RNA, 18 nt, Shigella flexneri 2a str. 2457T
gcgaaugacaugcccggu

SEQ ID NO: 3876871 - RNA, 22 nt, Shigella flexneri 2a str. 2457T
gcgaauucuugccuuuccuccu

SEQ ID NO: 3876872 - RNA, 21 nt, Shigella flexneri 2a str. 2457T
gcgacaaacaggaaguuucag

SEQ ID NO: 3876873 - RNA, 15 nt, Shigella flexneri 2a str. 2457T
gcgacaaucccugca

SEQ ID NO: 3876874 - RNA, 12 nt, Shigella flexneri 2a str. 2457T
gcgacaccagcc

SEQ ID NO: 3876875 - RNA, 22 nt, Shigella flexneri 2a str. 2457T
gcgacaccucccagcgcgguga

SEQ ID NO: 3876876 - RNA, 21 nt, Shigella flexneri 2a str. 2457T
gcgacacuguucgcgucuuau

SEQ ID NO: 3876877 - RNA, 20 nt, Shigella flexneri 2a str. 2457T
gcgacagagauauucagccc

SEQ ID NO: 3876878 - RNA, 16 nt, Shigella flexneri 2a str. 2457T
gcgacagauucgcggg

SEQ ID NO: 3876879 - RNA, 14 nt, Shigella flexneri 2a str. 2457T
gcgacaggagccgc

SEQ ID NO: 3876880 - RNA, 20 nt, Shigella flexneri 2a str. 2457T
gcgacagggaucucuuccag

SEQ ID NO: 3876881 - RNA, 16 nt, Shigella flexneri 2a str. 2457T
gcgacaguaucaucau

SEQ ID NO: 3876882 - RNA, 13 nt, Shigella flexneri 2a str. 2457T
gcgacauaucauu

SEQ ID NO: 3876883 - RNA, 20 nt, Shigella flexneri 2a str. 2457T
gcgacauaucauuuugcugc

SEQ ID NO: 3876884 - RNA, 16 nt, Shigella flexneri 2a str. 2457T
gcgacauauuccccuu

SEQ ID NO: 3876885 - RNA, 20 nt, Shigella flexneri 2a str. 2457T
gcgacaucaucagcgguggc

SEQ ID NO: 3876886 - RNA, 16 nt, Shigella flexneri 2a str. 2457T
gcgacaucuucuccag

SEQ ID NO: 3876887 - RNA, 15 nt, Shigella flexneri 2a str. 2457T
gcgaccaaacugcuc

SEQ ID NO: 3876888 - RNA, 15 nt, Shigella flexneri 2a str. 2457T
gcgaccacacucaau

SEQ ID NO: 3876889 - RNA, 20 nt, Shigella flexneri 2a str. 2457T
gcgaccagcgucgcaucagg

SEQ ID NO: 3876890 - RNA, 13 nt, Shigella flexneri 2a str. 2457T
gcgaccgccgcca

SEQ ID NO: 3876891 - RNA, 18 nt, Shigella flexneri 2a str. 2457T
gcgaccggaauguuccau

SEQ ID NO: 3876892 - RNA, 22 nt, Shigella flexneri 2a str. 2457T
gcgaccggcgucgcauccggca

SEQ ID NO: 3876893 - RNA, 15 nt, Shigella flexneri 2a str. 2457T
gcgaccguucgccag

SEQ ID NO: 3876894 - RNA, 23 nt, Shigella flexneri 2a str. 2457T
gcgaccuacacgccuucuccggc

SEQ ID NO: 3876895 - RNA, 16 nt, Shigella flexneri 2a str. 2457T
gcgaccuguucuccug

SEQ ID NO: 3876896 - RNA, 21 nt, Shigella flexneri 2a str. 2457T
gcgacgccggucgcgucuuau

SEQ ID NO: 3876897 - RNA, 23 nt, Shigella flexneri 2a str. 2457T
gcgacgcguaugucgaucaccca

SEQ ID NO: 3876898 - RNA, 20 nt, Shigella flexneri 2a str. 2457T
gcgacgcucacgcgucuuau

SEQ ID NO: 3876899 - RNA, 20 nt, Shigella flexneri 2a str. 2457T
gcgacgcugacgcgucuuau

SEQ ID NO: 3876900 - RNA, 21 nt, Shigella flexneri 2a str. 2457T
gcgacgcugauagcgucuuau

SEQ ID NO: 3876901 - RNA, 19 nt, Shigella flexneri 2a str. 2457T
gcgacgcugcgcgucuuau

SEQ ID NO: 3876902 - RNA, 21 nt, Shigella flexneri 2a str. 2457T
gcgacgcuggccgcgucuuau

SEQ ID NO: 3876903 - RNA, 14 nt, Shigella flexneri 2a str. 2457T
gcgcaccagcguca

SEQ ID NO: 3876904 - RNA, 21 nt, Shigella flexneri 2a str. 2457T
gcgcacgucaccgcagcaucg

SEQ ID NO: 3876905 - RNA, 15 nt, Shigella flexneri 2a str. 2457T
gcgcagcagcgcgcc

SEQ ID NO: 3876906 - RNA, 15 nt, Shigella flexneri 2a str. 2457T
gcgcagcgaguaaaa

SEQ ID NO: 3876907 - RNA, 22 nt, Shigella flexneri 2a str. 2457T
gcgcagcguucauaaauacaga

SEQ ID NO: 3876908 - RNA, 17 nt, Shigella flexneri 2a str. 2457T
gcgcagcugagaaaaag

SEQ ID NO: 3876909 - RNA, 15 nt, Shigella flexneri 2a str. 2457T
gcgcaggauaaccuu

SEQ ID NO: 3876910 - RNA, 21 nt, Shigella flexneri 2a str. 2457T
gcgcagggcaugacacagaau

SEQ ID NO: 3876911 - RNA, 21 nt, Shigella flexneri 2a str. 2457T
gcgcaggguuugcaucgccau

SEQ ID NO: 3876912 - RNA, 17 nt, Shigella flexneri 2a str. 2457T
gcgcaguaaauccgcca

SEQ ID NO: 3876913 - RNA, 13 nt, Shigella flexneri 2a str. 2457T
gcgcagucaccag

SEQ ID NO: 3876914 - RNA, 21 nt, Shigella flexneri 2a str. 2457T
gcgcagugccgguggaagggc

SEQ ID NO: 3876915 - RNA, 19 nt, Shigella flexneri 2a str. 2457T
gcgcaguucgcacaccgcu

SEQ ID NO: 3876916 - RNA, 18 nt, Shigella flexneri 2a str. 2457T
gcgcauaacucaccauca

SEQ ID NO: 3876917 - RNA, 14 nt, Shigella flexneri 2a str. 2457T
gcgcauaacugccg

SEQ ID NO: 3876918 - RNA, 18 nt, Shigella flexneri 2a str. 2457T
gcgcaucaaagccaggca

SEQ ID NO: 3876919 - RNA, 19 nt, Shigella flexneri 2a str. 2457T
gcgcaucaaagccaggcag

SEQ ID NO: 3876920 - RNA, 14 nt, Shigella flexneri 2a str. 2457T
gcgcaucagcuccg

SEQ ID NO: 3876921 - RNA, 15 nt, Shigella flexneri 2a str. 2457T
gcgcaucagcuccgg

SEQ ID NO: 3876922 - RNA, 16 nt, Shigella flexneri 2a str. 2457T
gcgcaucagcuccggu

SEQ ID NO: 3876923 - RNA, 19 nt, Shigella flexneri 2a str. 2457T
gcgcaucaugccacccagg

SEQ ID NO: 3876924 - RNA, 14 nt, Shigella flexneri 2a str. 2457T
gcgcauccagcgcu

SEQ ID NO: 3876925 - RNA, 19 nt, Shigella flexneri 2a str. 2457T
gcgcauccaguuccuucaa

SEQ ID NO: 3876926 - RNA, 17 nt, Shigella flexneri 2a str. 2457T
gcgcaucccauuucucc

SEQ ID NO: 3876927 - RNA, 12 nt, Shigella flexneri 2a str. 2457T
gcgcauccggca

SEQ ID NO: 3876928 - RNA, 22 nt, Shigella flexneri 2a str. 2457T
gcgcauccggcaccagcgcaca

SEQ ID NO: 3876929 - RNA, 18 nt, Shigella flexneri 2a str. 2457T
gcgcaucggucagaccca

SEQ ID NO: 3876930 - RNA, 19 nt, Shigella flexneri 2a str. 2457T
gcgcaucggucagacccag

SEQ ID NO: 3876931 - RNA, 18 nt, Shigella flexneri 2a str. 2457T
gcgcaucggucgaugaaa

SEQ ID NO: 3876932 - RNA, 17 nt, Shigella flexneri 2a str. 2457T
gcgcaucuuauccggcc

SEQ ID NO: 3876933 - RNA, 18 nt, Shigella flexneri 2a str. 2457T
gcgcaucuuauccggccu

SEQ ID NO: 3876934 - RNA, 21 nt, Shigella flexneri 2a str. 2457T
gcgcauggcguccgucaucga

SEQ ID NO: 3876935 - RNA, 16 nt, Shigella flexneri 2a str. 2457T
gcgcauguuggcgcgg

SEQ ID NO: 3876936 - RNA, 17 nt, Shigella flexneri 2a str. 2457T
gcgcauguuggcgcggu

SEQ ID NO: 3876937 - RNA, 18 nt, Shigella flexneri 2a str. 2457T
gcgcauucuggagcugga

SEQ ID NO: 3876938 - RNA, 17 nt, Shigella flexneri 2a str. 2457T
gcgcauuucccagcaag

SEQ ID NO: 3876939 - RNA, 15 nt, Shigella flexneri 2a str. 2457T
gcgccaaaugucagc

SEQ ID NO: 3876940 - RNA, 17 nt, Shigella flexneri 2a str. 2457T
gcgccaagauagaacca

SEQ ID NO: 3876941 - RNA, 16 nt, Shigella flexneri 2a str. 2457T
gcgccaagcagcgcgc

SEQ ID NO: 3876942 - RNA, 19 nt, Shigella flexneri 2a str. 2457T
gcgccaagcagcgcgcaga

SEQ ID NO: 3876943 - RNA, 17 nt, Shigella flexneri 2a str. 2457T
gcgccaaucagcgcagc

SEQ ID NO: 3876944 - RNA, 14 nt, Shigella flexneri 2a str. 2457T
gcgccaaucggcaa

SEQ ID NO: 3876945 - RNA, 20 nt, Shigella flexneri 2a str. 2457T
gcgccaaucggcaauucagu

SEQ ID NO: 3876946 - RNA, 24 nt, Shigella flexneri 2a str. 2457T
gcgccacauaagaucaucggccag

SEQ ID NO: 3876947 - RNA, 15 nt, Shigella flexneri 2a str. 2457T
gcgccacaucagacu

SEQ ID NO: 3876948 - RNA, 15 nt, Shigella flexneri 2a str. 2457T
gcgccacauccggca

SEQ ID NO: 3876949 - RNA, 11 nt, Shigella flexneri 2a str. 2457T
gcgccaccagc

SEQ ID NO: 3876950 - RNA, 17 nt, Shigella flexneri 2a str. 2457T
gcgccacgguguuguug

SEQ ID NO: 3876951 - RNA, 24 nt, Shigella flexneri 2a str. 2457T
gcgccacguaauuauaugccagcc

SEQ ID NO: 3876952 - RNA, 15 nt, Shigella flexneri 2a str. 2457T
gcgccagaagggaca

SEQ ID NO: 3876953 - RNA, 16 nt, Shigella flexneri 2a str. 2457T
gcgccagacaaaccac

SEQ ID NO: 3876954 - RNA, 24 nt, Shigella flexneri 2a str. 2457T
gcgccagacccagacgcucagggu

SEQ ID NO: 3876955 - RNA, 22 nt, Shigella flexneri 2a str. 2457T
gcgccagcaucgcauccggcaa

SEQ ID NO: 3876956 - RNA, 17 nt, Shigella flexneri 2a str. 2457T
gcgccagccaccacaau

SEQ ID NO: 3876957 - RNA, 14 nt, Shigella flexneri 2a str. 2457T
gcgccagccagcca

SEQ ID NO: 3876958 - RNA, 13 nt, Shigella flexneri 2a str. 2457T
gcgccagcggcag

SEQ ID NO: 3876959 - RNA, 17 nt, Shigella flexneri 2a str. 2457T
gcgccagcggccagcgc

SEQ ID NO: 3876960 - RNA, 18 nt, Shigella flexneri 2a str. 2457T
gcgccagcggccagcgca

SEQ ID NO: 3876961 - RNA, 21 nt, Shigella flexneri 2a str. 2457T
gcgccagcgggcuccacggaa

SEQ ID NO: 3876962 - RNA, 18 nt, Shigella flexneri 2a str. 2457T
gcgccagcgucaucauag

SEQ ID NO: 3876963 - RNA, 13 nt, Shigella flexneri 2a str. 2457T
gcgccaggcgcug

SEQ ID NO: 3876964 - RNA, 18 nt, Shigella flexneri 2a str. 2457T
gcgccauaccaugcacca

SEQ ID NO: 3876965 - RNA, 18 nt, Shigella flexneri 2a str. 2457T
gcgccaucaaugccgcaa

SEQ ID NO: 3876966 - RNA, 22 nt, Shigella flexneri 2a str. 2457T
gcgccaugcguuuuaccgccuc

SEQ ID NO: 3876967 - RNA, 20 nt, Shigella flexneri 2a str. 2457T
gcgccauugauguaauuauc

SEQ ID NO: 3876968 - RNA, 13 nt, Shigella flexneri 2a str. 2457T
gcgccauuuucau

SEQ ID NO: 3876969 - RNA, 14 nt, Shigella flexneri 2a str. 2457T
gcgccauuuuucac

SEQ ID NO: 3876970 - RNA, 17 nt, Shigella flexneri 2a str. 2457T
gcgcccaacacuucccc

SEQ ID NO: 3876971 - RNA, 14 nt, Shigella flexneri 2a str. 2457T
gcgcccaacaguag

SEQ ID NO: 3876972 - RNA, 13 nt, Shigella flexneri 2a str. 2457T
gcgcccaucggcg

SEQ ID NO: 3876973 - RNA, 16 nt, Shigella flexneri 2a str. 2457T
gcgccccacaccacca

SEQ ID NO: 3876974 - RNA, 23 nt, Shigella flexneri 2a str. 2457T
gcgccccuggucauaggccgcug

SEQ ID NO: 3876975 - RNA, 13 nt, Shigella flexneri 2a str. 2457T
gcgcccgccagca

SEQ ID NO: 3876976 - RNA, 16 nt, Shigella flexneri 2a str. 2457T
gcgcccgccagcaccg

SEQ ID NO: 3876977 - RNA, 15 nt, Shigella flexneri 2a str. 2457T
gcgcccgccagcauc

SEQ ID NO: 3876978 - RNA, 21 nt, Shigella flexneri 2a str. 2457T
gcgcccgucugggcgcggcuc

SEQ ID NO: 3876979 - RNA, 12 nt, Shigella flexneri 2a str. 2457T
gcgcccuuucgc

SEQ ID NO: 3876980 - RNA, 14 nt, Shigella flexneri 2a str. 2457T
gcgccgacagcagc

SEQ ID NO: 3876981 - RNA, 15 nt, Shigella flexneri 2a str. 2457T
gcgccgacagcagcc

SEQ ID NO: 3876982 - RNA, 20 nt, Shigella flexneri 2a str. 2457T
gcgccgcaacuaccagcagu

SEQ ID NO: 3876983 - RNA, 14 nt, Shigella flexneri 2a str. 2457T
gcgccgcauccgac

SEQ ID NO: 3876984 - RNA, 13 nt, Shigella flexneri 2a str. 2457T
gcgccgccaaccc

SEQ ID NO: 3876985 - RNA, 16 nt, Shigella flexneri 2a str. 2457T
gcgccgccucagccag

SEQ ID NO: 3876986 - RNA, 21 nt, Shigella flexneri 2a str. 2457T
gcgccgccucccuucgcugcu

SEQ ID NO: 3876987 - RNA, 17 nt, Shigella flexneri 2a str. 2457T
gcgccgcucaguacgag

SEQ ID NO: 3876988 - RNA, 18 nt, Shigella flexneri 2a str. 2457T
gcgccggucacaucuucc

SEQ ID NO: 3876989 - RNA, 17 nt, Shigella flexneri 2a str. 2457T
gcgccguuuuuuuucug

SEQ ID NO: 3876990 - RNA, 22 nt, Shigella flexneri 2a str. 2457T
gcgccucaacgccuaaugccag

SEQ ID NO: 3876991 - RNA, 22 nt, Shigella flexneri 2a str. 2457T
gcgccugaccauuaucaaacag

SEQ ID NO: 3876992 - RNA, 18 nt, Shigella flexneri 2a str. 2457T
gcgccugcaggaucagca

SEQ ID NO: 3876993 - RNA, 18 nt, Shigella flexneri 2a str. 2457T
gcgccugcggccagcagc

SEQ ID NO: 3876994 - RNA, 22 nt, Shigella flexneri 2a str. 2457T
gcgccugcggccagcagcugua

SEQ ID NO: 3876995 - RNA, 14 nt, Shigella flexneri 2a str. 2457T
gcgccuucauucag

SEQ ID NO: 3876996 - RNA, 19 nt, Shigella flexneri 2a str. 2457T
gcgccuucauucaggccaa

SEQ ID NO: 3876997 - RNA, 21 nt, Shigella flexneri 2a str. 2457T
gcgccuucuacagcuucacgc

SEQ ID NO: 3876998 - RNA, 15 nt, Shigella flexneri 2a str. 2457T
gcgccuuguuaccug

SEQ ID NO: 3876999 - RNA, 22 nt, Shigella flexneri 2a str. 2457T
gcgccuuuaauauuaacgccag

SEQ ID NO: 3877000 - RNA, 16 nt, Shigella flexneri 2a str. 2457T
gcggaaaucuccagau

SEQ ID NO: 3877001 - RNA, 21 nt, Shigella flexneri 2a str. 2457T
gcggaacgcacuauacaacca

SEQ ID NO: 3877002 - RNA, 15 nt, Shigella flexneri 2a str. 2457T
gcggaacugaagcug

SEQ ID NO: 3877003 - RNA, 12 nt, Shigella flexneri 2a str. 2457T
gcggaauaacgc

SEQ ID NO: 3877004 - RNA, 18 nt, Shigella flexneri 2a str. 2457T
gcggaauaacgcgaucgc

SEQ ID NO: 3877005 - RNA, 13 nt, Shigella flexneri 2a str. 2457T
gcggacaaccagc

SEQ ID NO: 3877006 - RNA, 15 nt, Shigella flexneri 2a str. 2457T
gcggacaaccagcuu

SEQ ID NO: 3877007 - RNA, 19 nt, Shigella flexneri 2a str. 2457T
gcggacaaugccuaccgca

SEQ ID NO: 3877008 - RNA, 21 nt, Shigella flexneri 2a str. 2457T
gcggacgcacauagcgugaca

SEQ ID NO: 3877009 - RNA, 13 nt, Shigella flexneri 2a str. 2457T
gcggacugaauac

SEQ ID NO: 3877010 - RNA, 16 nt, Shigella flexneri 2a str. 2457T
gcggagaguaaacggu

SEQ ID NO: 3877011 - RNA, 20 nt, Shigella flexneri 2a str. 2457T
gcggagcucccaggcuccgc

SEQ ID NO: 3877012 - RNA, 15 nt, Shigella flexneri 2a str. 2457T
gcggaggggcggcuc

SEQ ID NO: 3877013 - RNA, 15 nt, Shigella flexneri 2a str. 2457T
gcggaguaaucgcca

SEQ ID NO: 3877014 - RNA, 18 nt, Shigella flexneri 2a str. 2457T
gcggauaaacuuggcuau

SEQ ID NO: 3877015 - RNA, 13 nt, Shigella flexneri 2a str. 2457T
gcggauaaagcag

SEQ ID NO: 3877016 - RNA, 19 nt, Shigella flexneri 2a str. 2457T
gcggauaaagcagagcagg

SEQ ID NO: 3877017 - RNA, 19 nt, Shigella flexneri 2a str. 2457T
gcggauacaggaagcgaau

SEQ ID NO: 3877018 - RNA, 21 nt, Shigella flexneri 2a str. 2457T
gcggauaggaaucagcaguuc

SEQ ID NO: 3877019 - RNA, 22 nt, Shigella flexneri 2a str. 2457T
gcggauaucuacaaaaccacac

SEQ ID NO: 3877020 - RNA, 19 nt, Shigella flexneri 2a str. 2457T
gcggaucaguuccagcagc

SEQ ID NO: 3877021 - RNA, 21 nt, Shigella flexneri 2a str. 2457T
gcggauguuggguuagccaac

SEQ ID NO: 3877022 - RNA, 18 nt, Shigella flexneri 2a str. 2457T
gcggauucgaugcccagc

SEQ ID NO: 3877023 - RNA, 20 nt, Shigella flexneri 2a str. 2457T
gcggcaaaaucgccggugau

SEQ ID NO: 3877024 - RNA, 13 nt, Shigella flexneri 2a str. 2457T
gcggcaaauauua

SEQ ID NO: 3877025 - RNA, 21 nt, Shigella flexneri 2a str. 2457T
gcggcaacguauauaacggaa

SEQ ID NO: 3877026 - RNA, 13 nt, Shigella flexneri 2a str. 2457T
gcggcaagaucgc

SEQ ID NO: 3877027 - RNA, 15 nt, Shigella flexneri 2a str. 2457T
gcggcaagcccagcc

SEQ ID NO: 3877028 - RNA, 13 nt, Shigella flexneri 2a str. 2457T
gcggcaaucgcca

SEQ ID NO: 3877029 - RNA, 14 nt, Shigella flexneri 2a str. 2457T
gcggcaaucgccag

SEQ ID NO: 3877030 - RNA, 15 nt, Shigella flexneri 2a str. 2457T
gcggcaaucgcugcu

SEQ ID NO: 3877031 - RNA, 21 nt, Shigella flexneri 2a str. 2457T
gcggcacacagcacggcagca

SEQ ID NO: 3877032 - RNA, 20 nt, Shigella flexneri 2a str. 2457T
gcggcacccauuuauccagc

SEQ ID NO: 3877033 - RNA, 24 nt, Shigella flexneri 2a str. 2457T
gcggcacugcucuuuaacaauuua

SEQ ID NO: 3877034 - RNA, 20 nt, Shigella flexneri 2a str. 2457T
gcggcacuguuucgccaggu

SEQ ID NO: 3877035 - RNA, 20 nt, Shigella flexneri 2a str. 2457T
gcggcagcaggaucuccagc

SEQ ID NO: 3877036 - RNA, 12 nt, Shigella flexneri 2a str. 2457T
gcggcagcaggu

SEQ ID NO: 3877037 - RNA, 15 nt, Shigella flexneri 2a str. 2457T
gcggcagccaccgcc

SEQ ID NO: 3877038 - RNA, 14 nt, Shigella flexneri 2a str. 2457T
gcggcagcuccagc

SEQ ID NO: 3877039 - RNA, 17 nt, Shigella flexneri 2a str. 2457T
gcggcaggacgcgcgcu

SEQ ID NO: 3877040 - RNA, 15 nt, Shigella flexneri 2a str. 2457T
gcggcaggccgugga

SEQ ID NO: 3877041 - RNA, 17 nt, Shigella flexneri 2a str. 2457T
gcggcaggguuugcgcc

SEQ ID NO: 3877042 - RNA, 19 nt, Shigella flexneri 2a str. 2457T
gcggcagguugaugaugac

SEQ ID NO: 3877043 - RNA, 19 nt, Shigella flexneri 2a str. 2457T
gcggcaguauagcggcaug

SEQ ID NO: 3877044 - RNA, 18 nt, Shigella flexneri 2a str. 2457T
gcggcaguggcuaagcag

SEQ ID NO: 3877045 - RNA, 17 nt, Shigella flexneri 2a str. 2457T
gcggcauaucagcgagu

SEQ ID NO: 3877046 - RNA, 21 nt, Shigella flexneri 2a str. 2457T
gcggcauccagguuucuucca

SEQ ID NO: 3877047 - RNA, 18 nt, Shigella flexneri 2a str. 2457T
gcggcauuucgccgagca

SEQ ID NO: 3877048 - RNA, 22 nt, Shigella flexneri 2a str. 2457T
gcggccagccauccgucaucca

SEQ ID NO: 3877049 - RNA, 16 nt, Shigella flexneri 2a str. 2457T
gcggcccaggcggcgu

SEQ ID NO: 3877050 - RNA, 21 nt, Shigella flexneri 2a str. 2457T
gcggcccagugagucggggcc

SEQ ID NO: 3877051 - RNA, 19 nt, Shigella flexneri 2a str. 2457T
gcggccggaugcgccgcca

SEQ ID NO: 3877052 - RNA, 18 nt, Shigella flexneri 2a str. 2457T
gcggcgaacuuaaucauc

SEQ ID NO: 3877053 - RNA, 19 nt, Shigella flexneri 2a str. 2457T
gcggcgaagauacccgcga

SEQ ID NO: 3877054 - RNA, 20 nt, Shigella flexneri 2a str. 2457T
gcggcgacaaauguugcauc

SEQ ID NO: 3877055 - RNA, 14 nt, Shigella flexneri 2a str. 2457T
gcggcgagcaucgc

SEQ ID NO: 3877056 - RNA, 21 nt, Shigella flexneri 2a str. 2457T
gcggcgauaauauugaugcac

SEQ ID NO: 3877057 - RNA, 18 nt, Shigella flexneri 2a str. 2457T
gcggcgauauccagcgcg

SEQ ID NO: 3877058 - RNA, 20 nt, Shigella flexneri 2a str. 2457T
gcggcgauauccagcgcggc

SEQ ID NO: 3877059 - RNA, 14 nt, Shigella flexneri 2a str. 2457T
gcggcgauuaagaa

SEQ ID NO: 3877060 - RNA, 17 nt, Shigella flexneri 2a str. 2457T
gcggcggaaaaagcgga

SEQ ID NO: 3877061 - RNA, 11 nt, Shigella flexneri 2a str. 2457T
gcggcggcaga

SEQ ID NO: 3877062 - RNA, 19 nt, Shigella flexneri 2a str. 2457T
gcggcggguuaaccagcac

SEQ ID NO: 3877063 - RNA, 18 nt, Shigella flexneri 2a str. 2457T
gcggcguaaacgccuuau

SEQ ID NO: 3877064 - RNA, 17 nt, Shigella flexneri 2a str. 2457T
gcggcguaucuuccagg

SEQ ID NO: 3877065 - RNA, 23 nt, Shigella flexneri 2a str. 2457T
gcggcgucauaauccggcaacaa

SEQ ID NO: 3877066 - RNA, 23 nt, Shigella flexneri 2a str. 2457T
gcggcgugaacgccuaauccagc

SEQ ID NO: 3877067 - RNA, 17 nt, Shigella flexneri 2a str. 2457T
gcggcgugaacgccuua

SEQ ID NO: 3877068 - RNA, 16 nt, Shigella flexneri 2a str. 2457T
gcggcguuccaccgcu

SEQ ID NO: 3877069 - RNA, 16 nt, Shigella flexneri 2a str. 2457T
gcggcguugagaaaac

SEQ ID NO: 3877070 - RNA, 22 nt, Shigella flexneri 2a str. 2457T
gcggcuauauucaaacacccga

SEQ ID NO: 3877071 - RNA, 14 nt, Shigella flexneri 2a str. 2457T
gcggcuaucccaaa

SEQ ID NO: 3877072 - RNA, 22 nt, Shigella flexneri 2a str. 2457T
gcggcucauugccauucgccag

SEQ ID NO: 3877073 - RNA, 12 nt, Shigella flexneri 2a str. 2457T
gcggcucuccug

SEQ ID NO: 3877074 - RNA, 19 nt, Shigella flexneri 2a str. 2457T
gcggcucucuuucuccagc

SEQ ID NO: 3877075 - RNA, 12 nt, Shigella flexneri 2a str. 2457T
gcggcugccagc

SEQ ID NO: 3877076 - RNA, 20 nt, Shigella flexneri 2a str. 2457T
gcggcugcugauguucgcca

SEQ ID NO: 3877077 - RNA, 21 nt, Shigella flexneri 2a str. 2457T
gcggcugcugauguucgccag

SEQ ID NO: 3877078 - RNA, 12 nt, Shigella flexneri 2a str. 2457T
gcggcuggcgca

SEQ ID NO: 3877079 - RNA, 15 nt, Shigella flexneri 2a str. 2457T
gcggcuggcugaccu

SEQ ID NO: 3877080 - RNA, 19 nt, Shigella flexneri 2a str. 2457T
gcggcuguuggugccagau

SEQ ID NO: 3877081 - RNA, 22 nt, Shigella flexneri 2a str. 2457T
gcggcuuagcugaucgacaaaa

SEQ ID NO: 3877082 - RNA, 18 nt, Shigella flexneri 2a str. 2457T
gcggcuuauucauuacuc

SEQ ID NO: 3877083 - RNA, 23 nt, Shigella flexneri 2a str. 2457T
gcggcuucgguuuuguugccgcc

SEQ ID NO: 3877084 - RNA, 20 nt, Shigella flexneri 2a str. 2457T
gcggcuuguacgccgccgca

SEQ ID NO: 3877085 - RNA, 14 nt, Shigella flexneri 2a str. 2457T
gcggcuuuuuacgc

SEQ ID NO: 3877086 - RNA, 15 nt, Shigella flexneri 2a str. 2457T
gcgggaacagcgacc

SEQ ID NO: 3877087 - RNA, 19 nt, Shigella flexneri 2a str. 2457T
gcgggaugccagucaauga

SEQ ID NO: 3877088 - RNA, 13 nt, Shigella flexneri 2a str. 2457T
gcgggcaagcggc

SEQ ID NO: 3877089 - RNA, 17 nt, Shigella flexneri 2a str. 2457T
gcgggcaaucggcugca

SEQ ID NO: 3877090 - RNA, 14 nt, Shigella flexneri 2a str. 2457T
gcgggcaguaaacg

SEQ ID NO: 3877091 - RNA, 17 nt, Shigella flexneri 2a str. 2457T
gcgggcaucaucuuccg

SEQ ID NO: 3877092 - RNA, 14 nt, Shigella flexneri 2a str. 2457T
gcgggccacugacg

SEQ ID NO: 3877093 - RNA, 21 nt, Shigella flexneri 2a str. 2457T
gcgggccauccaccagugacu

SEQ ID NO: 3877094 - RNA, 18 nt, Shigella flexneri 2a str. 2457T
gcgggcgcgcaggcgcug

SEQ ID NO: 3877095 - RNA, 23 nt, Shigella flexneri 2a str. 2457T
gcgggcgguaagccggagcuggc

SEQ ID NO: 3877096 - RNA, 17 nt, Shigella flexneri 2a str. 2457T
gcgggcguagugcccgc

SEQ ID NO: 3877097 - RNA, 20 nt, Shigella flexneri 2a str. 2457T
gcgugccuaauuccgcgcga

SEQ ID NO: 3877098 - RNA, 21 nt, Shigella flexneri 2a str. 2457T
gcguggaacacuuugccguca

SEQ ID NO: 3877099 - RNA, 21 nt, Shigella flexneri 2a str. 2457T
gcguggcaucaauaccgcgua

SEQ ID NO: 3877100 - RNA, 23 nt, Shigella flexneri 2a str. 2457T
gcguggcgauaaucagcgccagc

SEQ ID NO: 3877101 - RNA, 16 nt, Shigella flexneri 2a str. 2457T
gcguggcgcagugccu

SEQ ID NO: 3877102 - RNA, 14 nt, Shigella flexneri 2a str. 2457T
gcgugguccagcug

SEQ ID NO: 3877103 - RNA, 15 nt, Shigella flexneri 2a str. 2457T
gcgugucccacuggu

SEQ ID NO: 3877104 - RNA, 22 nt, Shigella flexneri 2a str. 2457T
gcgugucgagcauugccagcau

SEQ ID NO: 3877105 - RNA, 13 nt, Shigella flexneri 2a str. 2457T
gcgugucggacgg

SEQ ID NO: 3877106 - RNA, 13 nt, Shigella flexneri 2a str. 2457T
gcguguggugagg

SEQ ID NO: 3877107 - RNA, 13 nt, Shigella flexneri 2a str. 2457T
gcguuaaaacagg

SEQ ID NO: 3877108 - RNA, 21 nt, Shigella flexneri 2a str. 2457T
gcguuaacuguacaggcuccu

SEQ ID NO: 3877109 - RNA, 14 nt, Shigella flexneri 2a str. 2457T
gcguuaagcauucg

SEQ ID NO: 3877110 - RNA, 22 nt, Shigella flexneri 2a str. 2457T
gcguuaaugucgauauggggau

SEQ ID NO: 3877111 - RNA, 16 nt, Shigella flexneri 2a str. 2457T
gcguuacagcuggagu

SEQ ID NO: 3877112 - RNA, 15 nt, Shigella flexneri 2a str. 2457T
gcguuacccauucaa

SEQ ID NO: 3877113 - RNA, 19 nt, Shigella flexneri 2a str. 2457T
gcguuacucuggcgcugga

SEQ ID NO: 3877114 - RNA, 18 nt, Shigella flexneri 2a str. 2457T
gcguuagacgcguuuaca

SEQ ID NO: 3877115 - RNA, 22 nt, Shigella flexneri 2a str. 2457T
gcguuagauagcggcugacggu

SEQ ID NO: 3877116 - RNA, 22 nt, Shigella flexneri 2a str. 2457T
gcguucacgacgcauccggcau

SEQ ID NO: 3877117 - RNA, 20 nt, Shigella flexneri 2a str. 2457T
gcguucacgccgcauccggc

SEQ ID NO: 3877118 - RNA, 21 nt, Shigella flexneri 2a str. 2457T
gcguucagugaucgccugcau

SEQ ID NO: 3877119 - RNA, 16 nt, Shigella flexneri 2a str. 2457T
gcguucaucaguucca

SEQ ID NO: 3877120 - RNA, 11 nt, Shigella flexneri 2a str. 2457T
gcguuccccag

SEQ ID NO: 3877121 - RNA, 15 nt, Shigella flexneri 2a str. 2457T
gcguuccccagaagc

SEQ ID NO: 3877122 - RNA, 17 nt, Shigella flexneri 2a str. 2457T
gcguuccuggggaaaau

SEQ ID NO: 3877123 - RNA, 15 nt, Shigella flexneri 2a str. 2457T
gcguucgcgccgcau

SEQ ID NO: 3877124 - RNA, 17 nt, Shigella flexneri 2a str. 2457T
gcguucugccuggcgca

SEQ ID NO: 3877125 - RNA, 23 nt, Shigella flexneri 2a str. 2457T
gcguucugguaaaccuuccacac

SEQ ID NO: 3877126 - RNA, 19 nt, Shigella flexneri 2a str. 2457T
gcguucuguggcagggcag

SEQ ID NO: 3877127 - RNA, 14 nt, Shigella flexneri 2a str. 2457T
gcguugagaaacgc

SEQ ID NO: 3877128 - RNA, 15 nt, Shigella flexneri 2a str. 2457T
gcguugauuggcgca

SEQ ID NO: 3877129 - RNA, 20 nt, Shigella flexneri 2a str. 2457T
gcguugcgccuguucccuuc

SEQ ID NO: 3877130 - RNA, 23 nt, Shigella flexneri 2a str. 2457T
gcguugcggaaagcuugcgucgc

SEQ ID NO: 3877131 - RNA, 21 nt, Shigella flexneri 2a str. 2457T
gcguuggcgugacuucgccga

SEQ ID NO: 3877132 - RNA, 19 nt, Shigella flexneri 2a str. 2457T
gcguuguaacaauccgaua

SEQ ID NO: 3877133 - RNA, 14 nt, Shigella flexneri 2a str. 2457T
gcguuuaaucacac

SEQ ID NO: 3877134 - RNA, 15 nt, Shigella flexneri 2a str. 2457T
gcguuuaccugccug

SEQ ID NO: 3877135 - RNA, 22 nt, Shigella flexneri 2a str. 2457T
gcguuuacgccgcauccggcau

SEQ ID NO: 3877136 - RNA, 18 nt, Shigella flexneri 2a str. 2457T
gcguuucaaaaacaaaga

SEQ ID NO: 3877137 - RNA, 16 nt, Shigella flexneri 2a str. 2457T
gcguuucaacaaacga

SEQ ID NO: 3877138 - RNA, 22 nt, Shigella flexneri 2a str. 2457T
gcguuuccagcaguuccagcau

SEQ ID NO: 3877139 - RNA, 21 nt, Shigella flexneri 2a str. 2457T
gcguuucuggcuuaaacgcag

SEQ ID NO: 3877140 - RNA, 23 nt, Shigella flexneri 2a str. 2457T
gcguuugaaauaccagguugccu

SEQ ID NO: 3877141 - RNA, 14 nt, Shigella flexneri 2a str. 2457T
gcguuugccagcgu

SEQ ID NO: 3877142 - RNA, 15 nt, Shigella flexneri 2a str. 2457T
gcguuuguccgccgg

SEQ ID NO: 3877143 - RNA, 13 nt, Shigella flexneri 2a str. 2457T
gcguuuguccggu

SEQ ID NO: 3877144 - RNA, 12 nt, Shigella flexneri 2a str. 2457T
gcguuuguugcg

SEQ ID NO: 3877145 - RNA, 11 nt, Shigella flexneri 2a str. 2457T
gcguuuuccag

SEQ ID NO: 3877146 - RNA, 15 nt, Shigella flexneri 2a str. 2457T
gcguuuucgccgcau

SEQ ID NO: 3877147 - RNA, 13 nt, Shigella flexneri 2a str. 2457T
gcguuuugcagau

SEQ ID NO: 3877148 - RNA, 17 nt, Shigella flexneri 2a str. 2457T
gcguuuuuaucuucaca

SEQ ID NO: 3877149 - RNA, 23 nt, Shigella flexneri 2a str. 2457T
gcguuuuucuucagccccuccac

SEQ ID NO: 3877150 - RNA, 12 nt, Shigella flexneri 2a str. 2457T
gcguuuuuucau

SEQ ID NO: 3877151 - RNA, 23 nt, Shigella flexneri 2a str. 2457T
gcguuuuuucgauaucaagccau

SEQ ID NO: 3877152 - RNA, 16 nt, Shigella flexneri 2a str. 2457T
gcuaaaaacaucauga

SEQ ID NO: 3877153 - RNA, 18 nt, Shigella flexneri 2a str. 2457T
gcuaaagacuuugcugcc

SEQ ID NO: 3877154 - RNA, 20 nt, Shigella flexneri 2a str. 2457T
gcuaaaugccgcguggccug

SEQ ID NO: 3877155 - RNA, 21 nt, Shigella flexneri 2a str. 2457T
gcuaaauguuuaguauuguua

SEQ ID NO: 3877156 - RNA, 16 nt, Shigella flexneri 2a str. 2457T
gcuaacaggcuuuuac

SEQ ID NO: 3877157 - RNA, 22 nt, Shigella flexneri 2a str. 2457T
gcuaacgcccgccgugaucugg

SEQ ID NO: 3877158 - RNA, 14 nt, Shigella flexneri 2a str. 2457T
gcuaacguuuuuaa

SEQ ID NO: 3877159 - RNA, 15 nt, Shigella flexneri 2a str. 2457T
gcuaacugguggcag

SEQ ID NO: 3877160 - RNA, 15 nt, Shigella flexneri 2a str. 2457T
gcuaagauaccccag

SEQ ID NO: 3877161 - RNA, 21 nt, Shigella flexneri 2a str. 2457T
gcuaaggcuguuguagaccgg

SEQ ID NO: 3877162 - RNA, 19 nt, Shigella flexneri 2a str. 2457T
gcuaaguacguaacgaccc

SEQ ID NO: 3877163 - RNA, 13 nt, Shigella flexneri 2a str. 2457T
gcuaauaaucagc

SEQ ID NO: 3877164 - RNA, 18 nt, Shigella flexneri 2a str. 2457T
gcuaaucucuucaccaua

SEQ ID NO: 3877165 - RNA, 20 nt, Shigella flexneri 2a str. 2457T
gcuaauugcgaacugugcac

SEQ ID NO: 3877166 - RNA, 16 nt, Shigella flexneri 2a str. 2457T
gcuaauuuugccauca

SEQ ID NO: 3877167 - RNA, 17 nt, Shigella flexneri 2a str. 2457T
gcuacaaaaaugcccga

SEQ ID NO: 3877168 - RNA, 21 nt, Shigella flexneri 2a str. 2457T
gcuacagcaucaucgcuuugu

SEQ ID NO: 3877169 - RNA, 13 nt, Shigella flexneri 2a str. 2457T
gcuacauaacgca

SEQ ID NO: 3877170 - RNA, 15 nt, Shigella flexneri 2a str. 2457T
gcuacauaacgcagc

SEQ ID NO: 3877171 - RNA, 17 nt, Shigella flexneri 2a str. 2457T
gcuacauacuuaaauaa

SEQ ID NO: 3877172 - RNA, 13 nt, Shigella flexneri 2a str. 2457T
gcuaccaaaaaau

SEQ ID NO: 3877173 - RNA, 20 nt, Shigella flexneri 2a str. 2457T
gcuaccgcccugagcaucaa

SEQ ID NO: 3877174 - RNA, 14 nt, Shigella flexneri 2a str. 2457T
gcuaccggcaaacu

SEQ ID NO: 3877175 - RNA, 17 nt, Shigella flexneri 2a str. 2457T
gcuaccuugcucggcgc

SEQ ID NO: 3877176 - RNA, 17 nt, Shigella flexneri 2a str. 2457T
gcuacgcagaaccagaa

SEQ ID NO: 3877177 - RNA, 17 nt, Shigella flexneri 2a str. 2457T
gcuacgccagcaagggu

SEQ ID NO: 3877178 - RNA, 21 nt, Shigella flexneri 2a str. 2457T
gcuacgcuaauuuugccauca

SEQ ID NO: 3877179 - RNA, 12 nt, Shigella flexneri 2a str. 2457T
gcuacggcauga

SEQ ID NO: 3877180 - RNA, 20 nt, Shigella flexneri 2a str. 2457T
gcuacggcguuucacuucug

SEQ ID NO: 3877181 - RNA, 17 nt, Shigella flexneri 2a str. 2457T
gcuacuggcaauccagc

SEQ ID NO: 3877182 - RNA, 16 nt, Shigella flexneri 2a str. 2457T
gcuagguugaccugga

SEQ ID NO: 3877183 - RNA, 16 nt, Shigella flexneri 2a str. 2457T
gcuauaacauuuuucu

SEQ ID NO: 3877184 - RNA, 14 nt, Shigella flexneri 2a str. 2457T
gcuauacagcagcc

SEQ ID NO: 3877185 - RNA, 16 nt, Shigella flexneri 2a str. 2457T
gcuauacagcagccau

SEQ ID NO: 3877186 - RNA, 21 nt, Shigella flexneri 2a str. 2457T
gcuauaccccaccccgaaaug

SEQ ID NO: 3877187 - RNA, 14 nt, Shigella flexneri 2a str. 2457T
gcuauaucgcugau

SEQ ID NO: 3877188 - RNA, 14 nt, Shigella flexneri 2a str. 2457T
gcuauauugcagga

SEQ ID NO: 3877189 - RNA, 16 nt, Shigella flexneri 2a str. 2457T
gcuaucagcgccacca

SEQ ID NO: 3877190 - RNA, 19 nt, Shigella flexneri 2a str. 2457T
gcuaucagcgccaccacaa

SEQ ID NO: 3877191 - RNA, 17 nt, Shigella flexneri 2a str. 2457T
gcuauccacgucgacaa

SEQ ID NO: 3877192 - RNA, 16 nt, Shigella flexneri 2a str. 2457T
gcuaucgaggcucuga

SEQ ID NO: 3877193 - RNA, 20 nt, Shigella flexneri 2a str. 2457T
gcuaucgcugauauacccuu

SEQ ID NO: 3877194 - RNA, 23 nt, Shigella flexneri 2a str. 2457T
gcucgccuuucggcugcagcagu

SEQ ID NO: 3877195 - RNA, 13 nt, Shigella flexneri 2a str. 2457T
gcucgcgcagaua

SEQ ID NO: 3877196 - RNA, 22 nt, Shigella flexneri 2a str. 2457T
gcucgcgccagguguuuaacca

SEQ ID NO: 3877197 - RNA, 19 nt, Shigella flexneri 2a str. 2457T
gcucgcgccgcauccgaca

SEQ ID NO: 3877198 - RNA, 24 nt, Shigella flexneri 2a str. 2457T
gcucgcgcuugcggaagcaaccgg

SEQ ID NO: 3877199 - RNA, 21 nt, Shigella flexneri 2a str. 2457T
gcucgcggugacgaucguggu

SEQ ID NO: 3877200 - RNA, 18 nt, Shigella flexneri 2a str. 2457T
gcucgcgguuagcggcuu

SEQ ID NO: 3877201 - RNA, 21 nt, Shigella flexneri 2a str. 2457T
gcucgcguucgauggcgcgcc

SEQ ID NO: 3877202 - RNA, 15 nt, Shigella flexneri 2a str. 2457T
gcucggcaacaccuc

SEQ ID NO: 3877203 - RNA, 16 nt, Shigella flexneri 2a str. 2457T
gcucgugggauugccg

SEQ ID NO: 3877204 - RNA, 22 nt, Shigella flexneri 2a str. 2457T
gcucucacuuauuuguuauuac

SEQ ID NO: 3877205 - RNA, 19 nt, Shigella flexneri 2a str. 2457T
gcucucagccagcuggcag

SEQ ID NO: 3877206 - RNA, 22 nt, Shigella flexneri 2a str. 2457T
gcucucagccagcuggcagaau

SEQ ID NO: 3877207 - RNA, 21 nt, Shigella flexneri 2a str. 2457T
gcucucauuuuucagcguucc

SEQ ID NO: 3877208 - RNA, 18 nt, Shigella flexneri 2a str. 2457T
gcucuccacgcuauacag

SEQ ID NO: 3877209 - RNA, 19 nt, Shigella flexneri 2a str. 2457T
gcucuccugaacuuucucc

SEQ ID NO: 3877210 - RNA, 20 nt, Shigella flexneri 2a str. 2457T
gcucucgcagcucaucaaca

SEQ ID NO: 3877211 - RNA, 13 nt, Shigella flexneri 2a str. 2457T
gcucucguuuuau

SEQ ID NO: 3877212 - RNA, 13 nt, Shigella flexneri 2a str. 2457T
gcucucuuccagu

SEQ ID NO: 3877213 - RNA, 14 nt, Shigella flexneri 2a str. 2457T
gcucucuuucucca

SEQ ID NO: 3877214 - RNA, 18 nt, Shigella flexneri 2a str. 2457T
gcucucuuucucgcugac

SEQ ID NO: 3877215 - RNA, 13 nt, Shigella flexneri 2a str. 2457T
gcucugaggcuga

SEQ ID NO: 3877216 - RNA, 21 nt, Shigella flexneri 2a str. 2457T
gcucugauugccuuccaccag

SEQ ID NO: 3877217 - RNA, 20 nt, Shigella flexneri 2a str. 2457T
gcucugcacuaaugcaucug

SEQ ID NO: 3877218 - RNA, 21 nt, Shigella flexneri 2a str. 2457T
gcucugccacugguuuuccug

SEQ ID NO: 3877219 - RNA, 12 nt, Shigella flexneri 2a str. 2457T
gcucugccagac

SEQ ID NO: 3877220 - RNA, 19 nt, Shigella flexneri 2a str. 2457T
gcucugcgcgugcaguggu

SEQ ID NO: 3877221 - RNA, 19 nt, Shigella flexneri 2a str. 2457T
gcucugcugucaccgaagc

SEQ ID NO: 3877222 - RNA, 20 nt, Shigella flexneri 2a str. 2457T
gcucugcuuucucagcaaau

SEQ ID NO: 3877223 - RNA, 23 nt, Shigella flexneri 2a str. 2457T
gcucuggcaggcuucaauuuuuu

SEQ ID NO: 3877224 - RNA, 19 nt, Shigella flexneri 2a str. 2457T
gcucuggcggagcucccag

SEQ ID NO: 3877225 - RNA, 18 nt, Shigella flexneri 2a str. 2457T
gcucuggugcggcaaaaa

SEQ ID NO: 3877226 - RNA, 19 nt, Shigella flexneri 2a str. 2457T
gcucugguucaccauucug

SEQ ID NO: 3877227 - RNA, 15 nt, Shigella flexneri 2a str. 2457T
gcucuucaaugguca

SEQ ID NO: 3877228 - RNA, 16 nt, Shigella flexneri 2a str. 2457T
gcucuucaauggucag

SEQ ID NO: 3877229 - RNA, 14 nt, Shigella flexneri 2a str. 2457T
gcucuucaucgcua

SEQ ID NO: 3877230 - RNA, 21 nt, Shigella flexneri 2a str. 2457T
gcucuucaucgcuaaaauacu

SEQ ID NO: 3877231 - RNA, 14 nt, Shigella flexneri 2a str. 2457T
gcucuucaugcagc

SEQ ID NO: 3877232 - RNA, 21 nt, Shigella flexneri 2a str. 2457T
gcucuucaugcagcaugguca

SEQ ID NO: 3877233 - RNA, 22 nt, Shigella flexneri 2a str. 2457T
gcucuuccaggcauuaaauccu

SEQ ID NO: 3877234 - RNA, 22 nt, Shigella flexneri 2a str. 2457T
gcucuucuucacucucaccacg

SEQ ID NO: 3877235 - RNA, 15 nt, Shigella flexneri 2a str. 2457T
gcucuucuucgcgau

SEQ ID NO: 3877236 - RNA, 20 nt, Shigella flexneri 2a str. 2457T
gcucuuuucuuuaucuauua

SEQ ID NO: 3877237 - RNA, 22 nt, Shigella flexneri 2a str. 2457T
gcucuuuugacgcccccaaacu

SEQ ID NO: 3877238 - RNA, 22 nt, Shigella flexneri 2a str. 2457T
gcugaaagcgccgggaaugcca

SEQ ID NO: 3877239 - RNA, 18 nt, Shigella flexneri 2a str. 2457T
gcugaaagggcaaauaau

SEQ ID NO: 3877240 - RNA, 15 nt, Shigella flexneri 2a str. 2457T
gcugaaaguucauga

SEQ ID NO: 3877241 - RNA, 23 nt, Shigella flexneri 2a str. 2457T
gcugaaaguuuucuucagugccu

SEQ ID NO: 3877242 - RNA, 17 nt, Shigella flexneri 2a str. 2457T
gcugaaaucacagcggc

SEQ ID NO: 3877243 - RNA, 18 nt, Shigella flexneri 2a str. 2457T
gcugaacgaaaagcgcac

SEQ ID NO: 3877244 - RNA, 15 nt, Shigella flexneri 2a str. 2457T
gcugaacgccacgcu

SEQ ID NO: 3877245 - RNA, 18 nt, Shigella flexneri 2a str. 2457T
gcugaagaaaauggccag

SEQ ID NO: 3877246 - RNA, 22 nt, Shigella flexneri 2a str. 2457T
gcugaagcagaaagcggaucag

SEQ ID NO: 3877247 - RNA, 15 nt, Shigella flexneri 2a str. 2457T
gcugaauaucuuucu

SEQ ID NO: 3877248 - RNA, 13 nt, Shigella flexneri 2a str. 2457T
gcugaauccccuu

SEQ ID NO: 3877249 - RNA, 21 nt, Shigella flexneri 2a str. 2457T
gcugaaugaggcuuuaauacc

SEQ ID NO: 3877250 - RNA, 19 nt, Shigella flexneri 2a str. 2457T
gcugaauuucaucaccagc

SEQ ID NO: 3877251 - RNA, 23 nt, Shigella flexneri 2a str. 2457T
gcugaauuuuuuucucgcggcgg

SEQ ID NO: 3877252 - RNA, 20 nt, Shigella flexneri 2a str. 2457T
gcugacaacgcugaauggcg

SEQ ID NO: 3877253 - RNA, 21 nt, Shigella flexneri 2a str. 2457T
gcugacacuauucgccagcac

SEQ ID NO: 3877254 - RNA, 22 nt, Shigella flexneri 2a str. 2457T
gcugacacuauucgccagcacg

SEQ ID NO: 3877255 - RNA, 19 nt, Shigella flexneri 2a str. 2457T
gcugacagcgcgucuugua

SEQ ID NO: 3877256 - RNA, 17 nt, Shigella flexneri 2a str. 2457T
gcugacaggcgcugaug

SEQ ID NO: 3877257 - RNA, 18 nt, Shigella flexneri 2a str. 2457T
gcugacaggcgcugauga

SEQ ID NO: 3877258 - RNA, 18 nt, Shigella flexneri 2a str. 2457T
gcugacauaaacaccagc

SEQ ID NO: 3877259 - RNA, 22 nt, Shigella flexneri 2a str. 2457T
gcugacauaaacaccagcaaua

SEQ ID NO: 3877260 - RNA, 23 nt, Shigella flexneri 2a str. 2457T
gcugacauaaacaccagcaauaa

SEQ ID NO: 3877261 - RNA, 20 nt, Shigella flexneri 2a str. 2457T
gcugacauuaucagacaccg

SEQ ID NO: 3877262 - RNA, 16 nt, Shigella flexneri 2a str. 2457T
gcugaccaccagcacg

SEQ ID NO: 3877263 - RNA, 22 nt, Shigella flexneri 2a str. 2457T
gcugaccgccgucgauggcgca

SEQ ID NO: 3877264 - RNA, 19 nt, Shigella flexneri 2a str. 2457T
gcugacgauuguagaaaau

SEQ ID NO: 3877265 - RNA, 22 nt, Shigella flexneri 2a str. 2457T
gcugacgcaacugguccagccc

SEQ ID NO: 3877266 - RNA, 15 nt, Shigella flexneri 2a str. 2457T
gcugacgcaucuucu

SEQ ID NO: 3877267 - RNA, 16 nt, Shigella flexneri 2a str. 2457T
gcugacggcgauaaau

SEQ ID NO: 3877268 - RNA, 21 nt, Shigella flexneri 2a str. 2457T
gcugacggugccagguaaaca

SEQ ID NO: 3877269 - RNA, 16 nt, Shigella flexneri 2a str. 2457T
gcugacguagcagcuc

SEQ ID NO: 3877270 - RNA, 19 nt, Shigella flexneri 2a str. 2457T
gcugacugauauugcccgu

SEQ ID NO: 3877271 - RNA, 17 nt, Shigella flexneri 2a str. 2457T
gcugacugucgcagcca

SEQ ID NO: 3877272 - RNA, 22 nt, Shigella flexneri 2a str. 2457T
gcugacugucgcagccagcgcg

SEQ ID NO: 3877273 - RNA, 17 nt, Shigella flexneri 2a str. 2457T
gcugacuuugauccagc

SEQ ID NO: 3877274 - RNA, 12 nt, Shigella flexneri 2a str. 2457T
gcugagaaaaag

SEQ ID NO: 3877275 - RNA, 14 nt, Shigella flexneri 2a str. 2457T
gcugagaaaugcca

SEQ ID NO: 3877276 - RNA, 23 nt, Shigella flexneri 2a str. 2457T
gcugagaacaagauugccugaug

SEQ ID NO: 3877277 - RNA, 20 nt, Shigella flexneri 2a str. 2457T
gcugagaucaaacucuuuca

SEQ ID NO: 3877278 - RNA, 14 nt, Shigella flexneri 2a str. 2457T
gcugagcacuaucc

SEQ ID NO: 3877279 - RNA, 23 nt, Shigella flexneri 2a str. 2457T
gcugagcgugccccugaauaauc

SEQ ID NO: 3877280 - RNA, 14 nt, Shigella flexneri 2a str. 2457T
gcugaggcguuuca

SEQ ID NO: 3877281 - RNA, 18 nt, Shigella flexneri 2a str. 2457T
gcugagguuaugcaaacg

SEQ ID NO: 3877282 - RNA, 19 nt, Shigella flexneri 2a str. 2457T
gcugauaaaacucucaucu

SEQ ID NO: 3877283 - RNA, 15 nt, Shigella flexneri 2a str. 2457T
gcugauaacaauauc

SEQ ID NO: 3877284 - RNA, 14 nt, Shigella flexneri 2a str. 2457T
gcugauaagacgca

SEQ ID NO: 3877285 - RNA, 15 nt, Shigella flexneri 2a str. 2457T
gcugauaugccagac

SEQ ID NO: 3877286 - RNA, 13 nt, Shigella flexneri 2a str. 2457T
gcugauauuuauc

SEQ ID NO: 3877287 - RNA, 15 nt, Shigella flexneri 2a str. 2457T
gcugaugcaggcgau

SEQ ID NO: 3877288 - RNA, 14 nt, Shigella flexneri 2a str. 2457T
gcugaugccaggcu

SEQ ID NO: 3877289 - RNA, 19 nt, Shigella flexneri 2a str. 2457T
gcugauggcgccaguuauu

SEQ ID NO: 3877290 - RNA, 13 nt, Shigella flexneri 2a str. 2457T
gcuggcaaugacc

SEQ ID NO: 3877291 - RNA, 20 nt, Shigella flexneri 2a str. 2457T
gcuggcagaagcccagcgac

SEQ ID NO: 3877292 - RNA, 17 nt, Shigella flexneri 2a str. 2457T
gcuggcagcugcuacgc

SEQ ID NO: 3877293 - RNA, 22 nt, Shigella flexneri 2a str. 2457T
gcuggcagugggccagaaaaaa

SEQ ID NO: 3877294 - RNA, 15 nt, Shigella flexneri 2a str. 2457T
gcuggcaucggcaaa

SEQ ID NO: 3877295 - RNA, 18 nt, Shigella flexneri 2a str. 2457T
gcuggcaucuugauacca

SEQ ID NO: 3877296 - RNA, 16 nt, Shigella flexneri 2a str. 2457T
gcuggcauugauguuu

SEQ ID NO: 3877297 - RNA, 15 nt, Shigella flexneri 2a str. 2457T
gcuggcccaucagaa

SEQ ID NO: 3877298 - RNA, 18 nt, Shigella flexneri 2a str. 2457T
gcuggccgcgucuuaucc

SEQ ID NO: 3877299 - RNA, 22 nt, Shigella flexneri 2a str. 2457T
gcuggccuauuaugacuccagc

SEQ ID NO: 3877300 - RNA, 18 nt, Shigella flexneri 2a str. 2457T
gcuggcgaacgugcagga

SEQ ID NO: 3877301 - RNA, 15 nt, Shigella flexneri 2a str. 2457T
gcuggcgauuccacu

SEQ ID NO: 3877302 - RNA, 22 nt, Shigella flexneri 2a str. 2457T
gcuggcgcauguuggcgcggug

SEQ ID NO: 3877303 - RNA, 17 nt, Shigella flexneri 2a str. 2457T
gcuggcggaaacggguu

SEQ ID NO: 3877304 - RNA, 16 nt, Shigella flexneri 2a str. 2457T
gcuggcggcggcgggc

SEQ ID NO: 3877305 - RNA, 17 nt, Shigella flexneri 2a str. 2457T
gcuggcguacccaucaa

SEQ ID NO: 3877306 - RNA, 13 nt, Shigella flexneri 2a str. 2457T
gcuggcgucuggg

SEQ ID NO: 3877307 - RNA, 14 nt, Shigella flexneri 2a str. 2457T
gcuggcugaacauu

SEQ ID NO: 3877308 - RNA, 16 nt, Shigella flexneri 2a str. 2457T
gcuggcuggcacgcuc

SEQ ID NO: 3877309 - RNA, 22 nt, Shigella flexneri 2a str. 2457T
gcuggcuuuccgggagcaauuu

SEQ ID NO: 3877310 - RNA, 14 nt, Shigella flexneri 2a str. 2457T
gcugggaaaucacc

SEQ ID NO: 3877311 - RNA, 16 nt, Shigella flexneri 2a str. 2457T
gcugggaaaucaccac

SEQ ID NO: 3877312 - RNA, 20 nt, Shigella flexneri 2a str. 2457T
gcugggaaaucaccaccagc

SEQ ID NO: 3877313 - RNA, 15 nt, Shigella flexneri 2a str. 2457T
gcugggauggcaaaa

SEQ ID NO: 3877314 - RNA, 21 nt, Shigella flexneri 2a str. 2457T
gcuggguuucgccugccagau

SEQ ID NO: 3877315 - RNA, 22 nt, Shigella flexneri 2a str. 2457T
gcuggguuucgccugccagaug

SEQ ID NO: 3877316 - RNA, 14 nt, Shigella flexneri 2a str. 2457T
gcuggucagcaacu

SEQ ID NO: 3877317 - RNA, 14 nt, Shigella flexneri 2a str. 2457T
gcuggucagcaucg

SEQ ID NO: 3877318 - RNA, 16 nt, Shigella flexneri 2a str. 2457T
gcuggucagcgccagu

SEQ ID NO: 3877319 - RNA, 16 nt, Shigella flexneri 2a str. 2457T
gcuggugaguaacgcg

SEQ ID NO: 3877320 - RNA, 14 nt, Shigella flexneri 2a str. 2457T
gcuggugauugccg

SEQ ID NO: 3877321 - RNA, 12 nt, Shigella flexneri 2a str. 2457T
gcugguggugca

SEQ ID NO: 3877322 - RNA, 14 nt, Shigella flexneri 2a str. 2457T
gcugguucugcggg

SEQ ID NO: 3877323 - RNA, 18 nt, Shigella flexneri 2a str. 2457T
gcugguuuuguaggccgg

SEQ ID NO: 3877324 - RNA, 20 nt, Shigella flexneri 2a str. 2457T
gcugguuuugugcgccacau

SEQ ID NO: 3877325 - RNA, 15 nt, Shigella flexneri 2a str. 2457T
gcuguaaccagcgca

SEQ ID NO: 3877326 - RNA, 14 nt, Shigella flexneri 2a str. 2457T
gcuguacagcagua

SEQ ID NO: 3877327 - RNA, 16 nt, Shigella flexneri 2a str. 2457T
gcuguacauauccagu

SEQ ID NO: 3877328 - RNA, 14 nt, Shigella flexneri 2a str. 2457T
gcuguacgccuuca

SEQ ID NO: 3877329 - RNA, 16 nt, Shigella flexneri 2a str. 2457T
gcuguauguuccccuc

SEQ ID NO: 3877330 - RNA, 20 nt, Shigella flexneri 2a str. 2457T
gcuguauucaagccaugaau

SEQ ID NO: 3877331 - RNA, 18 nt, Shigella flexneri 2a str. 2457T
gcuguauucuucagcgac

SEQ ID NO: 3877332 - RNA, 18 nt, Shigella flexneri 2a str. 2457T
gcugucaacugcgccacu

SEQ ID NO: 3877333 - RNA, 18 nt, Shigella flexneri 2a str. 2457T
gcugucaccgaagcggcc

SEQ ID NO: 3877334 - RNA, 19 nt, Shigella flexneri 2a str. 2457T
gcuguccgcgucuuaucag

SEQ ID NO: 3877335 - RNA, 17 nt, Shigella flexneri 2a str. 2457T
gcuguccgcuucaccac

SEQ ID NO: 3877336 - RNA, 19 nt, Shigella flexneri 2a str. 2457T
gcuguccggcgcacuggug

SEQ ID NO: 3877337 - RNA, 23 nt, Shigella flexneri 2a str. 2457T
gcugucgccaucccugucgucca

SEQ ID NO: 3877338 - RNA, 20 nt, Shigella flexneri 2a str. 2457T
gcugucggcaagauacugca

SEQ ID NO: 3877339 - RNA, 14 nt, Shigella flexneri 2a str. 2457T
gcugucggcacuga

SEQ ID NO: 3877340 - RNA, 13 nt, Shigella flexneri 2a str. 2457T
gcugucggcggcg

SEQ ID NO: 3877341 - RNA, 16 nt, Shigella flexneri 2a str. 2457T
gcugucuaccagcacc

SEQ ID NO: 3877342 - RNA, 19 nt, Shigella flexneri 2a str. 2457T
gcugugaaccgcacagguu

SEQ ID NO: 3877343 - RNA, 20 nt, Shigella flexneri 2a str. 2457T
gcugugacagauuuugccag

SEQ ID NO: 3877344 - RNA, 19 nt, Shigella flexneri 2a str. 2457T
gcugugcgauagcaacgag

SEQ ID NO: 3877345 - RNA, 14 nt, Shigella flexneri 2a str. 2457T
gcugugcggucuga

SEQ ID NO: 3877346 - RNA, 18 nt, Shigella flexneri 2a str. 2457T
gcugugggguauuuccag

SEQ ID NO: 3877347 - RNA, 20 nt, Shigella flexneri 2a str. 2457T
gcuguguguaggccagcgau

SEQ ID NO: 3877348 - RNA, 15 nt, Shigella flexneri 2a str. 2457T
gcuguucacugugcu

SEQ ID NO: 3877349 - RNA, 18 nt, Shigella flexneri 2a str. 2457T
gcuguucacugugcuggu

SEQ ID NO: 3877350 - RNA, 15 nt, Shigella flexneri 2a str. 2457T
gcuguuccaucuuua

SEQ ID NO: 3877351 - RNA, 12 nt, Shigella flexneri 2a str. 2457T
gcuguucuuccc

SEQ ID NO: 3877352 - RNA, 16 nt, Shigella flexneri 2a str. 2457T
gcuguucuucugcuga

SEQ ID NO: 3877353 - RNA, 17 nt, Shigella flexneri 2a str. 2457T
gcuguucuucugcugau

SEQ ID NO: 3877354 - RNA, 14 nt, Shigella flexneri 2a str. 2457T
gcuguugaaugccg

SEQ ID NO: 3877355 - RNA, 16 nt, Shigella flexneri 2a str. 2457T
gcuguugcaagacgau

SEQ ID NO: 3877356 - RNA, 15 nt, Shigella flexneri 2a str. 2457T
gcuguuggugccaga

SEQ ID NO: 3877357 - RNA, 16 nt, Shigella flexneri 2a str. 2457T
gcuguuggugccagau

SEQ ID NO: 3877358 - RNA, 17 nt, Shigella flexneri 2a str. 2457T
gcuguugucugaaugau

SEQ ID NO: 3877359 - RNA, 14 nt, Shigella flexneri 2a str. 2457T
gcuguugugcucgc

SEQ ID NO: 3877360 - RNA, 15 nt, Shigella flexneri 2a str. 2457T
gcuguuguucaacac

SEQ ID NO: 3877361 - RNA, 16 nt, Shigella flexneri 2a str. 2457T
gcuguuguucaacacu

SEQ ID NO: 3877362 - RNA, 12 nt, Shigella flexneri 2a str. 2457T
gcuguuuaaccu

SEQ ID NO: 3877363 - RNA, 18 nt, Shigella flexneri 2a str. 2457T
gcuguuucaggaacaccg

SEQ ID NO: 3877364 - RNA, 21 nt, Shigella flexneri 2a str. 2457T
gcuguuucgcuucuucagccu

SEQ ID NO: 3877365 - RNA, 17 nt, Shigella flexneri 2a str. 2457T
gcuguuuguucaagcgc

SEQ ID NO: 3877366 - RNA, 19 nt, Shigella flexneri 2a str. 2457T
gcuguuuguucaagcgcaa

SEQ ID NO: 3877367 - RNA, 14 nt, Shigella flexneri 2a str. 2457T
gcuguuuucagcac

SEQ ID NO: 3877368 - RNA, 18 nt, Shigella flexneri 2a str. 2457T
gcuguuuucagcaccaga

SEQ ID NO: 3877369 - RNA, 16 nt, Shigella flexneri 2a str. 2457T
gcuguuuuccagcacc

SEQ ID NO: 3877370 - RNA, 23 nt, Shigella flexneri 2a str. 2457T
gcuguuuuccagcaccacuuccg

SEQ ID NO: 3877371 - RNA, 15 nt, Shigella flexneri 2a str. 2457T
gcuguuuuucguuug

SEQ ID NO: 3877372 - RNA, 19 nt, Shigella flexneri 2a str. 2457T
gcuguuuuuucaggcccuc

SEQ ID NO: 3877373 - RNA, 13 nt, Shigella flexneri 2a str. 2457T
gcuuaaauacgcc

SEQ ID NO: 3877374 - RNA, 17 nt, Shigella flexneri 2a str. 2457T
gcuuaacugcgcuuucg

SEQ ID NO: 3877375 - RNA, 16 nt, Shigella flexneri 2a str. 2457T
gcuuaaggcagaaaca

SEQ ID NO: 3877376 - RNA, 13 nt, Shigella flexneri 2a str. 2457T
gcuuaaucugcca

SEQ ID NO: 3877377 - RNA, 22 nt, Shigella flexneri 2a str. 2457T
gcuuaauugcccgaagccaauu

SEQ ID NO: 3877378 - RNA, 17 nt, Shigella flexneri 2a str. 2457T
gcuuacaaaaccugcuu

SEQ ID NO: 3877379 - RNA, 13 nt, Shigella flexneri 2a str. 2457T
gcuuacaggcugg

SEQ ID NO: 3877380 - RNA, 15 nt, Shigella flexneri 2a str. 2457T
gcuuaccaugccaac

SEQ ID NO: 3877381 - RNA, 19 nt, Shigella flexneri 2a str. 2457T
gcuuacccuaaauccgcca

SEQ ID NO: 3877382 - RNA, 21 nt, Shigella flexneri 2a str. 2457T
gcuuaccguccucuucccaga

SEQ ID NO: 3877383 - RNA, 23 nt, Shigella flexneri 2a str. 2457T
gcuuacgaagccguauucugacu

SEQ ID NO: 3877384 - RNA, 14 nt, Shigella flexneri 2a str. 2457T
gcuuacgccugcca

SEQ ID NO: 3877385 - RNA, 16 nt, Shigella flexneri 2a str. 2457T
gcuuacgccugccagc

SEQ ID NO: 3877386 - RNA, 17 nt, Shigella flexneri 2a str. 2457T
gcuuacgccugccagcu

SEQ ID NO: 3877387 - RNA, 14 nt, Shigella flexneri 2a str. 2457T
gcuuacucauccac

SEQ ID NO: 3877388 - RNA, 16 nt, Shigella flexneri 2a str. 2457T
gcuugcgucauccagc

SEQ ID NO: 3877389 - RNA, 19 nt, Shigella flexneri 2a str. 2457T
gcuugcgucauccagcacu

SEQ ID NO: 3877390 - RNA, 15 nt, Shigella flexneri 2a str. 2457T
gcuugcuuuccagcu

SEQ ID NO: 3877391 - RNA, 11 nt, Shigella flexneri 2a str. 2457T
gcuugggcaga

SEQ ID NO: 3877392 - RNA, 13 nt, Shigella flexneri 2a str. 2457T
gcuugggcagaau

SEQ ID NO: 3877393 - RNA, 15 nt, Shigella flexneri 2a str. 2457T
gcuugguuuugccau

SEQ ID NO: 3877394 - RNA, 18 nt, Shigella flexneri 2a str. 2457T
gcuugguuuugccaugca

SEQ ID NO: 3877395 - RNA, 22 nt, Shigella flexneri 2a str. 2457T
gcuuguaaaugaacucaacgcc

SEQ ID NO: 3877396 - RNA, 16 nt, Shigella flexneri 2a str. 2457T
gcuuguggugaaacua

SEQ ID NO: 3877397 - RNA, 16 nt, Shigella flexneri 2a str. 2457T
gcuuguugcuaauuua

SEQ ID NO: 3877398 - RNA, 17 nt, Shigella flexneri 2a str. 2457T
gcuuguuucauuacucg

SEQ ID NO: 3877399 - RNA, 14 nt, Shigella flexneri 2a str. 2457T
gcuuuaaaaaagaa

SEQ ID NO: 3877400 - RNA, 16 nt, Shigella flexneri 2a str. 2457T
gcuuuauagcguugcc

SEQ ID NO: 3877401 - RNA, 20 nt, Shigella flexneri 2a str. 2457T
gcuuuauagcguugcccgau

SEQ ID NO: 3877402 - RNA, 12 nt, Shigella flexneri 2a str. 2457T
gcuuuauauucu

SEQ ID NO: 3877403 - RNA, 22 nt, Shigella flexneri 2a str. 2457T
gcuuuaucgccaccaacccgga

SEQ ID NO: 3877404 - RNA, 20 nt, Shigella flexneri 2a str. 2457T
gcuuucaacguagccugcca

SEQ ID NO: 3877405 - RNA, 17 nt, Shigella flexneri 2a str. 2457T
gcuuucaccgccugauc

SEQ ID NO: 3877406 - RNA, 15 nt, Shigella flexneri 2a str. 2457T
gcuuucacgccgccg

SEQ ID NO: 3877407 - RNA, 21 nt, Shigella flexneri 2a str. 2457T
gcuuucacgccgccguuagcu

SEQ ID NO: 3877408 - RNA, 16 nt, Shigella flexneri 2a str. 2457T
gcuuucacuauuucuu

SEQ ID NO: 3877409 - RNA, 18 nt, Shigella flexneri 2a str. 2457T
gcuuucacuauuucuuug

SEQ ID NO: 3877410 - RNA, 21 nt, Shigella flexneri 2a str. 2457T
gcuuucacucaguguuggaug

SEQ ID NO: 3877411 - RNA, 15 nt, Shigella flexneri 2a str. 2457T
gcuuucacucugaaa

SEQ ID NO: 3877412 - RNA, 21 nt, Shigella flexneri 2a str. 2457T
gcuuucacucugaaaacgcug

SEQ ID NO: 3877413 - RNA, 15 nt, Shigella flexneri 2a str. 2457T
gcuuucagcacgaca

SEQ ID NO: 3877414 - RNA, 13 nt, Shigella flexneri 2a str. 2457T
gcuuucagcagcg

SEQ ID NO: 3877415 - RNA, 17 nt, Shigella flexneri 2a str. 2457T
gcuuucagcagcggcuc

SEQ ID NO: 3877416 - RNA, 18 nt, Shigella flexneri 2a str. 2457T
gcuuucaggucagcgaau

SEQ ID NO: 3877417 - RNA, 15 nt, Shigella flexneri 2a str. 2457T
gcuuucauucagaac

SEQ ID NO: 3877418 - RNA, 16 nt, Shigella flexneri 2a str. 2457T
gcuuucauuucagcgu

SEQ ID NO: 3877419 - RNA, 17 nt, Shigella flexneri 2a str. 2457T
gcuuuccaacuguacca

SEQ ID NO: 3877420 - RNA, 15 nt, Shigella flexneri 2a str. 2457T
gcuuuccaccaucac

SEQ ID NO: 3877421 - RNA, 23 nt, Shigella flexneri 2a str. 2457T
gcuuuccaccaucacgccaauaa

SEQ ID NO: 3877422 - RNA, 18 nt, Shigella flexneri 2a str. 2457T
gcuuuccagcuucaaauu

SEQ ID NO: 3877423 - RNA, 19 nt, Shigella flexneri 2a str. 2457T
gcuuuccaggcaucagcaa

SEQ ID NO: 3877424 - RNA, 17 nt, Shigella flexneri 2a str. 2457T
gcuuucccuucaggcgu

SEQ ID NO: 3877425 - RNA, 20 nt, Shigella flexneri 2a str. 2457T
gcuuuccgucagcggcaauu

SEQ ID NO: 3877426 - RNA, 16 nt, Shigella flexneri 2a str. 2457T
gcuuucgagcacgacu

SEQ ID NO: 3877427 - RNA, 22 nt, Shigella flexneri 2a str. 2457T
gcuuucgcaauaaucaucucuc

SEQ ID NO: 3877428 - RNA, 20 nt, Shigella flexneri 2a str. 2457T
gcuuucgccaggucgcugac

SEQ ID NO: 3877429 - RNA, 21 nt, Shigella flexneri 2a str. 2457T
gcuuucgcuacuucaaacaaa

SEQ ID NO: 3877430 - RNA, 16 nt, Shigella flexneri 2a str. 2457T
gcuuucgcuuucucuu

SEQ ID NO: 3877431 - RNA, 20 nt, Shigella flexneri 2a str. 2457T
gcuuucggaaagaucgccac

SEQ ID NO: 3877432 - RNA, 14 nt, Shigella flexneri 2a str. 2457T
gcuuucgugaagcu

SEQ ID NO: 3877433 - RNA, 22 nt, Shigella flexneri 2a str. 2457T
gcuuucguuuucuacuuuguaa

SEQ ID NO: 3877434 - RNA, 14 nt, Shigella flexneri 2a str. 2457T
gcuuucucaccaug

SEQ ID NO: 3877435 - RNA, 20 nt, Shigella flexneri 2a str. 2457T
gcuuucucugcaagaacuuu

SEQ ID NO: 3877436 - RNA, 14 nt, Shigella flexneri 2a str. 2457T
gcuuucucuuccag

SEQ ID NO: 3877437 - RNA, 15 nt, Shigella flexneri 2a str. 2457T
gcuuucugaacugaa

SEQ ID NO: 3877438 - RNA, 16 nt, Shigella flexneri 2a str. 2457T
gcuuucugaacugaac

SEQ ID NO: 3877439 - RNA, 23 nt, Shigella flexneri 2a str. 2457T
gcuuucuucucagauauaaacgg

SEQ ID NO: 3877440 - RNA, 20 nt, Shigella flexneri 2a str. 2457T
gcuuugaauaucuccucugc

SEQ ID NO: 3877441 - RNA, 22 nt, Shigella flexneri 2a str. 2457T
gcuuugacgaugcuccacuccu

SEQ ID NO: 3877442 - RNA, 23 nt, Shigella flexneri 2a str. 2457T
gcuuugacgaugcuccacuccug

SEQ ID NO: 3877443 - RNA, 14 nt, Shigella flexneri 2a str. 2457T
gcuuugcaacugcu

SEQ ID NO: 3877444 - RNA, 15 nt, Shigella flexneri 2a str. 2457T
gcuuugcaggcuggu

SEQ ID NO: 3877445 - RNA, 15 nt, Shigella flexneri 2a str. 2457T
gcuuugccgucaucu

SEQ ID NO: 3877446 - RNA, 17 nt, Shigella flexneri 2a str. 2457T
gcuuugcuguuuccagu

SEQ ID NO: 3877447 - RNA, 19 nt, Shigella flexneri 2a str. 2457T
gcuuuggcaaacuacaaau

SEQ ID NO: 3877448 - RNA, 23 nt, Shigella flexneri 2a str. 2457T
gcuuuggcugccgccaguuuacu

SEQ ID NO: 3877449 - RNA, 18 nt, Shigella flexneri 2a str. 2457T
gcuuuggugccagauuua

SEQ ID NO: 3877450 - RNA, 18 nt, Shigella flexneri 2a str. 2457T
gcuuuguuuaugccagau

SEQ ID NO: 3877451 - RNA, 18 nt, Shigella flexneri 2a str. 2457T
gcuuuguuuaugccggau

SEQ ID NO: 3877452 - RNA, 16 nt, Shigella flexneri 2a str. 2457T
gcuuuuaacaccugca

SEQ ID NO: 3877453 - RNA, 20 nt, Shigella flexneri 2a str. 2457T
gcuuuuaccgcgucaucggc

SEQ ID NO: 3877454 - RNA, 19 nt, Shigella flexneri 2a str. 2457T
gcuuuuccauaucaagcau

SEQ ID NO: 3877455 - RNA, 17 nt, Shigella flexneri 2a str. 2457T
gcuuuuccggucagcaa

SEQ ID NO: 3877456 - RNA, 22 nt, Shigella flexneri 2a str. 2457T
gcuuuucuaccaccaaaaccac

SEQ ID NO: 3877457 - RNA, 15 nt, Shigella flexneri 2a str. 2457T
gcuuuugcuugcgau

SEQ ID NO: 3877458 - RNA, 20 nt, Shigella flexneri 2a str. 2457T
gcuuuuuaaucucccgccag

SEQ ID NO: 3877459 - RNA, 18 nt, Shigella flexneri 2a str. 2457T
gcuuuuuaguaucuauuc

SEQ ID NO: 3877460 - RNA, 17 nt, Shigella flexneri 2a str. 2457T
gcuuuuucaauuuccag

SEQ ID NO: 3877461 - RNA, 19 nt, Shigella flexneri 2a str. 2457T
gcuuuuuccaggcuggcag

SEQ ID NO: 3877462 - RNA, 19 nt, Shigella flexneri 2a str. 2457T
gcuuuuucccugguaaaaa

SEQ ID NO: 3877463 - RNA, 13 nt, Shigella flexneri 2a str. 2457T
gcuuuuucgcgau

SEQ ID NO: 3877464 - RNA, 17 nt, Shigella flexneri 2a str. 2457T
gcuuuuucugcuucugc

SEQ ID NO: 3877465 - RNA, 22 nt, Shigella flexneri 2a str. 2457T
gcuuuuugcauuuccgcugauu

SEQ ID NO: 3877466 - RNA, 13 nt, Shigella flexneri 2a str. 2457T
gcuuuuuuaaccg

SEQ ID NO: 3877467 - RNA, 17 nt, Shigella flexneri 2a str. 2457T
gcuuuuuuacaucauca

SEQ ID NO: 3877468 - RNA, 22 nt, Shigella flexneri 2a str. 2457T
gcuuuuuuagguacaaagccaa

SEQ ID NO: 3877469 - RNA, 16 nt, Shigella flexneri 2a str. 2457T
gcuuuuuugagcagca

SEQ ID NO: 3877470 - RNA, 17 nt, Shigella flexneri 2a str. 2457T
gcuuuuuuuacgucugc

SEQ ID NO: 3877471 - RNA, 20 nt, Shigella flexneri 2a str. 2457T
gcuuuuuuuacgucugcaau

SEQ ID NO: 3877472 - RNA, 17 nt, Shigella flexneri 2a str. 2457T
ggaaaaaaauuaacgca

SEQ ID NO: 3877473 - RNA, 14 nt, Shigella flexneri 2a str. 2457T
ggaaaaacggaggc

SEQ ID NO: 3877474 - RNA, 21 nt, Shigella flexneri 2a str. 2457T
ggaaaaagagcagcugauuga

SEQ ID NO: 3877475 - RNA, 20 nt, Shigella flexneri 2a str. 2457T
ggaaaaauuuauugaaagca

SEQ ID NO: 3877476 - RNA, 23 nt, Shigella flexneri 2a str. 2457T
ggaaaacguuucaaacaggcugc

SEQ ID NO: 3877477 - RNA, 18 nt, Shigella flexneri 2a str. 2457T
ggaaaauaaucaugcagc

SEQ ID NO: 3877478 - RNA, 13 nt, Shigella flexneri 2a str. 2457T
ggaaaaucaucuu

SEQ ID NO: 3877479 - RNA, 14 nt, Shigella flexneri 2a str. 2457T
ggaaacccaacgca

SEQ ID NO: 3877480 - RNA, 19 nt, Shigella flexneri 2a str. 2457T
ggaaacccaacgcaaagag

SEQ ID NO: 3877481 - RNA, 17 nt, Shigella flexneri 2a str. 2457T
ggaaacgacuauuaaac

SEQ ID NO: 3877482 - RNA, 17 nt, Shigella flexneri 2a str. 2457T
ggaaacucacgccagca

SEQ ID NO: 3877483 - RNA, 13 nt, Shigella flexneri 2a str. 2457T
ggaaacuccagcc

SEQ ID NO: 3877484 - RNA, 23 nt, Shigella flexneri 2a str. 2457T
ggaaacugucaauaaacgccugc

SEQ ID NO: 3877485 - RNA, 20 nt, Shigella flexneri 2a str. 2457T
ggacgagucgucgauaucga

SEQ ID NO: 3877486 - RNA, 20 nt, Shigella flexneri 2a str. 2457T
ggacgcacaucgcugugcug

SEQ ID NO: 3877487 - RNA, 16 nt, Shigella flexneri 2a str. 2457T
ggacgcugagcacguu

SEQ ID NO: 3877488 - RNA, 22 nt, Shigella flexneri 2a str. 2457T
ggacuccgcaccgccguguucu

SEQ ID NO: 3877489 - RNA, 18 nt, Shigella flexneri 2a str. 2457T
ggacugaaaguacuucac

SEQ ID NO: 3877490 - RNA, 19 nt, Shigella flexneri 2a str. 2457T
ggacuuaaggucacagaag

SEQ ID NO: 3877491 - RNA, 15 nt, Shigella flexneri 2a str. 2457T
ggacuucaucacgau

SEQ ID NO: 3877492 - RNA, 18 nt, Shigella flexneri 2a str. 2457T
ggacuuguuuuugaucuc

SEQ ID NO: 3877493 - RNA, 12 nt, Shigella flexneri 2a str. 2457T
ggagaacgcugc

SEQ ID NO: 3877494 - RNA, 16 nt, Shigella flexneri 2a str. 2457T
ggagaacggacccgcg

SEQ ID NO: 3877495 - RNA, 20 nt, Shigella flexneri 2a str. 2457T
ggagacagcuuagacagcgc

SEQ ID NO: 3877496 - RNA, 16 nt, Shigella flexneri 2a str. 2457T
ggagacauuacgucca

SEQ ID NO: 3877497 - RNA, 22 nt, Shigella flexneri 2a str. 2457T
ggagacauuacguccaucacaa

SEQ ID NO: 3877498 - RNA, 21 nt, Shigella flexneri 2a str. 2457T
ggagacgauucguaaauucgc

SEQ ID NO: 3877499 - RNA, 15 nt, Shigella flexneri 2a str. 2457T
ggagacuaaggcagc

SEQ ID NO: 3877500 - RNA, 13 nt, Shigella flexneri 2a str. 2457T
ggagagggccggg

SEQ ID NO: 3877501 - RNA, 15 nt, Shigella flexneri 2a str. 2457T
ggagagggccggggu

SEQ ID NO: 3877502 - RNA, 19 nt, Shigella flexneri 2a str. 2457T
ggagaguugcaccagcaac

SEQ ID NO: 3877503 - RNA, 19 nt, Shigella flexneri 2a str. 2457T
ggagauaucgccaggccag

SEQ ID NO: 3877504 - RNA, 19 nt, Shigella flexneri 2a str. 2457T
ggagauuaacugggcguca

SEQ ID NO: 3877505 - RNA, 13 nt, Shigella flexneri 2a str. 2457T
ggagcaacaggga

SEQ ID NO: 3877506 - RNA, 22 nt, Shigella flexneri 2a str. 2457T
ggagcagagcauucccgccauc

SEQ ID NO: 3877507 - RNA, 12 nt, Shigella flexneri 2a str. 2457T
ggagcagccccu

SEQ ID NO: 3877508 - RNA, 19 nt, Shigella flexneri 2a str. 2457T
ggagccacauagacgguuu

SEQ ID NO: 3877509 - RNA, 21 nt, Shigella flexneri 2a str. 2457T
ggagccaccuuaugagucaga

SEQ ID NO: 3877510 - RNA, 17 nt, Shigella flexneri 2a str. 2457T
ggagcgaauacuccccu

SEQ ID NO: 3877511 - RNA, 17 nt, Shigella flexneri 2a str. 2457T
ggagcgauuaugaaaca

SEQ ID NO: 3877512 - RNA, 13 nt, Shigella flexneri 2a str. 2457T
ggagcuaaacagc

SEQ ID NO: 3877513 - RNA, 21 nt, Shigella flexneri 2a str. 2457T
ggaggagagugcaaugaaaaa

SEQ ID NO: 3877514 - RNA, 17 nt, Shigella flexneri 2a str. 2457T
ggaggcaagacaugcug

SEQ ID NO: 3877515 - RNA, 20 nt, Shigella flexneri 2a str. 2457T
ggagggauguggcccagccu

SEQ ID NO: 3877516 - RNA, 19 nt, Shigella flexneri 2a str. 2457T
ggagggguuuuugccagca

SEQ ID NO: 3877517 - RNA, 14 nt, Shigella flexneri 2a str. 2457T
ggagguguucauaa

SEQ ID NO: 3877518 - RNA, 23 nt, Shigella flexneri 2a str. 2457T
ggagucagacccugcucuuucag

SEQ ID NO: 3877519 - RNA, 15 nt, Shigella flexneri 2a str. 2457T
ggagugaaaauucuc

SEQ ID NO: 3877520 - RNA, 11 nt, Shigella flexneri 2a str. 2457T
ggagugcagca

SEQ ID NO: 3877521 - RNA, 18 nt, Shigella flexneri 2a str. 2457T
ggauaaacuuggcuauaa

SEQ ID NO: 3877522 - RNA, 13 nt, Shigella flexneri 2a str. 2457T
ggauaaagccccc

SEQ ID NO: 3877523 - RNA, 21 nt, Shigella flexneri 2a str. 2457T
ggauaaagcguucacgccgca

SEQ ID NO: 3877524 - RNA, 19 nt, Shigella flexneri 2a str. 2457T
ggauaaaucuccauuucau

SEQ ID NO: 3877525 - RNA, 20 nt, Shigella flexneri 2a str. 2457T
ggauaacuauggucggucag

SEQ ID NO: 3877526 - RNA, 18 nt, Shigella flexneri 2a str. 2457T
ggauaaggcguuaacgcc

SEQ ID NO: 3877527 - RNA, 21 nt, Shigella flexneri 2a str. 2457T
ggauaaggcguucacgccgca

SEQ ID NO: 3877528 - RNA, 16 nt, Shigella flexneri 2a str. 2457T
ggauaccaccagugcc

SEQ ID NO: 3877529 - RNA, 19 nt, Shigella flexneri 2a str. 2457T
ggauagccucucggcauuu

SEQ ID NO: 3877530 - RNA, 21 nt, Shigella flexneri 2a str. 2457T
ggauagccucucggcauuuau

SEQ ID NO: 3877531 - RNA, 22 nt, Shigella flexneri 2a str. 2457T
ggauaggcuucuauaccaauga

SEQ ID NO: 3877532 - RNA, 21 nt, Shigella flexneri 2a str. 2457T
ggauaucaacguuauucgcuu

SEQ ID NO: 3877533 - RNA, 20 nt, Shigella flexneri 2a str. 2457T
ggauauccacugucaaaucc

SEQ ID NO: 3877534 - RNA, 17 nt, Shigella flexneri 2a str. 2457T
ggauauuuuuuugcaug

SEQ ID NO: 3877535 - RNA, 21 nt, Shigella flexneri 2a str. 2457T
ggaucaacauucagaucgguu

SEQ ID NO: 3877536 - RNA, 21 nt, Shigella flexneri 2a str. 2457T
ggaucaauuaauccuuucgaa

SEQ ID NO: 3877537 - RNA, 14 nt, Shigella flexneri 2a str. 2457T
ggaucacaucgccg

SEQ ID NO: 3877538 - RNA, 21 nt, Shigella flexneri 2a str. 2457T
ggaucaccagaccaauggcuu

SEQ ID NO: 3877539 - RNA, 17 nt, Shigella flexneri 2a str. 2457T
ggaucacuccccgccgu

SEQ ID NO: 3877540 - RNA, 15 nt, Shigella flexneri 2a str. 2457T
ggaucagaaugcgcu

SEQ ID NO: 3877541 - RNA, 20 nt, Shigella flexneri 2a str. 2457T
ggaucagcaaauccaucgcc

SEQ ID NO: 3877542 - RNA, 15 nt, Shigella flexneri 2a str. 2457T
ggaucaguuccagca

SEQ ID NO: 3877543 - RNA, 22 nt, Shigella flexneri 2a str. 2457T
ggaucauccacccgcagcaagc

SEQ ID NO: 3877544 - RNA, 14 nt, Shigella flexneri 2a str. 2457T
ggauccccugcccg

SEQ ID NO: 3877545 - RNA, 13 nt, Shigella flexneri 2a str. 2457T
ggaucgauaccgu

SEQ ID NO: 3877546 - RNA, 12 nt, Shigella flexneri 2a str. 2457T
ggaucgccaggu

SEQ ID NO: 3877547 - RNA, 23 nt, Shigella flexneri 2a str. 2457T
ggaucgcuguccgcuucaccacc

SEQ ID NO: 3877548 - RNA, 12 nt, Shigella flexneri 2a str. 2457T
ggaucggaggca

SEQ ID NO: 3877549 - RNA, 21 nt, Shigella flexneri 2a str. 2457T
ggaucggugcagacacgcaau

SEQ ID NO: 3877550 - RNA, 14 nt, Shigella flexneri 2a str. 2457T
ggaucgugauagua

SEQ ID NO: 3877551 - RNA, 14 nt, Shigella flexneri 2a str. 2457T
ggaucuccagcucc

SEQ ID NO: 3877552 - RNA, 18 nt, Shigella flexneri 2a str. 2457T
ggaucugaugggauuaga

SEQ ID NO: 3877553 - RNA, 21 nt, Shigella flexneri 2a str. 2457T
ggaucuuugccagaucgccug

SEQ ID NO: 3877554 - RNA, 15 nt, Shigella flexneri 2a str. 2457T
ggaugaaaaaauccc

SEQ ID NO: 3877555 - RNA, 12 nt, Shigella flexneri 2a str. 2457T
ggaugacccagc

SEQ ID NO: 3877556 - RNA, 23 nt, Shigella flexneri 2a str. 2457T
ggaugaucgaagauuacgccggu

SEQ ID NO: 3877557 - RNA, 17 nt, Shigella flexneri 2a str. 2457T
ggaugcccccagguugu

SEQ ID NO: 3877558 - RNA, 16 nt, Shigella flexneri 2a str. 2457T
ggaugccucuccuguu

SEQ ID NO: 3877559 - RNA, 23 nt, Shigella flexneri 2a str. 2457T
ggaugccugaugcgacgcugaua

SEQ ID NO: 3877560 - RNA, 18 nt, Shigella flexneri 2a str. 2457T
ggaugcggcguuaacgcc

SEQ ID NO: 3877561 - RNA, 19 nt, Shigella flexneri 2a str. 2457T
ggaugcucucaucacuaca

SEQ ID NO: 3877562 - RNA, 11 nt, Shigella flexneri 2a str. 2457T
ggauggcggcu

SEQ ID NO: 3877563 - RNA, 12 nt, Shigella flexneri 2a str. 2457T
ggauggcggcuu

SEQ ID NO: 3877564 - RNA, 19 nt, Shigella flexneri 2a str. 2457T
ggauggcuggccgugcaga

SEQ ID NO: 3877565 - RNA, 17 nt, Shigella flexneri 2a str. 2457T
ggaugggcguagcuggg

SEQ ID NO: 3877566 - RNA, 22 nt, Shigella flexneri 2a str. 2457T
ggauggucgcuuuguggcggca

SEQ ID NO: 3877567 - RNA, 21 nt, Shigella flexneri 2a str. 2457T
ggaugucgcugcuagggcgcg

SEQ ID NO: 3877568 - RNA, 19 nt, Shigella flexneri 2a str. 2457T
ggauguguuauucagcugg

SEQ ID NO: 3877569 - RNA, 13 nt, Shigella flexneri 2a str. 2457T
ggauguugcugca

SEQ ID NO: 3877570 - RNA, 15 nt, Shigella flexneri 2a str. 2457T
ggauuacaaauaaau

SEQ ID NO: 3877571 - RNA, 17 nt, Shigella flexneri 2a str. 2457T
ggauuacuccccgcaca

SEQ ID NO: 3877572 - RNA, 22 nt, Shigella flexneri 2a str. 2457T
ggauucacguugaugguaggug

SEQ ID NO: 3877573 - RNA, 21 nt, Shigella flexneri 2a str. 2457T
ggauuccagcgccgccagaag

SEQ ID NO: 3877574 - RNA, 22 nt, Shigella flexneri 2a str. 2457T
ggauuccugcgcuuccagcucc

SEQ ID NO: 3877575 - RNA, 19 nt, Shigella flexneri 2a str. 2457T
ggauugcuauuuaacaguu

SEQ ID NO: 3877576 - RNA, 16 nt, Shigella flexneri 2a str. 2457T
ggauugcugaaauaca

SEQ ID NO: 3877577 - RNA, 15 nt, Shigella flexneri 2a str. 2457T
ggauugcuucugcuu

SEQ ID NO: 3877578 - RNA, 20 nt, Shigella flexneri 2a str. 2457T
ggauugugcaggcgcucaua

SEQ ID NO: 3877579 - RNA, 12 nt, Shigella flexneri 2a str. 2457T
ggauuucgcccg

SEQ ID NO: 3877580 - RNA, 13 nt, Shigella flexneri 2a str. 2457T
ggauuugugucag

SEQ ID NO: 3877581 - RNA, 20 nt, Shigella flexneri 2a str. 2457T
ggcaaaaacccuucuuccau

SEQ ID NO: 3877582 - RNA, 22 nt, Shigella flexneri 2a str. 2457T
ggcaggcuucaacacaggccgg

SEQ ID NO: 3877583 - RNA, 15 nt, Shigella flexneri 2a str. 2457T
ggcagggccaccagc

SEQ ID NO: 3877584 - RNA, 15 nt, Shigella flexneri 2a str. 2457T
ggcagguuaaugacc

SEQ ID NO: 3877585 - RNA, 19 nt, Shigella flexneri 2a str. 2457T
ggcaguaccugaccaguga

SEQ ID NO: 3877586 - RNA, 16 nt, Shigella flexneri 2a str. 2457T
ggcaguacgcggcggu

SEQ ID NO: 3877587 - RNA, 20 nt, Shigella flexneri 2a str. 2457T
ggcaguaugcucagaauaug

SEQ ID NO: 3877588 - RNA, 14 nt, Shigella flexneri 2a str. 2457T
ggcagucuggacaa

SEQ ID NO: 3877589 - RNA, 22 nt, Shigella flexneri 2a str. 2457T
ggcagugcuuucauuucagcgu

SEQ ID NO: 3877590 - RNA, 17 nt, Shigella flexneri 2a str. 2457T
ggcaguggugcggcuga

SEQ ID NO: 3877591 - RNA, 20 nt, Shigella flexneri 2a str. 2457T
ggcaguucgucuuuggguuc

SEQ ID NO: 3877592 - RNA, 16 nt, Shigella flexneri 2a str. 2457T
ggcauaaucauuacaa

SEQ ID NO: 3877593 - RNA, 14 nt, Shigella flexneri 2a str. 2457T
ggcauacaacgcca

SEQ ID NO: 3877594 - RNA, 19 nt, Shigella flexneri 2a str. 2457T
ggcauacaacgccaugaag

SEQ ID NO: 3877595 - RNA, 21 nt, Shigella flexneri 2a str. 2457T
ggcauagccaccuggcugcgu

SEQ ID NO: 3877596 - RNA, 20 nt, Shigella flexneri 2a str. 2457T
ggcauauaggucugauuccg

SEQ ID NO: 3877597 - RNA, 21 nt, Shigella flexneri 2a str. 2457T
ggcauauaguggguaacaauu

SEQ ID NO: 3877598 - RNA, 10 nt, Shigella flexneri 2a str. 2457T
ggcaucaaac

SEQ ID NO: 3877599 - RNA, 22 nt, Shigella flexneri 2a str. 2457T
ggcaucaaugaaaggcuuccca

SEQ ID NO: 3877600 - RNA, 18 nt, Shigella flexneri 2a str. 2457T
ggcaucacgaauccgcac

SEQ ID NO: 3877601 - RNA, 23 nt, Shigella flexneri 2a str. 2457T
ggcaucagacaaaugucacugcu

SEQ ID NO: 3877602 - RNA, 13 nt, Shigella flexneri 2a str. 2457T
ggcaucagcaauu

SEQ ID NO: 3877603 - RNA, 13 nt, Shigella flexneri 2a str. 2457T
ggcaucagcagaa

SEQ ID NO: 3877604 - RNA, 12 nt, Shigella flexneri 2a str. 2457T
ggcaucaguaug

SEQ ID NO: 3877605 - RNA, 16 nt, Shigella flexneri 2a str. 2457T
ggcauccagagaucgc

SEQ ID NO: 3877606 - RNA, 19 nt, Shigella flexneri 2a str. 2457T
ggcauccugaucguccugc

SEQ ID NO: 3877607 - RNA, 18 nt, Shigella flexneri 2a str. 2457T
ggcauccuugcuaaccaa

SEQ ID NO: 3877608 - RNA, 16 nt, Shigella flexneri 2a str. 2457T
ggcaucguccauuucu

SEQ ID NO: 3877609 - RNA, 12 nt, Shigella flexneri 2a str. 2457T
ggcaucgugcac

SEQ ID NO: 3877610 - RNA, 19 nt, Shigella flexneri 2a str. 2457T
ggcaucguguugaugcucc

SEQ ID NO: 3877611 - RNA, 14 nt, Shigella flexneri 2a str. 2457T
ggcaucuucuucau

SEQ ID NO: 3877612 - RNA, 12 nt, Shigella flexneri 2a str. 2457T
ggcaugaaagcg

SEQ ID NO: 3877613 - RNA, 12 nt, Shigella flexneri 2a str. 2457T
ggcaugauucau

SEQ ID NO: 3877614 - RNA, 15 nt, Shigella flexneri 2a str. 2457T
ggcaugauucauccg

SEQ ID NO: 3877615 - RNA, 20 nt, Shigella flexneri 2a str. 2457T
ggcaugcagcguaccugggu

SEQ ID NO: 3877616 - RNA, 14 nt, Shigella flexneri 2a str. 2457T
ggcauggcgcuggc

SEQ ID NO: 3877617 - RNA, 22 nt, Shigella flexneri 2a str. 2457T
ggcaugucgguuguacaaaaaa

SEQ ID NO: 3877618 - RNA, 15 nt, Shigella flexneri 2a str. 2457T
ggcauguggcggcgc

SEQ ID NO: 3877619 - RNA, 23 nt, Shigella flexneri 2a str. 2457T
ggcauguggcggcgcgaggcgaa

SEQ ID NO: 3877620 - RNA, 14 nt, Shigella flexneri 2a str. 2457T
ggcauucagauaau

SEQ ID NO: 3877621 - RNA, 12 nt, Shigella flexneri 2a str. 2457T
ggcauucagcca

SEQ ID NO: 3877622 - RNA, 15 nt, Shigella flexneri 2a str. 2457T
ggcauucagugcaaa

SEQ ID NO: 3877623 - RNA, 18 nt, Shigella flexneri 2a str. 2457T
ggcauucucacuccagcc

SEQ ID NO: 3877624 - RNA, 15 nt, Shigella flexneri 2a str. 2457T
ggcauuuacgccgca

SEQ ID NO: 3877625 - RNA, 16 nt, Shigella flexneri 2a str. 2457T
ggcauuuugugcacga

SEQ ID NO: 3877626 - RNA, 22 nt, Shigella flexneri 2a str. 2457T
ggccaaaaccacagugacccgc

SEQ ID NO: 3877627 - RNA, 19 nt, Shigella flexneri 2a str. 2457T
ggccaacguccauaaugcg

SEQ ID NO: 3877628 - RNA, 16 nt, Shigella flexneri 2a str. 2457T
ggccaacuggcaaaag

SEQ ID NO: 3877629 - RNA, 17 nt, Shigella flexneri 2a str. 2457T
ggccaaucagcaauaaa

SEQ ID NO: 3877630 - RNA, 22 nt, Shigella flexneri 2a str. 2457T
ggccaaugccucuacgcccggu

SEQ ID NO: 3877631 - RNA, 19 nt, Shigella flexneri 2a str. 2457T
ggccaauugcugugccgga

SEQ ID NO: 3877632 - RNA, 13 nt, Shigella flexneri 2a str. 2457T
ggccaauuggcug

SEQ ID NO: 3877633 - RNA, 16 nt, Shigella flexneri 2a str. 2457T
ggccaauuggcuggcc

SEQ ID NO: 3877634 - RNA, 20 nt, Shigella flexneri 2a str. 2457T
ggccacaaacgacgggccag

SEQ ID NO: 3877635 - RNA, 14 nt, Shigella flexneri 2a str. 2457T
ggccacagccagcc

SEQ ID NO: 3877636 - RNA, 14 nt, Shigella flexneri 2a str. 2457T
ggccacagcgccag

SEQ ID NO: 3877637 - RNA, 17 nt, Shigella flexneri 2a str. 2457T
ggccacagcgccagaca

SEQ ID NO: 3877638 - RNA, 14 nt, Shigella flexneri 2a str. 2457T
ggccaccaggccac

SEQ ID NO: 3877639 - RNA, 19 nt, Shigella flexneri 2a str. 2457T
ggccaccgaagagacauug

SEQ ID NO: 3877640 - RNA, 21 nt, Shigella flexneri 2a str. 2457T
ggccaccgaagcuuucuugca

SEQ ID NO: 3877641 - RNA, 22 nt, Shigella flexneri 2a str. 2457T
ggccaccgaagcuuucuugcag

SEQ ID NO: 3877642 - RNA, 14 nt, Shigella flexneri 2a str. 2457T
ggccacgacauucg

SEQ ID NO: 3877643 - RNA, 17 nt, Shigella flexneri 2a str. 2457T
ggccacgucauccggaa

SEQ ID NO: 3877644 - RNA, 12 nt, Shigella flexneri 2a str. 2457T
ggccagaaaaaa

SEQ ID NO: 3877645 - RNA, 15 nt, Shigella flexneri 2a str. 2457T
ggccagacauuauaa

SEQ ID NO: 3877646 - RNA, 11 nt, Shigella flexneri 2a str. 2457T
ggccagagcau

SEQ ID NO: 3877647 - RNA, 14 nt, Shigella flexneri 2a str. 2457T
ggccagagcaucag

SEQ ID NO: 3877648 - RNA, 15 nt, Shigella flexneri 2a str. 2457T
ggccagcaaucccca

SEQ ID NO: 3877649 - RNA, 14 nt, Shigella flexneri 2a str. 2457T
ggccagccagagau

SEQ ID NO: 3877650 - RNA, 18 nt, Shigella flexneri 2a str. 2457T
ggccagccauccgucauc

SEQ ID NO: 3877651 - RNA, 12 nt, Shigella flexneri 2a str. 2457T
ggccagccgccg

SEQ ID NO: 3877652 - RNA, 17 nt, Shigella flexneri 2a str. 2457T
ggccagcgccaccacca

SEQ ID NO: 3877653 - RNA, 23 nt, Shigella flexneri 2a str. 2457T
ggccaggaacgggauugccagca

SEQ ID NO: 3877654 - RNA, 17 nt, Shigella flexneri 2a str. 2457T
ggccagguuuucuuuca

SEQ ID NO: 3877655 - RNA, 18 nt, Shigella flexneri 2a str. 2457T
ggccagguuuucuuucac

SEQ ID NO: 3877656 - RNA, 21 nt, Shigella flexneri 2a str. 2457T
ggccagguuuucuuucaccuc

SEQ ID NO: 3877657 - RNA, 22 nt, Shigella flexneri 2a str. 2457T
ggccaguaagcaguccagcgcc

SEQ ID NO: 3877658 - RNA, 13 nt, Shigella flexneri 2a str. 2457T
ggccaguccaggu

SEQ ID NO: 3877659 - RNA, 15 nt, Shigella flexneri 2a str. 2457T
ggccaguuucauagu

SEQ ID NO: 3877660 - RNA, 14 nt, Shigella flexneri 2a str. 2457T
ggccaucagcagcg

SEQ ID NO: 3877661 - RNA, 20 nt, Shigella flexneri 2a str. 2457T
ggccaucagcagcggagaaa

SEQ ID NO: 3877662 - RNA, 13 nt, Shigella flexneri 2a str. 2457T
ggccauccaucaa

SEQ ID NO: 3877663 - RNA, 16 nt, Shigella flexneri 2a str. 2457T
ggccaugcggcgagga

SEQ ID NO: 3877664 - RNA, 21 nt, Shigella flexneri 2a str. 2457T
ggccaugggcgcgauaaugcg

SEQ ID NO: 3877665 - RNA, 14 nt, Shigella flexneri 2a str. 2457T
ggccauuccagcac

SEQ ID NO: 3877666 - RNA, 19 nt, Shigella flexneri 2a str. 2457T
ggccauuccagcacccggc

SEQ ID NO: 3877667 - RNA, 23 nt, Shigella flexneri 2a str. 2457T
ggccauugaauauuuuucgucag

SEQ ID NO: 3877668 - RNA, 16 nt, Shigella flexneri 2a str. 2457T
ggcccaccuggcugag

SEQ ID NO: 3877669 - RNA, 14 nt, Shigella flexneri 2a str. 2457T
ggcccagccgugaa

SEQ ID NO: 3877670 - RNA, 11 nt, Shigella flexneri 2a str. 2457T
ggcccaggcau

SEQ ID NO: 3877671 - RNA, 17 nt, Shigella flexneri 2a str. 2457T
ggcccauaacgccugcu

SEQ ID NO: 3877672 - RNA, 12 nt, Shigella flexneri 2a str. 2457T
ggcccaucaucu

SEQ ID NO: 3877673 - RNA, 13 nt, Shigella flexneri 2a str. 2457T
ggcccaucgccag

SEQ ID NO: 3877674 - RNA, 14 nt, Shigella flexneri 2a str. 2457T
ggcccaucgccagu

SEQ ID NO: 3877675 - RNA, 18 nt, Shigella flexneri 2a str. 2457T
ggcccgacgaugaccgca

SEQ ID NO: 3877676 - RNA, 17 nt, Shigella flexneri 2a str. 2457T
ggcccgcgugccggaag

SEQ ID NO: 3877677 - RNA, 21 nt, Shigella flexneri 2a str. 2457T
ggcccuuucccuucucgucgg

SEQ ID NO: 3877678 - RNA, 19 nt, Shigella flexneri 2a str. 2457T
ggccgaaaaaugcuggauc

SEQ ID NO: 3877679 - RNA, 15 nt, Shigella flexneri 2a str. 2457T
ggccgaagaggaacu

SEQ ID NO: 3877680 - RNA, 17 nt, Shigella flexneri 2a str. 2457T
ggcgcgaaccaucaccu

SEQ ID NO: 3877681 - RNA, 19 nt, Shigella flexneri 2a str. 2457T
ggcgcgcagaaagaggcgg

SEQ ID NO: 3877682 - RNA, 19 nt, Shigella flexneri 2a str. 2457T
ggcgcggaaagcaccugcg

SEQ ID NO: 3877683 - RNA, 15 nt, Shigella flexneri 2a str. 2457T
ggcgcgucagauuga

SEQ ID NO: 3877684 - RNA, 18 nt, Shigella flexneri 2a str. 2457T
ggcgcgucgaaaacggcu

SEQ ID NO: 3877685 - RNA, 16 nt, Shigella flexneri 2a str. 2457T
ggcgcuacgcuaucag

SEQ ID NO: 3877686 - RNA, 19 nt, Shigella flexneri 2a str. 2457T
ggcgcuccugcgggagcgc

SEQ ID NO: 3877687 - RNA, 16 nt, Shigella flexneri 2a str. 2457T
ggcgcugauaaauccc

SEQ ID NO: 3877688 - RNA, 13 nt, Shigella flexneri 2a str. 2457T
ggcgcugaucuua

SEQ ID NO: 3877689 - RNA, 17 nt, Shigella flexneri 2a str. 2457T
ggcgcugaugagcaaau

SEQ ID NO: 3877690 - RNA, 21 nt, Shigella flexneri 2a str. 2457T
ggcgcugcuguacuuuuuccu

SEQ ID NO: 3877691 - RNA, 20 nt, Shigella flexneri 2a str. 2457T
ggcgcuugucgucccaggca

SEQ ID NO: 3877692 - RNA, 20 nt, Shigella flexneri 2a str. 2457T
ggcggaaaucagagauuugc

SEQ ID NO: 3877693 - RNA, 19 nt, Shigella flexneri 2a str. 2457T
ggcggaaaucuuucauuuc

SEQ ID NO: 3877694 - RNA, 15 nt, Shigella flexneri 2a str. 2457T
ggcggaauaccgaca

SEQ ID NO: 3877695 - RNA, 14 nt, Shigella flexneri 2a str. 2457T
ggcggauggcgaau

SEQ ID NO: 3877696 - RNA, 14 nt, Shigella flexneri 2a str. 2457T
ggcggcaaugaaag

SEQ ID NO: 3877697 - RNA, 20 nt, Shigella flexneri 2a str. 2457T
ggcggcaguauagcggcaug

SEQ ID NO: 3877698 - RNA, 13 nt, Shigella flexneri 2a str. 2457T
ggcggcgaagcug

SEQ ID NO: 3877699 - RNA, 12 nt, Shigella flexneri 2a str. 2457T
ggcggcgcgcca

SEQ ID NO: 3877700 - RNA, 13 nt, Shigella flexneri 2a str. 2457T
ggcggcgcggcga

SEQ ID NO: 3877701 - RNA, 17 nt, Shigella flexneri 2a str. 2457T
ggcggcguucagucgcc

SEQ ID NO: 3877702 - RNA, 14 nt, Shigella flexneri 2a str. 2457T
ggcggcucaccugc

SEQ ID NO: 3877703 - RNA, 15 nt, Shigella flexneri 2a str. 2457T
ggcggcucaccugca

SEQ ID NO: 3877704 - RNA, 14 nt, Shigella flexneri 2a str. 2457T
ggcggcucuccuga

SEQ ID NO: 3877705 - RNA, 18 nt, Shigella flexneri 2a str. 2457T
ggcggcuggguuggcaau

SEQ ID NO: 3877706 - RNA, 21 nt, Shigella flexneri 2a str. 2457T
ggcgggaucaccugcacaugc

SEQ ID NO: 3877707 - RNA, 22 nt, Shigella flexneri 2a str. 2457T
ggcgggaucaccugcacaugca

SEQ ID NO: 3877708 - RNA, 16 nt, Shigella flexneri 2a str. 2457T
ggcgggcaacguucca

SEQ ID NO: 3877709 - RNA, 18 nt, Shigella flexneri 2a str. 2457T
ggcgggcaagcggcggca

SEQ ID NO: 3877710 - RNA, 17 nt, Shigella flexneri 2a str. 2457T
ggcggucagcgccagcg

SEQ ID NO: 3877711 - RNA, 19 nt, Shigella flexneri 2a str. 2457T
ggcggucaugacgauacgg

SEQ ID NO: 3877712 - RNA, 17 nt, Shigella flexneri 2a str. 2457T
ggcggugaccagcagca

SEQ ID NO: 3877713 - RNA, 18 nt, Shigella flexneri 2a str. 2457T
ggcggugccaucgauaau

SEQ ID NO: 3877714 - RNA, 17 nt, Shigella flexneri 2a str. 2457T
ggcgguuaauaaugauu

SEQ ID NO: 3877715 - RNA, 12 nt, Shigella flexneri 2a str. 2457T
ggcguaaacgcc

SEQ ID NO: 3877716 - RNA, 18 nt, Shigella flexneri 2a str. 2457T
ggcguaaacgccuuaucc

SEQ ID NO: 3877717 - RNA, 20 nt, Shigella flexneri 2a str. 2457T
ggcguacugaccgucgccuu

SEQ ID NO: 3877718 - RNA, 18 nt, Shigella flexneri 2a str. 2457T
ggcguagugcccgcagua

SEQ ID NO: 3877719 - RNA, 23 nt, Shigella flexneri 2a str. 2457T
ggcgucaacaacacucucugaag

SEQ ID NO: 3877720 - RNA, 14 nt, Shigella flexneri 2a str. 2457T
ggcguccaccugcg

SEQ ID NO: 3877721 - RNA, 13 nt, Shigella flexneri 2a str. 2457T
ggcguccagaugc

SEQ ID NO: 3877722 - RNA, 13 nt, Shigella flexneri 2a str. 2457T
ggcguccagugcc

SEQ ID NO: 3877723 - RNA, 19 nt, Shigella flexneri 2a str. 2457T
ggcgucgcauccggcacua

SEQ ID NO: 3877724 - RNA, 18 nt, Shigella flexneri 2a str. 2457T
ggcgugaacgccuuaucc

SEQ ID NO: 3877725 - RNA, 14 nt, Shigella flexneri 2a str. 2457T
ggcgugaacgcgcu

SEQ ID NO: 3877726 - RNA, 22 nt, Shigella flexneri 2a str. 2457T
ggcgugagaucgcgcgggagca

SEQ ID NO: 3877727 - RNA, 21 nt, Shigella flexneri 2a str. 2457T
ggcgugauucauacagcggcc

SEQ ID NO: 3877728 - RNA, 17 nt, Shigella flexneri 2a str. 2457T
ggcgugauuccagacgg

SEQ ID NO: 3877729 - RNA, 20 nt, Shigella flexneri 2a str. 2457T
ggcguggcccuaggcauaga

SEQ ID NO: 3877730 - RNA, 19 nt, Shigella flexneri 2a str. 2457T
ggcguuaacgccgcauccg

SEQ ID NO: 3877731 - RNA, 18 nt, Shigella flexneri 2a str. 2457T
ggcguuagucgucgccga

SEQ ID NO: 3877732 - RNA, 14 nt, Shigella flexneri 2a str. 2457T
ggcguuaucacguu

SEQ ID NO: 3877733 - RNA, 20 nt, Shigella flexneri 2a str. 2457T
ggcguuaucggguccgggca

SEQ ID NO: 3877734 - RNA, 17 nt, Shigella flexneri 2a str. 2457T
ggcguuaugccuguaau

SEQ ID NO: 3877735 - RNA, 21 nt, Shigella flexneri 2a str. 2457T
ggcguucacgccgcauccgac

SEQ ID NO: 3877736 - RNA, 18 nt, Shigella flexneri 2a str. 2457T
ggcguuuacgccgcauca

SEQ ID NO: 3877737 - RNA, 20 nt, Shigella flexneri 2a str. 2457T
ggcguuuguaacccaccaug

SEQ ID NO: 3877738 - RNA, 12 nt, Shigella flexneri 2a str. 2457T
ggcuaaaaaaag

SEQ ID NO: 3877739 - RNA, 21 nt, Shigella flexneri 2a str. 2457T
ggcuaacacccgucguugcaa

SEQ ID NO: 3877740 - RNA, 17 nt, Shigella flexneri 2a str. 2457T
ggcuaaccgcuuuucca

SEQ ID NO: 3877741 - RNA, 20 nt, Shigella flexneri 2a str. 2457T
ggcuaaccgucugugugccu

SEQ ID NO: 3877742 - RNA, 13 nt, Shigella flexneri 2a str. 2457T
ggcuaaucgccag

SEQ ID NO: 3877743 - RNA, 19 nt, Shigella flexneri 2a str. 2457T
ggcuaaucuugaaaccaga

SEQ ID NO: 3877744 - RNA, 23 nt, Shigella flexneri 2a str. 2457T
ggcuaauucuguuuuaucagacc

SEQ ID NO: 3877745 - RNA, 14 nt, Shigella flexneri 2a str. 2457T
ggcuaccgcaguga

SEQ ID NO: 3877746 - RNA, 22 nt, Shigella flexneri 2a str. 2457T
ggcuauaaucacucaaaauauc

SEQ ID NO: 3877747 - RNA, 21 nt, Shigella flexneri 2a str. 2457T
ggcuaucucaccccauuugcc

SEQ ID NO: 3877748 - RNA, 23 nt, Shigella flexneri 2a str. 2457T
ggcuauuagaaauuccuaugcaa

SEQ ID NO: 3877749 - RNA, 20 nt, Shigella flexneri 2a str. 2457T
ggcuauuccacgcaucaagc

SEQ ID NO: 3877750 - RNA, 14 nt, Shigella flexneri 2a str. 2457T
ggcucaaucgccac

SEQ ID NO: 3877751 - RNA, 15 nt, Shigella flexneri 2a str. 2457T
ggcucaaucgccacc

SEQ ID NO: 3877752 - RNA, 14 nt, Shigella flexneri 2a str. 2457T
ggcucagccgauga

SEQ ID NO: 3877753 - RNA, 12 nt, Shigella flexneri 2a str. 2457T
ggcucagcucug

SEQ ID NO: 3877754 - RNA, 23 nt, Shigella flexneri 2a str. 2457T
ggcucagcucuggcacaugcaua

SEQ ID NO: 3877755 - RNA, 16 nt, Shigella flexneri 2a str. 2457T
ggcucauaccuuccac

SEQ ID NO: 3877756 - RNA, 20 nt, Shigella flexneri 2a str. 2457T
ggcucauccccugaugcugu

SEQ ID NO: 3877757 - RNA, 14 nt, Shigella flexneri 2a str. 2457T
ggcucaucggguaa

SEQ ID NO: 3877758 - RNA, 21 nt, Shigella flexneri 2a str. 2457T
ggcucaucucuucgguuggca

SEQ ID NO: 3877759 - RNA, 20 nt, Shigella flexneri 2a str. 2457T
ggcucaugcuguccagguua

SEQ ID NO: 3877760 - RNA, 14 nt, Shigella flexneri 2a str. 2457T
ggcuccgcaagcga

SEQ ID NO: 3877761 - RNA, 21 nt, Shigella flexneri 2a str. 2457T
ggcuccgggaaaacgcuggca

SEQ ID NO: 3877762 - RNA, 18 nt, Shigella flexneri 2a str. 2457T
ggcuccgggcgcaccagu

SEQ ID NO: 3877763 - RNA, 16 nt, Shigella flexneri 2a str. 2457T
ggcuccucugacugga

SEQ ID NO: 3877764 - RNA, 14 nt, Shigella flexneri 2a str. 2457T
ggcucgaucuggug

SEQ ID NO: 3877765 - RNA, 18 nt, Shigella flexneri 2a str. 2457T
ggcucgccauccagugaa

SEQ ID NO: 3877766 - RNA, 22 nt, Shigella flexneri 2a str. 2457T
ggcucuuaagcaccgacguuga

SEQ ID NO: 3877767 - RNA, 18 nt, Shigella flexneri 2a str. 2457T
ggcucuucgcuccaguca

SEQ ID NO: 3877768 - RNA, 18 nt, Shigella flexneri 2a str. 2457T
ggcucuuuuucggggcug

SEQ ID NO: 3877769 - RNA, 21 nt, Shigella flexneri 2a str. 2457T
ggcugacacuauucgccagca

SEQ ID NO: 3877770 - RNA, 18 nt, Shigella flexneri 2a str. 2457T
ggcugacauuaucagaca

SEQ ID NO: 3877771 - RNA, 22 nt, Shigella flexneri 2a str. 2457T
ggcugacugcuuugcacaggca

SEQ ID NO: 3877772 - RNA, 20 nt, Shigella flexneri 2a str. 2457T
ggcugagcaaacaguucugc

SEQ ID NO: 3877773 - RNA, 10 nt, Shigella flexneri 2a str. 2457T
ggcugcagca

SEQ ID NO: 3877774 - RNA, 13 nt, Shigella flexneri 2a str. 2457T
ggcugccagcucu

SEQ ID NO: 3877775 - RNA, 14 nt, Shigella flexneri 2a str. 2457T
ggcugccagcucuc

SEQ ID NO: 3877776 - RNA, 20 nt, Shigella flexneri 2a str. 2457T
ggcugccggaaggcagccuu

SEQ ID NO: 3877777 - RNA, 17 nt, Shigella flexneri 2a str. 2457T
gggcgacaaucaucgcc

SEQ ID NO: 3877778 - RNA, 18 nt, Shigella flexneri 2a str. 2457T
gggcgagguggauauaaa

SEQ ID NO: 3877779 - RNA, 20 nt, Shigella flexneri 2a str. 2457T
gggcgauaaaucuccacccg

SEQ ID NO: 3877780 - RNA, 13 nt, Shigella flexneri 2a str. 2457T
gggcgauccggca

SEQ ID NO: 3877781 - RNA, 11 nt, Shigella flexneri 2a str. 2457T
gggcgcgggcg

SEQ ID NO: 3877782 - RNA, 20 nt, Shigella flexneri 2a str. 2457T
gggcggaacuucgcgaguga

SEQ ID NO: 3877783 - RNA, 23 nt, Shigella flexneri 2a str. 2457T
gggcggagaugcggaaauaucgg

SEQ ID NO: 3877784 - RNA, 20 nt, Shigella flexneri 2a str. 2457T
gggcguccugcuugccagau

SEQ ID NO: 3877785 - RNA, 20 nt, Shigella flexneri 2a str. 2457T
gggcuauauacccuucucag

SEQ ID NO: 3877786 - RNA, 21 nt, Shigella flexneri 2a str. 2457T
gggcugacguuaagaaaacgg

SEQ ID NO: 3877787 - RNA, 21 nt, Shigella flexneri 2a str. 2457T
gggcuggaaacgcgaucgcca

SEQ ID NO: 3877788 - RNA, 12 nt, Shigella flexneri 2a str. 2457T
gggcuggccaau

SEQ ID NO: 3877789 - RNA, 22 nt, Shigella flexneri 2a str. 2457T
gggcuguauacgcgccacauca

SEQ ID NO: 3877790 - RNA, 18 nt, Shigella flexneri 2a str. 2457T
gggcuuuauucaccagua

SEQ ID NO: 3877791 - RNA, 21 nt, Shigella flexneri 2a str. 2457T
gggcuuucaucacuugaucca

SEQ ID NO: 3877792 - RNA, 21 nt, Shigella flexneri 2a str. 2457T
gggcuuuuuuuauuauuccgu

SEQ ID NO: 3877793 - RNA, 14 nt, Shigella flexneri 2a str. 2457T
ggggauaagaauau

SEQ ID NO: 3877794 - RNA, 14 nt, Shigella flexneri 2a str. 2457T
ggggaugcugaaaa

SEQ ID NO: 3877795 - RNA, 16 nt, Shigella flexneri 2a str. 2457T
ggggauguuggcgaau

SEQ ID NO: 3877796 - RNA, 23 nt, Shigella flexneri 2a str. 2457T
ggggauuuucacugugcuuuaca

SEQ ID NO: 3877797 - RNA, 20 nt, Shigella flexneri 2a str. 2457T
gggggcuaaucuugaaacca

SEQ ID NO: 3877798 - RNA, 12 nt, Shigella flexneri 2a str. 2457T
ggggugucggug

SEQ ID NO: 3877799 - RNA, 13 nt, Shigella flexneri 2a str. 2457T
gggguuacgaccu

SEQ ID NO: 3877800 - RNA, 21 nt, Shigella flexneri 2a str. 2457T
ggguaaaaccccgcguacuga

SEQ ID NO: 3877801 - RNA, 21 nt, Shigella flexneri 2a str. 2457T
ggguacagcacgaugaaucug

SEQ ID NO: 3877802 - RNA, 20 nt, Shigella flexneri 2a str. 2457T
ggguauaaaacucaccgcgc

SEQ ID NO: 3877803 - RNA, 21 nt, Shigella flexneri 2a str. 2457T
ggguauggaucccucuuucug

SEQ ID NO: 3877804 - RNA, 14 nt, Shigella flexneri 2a str. 2457T
gggucaggccagga

SEQ ID NO: 3877805 - RNA, 19 nt, Shigella flexneri 2a str. 2457T
gggucuuccagcaaaucca

SEQ ID NO: 3877806 - RNA, 22 nt, Shigella flexneri 2a str. 2457T
gggugaccgaaggcgauaucug

SEQ ID NO: 3877807 - RNA, 19 nt, Shigella flexneri 2a str. 2457T
gggugagggcguagagaga

SEQ ID NO: 3877808 - RNA, 20 nt, Shigella flexneri 2a str. 2457T
gggugauuguucgcaccggu

SEQ ID NO: 3877809 - RNA, 21 nt, Shigella flexneri 2a str. 2457T
gggugcgaauaagcugcguga

SEQ ID NO: 3877810 - RNA, 22 nt, Shigella flexneri 2a str. 2457T
gggugcgacaggagccgcagua

SEQ ID NO: 3877811 - RNA, 19 nt, Shigella flexneri 2a str. 2457T
ggguguauucaugcccugc

SEQ ID NO: 3877812 - RNA, 17 nt, Shigella flexneri 2a str. 2457T
ggguucaaaaacuaauu

SEQ ID NO: 3877813 - RNA, 18 nt, Shigella flexneri 2a str. 2457T
ggguuucgccugccagau

SEQ ID NO: 3877814 - RNA, 18 nt, Shigella flexneri 2a str. 2457T
ggguuuugcccagcguua

SEQ ID NO: 3877815 - RNA, 18 nt, Shigella flexneri 2a str. 2457T
ggguuuuucgcgcgggca

SEQ ID NO: 3877816 - RNA, 16 nt, Shigella flexneri 2a str. 2457T
ggguuuuugccagcaa

SEQ ID NO: 3877817 - RNA, 21 nt, Shigella flexneri 2a str. 2457T
gguaaaauggucagccagcgg

SEQ ID NO: 3877818 - RNA, 14 nt, Shigella flexneri 2a str. 2457T
gguaaacauccguu

SEQ ID NO: 3877819 - RNA, 12 nt, Shigella flexneri 2a str. 2457T
gguaaagaagag

SEQ ID NO: 3877820 - RNA, 15 nt, Shigella flexneri 2a str. 2457T
gguaaagccgugcug

SEQ ID NO: 3877821 - RNA, 23 nt, Shigella flexneri 2a str. 2457T
gguaaagccgugcugcugccaaa

SEQ ID NO: 3877822 - RNA, 17 nt, Shigella flexneri 2a str. 2457T
gguaacauacuccaccc

SEQ ID NO: 3877823 - RNA, 12 nt, Shigella flexneri 2a str. 2457T
gguaacauccag

SEQ ID NO: 3877824 - RNA, 19 nt, Shigella flexneri 2a str. 2457T
gguaaccccucuucagccc

SEQ ID NO: 3877825 - RNA, 22 nt, Shigella flexneri 2a str. 2457T
gguaacggcgucaacaccgggu

SEQ ID NO: 3877826 - RNA, 13 nt, Shigella flexneri 2a str. 2457T
gguaagcaaaggu

SEQ ID NO: 3877827 - RNA, 15 nt, Shigella flexneri 2a str. 2457T
gguaagccgccggua

SEQ ID NO: 3877828 - RNA, 14 nt, Shigella flexneri 2a str. 2457T
gguaaggugauuag

SEQ ID NO: 3877829 - RNA, 22 nt, Shigella flexneri 2a str. 2457T
gguaauacuaaucucacccaua

SEQ ID NO: 3877830 - RNA, 14 nt, Shigella flexneri 2a str. 2457T
gguaaugccaguca

SEQ ID NO: 3877831 - RNA, 22 nt, Shigella flexneri 2a str. 2457T
gguaaugccagucaguuaagca

SEQ ID NO: 3877832 - RNA, 14 nt, Shigella flexneri 2a str. 2457T
gguaauugaucuca

SEQ ID NO: 3877833 - RNA, 14 nt, Shigella flexneri 2a str. 2457T
gguacaaacaucau

SEQ ID NO: 3877834 - RNA, 17 nt, Shigella flexneri 2a str. 2457T
gguacaaacaucaucca

SEQ ID NO: 3877835 - RNA, 13 nt, Shigella flexneri 2a str. 2457T
gguacaaagccaa

SEQ ID NO: 3877836 - RNA, 16 nt, Shigella flexneri 2a str. 2457T
gguacaaagccaacag

SEQ ID NO: 3877837 - RNA, 12 nt, Shigella flexneri 2a str. 2457T
gguacaaccgca

SEQ ID NO: 3877838 - RNA, 22 nt, Shigella flexneri 2a str. 2457T
gguaccguugaccaguccggcu

SEQ ID NO: 3877839 - RNA, 18 nt, Shigella flexneri 2a str. 2457T
gguacgaaaagggcugga

SEQ ID NO: 3877840 - RNA, 23 nt, Shigella flexneri 2a str. 2457T
gguacgaauacggauauguuuac

SEQ ID NO: 3877841 - RNA, 22 nt, Shigella flexneri 2a str. 2457T
gguacgcaauuccagcaagcca

SEQ ID NO: 3877842 - RNA, 19 nt, Shigella flexneri 2a str. 2457T
gguacgccuuaguuauaaa

SEQ ID NO: 3877843 - RNA, 19 nt, Shigella flexneri 2a str. 2457T
gguacuucgauuucgccac

SEQ ID NO: 3877844 - RNA, 13 nt, Shigella flexneri 2a str. 2457T
gguagaagccagu

SEQ ID NO: 3877845 - RNA, 13 nt, Shigella flexneri 2a str. 2457T
gguagagaaguuu

SEQ ID NO: 3877846 - RNA, 15 nt, Shigella flexneri 2a str. 2457T
gguagagguuauaaa

SEQ ID NO: 3877847 - RNA, 23 nt, Shigella flexneri 2a str. 2457T
gguagagguuauaaauaaaaauu

SEQ ID NO: 3877848 - RNA, 20 nt, Shigella flexneri 2a str. 2457T
gguagauuauuucgcugcgg

SEQ ID NO: 3877849 - RNA, 16 nt, Shigella flexneri 2a str. 2457T
gguagcgcauaagcca

SEQ ID NO: 3877850 - RNA, 12 nt, Shigella flexneri 2a str. 2457T
gguagcggguga

SEQ ID NO: 3877851 - RNA, 15 nt, Shigella flexneri 2a str. 2457T
gguagggauaucuuc

SEQ ID NO: 3877852 - RNA, 16 nt, Shigella flexneri 2a str. 2457T
gguagucgcgguccgg

SEQ ID NO: 3877853 - RNA, 18 nt, Shigella flexneri 2a str. 2457T
gguagugccgucagcagg

SEQ ID NO: 3877854 - RNA, 17 nt, Shigella flexneri 2a str. 2457T
gguauacgucccgguga

SEQ ID NO: 3877855 - RNA, 18 nt, Shigella flexneri 2a str. 2457T
gguauagaagccauccag

SEQ ID NO: 3877856 - RNA, 15 nt, Shigella flexneri 2a str. 2457T
gguaucaaacacagg

SEQ ID NO: 3877857 - RNA, 11 nt, Shigella flexneri 2a str. 2457T
gguaucaaacc

SEQ ID NO: 3877858 - RNA, 18 nt, Shigella flexneri 2a str. 2457T
gguaucgcgccagccagu

SEQ ID NO: 3877859 - RNA, 13 nt, Shigella flexneri 2a str. 2457T
gguauggaguuua

SEQ ID NO: 3877860 - RNA, 16 nt, Shigella flexneri 2a str. 2457T
gguauuaaucugccag

SEQ ID NO: 3877861 - RNA, 22 nt, Shigella flexneri 2a str. 2457T
gguauuaccaccggacaucgca

SEQ ID NO: 3877862 - RNA, 22 nt, Shigella flexneri 2a str. 2457T
gguauuagcgcaaagacggaug

SEQ ID NO: 3877863 - RNA, 15 nt, Shigella flexneri 2a str. 2457T
gguauuaguggcaac

SEQ ID NO: 3877864 - RNA, 19 nt, Shigella flexneri 2a str. 2457T
gguauucaaccguuuccag

SEQ ID NO: 3877865 - RNA, 15 nt, Shigella flexneri 2a str. 2457T
gguauugcuucucag

SEQ ID NO: 3877866 - RNA, 13 nt, Shigella flexneri 2a str. 2457T
gguauuggcggca

SEQ ID NO: 3877867 - RNA, 15 nt, Shigella flexneri 2a str. 2457T
ggucaaaaaaugaaa

SEQ ID NO: 3877868 - RNA, 14 nt, Shigella flexneri 2a str. 2457T
ggucaaaagcugca

SEQ ID NO: 3877869 - RNA, 22 nt, Shigella flexneri 2a str. 2457T
ggucaacauucccugcaccggu

SEQ ID NO: 3877870 - RNA, 22 nt, Shigella flexneri 2a str. 2457T
ggucaauguugaggcuaccgga

SEQ ID NO: 3877871 - RNA, 15 nt, Shigella flexneri 2a str. 2457T
ggucacaucgcugac

SEQ ID NO: 3877872 - RNA, 13 nt, Shigella flexneri 2a str. 2457T
ggucaccaguuca

SEQ ID NO: 3877873 - RNA, 18 nt, Shigella flexneri 2a str. 2457T
ggucaccaguucacgcga

SEQ ID NO: 3877874 - RNA, 12 nt, Shigella flexneri 2a str. 2457T
ggugucgauacc

SEQ ID NO: 3877875 - RNA, 21 nt, Shigella flexneri 2a str. 2457T
ggugucgccuuccacuucugc

SEQ ID NO: 3877876 - RNA, 20 nt, Shigella flexneri 2a str. 2457T
ggugucguauucucaauaaa

SEQ ID NO: 3877877 - RNA, 19 nt, Shigella flexneri 2a str. 2457T
ggugucguuacgccgcaga

SEQ ID NO: 3877878 - RNA, 21 nt, Shigella flexneri 2a str. 2457T
gguguguauccguuuuacugg

SEQ ID NO: 3877879 - RNA, 16 nt, Shigella flexneri 2a str. 2457T
gguguucacgccgcau

SEQ ID NO: 3877880 - RNA, 20 nt, Shigella flexneri 2a str. 2457T
gguguucagauggccaauaa

SEQ ID NO: 3877881 - RNA, 22 nt, Shigella flexneri 2a str. 2457T
gguguucauccuggcacagcag

SEQ ID NO: 3877882 - RNA, 22 nt, Shigella flexneri 2a str. 2457T
gguguugcguuuuuaucuucac

SEQ ID NO: 3877883 - RNA, 16 nt, Shigella flexneri 2a str. 2457T
gguguuuaaccaacac

SEQ ID NO: 3877884 - RNA, 15 nt, Shigella flexneri 2a str. 2457T
gguguuuaguuucgu

SEQ ID NO: 3877885 - RNA, 13 nt, Shigella flexneri 2a str. 2457T
gguguuugacugu

SEQ ID NO: 3877886 - RNA, 13 nt, Shigella flexneri 2a str. 2457T
gguuaaaaacagc

SEQ ID NO: 3877887 - RNA, 20 nt, Shigella flexneri 2a str. 2457T
gguuaacaaucacaauagaa

SEQ ID NO: 3877888 - RNA, 18 nt, Shigella flexneri 2a str. 2457T
gguuaacaucaugucggc

SEQ ID NO: 3877889 - RNA, 12 nt, Shigella flexneri 2a str. 2457T
gguuaaccagca

SEQ ID NO: 3877890 - RNA, 17 nt, Shigella flexneri 2a str. 2457T
gguuaacuguggcguua

SEQ ID NO: 3877891 - RNA, 20 nt, Shigella flexneri 2a str. 2457T
gguuaagccucacgguucau

SEQ ID NO: 3877892 - RNA, 16 nt, Shigella flexneri 2a str. 2457T
gguuaaucggcaggga

SEQ ID NO: 3877893 - RNA, 17 nt, Shigella flexneri 2a str. 2457T
gguuaauuaccuuauca

SEQ ID NO: 3877894 - RNA, 18 nt, Shigella flexneri 2a str. 2457T
gguuaccgacugcggccu

SEQ ID NO: 3877895 - RNA, 14 nt, Shigella flexneri 2a str. 2457T
gguuaguaugaaga

SEQ ID NO: 3877896 - RNA, 21 nt, Shigella flexneri 2a str. 2457T
gguuagucugcauuuucucgc

SEQ ID NO: 3877897 - RNA, 13 nt, Shigella flexneri 2a str. 2457T
gguuauauuuccc

SEQ ID NO: 3877898 - RNA, 14 nt, Shigella flexneri 2a str. 2457T
gguucaaaguaaua

SEQ ID NO: 3877899 - RNA, 16 nt, Shigella flexneri 2a str. 2457T
gguucaauaucuuccu

SEQ ID NO: 3877900 - RNA, 22 nt, Shigella flexneri 2a str. 2457T
gguucaccgcgagcauaggcau

SEQ ID NO: 3877901 - RNA, 13 nt, Shigella flexneri 2a str. 2457T
gguucaccgguga

SEQ ID NO: 3877902 - RNA, 23 nt, Shigella flexneri 2a str. 2457T
gguucaucgugcuguuugaaaug

SEQ ID NO: 3877903 - RNA, 11 nt, Shigella flexneri 2a str. 2457T
gguuccagcuu

SEQ ID NO: 3877904 - RNA, 23 nt, Shigella flexneri 2a str. 2457T
gguuccccccacaaucagccaga

SEQ ID NO: 3877905 - RNA, 21 nt, Shigella flexneri 2a str. 2457T
gguucguaagcgauaaccgca

SEQ ID NO: 3877906 - RNA, 14 nt, Shigella flexneri 2a str. 2457T
gguucugcggguua

SEQ ID NO: 3877907 - RNA, 20 nt, Shigella flexneri 2a str. 2457T
gguucugcggguuagucugc

SEQ ID NO: 3877908 - RNA, 21 nt, Shigella flexneri 2a str. 2457T
gguucuuuggucaggcgcuga

SEQ ID NO: 3877909 - RNA, 13 nt, Shigella flexneri 2a str. 2457T
gguugaacccuuu

SEQ ID NO: 3877910 - RNA, 16 nt, Shigella flexneri 2a str. 2457T
gguugaccuggaagga

SEQ ID NO: 3877911 - RNA, 13 nt, Shigella flexneri 2a str. 2457T
gguugacugcuga

SEQ ID NO: 3877912 - RNA, 13 nt, Shigella flexneri 2a str. 2457T
gguugauggcagu

SEQ ID NO: 3877913 - RNA, 23 nt, Shigella flexneri 2a str. 2457T
gguugccagcgccaacgcaccug

SEQ ID NO: 3877914 - RNA, 21 nt, Shigella flexneri 2a str. 2457T
gguugccauuaauaaccgaau

SEQ ID NO: 3877915 - RNA, 18 nt, Shigella flexneri 2a str. 2457T
gguugcuggaaagagaaa

SEQ ID NO: 3877916 - RNA, 13 nt, Shigella flexneri 2a str. 2457T
gguuggcgugcgg

SEQ ID NO: 3877917 - RNA, 14 nt, Shigella flexneri 2a str. 2457T
gguuggcucaucaa

SEQ ID NO: 3877918 - RNA, 16 nt, Shigella flexneri 2a str. 2457T
gguugguacuguggca

SEQ ID NO: 3877919 - RNA, 14 nt, Shigella flexneri 2a str. 2457T
gguuuaaacagaga

SEQ ID NO: 3877920 - RNA, 23 nt, Shigella flexneri 2a str. 2457T
gguuuaagacaauuuaauaagaa

SEQ ID NO: 3877921 - RNA, 21 nt, Shigella flexneri 2a str. 2457T
gguuuacccgcuugaguauuu

SEQ ID NO: 3877922 - RNA, 19 nt, Shigella flexneri 2a str. 2457T
gguuucaagauuagccccc

SEQ ID NO: 3877923 - RNA, 20 nt, Shigella flexneri 2a str. 2457T
gguuucaagauuagcccccg

SEQ ID NO: 3877924 - RNA, 14 nt, Shigella flexneri 2a str. 2457T
gguuucaauuuccc

SEQ ID NO: 3877925 - RNA, 19 nt, Shigella flexneri 2a str. 2457T
gguuuccacaugguuggcc

SEQ ID NO: 3877926 - RNA, 19 nt, Shigella flexneri 2a str. 2457T
gguuucgugaaacucagca

SEQ ID NO: 3877927 - RNA, 12 nt, Shigella flexneri 2a str. 2457T
gguuucgugcau

SEQ ID NO: 3877928 - RNA, 11 nt, Shigella flexneri 2a str. 2457T
gguuucuuuuu

SEQ ID NO: 3877929 - RNA, 16 nt, Shigella flexneri 2a str. 2457T
gguuugaaaaaaccug

SEQ ID NO: 3877930 - RNA, 14 nt, Shigella flexneri 2a str. 2457T
gguuuguuauccac

SEQ ID NO: 3877931 - RNA, 11 nt, Shigella flexneri 2a str. 2457T
gguuuuaucca

SEQ ID NO: 3877932 - RNA, 23 nt, Shigella flexneri 2a str. 2457T
gguuuuauuauuccauccugcuc

SEQ ID NO: 3877933 - RNA, 12 nt, Shigella flexneri 2a str. 2457T
gguuuucaaucg

SEQ ID NO: 3877934 - RNA, 22 nt, Shigella flexneri 2a str. 2457T
gguuuucaaucgacuuuucaua

SEQ ID NO: 3877935 - RNA, 13 nt, Shigella flexneri 2a str. 2457T
gguuuucaaugau

SEQ ID NO: 3877936 - RNA, 19 nt, Shigella flexneri 2a str. 2457T
gguuuucgcgccagccagu

SEQ ID NO: 3877937 - RNA, 18 nt, Shigella flexneri 2a str. 2457T
gguuuucgcgcgcaguua

SEQ ID NO: 3877938 - RNA, 19 nt, Shigella flexneri 2a str. 2457T
gguuuucucccucgcucug

SEQ ID NO: 3877939 - RNA, 20 nt, Shigella flexneri 2a str. 2457T
gguuuugcccacagagcuga

SEQ ID NO: 3877940 - RNA, 15 nt, Shigella flexneri 2a str. 2457T
gguuuuguuuaaaua

SEQ ID NO: 3877941 - RNA, 20 nt, Shigella flexneri 2a str. 2457T
gguuuuucuugguucugcac

SEQ ID NO: 3877942 - RNA, 20 nt, Shigella flexneri 2a str. 2457T
gguuuuuguuuugagcacuc

SEQ ID NO: 3877943 - RNA, 22 nt, Shigella flexneri 2a str. 2457T
gguuuuuuauuaauucuaaaac

SEQ ID NO: 3877944 - RNA, 20 nt, Shigella flexneri 2a str. 2457T
gguuuuuuauuuaagcuggg

SEQ ID NO: 3877945 - RNA, 15 nt, Shigella flexneri 2a str. 2457T
gguuuuuugaacaga

SEQ ID NO: 3877946 - RNA, 14 nt, Shigella flexneri 2a str. 2457T
gguuuuuuucgaac

SEQ ID NO: 3877947 - RNA, 16 nt, Shigella flexneri 2a str. 2457T
guaaaaacgcauuuau

SEQ ID NO: 3877948 - RNA, 12 nt, Shigella flexneri 2a str. 2457T
guaaaaagaaag

SEQ ID NO: 3877949 - RNA, 15 nt, Shigella flexneri 2a str. 2457T
guaaaaagaaaguuu

SEQ ID NO: 3877950 - RNA, 20 nt, Shigella flexneri 2a str. 2457T
guaaaaagaaaguuugcaga

SEQ ID NO: 3877951 - RNA, 15 nt, Shigella flexneri 2a str. 2457T
guaaaaccaugccau

SEQ ID NO: 3877952 - RNA, 21 nt, Shigella flexneri 2a str. 2457T
guaaaaccgacuuaaaaggaa

SEQ ID NO: 3877953 - RNA, 16 nt, Shigella flexneri 2a str. 2457T
guaaaaccgauauguu

SEQ ID NO: 3877954 - RNA, 21 nt, Shigella flexneri 2a str. 2457T
guaaaaccgcgaugaccaaaa

SEQ ID NO: 3877955 - RNA, 12 nt, Shigella flexneri 2a str. 2457T
guaaaaccugac

SEQ ID NO: 3877956 - RNA, 18 nt, Shigella flexneri 2a str. 2457T
guaaaaccugacaacaaa

SEQ ID NO: 3877957 - RNA, 12 nt, Shigella flexneri 2a str. 2457T
guaaaacgccca

SEQ ID NO: 3877958 - RNA, 21 nt, Shigella flexneri 2a str. 2457T
guaaaacggauaugauuuaaa

SEQ ID NO: 3877959 - RNA, 13 nt, Shigella flexneri 2a str. 2457T
guaaaaggagaua

SEQ ID NO: 3877960 - RNA, 15 nt, Shigella flexneri 2a str. 2457T
guaaaaggauguuua

SEQ ID NO: 3877961 - RNA, 15 nt, Shigella flexneri 2a str. 2457T
guaaaauaacagcgg

SEQ ID NO: 3877962 - RNA, 23 nt, Shigella flexneri 2a str. 2457T
guaaaauuuggguguaucuucag

SEQ ID NO: 3877963 - RNA, 11 nt, Shigella flexneri 2a str. 2457T
guaaacaacau

SEQ ID NO: 3877964 - RNA, 15 nt, Shigella flexneri 2a str. 2457T
guaaacaacuggcgc

SEQ ID NO: 3877965 - RNA, 18 nt, Shigella flexneri 2a str. 2457T
guaaaccacccaccagcg

SEQ ID NO: 3877966 - RNA, 18 nt, Shigella flexneri 2a str. 2457T
guaaaccagagagaagcu

SEQ ID NO: 3877967 - RNA, 16 nt, Shigella flexneri 2a str. 2457T
guaaacccagccgcgu

SEQ ID NO: 3877968 - RNA, 19 nt, Shigella flexneri 2a str. 2457T
guaaacccuaacaucaucc

SEQ ID NO: 3877969 - RNA, 16 nt, Shigella flexneri 2a str. 2457T
guaaaccgcucgucac

SEQ ID NO: 3877970 - RNA, 17 nt, Shigella flexneri 2a str. 2457T
guaaaccguuaucaccu

SEQ ID NO: 3877971 - RNA, 14 nt, Shigella flexneri 2a str. 2457T
guaaaccucuuucg

SEQ ID NO: 3877972 - RNA, 19 nt, Shigella flexneri 2a str. 2457T
guaauuuaacaacucacca

SEQ ID NO: 3877973 - RNA, 11 nt, Shigella flexneri 2a str. 2457T
guaauuucaau

SEQ ID NO: 3877974 - RNA, 15 nt, Shigella flexneri 2a str. 2457T
guaauuucacaaguu

SEQ ID NO: 3877975 - RNA, 23 nt, Shigella flexneri 2a str. 2457T
guaauuugccguuaaucccagac

SEQ ID NO: 3877976 - RNA, 21 nt, Shigella flexneri 2a str. 2457T
guacaaaauuagaaagggaag

SEQ ID NO: 3877977 - RNA, 18 nt, Shigella flexneri 2a str. 2457T
guacaaacgcuuuacuca

SEQ ID NO: 3877978 - RNA, 12 nt, Shigella flexneri 2a str. 2457T
guacaaccgcaa

SEQ ID NO: 3877979 - RNA, 14 nt, Shigella flexneri 2a str. 2457T
guacaacgccguuu

SEQ ID NO: 3877980 - RNA, 21 nt, Shigella flexneri 2a str. 2457T
guacaacuaagccaguucauu

SEQ ID NO: 3877981 - RNA, 19 nt, Shigella flexneri 2a str. 2457T
guacaaucguuucaugcca

SEQ ID NO: 3877982 - RNA, 11 nt, Shigella flexneri 2a str. 2457T
guacaccaaca

SEQ ID NO: 3877983 - RNA, 15 nt, Shigella flexneri 2a str. 2457T
guacaccaacaucac

SEQ ID NO: 3877984 - RNA, 17 nt, Shigella flexneri 2a str. 2457T
guacaccaacaucacgc

SEQ ID NO: 3877985 - RNA, 12 nt, Shigella flexneri 2a str. 2457T
guacaccaccua

SEQ ID NO: 3877986 - RNA, 12 nt, Shigella flexneri 2a str. 2457T
guacagaaucug

SEQ ID NO: 3877987 - RNA, 18 nt, Shigella flexneri 2a str. 2457T
guacagagggcaggcaac

SEQ ID NO: 3877988 - RNA, 23 nt, Shigella flexneri 2a str. 2457T
guacagagguaagauguucuauc

SEQ ID NO: 3877989 - RNA, 16 nt, Shigella flexneri 2a str. 2457T
guacagauccgccauu

SEQ ID NO: 3877990 - RNA, 15 nt, Shigella flexneri 2a str. 2457T
guacagccgccagac

SEQ ID NO: 3877991 - RNA, 12 nt, Shigella flexneri 2a str. 2457T
guacaggcacau

SEQ ID NO: 3877992 - RNA, 21 nt, Shigella flexneri 2a str. 2457T
guacaguacugggauucacgu

SEQ ID NO: 3877993 - RNA, 20 nt, Shigella flexneri 2a str. 2457T
guacauagccaucugccuga

SEQ ID NO: 3877994 - RNA, 19 nt, Shigella flexneri 2a str. 2457T
guacaucguagugaugcca

SEQ ID NO: 3877995 - RNA, 17 nt, Shigella flexneri 2a str. 2457T
guacaugaagcacugca

SEQ ID NO: 3877996 - RNA, 16 nt, Shigella flexneri 2a str. 2457T
guacauggugcacauu

SEQ ID NO: 3877997 - RNA, 15 nt, Shigella flexneri 2a str. 2457T
guacauuaaaauugg

SEQ ID NO: 3877998 - RNA, 15 nt, Shigella flexneri 2a str. 2457T
guacauuaagcgcau

SEQ ID NO: 3877999 - RNA, 15 nt, Shigella flexneri 2a str. 2457T
guacauuguuuucca

SEQ ID NO: 3878000 - RNA, 18 nt, Shigella flexneri 2a str. 2457T
guacauuguuuuccagac

SEQ ID NO: 3878001 - RNA, 15 nt, Shigella flexneri 2a str. 2457T
guaccaccgcgaaaa

SEQ ID NO: 3878002 - RNA, 21 nt, Shigella flexneri 2a str. 2457T
guaccacgcacagcccgccgc

SEQ ID NO: 3878003 - RNA, 20 nt, Shigella flexneri 2a str. 2457T
guaccacgguacgccagagu

SEQ ID NO: 3878004 - RNA, 13 nt, Shigella flexneri 2a str. 2457T
guaccagcaccgu

SEQ ID NO: 3878005 - RNA, 12 nt, Shigella flexneri 2a str. 2457T
guaccagcagcg

SEQ ID NO: 3878006 - RNA, 16 nt, Shigella flexneri 2a str. 2457T
guaccagccuugccag

SEQ ID NO: 3878007 - RNA, 17 nt, Shigella flexneri 2a str. 2457T
guaccagcggcuuccag

SEQ ID NO: 3878008 - RNA, 13 nt, Shigella flexneri 2a str. 2457T
guaccaucuucac

SEQ ID NO: 3878009 - RNA, 17 nt, Shigella flexneri 2a str. 2457T
guaccaugauccugcaa

SEQ ID NO: 3878010 - RNA, 17 nt, Shigella flexneri 2a str. 2457T
guaccaugcgcaucauc

SEQ ID NO: 3878011 - RNA, 14 nt, Shigella flexneri 2a str. 2457T
guacccuucgucaa

SEQ ID NO: 3878012 - RNA, 14 nt, Shigella flexneri 2a str. 2457T
guaccgauuugauc

SEQ ID NO: 3878013 - RNA, 17 nt, Shigella flexneri 2a str. 2457T
guaccgccagcaggaac

SEQ ID NO: 3878014 - RNA, 20 nt, Shigella flexneri 2a str. 2457T
guaccgccgccauaaacagc

SEQ ID NO: 3878015 - RNA, 21 nt, Shigella flexneri 2a str. 2457T
guaccgccgcgaaccugugaa

SEQ ID NO: 3878016 - RNA, 18 nt, Shigella flexneri 2a str. 2457T
guaccuccuucacagugg

SEQ ID NO: 3878017 - RNA, 17 nt, Shigella flexneri 2a str. 2457T
guaccucuucgcuggca

SEQ ID NO: 3878018 - RNA, 12 nt, Shigella flexneri 2a str. 2457T
guaccugaauua

SEQ ID NO: 3878019 - RNA, 17 nt, Shigella flexneri 2a str. 2457T
guaccuucagcggcagc

SEQ ID NO: 3878020 - RNA, 18 nt, Shigella flexneri 2a str. 2457T
guacgaaauaacugaaua

SEQ ID NO: 3878021 - RNA, 13 nt, Shigella flexneri 2a str. 2457T
guacgacaagucu

SEQ ID NO: 3878022 - RNA, 16 nt, Shigella flexneri 2a str. 2457T
guacgauacagaagca

SEQ ID NO: 3878023 - RNA, 20 nt, Shigella flexneri 2a str. 2457T
guacgcaauuccagcaagcc

SEQ ID NO: 3878024 - RNA, 21 nt, Shigella flexneri 2a str. 2457T
guacgcggcaauccccgccag

SEQ ID NO: 3878025 - RNA, 18 nt, Shigella flexneri 2a str. 2457T
guacgcguucaaucaaau

SEQ ID NO: 3878026 - RNA, 15 nt, Shigella flexneri 2a str. 2457T
guacgcuccagcagg

SEQ ID NO: 3878027 - RNA, 16 nt, Shigella flexneri 2a str. 2457T
guacgcuuucacccgg

SEQ ID NO: 3878028 - RNA, 14 nt, Shigella flexneri 2a str. 2457T
guacgggucgggcu

SEQ ID NO: 3878029 - RNA, 19 nt, Shigella flexneri 2a str. 2457T
guacgguacugaaaccuga

SEQ ID NO: 3878030 - RNA, 19 nt, Shigella flexneri 2a str. 2457T
guacgucauccguggcgac

SEQ ID NO: 3878031 - RNA, 13 nt, Shigella flexneri 2a str. 2457T
guacgucgagaau

SEQ ID NO: 3878032 - RNA, 15 nt, Shigella flexneri 2a str. 2457T
guacguggaggaugg

SEQ ID NO: 3878033 - RNA, 15 nt, Shigella flexneri 2a str. 2457T
guacguucauggcgc

SEQ ID NO: 3878034 - RNA, 20 nt, Shigella flexneri 2a str. 2457T
guacucaccagacaucccag

SEQ ID NO: 3878035 - RNA, 15 nt, Shigella flexneri 2a str. 2457T
guacucaccgcucac

SEQ ID NO: 3878036 - RNA, 14 nt, Shigella flexneri 2a str. 2457T
guacucaucgcccg

SEQ ID NO: 3878037 - RNA, 11 nt, Shigella flexneri 2a str. 2457T
guacuccagca

SEQ ID NO: 3878038 - RNA, 13 nt, Shigella flexneri 2a str. 2457T
guacuccagcaga

SEQ ID NO: 3878039 - RNA, 14 nt, Shigella flexneri 2a str. 2457T
guacuccagcagac

SEQ ID NO: 3878040 - RNA, 18 nt, Shigella flexneri 2a str. 2457T
guacuccaucucgccauc

SEQ ID NO: 3878041 - RNA, 14 nt, Shigella flexneri 2a str. 2457T
guacugaccaucag

SEQ ID NO: 3878042 - RNA, 24 nt, Shigella flexneri 2a str. 2457T
guacugaccgucgccuucaacgua

SEQ ID NO: 3878043 - RNA, 18 nt, Shigella flexneri 2a str. 2457T
guacuggcaaucgccagc

SEQ ID NO: 3878044 - RNA, 19 nt, Shigella flexneri 2a str. 2457T
guacuggcgugggcaucga

SEQ ID NO: 3878045 - RNA, 15 nt, Shigella flexneri 2a str. 2457T
guacuguggcaucgg

SEQ ID NO: 3878046 - RNA, 13 nt, Shigella flexneri 2a str. 2457T
guacuguuucacu

SEQ ID NO: 3878047 - RNA, 23 nt, Shigella flexneri 2a str. 2457T
guacuguuucacuguugaagccg

SEQ ID NO: 3878048 - RNA, 18 nt, Shigella flexneri 2a str. 2457T
guacuuaugcucugcgau

SEQ ID NO: 3878049 - RNA, 14 nt, Shigella flexneri 2a str. 2457T
guagaaaaucucaa

SEQ ID NO: 3878050 - RNA, 15 nt, Shigella flexneri 2a str. 2457T
guagaaaaucucaau

SEQ ID NO: 3878051 - RNA, 15 nt, Shigella flexneri 2a str. 2457T
guagaacccuaccag

SEQ ID NO: 3878052 - RNA, 17 nt, Shigella flexneri 2a str. 2457T
guagaagccagucagcu

SEQ ID NO: 3878053 - RNA, 20 nt, Shigella flexneri 2a str. 2457T
guagacgagccguuccuaac

SEQ ID NO: 3878054 - RNA, 15 nt, Shigella flexneri 2a str. 2457T
guagacucaagcagu

SEQ ID NO: 3878055 - RNA, 18 nt, Shigella flexneri 2a str. 2457T
guagacugcagcggucac

SEQ ID NO: 3878056 - RNA, 14 nt, Shigella flexneri 2a str. 2457T
guagagaauccagu

SEQ ID NO: 3878057 - RNA, 19 nt, Shigella flexneri 2a str. 2457T
guagauugcacuugcuuaa

SEQ ID NO: 3878058 - RNA, 20 nt, Shigella flexneri 2a str. 2457T
guagcaccgacgucgauaua

SEQ ID NO: 3878059 - RNA, 15 nt, Shigella flexneri 2a str. 2457T
guagcaggccggaga

SEQ ID NO: 3878060 - RNA, 22 nt, Shigella flexneri 2a str. 2457T
guagcagguaaucugccauauu

SEQ ID NO: 3878061 - RNA, 23 nt, Shigella flexneri 2a str. 2457T
guagccaauaaaugccaccacac

SEQ ID NO: 3878062 - RNA, 14 nt, Shigella flexneri 2a str. 2457T
guagccagacaaug

SEQ ID NO: 3878063 - RNA, 22 nt, Shigella flexneri 2a str. 2457T
guagccaugcauaaugcagcca

SEQ ID NO: 3878064 - RNA, 17 nt, Shigella flexneri 2a str. 2457T
guagccauuugauucac

SEQ ID NO: 3878065 - RNA, 23 nt, Shigella flexneri 2a str. 2457T
guagccauuugauucacaaggcc

SEQ ID NO: 3878066 - RNA, 21 nt, Shigella flexneri 2a str. 2457T
guagccccaauguucguccau

SEQ ID NO: 3878067 - RNA, 18 nt, Shigella flexneri 2a str. 2457T
guagccccagucuuccug

SEQ ID NO: 3878068 - RNA, 19 nt, Shigella flexneri 2a str. 2457T
guagccgcggaucacgcga

SEQ ID NO: 3878069 - RNA, 17 nt, Shigella flexneri 2a str. 2457T
guagccuuuuucagccg

SEQ ID NO: 3878070 - RNA, 13 nt, Shigella flexneri 2a str. 2457T
gucacuucaucgu

SEQ ID NO: 3878071 - RNA, 14 nt, Shigella flexneri 2a str. 2457T
gucacuuuuacuca

SEQ ID NO: 3878072 - RNA, 22 nt, Shigella flexneri 2a str. 2457T
gucacuuuuggugcuuuugcug

SEQ ID NO: 3878073 - RNA, 16 nt, Shigella flexneri 2a str. 2457T
gucagaccaaaacgcg

SEQ ID NO: 3878074 - RNA, 20 nt, Shigella flexneri 2a str. 2457T
gucagaccggcaaccagcac

SEQ ID NO: 3878075 - RNA, 16 nt, Shigella flexneri 2a str. 2457T
gucagaguguugcggc

SEQ ID NO: 3878076 - RNA, 13 nt, Shigella flexneri 2a str. 2457T
gucagauccgcca

SEQ ID NO: 3878077 - RNA, 13 nt, Shigella flexneri 2a str. 2457T
gucagaugcggcu

SEQ ID NO: 3878078 - RNA, 21 nt, Shigella flexneri 2a str. 2457T
gucagcaaaauacugaacagg

SEQ ID NO: 3878079 - RNA, 16 nt, Shigella flexneri 2a str. 2457T
gucagcaaccugcuua

SEQ ID NO: 3878080 - RNA, 17 nt, Shigella flexneri 2a str. 2457T
gucagcacaaacaauuu

SEQ ID NO: 3878081 - RNA, 19 nt, Shigella flexneri 2a str. 2457T
gucagcagguguccagcca

SEQ ID NO: 3878082 - RNA, 12 nt, Shigella flexneri 2a str. 2457T
gucagcaucaua

SEQ ID NO: 3878083 - RNA, 19 nt, Shigella flexneri 2a str. 2457T
gucagcaucauaccuccgc

SEQ ID NO: 3878084 - RNA, 13 nt, Shigella flexneri 2a str. 2457T
gucagccagcggc

SEQ ID NO: 3878085 - RNA, 20 nt, Shigella flexneri 2a str. 2457T
gucagccucgcuggucagcg

SEQ ID NO: 3878086 - RNA, 16 nt, Shigella flexneri 2a str. 2457T
gucagcgaucagcauu

SEQ ID NO: 3878087 - RNA, 23 nt, Shigella flexneri 2a str. 2457T
gucagcgccaggcuuuccgucag

SEQ ID NO: 3878088 - RNA, 16 nt, Shigella flexneri 2a str. 2457T
gucagcgccuggcugc

SEQ ID NO: 3878089 - RNA, 18 nt, Shigella flexneri 2a str. 2457T
gucagcguacaggacggu

SEQ ID NO: 3878090 - RNA, 17 nt, Shigella flexneri 2a str. 2457T
gucagcgucagguccgu

SEQ ID NO: 3878091 - RNA, 17 nt, Shigella flexneri 2a str. 2457T
gucagcguuucaacaaa

SEQ ID NO: 3878092 - RNA, 21 nt, Shigella flexneri 2a str. 2457T
gucagcucucagccagcuggc

SEQ ID NO: 3878093 - RNA, 13 nt, Shigella flexneri 2a str. 2457T
gucagcugcuguu

SEQ ID NO: 3878094 - RNA, 17 nt, Shigella flexneri 2a str. 2457T
gucaggagcuggaugcc

SEQ ID NO: 3878095 - RNA, 21 nt, Shigella flexneri 2a str. 2457T
gucaggcaaccgcugagcgau

SEQ ID NO: 3878096 - RNA, 19 nt, Shigella flexneri 2a str. 2457T
gucaggccggcauauaccu

SEQ ID NO: 3878097 - RNA, 18 nt, Shigella flexneri 2a str. 2457T
gucaggcgcgugaaugcc

SEQ ID NO: 3878098 - RNA, 12 nt, Shigella flexneri 2a str. 2457T
gucagguaacaa

SEQ ID NO: 3878099 - RNA, 12 nt, Shigella flexneri 2a str. 2457T
gucaguaaugag

SEQ ID NO: 3878100 - RNA, 21 nt, Shigella flexneri 2a str. 2457T
gucaguagcgcaaucaccacc

SEQ ID NO: 3878101 - RNA, 14 nt, Shigella flexneri 2a str. 2457T
gucagucaucacuu

SEQ ID NO: 3878102 - RNA, 19 nt, Shigella flexneri 2a str. 2457T
gucaguggacgauaagcac

SEQ ID NO: 3878103 - RNA, 15 nt, Shigella flexneri 2a str. 2457T
gucagugucuuaucu

SEQ ID NO: 3878104 - RNA, 17 nt, Shigella flexneri 2a str. 2457T
gucagugucuuaucugg

SEQ ID NO: 3878105 - RNA, 19 nt, Shigella flexneri 2a str. 2457T
gucagugucuuaucuggca

SEQ ID NO: 3878106 - RNA, 13 nt, Shigella flexneri 2a str. 2457T
gucaguucauggu

SEQ ID NO: 3878107 - RNA, 13 nt, Shigella flexneri 2a str. 2457T
gucaguuggcugu

SEQ ID NO: 3878108 - RNA, 16 nt, Shigella flexneri 2a str. 2457T
gucaguuggcuguggu

SEQ ID NO: 3878109 - RNA, 15 nt, Shigella flexneri 2a str. 2457T
gucaguuucagccag

SEQ ID NO: 3878110 - RNA, 20 nt, Shigella flexneri 2a str. 2457T
gucauaacacagguaacuua

SEQ ID NO: 3878111 - RNA, 17 nt, Shigella flexneri 2a str. 2457T
gucauaauaugaccuga

SEQ ID NO: 3878112 - RNA, 18 nt, Shigella flexneri 2a str. 2457T
gucauacgcguaaaacag

SEQ ID NO: 3878113 - RNA, 19 nt, Shigella flexneri 2a str. 2457T
gucauagguucuuuuaaau

SEQ ID NO: 3878114 - RNA, 12 nt, Shigella flexneri 2a str. 2457T
gucauauagccg

SEQ ID NO: 3878115 - RNA, 22 nt, Shigella flexneri 2a str. 2457T
gucaucaaacggcauaugccau

SEQ ID NO: 3878116 - RNA, 21 nt, Shigella flexneri 2a str. 2457T
gucaucagcauaaucaccagu

SEQ ID NO: 3878117 - RNA, 20 nt, Shigella flexneri 2a str. 2457T
gucaucagcgccaacccgcu

SEQ ID NO: 3878118 - RNA, 18 nt, Shigella flexneri 2a str. 2457T
gucaucauagacuucccu

SEQ ID NO: 3878119 - RNA, 14 nt, Shigella flexneri 2a str. 2457T
gucauccagcacuu

SEQ ID NO: 3878120 - RNA, 16 nt, Shigella flexneri 2a str. 2457T
gucauccaggaacucc

SEQ ID NO: 3878121 - RNA, 18 nt, Shigella flexneri 2a str. 2457T
gucauccaggaacuccag

SEQ ID NO: 3878122 - RNA, 13 nt, Shigella flexneri 2a str. 2457T
gucauccauacca

SEQ ID NO: 3878123 - RNA, 22 nt, Shigella flexneri 2a str. 2457T
gucauccauaccacgaccucaa

SEQ ID NO: 3878124 - RNA, 16 nt, Shigella flexneri 2a str. 2457T
gucaucccagucuuca

SEQ ID NO: 3878125 - RNA, 22 nt, Shigella flexneri 2a str. 2457T
gucauccuaaacgcuggcagga

SEQ ID NO: 3878126 - RNA, 16 nt, Shigella flexneri 2a str. 2457T
gucaucgacagcaaau

SEQ ID NO: 3878127 - RNA, 17 nt, Shigella flexneri 2a str. 2457T
gucaucgaugagaugac

SEQ ID NO: 3878128 - RNA, 18 nt, Shigella flexneri 2a str. 2457T
gucaucgcauacaaaaac

SEQ ID NO: 3878129 - RNA, 21 nt, Shigella flexneri 2a str. 2457T
gucaucggaucauuagucaca

SEQ ID NO: 3878130 - RNA, 14 nt, Shigella flexneri 2a str. 2457T
gucaucugcacggu

SEQ ID NO: 3878131 - RNA, 15 nt, Shigella flexneri 2a str. 2457T
gucaugacuacacua

SEQ ID NO: 3878132 - RNA, 12 nt, Shigella flexneri 2a str. 2457T
gucaugcagcuc

SEQ ID NO: 3878133 - RNA, 14 nt, Shigella flexneri 2a str. 2457T
gucauggcugacac

SEQ ID NO: 3878134 - RNA, 15 nt, Shigella flexneri 2a str. 2457T
gucauggcugacugu

SEQ ID NO: 3878135 - RNA, 14 nt, Shigella flexneri 2a str. 2457T
gucaugucaugagu

SEQ ID NO: 3878136 - RNA, 21 nt, Shigella flexneri 2a str. 2457T
gucauuaaagccgccaaacgg

SEQ ID NO: 3878137 - RNA, 14 nt, Shigella flexneri 2a str. 2457T
gucauuacaacaag

SEQ ID NO: 3878138 - RNA, 21 nt, Shigella flexneri 2a str. 2457T
gucauuucccaucucaauauu

SEQ ID NO: 3878139 - RNA, 21 nt, Shigella flexneri 2a str. 2457T
gucauuuugcguguuucagaa

SEQ ID NO: 3878140 - RNA, 15 nt, Shigella flexneri 2a str. 2457T
gucauuuuuucgaca

SEQ ID NO: 3878141 - RNA, 14 nt, Shigella flexneri 2a str. 2457T
guccaaaagguccu

SEQ ID NO: 3878142 - RNA, 20 nt, Shigella flexneri 2a str. 2457T
guccaaaagguccuucaggc

SEQ ID NO: 3878143 - RNA, 14 nt, Shigella flexneri 2a str. 2457T
guccaaucagcaca

SEQ ID NO: 3878144 - RNA, 13 nt, Shigella flexneri 2a str. 2457T
guccacaggaaaa

SEQ ID NO: 3878145 - RNA, 18 nt, Shigella flexneri 2a str. 2457T
guccaccaauagcccaug

SEQ ID NO: 3878146 - RNA, 18 nt, Shigella flexneri 2a str. 2457T
guccaccgcgaugcugcc

SEQ ID NO: 3878147 - RNA, 16 nt, Shigella flexneri 2a str. 2457T
guccaccgugauucac

SEQ ID NO: 3878148 - RNA, 13 nt, Shigella flexneri 2a str. 2457T
guccacggugcga

SEQ ID NO: 3878149 - RNA, 19 nt, Shigella flexneri 2a str. 2457T
guccacgguugguuuuauc

SEQ ID NO: 3878150 - RNA, 13 nt, Shigella flexneri 2a str. 2457T
guccacgucauca

SEQ ID NO: 3878151 - RNA, 12 nt, Shigella flexneri 2a str. 2457T
guccagcaggcg

SEQ ID NO: 3878152 - RNA, 12 nt, Shigella flexneri 2a str. 2457T
guccagcgccug

SEQ ID NO: 3878153 - RNA, 18 nt, Shigella flexneri 2a str. 2457T
guccagcuccguccagcc

SEQ ID NO: 3878154 - RNA, 18 nt, Shigella flexneri 2a str. 2457T
guccaggcugcaaagucu

SEQ ID NO: 3878155 - RNA, 21 nt, Shigella flexneri 2a str. 2457T
guccagucgcaaaccuggcau

SEQ ID NO: 3878156 - RNA, 16 nt, Shigella flexneri 2a str. 2457T
guccaguuugccuuca

SEQ ID NO: 3878157 - RNA, 21 nt, Shigella flexneri 2a str. 2457T
guccaucacaaucauccuacc

SEQ ID NO: 3878158 - RNA, 17 nt, Shigella flexneri 2a str. 2457T
guccauccauacgggca

SEQ ID NO: 3878159 - RNA, 21 nt, Shigella flexneri 2a str. 2457T
guccaugcugucggcugccag

SEQ ID NO: 3878160 - RNA, 14 nt, Shigella flexneri 2a str. 2457T
guccauuaccgaua

SEQ ID NO: 3878161 - RNA, 19 nt, Shigella flexneri 2a str. 2457T
gucccacuggucgcccugg

SEQ ID NO: 3878162 - RNA, 20 nt, Shigella flexneri 2a str. 2457T
gucccagccuugccagaugu

SEQ ID NO: 3878163 - RNA, 18 nt, Shigella flexneri 2a str. 2457T
gucccauuuuaaacguca

SEQ ID NO: 3878164 - RNA, 21 nt, Shigella flexneri 2a str. 2457T
guccccaucaggaaacccgcc

SEQ ID NO: 3878165 - RNA, 19 nt, Shigella flexneri 2a str. 2457T
guccccgagcacaugcagu

SEQ ID NO: 3878166 - RNA, 19 nt, Shigella flexneri 2a str. 2457T
guccccuggggagugaccu

SEQ ID NO: 3878167 - RNA, 23 nt, Shigella flexneri 2a str. 2457T
gucccgaccccgaccgucugcug

SEQ ID NO: 3878168 - RNA, 21 nt, Shigella flexneri 2a str. 2457T
gucgucugucgggaacacuuu

SEQ ID NO: 3878169 - RNA, 14 nt, Shigella flexneri 2a str. 2457T
gucgugaaacgcgu

SEQ ID NO: 3878170 - RNA, 12 nt, Shigella flexneri 2a str. 2457T
gucgugaaugcc

SEQ ID NO: 3878171 - RNA, 12 nt, Shigella flexneri 2a str. 2457T
gucguggcaaaa

SEQ ID NO: 3878172 - RNA, 13 nt, Shigella flexneri 2a str. 2457T
gucguuauauaaa

SEQ ID NO: 3878173 - RNA, 14 nt, Shigella flexneri 2a str. 2457T
gucguucaggcgcu

SEQ ID NO: 3878174 - RNA, 22 nt, Shigella flexneri 2a str. 2457T
gucguugcaaucagcggugccg

SEQ ID NO: 3878175 - RNA, 20 nt, Shigella flexneri 2a str. 2457T
gucguugcuaacaauggagc

SEQ ID NO: 3878176 - RNA, 17 nt, Shigella flexneri 2a str. 2457T
gucguuguacaaaccau

SEQ ID NO: 3878177 - RNA, 16 nt, Shigella flexneri 2a str. 2457T
gucguuuucaguugcu

SEQ ID NO: 3878178 - RNA, 15 nt, Shigella flexneri 2a str. 2457T
gucuaaauuuugcau

SEQ ID NO: 3878179 - RNA, 23 nt, Shigella flexneri 2a str. 2457T
gucuaacaugagguccagcgagc

SEQ ID NO: 3878180 - RNA, 19 nt, Shigella flexneri 2a str. 2457T
gucuaacgaugccagcacc

SEQ ID NO: 3878181 - RNA, 17 nt, Shigella flexneri 2a str. 2457T
gucuaccagcaccugcu

SEQ ID NO: 3878182 - RNA, 12 nt, Shigella flexneri 2a str. 2457T
gucucaaaccgg

SEQ ID NO: 3878183 - RNA, 15 nt, Shigella flexneri 2a str. 2457T
gucucagauucagau

SEQ ID NO: 3878184 - RNA, 16 nt, Shigella flexneri 2a str. 2457T
gucucaggugucuggc

SEQ ID NO: 3878185 - RNA, 17 nt, Shigella flexneri 2a str. 2457T
gucucaggugucuggca

SEQ ID NO: 3878186 - RNA, 18 nt, Shigella flexneri 2a str. 2457T
gucuccaccuuaucgaca

SEQ ID NO: 3878187 - RNA, 18 nt, Shigella flexneri 2a str. 2457T
gucucccgaugccagcac

SEQ ID NO: 3878188 - RNA, 18 nt, Shigella flexneri 2a str. 2457T
gucuccgcugagacgcgc

SEQ ID NO: 3878189 - RNA, 23 nt, Shigella flexneri 2a str. 2457T
gucuccgcugagacgcgcuugca

SEQ ID NO: 3878190 - RNA, 15 nt, Shigella flexneri 2a str. 2457T
gucuccgguccaguc

SEQ ID NO: 3878191 - RNA, 19 nt, Shigella flexneri 2a str. 2457T
gucuccugccgagcgugcg

SEQ ID NO: 3878192 - RNA, 19 nt, Shigella flexneri 2a str. 2457T
gucucgauacgcccuggau

SEQ ID NO: 3878193 - RNA, 22 nt, Shigella flexneri 2a str. 2457T
gucucgauguagauauacugca

SEQ ID NO: 3878194 - RNA, 23 nt, Shigella flexneri 2a str. 2457T
gucucucagcacaccauaaaaca

SEQ ID NO: 3878195 - RNA, 18 nt, Shigella flexneri 2a str. 2457T
gucucuggcuucccggca

SEQ ID NO: 3878196 - RNA, 14 nt, Shigella flexneri 2a str. 2457T
gucucuuccggcuc

SEQ ID NO: 3878197 - RNA, 16 nt, Shigella flexneri 2a str. 2457T
gucucuuucaugguua

SEQ ID NO: 3878198 - RNA, 17 nt, Shigella flexneri 2a str. 2457T
gucucuuuucguuuugg

SEQ ID NO: 3878199 - RNA, 21 nt, Shigella flexneri 2a str. 2457T
gucugaauaucaucccccugc

SEQ ID NO: 3878200 - RNA, 21 nt, Shigella flexneri 2a str. 2457T
gucugaucggcaaucacgccc

SEQ ID NO: 3878201 - RNA, 22 nt, Shigella flexneri 2a str. 2457T
gucugauuccgauauucaauug

SEQ ID NO: 3878202 - RNA, 22 nt, Shigella flexneri 2a str. 2457T
gucugcauuuucucgcggacug

SEQ ID NO: 3878203 - RNA, 18 nt, Shigella flexneri 2a str. 2457T
gucugccaucauggcauc

SEQ ID NO: 3878204 - RNA, 18 nt, Shigella flexneri 2a str. 2457T
gucugccgggaagcucuc

SEQ ID NO: 3878205 - RNA, 17 nt, Shigella flexneri 2a str. 2457T
gucugccgguacuucac

SEQ ID NO: 3878206 - RNA, 17 nt, Shigella flexneri 2a str. 2457T
gucugccguugccacgu

SEQ ID NO: 3878207 - RNA, 16 nt, Shigella flexneri 2a str. 2457T
gucugcugaccaccug

SEQ ID NO: 3878208 - RNA, 14 nt, Shigella flexneri 2a str. 2457T
gucuggaacggcag

SEQ ID NO: 3878209 - RNA, 13 nt, Shigella flexneri 2a str. 2457T
gucuggaagccag

SEQ ID NO: 3878210 - RNA, 16 nt, Shigella flexneri 2a str. 2457T
gucuggauuuggcugc

SEQ ID NO: 3878211 - RNA, 22 nt, Shigella flexneri 2a str. 2457T
gucuggauuuggcugccgagca

SEQ ID NO: 3878212 - RNA, 15 nt, Shigella flexneri 2a str. 2457T
gucuggcguugcugg

SEQ ID NO: 3878213 - RNA, 14 nt, Shigella flexneri 2a str. 2457T
gucuggugaccugg

SEQ ID NO: 3878214 - RNA, 18 nt, Shigella flexneri 2a str. 2457T
gucuguaccaccagaauc

SEQ ID NO: 3878215 - RNA, 12 nt, Shigella flexneri 2a str. 2457T
gucuguacggca

SEQ ID NO: 3878216 - RNA, 14 nt, Shigella flexneri 2a str. 2457T
gucuguacggcagu

SEQ ID NO: 3878217 - RNA, 13 nt, Shigella flexneri 2a str. 2457T
gucuguaugacaa

SEQ ID NO: 3878218 - RNA, 13 nt, Shigella flexneri 2a str. 2457T
gucuguuccccuc

SEQ ID NO: 3878219 - RNA, 19 nt, Shigella flexneri 2a str. 2457T
gucuguucgccccaaaaaa

SEQ ID NO: 3878220 - RNA, 15 nt, Shigella flexneri 2a str. 2457T
gucuguuuuaucucc

SEQ ID NO: 3878221 - RNA, 18 nt, Shigella flexneri 2a str. 2457T
gucuguuuuaucucccug

SEQ ID NO: 3878222 - RNA, 21 nt, Shigella flexneri 2a str. 2457T
gucuuaaaggggugaaaaaaa

SEQ ID NO: 3878223 - RNA, 13 nt, Shigella flexneri 2a str. 2457T
gucuuaauguaau

SEQ ID NO: 3878224 - RNA, 16 nt, Shigella flexneri 2a str. 2457T
gucuuaucaggccagg

SEQ ID NO: 3878225 - RNA, 19 nt, Shigella flexneri 2a str. 2457T
gucuuaucaggccuacaac

SEQ ID NO: 3878226 - RNA, 21 nt, Shigella flexneri 2a str. 2457T
gucuuaucaggccuacaaguc

SEQ ID NO: 3878227 - RNA, 20 nt, Shigella flexneri 2a str. 2457T
gucuuauccggccuuccugu

SEQ ID NO: 3878228 - RNA, 13 nt, Shigella flexneri 2a str. 2457T
gucuuaucuggca

SEQ ID NO: 3878229 - RNA, 14 nt, Shigella flexneri 2a str. 2457T
gucuucaaccgcag

SEQ ID NO: 3878230 - RNA, 12 nt, Shigella flexneri 2a str. 2457T
gucuucaauagg

SEQ ID NO: 3878231 - RNA, 12 nt, Shigella flexneri 2a str. 2457T
gucuuccugugg

SEQ ID NO: 3878232 - RNA, 24 nt, Shigella flexneri 2a str. 2457T
gucuucgcgcaccaacgacggcca

SEQ ID NO: 3878233 - RNA, 18 nt, Shigella flexneri 2a str. 2457T
gucuucucaccgccgccu

SEQ ID NO: 3878234 - RNA, 19 nt, Shigella flexneri 2a str. 2457T
gucuucugugauuccgcca

SEQ ID NO: 3878235 - RNA, 20 nt, Shigella flexneri 2a str. 2457T
gucuucugugauuccgccag

SEQ ID NO: 3878236 - RNA, 19 nt, Shigella flexneri 2a str. 2457T
gucuuggguauaaaacuca

SEQ ID NO: 3878237 - RNA, 22 nt, Shigella flexneri 2a str. 2457T
gucuuucuuaccccugauuuug

SEQ ID NO: 3878238 - RNA, 13 nt, Shigella flexneri 2a str. 2457T
gucuuuugaucaa

SEQ ID NO: 3878239 - RNA, 16 nt, Shigella flexneri 2a str. 2457T
gucuuuuuaaugacuu

SEQ ID NO: 3878240 - RNA, 22 nt, Shigella flexneri 2a str. 2457T
gucuuuuuucacuggcaaugac

SEQ ID NO: 3878241 - RNA, 14 nt, Shigella flexneri 2a str. 2457T
gugaaaaaaacugc

SEQ ID NO: 3878242 - RNA, 11 nt, Shigella flexneri 2a str. 2457T
gugaaaaaaag

SEQ ID NO: 3878243 - RNA, 21 nt, Shigella flexneri 2a str. 2457T
gugaaaaaccaaucucccagc

SEQ ID NO: 3878244 - RNA, 19 nt, Shigella flexneri 2a str. 2457T
gugaaacaaaucacuauua

SEQ ID NO: 3878245 - RNA, 23 nt, Shigella flexneri 2a str. 2457T
gugaaaccuuuaugcagcucggu

SEQ ID NO: 3878246 - RNA, 17 nt, Shigella flexneri 2a str. 2457T
gugaaagagccgucauu

SEQ ID NO: 3878247 - RNA, 13 nt, Shigella flexneri 2a str. 2457T
gugaaaguaaaaa

SEQ ID NO: 3878248 - RNA, 17 nt, Shigella flexneri 2a str. 2457T
gugaaaucugaaaucau

SEQ ID NO: 3878249 - RNA, 16 nt, Shigella flexneri 2a str. 2457T
gugaaauuaaacuguc

SEQ ID NO: 3878250 - RNA, 14 nt, Shigella flexneri 2a str. 2457T
gugaacgccuuauc

SEQ ID NO: 3878251 - RNA, 20 nt, Shigella flexneri 2a str. 2457T
gugaacgccuuauccggccu

SEQ ID NO: 3878252 - RNA, 20 nt, Shigella flexneri 2a str. 2457T
gugaacgccuuaucuggccu

SEQ ID NO: 3878253 - RNA, 19 nt, Shigella flexneri 2a str. 2457T
gugaacgcguuauccggcu

SEQ ID NO: 3878254 - RNA, 13 nt, Shigella flexneri 2a str. 2457T
gugaagagaugga

SEQ ID NO: 3878255 - RNA, 23 nt, Shigella flexneri 2a str. 2457T
gugaagugagaauuuuucacucc

SEQ ID NO: 3878256 - RNA, 21 nt, Shigella flexneri 2a str. 2457T
gugaaguugccggauguguug

SEQ ID NO: 3878257 - RNA, 17 nt, Shigella flexneri 2a str. 2457T
gugaauaaauuuuauuc

SEQ ID NO: 3878258 - RNA, 22 nt, Shigella flexneri 2a str. 2457T
gugaauaaauuuuauucauauu

SEQ ID NO: 3878259 - RNA, 21 nt, Shigella flexneri 2a str. 2457T
gugaauauuccuuaugguuca

SEQ ID NO: 3878260 - RNA, 23 nt, Shigella flexneri 2a str. 2457T
gugaauauuuaaccugagcuuga

SEQ ID NO: 3878261 - RNA, 14 nt, Shigella flexneri 2a str. 2457T
gugaaucacuccau

SEQ ID NO: 3878262 - RNA, 13 nt, Shigella flexneri 2a str. 2457T
gugaaugccuuau

SEQ ID NO: 3878263 - RNA, 13 nt, Shigella flexneri 2a str. 2457T
gugaauucacaau

SEQ ID NO: 3878264 - RNA, 17 nt, Shigella flexneri 2a str. 2457T
gugacaaucaccagguc

SEQ ID NO: 3878265 - RNA, 12 nt, Shigella flexneri 2a str. 2457T
gugacacaauca

SEQ ID NO: 3878266 - RNA, 19 nt, Shigella flexneri 2a str. 2457T
gugccacaccagcuuucgc

SEQ ID NO: 3878267 - RNA, 14 nt, Shigella flexneri 2a str. 2457T
gugccacauccagu

SEQ ID NO: 3878268 - RNA, 22 nt, Shigella flexneri 2a str. 2457T
gugccacauccaguggcagagu

SEQ ID NO: 3878269 - RNA, 19 nt, Shigella flexneri 2a str. 2457T
gugccaccagugcaggcac

SEQ ID NO: 3878270 - RNA, 23 nt, Shigella flexneri 2a str. 2457T
gugccacgcacaggugcaaaaaa

SEQ ID NO: 3878271 - RNA, 17 nt, Shigella flexneri 2a str. 2457T
gugccagaccaaacagc

SEQ ID NO: 3878272 - RNA, 14 nt, Shigella flexneri 2a str. 2457T
gugccagauagcca

SEQ ID NO: 3878273 - RNA, 18 nt, Shigella flexneri 2a str. 2457T
gugccagguaaacaccuu

SEQ ID NO: 3878274 - RNA, 17 nt, Shigella flexneri 2a str. 2457T
gugccaucauacagccg

SEQ ID NO: 3878275 - RNA, 13 nt, Shigella flexneri 2a str. 2457T
gugccaucgauaa

SEQ ID NO: 3878276 - RNA, 18 nt, Shigella flexneri 2a str. 2457T
gugccauugaccagcugc

SEQ ID NO: 3878277 - RNA, 15 nt, Shigella flexneri 2a str. 2457T
gugcccgaccacuuc

SEQ ID NO: 3878278 - RNA, 17 nt, Shigella flexneri 2a str. 2457T
gugcccgggucagcgcc

SEQ ID NO: 3878279 - RNA, 15 nt, Shigella flexneri 2a str. 2457T
gugcccguaaaaaau

SEQ ID NO: 3878280 - RNA, 21 nt, Shigella flexneri 2a str. 2457T
gugcccguaaaaaauggcugg

SEQ ID NO: 3878281 - RNA, 22 nt, Shigella flexneri 2a str. 2457T
gugcccuuguugcuauggggaa

SEQ ID NO: 3878282 - RNA, 13 nt, Shigella flexneri 2a str. 2457T
gugccgcagcuuc

SEQ ID NO: 3878283 - RNA, 22 nt, Shigella flexneri 2a str. 2457T
gugccgcgauaccacccgcagu

SEQ ID NO: 3878284 - RNA, 16 nt, Shigella flexneri 2a str. 2457T
gugccgguggaagggc

SEQ ID NO: 3878285 - RNA, 13 nt, Shigella flexneri 2a str. 2457T
gugccgucagcag

SEQ ID NO: 3878286 - RNA, 22 nt, Shigella flexneri 2a str. 2457T
gugccuaacaauucgccagggc

SEQ ID NO: 3878287 - RNA, 13 nt, Shigella flexneri 2a str. 2457T
gugccucaagaau

SEQ ID NO: 3878288 - RNA, 20 nt, Shigella flexneri 2a str. 2457T
gugccucguucacauauugc

SEQ ID NO: 3878289 - RNA, 22 nt, Shigella flexneri 2a str. 2457T
gugccugagccggaguugcaga

SEQ ID NO: 3878290 - RNA, 17 nt, Shigella flexneri 2a str. 2457T
gugccugcauaaacgcc

SEQ ID NO: 3878291 - RNA, 14 nt, Shigella flexneri 2a str. 2457T
gugccugucgggac

SEQ ID NO: 3878292 - RNA, 14 nt, Shigella flexneri 2a str. 2457T
gugcgaggugagca

SEQ ID NO: 3878293 - RNA, 19 nt, Shigella flexneri 2a str. 2457T
gugcgcaaacuucuucagu

SEQ ID NO: 3878294 - RNA, 18 nt, Shigella flexneri 2a str. 2457T
gugcgcaauacguugcaa

SEQ ID NO: 3878295 - RNA, 18 nt, Shigella flexneri 2a str. 2457T
gugcgccacaaccguccu

SEQ ID NO: 3878296 - RNA, 13 nt, Shigella flexneri 2a str. 2457T
gugcgccaugcuu

SEQ ID NO: 3878297 - RNA, 21 nt, Shigella flexneri 2a str. 2457T
gugcgcgauagauagcguucu

SEQ ID NO: 3878298 - RNA, 18 nt, Shigella flexneri 2a str. 2457T
gugcgcgugagcugggau

SEQ ID NO: 3878299 - RNA, 12 nt, Shigella flexneri 2a str. 2457T
gugcggcagggg

SEQ ID NO: 3878300 - RNA, 15 nt, Shigella flexneri 2a str. 2457T
gugcgggcacaggcg

SEQ ID NO: 3878301 - RNA, 14 nt, Shigella flexneri 2a str. 2457T
gugcgguaagcugc

SEQ ID NO: 3878302 - RNA, 17 nt, Shigella flexneri 2a str. 2457T
gugcgguaagcugcggu

SEQ ID NO: 3878303 - RNA, 12 nt, Shigella flexneri 2a str. 2457T
gugcgucagggc

SEQ ID NO: 3878304 - RNA, 15 nt, Shigella flexneri 2a str. 2457T
gugcguugucaucga

SEQ ID NO: 3878305 - RNA, 18 nt, Shigella flexneri 2a str. 2457T
gugcuauuuuagaaaaac

SEQ ID NO: 3878306 - RNA, 13 nt, Shigella flexneri 2a str. 2457T
gugcucaaucuga

SEQ ID NO: 3878307 - RNA, 22 nt, Shigella flexneri 2a str. 2457T
gugcucaaugagcaccuuuuuu

SEQ ID NO: 3878308 - RNA, 13 nt, Shigella flexneri 2a str. 2457T
gugcucacuacgg

SEQ ID NO: 3878309 - RNA, 14 nt, Shigella flexneri 2a str. 2457T
gugcucauccuuca

SEQ ID NO: 3878310 - RNA, 13 nt, Shigella flexneri 2a str. 2457T
gugcuccaggagc

SEQ ID NO: 3878311 - RNA, 22 nt, Shigella flexneri 2a str. 2457T
gugcuccagucguucaaccacu

SEQ ID NO: 3878312 - RNA, 21 nt, Shigella flexneri 2a str. 2457T
gugcucguaaguuaacugcac

SEQ ID NO: 3878313 - RNA, 20 nt, Shigella flexneri 2a str. 2457T
gugcucucaaauaucugccg

SEQ ID NO: 3878314 - RNA, 20 nt, Shigella flexneri 2a str. 2457T
gugcugaaagggcaaauaau

SEQ ID NO: 3878315 - RNA, 18 nt, Shigella flexneri 2a str. 2457T
gugcugaguuucagacca

SEQ ID NO: 3878316 - RNA, 12 nt, Shigella flexneri 2a str. 2457T
gugcugauuuug

SEQ ID NO: 3878317 - RNA, 14 nt, Shigella flexneri 2a str. 2457T
gugcugugacagau

SEQ ID NO: 3878318 - RNA, 21 nt, Shigella flexneri 2a str. 2457T
gugcuuaucgcgaugauuuuc

SEQ ID NO: 3878319 - RNA, 13 nt, Shigella flexneri 2a str. 2457T
gugcuucacucaa

SEQ ID NO: 3878320 - RNA, 14 nt, Shigella flexneri 2a str. 2457T
gugcuuucagcgaa

SEQ ID NO: 3878321 - RNA, 16 nt, Shigella flexneri 2a str. 2457T
guggaaaagaaaacag

SEQ ID NO: 3878322 - RNA, 16 nt, Shigella flexneri 2a str. 2457T
guggaaaaggcggcgc

SEQ ID NO: 3878323 - RNA, 15 nt, Shigella flexneri 2a str. 2457T
guggaaacagugauu

SEQ ID NO: 3878324 - RNA, 17 nt, Shigella flexneri 2a str. 2457T
guggaauaugcgccaca

SEQ ID NO: 3878325 - RNA, 21 nt, Shigella flexneri 2a str. 2457T
guggacgaacaguucaacgcc

SEQ ID NO: 3878326 - RNA, 14 nt, Shigella flexneri 2a str. 2457T
guggauguuuuacu

SEQ ID NO: 3878327 - RNA, 15 nt, Shigella flexneri 2a str. 2457T
guggauuaucuucac

SEQ ID NO: 3878328 - RNA, 15 nt, Shigella flexneri 2a str. 2457T
guggauucuggugau

SEQ ID NO: 3878329 - RNA, 12 nt, Shigella flexneri 2a str. 2457T
guggcaaagaaa

SEQ ID NO: 3878330 - RNA, 18 nt, Shigella flexneri 2a str. 2457T
guggcaaagaaauccaca

SEQ ID NO: 3878331 - RNA, 23 nt, Shigella flexneri 2a str. 2457T
guggcaaagguggccauccgcgu

SEQ ID NO: 3878332 - RNA, 22 nt, Shigella flexneri 2a str. 2457T
guggcaaccacaaccgccguug

SEQ ID NO: 3878333 - RNA, 20 nt, Shigella flexneri 2a str. 2457T
guggcaaucauauucaccac

SEQ ID NO: 3878334 - RNA, 14 nt, Shigella flexneri 2a str. 2457T
guggcaaucaucgu

SEQ ID NO: 3878335 - RNA, 19 nt, Shigella flexneri 2a str. 2457T
guggcaaucguagcccagc

SEQ ID NO: 3878336 - RNA, 15 nt, Shigella flexneri 2a str. 2457T
guggcagggcagcga

SEQ ID NO: 3878337 - RNA, 15 nt, Shigella flexneri 2a str. 2457T
guggcagucuggccu

SEQ ID NO: 3878338 - RNA, 16 nt, Shigella flexneri 2a str. 2457T
guggccaguuccacuu

SEQ ID NO: 3878339 - RNA, 20 nt, Shigella flexneri 2a str. 2457T
guggcgauucauaugcgcca

SEQ ID NO: 3878340 - RNA, 13 nt, Shigella flexneri 2a str. 2457T
guggcgcagccgu

SEQ ID NO: 3878341 - RNA, 21 nt, Shigella flexneri 2a str. 2457T
guggcgcgaagcccucaaaca

SEQ ID NO: 3878342 - RNA, 16 nt, Shigella flexneri 2a str. 2457T
guggcgcuccacuuca

SEQ ID NO: 3878343 - RNA, 18 nt, Shigella flexneri 2a str. 2457T
guggcgggaucaccugca

SEQ ID NO: 3878344 - RNA, 16 nt, Shigella flexneri 2a str. 2457T
guggcguggcgcucca

SEQ ID NO: 3878345 - RNA, 15 nt, Shigella flexneri 2a str. 2457T
guggcguuuccagca

SEQ ID NO: 3878346 - RNA, 16 nt, Shigella flexneri 2a str. 2457T
guggcguuuccagcag

SEQ ID NO: 3878347 - RNA, 20 nt, Shigella flexneri 2a str. 2457T
guggcguuugccaccugugc

SEQ ID NO: 3878348 - RNA, 15 nt, Shigella flexneri 2a str. 2457T
guggcugcguuucau

SEQ ID NO: 3878349 - RNA, 18 nt, Shigella flexneri 2a str. 2457T
gugggaauaaccauggca

SEQ ID NO: 3878350 - RNA, 16 nt, Shigella flexneri 2a str. 2457T
gugggaccaccgcgcu

SEQ ID NO: 3878351 - RNA, 23 nt, Shigella flexneri 2a str. 2457T
gugggaucacaucuucaauccac

SEQ ID NO: 3878352 - RNA, 16 nt, Shigella flexneri 2a str. 2457T
gugggauuccagcgcc

SEQ ID NO: 3878353 - RNA, 15 nt, Shigella flexneri 2a str. 2457T
gugggcgaaggcgca

SEQ ID NO: 3878354 - RNA, 13 nt, Shigella flexneri 2a str. 2457T
gugggcguugguc

SEQ ID NO: 3878355 - RNA, 19 nt, Shigella flexneri 2a str. 2457T
guggguauauuucaggcca

SEQ ID NO: 3878356 - RNA, 20 nt, Shigella flexneri 2a str. 2457T
gugggucugucccauuuuaa

SEQ ID NO: 3878357 - RNA, 19 nt, Shigella flexneri 2a str. 2457T
guggucagcagcuuucuuu

SEQ ID NO: 3878358 - RNA, 17 nt, Shigella flexneri 2a str. 2457T
guggucauaucaauagu

SEQ ID NO: 3878359 - RNA, 18 nt, Shigella flexneri 2a str. 2457T
guggugagauugcugcgu

SEQ ID NO: 3878360 - RNA, 17 nt, Shigella flexneri 2a str. 2457T
guggugaggccagagca

SEQ ID NO: 3878361 - RNA, 14 nt, Shigella flexneri 2a str. 2457T
guggugaucaccca

SEQ ID NO: 3878362 - RNA, 17 nt, Shigella flexneri 2a str. 2457T
guggugaucacccagac

SEQ ID NO: 3878363 - RNA, 12 nt, Shigella flexneri 2a str. 2457T
guggugauuuuc

SEQ ID NO: 3878364 - RNA, 17 nt, Shigella flexneri 2a str. 2457T
guuagucugcauuuucu

SEQ ID NO: 3878365 - RNA, 15 nt, Shigella flexneri 2a str. 2457T
guuagugucuuaucu

SEQ ID NO: 3878366 - RNA, 17 nt, Shigella flexneri 2a str. 2457T
guuagugucuuaucugg

SEQ ID NO: 3878367 - RNA, 19 nt, Shigella flexneri 2a str. 2457T
guuagugucuuaucuggca

SEQ ID NO: 3878368 - RNA, 21 nt, Shigella flexneri 2a str. 2457T
guuauaaacgcucggcaacac

SEQ ID NO: 3878369 - RNA, 15 nt, Shigella flexneri 2a str. 2457T
guuauacagaguguu

SEQ ID NO: 3878370 - RNA, 19 nt, Shigella flexneri 2a str. 2457T
guuauacaucgcuuuccag

SEQ ID NO: 3878371 - RNA, 14 nt, Shigella flexneri 2a str. 2457T
guuauaccagucca

SEQ ID NO: 3878372 - RNA, 18 nt, Shigella flexneri 2a str. 2457T
guuaucaagugcuuucau

SEQ ID NO: 3878373 - RNA, 23 nt, Shigella flexneri 2a str. 2457T
guuaucagaaccgcccagaccug

SEQ ID NO: 3878374 - RNA, 16 nt, Shigella flexneri 2a str. 2457T
guuaucagcaacuggc

SEQ ID NO: 3878375 - RNA, 17 nt, Shigella flexneri 2a str. 2457T
guuaucagcaacuggca

SEQ ID NO: 3878376 - RNA, 20 nt, Shigella flexneri 2a str. 2457T
guuauccgacuuauucuuca

SEQ ID NO: 3878377 - RNA, 23 nt, Shigella flexneri 2a str. 2457T
guuauccugaucaagcacaugcu

SEQ ID NO: 3878378 - RNA, 13 nt, Shigella flexneri 2a str. 2457T
guuaugccucaac

SEQ ID NO: 3878379 - RNA, 13 nt, Shigella flexneri 2a str. 2457T
guuaugcucggca

SEQ ID NO: 3878380 - RNA, 20 nt, Shigella flexneri 2a str. 2457T
guuauuaaauaaccagcgca

SEQ ID NO: 3878381 - RNA, 22 nt, Shigella flexneri 2a str. 2457T
guuauuacugcguauuuccugc

SEQ ID NO: 3878382 - RNA, 15 nt, Shigella flexneri 2a str. 2457T
guuauucgcuuccuc

SEQ ID NO: 3878383 - RNA, 14 nt, Shigella flexneri 2a str. 2457T
guuauugaucgcca

SEQ ID NO: 3878384 - RNA, 22 nt, Shigella flexneri 2a str. 2457T
guuauugguauggucgugauca

SEQ ID NO: 3878385 - RNA, 22 nt, Shigella flexneri 2a str. 2457T
guuauugucgggcguuucgcca

SEQ ID NO: 3878386 - RNA, 11 nt, Shigella flexneri 2a str. 2457T
guuauuuccag

SEQ ID NO: 3878387 - RNA, 17 nt, Shigella flexneri 2a str. 2457T
guucaaaaacuaauuca

SEQ ID NO: 3878388 - RNA, 18 nt, Shigella flexneri 2a str. 2457T
guucaacgcccgcuuuca

SEQ ID NO: 3878389 - RNA, 17 nt, Shigella flexneri 2a str. 2457T
guucaauacccacugcg

SEQ ID NO: 3878390 - RNA, 19 nt, Shigella flexneri 2a str. 2457T
guucaauacccacugcgca

SEQ ID NO: 3878391 - RNA, 22 nt, Shigella flexneri 2a str. 2457T
guucaauacgcaguuuugucuu

SEQ ID NO: 3878392 - RNA, 13 nt, Shigella flexneri 2a str. 2457T
guucaauuuccag

SEQ ID NO: 3878393 - RNA, 15 nt, Shigella flexneri 2a str. 2457T
guucacgcagcucac

SEQ ID NO: 3878394 - RNA, 18 nt, Shigella flexneri 2a str. 2457T
guucacgcagcuucucgu

SEQ ID NO: 3878395 - RNA, 22 nt, Shigella flexneri 2a str. 2457T
guucacgccaucaucggcaaac

SEQ ID NO: 3878396 - RNA, 20 nt, Shigella flexneri 2a str. 2457T
guucacgccgcauccggcau

SEQ ID NO: 3878397 - RNA, 19 nt, Shigella flexneri 2a str. 2457T
guucacgccgcaucuggca

SEQ ID NO: 3878398 - RNA, 22 nt, Shigella flexneri 2a str. 2457T
guucacggcgauaccaguaaua

SEQ ID NO: 3878399 - RNA, 18 nt, Shigella flexneri 2a str. 2457T
guucacucaucaacguuu

SEQ ID NO: 3878400 - RNA, 22 nt, Shigella flexneri 2a str. 2457T
guucacugccguacaggcagcu

SEQ ID NO: 3878401 - RNA, 21 nt, Shigella flexneri 2a str. 2457T
guucacuuaaucucugacgcg

SEQ ID NO: 3878402 - RNA, 19 nt, Shigella flexneri 2a str. 2457T
guucacuuuugcugcaaaa

SEQ ID NO: 3878403 - RNA, 14 nt, Shigella flexneri 2a str. 2457T
guucagaaagcgcc

SEQ ID NO: 3878404 - RNA, 15 nt, Shigella flexneri 2a str. 2457T
guucagcaguucugc

SEQ ID NO: 3878405 - RNA, 22 nt, Shigella flexneri 2a str. 2457T
guucagcaguucugccaggcug

SEQ ID NO: 3878406 - RNA, 18 nt, Shigella flexneri 2a str. 2457T
guucagccugacagcacg

SEQ ID NO: 3878407 - RNA, 18 nt, Shigella flexneri 2a str. 2457T
guucagcgggcagggcau

SEQ ID NO: 3878408 - RNA, 23 nt, Shigella flexneri 2a str. 2457T
guucagcguacguucauggcgcg

SEQ ID NO: 3878409 - RNA, 22 nt, Shigella flexneri 2a str. 2457T
guucagcgucggcgucaucgac

SEQ ID NO: 3878410 - RNA, 18 nt, Shigella flexneri 2a str. 2457T
guucaguacgaaauaacu

SEQ ID NO: 3878411 - RNA, 14 nt, Shigella flexneri 2a str. 2457T
guucagugaucgcc

SEQ ID NO: 3878412 - RNA, 18 nt, Shigella flexneri 2a str. 2457T
guucauccccucuuccau

SEQ ID NO: 3878413 - RNA, 14 nt, Shigella flexneri 2a str. 2457T
guucaucucaaaca

SEQ ID NO: 3878414 - RNA, 20 nt, Shigella flexneri 2a str. 2457T
guuccacauaaaguagccaa

SEQ ID NO: 3878415 - RNA, 18 nt, Shigella flexneri 2a str. 2457T
guuccaccgcguuuucca

SEQ ID NO: 3878416 - RNA, 22 nt, Shigella flexneri 2a str. 2457T
guuccaccgcguuuuccaguuc

SEQ ID NO: 3878417 - RNA, 15 nt, Shigella flexneri 2a str. 2457T
guuccacucuuucag

SEQ ID NO: 3878418 - RNA, 18 nt, Shigella flexneri 2a str. 2457T
guuccagaccauauuuuc

SEQ ID NO: 3878419 - RNA, 14 nt, Shigella flexneri 2a str. 2457T
guuccagcaucucc

SEQ ID NO: 3878420 - RNA, 17 nt, Shigella flexneri 2a str. 2457T
guuccagcaucuccugc

SEQ ID NO: 3878421 - RNA, 20 nt, Shigella flexneri 2a str. 2457T
guuccagcaucuccugcaac

SEQ ID NO: 3878422 - RNA, 22 nt, Shigella flexneri 2a str. 2457T
guuccagcuucagauucagcgu

SEQ ID NO: 3878423 - RNA, 20 nt, Shigella flexneri 2a str. 2457T
guuccagggccuccugcagc

SEQ ID NO: 3878424 - RNA, 21 nt, Shigella flexneri 2a str. 2457T
guuccagugcguacccagcgu

SEQ ID NO: 3878425 - RNA, 17 nt, Shigella flexneri 2a str. 2457T
guuccauaaucgccuga

SEQ ID NO: 3878426 - RNA, 22 nt, Shigella flexneri 2a str. 2457T
guuccauaccgucgccagacgc

SEQ ID NO: 3878427 - RNA, 15 nt, Shigella flexneri 2a str. 2457T
guuccaucaccagau

SEQ ID NO: 3878428 - RNA, 21 nt, Shigella flexneri 2a str. 2457T
guuccaucuuuaugaaauauc

SEQ ID NO: 3878429 - RNA, 14 nt, Shigella flexneri 2a str. 2457T
guucccaacaacag

SEQ ID NO: 3878430 - RNA, 21 nt, Shigella flexneri 2a str. 2457T
guucccccugccagaccauuu

SEQ ID NO: 3878431 - RNA, 13 nt, Shigella flexneri 2a str. 2457T
guuccccucaccc

SEQ ID NO: 3878432 - RNA, 13 nt, Shigella flexneri 2a str. 2457T
guuccgauaaguu

SEQ ID NO: 3878433 - RNA, 22 nt, Shigella flexneri 2a str. 2457T
guuccgccauuuuaaucaucug

SEQ ID NO: 3878434 - RNA, 22 nt, Shigella flexneri 2a str. 2457T
guuccggcaacgacgucgauuu

SEQ ID NO: 3878435 - RNA, 15 nt, Shigella flexneri 2a str. 2457T
guuccugcaucgccu

SEQ ID NO: 3878436 - RNA, 19 nt, Shigella flexneri 2a str. 2457T
guuccugccagauuugcug

SEQ ID NO: 3878437 - RNA, 12 nt, Shigella flexneri 2a str. 2457T
guuccuggggaa

SEQ ID NO: 3878438 - RNA, 17 nt, Shigella flexneri 2a str. 2457T
guuccuggggaaaaugg

SEQ ID NO: 3878439 - RNA, 17 nt, Shigella flexneri 2a str. 2457T
guuccuugcgcuuucuu

SEQ ID NO: 3878440 - RNA, 20 nt, Shigella flexneri 2a str. 2457T
guucgacaagcguuagcgug

SEQ ID NO: 3878441 - RNA, 13 nt, Shigella flexneri 2a str. 2457T
guucgagcaucac

SEQ ID NO: 3878442 - RNA, 16 nt, Shigella flexneri 2a str. 2457T
guucgauggcgcgcca

SEQ ID NO: 3878443 - RNA, 15 nt, Shigella flexneri 2a str. 2457T
guucgauuucauuca

SEQ ID NO: 3878444 - RNA, 14 nt, Shigella flexneri 2a str. 2457T
guucgauuucccag

SEQ ID NO: 3878445 - RNA, 22 nt, Shigella flexneri 2a str. 2457T
guucgcaaagguuuuaccgcac

SEQ ID NO: 3878446 - RNA, 23 nt, Shigella flexneri 2a str. 2457T
guucgcauacggguuuuccccuu

SEQ ID NO: 3878447 - RNA, 22 nt, Shigella flexneri 2a str. 2457T
guucgcccacgcgcauucccag

SEQ ID NO: 3878448 - RNA, 22 nt, Shigella flexneri 2a str. 2457T
guucgcgaaaguuaccgcgcca

SEQ ID NO: 3878449 - RNA, 18 nt, Shigella flexneri 2a str. 2457T
guucgcgcgcugccagaa

SEQ ID NO: 3878450 - RNA, 20 nt, Shigella flexneri 2a str. 2457T
guucgcguaacugcugcuca

SEQ ID NO: 3878451 - RNA, 21 nt, Shigella flexneri 2a str. 2457T
guucgcguacugcugaccguu

SEQ ID NO: 3878452 - RNA, 16 nt, Shigella flexneri 2a str. 2457T
guucgcuaaagacuuu

SEQ ID NO: 3878453 - RNA, 14 nt, Shigella flexneri 2a str. 2457T
guucggaguggcag

SEQ ID NO: 3878454 - RNA, 15 nt, Shigella flexneri 2a str. 2457T
guucggcgguuuuuu

SEQ ID NO: 3878455 - RNA, 20 nt, Shigella flexneri 2a str. 2457T
guucggggcuguuuuccagc

SEQ ID NO: 3878456 - RNA, 20 nt, Shigella flexneri 2a str. 2457T
guucgguauuaaucugccag

SEQ ID NO: 3878457 - RNA, 11 nt, Shigella flexneri 2a str. 2457T
guucguccauu

SEQ ID NO: 3878458 - RNA, 20 nt, Shigella flexneri 2a str. 2457T
guucgucgucuuuauccuga

SEQ ID NO: 3878459 - RNA, 20 nt, Shigella flexneri 2a str. 2457T
guucgugacgucucaaucac

SEQ ID NO: 3878460 - RNA, 22 nt, Shigella flexneri 2a str. 2457T
guucguuauugggguuacgacc

SEQ ID NO: 3878461 - RNA, 18 nt, Shigella flexneri 2a str. 2457T
guugggcgcuggcggcug

SEQ ID NO: 3878462 - RNA, 14 nt, Shigella flexneri 2a str. 2457T
guugguaaccaaau

SEQ ID NO: 3878463 - RNA, 14 nt, Shigella flexneri 2a str. 2457T
guuggugcgaucug

SEQ ID NO: 3878464 - RNA, 21 nt, Shigella flexneri 2a str. 2457T
guuguaaaaaaccccgcuccg

SEQ ID NO: 3878465 - RNA, 15 nt, Shigella flexneri 2a str. 2457T
guuguaaucaccacu

SEQ ID NO: 3878466 - RNA, 14 nt, Shigella flexneri 2a str. 2457T
guuguaaugacaac

SEQ ID NO: 3878467 - RNA, 14 nt, Shigella flexneri 2a str. 2457T
guuguacauuacca

SEQ ID NO: 3878468 - RNA, 22 nt, Shigella flexneri 2a str. 2457T
guuguagaccggaaaagguguu

SEQ ID NO: 3878469 - RNA, 15 nt, Shigella flexneri 2a str. 2457T
guugucagcaacugu

SEQ ID NO: 3878470 - RNA, 20 nt, Shigella flexneri 2a str. 2457T
guugucgauaaacaguuucg

SEQ ID NO: 3878471 - RNA, 21 nt, Shigella flexneri 2a str. 2457T
guugucgauaaacaguuucgc

SEQ ID NO: 3878472 - RNA, 16 nt, Shigella flexneri 2a str. 2457T
guugucgccgcuggug

SEQ ID NO: 3878473 - RNA, 16 nt, Shigella flexneri 2a str. 2457T
guugucgcuguaaugu

SEQ ID NO: 3878474 - RNA, 18 nt, Shigella flexneri 2a str. 2457T
guugugccuuccaucccu

SEQ ID NO: 3878475 - RNA, 16 nt, Shigella flexneri 2a str. 2457T
guugugucgccagcaa

SEQ ID NO: 3878476 - RNA, 14 nt, Shigella flexneri 2a str. 2457T
guuguuccuuccag

SEQ ID NO: 3878477 - RNA, 14 nt, Shigella flexneri 2a str. 2457T
guuguucgcgcaca

SEQ ID NO: 3878478 - RNA, 21 nt, Shigella flexneri 2a str. 2457T
guuuaacacgcucuggcaggc

SEQ ID NO: 3878479 - RNA, 14 nt, Shigella flexneri 2a str. 2457T
guuuaaccaucagg

SEQ ID NO: 3878480 - RNA, 22 nt, Shigella flexneri 2a str. 2457T
guuuaacgccuucccuuucagc

SEQ ID NO: 3878481 - RNA, 14 nt, Shigella flexneri 2a str. 2457T
guuuaagacgccgc

SEQ ID NO: 3878482 - RNA, 16 nt, Shigella flexneri 2a str. 2457T
guuuaaggcaguucuc

SEQ ID NO: 3878483 - RNA, 21 nt, Shigella flexneri 2a str. 2457T
guuuaauucugcggcaaugcg

SEQ ID NO: 3878484 - RNA, 23 nt, Shigella flexneri 2a str. 2457T
guuuacccuucgcacgcgaacaa

SEQ ID NO: 3878485 - RNA, 14 nt, Shigella flexneri 2a str. 2457T
guuuaccgccauca

SEQ ID NO: 3878486 - RNA, 18 nt, Shigella flexneri 2a str. 2457T
guuuaccugaauaucgcc

SEQ ID NO: 3878487 - RNA, 20 nt, Shigella flexneri 2a str. 2457T
guuuacgccgcauccggcau

SEQ ID NO: 3878488 - RNA, 19 nt, Shigella flexneri 2a str. 2457T
guuuacugucugcuucugc

SEQ ID NO: 3878489 - RNA, 22 nt, Shigella flexneri 2a str. 2457T
guuuagagacgcauugauaaug

SEQ ID NO: 3878490 - RNA, 20 nt, Shigella flexneri 2a str. 2457T
guuuagccgcuucugcagcu

SEQ ID NO: 3878491 - RNA, 13 nt, Shigella flexneri 2a str. 2457T
guuuauccauccc

SEQ ID NO: 3878492 - RNA, 18 nt, Shigella flexneri 2a str. 2457T
guuuaucccaauuaucug

SEQ ID NO: 3878493 - RNA, 18 nt, Shigella flexneri 2a str. 2457T
guuuaucuacagcauuuc

SEQ ID NO: 3878494 - RNA, 14 nt, Shigella flexneri 2a str. 2457T
guuuaucuucccag

SEQ ID NO: 3878495 - RNA, 16 nt, Shigella flexneri 2a str. 2457T
guuucaaaaacaaaga

SEQ ID NO: 3878496 - RNA, 14 nt, Shigella flexneri 2a str. 2457T
guuucaaacaggcu

SEQ ID NO: 3878497 - RNA, 16 nt, Shigella flexneri 2a str. 2457T
guuucaaacaggcugc

SEQ ID NO: 3878498 - RNA, 15 nt, Shigella flexneri 2a str. 2457T
guuucaacacaggau

SEQ ID NO: 3878499 - RNA, 21 nt, Shigella flexneri 2a str. 2457T
guuucaacgacccagccagac

SEQ ID NO: 3878500 - RNA, 23 nt, Shigella flexneri 2a str. 2457T
guuucaacggaccaauaaacgcc

SEQ ID NO: 3878501 - RNA, 16 nt, Shigella flexneri 2a str. 2457T
guuucaaugcucugca

SEQ ID NO: 3878502 - RNA, 20 nt, Shigella flexneri 2a str. 2457T
guuucaccgcacgacgaauc

SEQ ID NO: 3878503 - RNA, 13 nt, Shigella flexneri 2a str. 2457T
guuucaccgcgua

SEQ ID NO: 3878504 - RNA, 16 nt, Shigella flexneri 2a str. 2457T
guuucacuuucugcaa

SEQ ID NO: 3878505 - RNA, 18 nt, Shigella flexneri 2a str. 2457T
guuucagaccaauaaucc

SEQ ID NO: 3878506 - RNA, 20 nt, Shigella flexneri 2a str. 2457T
guuucagccccaucaacgcc

SEQ ID NO: 3878507 - RNA, 14 nt, Shigella flexneri 2a str. 2457T
guuucaguaauccu

SEQ ID NO: 3878508 - RNA, 16 nt, Shigella flexneri 2a str. 2457T
guuucauaucugccag

SEQ ID NO: 3878509 - RNA, 13 nt, Shigella flexneri 2a str. 2457T
guuucaucuucag

SEQ ID NO: 3878510 - RNA, 22 nt, Shigella flexneri 2a str. 2457T
guuuccacggauaacaaaauaa

SEQ ID NO: 3878511 - RNA, 13 nt, Shigella flexneri 2a str. 2457T
guuuccagauuuu

SEQ ID NO: 3878512 - RNA, 12 nt, Shigella flexneri 2a str. 2457T
guuuccagcacc

SEQ ID NO: 3878513 - RNA, 11 nt, Shigella flexneri 2a str. 2457T
guuuccagcag

SEQ ID NO: 3878514 - RNA, 21 nt, Shigella flexneri 2a str. 2457T
guuuccagcaucgaccaggau

SEQ ID NO: 3878515 - RNA, 22 nt, Shigella flexneri 2a str. 2457T
guuuccagcucggcaaucuguu

SEQ ID NO: 3878516 - RNA, 17 nt, Shigella flexneri 2a str. 2457T
guuucgaauuacacagc

SEQ ID NO: 3878517 - RNA, 20 nt, Shigella flexneri 2a str. 2457T
guuucgaauuacacagccac

SEQ ID NO: 3878518 - RNA, 19 nt, Shigella flexneri 2a str. 2457T
guuucgcagucgccagcaa

SEQ ID NO: 3878519 - RNA, 14 nt, Shigella flexneri 2a str. 2457T
guuucgccugccag

SEQ ID NO: 3878520 - RNA, 22 nt, Shigella flexneri 2a str. 2457T
guuucgccuuuugauacucugu

SEQ ID NO: 3878521 - RNA, 16 nt, Shigella flexneri 2a str. 2457T
guuucgcuucuucagc

SEQ ID NO: 3878522 - RNA, 18 nt, Shigella flexneri 2a str. 2457T
guuucggcaucagcagaa

SEQ ID NO: 3878523 - RNA, 18 nt, Shigella flexneri 2a str. 2457T
guuucggucauuuugacc

SEQ ID NO: 3878524 - RNA, 15 nt, Shigella flexneri 2a str. 2457T
guuucgugcaucaug

SEQ ID NO: 3878525 - RNA, 18 nt, Shigella flexneri 2a str. 2457T
guuucgugcaucauggaa

SEQ ID NO: 3878526 - RNA, 18 nt, Shigella flexneri 2a str. 2457T
guuucguggauaacaccg

SEQ ID NO: 3878527 - RNA, 18 nt, Shigella flexneri 2a str. 2457T
guuucucugacgcucucu

SEQ ID NO: 3878528 - RNA, 12 nt, Shigella flexneri 2a str. 2457T
guuucucuucug

SEQ ID NO: 3878529 - RNA, 13 nt, Shigella flexneri 2a str. 2457T
guuucucuuucuu

SEQ ID NO: 3878530 - RNA, 21 nt, Shigella flexneri 2a str. 2457T
guuucugaauuucagcgccug

SEQ ID NO: 3878531 - RNA, 20 nt, Shigella flexneri 2a str. 2457T
guuucugacauuuuuacucc

SEQ ID NO: 3878532 - RNA, 16 nt, Shigella flexneri 2a str. 2457T
guuucugcagcuccag

SEQ ID NO: 3878533 - RNA, 22 nt, Shigella flexneri 2a str. 2457T
guuucuuugccgaggaagacaa

SEQ ID NO: 3878534 - RNA, 21 nt, Shigella flexneri 2a str. 2457T
guuugacuuauaagucucaga

SEQ ID NO: 3878535 - RNA, 16 nt, Shigella flexneri 2a str. 2457T
guuugaucacuuccag

SEQ ID NO: 3878536 - RNA, 18 nt, Shigella flexneri 2a str. 2457T
guuugaucacuuccagca

SEQ ID NO: 3878537 - RNA, 17 nt, Shigella flexneri 2a str. 2457T
guuugauuauucacaau

SEQ ID NO: 3878538 - RNA, 23 nt, Shigella flexneri 2a str. 2457T
guuugcaggguuaauugaugguu

SEQ ID NO: 3878539 - RNA, 15 nt, Shigella flexneri 2a str. 2457T
guuugcauccagcuc

SEQ ID NO: 3878540 - RNA, 16 nt, Shigella flexneri 2a str. 2457T
guuugccaccugugca

SEQ ID NO: 3878541 - RNA, 23 nt, Shigella flexneri 2a str. 2457T
guuugccaugacuuucuggcacg

SEQ ID NO: 3878542 - RNA, 12 nt, Shigella flexneri 2a str. 2457T
guuugccauuuu

SEQ ID NO: 3878543 - RNA, 19 nt, Shigella flexneri 2a str. 2457T
guuugccguugaucucucc

SEQ ID NO: 3878544 - RNA, 22 nt, Shigella flexneri 2a str. 2457T
guuugccuuucggcgcagucac

SEQ ID NO: 3878545 - RNA, 12 nt, Shigella flexneri 2a str. 2457T
guuugcugcaug

SEQ ID NO: 3878546 - RNA, 19 nt, Shigella flexneri 2a str. 2457T
guuugcugccuucacggcu

SEQ ID NO: 3878547 - RNA, 13 nt, Shigella flexneri 2a str. 2457T
guuuggcaaauac

SEQ ID NO: 3878548 - RNA, 22 nt, Shigella flexneri 2a str. 2457T
guuuggccgcgccaaugccuga

SEQ ID NO: 3878549 - RNA, 22 nt, Shigella flexneri 2a str. 2457T
guuuguaacccaccaugccgau

SEQ ID NO: 3878550 - RNA, 13 nt, Shigella flexneri 2a str. 2457T
guuuguagcagaa

SEQ ID NO: 3878551 - RNA, 21 nt, Shigella flexneri 2a str. 2457T
guuugucauaaaucucagccc

SEQ ID NO: 3878552 - RNA, 17 nt, Shigella flexneri 2a str. 2457T
guuugugggaauaacca

SEQ ID NO: 3878553 - RNA, 17 nt, Shigella flexneri 2a str. 2457T
guuuguuacgauagaau

SEQ ID NO: 3878554 - RNA, 16 nt, Shigella flexneri 2a str. 2457T
guuuguucaagcgcaa

SEQ ID NO: 3878555 - RNA, 12 nt, Shigella flexneri 2a str. 2457T
guuuguucagcu

SEQ ID NO: 3878556 - RNA, 17 nt, Shigella flexneri 2a str. 2457T
guuuuaaagcaaaaaaa

SEQ ID NO: 3878557 - RNA, 19 nt, Shigella flexneri 2a str. 2457T
guuuuaaucacuucuucuu

SEQ ID NO: 3878558 - RNA, 16 nt, Shigella flexneri 2a str. 2457T
uaaaacgagauagcgu

SEQ ID NO: 3878559 - RNA, 23 nt, Shigella flexneri 2a str. 2457T
uaaaacgcacgcugucaccagug

SEQ ID NO: 3878560 - RNA, 20 nt, Shigella flexneri 2a str. 2457T
uaaaacgcagucuucccagc

SEQ ID NO: 3878561 - RNA, 23 nt, Shigella flexneri 2a str. 2457T
uaaaacgcagucuucccagcccc

SEQ ID NO: 3878562 - RNA, 14 nt, Shigella flexneri 2a str. 2457T
uaaaacgugccauu

SEQ ID NO: 3878563 - RNA, 17 nt, Shigella flexneri 2a str. 2457T
uaaaacuuuauucagug

SEQ ID NO: 3878564 - RNA, 19 nt, Shigella flexneri 2a str. 2457T
uaaaagaaggcgauguucu

SEQ ID NO: 3878565 - RNA, 12 nt, Shigella flexneri 2a str. 2457T
uaaaagcaaaaa

SEQ ID NO: 3878566 - RNA, 21 nt, Shigella flexneri 2a str. 2457T
uaaaagcacagaaucuaagau

SEQ ID NO: 3878567 - RNA, 20 nt, Shigella flexneri 2a str. 2457T
uaaaagccaggagccaacac

SEQ ID NO: 3878568 - RNA, 20 nt, Shigella flexneri 2a str. 2457T
uaaaagcgcgcccaacagua

SEQ ID NO: 3878569 - RNA, 15 nt, Shigella flexneri 2a str. 2457T
uaaaagcgugaaaca

SEQ ID NO: 3878570 - RNA, 21 nt, Shigella flexneri 2a str. 2457T
uaaaagcgugaaacaaaucac

SEQ ID NO: 3878571 - RNA, 12 nt, Shigella flexneri 2a str. 2457T
uaaaaggaaaca

SEQ ID NO: 3878572 - RNA, 14 nt, Shigella flexneri 2a str. 2457T
uaaaaggagauaaa

SEQ ID NO: 3878573 - RNA, 15 nt, Shigella flexneri 2a str. 2457T
uaaaaggagauaaac

SEQ ID NO: 3878574 - RNA, 15 nt, Shigella flexneri 2a str. 2457T
uaaaaggauguuuau

SEQ ID NO: 3878575 - RNA, 18 nt, Shigella flexneri 2a str. 2457T
uaaaaggcgccauuuuca

SEQ ID NO: 3878576 - RNA, 21 nt, Shigella flexneri 2a str. 2457T
uaaaauaucuuccacuucacg

SEQ ID NO: 3878577 - RNA, 12 nt, Shigella flexneri 2a str. 2457T
uaaaauauugaa

SEQ ID NO: 3878578 - RNA, 18 nt, Shigella flexneri 2a str. 2457T
uaaaaucagaaaucacca

SEQ ID NO: 3878579 - RNA, 18 nt, Shigella flexneri 2a str. 2457T
uaaaaucgacaucugcaa

SEQ ID NO: 3878580 - RNA, 20 nt, Shigella flexneri 2a str. 2457T
uaaaaucgacaucugcaauu

SEQ ID NO: 3878581 - RNA, 21 nt, Shigella flexneri 2a str. 2457T
uaaaaugacucgccgcugugg

SEQ ID NO: 3878582 - RNA, 15 nt, Shigella flexneri 2a str. 2457T
uaaaaugauacgcuc

SEQ ID NO: 3878583 - RNA, 17 nt, Shigella flexneri 2a str. 2457T
uaaaaugauacgcuccc

SEQ ID NO: 3878584 - RNA, 19 nt, Shigella flexneri 2a str. 2457T
uaaaauuauagggaugcag

SEQ ID NO: 3878585 - RNA, 22 nt, Shigella flexneri 2a str. 2457T
uaaaauuauccagcuuuuccca

SEQ ID NO: 3878586 - RNA, 21 nt, Shigella flexneri 2a str. 2457T
uaaaauuaucgccucuaaagu

SEQ ID NO: 3878587 - RNA, 15 nt, Shigella flexneri 2a str. 2457T
uaaaauucaucaaau

SEQ ID NO: 3878588 - RNA, 17 nt, Shigella flexneri 2a str. 2457T
uaaaauucauucaauua

SEQ ID NO: 3878589 - RNA, 22 nt, Shigella flexneri 2a str. 2457T
uaaaauucuuacguaauuuaua

SEQ ID NO: 3878590 - RNA, 13 nt, Shigella flexneri 2a str. 2457T
uaaaauuuaacau

SEQ ID NO: 3878591 - RNA, 12 nt, Shigella flexneri 2a str. 2457T
uaaacaaagcgc

SEQ ID NO: 3878592 - RNA, 20 nt, Shigella flexneri 2a str. 2457T
uaaacaagcguacaaaauua

SEQ ID NO: 3878593 - RNA, 17 nt, Shigella flexneri 2a str. 2457T
uaaacaagguuugaaaa

SEQ ID NO: 3878594 - RNA, 21 nt, Shigella flexneri 2a str. 2457T
uaaacaaugagauauuuaaau

SEQ ID NO: 3878595 - RNA, 18 nt, Shigella flexneri 2a str. 2457T
uaaacaccagcaauaaug

SEQ ID NO: 3878596 - RNA, 21 nt, Shigella flexneri 2a str. 2457T
uaaacaccugggcaaugguga

SEQ ID NO: 3878597 - RNA, 17 nt, Shigella flexneri 2a str. 2457T
uaaacaccuucauccag

SEQ ID NO: 3878598 - RNA, 18 nt, Shigella flexneri 2a str. 2457T
uaaacaccuucauccagc

SEQ ID NO: 3878599 - RNA, 15 nt, Shigella flexneri 2a str. 2457T
uaaacagacaguaau

SEQ ID NO: 3878600 - RNA, 17 nt, Shigella flexneri 2a str. 2457T
uaaacagcgcugcgaaa

SEQ ID NO: 3878601 - RNA, 17 nt, Shigella flexneri 2a str. 2457T
uaaacagguaaagacca

SEQ ID NO: 3878602 - RNA, 23 nt, Shigella flexneri 2a str. 2457T
uaaacagguaaagaccauaaaua

SEQ ID NO: 3878603 - RNA, 20 nt, Shigella flexneri 2a str. 2457T
uaaacaguacgagagaagag

SEQ ID NO: 3878604 - RNA, 18 nt, Shigella flexneri 2a str. 2457T
uaaacaucaaaccacuua

SEQ ID NO: 3878605 - RNA, 16 nt, Shigella flexneri 2a str. 2457T
uaaacauuaaaauucu

SEQ ID NO: 3878606 - RNA, 15 nt, Shigella flexneri 2a str. 2457T
uaaaccacccaccag

SEQ ID NO: 3878607 - RNA, 20 nt, Shigella flexneri 2a str. 2457T
uaaaccacccaccagcgccg

SEQ ID NO: 3878608 - RNA, 16 nt, Shigella flexneri 2a str. 2457T
uaaaccacugacacag

SEQ ID NO: 3878609 - RNA, 19 nt, Shigella flexneri 2a str. 2457T
uaaacccgaccacuuccac

SEQ ID NO: 3878610 - RNA, 15 nt, Shigella flexneri 2a str. 2457T
uaaacccuaacauca

SEQ ID NO: 3878611 - RNA, 23 nt, Shigella flexneri 2a str. 2457T
uaaaccgaaucuguuuuuuggug

SEQ ID NO: 3878612 - RNA, 19 nt, Shigella flexneri 2a str. 2457T
uaaaccggacaauaaaaaa

SEQ ID NO: 3878613 - RNA, 21 nt, Shigella flexneri 2a str. 2457T
uaaaccgucagcaccagggaa

SEQ ID NO: 3878614 - RNA, 13 nt, Shigella flexneri 2a str. 2457T
uaaaccuccagca

SEQ ID NO: 3878615 - RNA, 17 nt, Shigella flexneri 2a str. 2457T
uaaaccuccagcaucag

SEQ ID NO: 3878616 - RNA, 12 nt, Shigella flexneri 2a str. 2457T
uaaaccuucauc

SEQ ID NO: 3878617 - RNA, 20 nt, Shigella flexneri 2a str. 2457T
uaaacgcccaauccggccua

SEQ ID NO: 3878618 - RNA, 19 nt, Shigella flexneri 2a str. 2457T
uaaacgccugcuuaucgcc

SEQ ID NO: 3878619 - RNA, 14 nt, Shigella flexneri 2a str. 2457T
uaaacgccuuaucc

SEQ ID NO: 3878620 - RNA, 20 nt, Shigella flexneri 2a str. 2457T
uaaacgccuuauccagccua

SEQ ID NO: 3878621 - RNA, 20 nt, Shigella flexneri 2a str. 2457T
uaaacgccuuauccggccua

SEQ ID NO: 3878622 - RNA, 20 nt, Shigella flexneri 2a str. 2457T
uaaacgccuuauccggcuua

SEQ ID NO: 3878623 - RNA, 15 nt, Shigella flexneri 2a str. 2457T
uaaacgcuauuugcc

SEQ ID NO: 3878624 - RNA, 20 nt, Shigella flexneri 2a str. 2457T
uaaacgcuuuguccggccca

SEQ ID NO: 3878625 - RNA, 20 nt, Shigella flexneri 2a str. 2457T
uaaacgcuuuuuugagcagc

SEQ ID NO: 3878626 - RNA, 22 nt, Shigella flexneri 2a str. 2457T
uaaacgggcguauaacacgccc

SEQ ID NO: 3878627 - RNA, 23 nt, Shigella flexneri 2a str. 2457T
uaaacgguaagcccgugaccagc

SEQ ID NO: 3878628 - RNA, 12 nt, Shigella flexneri 2a str. 2457T
uaaacgguaccg

SEQ ID NO: 3878629 - RNA, 15 nt, Shigella flexneri 2a str. 2457T
uaaacgucucacuaa

SEQ ID NO: 3878630 - RNA, 21 nt, Shigella flexneri 2a str. 2457T
uaaacguggggucucugcaaa

SEQ ID NO: 3878631 - RNA, 21 nt, Shigella flexneri 2a str. 2457T
uaaacgugugugccagguucg

SEQ ID NO: 3878632 - RNA, 12 nt, Shigella flexneri 2a str. 2457T
uaaacucaaagu

SEQ ID NO: 3878633 - RNA, 12 nt, Shigella flexneri 2a str. 2457T
uaaacuccuuuc

SEQ ID NO: 3878634 - RNA, 15 nt, Shigella flexneri 2a str. 2457T
uaaacucugccgcaa

SEQ ID NO: 3878635 - RNA, 22 nt, Shigella flexneri 2a str. 2457T
uaaacugagccaaacgcccagc

SEQ ID NO: 3878636 - RNA, 13 nt, Shigella flexneri 2a str. 2457T
uaaacuggcugug

SEQ ID NO: 3878637 - RNA, 20 nt, Shigella flexneri 2a str. 2457T
uaaacuuacugacaucaaac

SEQ ID NO: 3878638 - RNA, 12 nt, Shigella flexneri 2a str. 2457T
uaaacuuggcua

SEQ ID NO: 3878639 - RNA, 14 nt, Shigella flexneri 2a str. 2457T
uaaacuuuuucgcg

SEQ ID NO: 3878640 - RNA, 15 nt, Shigella flexneri 2a str. 2457T
uaaagaaaaagcgcc

SEQ ID NO: 3878641 - RNA, 23 nt, Shigella flexneri 2a str. 2457T
uaaagaaaguaaucuauauuucu

SEQ ID NO: 3878642 - RNA, 22 nt, Shigella flexneri 2a str. 2457T
uaaagaacucgaggauaaauuu

SEQ ID NO: 3878643 - RNA, 22 nt, Shigella flexneri 2a str. 2457T
uaaagaccauugaugcucuccg

SEQ ID NO: 3878644 - RNA, 22 nt, Shigella flexneri 2a str. 2457T
uaaagacguuaacuacaaucac

SEQ ID NO: 3878645 - RNA, 20 nt, Shigella flexneri 2a str. 2457T
uaaagagaacucuuuuuucc

SEQ ID NO: 3878646 - RNA, 15 nt, Shigella flexneri 2a str. 2457T
uaaagaguaaauugc

SEQ ID NO: 3878647 - RNA, 24 nt, Shigella flexneri 2a str. 2457T
uaaagaguaaauugcaaaccucag

SEQ ID NO: 3878648 - RNA, 16 nt, Shigella flexneri 2a str. 2457T
uaaagaguucaaagcc

SEQ ID NO: 3878649 - RNA, 23 nt, Shigella flexneri 2a str. 2457T
uaaagaguuuaucuguuaaucug

SEQ ID NO: 3878650 - RNA, 15 nt, Shigella flexneri 2a str. 2457T
uaaagcaaaaaaaga

SEQ ID NO: 3878651 - RNA, 11 nt, Shigella flexneri 2a str. 2457T
uaaagcaauga

SEQ ID NO: 3878652 - RNA, 19 nt, Shigella flexneri 2a str. 2457T
uaaagcaucugccagccau

SEQ ID NO: 3878653 - RNA, 19 nt, Shigella flexneri 2a str. 2457T
uaaagcccccgcaacauug

SEQ ID NO: 3878654 - RNA, 17 nt, Shigella flexneri 2a str. 2457T
uaaagcccucaccgaag

SEQ ID NO: 3878655 - RNA, 20 nt, Shigella flexneri 2a str. 2457T
uaacacucgugcgucgcauc

SEQ ID NO: 3878656 - RNA, 16 nt, Shigella flexneri 2a str. 2457T
uaacagcaaaacgccc

SEQ ID NO: 3878657 - RNA, 14 nt, Shigella flexneri 2a str. 2457T
uaacagcagcagcg

SEQ ID NO: 3878658 - RNA, 16 nt, Shigella flexneri 2a str. 2457T
uaacagcaucgcauca

SEQ ID NO: 3878659 - RNA, 17 nt, Shigella flexneri 2a str. 2457T
uaacagcguccacagcc

SEQ ID NO: 3878660 - RNA, 15 nt, Shigella flexneri 2a str. 2457T
uaacaggaagcagcu

SEQ ID NO: 3878661 - RNA, 15 nt, Shigella flexneri 2a str. 2457T
uaacaggauuuucua

SEQ ID NO: 3878662 - RNA, 22 nt, Shigella flexneri 2a str. 2457T
uaacaggauuuucuaauauuag

SEQ ID NO: 3878663 - RNA, 17 nt, Shigella flexneri 2a str. 2457T
uaacagggaaugugaug

SEQ ID NO: 3878664 - RNA, 17 nt, Shigella flexneri 2a str. 2457T
uaacagugcaccggaca

SEQ ID NO: 3878665 - RNA, 17 nt, Shigella flexneri 2a str. 2457T
uaacauaccuaaaagca

SEQ ID NO: 3878666 - RNA, 12 nt, Shigella flexneri 2a str. 2457T
uaacauccaacg

SEQ ID NO: 3878667 - RNA, 10 nt, Shigella flexneri 2a str. 2457T
uaacauccag

SEQ ID NO: 3878668 - RNA, 14 nt, Shigella flexneri 2a str. 2457T
uaacauuuuacuua

SEQ ID NO: 3878669 - RNA, 23 nt, Shigella flexneri 2a str. 2457T
uaacauuuuacuuacuucagcaa

SEQ ID NO: 3878670 - RNA, 19 nt, Shigella flexneri 2a str. 2457T
uaacauuuuucucggcaau

SEQ ID NO: 3878671 - RNA, 21 nt, Shigella flexneri 2a str. 2457T
uaaccaaacguggucgccagc

SEQ ID NO: 3878672 - RNA, 21 nt, Shigella flexneri 2a str. 2457T
uaaccaaaucuccagugguga

SEQ ID NO: 3878673 - RNA, 16 nt, Shigella flexneri 2a str. 2457T
uaaccaacaauaaaau

SEQ ID NO: 3878674 - RNA, 17 nt, Shigella flexneri 2a str. 2457T
uaaccaacaaugcaaaa

SEQ ID NO: 3878675 - RNA, 21 nt, Shigella flexneri 2a str. 2457T
uaaccaacaaugcaaaauagg

SEQ ID NO: 3878676 - RNA, 21 nt, Shigella flexneri 2a str. 2457T
uaaccaacggcgagccagcgc

SEQ ID NO: 3878677 - RNA, 20 nt, Shigella flexneri 2a str. 2457T
uaaccagaugucgcgcacug

SEQ ID NO: 3878678 - RNA, 12 nt, Shigella flexneri 2a str. 2457T
uaaccagcacca

SEQ ID NO: 3878679 - RNA, 15 nt, Shigella flexneri 2a str. 2457T
uaaccagcaccagcu

SEQ ID NO: 3878680 - RNA, 23 nt, Shigella flexneri 2a str. 2457T
uaaccagcacguugaacugacug

SEQ ID NO: 3878681 - RNA, 18 nt, Shigella flexneri 2a str. 2457T
uaaccagccaaauaaaau

SEQ ID NO: 3878682 - RNA, 23 nt, Shigella flexneri 2a str. 2457T
uaaccagccuggcggaaagccag

SEQ ID NO: 3878683 - RNA, 20 nt, Shigella flexneri 2a str. 2457T
uaaccagcgcagacaccaga

SEQ ID NO: 3878684 - RNA, 21 nt, Shigella flexneri 2a str. 2457T
uaaccagcguuuccagcacca

SEQ ID NO: 3878685 - RNA, 18 nt, Shigella flexneri 2a str. 2457T
uaaccaguugucgcacau

SEQ ID NO: 3878686 - RNA, 19 nt, Shigella flexneri 2a str. 2457T
uaaccaguugucgcacauu

SEQ ID NO: 3878687 - RNA, 14 nt, Shigella flexneri 2a str. 2457T
uaaccauaaccaau

SEQ ID NO: 3878688 - RNA, 16 nt, Shigella flexneri 2a str. 2457T
uaaccaucaaaacgcu

SEQ ID NO: 3878689 - RNA, 15 nt, Shigella flexneri 2a str. 2457T
uaaccaucagcucug

SEQ ID NO: 3878690 - RNA, 20 nt, Shigella flexneri 2a str. 2457T
uaaccauccauauuuggcau

SEQ ID NO: 3878691 - RNA, 21 nt, Shigella flexneri 2a str. 2457T
uaaccauccauauuuggcaug

SEQ ID NO: 3878692 - RNA, 16 nt, Shigella flexneri 2a str. 2457T
uaaccaucuucuucac

SEQ ID NO: 3878693 - RNA, 20 nt, Shigella flexneri 2a str. 2457T
uaacccaggggucaguuccc

SEQ ID NO: 3878694 - RNA, 19 nt, Shigella flexneri 2a str. 2457T
uaacccccaaauaaccccu

SEQ ID NO: 3878695 - RNA, 18 nt, Shigella flexneri 2a str. 2457T
uaacccggcaccaacaaa

SEQ ID NO: 3878696 - RNA, 21 nt, Shigella flexneri 2a str. 2457T
uaacccggcaccaacaaagcc

SEQ ID NO: 3878697 - RNA, 20 nt, Shigella flexneri 2a str. 2457T
uaacccuccguuucacuucu

SEQ ID NO: 3878698 - RNA, 17 nt, Shigella flexneri 2a str. 2457T
uaacccucuccccgaug

SEQ ID NO: 3878699 - RNA, 20 nt, Shigella flexneri 2a str. 2457T
uaaccgcaguguaguucugg

SEQ ID NO: 3878700 - RNA, 14 nt, Shigella flexneri 2a str. 2457T
uaaccgcaucaaca

SEQ ID NO: 3878701 - RNA, 19 nt, Shigella flexneri 2a str. 2457T
uaaccgcccagugccagca

SEQ ID NO: 3878702 - RNA, 23 nt, Shigella flexneri 2a str. 2457T
uaaccgcuucgcuggcagcugcu

SEQ ID NO: 3878703 - RNA, 15 nt, Shigella flexneri 2a str. 2457T
uaaccgcuuuuccag

SEQ ID NO: 3878704 - RNA, 12 nt, Shigella flexneri 2a str. 2457T
uaaccgcuuuuu

SEQ ID NO: 3878705 - RNA, 16 nt, Shigella flexneri 2a str. 2457T
uaaccgcuuuuucaau

SEQ ID NO: 3878706 - RNA, 22 nt, Shigella flexneri 2a str. 2457T
uaaccgcuuuuucaauuuccag

SEQ ID NO: 3878707 - RNA, 22 nt, Shigella flexneri 2a str. 2457T
uaaccggaggauaugcaucaug

SEQ ID NO: 3878708 - RNA, 19 nt, Shigella flexneri 2a str. 2457T
uaaccgggguuucacccac

SEQ ID NO: 3878709 - RNA, 21 nt, Shigella flexneri 2a str. 2457T
uaaccgguacgccgcguuuau

SEQ ID NO: 3878710 - RNA, 18 nt, Shigella flexneri 2a str. 2457T
uaaccgugggaaacagua

SEQ ID NO: 3878711 - RNA, 14 nt, Shigella flexneri 2a str. 2457T
uaaccguugaccag

SEQ ID NO: 3878712 - RNA, 14 nt, Shigella flexneri 2a str. 2457T
uaaccuaaaugcuc

SEQ ID NO: 3878713 - RNA, 12 nt, Shigella flexneri 2a str. 2457T
uaaccugagagu

SEQ ID NO: 3878714 - RNA, 23 nt, Shigella flexneri 2a str. 2457T
uaaccugagagugauuaacuguu

SEQ ID NO: 3878715 - RNA, 15 nt, Shigella flexneri 2a str. 2457T
uaaccuggcaguucg

SEQ ID NO: 3878716 - RNA, 17 nt, Shigella flexneri 2a str. 2457T
uaaccuucuucauuaug

SEQ ID NO: 3878717 - RNA, 23 nt, Shigella flexneri 2a str. 2457T
uaaccuuguccaccgugauucac

SEQ ID NO: 3878718 - RNA, 14 nt, Shigella flexneri 2a str. 2457T
uaaccuuuaaucag

SEQ ID NO: 3878719 - RNA, 13 nt, Shigella flexneri 2a str. 2457T
uaacgaaagcgcc

SEQ ID NO: 3878720 - RNA, 14 nt, Shigella flexneri 2a str. 2457T
uaacgaacgcagug

SEQ ID NO: 3878721 - RNA, 20 nt, Shigella flexneri 2a str. 2457T
uaacgaacgcagugauaacu

SEQ ID NO: 3878722 - RNA, 15 nt, Shigella flexneri 2a str. 2457T
uaacgacauuuucug

SEQ ID NO: 3878723 - RNA, 16 nt, Shigella flexneri 2a str. 2457T
uaacgacugcggauuu

SEQ ID NO: 3878724 - RNA, 14 nt, Shigella flexneri 2a str. 2457T
uaacgaugccagca

SEQ ID NO: 3878725 - RNA, 22 nt, Shigella flexneri 2a str. 2457T
uaacgauuuggccgaagaggaa

SEQ ID NO: 3878726 - RNA, 17 nt, Shigella flexneri 2a str. 2457T
uaacgcacacauccaca

SEQ ID NO: 3878727 - RNA, 23 nt, Shigella flexneri 2a str. 2457T
uaacgcagaaucuucuucucagc

SEQ ID NO: 3878728 - RNA, 21 nt, Shigella flexneri 2a str. 2457T
uaacgccaauucauuccuuga

SEQ ID NO: 3878729 - RNA, 14 nt, Shigella flexneri 2a str. 2457T
uaacgccagacucg

SEQ ID NO: 3878730 - RNA, 20 nt, Shigella flexneri 2a str. 2457T
uaacgcccgagccgguugcc

SEQ ID NO: 3878731 - RNA, 21 nt, Shigella flexneri 2a str. 2457T
uaacgccggagagaaaaaccu

SEQ ID NO: 3878732 - RNA, 21 nt, Shigella flexneri 2a str. 2457T
uaacgccguuauuaaaaagcc

SEQ ID NO: 3878733 - RNA, 16 nt, Shigella flexneri 2a str. 2457T
uaacgccuuuuccagc

SEQ ID NO: 3878734 - RNA, 17 nt, Shigella flexneri 2a str. 2457T
uaacgccuuuuccagcg

SEQ ID NO: 3878735 - RNA, 20 nt, Shigella flexneri 2a str. 2457T
uaacgcgucuuaucuggccu

SEQ ID NO: 3878736 - RNA, 21 nt, Shigella flexneri 2a str. 2457T
uaacgcgucuuaucuggccua

SEQ ID NO: 3878737 - RNA, 17 nt, Shigella flexneri 2a str. 2457T
uaacgcguuuucaccga

SEQ ID NO: 3878738 - RNA, 13 nt, Shigella flexneri 2a str. 2457T
uaacgcuggggau

SEQ ID NO: 3878739 - RNA, 16 nt, Shigella flexneri 2a str. 2457T
uaacgcuucucccagc

SEQ ID NO: 3878740 - RNA, 16 nt, Shigella flexneri 2a str. 2457T
uaacgcuucuggcgua

SEQ ID NO: 3878741 - RNA, 14 nt, Shigella flexneri 2a str. 2457T
uaacggaauugcca

SEQ ID NO: 3878742 - RNA, 14 nt, Shigella flexneri 2a str. 2457T
uaacggccugacca

SEQ ID NO: 3878743 - RNA, 22 nt, Shigella flexneri 2a str. 2457T
uaacggcucacgcccaucagca

SEQ ID NO: 3878744 - RNA, 22 nt, Shigella flexneri 2a str. 2457T
uaacggcucugcuuucucagca

SEQ ID NO: 3878745 - RNA, 19 nt, Shigella flexneri 2a str. 2457T
uaacggcugauaacaauau

SEQ ID NO: 3878746 - RNA, 21 nt, Shigella flexneri 2a str. 2457T
uaacgguaaagcccucaccga

SEQ ID NO: 3878747 - RNA, 17 nt, Shigella flexneri 2a str. 2457T
uaacgguaucuuuccag

SEQ ID NO: 3878748 - RNA, 18 nt, Shigella flexneri 2a str. 2457T
uaacgguguaaugccagu

SEQ ID NO: 3878749 - RNA, 17 nt, Shigella flexneri 2a str. 2457T
uaacgguucaauuuaag

SEQ ID NO: 3878750 - RNA, 19 nt, Shigella flexneri 2a str. 2457T
uaacguaaaaacccgcuuc

SEQ ID NO: 3878751 - RNA, 15 nt, Shigella flexneri 2a str. 2457T
uaacgucaccauccc

SEQ ID NO: 3878752 - RNA, 14 nt, Shigella flexneri 2a str. 2457T
uaaucaugucugga

SEQ ID NO: 3878753 - RNA, 16 nt, Shigella flexneri 2a str. 2457T
uaaucauuacaaccgc

SEQ ID NO: 3878754 - RNA, 17 nt, Shigella flexneri 2a str. 2457T
uaauccacagcaaugca

SEQ ID NO: 3878755 - RNA, 14 nt, Shigella flexneri 2a str. 2457T
uaauccacuuucuu

SEQ ID NO: 3878756 - RNA, 20 nt, Shigella flexneri 2a str. 2457T
uaauccacuuucuuaaagcc

SEQ ID NO: 3878757 - RNA, 15 nt, Shigella flexneri 2a str. 2457T
uaauccagccuacaa

SEQ ID NO: 3878758 - RNA, 19 nt, Shigella flexneri 2a str. 2457T
uaauccaggacauaucagg

SEQ ID NO: 3878759 - RNA, 19 nt, Shigella flexneri 2a str. 2457T
uaaucccgcgcaacaaaua

SEQ ID NO: 3878760 - RNA, 15 nt, Shigella flexneri 2a str. 2457T
uaaucccuucccgca

SEQ ID NO: 3878761 - RNA, 14 nt, Shigella flexneri 2a str. 2457T
uaauccgagaaucg

SEQ ID NO: 3878762 - RNA, 18 nt, Shigella flexneri 2a str. 2457T
uaauccucuuugcuuccu

SEQ ID NO: 3878763 - RNA, 22 nt, Shigella flexneri 2a str. 2457T
uaauccugaguuaagcaaaaaa

SEQ ID NO: 3878764 - RNA, 15 nt, Shigella flexneri 2a str. 2457T
uaaucgaaaacauca

SEQ ID NO: 3878765 - RNA, 18 nt, Shigella flexneri 2a str. 2457T
uaaucgacaguugcugcg

SEQ ID NO: 3878766 - RNA, 16 nt, Shigella flexneri 2a str. 2457T
uaaucgagauaccuaa

SEQ ID NO: 3878767 - RNA, 13 nt, Shigella flexneri 2a str. 2457T
uaaucgcaauuac

SEQ ID NO: 3878768 - RNA, 16 nt, Shigella flexneri 2a str. 2457T
uaaucgcacaaaauca

SEQ ID NO: 3878769 - RNA, 17 nt, Shigella flexneri 2a str. 2457T
uaaucgcauugacgcca

SEQ ID NO: 3878770 - RNA, 21 nt, Shigella flexneri 2a str. 2457T
uaaucgccagcaaaaucacca

SEQ ID NO: 3878771 - RNA, 16 nt, Shigella flexneri 2a str. 2457T
uaaucgcccucgccuu

SEQ ID NO: 3878772 - RNA, 14 nt, Shigella flexneri 2a str. 2457T
uaaucgccuuaccc

SEQ ID NO: 3878773 - RNA, 15 nt, Shigella flexneri 2a str. 2457T
uaaucgcuucuucuu

SEQ ID NO: 3878774 - RNA, 14 nt, Shigella flexneri 2a str. 2457T
uaaucgcuuuauag

SEQ ID NO: 3878775 - RNA, 18 nt, Shigella flexneri 2a str. 2457T
uaaucgucaguuuuucac

SEQ ID NO: 3878776 - RNA, 14 nt, Shigella flexneri 2a str. 2457T
uaaucgucaucagc

SEQ ID NO: 3878777 - RNA, 15 nt, Shigella flexneri 2a str. 2457T
uaaucgucaucagcg

SEQ ID NO: 3878778 - RNA, 20 nt, Shigella flexneri 2a str. 2457T
uaaucgucaucagcgccaac

SEQ ID NO: 3878779 - RNA, 13 nt, Shigella flexneri 2a str. 2457T
uaaucgugaaaag

SEQ ID NO: 3878780 - RNA, 15 nt, Shigella flexneri 2a str. 2457T
uaaucuauauuucug

SEQ ID NO: 3878781 - RNA, 13 nt, Shigella flexneri 2a str. 2457T
uaaucucgccuua

SEQ ID NO: 3878782 - RNA, 23 nt, Shigella flexneri 2a str. 2457T
uaaucugaauggcugcauuccuu

SEQ ID NO: 3878783 - RNA, 22 nt, Shigella flexneri 2a str. 2457T
uaaucuggauguucggcgucuu

SEQ ID NO: 3878784 - RNA, 14 nt, Shigella flexneri 2a str. 2457T
uaaucuguacugug

SEQ ID NO: 3878785 - RNA, 17 nt, Shigella flexneri 2a str. 2457T
uaaucuguuucaucucu

SEQ ID NO: 3878786 - RNA, 19 nt, Shigella flexneri 2a str. 2457T
uaaucuuagguaaugacuc

SEQ ID NO: 3878787 - RNA, 18 nt, Shigella flexneri 2a str. 2457T
uaaucuuccagaucaccg

SEQ ID NO: 3878788 - RNA, 13 nt, Shigella flexneri 2a str. 2457T
uaaucuuuaaaaa

SEQ ID NO: 3878789 - RNA, 20 nt, Shigella flexneri 2a str. 2457T
uaaucuuuaaaaaaagcauu

SEQ ID NO: 3878790 - RNA, 14 nt, Shigella flexneri 2a str. 2457T
uaaucuuuucauau

SEQ ID NO: 3878791 - RNA, 23 nt, Shigella flexneri 2a str. 2457T
uaaugaacuccggagaguauuau

SEQ ID NO: 3878792 - RNA, 21 nt, Shigella flexneri 2a str. 2457T
uaaugaaucgucggaauggca

SEQ ID NO: 3878793 - RNA, 14 nt, Shigella flexneri 2a str. 2457T
uaaugacccacccc

SEQ ID NO: 3878794 - RNA, 21 nt, Shigella flexneri 2a str. 2457T
uaaugacuccaacuuacugau

SEQ ID NO: 3878795 - RNA, 21 nt, Shigella flexneri 2a str. 2457T
uaaugacuuuuggaccacgga

SEQ ID NO: 3878796 - RNA, 16 nt, Shigella flexneri 2a str. 2457T
uaaugagaauaaucac

SEQ ID NO: 3878797 - RNA, 19 nt, Shigella flexneri 2a str. 2457T
uaaugagaauaaucaccuu

SEQ ID NO: 3878798 - RNA, 20 nt, Shigella flexneri 2a str. 2457T
uaaugagcaccgcaccuaaa

SEQ ID NO: 3878799 - RNA, 14 nt, Shigella flexneri 2a str. 2457T
uaaugagcagaaaa

SEQ ID NO: 3878800 - RNA, 18 nt, Shigella flexneri 2a str. 2457T
uaaugcaaaaugccgucg

SEQ ID NO: 3878801 - RNA, 19 nt, Shigella flexneri 2a str. 2457T
uaaugcagaucuuacggcu

SEQ ID NO: 3878802 - RNA, 22 nt, Shigella flexneri 2a str. 2457T
uaaugccaaucuucacaucauc

SEQ ID NO: 3878803 - RNA, 13 nt, Shigella flexneri 2a str. 2457T
uaaugccacauua

SEQ ID NO: 3878804 - RNA, 21 nt, Shigella flexneri 2a str. 2457T
uaaugccagucaguuaagcaa

SEQ ID NO: 3878805 - RNA, 23 nt, Shigella flexneri 2a str. 2457T
uaaugcccaucucuucuucaagc

SEQ ID NO: 3878806 - RNA, 21 nt, Shigella flexneri 2a str. 2457T
uaaugcccgaugaccuuguca

SEQ ID NO: 3878807 - RNA, 19 nt, Shigella flexneri 2a str. 2457T
uaaugcgacaacagaaaua

SEQ ID NO: 3878808 - RNA, 21 nt, Shigella flexneri 2a str. 2457T
uaaugcguaacguuucuuuca

SEQ ID NO: 3878809 - RNA, 15 nt, Shigella flexneri 2a str. 2457T
uaaugcugacaaaac

SEQ ID NO: 3878810 - RNA, 18 nt, Shigella flexneri 2a str. 2457T
uaaugcugugaagauggc

SEQ ID NO: 3878811 - RNA, 22 nt, Shigella flexneri 2a str. 2457T
uaaugcuucuaccgucuguaac

SEQ ID NO: 3878812 - RNA, 23 nt, Shigella flexneri 2a str. 2457T
uaauggcaauacugacaucagca

SEQ ID NO: 3878813 - RNA, 19 nt, Shigella flexneri 2a str. 2457T
uaauggccuuuucgccacc

SEQ ID NO: 3878814 - RNA, 13 nt, Shigella flexneri 2a str. 2457T
uaauggcgcgggu

SEQ ID NO: 3878815 - RNA, 22 nt, Shigella flexneri 2a str. 2457T
uaauggcuggggaauauuuaau

SEQ ID NO: 3878816 - RNA, 22 nt, Shigella flexneri 2a str. 2457T
uaaugguccgugacccggaaua

SEQ ID NO: 3878817 - RNA, 17 nt, Shigella flexneri 2a str. 2457T
uaauggucgagcgacag

SEQ ID NO: 3878818 - RNA, 20 nt, Shigella flexneri 2a str. 2457T
uaauuaacaacguuuuucua

SEQ ID NO: 3878819 - RNA, 21 nt, Shigella flexneri 2a str. 2457T
uaauuaagcgcaaaggccagc

SEQ ID NO: 3878820 - RNA, 15 nt, Shigella flexneri 2a str. 2457T
uaauuacacccuuaa

SEQ ID NO: 3878821 - RNA, 18 nt, Shigella flexneri 2a str. 2457T
uaauuacugcuuaaaugc

SEQ ID NO: 3878822 - RNA, 14 nt, Shigella flexneri 2a str. 2457T
uaauuauccugugg

SEQ ID NO: 3878823 - RNA, 19 nt, Shigella flexneri 2a str. 2457T
uaauuaugccgaucaucau

SEQ ID NO: 3878824 - RNA, 15 nt, Shigella flexneri 2a str. 2457T
uaauuauuaacaaaa

SEQ ID NO: 3878825 - RNA, 15 nt, Shigella flexneri 2a str. 2457T
uaauuauuauaauaa

SEQ ID NO: 3878826 - RNA, 20 nt, Shigella flexneri 2a str. 2457T
uaauuauuuauuuuucuuga

SEQ ID NO: 3878827 - RNA, 19 nt, Shigella flexneri 2a str. 2457T
uaauucaggaaauuaccgc

SEQ ID NO: 3878828 - RNA, 13 nt, Shigella flexneri 2a str. 2457T
uaauucauuugcu

SEQ ID NO: 3878829 - RNA, 21 nt, Shigella flexneri 2a str. 2457T
uaauucccugcgccagcggca

SEQ ID NO: 3878830 - RNA, 17 nt, Shigella flexneri 2a str. 2457T
uaauuccggugaaaggc

SEQ ID NO: 3878831 - RNA, 15 nt, Shigella flexneri 2a str. 2457T
uaauuccugcgcugc

SEQ ID NO: 3878832 - RNA, 20 nt, Shigella flexneri 2a str. 2457T
uaauucgcuuuuauaaaggg

SEQ ID NO: 3878833 - RNA, 14 nt, Shigella flexneri 2a str. 2457T
uaauugaaggcuua

SEQ ID NO: 3878834 - RNA, 13 nt, Shigella flexneri 2a str. 2457T
uaauugagaacca

SEQ ID NO: 3878835 - RNA, 19 nt, Shigella flexneri 2a str. 2457T
uaauugagaaccacaauga

SEQ ID NO: 3878836 - RNA, 17 nt, Shigella flexneri 2a str. 2457T
uaauugcuccauccauu

SEQ ID NO: 3878837 - RNA, 13 nt, Shigella flexneri 2a str. 2457T
uaauugcuuuuac

SEQ ID NO: 3878838 - RNA, 16 nt, Shigella flexneri 2a str. 2457T
uaauuggaauacauau

SEQ ID NO: 3878839 - RNA, 22 nt, Shigella flexneri 2a str. 2457T
uaauuggaauacauauauuaca

SEQ ID NO: 3878840 - RNA, 18 nt, Shigella flexneri 2a str. 2457T
uaauuggaguaucaccau

SEQ ID NO: 3878841 - RNA, 19 nt, Shigella flexneri 2a str. 2457T
uaauuggaguaucaccauc

SEQ ID NO: 3878842 - RNA, 18 nt, Shigella flexneri 2a str. 2457T
uaauuuagugaccaauca

SEQ ID NO: 3878843 - RNA, 16 nt, Shigella flexneri 2a str. 2457T
uaauuucaauggggug

SEQ ID NO: 3878844 - RNA, 11 nt, Shigella flexneri 2a str. 2457T
uaauuucacaa

SEQ ID NO: 3878845 - RNA, 21 nt, Shigella flexneri 2a str. 2457T
uaauuucacaaguugucccau

SEQ ID NO: 3878846 - RNA, 19 nt, Shigella flexneri 2a str. 2457T
uaauuucacaccaucaaca

SEQ ID NO: 3878847 - RNA, 20 nt, Shigella flexneri 2a str. 2457T
uaauuucacaccaucaacaa

SEQ ID NO: 3878848 - RNA, 22 nt, Shigella flexneri 2a str. 2457T
uaauuucaucugccuuauugaa

SEQ ID NO: 3878849 - RNA, 14 nt, Shigella flexneri 2a str. 2457T
uacauauauuacaa

SEQ ID NO: 3878850 - RNA, 17 nt, Shigella flexneri 2a str. 2457T
uacauaugcgcuggcag

SEQ ID NO: 3878851 - RNA, 14 nt, Shigella flexneri 2a str. 2457T
uacauauuuuucau

SEQ ID NO: 3878852 - RNA, 18 nt, Shigella flexneri 2a str. 2457T
uacaucaccguucagcuu

SEQ ID NO: 3878853 - RNA, 14 nt, Shigella flexneri 2a str. 2457T
uacaucauuucaau

SEQ ID NO: 3878854 - RNA, 18 nt, Shigella flexneri 2a str. 2457T
uacauccucucuuuccuu

SEQ ID NO: 3878855 - RNA, 22 nt, Shigella flexneri 2a str. 2457T
uacaucgcgcuuaucgccagcg

SEQ ID NO: 3878856 - RNA, 15 nt, Shigella flexneri 2a str. 2457T
uacaucuucaucauc

SEQ ID NO: 3878857 - RNA, 18 nt, Shigella flexneri 2a str. 2457T
uacaucuuccacuuugau

SEQ ID NO: 3878858 - RNA, 16 nt, Shigella flexneri 2a str. 2457T
uacaugaagcacugca

SEQ ID NO: 3878859 - RNA, 12 nt, Shigella flexneri 2a str. 2457T
uacaugcagggc

SEQ ID NO: 3878860 - RNA, 12 nt, Shigella flexneri 2a str. 2457T
uacaugcugcuu

SEQ ID NO: 3878861 - RNA, 23 nt, Shigella flexneri 2a str. 2457T
uacauguaaaaggcgcuaaaaau

SEQ ID NO: 3878862 - RNA, 20 nt, Shigella flexneri 2a str. 2457T
uacauguguuaaauauuuaa

SEQ ID NO: 3878863 - RNA, 16 nt, Shigella flexneri 2a str. 2457T
uacauuaguaauuucc

SEQ ID NO: 3878864 - RNA, 19 nt, Shigella flexneri 2a str. 2457T
uacauuaucgcgucuaaau

SEQ ID NO: 3878865 - RNA, 21 nt, Shigella flexneri 2a str. 2457T
uacauuaucgcgucuaaauuu

SEQ ID NO: 3878866 - RNA, 13 nt, Shigella flexneri 2a str. 2457T
uacauugccgggc

SEQ ID NO: 3878867 - RNA, 16 nt, Shigella flexneri 2a str. 2457T
uacauuggugccggau

SEQ ID NO: 3878868 - RNA, 19 nt, Shigella flexneri 2a str. 2457T
uacauuuccaggaaggcca

SEQ ID NO: 3878869 - RNA, 15 nt, Shigella flexneri 2a str. 2457T
uacauuuuaauaaug

SEQ ID NO: 3878870 - RNA, 17 nt, Shigella flexneri 2a str. 2457T
uacauuuuaauaaugag

SEQ ID NO: 3878871 - RNA, 11 nt, Shigella flexneri 2a str. 2457T
uacauuuugac

SEQ ID NO: 3878872 - RNA, 21 nt, Shigella flexneri 2a str. 2457T
uaccaaaaucaucaauugcca

SEQ ID NO: 3878873 - RNA, 14 nt, Shigella flexneri 2a str. 2457T
uaccaacauacugc

SEQ ID NO: 3878874 - RNA, 13 nt, Shigella flexneri 2a str. 2457T
uaccacaaccugc

SEQ ID NO: 3878875 - RNA, 18 nt, Shigella flexneri 2a str. 2457T
uaccacagacaaaauccu

SEQ ID NO: 3878876 - RNA, 21 nt, Shigella flexneri 2a str. 2457T
uaccacagacaaaauccugcc

SEQ ID NO: 3878877 - RNA, 11 nt, Shigella flexneri 2a str. 2457T
uaccacaucaa

SEQ ID NO: 3878878 - RNA, 23 nt, Shigella flexneri 2a str. 2457T
uaccaccaaugucgaaagcccca

SEQ ID NO: 3878879 - RNA, 20 nt, Shigella flexneri 2a str. 2457T
uaccaccugcucgucauccg

SEQ ID NO: 3878880 - RNA, 21 nt, Shigella flexneri 2a str. 2457T
uaccaccuuacuuacacauca

SEQ ID NO: 3878881 - RNA, 16 nt, Shigella flexneri 2a str. 2457T
uaccacgcacagcccg

SEQ ID NO: 3878882 - RNA, 19 nt, Shigella flexneri 2a str. 2457T
uaccacguugacaaacugc

SEQ ID NO: 3878883 - RNA, 13 nt, Shigella flexneri 2a str. 2457T
uaccacuacauca

SEQ ID NO: 3878884 - RNA, 15 nt, Shigella flexneri 2a str. 2457T
uaccacuuccagcag

SEQ ID NO: 3878885 - RNA, 17 nt, Shigella flexneri 2a str. 2457T
uaccagaccgcacaccg

SEQ ID NO: 3878886 - RNA, 18 nt, Shigella flexneri 2a str. 2457T
uaccagaccgcacaccga

SEQ ID NO: 3878887 - RNA, 16 nt, Shigella flexneri 2a str. 2457T
uaccagauaaacaucg

SEQ ID NO: 3878888 - RNA, 19 nt, Shigella flexneri 2a str. 2457T
uaccagauaaucaccugcc

SEQ ID NO: 3878889 - RNA, 21 nt, Shigella flexneri 2a str. 2457T
uaccagauaaucaccugccuu

SEQ ID NO: 3878890 - RNA, 16 nt, Shigella flexneri 2a str. 2457T
uaccagauuaauuauu

SEQ ID NO: 3878891 - RNA, 17 nt, Shigella flexneri 2a str. 2457T
uaccagauuaauuauug

SEQ ID NO: 3878892 - RNA, 18 nt, Shigella flexneri 2a str. 2457T
uaccagauuaauuauuga

SEQ ID NO: 3878893 - RNA, 23 nt, Shigella flexneri 2a str. 2457T
uaccagauuaauuauugauucca

SEQ ID NO: 3878894 - RNA, 20 nt, Shigella flexneri 2a str. 2457T
uaccagcaacgcuucaacca

SEQ ID NO: 3878895 - RNA, 20 nt, Shigella flexneri 2a str. 2457T
uaccagcaacugauggccca

SEQ ID NO: 3878896 - RNA, 11 nt, Shigella flexneri 2a str. 2457T
uaccagcagcg

SEQ ID NO: 3878897 - RNA, 20 nt, Shigella flexneri 2a str. 2457T
uaccagccuucuucauccag

SEQ ID NO: 3878898 - RNA, 16 nt, Shigella flexneri 2a str. 2457T
uaccagcggccggaug

SEQ ID NO: 3878899 - RNA, 14 nt, Shigella flexneri 2a str. 2457T
uaccagcugccaca

SEQ ID NO: 3878900 - RNA, 20 nt, Shigella flexneri 2a str. 2457T
uaccaggcgaccguuuucac

SEQ ID NO: 3878901 - RNA, 19 nt, Shigella flexneri 2a str. 2457T
uaccaggcgguaugguaaa

SEQ ID NO: 3878902 - RNA, 16 nt, Shigella flexneri 2a str. 2457T
uaccaguacgcccacg

SEQ ID NO: 3878903 - RNA, 12 nt, Shigella flexneri 2a str. 2457T
uaccaguccuac

SEQ ID NO: 3878904 - RNA, 16 nt, Shigella flexneri 2a str. 2457T
uaccaguccuacacac

SEQ ID NO: 3878905 - RNA, 12 nt, Shigella flexneri 2a str. 2457T
uaccaucaccaa

SEQ ID NO: 3878906 - RNA, 17 nt, Shigella flexneri 2a str. 2457T
uaccaucggcagcgcca

SEQ ID NO: 3878907 - RNA, 16 nt, Shigella flexneri 2a str. 2457T
uaccaucuucaccgcc

SEQ ID NO: 3878908 - RNA, 15 nt, Shigella flexneri 2a str. 2457T
uaccaugcaccaacc

SEQ ID NO: 3878909 - RNA, 17 nt, Shigella flexneri 2a str. 2457T
uaccauggaagaaaaau

SEQ ID NO: 3878910 - RNA, 18 nt, Shigella flexneri 2a str. 2457T
uaccauggcucaccagca

SEQ ID NO: 3878911 - RNA, 22 nt, Shigella flexneri 2a str. 2457T
uaccauuaaucgauaaaccagc

SEQ ID NO: 3878912 - RNA, 15 nt, Shigella flexneri 2a str. 2457T
uaccauuaucaccaa

SEQ ID NO: 3878913 - RNA, 16 nt, Shigella flexneri 2a str. 2457T
uaccauuugcauagcg

SEQ ID NO: 3878914 - RNA, 14 nt, Shigella flexneri 2a str. 2457T
uacccaaaaaauag

SEQ ID NO: 3878915 - RNA, 18 nt, Shigella flexneri 2a str. 2457T
uacccaaaucgcccgguu

SEQ ID NO: 3878916 - RNA, 23 nt, Shigella flexneri 2a str. 2457T
uacccaaccgauaaccacgcuca

SEQ ID NO: 3878917 - RNA, 17 nt, Shigella flexneri 2a str. 2457T
uacccagcagcagcggu

SEQ ID NO: 3878918 - RNA, 22 nt, Shigella flexneri 2a str. 2457T
uacccagcgaauccagcaugcu

SEQ ID NO: 3878919 - RNA, 19 nt, Shigella flexneri 2a str. 2457T
uacccagcguguugaggaa

SEQ ID NO: 3878920 - RNA, 15 nt, Shigella flexneri 2a str. 2457T
uacccaggccugccc

SEQ ID NO: 3878921 - RNA, 19 nt, Shigella flexneri 2a str. 2457T
uaccccucuauccagcuca

SEQ ID NO: 3878922 - RNA, 15 nt, Shigella flexneri 2a str. 2457T
uacccgaugcaaaaa

SEQ ID NO: 3878923 - RNA, 18 nt, Shigella flexneri 2a str. 2457T
uacccgcuaacugguggc

SEQ ID NO: 3878924 - RNA, 21 nt, Shigella flexneri 2a str. 2457T
uacccgcucgaaguuuuccuc

SEQ ID NO: 3878925 - RNA, 21 nt, Shigella flexneri 2a str. 2457T
uacccgcuggcguaccaucuu

SEQ ID NO: 3878926 - RNA, 22 nt, Shigella flexneri 2a str. 2457T
uacccggccuguuuauccauca

SEQ ID NO: 3878927 - RNA, 15 nt, Shigella flexneri 2a str. 2457T
uacccgguuugugaa

SEQ ID NO: 3878928 - RNA, 13 nt, Shigella flexneri 2a str. 2457T
uacccugacccag

SEQ ID NO: 3878929 - RNA, 17 nt, Shigella flexneri 2a str. 2457T
uacccugugacagacua

SEQ ID NO: 3878930 - RNA, 18 nt, Shigella flexneri 2a str. 2457T
uacccuucaucacgcagc

SEQ ID NO: 3878931 - RNA, 17 nt, Shigella flexneri 2a str. 2457T
uacccuucgucaaucag

SEQ ID NO: 3878932 - RNA, 17 nt, Shigella flexneri 2a str. 2457T
uaccgaagaguaaccaa

SEQ ID NO: 3878933 - RNA, 12 nt, Shigella flexneri 2a str. 2457T
uaccgagcagcc

SEQ ID NO: 3878934 - RNA, 13 nt, Shigella flexneri 2a str. 2457T
uaccgaucaccga

SEQ ID NO: 3878935 - RNA, 15 nt, Shigella flexneri 2a str. 2457T
uaccgaucaccgaug

SEQ ID NO: 3878936 - RNA, 14 nt, Shigella flexneri 2a str. 2457T
uaccgauccccgga

SEQ ID NO: 3878937 - RNA, 13 nt, Shigella flexneri 2a str. 2457T
uaccgaucgccag

SEQ ID NO: 3878938 - RNA, 13 nt, Shigella flexneri 2a str. 2457T
uaccgauucccag

SEQ ID NO: 3878939 - RNA, 19 nt, Shigella flexneri 2a str. 2457T
uaccgcaccuuccggaaua

SEQ ID NO: 3878940 - RNA, 12 nt, Shigella flexneri 2a str. 2457T
uaccgccacagc

SEQ ID NO: 3878941 - RNA, 12 nt, Shigella flexneri 2a str. 2457T
uaccgccagacc

SEQ ID NO: 3878942 - RNA, 14 nt, Shigella flexneri 2a str. 2457T
uaccgccagaccac

SEQ ID NO: 3878943 - RNA, 21 nt, Shigella flexneri 2a str. 2457T
uaccgccaucaauugcucacu

SEQ ID NO: 3878944 - RNA, 18 nt, Shigella flexneri 2a str. 2457T
uaccgcccaccaccagcg

SEQ ID NO: 3878945 - RNA, 18 nt, Shigella flexneri 2a str. 2457T
uaccgccgaucucaccga

SEQ ID NO: 3878946 - RNA, 13 nt, Shigella flexneri 2a str. 2457T
uaccgccgcacaa

SEQ ID NO: 3878947 - RNA, 21 nt, Shigella flexneri 2a str. 2457T
uacgggcaauuucacguucac

SEQ ID NO: 3878948 - RNA, 18 nt, Shigella flexneri 2a str. 2457T
uacgggcggcuuugaaau

SEQ ID NO: 3878949 - RNA, 19 nt, Shigella flexneri 2a str. 2457T
uacggguucaagucccguc

SEQ ID NO: 3878950 - RNA, 16 nt, Shigella flexneri 2a str. 2457T
uacgguacugaaaccu

SEQ ID NO: 3878951 - RNA, 18 nt, Shigella flexneri 2a str. 2457T
uacgguacugaaaccuga

SEQ ID NO: 3878952 - RNA, 13 nt, Shigella flexneri 2a str. 2457T
uacgguggaacau

SEQ ID NO: 3878953 - RNA, 19 nt, Shigella flexneri 2a str. 2457T
uacgguguucacucaucaa

SEQ ID NO: 3878954 - RNA, 12 nt, Shigella flexneri 2a str. 2457T
uacgguuauagu

SEQ ID NO: 3878955 - RNA, 17 nt, Shigella flexneri 2a str. 2457T
uacgguuuuuugaacag

SEQ ID NO: 3878956 - RNA, 14 nt, Shigella flexneri 2a str. 2457T
uacguaaugcucau

SEQ ID NO: 3878957 - RNA, 17 nt, Shigella flexneri 2a str. 2457T
uacguaaugcucauucu

SEQ ID NO: 3878958 - RNA, 15 nt, Shigella flexneri 2a str. 2457T
uacguaauuuauaau

SEQ ID NO: 3878959 - RNA, 19 nt, Shigella flexneri 2a str. 2457T
uacguaccacgcacagccc

SEQ ID NO: 3878960 - RNA, 14 nt, Shigella flexneri 2a str. 2457T
uacguacguuaaca

SEQ ID NO: 3878961 - RNA, 22 nt, Shigella flexneri 2a str. 2457T
uacgucacuucaucgucauaau

SEQ ID NO: 3878962 - RNA, 12 nt, Shigella flexneri 2a str. 2457T
uacgucgagaau

SEQ ID NO: 3878963 - RNA, 15 nt, Shigella flexneri 2a str. 2457T
uacgugaggcaucag

SEQ ID NO: 3878964 - RNA, 15 nt, Shigella flexneri 2a str. 2457T
uacgugcacaggcaa

SEQ ID NO: 3878965 - RNA, 15 nt, Shigella flexneri 2a str. 2457T
uacguguuguuccag

SEQ ID NO: 3878966 - RNA, 12 nt, Shigella flexneri 2a str. 2457T
uacuaaaaagcg

SEQ ID NO: 3878967 - RNA, 21 nt, Shigella flexneri 2a str. 2457T
uacuaaucucacccauagaua

SEQ ID NO: 3878968 - RNA, 20 nt, Shigella flexneri 2a str. 2457T
uacuacguucaaucaccgca

SEQ ID NO: 3878969 - RNA, 21 nt, Shigella flexneri 2a str. 2457T
uacuauaaguguaaaauucua

SEQ ID NO: 3878970 - RNA, 11 nt, Shigella flexneri 2a str. 2457T
uacuaucugcu

SEQ ID NO: 3878971 - RNA, 12 nt, Shigella flexneri 2a str. 2457T
uacucaacuccc

SEQ ID NO: 3878972 - RNA, 16 nt, Shigella flexneri 2a str. 2457T
uacucaccagacaucc

SEQ ID NO: 3878973 - RNA, 20 nt, Shigella flexneri 2a str. 2457T
uacucagcaacuuccugcuu

SEQ ID NO: 3878974 - RNA, 18 nt, Shigella flexneri 2a str. 2457T
uacucagcgccugcugca

SEQ ID NO: 3878975 - RNA, 20 nt, Shigella flexneri 2a str. 2457T
uacuccaacucccuauagua

SEQ ID NO: 3878976 - RNA, 17 nt, Shigella flexneri 2a str. 2457T
uacuccugcucgccgau

SEQ ID NO: 3878977 - RNA, 19 nt, Shigella flexneri 2a str. 2457T
uacuccugguaucuuuaca

SEQ ID NO: 3878978 - RNA, 13 nt, Shigella flexneri 2a str. 2457T
uacuccuuagcaa

SEQ ID NO: 3878979 - RNA, 20 nt, Shigella flexneri 2a str. 2457T
uacucguuuauuaugccaca

SEQ ID NO: 3878980 - RNA, 16 nt, Shigella flexneri 2a str. 2457T
uacucucgcuccaguu

SEQ ID NO: 3878981 - RNA, 13 nt, Shigella flexneri 2a str. 2457T
uacucugacccag

SEQ ID NO: 3878982 - RNA, 21 nt, Shigella flexneri 2a str. 2457T
uacucugucugaugauaauca

SEQ ID NO: 3878983 - RNA, 21 nt, Shigella flexneri 2a str. 2457T
uacucuuucccggcaaucacc

SEQ ID NO: 3878984 - RNA, 23 nt, Shigella flexneri 2a str. 2457T
uacucuuucccggcaaucaccgc

SEQ ID NO: 3878985 - RNA, 16 nt, Shigella flexneri 2a str. 2457T
uacucuuugacaacau

SEQ ID NO: 3878986 - RNA, 21 nt, Shigella flexneri 2a str. 2457T
uacucuuugacaacaucaucu

SEQ ID NO: 3878987 - RNA, 13 nt, Shigella flexneri 2a str. 2457T
uacugaaaccuga

SEQ ID NO: 3878988 - RNA, 14 nt, Shigella flexneri 2a str. 2457T
uacugaaccacgga

SEQ ID NO: 3878989 - RNA, 17 nt, Shigella flexneri 2a str. 2457T
uacugaaucccugcgaa

SEQ ID NO: 3878990 - RNA, 16 nt, Shigella flexneri 2a str. 2457T
uacugacaucaaaccc

SEQ ID NO: 3878991 - RNA, 15 nt, Shigella flexneri 2a str. 2457T
uacugacauuaacgu

SEQ ID NO: 3878992 - RNA, 20 nt, Shigella flexneri 2a str. 2457T
uacugagaacgcaauggucg

SEQ ID NO: 3878993 - RNA, 21 nt, Shigella flexneri 2a str. 2457T
uacugagcggaugcuuaaccg

SEQ ID NO: 3878994 - RNA, 23 nt, Shigella flexneri 2a str. 2457T
uacugaggccggaugucgcugcu

SEQ ID NO: 3878995 - RNA, 18 nt, Shigella flexneri 2a str. 2457T
uacugauaauuuuuucac

SEQ ID NO: 3878996 - RNA, 20 nt, Shigella flexneri 2a str. 2457T
uacugauaauuuuuucacua

SEQ ID NO: 3878997 - RNA, 13 nt, Shigella flexneri 2a str. 2457T
uacugaucaucau

SEQ ID NO: 3878998 - RNA, 14 nt, Shigella flexneri 2a str. 2457T
uacugauggcuacg

SEQ ID NO: 3878999 - RNA, 18 nt, Shigella flexneri 2a str. 2457T
uacugauggcuacguucu

SEQ ID NO: 3879000 - RNA, 22 nt, Shigella flexneri 2a str. 2457T
uacugauugacgcguucgcuaa

SEQ ID NO: 3879001 - RNA, 13 nt, Shigella flexneri 2a str. 2457T
uacugauuuuauu

SEQ ID NO: 3879002 - RNA, 17 nt, Shigella flexneri 2a str. 2457T
uacugcauaaugccggu

SEQ ID NO: 3879003 - RNA, 17 nt, Shigella flexneri 2a str. 2457T
uacugcccuuucgccgc

SEQ ID NO: 3879004 - RNA, 15 nt, Shigella flexneri 2a str. 2457T
uacugccuugaugaa

SEQ ID NO: 3879005 - RNA, 21 nt, Shigella flexneri 2a str. 2457T
uacugcucagacggugaccag

SEQ ID NO: 3879006 - RNA, 22 nt, Shigella flexneri 2a str. 2457T
uacugcugaaugaggcuuuaau

SEQ ID NO: 3879007 - RNA, 14 nt, Shigella flexneri 2a str. 2457T
uacugcuggcaaca

SEQ ID NO: 3879008 - RNA, 11 nt, Shigella flexneri 2a str. 2457T
uacuggcaaua

SEQ ID NO: 3879009 - RNA, 16 nt, Shigella flexneri 2a str. 2457T
uacuggcaaucgccag

SEQ ID NO: 3879010 - RNA, 22 nt, Shigella flexneri 2a str. 2457T
uacuggcaaucgccagcggcag

SEQ ID NO: 3879011 - RNA, 16 nt, Shigella flexneri 2a str. 2457T
uacuggcagauuaugc

SEQ ID NO: 3879012 - RNA, 17 nt, Shigella flexneri 2a str. 2457T
uacuggcgauugucauu

SEQ ID NO: 3879013 - RNA, 16 nt, Shigella flexneri 2a str. 2457T
uacuggcgguuuucuu

SEQ ID NO: 3879014 - RNA, 16 nt, Shigella flexneri 2a str. 2457T
uacugggcggcaaaau

SEQ ID NO: 3879015 - RNA, 20 nt, Shigella flexneri 2a str. 2457T
uacugguagcaucugcauuc

SEQ ID NO: 3879016 - RNA, 16 nt, Shigella flexneri 2a str. 2457T
uacuggugcaaaaccu

SEQ ID NO: 3879017 - RNA, 19 nt, Shigella flexneri 2a str. 2457T
uacuguauacgggcuuuuu

SEQ ID NO: 3879018 - RNA, 22 nt, Shigella flexneri 2a str. 2457T
uacuguccauagcgauguauuu

SEQ ID NO: 3879019 - RNA, 13 nt, Shigella flexneri 2a str. 2457T
uacugucggcaau

SEQ ID NO: 3879020 - RNA, 15 nt, Shigella flexneri 2a str. 2457T
uacuucaacacauaa

SEQ ID NO: 3879021 - RNA, 15 nt, Shigella flexneri 2a str. 2457T
uacuucaaucgccac

SEQ ID NO: 3879022 - RNA, 13 nt, Shigella flexneri 2a str. 2457T
uacuucaccaguu

SEQ ID NO: 3879023 - RNA, 21 nt, Shigella flexneri 2a str. 2457T
uacuucaccuucuuuacugcc

SEQ ID NO: 3879024 - RNA, 20 nt, Shigella flexneri 2a str. 2457T
uacuucagacggucagcgag

SEQ ID NO: 3879025 - RNA, 21 nt, Shigella flexneri 2a str. 2457T
uacuucagacggucagcgaga

SEQ ID NO: 3879026 - RNA, 12 nt, Shigella flexneri 2a str. 2457T
uacuucagcaag

SEQ ID NO: 3879027 - RNA, 16 nt, Shigella flexneri 2a str. 2457T
uacuucaucugcuuca

SEQ ID NO: 3879028 - RNA, 20 nt, Shigella flexneri 2a str. 2457T
uacuuccccggcagugcuuu

SEQ ID NO: 3879029 - RNA, 17 nt, Shigella flexneri 2a str. 2457T
uacuuccgcuuccagcu

SEQ ID NO: 3879030 - RNA, 15 nt, Shigella flexneri 2a str. 2457T
uacuucgcaauacgc

SEQ ID NO: 3879031 - RNA, 15 nt, Shigella flexneri 2a str. 2457T
uacuucugaccagga

SEQ ID NO: 3879032 - RNA, 23 nt, Shigella flexneri 2a str. 2457T
uacuucuucaugccaaaagggag

SEQ ID NO: 3879033 - RNA, 18 nt, Shigella flexneri 2a str. 2457T
uacuuuauuuauaucagu

SEQ ID NO: 3879034 - RNA, 14 nt, Shigella flexneri 2a str. 2457T
uacuuucacaaaaa

SEQ ID NO: 3879035 - RNA, 18 nt, Shigella flexneri 2a str. 2457T
uacuuucacaaaaauaau

SEQ ID NO: 3879036 - RNA, 16 nt, Shigella flexneri 2a str. 2457T
uacuuuccagccacag

SEQ ID NO: 3879037 - RNA, 18 nt, Shigella flexneri 2a str. 2457T
uacuuuccagccacaguu

SEQ ID NO: 3879038 - RNA, 15 nt, Shigella flexneri 2a str. 2457T
uacuuugccuuucau

SEQ ID NO: 3879039 - RNA, 17 nt, Shigella flexneri 2a str. 2457T
uacuuuucaggauggua

SEQ ID NO: 3879040 - RNA, 14 nt, Shigella flexneri 2a str. 2457T
uacuuuuuccagua

SEQ ID NO: 3879041 - RNA, 17 nt, Shigella flexneri 2a str. 2457T
uacuuuuuucacccaca

SEQ ID NO: 3879042 - RNA, 19 nt, Shigella flexneri 2a str. 2457T
uagaaaauaaaaaacauuc

SEQ ID NO: 3879043 - RNA, 16 nt, Shigella flexneri 2a str. 2457T
uagaaacagaaugaug

SEQ ID NO: 3879044 - RNA, 18 nt, Shigella flexneri 2a str. 2457T
uagaaacagucuggagca

SEQ ID NO: 3879045 - RNA, 21 nt, Shigella flexneri 2a str. 2457T
uagcgaauuuuucgagggugc

SEQ ID NO: 3879046 - RNA, 19 nt, Shigella flexneri 2a str. 2457T
uagcgaccauacagcagca

SEQ ID NO: 3879047 - RNA, 22 nt, Shigella flexneri 2a str. 2457T
uagcgcauaagccaccucaacg

SEQ ID NO: 3879048 - RNA, 13 nt, Shigella flexneri 2a str. 2457T
uagcgcaucacuu

SEQ ID NO: 3879049 - RNA, 17 nt, Shigella flexneri 2a str. 2457T
uagcgcccgaacggaaa

SEQ ID NO: 3879050 - RNA, 22 nt, Shigella flexneri 2a str. 2457T
uagcgccggguuuuuuauuaau

SEQ ID NO: 3879051 - RNA, 15 nt, Shigella flexneri 2a str. 2457T
uagcgccguuuuuau

SEQ ID NO: 3879052 - RNA, 14 nt, Shigella flexneri 2a str. 2457T
uagcgccuucuaca

SEQ ID NO: 3879053 - RNA, 14 nt, Shigella flexneri 2a str. 2457T
uagcgcugcugcac

SEQ ID NO: 3879054 - RNA, 21 nt, Shigella flexneri 2a str. 2457T
uagcggacucaccgagcagca

SEQ ID NO: 3879055 - RNA, 16 nt, Shigella flexneri 2a str. 2457T
uagcggcggcagauug

SEQ ID NO: 3879056 - RNA, 21 nt, Shigella flexneri 2a str. 2457T
uagcggcgguaaaaucauccu

SEQ ID NO: 3879057 - RNA, 20 nt, Shigella flexneri 2a str. 2457T
uagcgggugaagagauccac

SEQ ID NO: 3879058 - RNA, 19 nt, Shigella flexneri 2a str. 2457T
uagcgucauuaaccagcca

SEQ ID NO: 3879059 - RNA, 18 nt, Shigella flexneri 2a str. 2457T
uagcguccggcugccagc

SEQ ID NO: 3879060 - RNA, 14 nt, Shigella flexneri 2a str. 2457T
uagcguuaccagca

SEQ ID NO: 3879061 - RNA, 14 nt, Shigella flexneri 2a str. 2457T
uagcguuuugcgcg

SEQ ID NO: 3879062 - RNA, 10 nt, Shigella flexneri 2a str. 2457T
uagcuaauca

SEQ ID NO: 3879063 - RNA, 15 nt, Shigella flexneri 2a str. 2457T
uagcuauauuuugcc

SEQ ID NO: 3879064 - RNA, 18 nt, Shigella flexneri 2a str. 2457T
uagcucgcuucaucugcc

SEQ ID NO: 3879065 - RNA, 15 nt, Shigella flexneri 2a str. 2457T
uagcucuggguaaca

SEQ ID NO: 3879066 - RNA, 19 nt, Shigella flexneri 2a str. 2457T
uagcuuaccggucuggguu

SEQ ID NO: 3879067 - RNA, 12 nt, Shigella flexneri 2a str. 2457T
uagcuucagccg

SEQ ID NO: 3879068 - RNA, 20 nt, Shigella flexneri 2a str. 2457T
uagcuucagccgggaagaau

SEQ ID NO: 3879069 - RNA, 13 nt, Shigella flexneri 2a str. 2457T
uagcuuuacccaa

SEQ ID NO: 3879070 - RNA, 17 nt, Shigella flexneri 2a str. 2457T
uagcuuuggugccagau

SEQ ID NO: 3879071 - RNA, 15 nt, Shigella flexneri 2a str. 2457T
uaggaagccggaauu

SEQ ID NO: 3879072 - RNA, 20 nt, Shigella flexneri 2a str. 2457T
uaggaauccgggucuguaaa

SEQ ID NO: 3879073 - RNA, 18 nt, Shigella flexneri 2a str. 2457T
uaggacagcguugccagc

SEQ ID NO: 3879074 - RNA, 15 nt, Shigella flexneri 2a str. 2457T
uaggacgaaaaauca

SEQ ID NO: 3879075 - RNA, 17 nt, Shigella flexneri 2a str. 2457T
uaggagguuuccggguc

SEQ ID NO: 3879076 - RNA, 21 nt, Shigella flexneri 2a str. 2457T
uaggagguuuccgggucggca

SEQ ID NO: 3879077 - RNA, 18 nt, Shigella flexneri 2a str. 2457T
uaggcaaaaaaaaugccc

SEQ ID NO: 3879078 - RNA, 17 nt, Shigella flexneri 2a str. 2457T
uaggcaauuggcgcauc

SEQ ID NO: 3879079 - RNA, 18 nt, Shigella flexneri 2a str. 2457T
uaggcaauuggcgcauca

SEQ ID NO: 3879080 - RNA, 17 nt, Shigella flexneri 2a str. 2457T
uaggcaggauaaggcgu

SEQ ID NO: 3879081 - RNA, 19 nt, Shigella flexneri 2a str. 2457T
uaggcaucccgcaccagcg

SEQ ID NO: 3879082 - RNA, 20 nt, Shigella flexneri 2a str. 2457T
uaggccagauaagacgcguc

SEQ ID NO: 3879083 - RNA, 20 nt, Shigella flexneri 2a str. 2457T
uaggccagauaagacgcguu

SEQ ID NO: 3879084 - RNA, 18 nt, Shigella flexneri 2a str. 2457T
uaggccgcugaugccagg

SEQ ID NO: 3879085 - RNA, 19 nt, Shigella flexneri 2a str. 2457T
uaggccugauaagacgcga

SEQ ID NO: 3879086 - RNA, 19 nt, Shigella flexneri 2a str. 2457T
uaggcggcaaacaguuucu

SEQ ID NO: 3879087 - RNA, 13 nt, Shigella flexneri 2a str. 2457T
uaggcgucacauc

SEQ ID NO: 3879088 - RNA, 15 nt, Shigella flexneri 2a str. 2457T
uagggaugcagaaug

SEQ ID NO: 3879089 - RNA, 12 nt, Shigella flexneri 2a str. 2457T
uaggguaaauua

SEQ ID NO: 3879090 - RNA, 17 nt, Shigella flexneri 2a str. 2457T
uaggguggggaaaaaca

SEQ ID NO: 3879091 - RNA, 13 nt, Shigella flexneri 2a str. 2457T
uagguaaacaucc

SEQ ID NO: 3879092 - RNA, 14 nt, Shigella flexneri 2a str. 2457T
uagguaaucauauu

SEQ ID NO: 3879093 - RNA, 20 nt, Shigella flexneri 2a str. 2457T
uagguacaaagccaacagca

SEQ ID NO: 3879094 - RNA, 20 nt, Shigella flexneri 2a str. 2457T
uagguggcaaagaaauccac

SEQ ID NO: 3879095 - RNA, 15 nt, Shigella flexneri 2a str. 2457T
uagguggcaccugac

SEQ ID NO: 3879096 - RNA, 19 nt, Shigella flexneri 2a str. 2457T
uaguaaacgcguagaucuc

SEQ ID NO: 3879097 - RNA, 18 nt, Shigella flexneri 2a str. 2457T
uaguaaauucacugccug

SEQ ID NO: 3879098 - RNA, 13 nt, Shigella flexneri 2a str. 2457T
uaguaacgccagc

SEQ ID NO: 3879099 - RNA, 17 nt, Shigella flexneri 2a str. 2457T
uaguaagauuauauaau

SEQ ID NO: 3879100 - RNA, 13 nt, Shigella flexneri 2a str. 2457T
uaguacaaauuuu

SEQ ID NO: 3879101 - RNA, 17 nt, Shigella flexneri 2a str. 2457T
uaguacccgaucacaac

SEQ ID NO: 3879102 - RNA, 22 nt, Shigella flexneri 2a str. 2457T
uaguacgggcaauuucacguuc

SEQ ID NO: 3879103 - RNA, 13 nt, Shigella flexneri 2a str. 2457T
uaguagaagagga

SEQ ID NO: 3879104 - RNA, 16 nt, Shigella flexneri 2a str. 2457T
uaguaucuauucauca

SEQ ID NO: 3879105 - RNA, 14 nt, Shigella flexneri 2a str. 2457T
uaguauuaagccag

SEQ ID NO: 3879106 - RNA, 16 nt, Shigella flexneri 2a str. 2457T
uaguauuguuaaauau

SEQ ID NO: 3879107 - RNA, 23 nt, Shigella flexneri 2a str. 2457T
uaguauuuucuuugacaaauucc

SEQ ID NO: 3879108 - RNA, 13 nt, Shigella flexneri 2a str. 2457T
uagucacaaaucu

SEQ ID NO: 3879109 - RNA, 20 nt, Shigella flexneri 2a str. 2457T
uagucacgguaguuagccgg

SEQ ID NO: 3879110 - RNA, 12 nt, Shigella flexneri 2a str. 2457T
uagucaucauca

SEQ ID NO: 3879111 - RNA, 18 nt, Shigella flexneri 2a str. 2457T
uagucaucaucaggaaca

SEQ ID NO: 3879112 - RNA, 15 nt, Shigella flexneri 2a str. 2457T
uagucccaaacagca

SEQ ID NO: 3879113 - RNA, 14 nt, Shigella flexneri 2a str. 2457T
uagucgcuuucauu

SEQ ID NO: 3879114 - RNA, 18 nt, Shigella flexneri 2a str. 2457T
uagucugguugagcagua

SEQ ID NO: 3879115 - RNA, 14 nt, Shigella flexneri 2a str. 2457T
uagugaaaucgcca

SEQ ID NO: 3879116 - RNA, 22 nt, Shigella flexneri 2a str. 2457T
uagugaugccauacuucauaac

SEQ ID NO: 3879117 - RNA, 22 nt, Shigella flexneri 2a str. 2457T
uagugaugcgcauuauggcuuc

SEQ ID NO: 3879118 - RNA, 13 nt, Shigella flexneri 2a str. 2457T
uagugcaguacau

SEQ ID NO: 3879119 - RNA, 16 nt, Shigella flexneri 2a str. 2457T
uagugcuuucagcgaa

SEQ ID NO: 3879120 - RNA, 15 nt, Shigella flexneri 2a str. 2457T
uaguggaacaaagaa

SEQ ID NO: 3879121 - RNA, 16 nt, Shigella flexneri 2a str. 2457T
uaguggcaaauucuug

SEQ ID NO: 3879122 - RNA, 12 nt, Shigella flexneri 2a str. 2457T
uagugucuuauc

SEQ ID NO: 3879123 - RNA, 13 nt, Shigella flexneri 2a str. 2457T
uagugugaucagc

SEQ ID NO: 3879124 - RNA, 15 nt, Shigella flexneri 2a str. 2457T
uagugugcaaucacu

SEQ ID NO: 3879125 - RNA, 13 nt, Shigella flexneri 2a str. 2457T
uaguguuccugcg

SEQ ID NO: 3879126 - RNA, 20 nt, Shigella flexneri 2a str. 2457T
uaguuagcguugucaauacu

SEQ ID NO: 3879127 - RNA, 14 nt, Shigella flexneri 2a str. 2457T
uaguucaacagauu

SEQ ID NO: 3879128 - RNA, 16 nt, Shigella flexneri 2a str. 2457T
uaguucauccccucuu

SEQ ID NO: 3879129 - RNA, 18 nt, Shigella flexneri 2a str. 2457T
uaguucauccccucuucc

SEQ ID NO: 3879130 - RNA, 16 nt, Shigella flexneri 2a str. 2457T
uaguuccacuauuuca

SEQ ID NO: 3879131 - RNA, 17 nt, Shigella flexneri 2a str. 2457T
uaguucgcguaacugcu

SEQ ID NO: 3879132 - RNA, 19 nt, Shigella flexneri 2a str. 2457T
uaguugcauuccaguccac

SEQ ID NO: 3879133 - RNA, 16 nt, Shigella flexneri 2a str. 2457T
uaguuguaaucauauu

SEQ ID NO: 3879134 - RNA, 19 nt, Shigella flexneri 2a str. 2457T
uaguuucguucgccguuuu

SEQ ID NO: 3879135 - RNA, 14 nt, Shigella flexneri 2a str. 2457T
uaguuugauaauuu

SEQ ID NO: 3879136 - RNA, 19 nt, Shigella flexneri 2a str. 2457T
uaguuuuauacucagucag

SEQ ID NO: 3879137 - RNA, 19 nt, Shigella flexneri 2a str. 2457T
uaguuuugccgacuggcgc

SEQ ID NO: 3879138 - RNA, 14 nt, Shigella flexneri 2a str. 2457T
uauaaaaaaacaau

SEQ ID NO: 3879139 - RNA, 11 nt, Shigella flexneri 2a str. 2457T
uauaaaaaccg

SEQ ID NO: 3879140 - RNA, 17 nt, Shigella flexneri 2a str. 2457T
uauaaagaaaaucugaa

SEQ ID NO: 3879141 - RNA, 11 nt, Shigella flexneri 2a str. 2457T
uauaaauaaaa

SEQ ID NO: 3879142 - RNA, 13 nt, Shigella flexneri 2a str. 2457T
uauaaauaaaaag

SEQ ID NO: 3879143 - RNA, 13 nt, Shigella flexneri 2a str. 2457T
uaucaucagcaug

SEQ ID NO: 3879144 - RNA, 19 nt, Shigella flexneri 2a str. 2457T
uaucaugcucugccagcgu

SEQ ID NO: 3879145 - RNA, 14 nt, Shigella flexneri 2a str. 2457T
uaucauuucuggaa

SEQ ID NO: 3879146 - RNA, 18 nt, Shigella flexneri 2a str. 2457T
uaucauuuuacguugcau

SEQ ID NO: 3879147 - RNA, 21 nt, Shigella flexneri 2a str. 2457T
uauccacaccaagccggaauu

SEQ ID NO: 3879148 - RNA, 22 nt, Shigella flexneri 2a str. 2457T
uauccaccgcguucagcagcuc

SEQ ID NO: 3879149 - RNA, 21 nt, Shigella flexneri 2a str. 2457T
uauccacgauacgcugcacaa

SEQ ID NO: 3879150 - RNA, 21 nt, Shigella flexneri 2a str. 2457T
uauccacgucgacaacucccg

SEQ ID NO: 3879151 - RNA, 17 nt, Shigella flexneri 2a str. 2457T
uauccagcaaagcguca

SEQ ID NO: 3879152 - RNA, 21 nt, Shigella flexneri 2a str. 2457T
uauccagcgauaccggugcac

SEQ ID NO: 3879153 - RNA, 12 nt, Shigella flexneri 2a str. 2457T
uauccagcgcau

SEQ ID NO: 3879154 - RNA, 22 nt, Shigella flexneri 2a str. 2457T
uauccagcgcggcgaaggugcc

SEQ ID NO: 3879155 - RNA, 16 nt, Shigella flexneri 2a str. 2457T
uauccagcggcagcca

SEQ ID NO: 3879156 - RNA, 21 nt, Shigella flexneri 2a str. 2457T
uauccaguccgcgcuugccgc

SEQ ID NO: 3879157 - RNA, 15 nt, Shigella flexneri 2a str. 2457T
uauccaguuguucgc

SEQ ID NO: 3879158 - RNA, 13 nt, Shigella flexneri 2a str. 2457T
uauccaguuucug

SEQ ID NO: 3879159 - RNA, 15 nt, Shigella flexneri 2a str. 2457T
uauccaguuucugcc

SEQ ID NO: 3879160 - RNA, 13 nt, Shigella flexneri 2a str. 2457T
uauccauauggcu

SEQ ID NO: 3879161 - RNA, 17 nt, Shigella flexneri 2a str. 2457T
uauccauccccagagca

SEQ ID NO: 3879162 - RNA, 15 nt, Shigella flexneri 2a str. 2457T
uauccccugcgaugg

SEQ ID NO: 3879163 - RNA, 19 nt, Shigella flexneri 2a str. 2457T
uaucccgccagcaccagca

SEQ ID NO: 3879164 - RNA, 15 nt, Shigella flexneri 2a str. 2457T
uauccgaaaaaggau

SEQ ID NO: 3879165 - RNA, 19 nt, Shigella flexneri 2a str. 2457T
uauccgacauuucugcugc

SEQ ID NO: 3879166 - RNA, 19 nt, Shigella flexneri 2a str. 2457T
uauccgaugaaucaccaca

SEQ ID NO: 3879167 - RNA, 21 nt, Shigella flexneri 2a str. 2457T
uauccggcacuuacuuuccuu

SEQ ID NO: 3879168 - RNA, 23 nt, Shigella flexneri 2a str. 2457T
uauccggcauuaucacaucagcg

SEQ ID NO: 3879169 - RNA, 19 nt, Shigella flexneri 2a str. 2457T
uauccggcccacaucaacu

SEQ ID NO: 3879170 - RNA, 14 nt, Shigella flexneri 2a str. 2457T
uauccggcuaacaa

SEQ ID NO: 3879171 - RNA, 14 nt, Shigella flexneri 2a str. 2457T
uauccugauaaaaa

SEQ ID NO: 3879172 - RNA, 20 nt, Shigella flexneri 2a str. 2457T
uauccugcccacuccagcua

SEQ ID NO: 3879173 - RNA, 20 nt, Shigella flexneri 2a str. 2457T
uauccuguggacgcagcuca

SEQ ID NO: 3879174 - RNA, 14 nt, Shigella flexneri 2a str. 2457T
uauccuucacacau

SEQ ID NO: 3879175 - RNA, 15 nt, Shigella flexneri 2a str. 2457T
uaucgaacaaaaaaa

SEQ ID NO: 3879176 - RNA, 12 nt, Shigella flexneri 2a str. 2457T
uaucgaacaugc

SEQ ID NO: 3879177 - RNA, 16 nt, Shigella flexneri 2a str. 2457T
uaucgacgaaccauuu

SEQ ID NO: 3879178 - RNA, 19 nt, Shigella flexneri 2a str. 2457T
uaucgacggcguauugcau

SEQ ID NO: 3879179 - RNA, 21 nt, Shigella flexneri 2a str. 2457T
uaucgagagaauggggucagc

SEQ ID NO: 3879180 - RNA, 19 nt, Shigella flexneri 2a str. 2457T
uaucgauuucuacacccag

SEQ ID NO: 3879181 - RNA, 23 nt, Shigella flexneri 2a str. 2457T
uaucgauuucuacacccagcccc

SEQ ID NO: 3879182 - RNA, 16 nt, Shigella flexneri 2a str. 2457T
uaucgauuuucaaaau

SEQ ID NO: 3879183 - RNA, 20 nt, Shigella flexneri 2a str. 2457T
uaucgcacagaugcgacggc

SEQ ID NO: 3879184 - RNA, 15 nt, Shigella flexneri 2a str. 2457T
uaucgcauuaucaaa

SEQ ID NO: 3879185 - RNA, 15 nt, Shigella flexneri 2a str. 2457T
uaucgccagcgccac

SEQ ID NO: 3879186 - RNA, 19 nt, Shigella flexneri 2a str. 2457T
uaucgcccugcuccagcaa

SEQ ID NO: 3879187 - RNA, 14 nt, Shigella flexneri 2a str. 2457T
uaucgccguacaua

SEQ ID NO: 3879188 - RNA, 18 nt, Shigella flexneri 2a str. 2457T
uaucgccguacauagcgu

SEQ ID NO: 3879189 - RNA, 23 nt, Shigella flexneri 2a str. 2457T
uaucgccucuaaaguauguaaua

SEQ ID NO: 3879190 - RNA, 16 nt, Shigella flexneri 2a str. 2457T
uaucgcgauacaccag

SEQ ID NO: 3879191 - RNA, 14 nt, Shigella flexneri 2a str. 2457T
uaucgcgcagaaau

SEQ ID NO: 3879192 - RNA, 15 nt, Shigella flexneri 2a str. 2457T
uaucgcgcagaaauu

SEQ ID NO: 3879193 - RNA, 18 nt, Shigella flexneri 2a str. 2457T
uaucgcgccaucaaaucu

SEQ ID NO: 3879194 - RNA, 19 nt, Shigella flexneri 2a str. 2457T
uaucgcucaauauccugac

SEQ ID NO: 3879195 - RNA, 13 nt, Shigella flexneri 2a str. 2457T
uaucgcuggccuc

SEQ ID NO: 3879196 - RNA, 18 nt, Shigella flexneri 2a str. 2457T
uaucggagaacaggaaua

SEQ ID NO: 3879197 - RNA, 13 nt, Shigella flexneri 2a str. 2457T
uaucggcaucgcu

SEQ ID NO: 3879198 - RNA, 14 nt, Shigella flexneri 2a str. 2457T
uaucggccauaugu

SEQ ID NO: 3879199 - RNA, 17 nt, Shigella flexneri 2a str. 2457T
uaucggccaucuguucu

SEQ ID NO: 3879200 - RNA, 13 nt, Shigella flexneri 2a str. 2457T
uaucggguacggg

SEQ ID NO: 3879201 - RNA, 24 nt, Shigella flexneri 2a str. 2457T
uaucgugccuacacauuaucucaa

SEQ ID NO: 3879202 - RNA, 21 nt, Shigella flexneri 2a str. 2457T
uaucgugcuggauuuguguca

SEQ ID NO: 3879203 - RNA, 16 nt, Shigella flexneri 2a str. 2457T
uaucuaccacugccug

SEQ ID NO: 3879204 - RNA, 12 nt, Shigella flexneri 2a str. 2457T
uaucuaccggga

SEQ ID NO: 3879205 - RNA, 20 nt, Shigella flexneri 2a str. 2457T
uaucuauucacgaaucuauu

SEQ ID NO: 3879206 - RNA, 12 nt, Shigella flexneri 2a str. 2457T
uaucucaacaca

SEQ ID NO: 3879207 - RNA, 15 nt, Shigella flexneri 2a str. 2457T
uaucucaccccauuu

SEQ ID NO: 3879208 - RNA, 18 nt, Shigella flexneri 2a str. 2457T
uaucucagauaaaugcaa

SEQ ID NO: 3879209 - RNA, 12 nt, Shigella flexneri 2a str. 2457T
uaucuccauccg

SEQ ID NO: 3879210 - RNA, 14 nt, Shigella flexneri 2a str. 2457T
uaucuccucugcuu

SEQ ID NO: 3879211 - RNA, 19 nt, Shigella flexneri 2a str. 2457T
uaucucugaugguuuuuug

SEQ ID NO: 3879212 - RNA, 13 nt, Shigella flexneri 2a str. 2457T
uaucugacagcaa

SEQ ID NO: 3879213 - RNA, 18 nt, Shigella flexneri 2a str. 2457T
uaucugcagauuaugccu

SEQ ID NO: 3879214 - RNA, 17 nt, Shigella flexneri 2a str. 2457T
uaucugccguucagcua

SEQ ID NO: 3879215 - RNA, 17 nt, Shigella flexneri 2a str. 2457T
uaucuggcaagcaggac

SEQ ID NO: 3879216 - RNA, 15 nt, Shigella flexneri 2a str. 2457T
uaucuggccuacaaa

SEQ ID NO: 3879217 - RNA, 21 nt, Shigella flexneri 2a str. 2457T
uaucuggcgcuaguacccgau

SEQ ID NO: 3879218 - RNA, 12 nt, Shigella flexneri 2a str. 2457T
uaucuuauagac

SEQ ID NO: 3879219 - RNA, 19 nt, Shigella flexneri 2a str. 2457T
uaucuuauagacuaaauuu

SEQ ID NO: 3879220 - RNA, 14 nt, Shigella flexneri 2a str. 2457T
uaucuucaaucaga

SEQ ID NO: 3879221 - RNA, 18 nt, Shigella flexneri 2a str. 2457T
uaucuucaaucagaugug

SEQ ID NO: 3879222 - RNA, 10 nt, Shigella flexneri 2a str. 2457T
uaucuucaca

SEQ ID NO: 3879223 - RNA, 18 nt, Shigella flexneri 2a str. 2457T
uaucuucaccguucguga

SEQ ID NO: 3879224 - RNA, 13 nt, Shigella flexneri 2a str. 2457T
uaucuuccacuuc

SEQ ID NO: 3879225 - RNA, 18 nt, Shigella flexneri 2a str. 2457T
uaucuuccagggugacaa

SEQ ID NO: 3879226 - RNA, 13 nt, Shigella flexneri 2a str. 2457T
uaucuucccagcc

SEQ ID NO: 3879227 - RNA, 15 nt, Shigella flexneri 2a str. 2457T
uaucuucccagccca

SEQ ID NO: 3879228 - RNA, 14 nt, Shigella flexneri 2a str. 2457T
uaucuuccuggcgc

SEQ ID NO: 3879229 - RNA, 18 nt, Shigella flexneri 2a str. 2457T
uaucuuuacugauaauuu

SEQ ID NO: 3879230 - RNA, 22 nt, Shigella flexneri 2a str. 2457T
uaucuuuuucgguauauaacgc

SEQ ID NO: 3879231 - RNA, 14 nt, Shigella flexneri 2a str. 2457T
uaugaaaauaggaa

SEQ ID NO: 3879232 - RNA, 11 nt, Shigella flexneri 2a str. 2457T
uaugaaacaac

SEQ ID NO: 3879233 - RNA, 17 nt, Shigella flexneri 2a str. 2457T
uaugaaagaaaaucaau

SEQ ID NO: 3879234 - RNA, 19 nt, Shigella flexneri 2a str. 2457T
uaugaauagcggaaaucuc

SEQ ID NO: 3879235 - RNA, 20 nt, Shigella flexneri 2a str. 2457T
uaugaauagcggaaaucucc

SEQ ID NO: 3879236 - RNA, 15 nt, Shigella flexneri 2a str. 2457T
uaugaaugauaaaau

SEQ ID NO: 3879237 - RNA, 19 nt, Shigella flexneri 2a str. 2457T
uaugaaugauaaaauucau

SEQ ID NO: 3879238 - RNA, 22 nt, Shigella flexneri 2a str. 2457T
uaugagaaaauuucauuaauau

SEQ ID NO: 3879239 - RNA, 13 nt, Shigella flexneri 2a str. 2457T
uaugaguaauguu

SEQ ID NO: 3879240 - RNA, 21 nt, Shigella flexneri 2a str. 2457T
uaugauaggucauaucacaaa

SEQ ID NO: 3879241 - RNA, 15 nt, Shigella flexneri 2a str. 2457T
uauucgggauugcca

SEQ ID NO: 3879242 - RNA, 14 nt, Shigella flexneri 2a str. 2457T
uauucgugcggcac

SEQ ID NO: 3879243 - RNA, 15 nt, Shigella flexneri 2a str. 2457T
uauucugacgccacc

SEQ ID NO: 3879244 - RNA, 17 nt, Shigella flexneri 2a str. 2457T
uauucuggguaguccau

SEQ ID NO: 3879245 - RNA, 21 nt, Shigella flexneri 2a str. 2457T
uauucuuauaaagaaaaucug

SEQ ID NO: 3879246 - RNA, 17 nt, Shigella flexneri 2a str. 2457T
uauucuuauuaaauugu

SEQ ID NO: 3879247 - RNA, 17 nt, Shigella flexneri 2a str. 2457T
uauucuugacgccauuu

SEQ ID NO: 3879248 - RNA, 23 nt, Shigella flexneri 2a str. 2457T
uauucuugcugauacuccucauu

SEQ ID NO: 3879249 - RNA, 17 nt, Shigella flexneri 2a str. 2457T
uauugaagauguugcca

SEQ ID NO: 3879250 - RNA, 18 nt, Shigella flexneri 2a str. 2457T
uauugaauuagcaauauu

SEQ ID NO: 3879251 - RNA, 13 nt, Shigella flexneri 2a str. 2457T
uauugagaucacc

SEQ ID NO: 3879252 - RNA, 13 nt, Shigella flexneri 2a str. 2457T
uauugagaucgcu

SEQ ID NO: 3879253 - RNA, 12 nt, Shigella flexneri 2a str. 2457T
uauugaugcuca

SEQ ID NO: 3879254 - RNA, 17 nt, Shigella flexneri 2a str. 2457T
uauugauuuaacagcaa

SEQ ID NO: 3879255 - RNA, 14 nt, Shigella flexneri 2a str. 2457T
uauugcaaucaucu

SEQ ID NO: 3879256 - RNA, 17 nt, Shigella flexneri 2a str. 2457T
uauugcacaguauagca

SEQ ID NO: 3879257 - RNA, 20 nt, Shigella flexneri 2a str. 2457T
uauugcacaguauagcauca

SEQ ID NO: 3879258 - RNA, 18 nt, Shigella flexneri 2a str. 2457T
uauugccgaagaccagau

SEQ ID NO: 3879259 - RNA, 16 nt, Shigella flexneri 2a str. 2457T
uauugccguccggcau

SEQ ID NO: 3879260 - RNA, 14 nt, Shigella flexneri 2a str. 2457T
uauugcgcaggcgc

SEQ ID NO: 3879261 - RNA, 19 nt, Shigella flexneri 2a str. 2457T
uauugcggauaaagcugcc

SEQ ID NO: 3879262 - RNA, 12 nt, Shigella flexneri 2a str. 2457T
uauugcuguacu

SEQ ID NO: 3879263 - RNA, 15 nt, Shigella flexneri 2a str. 2457T
uauugcuucucaggu

SEQ ID NO: 3879264 - RNA, 14 nt, Shigella flexneri 2a str. 2457T
uauugggugacugg

SEQ ID NO: 3879265 - RNA, 18 nt, Shigella flexneri 2a str. 2457T
uauugguaaacucaaagu

SEQ ID NO: 3879266 - RNA, 16 nt, Shigella flexneri 2a str. 2457T
uauuggugaauugcac

SEQ ID NO: 3879267 - RNA, 15 nt, Shigella flexneri 2a str. 2457T
uauugguguugugaa

SEQ ID NO: 3879268 - RNA, 15 nt, Shigella flexneri 2a str. 2457T
uauuguuuugaugaa

SEQ ID NO: 3879269 - RNA, 21 nt, Shigella flexneri 2a str. 2457T
uauuuaaagugcaaaaauuca

SEQ ID NO: 3879270 - RNA, 21 nt, Shigella flexneri 2a str. 2457T
uauuuaauggcgacauaaaau

SEQ ID NO: 3879271 - RNA, 15 nt, Shigella flexneri 2a str. 2457T
uauuuaccaauauaa

SEQ ID NO: 3879272 - RNA, 14 nt, Shigella flexneri 2a str. 2457T
uauuuauacaguga

SEQ ID NO: 3879273 - RNA, 21 nt, Shigella flexneri 2a str. 2457T
uauuuauaggguaaauuaccu

SEQ ID NO: 3879274 - RNA, 21 nt, Shigella flexneri 2a str. 2457T
uauuuauauuacgaauauaaa

SEQ ID NO: 3879275 - RNA, 16 nt, Shigella flexneri 2a str. 2457T
uauuuauccauaauuu

SEQ ID NO: 3879276 - RNA, 15 nt, Shigella flexneri 2a str. 2457T
uauuuauuaauccag

SEQ ID NO: 3879277 - RNA, 13 nt, Shigella flexneri 2a str. 2457T
uauuuauuuccuu

SEQ ID NO: 3879278 - RNA, 16 nt, Shigella flexneri 2a str. 2457T
uauuuauuuuucuuga

SEQ ID NO: 3879279 - RNA, 17 nt, Shigella flexneri 2a str. 2457T
uauuucaauaugauaaa

SEQ ID NO: 3879280 - RNA, 19 nt, Shigella flexneri 2a str. 2457T
uauuucacauaacugccuc

SEQ ID NO: 3879281 - RNA, 14 nt, Shigella flexneri 2a str. 2457T
uauuucacuucaac

SEQ ID NO: 3879282 - RNA, 14 nt, Shigella flexneri 2a str. 2457T
uauuucagaccugu

SEQ ID NO: 3879283 - RNA, 13 nt, Shigella flexneri 2a str. 2457T
uauuucagcccca

SEQ ID NO: 3879284 - RNA, 22 nt, Shigella flexneri 2a str. 2457T
uauuucauagauuaauuuccca

SEQ ID NO: 3879285 - RNA, 15 nt, Shigella flexneri 2a str. 2457T
uauuucauguuugaa

SEQ ID NO: 3879286 - RNA, 17 nt, Shigella flexneri 2a str. 2457T
uauuuccaccucccccu

SEQ ID NO: 3879287 - RNA, 15 nt, Shigella flexneri 2a str. 2457T
uauuuccagcucaac

SEQ ID NO: 3879288 - RNA, 17 nt, Shigella flexneri 2a str. 2457T
uauuuccagggccucuc

SEQ ID NO: 3879289 - RNA, 22 nt, Shigella flexneri 2a str. 2457T
uauuucccagauagcaacagca

SEQ ID NO: 3879290 - RNA, 22 nt, Shigella flexneri 2a str. 2457T
uauuuccuuccuuggauauuuu

SEQ ID NO: 3879291 - RNA, 19 nt, Shigella flexneri 2a str. 2457T
uauuuccuucgcuuuaauu

SEQ ID NO: 3879292 - RNA, 17 nt, Shigella flexneri 2a str. 2457T
uauuucgcgauucugau

SEQ ID NO: 3879293 - RNA, 14 nt, Shigella flexneri 2a str. 2457T
uauuucgucagcau

SEQ ID NO: 3879294 - RNA, 16 nt, Shigella flexneri 2a str. 2457T
uauuucuauauccuca

SEQ ID NO: 3879295 - RNA, 22 nt, Shigella flexneri 2a str. 2457T
uauuugacccgcaguaaaucag

SEQ ID NO: 3879296 - RNA, 21 nt, Shigella flexneri 2a str. 2457T
uauuugccuaauaaaucuaaa

SEQ ID NO: 3879297 - RNA, 20 nt, Shigella flexneri 2a str. 2457T
uauuuguaguuugauaauuu

SEQ ID NO: 3879298 - RNA, 13 nt, Shigella flexneri 2a str. 2457T
uauuuucaaucug

SEQ ID NO: 3879299 - RNA, 20 nt, Shigella flexneri 2a str. 2457T
uauuuuccgagguuaauauu

SEQ ID NO: 3879300 - RNA, 16 nt, Shigella flexneri 2a str. 2457T
uauuuucggcaccuuu

SEQ ID NO: 3879301 - RNA, 12 nt, Shigella flexneri 2a str. 2457T
uauuuucugaaa

SEQ ID NO: 3879302 - RNA, 13 nt, Shigella flexneri 2a str. 2457T
uauuuucugaaac

SEQ ID NO: 3879303 - RNA, 15 nt, Shigella flexneri 2a str. 2457T
uauuuugaauuugca

SEQ ID NO: 3879304 - RNA, 20 nt, Shigella flexneri 2a str. 2457T
uauuuugcccugcuaugcaa

SEQ ID NO: 3879305 - RNA, 18 nt, Shigella flexneri 2a str. 2457T
uauuuugcuuccggcaag

SEQ ID NO: 3879306 - RNA, 15 nt, Shigella flexneri 2a str. 2457T
uauuuugcuuuaagu

SEQ ID NO: 3879307 - RNA, 17 nt, Shigella flexneri 2a str. 2457T
uauuuuuaaacaucaaa

SEQ ID NO: 3879308 - RNA, 12 nt, Shigella flexneri 2a str. 2457T
uauuuuuaaaua

SEQ ID NO: 3879309 - RNA, 20 nt, Shigella flexneri 2a str. 2457T
uauuuuuaaauauaaaacaa

SEQ ID NO: 3879310 - RNA, 17 nt, Shigella flexneri 2a str. 2457T
uauuuuuaaccguauuu

SEQ ID NO: 3879311 - RNA, 21 nt, Shigella flexneri 2a str. 2457T
uauuuuucacccuucaauccc

SEQ ID NO: 3879312 - RNA, 20 nt, Shigella flexneri 2a str. 2457T
uauuuuuguugaaauaauac

SEQ ID NO: 3879313 - RNA, 18 nt, Shigella flexneri 2a str. 2457T
uauuuuuuugcauggaua

SEQ ID NO: 3879314 - RNA, 22 nt, Shigella flexneri 2a str. 2457T
uauuuuuuuucaggaaauaaau

SEQ ID NO: 3879315 - RNA, 16 nt, Shigella flexneri 2a str. 2457T
ucaaaaaaacggcgcu

SEQ ID NO: 3879316 - RNA, 17 nt, Shigella flexneri 2a str. 2457T
ucaaaaaacuggaaaaa

SEQ ID NO: 3879317 - RNA, 20 nt, Shigella flexneri 2a str. 2457T
ucaaaaaaugaaacuggaag

SEQ ID NO: 3879318 - RNA, 22 nt, Shigella flexneri 2a str. 2457T
ucaaaaaaugaaacuggaagau

SEQ ID NO: 3879319 - RNA, 16 nt, Shigella flexneri 2a str. 2457T
ucaaaaacuaauucac

SEQ ID NO: 3879320 - RNA, 12 nt, Shigella flexneri 2a str. 2457T
ucaaaaauggcu

SEQ ID NO: 3879321 - RNA, 19 nt, Shigella flexneri 2a str. 2457T
ucaaaacggucacggcugu

SEQ ID NO: 3879322 - RNA, 19 nt, Shigella flexneri 2a str. 2457T
ucaaaagauugaauuauuc

SEQ ID NO: 3879323 - RNA, 20 nt, Shigella flexneri 2a str. 2457T
ucaaaagauugaauuauuca

SEQ ID NO: 3879324 - RNA, 23 nt, Shigella flexneri 2a str. 2457T
ucaaaauauccguagugaaaaag

SEQ ID NO: 3879325 - RNA, 19 nt, Shigella flexneri 2a str. 2457T
ucaaaauaucgacauucaa

SEQ ID NO: 3879326 - RNA, 17 nt, Shigella flexneri 2a str. 2457T
ucaaaaucaucauugcu

SEQ ID NO: 3879327 - RNA, 15 nt, Shigella flexneri 2a str. 2457T
ucaaaauuaacaccu

SEQ ID NO: 3879328 - RNA, 13 nt, Shigella flexneri 2a str. 2457T
ucaaacaauuuuc

SEQ ID NO: 3879329 - RNA, 13 nt, Shigella flexneri 2a str. 2457T
ucaaacaggcugc

SEQ ID NO: 3879330 - RNA, 22 nt, Shigella flexneri 2a str. 2457T
ucaaacagggcaauuaaaaauu

SEQ ID NO: 3879331 - RNA, 18 nt, Shigella flexneri 2a str. 2457T
ucaaacaguucuggaaga

SEQ ID NO: 3879332 - RNA, 22 nt, Shigella flexneri 2a str. 2457T
ucaaacauuagcgcaugaccag

SEQ ID NO: 3879333 - RNA, 18 nt, Shigella flexneri 2a str. 2457T
ucaaaccacuuaauuauu

SEQ ID NO: 3879334 - RNA, 19 nt, Shigella flexneri 2a str. 2457T
ucaaaccacuuaauuauua

SEQ ID NO: 3879335 - RNA, 19 nt, Shigella flexneri 2a str. 2457T
ucaaaccauucccugcuuu

SEQ ID NO: 3879336 - RNA, 16 nt, Shigella flexneri 2a str. 2457T
ucaaacgccagaucac

SEQ ID NO: 3879337 - RNA, 18 nt, Shigella flexneri 2a str. 2457T
ucaaacgccgaugaccua

SEQ ID NO: 3879338 - RNA, 20 nt, Shigella flexneri 2a str. 2457T
ucaaacgcugacggugccag

SEQ ID NO: 3879339 - RNA, 18 nt, Shigella flexneri 2a str. 2457T
ucaagcuaacgaacgcag

SEQ ID NO: 3879340 - RNA, 16 nt, Shigella flexneri 2a str. 2457T
ucaagcuguucuuccc

SEQ ID NO: 3879341 - RNA, 23 nt, Shigella flexneri 2a str. 2457T
ucaaggccggagaagaugcguca

SEQ ID NO: 3879342 - RNA, 15 nt, Shigella flexneri 2a str. 2457T
ucaaggcgcugcauc

SEQ ID NO: 3879343 - RNA, 18 nt, Shigella flexneri 2a str. 2457T
ucaaggucaacaguucau

SEQ ID NO: 3879344 - RNA, 14 nt, Shigella flexneri 2a str. 2457T
ucaaggucaacauu

SEQ ID NO: 3879345 - RNA, 13 nt, Shigella flexneri 2a str. 2457T
ucaaguaaccuuu

SEQ ID NO: 3879346 - RNA, 16 nt, Shigella flexneri 2a str. 2457T
ucaaguauuuuuaauu

SEQ ID NO: 3879347 - RNA, 21 nt, Shigella flexneri 2a str. 2457T
ucaagucauugauucgaucaa

SEQ ID NO: 3879348 - RNA, 16 nt, Shigella flexneri 2a str. 2457T
ucaagugcuacccacu

SEQ ID NO: 3879349 - RNA, 18 nt, Shigella flexneri 2a str. 2457T
ucaagugcuuucaucaaa

SEQ ID NO: 3879350 - RNA, 13 nt, Shigella flexneri 2a str. 2457T
ucaaguuaccggu

SEQ ID NO: 3879351 - RNA, 14 nt, Shigella flexneri 2a str. 2457T
ucaauaaacaauga

SEQ ID NO: 3879352 - RNA, 15 nt, Shigella flexneri 2a str. 2457T
ucaauaaacgccugc

SEQ ID NO: 3879353 - RNA, 18 nt, Shigella flexneri 2a str. 2457T
ucaauaaagugauauuuc

SEQ ID NO: 3879354 - RNA, 13 nt, Shigella flexneri 2a str. 2457T
ucaauaaguuauc

SEQ ID NO: 3879355 - RNA, 13 nt, Shigella flexneri 2a str. 2457T
ucaauaaucaacg

SEQ ID NO: 3879356 - RNA, 20 nt, Shigella flexneri 2a str. 2457T
ucaauaaucugauuugucgg

SEQ ID NO: 3879357 - RNA, 22 nt, Shigella flexneri 2a str. 2457T
ucaauaccgccugcaaauaaau

SEQ ID NO: 3879358 - RNA, 19 nt, Shigella flexneri 2a str. 2457T
ucaauaccgcguaauacau

SEQ ID NO: 3879359 - RNA, 19 nt, Shigella flexneri 2a str. 2457T
ucaauacuuucacaaaaau

SEQ ID NO: 3879360 - RNA, 20 nt, Shigella flexneri 2a str. 2457T
ucaauacuuucacaaaaaua

SEQ ID NO: 3879361 - RNA, 19 nt, Shigella flexneri 2a str. 2457T
ucaauauccugaccuuuac

SEQ ID NO: 3879362 - RNA, 16 nt, Shigella flexneri 2a str. 2457T
ucaauaugauaaaccu

SEQ ID NO: 3879363 - RNA, 16 nt, Shigella flexneri 2a str. 2457T
ucaauauggaaguuuu

SEQ ID NO: 3879364 - RNA, 20 nt, Shigella flexneri 2a str. 2457T
ucaauauuaagaaucucuga

SEQ ID NO: 3879365 - RNA, 15 nt, Shigella flexneri 2a str. 2457T
ucaauauuaaugcug

SEQ ID NO: 3879366 - RNA, 20 nt, Shigella flexneri 2a str. 2457T
ucaauauuagcauuaaguaa

SEQ ID NO: 3879367 - RNA, 18 nt, Shigella flexneri 2a str. 2457T
ucaauauuugcaccuaaa

SEQ ID NO: 3879368 - RNA, 12 nt, Shigella flexneri 2a str. 2457T
ucaaucaccgca

SEQ ID NO: 3879369 - RNA, 14 nt, Shigella flexneri 2a str. 2457T
ucaaucaguucauu

SEQ ID NO: 3879370 - RNA, 20 nt, Shigella flexneri 2a str. 2457T
ucaaucauccauauuuucag

SEQ ID NO: 3879371 - RNA, 18 nt, Shigella flexneri 2a str. 2457T
ucaaucaucucucgcauc

SEQ ID NO: 3879372 - RNA, 15 nt, Shigella flexneri 2a str. 2457T
ucaaucccaucaggc

SEQ ID NO: 3879373 - RNA, 21 nt, Shigella flexneri 2a str. 2457T
ucaaucccuucgacuuucagu

SEQ ID NO: 3879374 - RNA, 14 nt, Shigella flexneri 2a str. 2457T
ucaaucgagauacg

SEQ ID NO: 3879375 - RNA, 15 nt, Shigella flexneri 2a str. 2457T
ucaaucgcaaucugg

SEQ ID NO: 3879376 - RNA, 22 nt, Shigella flexneri 2a str. 2457T
ucaaucgcacccgccaucaucc

SEQ ID NO: 3879377 - RNA, 14 nt, Shigella flexneri 2a str. 2457T
ucaaucgccaccac

SEQ ID NO: 3879378 - RNA, 22 nt, Shigella flexneri 2a str. 2457T
ucaaucgccucgccgaaacgcu

SEQ ID NO: 3879379 - RNA, 14 nt, Shigella flexneri 2a str. 2457T
ucaaucucagcaag

SEQ ID NO: 3879380 - RNA, 18 nt, Shigella flexneri 2a str. 2457T
ucaaucucuucacagaca

SEQ ID NO: 3879381 - RNA, 13 nt, Shigella flexneri 2a str. 2457T
ucaaucugcugcc

SEQ ID NO: 3879382 - RNA, 13 nt, Shigella flexneri 2a str. 2457T
ucaaucuucucuu

SEQ ID NO: 3879383 - RNA, 17 nt, Shigella flexneri 2a str. 2457T
ucaaucuuuacacacaa

SEQ ID NO: 3879384 - RNA, 20 nt, Shigella flexneri 2a str. 2457T
ucaaugaguucgcgcgcugc

SEQ ID NO: 3879385 - RNA, 23 nt, Shigella flexneri 2a str. 2457T
ucaaugcccaucacuaucgccau

SEQ ID NO: 3879386 - RNA, 18 nt, Shigella flexneri 2a str. 2457T
ucaaugccggacuguaaa

SEQ ID NO: 3879387 - RNA, 19 nt, Shigella flexneri 2a str. 2457T
ucaaugcggcggcgcaccg

SEQ ID NO: 3879388 - RNA, 15 nt, Shigella flexneri 2a str. 2457T
ucaaugcuuuuugca

SEQ ID NO: 3879389 - RNA, 17 nt, Shigella flexneri 2a str. 2457T
ucaaugcuuuuugcauu

SEQ ID NO: 3879390 - RNA, 22 nt, Shigella flexneri 2a str. 2457T
ucaauggcugcaaagcauuuuu

SEQ ID NO: 3879391 - RNA, 20 nt, Shigella flexneri 2a str. 2457T
ucaaugguggcaaucugaau

SEQ ID NO: 3879392 - RNA, 16 nt, Shigella flexneri 2a str. 2457T
ucaaugguguuuucca

SEQ ID NO: 3879393 - RNA, 23 nt, Shigella flexneri 2a str. 2457T
ucaauuaauucuccgcucucaau

SEQ ID NO: 3879394 - RNA, 19 nt, Shigella flexneri 2a str. 2457T
ucaauuaccacaaguaaaa

SEQ ID NO: 3879395 - RNA, 13 nt, Shigella flexneri 2a str. 2457T
ucaauuccuucug

SEQ ID NO: 3879396 - RNA, 17 nt, Shigella flexneri 2a str. 2457T
ucaauucggaaauaauc

SEQ ID NO: 3879397 - RNA, 20 nt, Shigella flexneri 2a str. 2457T
ucaauugcguuaaaaucagc

SEQ ID NO: 3879398 - RNA, 23 nt, Shigella flexneri 2a str. 2457T
ucaauugcuaguaaguuacauuu

SEQ ID NO: 3879399 - RNA, 15 nt, Shigella flexneri 2a str. 2457T
ucaauuggaucugau

SEQ ID NO: 3879400 - RNA, 21 nt, Shigella flexneri 2a str. 2457T
ucaauuuauugaauuuacaca

SEQ ID NO: 3879401 - RNA, 14 nt, Shigella flexneri 2a str. 2457T
ucaauuucacagua

SEQ ID NO: 3879402 - RNA, 17 nt, Shigella flexneri 2a str. 2457T
ucaauuucugcaaaaua

SEQ ID NO: 3879403 - RNA, 18 nt, Shigella flexneri 2a str. 2457T
ucaauuuguuccgccagc

SEQ ID NO: 3879404 - RNA, 14 nt, Shigella flexneri 2a str. 2457T
ucacaaaacgaaua

SEQ ID NO: 3879405 - RNA, 17 nt, Shigella flexneri 2a str. 2457T
ucacaaaacgaauaauu

SEQ ID NO: 3879406 - RNA, 18 nt, Shigella flexneri 2a str. 2457T
ucacaaaacgaauaauug

SEQ ID NO: 3879407 - RNA, 17 nt, Shigella flexneri 2a str. 2457T
ucacaaacagcgccugu

SEQ ID NO: 3879408 - RNA, 14 nt, Shigella flexneri 2a str. 2457T
ucacaaauaaaaaa

SEQ ID NO: 3879409 - RNA, 16 nt, Shigella flexneri 2a str. 2457T
ucacaagacuguaaau

SEQ ID NO: 3879410 - RNA, 22 nt, Shigella flexneri 2a str. 2457T
ucacaaggccauugacgcaucg

SEQ ID NO: 3879411 - RNA, 12 nt, Shigella flexneri 2a str. 2457T
ucacaaucaucg

SEQ ID NO: 3879412 - RNA, 21 nt, Shigella flexneri 2a str. 2457T
ucacaaucaucgcauccagcg

SEQ ID NO: 3879413 - RNA, 23 nt, Shigella flexneri 2a str. 2457T
ucacaauggcacaaauggcaaug

SEQ ID NO: 3879414 - RNA, 15 nt, Shigella flexneri 2a str. 2457T
ucacacaaccaugca

SEQ ID NO: 3879415 - RNA, 20 nt, Shigella flexneri 2a str. 2457T
ucacacaagguauccagacg

SEQ ID NO: 3879416 - RNA, 18 nt, Shigella flexneri 2a str. 2457T
ucacacacuuuuauuaac

SEQ ID NO: 3879417 - RNA, 17 nt, Shigella flexneri 2a str. 2457T
ucacacagugaaucucu

SEQ ID NO: 3879418 - RNA, 14 nt, Shigella flexneri 2a str. 2457T
ucacaccagcgaug

SEQ ID NO: 3879419 - RNA, 20 nt, Shigella flexneri 2a str. 2457T
ucacaccaucaaagaagcuc

SEQ ID NO: 3879420 - RNA, 19 nt, Shigella flexneri 2a str. 2457T
ucacaccgcgaucuuccac

SEQ ID NO: 3879421 - RNA, 19 nt, Shigella flexneri 2a str. 2457T
ucacacucaugauccugga

SEQ ID NO: 3879422 - RNA, 21 nt, Shigella flexneri 2a str. 2457T
ucacacuccagucccaguuca

SEQ ID NO: 3879423 - RNA, 18 nt, Shigella flexneri 2a str. 2457T
ucacacugaugacaggcu

SEQ ID NO: 3879424 - RNA, 15 nt, Shigella flexneri 2a str. 2457T
ucacagaaggccagg

SEQ ID NO: 3879425 - RNA, 16 nt, Shigella flexneri 2a str. 2457T
ucacagaagugaagca

SEQ ID NO: 3879426 - RNA, 19 nt, Shigella flexneri 2a str. 2457T
ucacagaggucuuuucucg

SEQ ID NO: 3879427 - RNA, 17 nt, Shigella flexneri 2a str. 2457T
ucacagaguauuuccag

SEQ ID NO: 3879428 - RNA, 19 nt, Shigella flexneri 2a str. 2457T
ucacagaguauuuccagcu

SEQ ID NO: 3879429 - RNA, 21 nt, Shigella flexneri 2a str. 2457T
ucacagcuaaucaucaucagu

SEQ ID NO: 3879430 - RNA, 16 nt, Shigella flexneri 2a str. 2457T
ucacaggccgccaggc

SEQ ID NO: 3879431 - RNA, 21 nt, Shigella flexneri 2a str. 2457T
ucacagggcucuuaagcaccg

SEQ ID NO: 3879432 - RNA, 19 nt, Shigella flexneri 2a str. 2457T
ucacagguucgaaucccgu

SEQ ID NO: 3879433 - RNA, 16 nt, Shigella flexneri 2a str. 2457T
ucacagucugaaugcc

SEQ ID NO: 3879434 - RNA, 12 nt, Shigella flexneri 2a str. 2457T
ucacauaaauuc

SEQ ID NO: 3879435 - RNA, 18 nt, Shigella flexneri 2a str. 2457T
ucacauaaucgaaaacau

SEQ ID NO: 3879436 - RNA, 13 nt, Shigella flexneri 2a str. 2457T
ucacaucaccaua

SEQ ID NO: 3879437 - RNA, 19 nt, Shigella flexneri 2a str. 2457T
ucacaucaccauaaaucag

SEQ ID NO: 3879438 - RNA, 14 nt, Shigella flexneri 2a str. 2457T
ucacaucagcgcau

SEQ ID NO: 3879439 - RNA, 15 nt, Shigella flexneri 2a str. 2457T
ucacaucagcgcauu

SEQ ID NO: 3879440 - RNA, 18 nt, Shigella flexneri 2a str. 2457T
ucacauccaguacgccuu

SEQ ID NO: 3879441 - RNA, 21 nt, Shigella flexneri 2a str. 2457T
ucacauccggcaauauucauu

SEQ ID NO: 3879442 - RNA, 16 nt, Shigella flexneri 2a str. 2457T
ucacauccugauagca

SEQ ID NO: 3879443 - RNA, 21 nt, Shigella flexneri 2a str. 2457T
ucacaugcuggaaccacagcg

SEQ ID NO: 3879444 - RNA, 14 nt, Shigella flexneri 2a str. 2457T
ucacauuuaaacaa

SEQ ID NO: 3879445 - RNA, 17 nt, Shigella flexneri 2a str. 2457T
ucacauuuuuaagccgu

SEQ ID NO: 3879446 - RNA, 22 nt, Shigella flexneri 2a str. 2457T
ucaccaacaguacgguaaagcc

SEQ ID NO: 3879447 - RNA, 16 nt, Shigella flexneri 2a str. 2457T
ucaccacagacaaaca

SEQ ID NO: 3879448 - RNA, 17 nt, Shigella flexneri 2a str. 2457T
ucaccacagacaaacag

SEQ ID NO: 3879449 - RNA, 15 nt, Shigella flexneri 2a str. 2457T
ucaccacauccagcu

SEQ ID NO: 3879450 - RNA, 20 nt, Shigella flexneri 2a str. 2457T
ucaccacccagcgguaaaau

SEQ ID NO: 3879451 - RNA, 19 nt, Shigella flexneri 2a str. 2457T
ucaccacgcugagagaagc

SEQ ID NO: 3879452 - RNA, 13 nt, Shigella flexneri 2a str. 2457T
ucaccacuguuaa

SEQ ID NO: 3879453 - RNA, 22 nt, Shigella flexneri 2a str. 2457T
ucaccacuucggcaaaaaaguc

SEQ ID NO: 3879454 - RNA, 20 nt, Shigella flexneri 2a str. 2457T
ucaccagacaucccagugca

SEQ ID NO: 3879455 - RNA, 15 nt, Shigella flexneri 2a str. 2457T
ucaccagauguccca

SEQ ID NO: 3879456 - RNA, 21 nt, Shigella flexneri 2a str. 2457T
ucaccagaugucccaucugau

SEQ ID NO: 3879457 - RNA, 16 nt, Shigella flexneri 2a str. 2457T
ucaccagcaaauccag

SEQ ID NO: 3879458 - RNA, 22 nt, Shigella flexneri 2a str. 2457T
ucaccagcaaauccagcgguug

SEQ ID NO: 3879459 - RNA, 15 nt, Shigella flexneri 2a str. 2457T
ucaccagcacuucac

SEQ ID NO: 3879460 - RNA, 19 nt, Shigella flexneri 2a str. 2457T
ucaccagcaguaaaccgcu

SEQ ID NO: 3879461 - RNA, 17 nt, Shigella flexneri 2a str. 2457T
ucaccagccugcaaacg

SEQ ID NO: 3879462 - RNA, 15 nt, Shigella flexneri 2a str. 2457T
ucaccagcgcacgca

SEQ ID NO: 3879463 - RNA, 18 nt, Shigella flexneri 2a str. 2457T
ucaccagcugacguagca

SEQ ID NO: 3879464 - RNA, 16 nt, Shigella flexneri 2a str. 2457T
ucaccaggucaccaga

SEQ ID NO: 3879465 - RNA, 21 nt, Shigella flexneri 2a str. 2457T
ucaccauaaaacgcgcuacug

SEQ ID NO: 3879466 - RNA, 13 nt, Shigella flexneri 2a str. 2457T
ucaccauaaauca

SEQ ID NO: 3879467 - RNA, 16 nt, Shigella flexneri 2a str. 2457T
ucaccauauucagcag

SEQ ID NO: 3879468 - RNA, 17 nt, Shigella flexneri 2a str. 2457T
ucaccauauucagcagc

SEQ ID NO: 3879469 - RNA, 18 nt, Shigella flexneri 2a str. 2457T
ucaccauauucagcagca

SEQ ID NO: 3879470 - RNA, 15 nt, Shigella flexneri 2a str. 2457T
ucaccaucagcagca

SEQ ID NO: 3879471 - RNA, 13 nt, Shigella flexneri 2a str. 2457T
ucaccaucuucac

SEQ ID NO: 3879472 - RNA, 17 nt, Shigella flexneri 2a str. 2457T
ucaccaugagcggcgcu

SEQ ID NO: 3879473 - RNA, 22 nt, Shigella flexneri 2a str. 2457T
ucaccauuacgcaaugcguacu

SEQ ID NO: 3879474 - RNA, 19 nt, Shigella flexneri 2a str. 2457T
ucaccauuacggugaaaau

SEQ ID NO: 3879475 - RNA, 16 nt, Shigella flexneri 2a str. 2457T
ucaccauuccgcauga

SEQ ID NO: 3879476 - RNA, 23 nt, Shigella flexneri 2a str. 2457T
ucaccauuuccgguacuggcuau

SEQ ID NO: 3879477 - RNA, 12 nt, Shigella flexneri 2a str. 2457T
ucacccaacaau

SEQ ID NO: 3879478 - RNA, 18 nt, Shigella flexneri 2a str. 2457T
ucacccaccgauuuucag

SEQ ID NO: 3879479 - RNA, 18 nt, Shigella flexneri 2a str. 2457T
ucacccacgguuacgcua

SEQ ID NO: 3879480 - RNA, 20 nt, Shigella flexneri 2a str. 2457T
ucaccccgcgcucacaccac

SEQ ID NO: 3879481 - RNA, 22 nt, Shigella flexneri 2a str. 2457T
ucacccgccgguggcguuucca

SEQ ID NO: 3879482 - RNA, 20 nt, Shigella flexneri 2a str. 2457T
ucacccggaggaaagcaccu

SEQ ID NO: 3879483 - RNA, 19 nt, Shigella flexneri 2a str. 2457T
ucacccggaucaauuaauc

SEQ ID NO: 3879484 - RNA, 23 nt, Shigella flexneri 2a str. 2457T
ucaccgaagcggccgucagaucg

SEQ ID NO: 3879485 - RNA, 13 nt, Shigella flexneri 2a str. 2457T
ucaccgaucauca

SEQ ID NO: 3879486 - RNA, 17 nt, Shigella flexneri 2a str. 2457T
ucaccgaugaucgccau

SEQ ID NO: 3879487 - RNA, 19 nt, Shigella flexneri 2a str. 2457T
ucaccgaugcacagaaccg

SEQ ID NO: 3879488 - RNA, 19 nt, Shigella flexneri 2a str. 2457T
ucaccgcaaacauaauccc

SEQ ID NO: 3879489 - RNA, 15 nt, Shigella flexneri 2a str. 2457T
ucaccgcaccagucg

SEQ ID NO: 3879490 - RNA, 22 nt, Shigella flexneri 2a str. 2457T
ucaccgcaucgucacugauagu

SEQ ID NO: 3879491 - RNA, 14 nt, Shigella flexneri 2a str. 2457T
ucaccgccagcaag

SEQ ID NO: 3879492 - RNA, 12 nt, Shigella flexneri 2a str. 2457T
ucaccgccgccu

SEQ ID NO: 3879493 - RNA, 13 nt, Shigella flexneri 2a str. 2457T
ucaccgccgccuu

SEQ ID NO: 3879494 - RNA, 14 nt, Shigella flexneri 2a str. 2457T
ucaccgcgaccaga

SEQ ID NO: 3879495 - RNA, 21 nt, Shigella flexneri 2a str. 2457T
ucaccgcgguguauaccagcu

SEQ ID NO: 3879496 - RNA, 16 nt, Shigella flexneri 2a str. 2457T
ucaccgcgucuucgcu

SEQ ID NO: 3879497 - RNA, 15 nt, Shigella flexneri 2a str. 2457T
ucaccggcaaagcca

SEQ ID NO: 3879498 - RNA, 20 nt, Shigella flexneri 2a str. 2457T
ucaccgggcuuggcaccauu

SEQ ID NO: 3879499 - RNA, 21 nt, Shigella flexneri 2a str. 2457T
ucaccgggcuuggcaccauua

SEQ ID NO: 3879500 - RNA, 19 nt, Shigella flexneri 2a str. 2457T
ucaccgguucggccauauc

SEQ ID NO: 3879501 - RNA, 16 nt, Shigella flexneri 2a str. 2457T
ucaccgugauccccac

SEQ ID NO: 3879502 - RNA, 16 nt, Shigella flexneri 2a str. 2457T
ucaccuaacagcaucg

SEQ ID NO: 3879503 - RNA, 15 nt, Shigella flexneri 2a str. 2457T
ucaccuacgcuggca

SEQ ID NO: 3879504 - RNA, 14 nt, Shigella flexneri 2a str. 2457T
ucaccucugucgau

SEQ ID NO: 3879505 - RNA, 22 nt, Shigella flexneri 2a str. 2457T
ucaccucugucgaugcgcucug

SEQ ID NO: 3879506 - RNA, 22 nt, Shigella flexneri 2a str. 2457T
ucaccucuucagcguccaucca

SEQ ID NO: 3879507 - RNA, 19 nt, Shigella flexneri 2a str. 2457T
ucaccucuucauuaaacca

SEQ ID NO: 3879508 - RNA, 14 nt, Shigella flexneri 2a str. 2457T
ucaccucuuuggcg

SEQ ID NO: 3879509 - RNA, 17 nt, Shigella flexneri 2a str. 2457T
ucaccucuuuuuccacu

SEQ ID NO: 3879510 - RNA, 20 nt, Shigella flexneri 2a str. 2457T
ucaccugauugaccgccagc

SEQ ID NO: 3879511 - RNA, 20 nt, Shigella flexneri 2a str. 2457T
ucaccugcacaccaaccgcu

SEQ ID NO: 3879512 - RNA, 13 nt, Shigella flexneri 2a str. 2457T
ucaccugcacaug

SEQ ID NO: 3879513 - RNA, 18 nt, Shigella flexneri 2a str. 2457T
ucaccugcauacaaauaa

SEQ ID NO: 3879514 - RNA, 15 nt, Shigella flexneri 2a str. 2457T
ucaccugcccuccgg

SEQ ID NO: 3879515 - RNA, 18 nt, Shigella flexneri 2a str. 2457T
ucaccugcgccugcgguu

SEQ ID NO: 3879516 - RNA, 17 nt, Shigella flexneri 2a str. 2457T
ucaccugcggugcagcc

SEQ ID NO: 3879517 - RNA, 17 nt, Shigella flexneri 2a str. 2457T
ucaccuggagccaguug

SEQ ID NO: 3879518 - RNA, 22 nt, Shigella flexneri 2a str. 2457T
ucaccuugcucgcccuggaugc

SEQ ID NO: 3879519 - RNA, 14 nt, Shigella flexneri 2a str. 2457T
ucacgaauccgcac

SEQ ID NO: 3879520 - RNA, 16 nt, Shigella flexneri 2a str. 2457T
ucacgaauccgcacca

SEQ ID NO: 3879521 - RNA, 15 nt, Shigella flexneri 2a str. 2457T
ucacgaaucgccgca

SEQ ID NO: 3879522 - RNA, 16 nt, Shigella flexneri 2a str. 2457T
ucacgaaucuauucau

SEQ ID NO: 3879523 - RNA, 18 nt, Shigella flexneri 2a str. 2457T
ucacgaccuguaccuuca

SEQ ID NO: 3879524 - RNA, 15 nt, Shigella flexneri 2a str. 2457T
ucacgauagccagaa

SEQ ID NO: 3879525 - RNA, 21 nt, Shigella flexneri 2a str. 2457T
ucacgauuguuaaucacaucg

SEQ ID NO: 3879526 - RNA, 18 nt, Shigella flexneri 2a str. 2457T
ucacgcagcuucucguga

SEQ ID NO: 3879527 - RNA, 16 nt, Shigella flexneri 2a str. 2457T
ucacgcaggcgagaau

SEQ ID NO: 3879528 - RNA, 12 nt, Shigella flexneri 2a str. 2457T
ucacgcauggac

SEQ ID NO: 3879529 - RNA, 13 nt, Shigella flexneri 2a str. 2457T
ucacgccaaccag

SEQ ID NO: 3879530 - RNA, 15 nt, Shigella flexneri 2a str. 2457T
ucacgccaauaaucg

SEQ ID NO: 3879531 - RNA, 12 nt, Shigella flexneri 2a str. 2457T
ucacgccaauac

SEQ ID NO: 3879532 - RNA, 22 nt, Shigella flexneri 2a str. 2457T
ucacgccagucgcacacaacag

SEQ ID NO: 3879533 - RNA, 18 nt, Shigella flexneri 2a str. 2457T
ucacgccaucaucggcaa

SEQ ID NO: 3879534 - RNA, 13 nt, Shigella flexneri 2a str. 2457T
ucagaagacgcuc

SEQ ID NO: 3879535 - RNA, 20 nt, Shigella flexneri 2a str. 2457T
ucagaauauauaaagauuca

SEQ ID NO: 3879536 - RNA, 21 nt, Shigella flexneri 2a str. 2457T
ucagaaucacgccaacaaaca

SEQ ID NO: 3879537 - RNA, 18 nt, Shigella flexneri 2a str. 2457T
ucagaaugcgcucuuccg

SEQ ID NO: 3879538 - RNA, 16 nt, Shigella flexneri 2a str. 2457T
ucagacaacuucccug

SEQ ID NO: 3879539 - RNA, 16 nt, Shigella flexneri 2a str. 2457T
ucagacacaauaauuu

SEQ ID NO: 3879540 - RNA, 20 nt, Shigella flexneri 2a str. 2457T
ucagacacaauaauuuuauu

SEQ ID NO: 3879541 - RNA, 13 nt, Shigella flexneri 2a str. 2457T
ucagacaccgauu

SEQ ID NO: 3879542 - RNA, 19 nt, Shigella flexneri 2a str. 2457T
ucagacacgccgccagacc

SEQ ID NO: 3879543 - RNA, 19 nt, Shigella flexneri 2a str. 2457T
ucagacccugcucuuucag

SEQ ID NO: 3879544 - RNA, 17 nt, Shigella flexneri 2a str. 2457T
ucagaccgcuucugcgu

SEQ ID NO: 3879545 - RNA, 18 nt, Shigella flexneri 2a str. 2457T
ucagaccggcaaccagca

SEQ ID NO: 3879546 - RNA, 16 nt, Shigella flexneri 2a str. 2457T
ucagaccuuuuaauuu

SEQ ID NO: 3879547 - RNA, 18 nt, Shigella flexneri 2a str. 2457T
ucagacggcugucuuccu

SEQ ID NO: 3879548 - RNA, 19 nt, Shigella flexneri 2a str. 2457T
ucagacuauucagcucuuc

SEQ ID NO: 3879549 - RNA, 20 nt, Shigella flexneri 2a str. 2457T
ucagacucauauaaaaaccg

SEQ ID NO: 3879550 - RNA, 17 nt, Shigella flexneri 2a str. 2457T
ucagacuuugcgccauc

SEQ ID NO: 3879551 - RNA, 14 nt, Shigella flexneri 2a str. 2457T
ucagagagccagcc

SEQ ID NO: 3879552 - RNA, 22 nt, Shigella flexneri 2a str. 2457T
ucagagagccagccccacagca

SEQ ID NO: 3879553 - RNA, 15 nt, Shigella flexneri 2a str. 2457T
ucagaggcuguuccg

SEQ ID NO: 3879554 - RNA, 16 nt, Shigella flexneri 2a str. 2457T
ucagagugccgaagaa

SEQ ID NO: 3879555 - RNA, 20 nt, Shigella flexneri 2a str. 2457T
ucagagugccgaagaacaua

SEQ ID NO: 3879556 - RNA, 12 nt, Shigella flexneri 2a str. 2457T
ucagauaaaaag

SEQ ID NO: 3879557 - RNA, 15 nt, Shigella flexneri 2a str. 2457T
ucagauaaaaaguuu

SEQ ID NO: 3879558 - RNA, 16 nt, Shigella flexneri 2a str. 2457T
ucagauaaaaaguuuu

SEQ ID NO: 3879559 - RNA, 15 nt, Shigella flexneri 2a str. 2457T
ucagauaaaauacac

SEQ ID NO: 3879560 - RNA, 13 nt, Shigella flexneri 2a str. 2457T
ucagauaaaugca

SEQ ID NO: 3879561 - RNA, 21 nt, Shigella flexneri 2a str. 2457T
ucagauaaaugcaaacgcauc

SEQ ID NO: 3879562 - RNA, 18 nt, Shigella flexneri 2a str. 2457T
ucagauaauagguaaaca

SEQ ID NO: 3879563 - RNA, 21 nt, Shigella flexneri 2a str. 2457T
ucagauaauccccaaugaccu

SEQ ID NO: 3879564 - RNA, 21 nt, Shigella flexneri 2a str. 2457T
ucagauaaugcccgaugaccu

SEQ ID NO: 3879565 - RNA, 22 nt, Shigella flexneri 2a str. 2457T
ucagauaaugcccgaugaccuu

SEQ ID NO: 3879566 - RNA, 17 nt, Shigella flexneri 2a str. 2457T
ucagauccgcacccgca

SEQ ID NO: 3879567 - RNA, 19 nt, Shigella flexneri 2a str. 2457T
ucagaucgguuuuuuucga

SEQ ID NO: 3879568 - RNA, 23 nt, Shigella flexneri 2a str. 2457T
ucagaucgguuuuuuucgaaccg

SEQ ID NO: 3879569 - RNA, 22 nt, Shigella flexneri 2a str. 2457T
ucagaucguucgcaccaaaucc

SEQ ID NO: 3879570 - RNA, 16 nt, Shigella flexneri 2a str. 2457T
ucagaucguugaccug

SEQ ID NO: 3879571 - RNA, 21 nt, Shigella flexneri 2a str. 2457T
ucagaucuaauguugguguga

SEQ ID NO: 3879572 - RNA, 18 nt, Shigella flexneri 2a str. 2457T
ucagaucuuucacgaaca

SEQ ID NO: 3879573 - RNA, 22 nt, Shigella flexneri 2a str. 2457T
ucagaugaacgagucaacgcuu

SEQ ID NO: 3879574 - RNA, 18 nt, Shigella flexneri 2a str. 2457T
ucagaugaugauacugac

SEQ ID NO: 3879575 - RNA, 22 nt, Shigella flexneri 2a str. 2457T
ucagaugcggcgugaacgccuu

SEQ ID NO: 3879576 - RNA, 21 nt, Shigella flexneri 2a str. 2457T
ucagaugcggcuucgcuucau

SEQ ID NO: 3879577 - RNA, 22 nt, Shigella flexneri 2a str. 2457T
ucagauuauagugauccugcau

SEQ ID NO: 3879578 - RNA, 17 nt, Shigella flexneri 2a str. 2457T
ucagauuaugucgcuca

SEQ ID NO: 3879579 - RNA, 21 nt, Shigella flexneri 2a str. 2457T
ucagauuaugucgcucaaugu

SEQ ID NO: 3879580 - RNA, 13 nt, Shigella flexneri 2a str. 2457T
ucagauugagcau

SEQ ID NO: 3879581 - RNA, 13 nt, Shigella flexneri 2a str. 2457T
ucagauugccgug

SEQ ID NO: 3879582 - RNA, 20 nt, Shigella flexneri 2a str. 2457T
ucagauuggcuucauugauu

SEQ ID NO: 3879583 - RNA, 15 nt, Shigella flexneri 2a str. 2457T
ucagauuguugauua

SEQ ID NO: 3879584 - RNA, 18 nt, Shigella flexneri 2a str. 2457T
ucagcaaauagauaaaau

SEQ ID NO: 3879585 - RNA, 15 nt, Shigella flexneri 2a str. 2457T
ucagcaacuguaacg

SEQ ID NO: 3879586 - RNA, 18 nt, Shigella flexneri 2a str. 2457T
ucagcaacuguaacgcag

SEQ ID NO: 3879587 - RNA, 17 nt, Shigella flexneri 2a str. 2457T
ucagcaagcgauaauuu

SEQ ID NO: 3879588 - RNA, 16 nt, Shigella flexneri 2a str. 2457T
ucagcaaggaaagcca

SEQ ID NO: 3879589 - RNA, 17 nt, Shigella flexneri 2a str. 2457T
ucagcaagugaauaaau

SEQ ID NO: 3879590 - RNA, 22 nt, Shigella flexneri 2a str. 2457T
ucagcaagugaauaaauuuuau

SEQ ID NO: 3879591 - RNA, 14 nt, Shigella flexneri 2a str. 2457T
ucagcaauacgcuu

SEQ ID NO: 3879592 - RNA, 17 nt, Shigella flexneri 2a str. 2457T
ucagcaaucgcgccagc

SEQ ID NO: 3879593 - RNA, 21 nt, Shigella flexneri 2a str. 2457T
ucagcaaucggcuugccguug

SEQ ID NO: 3879594 - RNA, 16 nt, Shigella flexneri 2a str. 2457T
ucagcaaucucuucaa

SEQ ID NO: 3879595 - RNA, 20 nt, Shigella flexneri 2a str. 2457T
ucagcaaucugaagccgcac

SEQ ID NO: 3879596 - RNA, 13 nt, Shigella flexneri 2a str. 2457T
ucagcaaucugau

SEQ ID NO: 3879597 - RNA, 16 nt, Shigella flexneri 2a str. 2457T
ucagcaauguuucucu

SEQ ID NO: 3879598 - RNA, 19 nt, Shigella flexneri 2a str. 2457T
ucagcaauucucucuucag

SEQ ID NO: 3879599 - RNA, 15 nt, Shigella flexneri 2a str. 2457T
ucagcaauuucuccg

SEQ ID NO: 3879600 - RNA, 12 nt, Shigella flexneri 2a str. 2457T
ucagcaccagau

SEQ ID NO: 3879601 - RNA, 19 nt, Shigella flexneri 2a str. 2457T
ucagcacgucuuccauugc

SEQ ID NO: 3879602 - RNA, 22 nt, Shigella flexneri 2a str. 2457T
ucagcagacggccaaaaucucu

SEQ ID NO: 3879603 - RNA, 20 nt, Shigella flexneri 2a str. 2457T
ucagcagauaucccgccagc

SEQ ID NO: 3879604 - RNA, 17 nt, Shigella flexneri 2a str. 2457T
ucagcagcagacagccu

SEQ ID NO: 3879605 - RNA, 22 nt, Shigella flexneri 2a str. 2457T
ucagcagcagcaagauauugau

SEQ ID NO: 3879606 - RNA, 23 nt, Shigella flexneri 2a str. 2457T
ucagcagcggcucggucagaccc

SEQ ID NO: 3879607 - RNA, 15 nt, Shigella flexneri 2a str. 2457T
ucagcagcucaucaa

SEQ ID NO: 3879608 - RNA, 16 nt, Shigella flexneri 2a str. 2457T
ucagcaguucacgcag

SEQ ID NO: 3879609 - RNA, 14 nt, Shigella flexneri 2a str. 2457T
ucagcaguucagca

SEQ ID NO: 3879610 - RNA, 20 nt, Shigella flexneri 2a str. 2457T
ucagcaguucagucagcagu

SEQ ID NO: 3879611 - RNA, 17 nt, Shigella flexneri 2a str. 2457T
ucagcaguucugccagg

SEQ ID NO: 3879612 - RNA, 15 nt, Shigella flexneri 2a str. 2457T
ucagcauaaaaauau

SEQ ID NO: 3879613 - RNA, 14 nt, Shigella flexneri 2a str. 2457T
ucagcauaaucacc

SEQ ID NO: 3879614 - RNA, 18 nt, Shigella flexneri 2a str. 2457T
ucagcauaaucaccagua

SEQ ID NO: 3879615 - RNA, 18 nt, Shigella flexneri 2a str. 2457T
ucagcauauaggaggccu

SEQ ID NO: 3879616 - RNA, 17 nt, Shigella flexneri 2a str. 2457T
ucagcaucaaugaccug

SEQ ID NO: 3879617 - RNA, 19 nt, Shigella flexneri 2a str. 2457T
ucagcauccauaucgccau

SEQ ID NO: 3879618 - RNA, 22 nt, Shigella flexneri 2a str. 2457T
ucagcaucccaccugaaauggu

SEQ ID NO: 3879619 - RNA, 24 nt, Shigella flexneri 2a str. 2457T
ucagcaucggugaggaucaccagu

SEQ ID NO: 3879620 - RNA, 14 nt, Shigella flexneri 2a str. 2457T
ucagcaucuggaaa

SEQ ID NO: 3879621 - RNA, 12 nt, Shigella flexneri 2a str. 2457T
ucagcaugacaa

SEQ ID NO: 3879622 - RNA, 15 nt, Shigella flexneri 2a str. 2457T
ucagcaugacaaaaa

SEQ ID NO: 3879623 - RNA, 17 nt, Shigella flexneri 2a str. 2457T
ucagcaugacaaaaaag

SEQ ID NO: 3879624 - RNA, 19 nt, Shigella flexneri 2a str. 2457T
ucagcauuacccagauaau

SEQ ID NO: 3879625 - RNA, 20 nt, Shigella flexneri 2a str. 2457T
ucagcauuucgcgauauugc

SEQ ID NO: 3879626 - RNA, 20 nt, Shigella flexneri 2a str. 2457T
ucagcauuuucuauuucuga

SEQ ID NO: 3879627 - RNA, 16 nt, Shigella flexneri 2a str. 2457T
ucagccaaauccagcg

SEQ ID NO: 3879628 - RNA, 13 nt, Shigella flexneri 2a str. 2457T
ucagccacuucuu

SEQ ID NO: 3879629 - RNA, 14 nt, Shigella flexneri 2a str. 2457T
ucagccagaaagaa

SEQ ID NO: 3879630 - RNA, 17 nt, Shigella flexneri 2a str. 2457T
ucagccagaaagaaccg

SEQ ID NO: 3879631 - RNA, 20 nt, Shigella flexneri 2a str. 2457T
ucagguuguuuucuggcuga

SEQ ID NO: 3879632 - RNA, 18 nt, Shigella flexneri 2a str. 2457T
ucagguuuuucagcugcc

SEQ ID NO: 3879633 - RNA, 14 nt, Shigella flexneri 2a str. 2457T
ucaguaaacgcuuu

SEQ ID NO: 3879634 - RNA, 19 nt, Shigella flexneri 2a str. 2457T
ucaguaauccuuucucaau

SEQ ID NO: 3879635 - RNA, 13 nt, Shigella flexneri 2a str. 2457T
ucaguaaugacug

SEQ ID NO: 3879636 - RNA, 13 nt, Shigella flexneri 2a str. 2457T
ucaguacaccacc

SEQ ID NO: 3879637 - RNA, 18 nt, Shigella flexneri 2a str. 2457T
ucaguacguucacgcagc

SEQ ID NO: 3879638 - RNA, 16 nt, Shigella flexneri 2a str. 2457T
ucaguagaauaaucug

SEQ ID NO: 3879639 - RNA, 19 nt, Shigella flexneri 2a str. 2457T
ucaguagcgcaaucaccac

SEQ ID NO: 3879640 - RNA, 13 nt, Shigella flexneri 2a str. 2457T
ucaguauaacuac

SEQ ID NO: 3879641 - RNA, 15 nt, Shigella flexneri 2a str. 2457T
ucaguauaacuacug

SEQ ID NO: 3879642 - RNA, 17 nt, Shigella flexneri 2a str. 2457T
ucaguauaacuacugau

SEQ ID NO: 3879643 - RNA, 13 nt, Shigella flexneri 2a str. 2457T
ucaguauuuccac

SEQ ID NO: 3879644 - RNA, 23 nt, Shigella flexneri 2a str. 2457T
ucagucacgacaaagacaucaaa

SEQ ID NO: 3879645 - RNA, 12 nt, Shigella flexneri 2a str. 2457T
ucagucagcagu

SEQ ID NO: 3879646 - RNA, 15 nt, Shigella flexneri 2a str. 2457T
ucagucgugauuguc

SEQ ID NO: 3879647 - RNA, 13 nt, Shigella flexneri 2a str. 2457T
ucagucucaaacc

SEQ ID NO: 3879648 - RNA, 12 nt, Shigella flexneri 2a str. 2457T
ucagugaaaccg

SEQ ID NO: 3879649 - RNA, 21 nt, Shigella flexneri 2a str. 2457T
ucagugaccgaaccuguuuuc

SEQ ID NO: 3879650 - RNA, 22 nt, Shigella flexneri 2a str. 2457T
ucagugagauaccaguugauca

SEQ ID NO: 3879651 - RNA, 15 nt, Shigella flexneri 2a str. 2457T
ucagugcgucgcugc

SEQ ID NO: 3879652 - RNA, 18 nt, Shigella flexneri 2a str. 2457T
ucaguggcuuaucuuccu

SEQ ID NO: 3879653 - RNA, 17 nt, Shigella flexneri 2a str. 2457T
ucagugguguagggcag

SEQ ID NO: 3879654 - RNA, 17 nt, Shigella flexneri 2a str. 2457T
ucagugucgcaguagcc

SEQ ID NO: 3879655 - RNA, 10 nt, Shigella flexneri 2a str. 2457T
ucagugucuu

SEQ ID NO: 3879656 - RNA, 20 nt, Shigella flexneri 2a str. 2457T
ucagugucuuaucuggcauu

SEQ ID NO: 3879657 - RNA, 13 nt, Shigella flexneri 2a str. 2457T
ucaguuaacggca

SEQ ID NO: 3879658 - RNA, 13 nt, Shigella flexneri 2a str. 2457T
ucaguucaaauuc

SEQ ID NO: 3879659 - RNA, 15 nt, Shigella flexneri 2a str. 2457T
ucaguucaaauucau

SEQ ID NO: 3879660 - RNA, 21 nt, Shigella flexneri 2a str. 2457T
ucaguucauggugcaagaaau

SEQ ID NO: 3879661 - RNA, 15 nt, Shigella flexneri 2a str. 2457T
ucaguuccagcagcg

SEQ ID NO: 3879662 - RNA, 14 nt, Shigella flexneri 2a str. 2457T
ucaguuccgcugca

SEQ ID NO: 3879663 - RNA, 18 nt, Shigella flexneri 2a str. 2457T
ucaguuccgggaucacca

SEQ ID NO: 3879664 - RNA, 23 nt, Shigella flexneri 2a str. 2457T
ucaguucguuuuacgcacuucuu

SEQ ID NO: 3879665 - RNA, 17 nt, Shigella flexneri 2a str. 2457T
ucaguugcaccugaucc

SEQ ID NO: 3879666 - RNA, 14 nt, Shigella flexneri 2a str. 2457T
ucaguuggggaaaa

SEQ ID NO: 3879667 - RNA, 22 nt, Shigella flexneri 2a str. 2457T
ucaguugguuagagcacaucac

SEQ ID NO: 3879668 - RNA, 18 nt, Shigella flexneri 2a str. 2457T
ucaguuuauagaacggca

SEQ ID NO: 3879669 - RNA, 15 nt, Shigella flexneri 2a str. 2457T
ucaguuugcaaaccc

SEQ ID NO: 3879670 - RNA, 22 nt, Shigella flexneri 2a str. 2457T
ucaguuuuuguugauaaacaaa

SEQ ID NO: 3879671 - RNA, 14 nt, Shigella flexneri 2a str. 2457T
ucauaaaaauuaaa

SEQ ID NO: 3879672 - RNA, 19 nt, Shigella flexneri 2a str. 2457T
ucauaaagcagccuauuuc

SEQ ID NO: 3879673 - RNA, 23 nt, Shigella flexneri 2a str. 2457T
ucauaaauacagagcacgcaagg

SEQ ID NO: 3879674 - RNA, 12 nt, Shigella flexneri 2a str. 2457T
ucauaacggcaa

SEQ ID NO: 3879675 - RNA, 22 nt, Shigella flexneri 2a str. 2457T
ucauaacucuccuguuuaauau

SEQ ID NO: 3879676 - RNA, 13 nt, Shigella flexneri 2a str. 2457T
ucauacaccagcg

SEQ ID NO: 3879677 - RNA, 16 nt, Shigella flexneri 2a str. 2457T
ucauacaccagcggca

SEQ ID NO: 3879678 - RNA, 21 nt, Shigella flexneri 2a str. 2457T
ucauacacuucacacacuuuu

SEQ ID NO: 3879679 - RNA, 20 nt, Shigella flexneri 2a str. 2457T
ucauacagccgguacauucc

SEQ ID NO: 3879680 - RNA, 20 nt, Shigella flexneri 2a str. 2457T
ucauacccaacguaacaaaa

SEQ ID NO: 3879681 - RNA, 18 nt, Shigella flexneri 2a str. 2457T
ucauaccccacauaguuu

SEQ ID NO: 3879682 - RNA, 16 nt, Shigella flexneri 2a str. 2457T
ucauaccgaucaccga

SEQ ID NO: 3879683 - RNA, 15 nt, Shigella flexneri 2a str. 2457T
ucauacgaacgccug

SEQ ID NO: 3879684 - RNA, 21 nt, Shigella flexneri 2a str. 2457T
ucauacgcggcagaaugguuu

SEQ ID NO: 3879685 - RNA, 19 nt, Shigella flexneri 2a str. 2457T
ucauacgcguaaaacagcc

SEQ ID NO: 3879686 - RNA, 14 nt, Shigella flexneri 2a str. 2457T
ucauacuccagucg

SEQ ID NO: 3879687 - RNA, 17 nt, Shigella flexneri 2a str. 2457T
ucauacugauuguacug

SEQ ID NO: 3879688 - RNA, 16 nt, Shigella flexneri 2a str. 2457T
ucauagacuucccucc

SEQ ID NO: 3879689 - RNA, 22 nt, Shigella flexneri 2a str. 2457T
ucauagauuaauuucccaccac

SEQ ID NO: 3879690 - RNA, 22 nt, Shigella flexneri 2a str. 2457T
ucauagcaguaccuccuucaca

SEQ ID NO: 3879691 - RNA, 15 nt, Shigella flexneri 2a str. 2457T
ucauagccuuucaau

SEQ ID NO: 3879692 - RNA, 16 nt, Shigella flexneri 2a str. 2457T
ucauagguaaacauca

SEQ ID NO: 3879693 - RNA, 19 nt, Shigella flexneri 2a str. 2457T
ucauaggucaguguaccgg

SEQ ID NO: 3879694 - RNA, 14 nt, Shigella flexneri 2a str. 2457T
ucauauaacgcagg

SEQ ID NO: 3879695 - RNA, 15 nt, Shigella flexneri 2a str. 2457T
ucauauaccgcauca

SEQ ID NO: 3879696 - RNA, 17 nt, Shigella flexneri 2a str. 2457T
ucauauagccgccuugu

SEQ ID NO: 3879697 - RNA, 20 nt, Shigella flexneri 2a str. 2457T
ucauaucugccagauaaugg

SEQ ID NO: 3879698 - RNA, 16 nt, Shigella flexneri 2a str. 2457T
ucauaugauaggcuuc

SEQ ID NO: 3879699 - RNA, 15 nt, Shigella flexneri 2a str. 2457T
ucauauuaaauuuuu

SEQ ID NO: 3879700 - RNA, 16 nt, Shigella flexneri 2a str. 2457T
ucauauuaaauuuuuu

SEQ ID NO: 3879701 - RNA, 16 nt, Shigella flexneri 2a str. 2457T
ucauauucugaaauau

SEQ ID NO: 3879702 - RNA, 15 nt, Shigella flexneri 2a str. 2457T
ucauauugcucugga

SEQ ID NO: 3879703 - RNA, 17 nt, Shigella flexneri 2a str. 2457T
ucaucaaaaucaucauu

SEQ ID NO: 3879704 - RNA, 18 nt, Shigella flexneri 2a str. 2457T
ucaucaaaaucaucauug

SEQ ID NO: 3879705 - RNA, 13 nt, Shigella flexneri 2a str. 2457T
ucaucaaagccaa

SEQ ID NO: 3879706 - RNA, 20 nt, Shigella flexneri 2a str. 2457T
ucaucaaauuacgauaauca

SEQ ID NO: 3879707 - RNA, 21 nt, Shigella flexneri 2a str. 2457T
ucaucaacugacuauccugga

SEQ ID NO: 3879708 - RNA, 20 nt, Shigella flexneri 2a str. 2457T
ucaucaagcaaggccagguu

SEQ ID NO: 3879709 - RNA, 18 nt, Shigella flexneri 2a str. 2457T
ucaucaagcugugccuga

SEQ ID NO: 3879710 - RNA, 14 nt, Shigella flexneri 2a str. 2457T
ucaucaagcuguuc

SEQ ID NO: 3879711 - RNA, 16 nt, Shigella flexneri 2a str. 2457T
ucaucaagcuguucuu

SEQ ID NO: 3879712 - RNA, 21 nt, Shigella flexneri 2a str. 2457T
ucaucaauaccugguccuuca

SEQ ID NO: 3879713 - RNA, 14 nt, Shigella flexneri 2a str. 2457T
ucaucaaugccagc

SEQ ID NO: 3879714 - RNA, 21 nt, Shigella flexneri 2a str. 2457T
ucaucaauugcgcaccagcuu

SEQ ID NO: 3879715 - RNA, 12 nt, Shigella flexneri 2a str. 2457T
ucaucacaccgc

SEQ ID NO: 3879716 - RNA, 16 nt, Shigella flexneri 2a str. 2457T
ucaucacaucccagca

SEQ ID NO: 3879717 - RNA, 12 nt, Shigella flexneri 2a str. 2457T
ucaucaccagaa

SEQ ID NO: 3879718 - RNA, 14 nt, Shigella flexneri 2a str. 2457T
ucaucaccagaauc

SEQ ID NO: 3879719 - RNA, 15 nt, Shigella flexneri 2a str. 2457T
ucaucaccaucaggc

SEQ ID NO: 3879720 - RNA, 22 nt, Shigella flexneri 2a str. 2457T
ucaucacccaacgccuuucgcu

SEQ ID NO: 3879721 - RNA, 19 nt, Shigella flexneri 2a str. 2457T
ucaucaccggggauaacgu

SEQ ID NO: 3879722 - RNA, 14 nt, Shigella flexneri 2a str. 2457T
ucaucacgaaaauc

SEQ ID NO: 3879723 - RNA, 15 nt, Shigella flexneri 2a str. 2457T
ucaucacgcaucacu

SEQ ID NO: 3879724 - RNA, 15 nt, Shigella flexneri 2a str. 2457T
ucaucacgcgguuac

SEQ ID NO: 3879725 - RNA, 21 nt, Shigella flexneri 2a str. 2457T
ucaucacgcgguuacgcaccg

SEQ ID NO: 3879726 - RNA, 17 nt, Shigella flexneri 2a str. 2457T
ucaucacguuggucugg

SEQ ID NO: 3879727 - RNA, 22 nt, Shigella flexneri 2a str. 2457T
ucaucagcaaaggcgugaacuu

SEQ ID NO: 3879728 - RNA, 20 nt, Shigella flexneri 2a str. 2457T
ucaucagcauaaucaccagu

SEQ ID NO: 3879729 - RNA, 19 nt, Shigella flexneri 2a str. 2457T
ucauguauauuauccauca

SEQ ID NO: 3879730 - RNA, 15 nt, Shigella flexneri 2a str. 2457T
ucauguuaaauuccg

SEQ ID NO: 3879731 - RNA, 19 nt, Shigella flexneri 2a str. 2457T
ucauguuaaauuccggcuc

SEQ ID NO: 3879732 - RNA, 20 nt, Shigella flexneri 2a str. 2457T
ucauuaaccguuuacgucau

SEQ ID NO: 3879733 - RNA, 19 nt, Shigella flexneri 2a str. 2457T
ucauuaagaacuccugaaa

SEQ ID NO: 3879734 - RNA, 13 nt, Shigella flexneri 2a str. 2457T
ucauuaccuucaa

SEQ ID NO: 3879735 - RNA, 15 nt, Shigella flexneri 2a str. 2457T
ucauuaccuucaaca

SEQ ID NO: 3879736 - RNA, 17 nt, Shigella flexneri 2a str. 2457T
ucauuacgccagucacg

SEQ ID NO: 3879737 - RNA, 21 nt, Shigella flexneri 2a str. 2457T
ucauuacgcgguuuauuaugc

SEQ ID NO: 3879738 - RNA, 14 nt, Shigella flexneri 2a str. 2457T
ucauuagcccaaua

SEQ ID NO: 3879739 - RNA, 16 nt, Shigella flexneri 2a str. 2457T
ucauuaggccauuuga

SEQ ID NO: 3879740 - RNA, 16 nt, Shigella flexneri 2a str. 2457T
ucauuauuaauauuca

SEQ ID NO: 3879741 - RNA, 15 nt, Shigella flexneri 2a str. 2457T
ucauuauugucggug

SEQ ID NO: 3879742 - RNA, 18 nt, Shigella flexneri 2a str. 2457T
ucauucaacgucuugcug

SEQ ID NO: 3879743 - RNA, 18 nt, Shigella flexneri 2a str. 2457T
ucauucaacuuaagucuc

SEQ ID NO: 3879744 - RNA, 13 nt, Shigella flexneri 2a str. 2457T
ucauucaccaguu

SEQ ID NO: 3879745 - RNA, 23 nt, Shigella flexneri 2a str. 2457T
ucauucagugacagguugcucau

SEQ ID NO: 3879746 - RNA, 14 nt, Shigella flexneri 2a str. 2457T
ucauucauccgccg

SEQ ID NO: 3879747 - RNA, 18 nt, Shigella flexneri 2a str. 2457T
ucauuccaccgaaacuuu

SEQ ID NO: 3879748 - RNA, 13 nt, Shigella flexneri 2a str. 2457T
ucauuccuggagc

SEQ ID NO: 3879749 - RNA, 22 nt, Shigella flexneri 2a str. 2457T
ucauucgcaguugcaguaccag

SEQ ID NO: 3879750 - RNA, 20 nt, Shigella flexneri 2a str. 2457T
ucauucgccgguuccagcuu

SEQ ID NO: 3879751 - RNA, 21 nt, Shigella flexneri 2a str. 2457T
ucauucucuauucuuaaaaua

SEQ ID NO: 3879752 - RNA, 20 nt, Shigella flexneri 2a str. 2457T
ucauucugcaaggcaaaaua

SEQ ID NO: 3879753 - RNA, 22 nt, Shigella flexneri 2a str. 2457T
ucauugaacgggugauuucccc

SEQ ID NO: 3879754 - RNA, 14 nt, Shigella flexneri 2a str. 2457T
ucauugacgccaag

SEQ ID NO: 3879755 - RNA, 19 nt, Shigella flexneri 2a str. 2457T
ucauugccaguccuaaaaa

SEQ ID NO: 3879756 - RNA, 13 nt, Shigella flexneri 2a str. 2457T
ucauugccgcauc

SEQ ID NO: 3879757 - RNA, 17 nt, Shigella flexneri 2a str. 2457T
ucauugcuaucuccugu

SEQ ID NO: 3879758 - RNA, 22 nt, Shigella flexneri 2a str. 2457T
ucauuguguacauccuaaaggc

SEQ ID NO: 3879759 - RNA, 18 nt, Shigella flexneri 2a str. 2457T
ucauuuacaucacgcagc

SEQ ID NO: 3879760 - RNA, 21 nt, Shigella flexneri 2a str. 2457T
ucauuuacaucacgcagcugc

SEQ ID NO: 3879761 - RNA, 17 nt, Shigella flexneri 2a str. 2457T
ucauuuauguucagccg

SEQ ID NO: 3879762 - RNA, 14 nt, Shigella flexneri 2a str. 2457T
ucauuuauuaccuu

SEQ ID NO: 3879763 - RNA, 13 nt, Shigella flexneri 2a str. 2457T
ucauuucgccuga

SEQ ID NO: 3879764 - RNA, 14 nt, Shigella flexneri 2a str. 2457T
ucauuucuggaagc

SEQ ID NO: 3879765 - RNA, 21 nt, Shigella flexneri 2a str. 2457T
ucauuucuguauaaucaccaa

SEQ ID NO: 3879766 - RNA, 24 nt, Shigella flexneri 2a str. 2457T
ucauuuuauugcguaaucuuuuca

SEQ ID NO: 3879767 - RNA, 20 nt, Shigella flexneri 2a str. 2457T
ucauuuucggcagugaaaac

SEQ ID NO: 3879768 - RNA, 16 nt, Shigella flexneri 2a str. 2457T
ucauuuucucuuucag

SEQ ID NO: 3879769 - RNA, 21 nt, Shigella flexneri 2a str. 2457T
ucauuuucuucagcaguucag

SEQ ID NO: 3879770 - RNA, 11 nt, Shigella flexneri 2a str. 2457T
ucauuuugguu

SEQ ID NO: 3879771 - RNA, 15 nt, Shigella flexneri 2a str. 2457T
ucauuuuucucaacg

SEQ ID NO: 3879772 - RNA, 22 nt, Shigella flexneri 2a str. 2457T
ucauuuuuucgacaucaagaaa

SEQ ID NO: 3879773 - RNA, 15 nt, Shigella flexneri 2a str. 2457T
uccaaaaaacaaacc

SEQ ID NO: 3879774 - RNA, 13 nt, Shigella flexneri 2a str. 2457T
uccaacaccaggc

SEQ ID NO: 3879775 - RNA, 20 nt, Shigella flexneri 2a str. 2457T
uccaacccgcgaauaucagc

SEQ ID NO: 3879776 - RNA, 20 nt, Shigella flexneri 2a str. 2457T
uccaacuuacugauaguguu

SEQ ID NO: 3879777 - RNA, 16 nt, Shigella flexneri 2a str. 2457T
uccaagauuaaaggca

SEQ ID NO: 3879778 - RNA, 15 nt, Shigella flexneri 2a str. 2457T
uccacaccacuuccg

SEQ ID NO: 3879779 - RNA, 16 nt, Shigella flexneri 2a str. 2457T
uccacagcaaugcauu

SEQ ID NO: 3879780 - RNA, 13 nt, Shigella flexneri 2a str. 2457T
uccacagucaggc

SEQ ID NO: 3879781 - RNA, 16 nt, Shigella flexneri 2a str. 2457T
uccacaucggcaucag

SEQ ID NO: 3879782 - RNA, 19 nt, Shigella flexneri 2a str. 2457T
uccacauuuuccaucacga

SEQ ID NO: 3879783 - RNA, 22 nt, Shigella flexneri 2a str. 2457T
uccaccaccgcaaaauagguau

SEQ ID NO: 3879784 - RNA, 16 nt, Shigella flexneri 2a str. 2457T
uccaccacgcugcaug

SEQ ID NO: 3879785 - RNA, 23 nt, Shigella flexneri 2a str. 2457T
uccaccacgcuguagccgccguc

SEQ ID NO: 3879786 - RNA, 17 nt, Shigella flexneri 2a str. 2457T
uccaccacguuuuucaa

SEQ ID NO: 3879787 - RNA, 16 nt, Shigella flexneri 2a str. 2457T
uccaccagauggcuuu

SEQ ID NO: 3879788 - RNA, 13 nt, Shigella flexneri 2a str. 2457T
uccaccagcacca

SEQ ID NO: 3879789 - RNA, 14 nt, Shigella flexneri 2a str. 2457T
uccaccagcggcug

SEQ ID NO: 3879790 - RNA, 10 nt, Shigella flexneri 2a str. 2457T
uccaccagug

SEQ ID NO: 3879791 - RNA, 13 nt, Shigella flexneri 2a str. 2457T
uccaccaucacgc

SEQ ID NO: 3879792 - RNA, 14 nt, Shigella flexneri 2a str. 2457T
uccacccgcagcca

SEQ ID NO: 3879793 - RNA, 15 nt, Shigella flexneri 2a str. 2457T
uccaccgauuuugag

SEQ ID NO: 3879794 - RNA, 17 nt, Shigella flexneri 2a str. 2457T
uccaccgcguucagcag

SEQ ID NO: 3879795 - RNA, 21 nt, Shigella flexneri 2a str. 2457T
uccaccugcgucgcgccguag

SEQ ID NO: 3879796 - RNA, 21 nt, Shigella flexneri 2a str. 2457T
uccaccuuaucgacaugcggu

SEQ ID NO: 3879797 - RNA, 18 nt, Shigella flexneri 2a str. 2457T
uccacgaaacggcguuga

SEQ ID NO: 3879798 - RNA, 22 nt, Shigella flexneri 2a str. 2457T
uccacgaaacggcguugagcaa

SEQ ID NO: 3879799 - RNA, 15 nt, Shigella flexneri 2a str. 2457T
uccacgauacgcugc

SEQ ID NO: 3879800 - RNA, 22 nt, Shigella flexneri 2a str. 2457T
uccacgccaagcucauaacggc

SEQ ID NO: 3879801 - RNA, 20 nt, Shigella flexneri 2a str. 2457T
uccacgccgcugucuaccag

SEQ ID NO: 3879802 - RNA, 21 nt, Shigella flexneri 2a str. 2457T
uccacgccgcugucuaccagc

SEQ ID NO: 3879803 - RNA, 13 nt, Shigella flexneri 2a str. 2457T
uccacgccugcau

SEQ ID NO: 3879804 - RNA, 23 nt, Shigella flexneri 2a str. 2457T
uccacgcggguuuacuacggcuu

SEQ ID NO: 3879805 - RNA, 19 nt, Shigella flexneri 2a str. 2457T
uccacgcuauacagcagcc

SEQ ID NO: 3879806 - RNA, 18 nt, Shigella flexneri 2a str. 2457T
uccacgcugcaucgccaa

SEQ ID NO: 3879807 - RNA, 17 nt, Shigella flexneri 2a str. 2457T
uccacggaaucaccgcc

SEQ ID NO: 3879808 - RNA, 19 nt, Shigella flexneri 2a str. 2457T
uccacggggacuccacacc

SEQ ID NO: 3879809 - RNA, 16 nt, Shigella flexneri 2a str. 2457T
uccacggugaggcgau

SEQ ID NO: 3879810 - RNA, 18 nt, Shigella flexneri 2a str. 2457T
uccacgguucuccacucu

SEQ ID NO: 3879811 - RNA, 19 nt, Shigella flexneri 2a str. 2457T
uccacucauuaauuuccug

SEQ ID NO: 3879812 - RNA, 19 nt, Shigella flexneri 2a str. 2457T
uccacuccgguguuuucuc

SEQ ID NO: 3879813 - RNA, 15 nt, Shigella flexneri 2a str. 2457T
uccacugcgagaaaa

SEQ ID NO: 3879814 - RNA, 16 nt, Shigella flexneri 2a str. 2457T
uccacugucaaaucca

SEQ ID NO: 3879815 - RNA, 13 nt, Shigella flexneri 2a str. 2457T
uccacuucaucaa

SEQ ID NO: 3879816 - RNA, 21 nt, Shigella flexneri 2a str. 2457T
uccacuucaucaagcaaggcc

SEQ ID NO: 3879817 - RNA, 21 nt, Shigella flexneri 2a str. 2457T
uccacuuccaccacuuccugc

SEQ ID NO: 3879818 - RNA, 16 nt, Shigella flexneri 2a str. 2457T
uccacuuccaccagcg

SEQ ID NO: 3879819 - RNA, 19 nt, Shigella flexneri 2a str. 2457T
uccacuuccaccagcggcu

SEQ ID NO: 3879820 - RNA, 21 nt, Shigella flexneri 2a str. 2457T
uccacuuccgcgucaaucugc

SEQ ID NO: 3879821 - RNA, 21 nt, Shigella flexneri 2a str. 2457T
uccacuucugcacgguuuuuc

SEQ ID NO: 3879822 - RNA, 16 nt, Shigella flexneri 2a str. 2457T
uccacuuucgcggcuu

SEQ ID NO: 3879823 - RNA, 17 nt, Shigella flexneri 2a str. 2457T
uccagaauaucuucaac

SEQ ID NO: 3879824 - RNA, 14 nt, Shigella flexneri 2a str. 2457T
uccagacccuucau

SEQ ID NO: 3879825 - RNA, 16 nt, Shigella flexneri 2a str. 2457T
uccagauaaguuugcc

SEQ ID NO: 3879826 - RNA, 13 nt, Shigella flexneri 2a str. 2457T
uccauaccggacu

SEQ ID NO: 3879827 - RNA, 16 nt, Shigella flexneri 2a str. 2457T
uccauacgggcaugug

SEQ ID NO: 3879828 - RNA, 17 nt, Shigella flexneri 2a str. 2457T
uccauauggcugcauuc

SEQ ID NO: 3879829 - RNA, 19 nt, Shigella flexneri 2a str. 2457T
uccaucaaagguuuuucag

SEQ ID NO: 3879830 - RNA, 21 nt, Shigella flexneri 2a str. 2457T
uccaucaacauugguguguua

SEQ ID NO: 3879831 - RNA, 13 nt, Shigella flexneri 2a str. 2457T
uccaucacuucau

SEQ ID NO: 3879832 - RNA, 16 nt, Shigella flexneri 2a str. 2457T
uccaucagauucagca

SEQ ID NO: 3879833 - RNA, 13 nt, Shigella flexneri 2a str. 2457T
uccauccagcaac

SEQ ID NO: 3879834 - RNA, 20 nt, Shigella flexneri 2a str. 2457T
uccauccagcaacaacagcg

SEQ ID NO: 3879835 - RNA, 18 nt, Shigella flexneri 2a str. 2457T
uccauccauacgggcaug

SEQ ID NO: 3879836 - RNA, 18 nt, Shigella flexneri 2a str. 2457T
uccaucccgcucuguaag

SEQ ID NO: 3879837 - RNA, 17 nt, Shigella flexneri 2a str. 2457T
uccauccggcaacauca

SEQ ID NO: 3879838 - RNA, 19 nt, Shigella flexneri 2a str. 2457T
uccaugaguaacagucagu

SEQ ID NO: 3879839 - RNA, 19 nt, Shigella flexneri 2a str. 2457T
uccaugcacugcaacgccu

SEQ ID NO: 3879840 - RNA, 22 nt, Shigella flexneri 2a str. 2457T
uccauggacgaugagacccgcc

SEQ ID NO: 3879841 - RNA, 17 nt, Shigella flexneri 2a str. 2457T
uccauguugcuggaaga

SEQ ID NO: 3879842 - RNA, 20 nt, Shigella flexneri 2a str. 2457T
uccauucaaacgugaacagc

SEQ ID NO: 3879843 - RNA, 20 nt, Shigella flexneri 2a str. 2457T
uccauucaccauuuuuuaau

SEQ ID NO: 3879844 - RNA, 21 nt, Shigella flexneri 2a str. 2457T
uccauucaccauuuuuuaauu

SEQ ID NO: 3879845 - RNA, 20 nt, Shigella flexneri 2a str. 2457T
uccauucuggauaaucaaug

SEQ ID NO: 3879846 - RNA, 16 nt, Shigella flexneri 2a str. 2457T
uccauugcucuggcaa

SEQ ID NO: 3879847 - RNA, 15 nt, Shigella flexneri 2a str. 2457T
uccauuucauugagu

SEQ ID NO: 3879848 - RNA, 22 nt, Shigella flexneri 2a str. 2457T
ucccaaaagcucggucauugcc

SEQ ID NO: 3879849 - RNA, 21 nt, Shigella flexneri 2a str. 2457T
ucccaaauaugaaaucucuug

SEQ ID NO: 3879850 - RNA, 13 nt, Shigella flexneri 2a str. 2457T
ucccaacaacagc

SEQ ID NO: 3879851 - RNA, 17 nt, Shigella flexneri 2a str. 2457T
ucccaacaacagcgcgc

SEQ ID NO: 3879852 - RNA, 16 nt, Shigella flexneri 2a str. 2457T
ucccaccgggcaacug

SEQ ID NO: 3879853 - RNA, 16 nt, Shigella flexneri 2a str. 2457T
ucccaccugaaauggu

SEQ ID NO: 3879854 - RNA, 19 nt, Shigella flexneri 2a str. 2457T
ucccagaauguuaacgcca

SEQ ID NO: 3879855 - RNA, 17 nt, Shigella flexneri 2a str. 2457T
ucccagauagcaacagc

SEQ ID NO: 3879856 - RNA, 13 nt, Shigella flexneri 2a str. 2457T
ucccagcccagcg

SEQ ID NO: 3879857 - RNA, 16 nt, Shigella flexneri 2a str. 2457T
ucccagcccagcgcuu

SEQ ID NO: 3879858 - RNA, 13 nt, Shigella flexneri 2a str. 2457T
ucccagccgggua

SEQ ID NO: 3879859 - RNA, 20 nt, Shigella flexneri 2a str. 2457T
ucccagccggguaagaaaag

SEQ ID NO: 3879860 - RNA, 23 nt, Shigella flexneri 2a str. 2457T
ucccagccucccauuuccuguaa

SEQ ID NO: 3879861 - RNA, 14 nt, Shigella flexneri 2a str. 2457T
ucccagccuugcca

SEQ ID NO: 3879862 - RNA, 19 nt, Shigella flexneri 2a str. 2457T
ucccagcgcggugauaacc

SEQ ID NO: 3879863 - RNA, 19 nt, Shigella flexneri 2a str. 2457T
ucccagcguggagagcagc

SEQ ID NO: 3879864 - RNA, 15 nt, Shigella flexneri 2a str. 2457T
ucccaggccaaaucc

SEQ ID NO: 3879865 - RNA, 22 nt, Shigella flexneri 2a str. 2457T
ucccaggccgccugcaacgcuu

SEQ ID NO: 3879866 - RNA, 17 nt, Shigella flexneri 2a str. 2457T
ucccaguagugcuuuca

SEQ ID NO: 3879867 - RNA, 20 nt, Shigella flexneri 2a str. 2457T
ucccagucauccggcucgua

SEQ ID NO: 3879868 - RNA, 15 nt, Shigella flexneri 2a str. 2457T
ucccagucuucauca

SEQ ID NO: 3879869 - RNA, 15 nt, Shigella flexneri 2a str. 2457T
ucccagugccugcau

SEQ ID NO: 3879870 - RNA, 15 nt, Shigella flexneri 2a str. 2457T
ucccaucuuuuuaag

SEQ ID NO: 3879871 - RNA, 23 nt, Shigella flexneri 2a str. 2457T
ucccauuuauuuuuccuccauug

SEQ ID NO: 3879872 - RNA, 23 nt, Shigella flexneri 2a str. 2457T
uccccaaaaaaucaacgacaaaa

SEQ ID NO: 3879873 - RNA, 11 nt, Shigella flexneri 2a str. 2457T
uccccaauacg

SEQ ID NO: 3879874 - RNA, 16 nt, Shigella flexneri 2a str. 2457T
uccccacagaaacaau

SEQ ID NO: 3879875 - RNA, 22 nt, Shigella flexneri 2a str. 2457T
uccccagaauccaggaaagcca

SEQ ID NO: 3879876 - RNA, 13 nt, Shigella flexneri 2a str. 2457T
uccccagacaaaa

SEQ ID NO: 3879877 - RNA, 15 nt, Shigella flexneri 2a str. 2457T
uccccauaucccgga

SEQ ID NO: 3879878 - RNA, 22 nt, Shigella flexneri 2a str. 2457T
uccccauggacgcgucagucgc

SEQ ID NO: 3879879 - RNA, 12 nt, Shigella flexneri 2a str. 2457T
ucccccacagcu

SEQ ID NO: 3879880 - RNA, 14 nt, Shigella flexneri 2a str. 2457T
ucccccacagcucu

SEQ ID NO: 3879881 - RNA, 20 nt, Shigella flexneri 2a str. 2457T
ucccccacagcucugcuguc

SEQ ID NO: 3879882 - RNA, 17 nt, Shigella flexneri 2a str. 2457T
ucccccgcgagaagcgg

SEQ ID NO: 3879883 - RNA, 18 nt, Shigella flexneri 2a str. 2457T
ucccccuuucugagagga

SEQ ID NO: 3879884 - RNA, 15 nt, Shigella flexneri 2a str. 2457T
uccccgagaaauacu

SEQ ID NO: 3879885 - RNA, 16 nt, Shigella flexneri 2a str. 2457T
uccccgagcacaugca

SEQ ID NO: 3879886 - RNA, 16 nt, Shigella flexneri 2a str. 2457T
uccccgcuucgcccgc

SEQ ID NO: 3879887 - RNA, 16 nt, Shigella flexneri 2a str. 2457T
uccccgcuugggcaga

SEQ ID NO: 3879888 - RNA, 14 nt, Shigella flexneri 2a str. 2457T
uccccggaaucaga

SEQ ID NO: 3879889 - RNA, 16 nt, Shigella flexneri 2a str. 2457T
uccccggaaucagagg

SEQ ID NO: 3879890 - RNA, 17 nt, Shigella flexneri 2a str. 2457T
uccccggcagugcuuuc

SEQ ID NO: 3879891 - RNA, 15 nt, Shigella flexneri 2a str. 2457T
uccccuaacucuuuc

SEQ ID NO: 3879892 - RNA, 22 nt, Shigella flexneri 2a str. 2457T
uccccucaucagugaacccaua

SEQ ID NO: 3879893 - RNA, 14 nt, Shigella flexneri 2a str. 2457T
uccccuccagcgag

SEQ ID NO: 3879894 - RNA, 16 nt, Shigella flexneri 2a str. 2457T
uccccuccagcgagcu

SEQ ID NO: 3879895 - RNA, 21 nt, Shigella flexneri 2a str. 2457T
uccccugcccgcgauccagcg

SEQ ID NO: 3879896 - RNA, 14 nt, Shigella flexneri 2a str. 2457T
uccccugcgcggcg

SEQ ID NO: 3879897 - RNA, 16 nt, Shigella flexneri 2a str. 2457T
uccccuggggagugac

SEQ ID NO: 3879898 - RNA, 21 nt, Shigella flexneri 2a str. 2457T
uccccuucucaaucccuuucu

SEQ ID NO: 3879899 - RNA, 14 nt, Shigella flexneri 2a str. 2457T
ucccgaaaaaccug

SEQ ID NO: 3879900 - RNA, 20 nt, Shigella flexneri 2a str. 2457T
ucccgauggucagcuucacc

SEQ ID NO: 3879901 - RNA, 17 nt, Shigella flexneri 2a str. 2457T
ucccgcagauaaauauc

SEQ ID NO: 3879902 - RNA, 19 nt, Shigella flexneri 2a str. 2457T
ucccgcagccacgucaccu

SEQ ID NO: 3879903 - RNA, 22 nt, Shigella flexneri 2a str. 2457T
ucccgcagccacgucaccugcc

SEQ ID NO: 3879904 - RNA, 19 nt, Shigella flexneri 2a str. 2457T
ucccgcaggagcgccgaau

SEQ ID NO: 3879905 - RNA, 15 nt, Shigella flexneri 2a str. 2457T
ucccgccagcaccag

SEQ ID NO: 3879906 - RNA, 17 nt, Shigella flexneri 2a str. 2457T
ucccgccgcuggcggga

SEQ ID NO: 3879907 - RNA, 19 nt, Shigella flexneri 2a str. 2457T
ucccgcgauuuccugaccc

SEQ ID NO: 3879908 - RNA, 23 nt, Shigella flexneri 2a str. 2457T
ucccgcgccgcagccggaaaacc

SEQ ID NO: 3879909 - RNA, 14 nt, Shigella flexneri 2a str. 2457T
ucccgcucuguaag

SEQ ID NO: 3879910 - RNA, 12 nt, Shigella flexneri 2a str. 2457T
ucccgcuggugc

SEQ ID NO: 3879911 - RNA, 23 nt, Shigella flexneri 2a str. 2457T
ucccgcuguuuguucaagcgcaa

SEQ ID NO: 3879912 - RNA, 15 nt, Shigella flexneri 2a str. 2457T
ucccgcuuacaucaa

SEQ ID NO: 3879913 - RNA, 17 nt, Shigella flexneri 2a str. 2457T
ucccgcuucguuuucag

SEQ ID NO: 3879914 - RNA, 18 nt, Shigella flexneri 2a str. 2457T
ucccgcuucguuuucagc

SEQ ID NO: 3879915 - RNA, 19 nt, Shigella flexneri 2a str. 2457T
ucccgcuucguuuucagcu

SEQ ID NO: 3879916 - RNA, 14 nt, Shigella flexneri 2a str. 2457T
ucccggaagccacc

SEQ ID NO: 3879917 - RNA, 19 nt, Shigella flexneri 2a str. 2457T
ucccggauaaaucuccauu

SEQ ID NO: 3879918 - RNA, 20 nt, Shigella flexneri 2a str. 2457T
ucccggauaaaucuccauuu

SEQ ID NO: 3879919 - RNA, 16 nt, Shigella flexneri 2a str. 2457T
ucccggaugcaccauc

SEQ ID NO: 3879920 - RNA, 21 nt, Shigella flexneri 2a str. 2457T
ucccggcaagauuccagugcc

SEQ ID NO: 3879921 - RNA, 21 nt, Shigella flexneri 2a str. 2457T
ucccggcaaucaccgccagcg

SEQ ID NO: 3879922 - RNA, 14 nt, Shigella flexneri 2a str. 2457T
ucccggcagagaaa

SEQ ID NO: 3879923 - RNA, 17 nt, Shigella flexneri 2a str. 2457T
uccgcuuaucaggccua

SEQ ID NO: 3879924 - RNA, 13 nt, Shigella flexneri 2a str. 2457T
uccgcuucaaucu

SEQ ID NO: 3879925 - RNA, 18 nt, Shigella flexneri 2a str. 2457T
uccgcuucaccaccgcaa

SEQ ID NO: 3879926 - RNA, 13 nt, Shigella flexneri 2a str. 2457T
uccgcuucugcuu

SEQ ID NO: 3879927 - RNA, 23 nt, Shigella flexneri 2a str. 2457T
uccgcuuuguguaaguuuaaccu

SEQ ID NO: 3879928 - RNA, 15 nt, Shigella flexneri 2a str. 2457T
uccggacguucagcc

SEQ ID NO: 3879929 - RNA, 19 nt, Shigella flexneri 2a str. 2457T
uccggacuccgcaccgccg

SEQ ID NO: 3879930 - RNA, 13 nt, Shigella flexneri 2a str. 2457T
uccggaucgccaa

SEQ ID NO: 3879931 - RNA, 17 nt, Shigella flexneri 2a str. 2457T
uccggauucaaaccuaa

SEQ ID NO: 3879932 - RNA, 23 nt, Shigella flexneri 2a str. 2457T
uccggcaaaaacaacgagccaau

SEQ ID NO: 3879933 - RNA, 23 nt, Shigella flexneri 2a str. 2457T
uccggcaaucggugcaaaugcca

SEQ ID NO: 3879934 - RNA, 15 nt, Shigella flexneri 2a str. 2457T
uccggcaauggcugc

SEQ ID NO: 3879935 - RNA, 20 nt, Shigella flexneri 2a str. 2457T
uccggcaauugugaugguca

SEQ ID NO: 3879936 - RNA, 22 nt, Shigella flexneri 2a str. 2457T
uccggcaccaauguaggccuga

SEQ ID NO: 3879937 - RNA, 15 nt, Shigella flexneri 2a str. 2457T
uccggcaccuuuuca

SEQ ID NO: 3879938 - RNA, 21 nt, Shigella flexneri 2a str. 2457T
uccggcacuuacuuuccuuaa

SEQ ID NO: 3879939 - RNA, 22 nt, Shigella flexneri 2a str. 2457T
uccggcagaagcaaucauccca

SEQ ID NO: 3879940 - RNA, 18 nt, Shigella flexneri 2a str. 2457T
uccggcagcagaaagcga

SEQ ID NO: 3879941 - RNA, 13 nt, Shigella flexneri 2a str. 2457T
uccggcagcgaac

SEQ ID NO: 3879942 - RNA, 20 nt, Shigella flexneri 2a str. 2457T
uccggcaguaauaccagacc

SEQ ID NO: 3879943 - RNA, 20 nt, Shigella flexneri 2a str. 2457T
uccggcauaaacaaagcgca

SEQ ID NO: 3879944 - RNA, 14 nt, Shigella flexneri 2a str. 2457T
uccggcauccagcc

SEQ ID NO: 3879945 - RNA, 15 nt, Shigella flexneri 2a str. 2457T
uccggcauccagcgu

SEQ ID NO: 3879946 - RNA, 20 nt, Shigella flexneri 2a str. 2457T
uccggcaucguuugcugccu

SEQ ID NO: 3879947 - RNA, 15 nt, Shigella flexneri 2a str. 2457T
uccggcaugaacaaa

SEQ ID NO: 3879948 - RNA, 18 nt, Shigella flexneri 2a str. 2457T
uccggcaugaacaaagcg

SEQ ID NO: 3879949 - RNA, 22 nt, Shigella flexneri 2a str. 2457T
uccggcaugauaccgauuacuc

SEQ ID NO: 3879950 - RNA, 21 nt, Shigella flexneri 2a str. 2457T
uccggcauuaucacaucagcg

SEQ ID NO: 3879951 - RNA, 22 nt, Shigella flexneri 2a str. 2457T
uccggcauucagugcaaaugcc

SEQ ID NO: 3879952 - RNA, 21 nt, Shigella flexneri 2a str. 2457T
uccggcauuugagcaggaugc

SEQ ID NO: 3879953 - RNA, 20 nt, Shigella flexneri 2a str. 2457T
uccggcgaaaaucccggcaa

SEQ ID NO: 3879954 - RNA, 15 nt, Shigella flexneri 2a str. 2457T
uccggcgacacaucu

SEQ ID NO: 3879955 - RNA, 12 nt, Shigella flexneri 2a str. 2457T
uccggcgcaauu

SEQ ID NO: 3879956 - RNA, 21 nt, Shigella flexneri 2a str. 2457T
uccggcgcaauucccggaccg

SEQ ID NO: 3879957 - RNA, 21 nt, Shigella flexneri 2a str. 2457T
uccggcgggucgcugccgaua

SEQ ID NO: 3879958 - RNA, 14 nt, Shigella flexneri 2a str. 2457T
uccggcgucgaaaa

SEQ ID NO: 3879959 - RNA, 13 nt, Shigella flexneri 2a str. 2457T
uccggcgucgcuu

SEQ ID NO: 3879960 - RNA, 20 nt, Shigella flexneri 2a str. 2457T
uccggcguuuugauuuucac

SEQ ID NO: 3879961 - RNA, 20 nt, Shigella flexneri 2a str. 2457T
uccggcugaggcguuucaac

SEQ ID NO: 3879962 - RNA, 17 nt, Shigella flexneri 2a str. 2457T
uccggcugccagccagg

SEQ ID NO: 3879963 - RNA, 20 nt, Shigella flexneri 2a str. 2457T
uccggcugggcgugaaucug

SEQ ID NO: 3879964 - RNA, 23 nt, Shigella flexneri 2a str. 2457T
uccggcugggcgugaaucugccu

SEQ ID NO: 3879965 - RNA, 14 nt, Shigella flexneri 2a str. 2457T
uccggcuuccuuaa

SEQ ID NO: 3879966 - RNA, 17 nt, Shigella flexneri 2a str. 2457T
uccggcuuuggcaaacu

SEQ ID NO: 3879967 - RNA, 15 nt, Shigella flexneri 2a str. 2457T
uccggcuuuuuacuu

SEQ ID NO: 3879968 - RNA, 20 nt, Shigella flexneri 2a str. 2457T
uccgggaaaacgcuggcagc

SEQ ID NO: 3879969 - RNA, 20 nt, Shigella flexneri 2a str. 2457T
uccgggaaauccucaaccgg

SEQ ID NO: 3879970 - RNA, 23 nt, Shigella flexneri 2a str. 2457T
uccgggaacaacgcaagcggcau

SEQ ID NO: 3879971 - RNA, 17 nt, Shigella flexneri 2a str. 2457T
uccgggagcaauuugua

SEQ ID NO: 3879972 - RNA, 16 nt, Shigella flexneri 2a str. 2457T
uccgggaucaccagac

SEQ ID NO: 3879973 - RNA, 16 nt, Shigella flexneri 2a str. 2457T
uccgggauggucagcg

SEQ ID NO: 3879974 - RNA, 13 nt, Shigella flexneri 2a str. 2457T
uccgggcaagauc

SEQ ID NO: 3879975 - RNA, 19 nt, Shigella flexneri 2a str. 2457T
uccgggccgaacaucagau

SEQ ID NO: 3879976 - RNA, 22 nt, Shigella flexneri 2a str. 2457T
uccgggccgcaaaccagcgcau

SEQ ID NO: 3879977 - RNA, 16 nt, Shigella flexneri 2a str. 2457T
uccgggcuaaucguca

SEQ ID NO: 3879978 - RNA, 23 nt, Shigella flexneri 2a str. 2457T
uccgggcugguuuucagcgaaac

SEQ ID NO: 3879979 - RNA, 14 nt, Shigella flexneri 2a str. 2457T
uccggggaagcgca

SEQ ID NO: 3879980 - RNA, 16 nt, Shigella flexneri 2a str. 2457T
uccgggguucgaaucc

SEQ ID NO: 3879981 - RNA, 17 nt, Shigella flexneri 2a str. 2457T
uccgggucauccaggaa

SEQ ID NO: 3879982 - RNA, 14 nt, Shigella flexneri 2a str. 2457T
uccggguuuucaac

SEQ ID NO: 3879983 - RNA, 14 nt, Shigella flexneri 2a str. 2457T
uccgguacgugcgu

SEQ ID NO: 3879984 - RNA, 20 nt, Shigella flexneri 2a str. 2457T
uccggucuaccgauccggca

SEQ ID NO: 3879985 - RNA, 22 nt, Shigella flexneri 2a str. 2457T
uccgguguuuucucucucugca

SEQ ID NO: 3879986 - RNA, 22 nt, Shigella flexneri 2a str. 2457T
uccgguuguucaaccaccggca

SEQ ID NO: 3879987 - RNA, 23 nt, Shigella flexneri 2a str. 2457T
uccgguuuacuuccgggaaaacc

SEQ ID NO: 3879988 - RNA, 21 nt, Shigella flexneri 2a str. 2457T
uccgguuugcguugcacgcag

SEQ ID NO: 3879989 - RNA, 14 nt, Shigella flexneri 2a str. 2457T
uccguaauuuuuac

SEQ ID NO: 3879990 - RNA, 15 nt, Shigella flexneri 2a str. 2457T
uccguagugaaaaag

SEQ ID NO: 3879991 - RNA, 18 nt, Shigella flexneri 2a str. 2457T
uccguauaccgucaggau

SEQ ID NO: 3879992 - RNA, 19 nt, Shigella flexneri 2a str. 2457T
uccgucagcgaguugauca

SEQ ID NO: 3879993 - RNA, 14 nt, Shigella flexneri 2a str. 2457T
uccgucagcggcaa

SEQ ID NO: 3879994 - RNA, 16 nt, Shigella flexneri 2a str. 2457T
uccgucauccauacca

SEQ ID NO: 3879995 - RNA, 16 nt, Shigella flexneri 2a str. 2457T
uccgucgaaagcccau

SEQ ID NO: 3879996 - RNA, 20 nt, Shigella flexneri 2a str. 2457T
uccgucgaaagcccaucauc

SEQ ID NO: 3879997 - RNA, 18 nt, Shigella flexneri 2a str. 2457T
uccgugaagcucacuucg

SEQ ID NO: 3879998 - RNA, 21 nt, Shigella flexneri 2a str. 2457T
uccguuaaccgugggaaacag

SEQ ID NO: 3879999 - RNA, 17 nt, Shigella flexneri 2a str. 2457T
uccguuuucagugucca

SEQ ID NO: 3880000 - RNA, 14 nt, Shigella flexneri 2a str. 2457T
uccguuuuccagcc

SEQ ID NO: 3880001 - RNA, 15 nt, Shigella flexneri 2a str. 2457T
uccguuuuccagccu

SEQ ID NO: 3880002 - RNA, 13 nt, Shigella flexneri 2a str. 2457T
uccuaaaguuguu

SEQ ID NO: 3880003 - RNA, 15 nt, Shigella flexneri 2a str. 2457T
uccuaacaaccaucc

SEQ ID NO: 3880004 - RNA, 14 nt, Shigella flexneri 2a str. 2457T
uccuacacauacuu

SEQ ID NO: 3880005 - RNA, 19 nt, Shigella flexneri 2a str. 2457T
uccuaugcaacaacugaaa

SEQ ID NO: 3880006 - RNA, 13 nt, Shigella flexneri 2a str. 2457T
uccuauugcugcu

SEQ ID NO: 3880007 - RNA, 13 nt, Shigella flexneri 2a str. 2457T
uccucaagaauau

SEQ ID NO: 3880008 - RNA, 21 nt, Shigella flexneri 2a str. 2457T
uccucaagaauaugcuuugcc

SEQ ID NO: 3880009 - RNA, 22 nt, Shigella flexneri 2a str. 2457T
uccucaagaauaugcuuugccu

SEQ ID NO: 3880010 - RNA, 22 nt, Shigella flexneri 2a str. 2457T
uccucacuguuuucuaacucau

SEQ ID NO: 3880011 - RNA, 19 nt, Shigella flexneri 2a str. 2457T
uccucaguuucgacgccuu

SEQ ID NO: 3880012 - RNA, 23 nt, Shigella flexneri 2a str. 2457T
uccucaucgauauuaucuucauc

SEQ ID NO: 3880013 - RNA, 17 nt, Shigella flexneri 2a str. 2457T
uccuccguauccuguca

SEQ ID NO: 3880014 - RNA, 11 nt, Shigella flexneri 2a str. 2457T
uccucgccguu

SEQ ID NO: 3880015 - RNA, 18 nt, Shigella flexneri 2a str. 2457T
uccucgcgcagcuuacgc

SEQ ID NO: 3880016 - RNA, 15 nt, Shigella flexneri 2a str. 2457T
uccucuauauuucac

SEQ ID NO: 3880017 - RNA, 15 nt, Shigella flexneri 2a str. 2457T
uccucucaugagcag

SEQ ID NO: 3880018 - RNA, 16 nt, Shigella flexneri 2a str. 2457T
uccucugacuggacuc

SEQ ID NO: 3880019 - RNA, 18 nt, Shigella flexneri 2a str. 2457T
uccucuguaaacuccuuu

SEQ ID NO: 3880020 - RNA, 21 nt, Shigella flexneri 2a str. 2457T
ucgaaccuuggucgaagcuuc

SEQ ID NO: 3880021 - RNA, 15 nt, Shigella flexneri 2a str. 2457T
ucgaacgccaguuca

SEQ ID NO: 3880022 - RNA, 18 nt, Shigella flexneri 2a str. 2457T
ucgaacgguaacaggaag

SEQ ID NO: 3880023 - RNA, 18 nt, Shigella flexneri 2a str. 2457T
ucgaacucauacaccagc

SEQ ID NO: 3880024 - RNA, 19 nt, Shigella flexneri 2a str. 2457T
ucgaacucauacaccagcg

SEQ ID NO: 3880025 - RNA, 17 nt, Shigella flexneri 2a str. 2457T
ucgaagaacugcuggaa

SEQ ID NO: 3880026 - RNA, 16 nt, Shigella flexneri 2a str. 2457T
ucgaagagggcaacuu

SEQ ID NO: 3880027 - RNA, 21 nt, Shigella flexneri 2a str. 2457T
ucgaaggauaaugaaggauga

SEQ ID NO: 3880028 - RNA, 13 nt, Shigella flexneri 2a str. 2457T
ucgaaguuuuccu

SEQ ID NO: 3880029 - RNA, 14 nt, Shigella flexneri 2a str. 2457T
ucgaaguuuuccuc

SEQ ID NO: 3880030 - RNA, 14 nt, Shigella flexneri 2a str. 2457T
ucgaauccucccgg

SEQ ID NO: 3880031 - RNA, 16 nt, Shigella flexneri 2a str. 2457T
ucgaaugccgucgagg

SEQ ID NO: 3880032 - RNA, 21 nt, Shigella flexneri 2a str. 2457T
ucgaaugccgucgaggaacau

SEQ ID NO: 3880033 - RNA, 14 nt, Shigella flexneri 2a str. 2457T
ucgaauuacacagc

SEQ ID NO: 3880034 - RNA, 15 nt, Shigella flexneri 2a str. 2457T
ucgaauuacacagcc

SEQ ID NO: 3880035 - RNA, 19 nt, Shigella flexneri 2a str. 2457T
ucgaauuacacagccacag

SEQ ID NO: 3880036 - RNA, 18 nt, Shigella flexneri 2a str. 2457T
ucgacaaaaucggaaaca

SEQ ID NO: 3880037 - RNA, 23 nt, Shigella flexneri 2a str. 2457T
ucgacaaacaccgaaccagagau

SEQ ID NO: 3880038 - RNA, 15 nt, Shigella flexneri 2a str. 2457T
ucgacaagauacugc

SEQ ID NO: 3880039 - RNA, 15 nt, Shigella flexneri 2a str. 2457T
ucgacaccaaacaga

SEQ ID NO: 3880040 - RNA, 15 nt, Shigella flexneri 2a str. 2457T
ucgacagacgccagc

SEQ ID NO: 3880041 - RNA, 13 nt, Shigella flexneri 2a str. 2457T
ucgacagcaggau

SEQ ID NO: 3880042 - RNA, 20 nt, Shigella flexneri 2a str. 2457T
ucgacagcgauuccaguucg

SEQ ID NO: 3880043 - RNA, 19 nt, Shigella flexneri 2a str. 2457T
ucgacagcgccuuuucuuu

SEQ ID NO: 3880044 - RNA, 15 nt, Shigella flexneri 2a str. 2457T
ucgacaguuucaccu

SEQ ID NO: 3880045 - RNA, 14 nt, Shigella flexneri 2a str. 2457T
ucgacauauucacc

SEQ ID NO: 3880046 - RNA, 17 nt, Shigella flexneri 2a str. 2457T
ucgacauauucaccauu

SEQ ID NO: 3880047 - RNA, 15 nt, Shigella flexneri 2a str. 2457T
ucgacaucaagaaau

SEQ ID NO: 3880048 - RNA, 12 nt, Shigella flexneri 2a str. 2457T
ucgaccagccag

SEQ ID NO: 3880049 - RNA, 21 nt, Shigella flexneri 2a str. 2457T
ucgaccagccaggccgccagu

SEQ ID NO: 3880050 - RNA, 16 nt, Shigella flexneri 2a str. 2457T
ucgaccaggauuugau

SEQ ID NO: 3880051 - RNA, 18 nt, Shigella flexneri 2a str. 2457T
ucgaccaggccaucagca

SEQ ID NO: 3880052 - RNA, 18 nt, Shigella flexneri 2a str. 2457T
ucgaccggguuucuuauu

SEQ ID NO: 3880053 - RNA, 17 nt, Shigella flexneri 2a str. 2457T
ucgacgagaauuuccuu

SEQ ID NO: 3880054 - RNA, 16 nt, Shigella flexneri 2a str. 2457T
ucgacgauugcuuuua

SEQ ID NO: 3880055 - RNA, 19 nt, Shigella flexneri 2a str. 2457T
ucgacgcgccagcaccgca

SEQ ID NO: 3880056 - RNA, 12 nt, Shigella flexneri 2a str. 2457T
ucgacgcgcgca

SEQ ID NO: 3880057 - RNA, 19 nt, Shigella flexneri 2a str. 2457T
ucgacggaauaaacccaca

SEQ ID NO: 3880058 - RNA, 20 nt, Shigella flexneri 2a str. 2457T
ucgacggggugcgguaaaac

SEQ ID NO: 3880059 - RNA, 20 nt, Shigella flexneri 2a str. 2457T
ucgacuccuauuaucggcac

SEQ ID NO: 3880060 - RNA, 21 nt, Shigella flexneri 2a str. 2457T
ucgacuuuagucgcuugcagg

SEQ ID NO: 3880061 - RNA, 17 nt, Shigella flexneri 2a str. 2457T
ucgagaaugucgauaaa

SEQ ID NO: 3880062 - RNA, 20 nt, Shigella flexneri 2a str. 2457T
ucgagacgggcgaggaaauu

SEQ ID NO: 3880063 - RNA, 22 nt, Shigella flexneri 2a str. 2457T
ucgagagaauggggucagcagg

SEQ ID NO: 3880064 - RNA, 18 nt, Shigella flexneri 2a str. 2457T
ucgagauaccuaacauuu

SEQ ID NO: 3880065 - RNA, 13 nt, Shigella flexneri 2a str. 2457T
ucgagcagagaaa

SEQ ID NO: 3880066 - RNA, 20 nt, Shigella flexneri 2a str. 2457T
ucgagcagagaaacgccagc

SEQ ID NO: 3880067 - RNA, 15 nt, Shigella flexneri 2a str. 2457T
ucgagcauauuuagg

SEQ ID NO: 3880068 - RNA, 20 nt, Shigella flexneri 2a str. 2457T
ucgagcaucacaucaaaucc

SEQ ID NO: 3880069 - RNA, 13 nt, Shigella flexneri 2a str. 2457T
ucgagccuuuacg

SEQ ID NO: 3880070 - RNA, 16 nt, Shigella flexneri 2a str. 2457T
ucgagcgacagauuca

SEQ ID NO: 3880071 - RNA, 19 nt, Shigella flexneri 2a str. 2457T
ucgagcgguaaaccguuau

SEQ ID NO: 3880072 - RNA, 13 nt, Shigella flexneri 2a str. 2457T
ucgaggagcugga

SEQ ID NO: 3880073 - RNA, 22 nt, Shigella flexneri 2a str. 2457T
ucgaggccgcggcucaggcgca

SEQ ID NO: 3880074 - RNA, 18 nt, Shigella flexneri 2a str. 2457T
ucgagguacgcuccagca

SEQ ID NO: 3880075 - RNA, 19 nt, Shigella flexneri 2a str. 2457T
ucgagucauauucugaaau

SEQ ID NO: 3880076 - RNA, 17 nt, Shigella flexneri 2a str. 2457T
ucgaguccuuccagguc

SEQ ID NO: 3880077 - RNA, 16 nt, Shigella flexneri 2a str. 2457T
ucgagugaauaauuga

SEQ ID NO: 3880078 - RNA, 14 nt, Shigella flexneri 2a str. 2457T
ucgauaaaccagca

SEQ ID NO: 3880079 - RNA, 22 nt, Shigella flexneri 2a str. 2457T
ucgauaaauggcgcauccagcc

SEQ ID NO: 3880080 - RNA, 13 nt, Shigella flexneri 2a str. 2457T
ucgauaaccaucc

SEQ ID NO: 3880081 - RNA, 14 nt, Shigella flexneri 2a str. 2457T
ucgauaaucaucag

SEQ ID NO: 3880082 - RNA, 20 nt, Shigella flexneri 2a str. 2457T
ucgauaucgcugucgccauc

SEQ ID NO: 3880083 - RNA, 23 nt, Shigella flexneri 2a str. 2457T
ucgaucaaacaauuuucauugaa

SEQ ID NO: 3880084 - RNA, 21 nt, Shigella flexneri 2a str. 2457T
ucgaucacuucgcgcaaccag

SEQ ID NO: 3880085 - RNA, 16 nt, Shigella flexneri 2a str. 2457T
ucgaucacuuucugcg

SEQ ID NO: 3880086 - RNA, 19 nt, Shigella flexneri 2a str. 2457T
ucgaucagugaaggcgccu

SEQ ID NO: 3880087 - RNA, 20 nt, Shigella flexneri 2a str. 2457T
ucgaucagugaaggcgccuc

SEQ ID NO: 3880088 - RNA, 19 nt, Shigella flexneri 2a str. 2457T
ucgauccagugauuccagu

SEQ ID NO: 3880089 - RNA, 18 nt, Shigella flexneri 2a str. 2457T
ucgaucucuucgccugcc

SEQ ID NO: 3880090 - RNA, 13 nt, Shigella flexneri 2a str. 2457T
ucgaucuguuuua

SEQ ID NO: 3880091 - RNA, 14 nt, Shigella flexneri 2a str. 2457T
ucgaugaaagcgcc

SEQ ID NO: 3880092 - RNA, 15 nt, Shigella flexneri 2a str. 2457T
ucgaugaucaaccgc

SEQ ID NO: 3880093 - RNA, 20 nt, Shigella flexneri 2a str. 2457T
ucgaugccugaugacaugca

SEQ ID NO: 3880094 - RNA, 19 nt, Shigella flexneri 2a str. 2457T
ucgaugccuugugggccug

SEQ ID NO: 3880095 - RNA, 16 nt, Shigella flexneri 2a str. 2457T
ucgaugcgcaauuaaa

SEQ ID NO: 3880096 - RNA, 18 nt, Shigella flexneri 2a str. 2457T
ucgauuuugcaauaaugg

SEQ ID NO: 3880097 - RNA, 22 nt, Shigella flexneri 2a str. 2457T
ucgcaaaccacgguuucagugg

SEQ ID NO: 3880098 - RNA, 19 nt, Shigella flexneri 2a str. 2457T
ucgcaaauaugugaucgaa

SEQ ID NO: 3880099 - RNA, 18 nt, Shigella flexneri 2a str. 2457T
ucgcaaauauuucacccg

SEQ ID NO: 3880100 - RNA, 22 nt, Shigella flexneri 2a str. 2457T
ucgcaaauccauucaucgccuu

SEQ ID NO: 3880101 - RNA, 20 nt, Shigella flexneri 2a str. 2457T
ucgcaauacccugacccaga

SEQ ID NO: 3880102 - RNA, 21 nt, Shigella flexneri 2a str. 2457T
ucgcaauccgccgauguugca

SEQ ID NO: 3880103 - RNA, 20 nt, Shigella flexneri 2a str. 2457T
ucgcaaucggguuaccggaa

SEQ ID NO: 3880104 - RNA, 10 nt, Shigella flexneri 2a str. 2457T
ucgcaauuac

SEQ ID NO: 3880105 - RNA, 16 nt, Shigella flexneri 2a str. 2457T
ucgcacaaaaucauga

SEQ ID NO: 3880106 - RNA, 17 nt, Shigella flexneri 2a str. 2457T
ucgcacaaaaucaugag

SEQ ID NO: 3880107 - RNA, 15 nt, Shigella flexneri 2a str. 2457T
ucgcaccaaacgggc

SEQ ID NO: 3880108 - RNA, 14 nt, Shigella flexneri 2a str. 2457T
ucgcacccgccauc

SEQ ID NO: 3880109 - RNA, 16 nt, Shigella flexneri 2a str. 2457T
ucgcacgccuggcagu

SEQ ID NO: 3880110 - RNA, 12 nt, Shigella flexneri 2a str. 2457T
ucgcacuaucga

SEQ ID NO: 3880111 - RNA, 16 nt, Shigella flexneri 2a str. 2457T
ucgcacuuaccuucac

SEQ ID NO: 3880112 - RNA, 13 nt, Shigella flexneri 2a str. 2457T
ucgcagaagccac

SEQ ID NO: 3880113 - RNA, 17 nt, Shigella flexneri 2a str. 2457T
ucgcagaagccacgcgu

SEQ ID NO: 3880114 - RNA, 13 nt, Shigella flexneri 2a str. 2457T
ucgcagaugaauu

SEQ ID NO: 3880115 - RNA, 22 nt, Shigella flexneri 2a str. 2457T
ucgcagaugaauuuaucuuuaa

SEQ ID NO: 3880116 - RNA, 17 nt, Shigella flexneri 2a str. 2457T
ucgcagcaaacgaaagc

SEQ ID NO: 3880117 - RNA, 14 nt, Shigella flexneri 2a str. 2457T
ucgcagcugccugc

SEQ ID NO: 3880118 - RNA, 19 nt, Shigella flexneri 2a str. 2457T
ucgcgauuaugccgccgac

SEQ ID NO: 3880119 - RNA, 15 nt, Shigella flexneri 2a str. 2457T
ucgcgcaaccagucc

SEQ ID NO: 3880120 - RNA, 24 nt, Shigella flexneri 2a str. 2457T
ucgcgcacgaggaacagcgcgcug

SEQ ID NO: 3880121 - RNA, 14 nt, Shigella flexneri 2a str. 2457T
ucgcgcacggugca

SEQ ID NO: 3880122 - RNA, 12 nt, Shigella flexneri 2a str. 2457T
ucgcgcacugcg

SEQ ID NO: 3880123 - RNA, 19 nt, Shigella flexneri 2a str. 2457T
ucgcgcagauagagcgccu

SEQ ID NO: 3880124 - RNA, 16 nt, Shigella flexneri 2a str. 2457T
ucgcgcagcacuugca

SEQ ID NO: 3880125 - RNA, 16 nt, Shigella flexneri 2a str. 2457T
ucgcgcaucagcaguu

SEQ ID NO: 3880126 - RNA, 20 nt, Shigella flexneri 2a str. 2457T
ucgcgccaaucagcgcagca

SEQ ID NO: 3880127 - RNA, 18 nt, Shigella flexneri 2a str. 2457T
ucgcgccagaaagcagca

SEQ ID NO: 3880128 - RNA, 12 nt, Shigella flexneri 2a str. 2457T
ucgcgccagcca

SEQ ID NO: 3880129 - RNA, 14 nt, Shigella flexneri 2a str. 2457T
ucgcgccagccagu

SEQ ID NO: 3880130 - RNA, 15 nt, Shigella flexneri 2a str. 2457T
ucgcgccaggcgcug

SEQ ID NO: 3880131 - RNA, 18 nt, Shigella flexneri 2a str. 2457T
ucgcgcccuccugcagcg

SEQ ID NO: 3880132 - RNA, 12 nt, Shigella flexneri 2a str. 2457T
ucgcgccgcauc

SEQ ID NO: 3880133 - RNA, 12 nt, Shigella flexneri 2a str. 2457T
ucgcgcgcugcc

SEQ ID NO: 3880134 - RNA, 19 nt, Shigella flexneri 2a str. 2457T
ucgcgcgggaaaucaaguu

SEQ ID NO: 3880135 - RNA, 15 nt, Shigella flexneri 2a str. 2457T
ucgcgcuaauuccag

SEQ ID NO: 3880136 - RNA, 18 nt, Shigella flexneri 2a str. 2457T
ucgcgcuaauuccagucg

SEQ ID NO: 3880137 - RNA, 17 nt, Shigella flexneri 2a str. 2457T
ucgcgcuuaucgccagc

SEQ ID NO: 3880138 - RNA, 17 nt, Shigella flexneri 2a str. 2457T
ucgcggcagcagagaaa

SEQ ID NO: 3880139 - RNA, 22 nt, Shigella flexneri 2a str. 2457T
ucgcggcgauauccagcgcggc

SEQ ID NO: 3880140 - RNA, 16 nt, Shigella flexneri 2a str. 2457T
ucgcgguuagcggcuu

SEQ ID NO: 3880141 - RNA, 16 nt, Shigella flexneri 2a str. 2457T
ucgcguaaauccagcg

SEQ ID NO: 3880142 - RNA, 16 nt, Shigella flexneri 2a str. 2457T
ucgcguaacugcugcu

SEQ ID NO: 3880143 - RNA, 14 nt, Shigella flexneri 2a str. 2457T
ucgcguaaggcuuc

SEQ ID NO: 3880144 - RNA, 16 nt, Shigella flexneri 2a str. 2457T
ucgcguacucaccgcu

SEQ ID NO: 3880145 - RNA, 14 nt, Shigella flexneri 2a str. 2457T
ucgcguucggaaau

SEQ ID NO: 3880146 - RNA, 17 nt, Shigella flexneri 2a str. 2457T
ucgcguugucauacgag

SEQ ID NO: 3880147 - RNA, 20 nt, Shigella flexneri 2a str. 2457T
ucgcuacaccaaucgucaau

SEQ ID NO: 3880148 - RNA, 20 nt, Shigella flexneri 2a str. 2457T
ucgcuacuauggaacgcuca

SEQ ID NO: 3880149 - RNA, 16 nt, Shigella flexneri 2a str. 2457T
ucgcuaucagcgccac

SEQ ID NO: 3880150 - RNA, 19 nt, Shigella flexneri 2a str. 2457T
ucgcucaauauccugaccu

SEQ ID NO: 3880151 - RNA, 23 nt, Shigella flexneri 2a str. 2457T
ucgcucacccagggaaaggauug

SEQ ID NO: 3880152 - RNA, 16 nt, Shigella flexneri 2a str. 2457T
ucgcucaucugcugcg

SEQ ID NO: 3880153 - RNA, 20 nt, Shigella flexneri 2a str. 2457T
ucgcuccauuccaucgccug

SEQ ID NO: 3880154 - RNA, 22 nt, Shigella flexneri 2a str. 2457T
ucgcucgagagagaaaauaauc

SEQ ID NO: 3880155 - RNA, 17 nt, Shigella flexneri 2a str. 2457T
ucgcucucuuucucgcu

SEQ ID NO: 3880156 - RNA, 15 nt, Shigella flexneri 2a str. 2457T
ucgcugaaaggcgau

SEQ ID NO: 3880157 - RNA, 21 nt, Shigella flexneri 2a str. 2457T
ucgcugaacgggccauccauc

SEQ ID NO: 3880158 - RNA, 22 nt, Shigella flexneri 2a str. 2457T
ucgcugaacgggccauccauca

SEQ ID NO: 3880159 - RNA, 21 nt, Shigella flexneri 2a str. 2457T
ucgcugaauaccgauucccag

SEQ ID NO: 3880160 - RNA, 15 nt, Shigella flexneri 2a str. 2457T
ucgcugaauaucuuu

SEQ ID NO: 3880161 - RNA, 20 nt, Shigella flexneri 2a str. 2457T
ucgcugacugauauugcccg

SEQ ID NO: 3880162 - RNA, 19 nt, Shigella flexneri 2a str. 2457T
ucgcugauuucaccaucuu

SEQ ID NO: 3880163 - RNA, 17 nt, Shigella flexneri 2a str. 2457T
ucgcugcagcucugcgc

SEQ ID NO: 3880164 - RNA, 11 nt, Shigella flexneri 2a str. 2457T
ucgcugccaca

SEQ ID NO: 3880165 - RNA, 16 nt, Shigella flexneri 2a str. 2457T
ucgcugcgcggcagcu

SEQ ID NO: 3880166 - RNA, 22 nt, Shigella flexneri 2a str. 2457T
ucgcugcuaauuuaucggcguu

SEQ ID NO: 3880167 - RNA, 15 nt, Shigella flexneri 2a str. 2457T
ucgcugcugguucug

SEQ ID NO: 3880168 - RNA, 13 nt, Shigella flexneri 2a str. 2457T
ucgcuggcaggcc

SEQ ID NO: 3880169 - RNA, 13 nt, Shigella flexneri 2a str. 2457T
ucgcuggucagcg

SEQ ID NO: 3880170 - RNA, 22 nt, Shigella flexneri 2a str. 2457T
ucgcuggugccaagcuccagca

SEQ ID NO: 3880171 - RNA, 16 nt, Shigella flexneri 2a str. 2457T
ucgcugucgccauccc

SEQ ID NO: 3880172 - RNA, 15 nt, Shigella flexneri 2a str. 2457T
ucgcugugcugcuga

SEQ ID NO: 3880173 - RNA, 20 nt, Shigella flexneri 2a str. 2457T
ucgcuguuuuuacucggucu

SEQ ID NO: 3880174 - RNA, 13 nt, Shigella flexneri 2a str. 2457T
ucgcuuaagccau

SEQ ID NO: 3880175 - RNA, 22 nt, Shigella flexneri 2a str. 2457T
ucgcuuaagccaucaucaauau

SEQ ID NO: 3880176 - RNA, 20 nt, Shigella flexneri 2a str. 2457T
ucgcuuaauggaaaacuguu

SEQ ID NO: 3880177 - RNA, 11 nt, Shigella flexneri 2a str. 2457T
ucgcuucaacc

SEQ ID NO: 3880178 - RNA, 12 nt, Shigella flexneri 2a str. 2457T
ucgcuucagccg

SEQ ID NO: 3880179 - RNA, 16 nt, Shigella flexneri 2a str. 2457T
ucgcuucaugcccgcc

SEQ ID NO: 3880180 - RNA, 18 nt, Shigella flexneri 2a str. 2457T
ucgcuuccauugagaaag

SEQ ID NO: 3880181 - RNA, 19 nt, Shigella flexneri 2a str. 2457T
ucgcuuccauugagaaagc

SEQ ID NO: 3880182 - RNA, 14 nt, Shigella flexneri 2a str. 2457T
ucgcuucuagugcu

SEQ ID NO: 3880183 - RNA, 13 nt, Shigella flexneri 2a str. 2457T
ucgcuuuccaggu

SEQ ID NO: 3880184 - RNA, 18 nt, Shigella flexneri 2a str. 2457T
ucgcuuucgcuuucucuu

SEQ ID NO: 3880185 - RNA, 20 nt, Shigella flexneri 2a str. 2457T
ucgcuuuuucugcaucaacc

SEQ ID NO: 3880186 - RNA, 14 nt, Shigella flexneri 2a str. 2457T
ucggaaaauuauuu

SEQ ID NO: 3880187 - RNA, 11 nt, Shigella flexneri 2a str. 2457T
ucggaaacggc

SEQ ID NO: 3880188 - RNA, 17 nt, Shigella flexneri 2a str. 2457T
ucggaaauaaucaccug

SEQ ID NO: 3880189 - RNA, 19 nt, Shigella flexneri 2a str. 2457T
ucggaagcagcguaacggc

SEQ ID NO: 3880190 - RNA, 20 nt, Shigella flexneri 2a str. 2457T
ucggaaugcaccgccugaua

SEQ ID NO: 3880191 - RNA, 17 nt, Shigella flexneri 2a str. 2457T
ucggacgauauuuuucc

SEQ ID NO: 3880192 - RNA, 21 nt, Shigella flexneri 2a str. 2457T
ucggagaacugcaacucaccu

SEQ ID NO: 3880193 - RNA, 14 nt, Shigella flexneri 2a str. 2457T
ucggaguaacaggu

SEQ ID NO: 3880194 - RNA, 21 nt, Shigella flexneri 2a str. 2457T
ucggauaagacgcgccagcgu

SEQ ID NO: 3880195 - RNA, 22 nt, Shigella flexneri 2a str. 2457T
ucggauaaggcgcucgcgccgc

SEQ ID NO: 3880196 - RNA, 17 nt, Shigella flexneri 2a str. 2457T
ucggaucgcgugcggca

SEQ ID NO: 3880197 - RNA, 14 nt, Shigella flexneri 2a str. 2457T
ucggauguuagucu

SEQ ID NO: 3880198 - RNA, 16 nt, Shigella flexneri 2a str. 2457T
ucggcaaaaucuucca

SEQ ID NO: 3880199 - RNA, 22 nt, Shigella flexneri 2a str. 2457T
ucggcaacuuuggguugccgcc

SEQ ID NO: 3880200 - RNA, 18 nt, Shigella flexneri 2a str. 2457T
ucggcaagauaaaucgca

SEQ ID NO: 3880201 - RNA, 17 nt, Shigella flexneri 2a str. 2457T
ucggcaauuucgcugcc

SEQ ID NO: 3880202 - RNA, 16 nt, Shigella flexneri 2a str. 2457T
ucggcacacacaucac

SEQ ID NO: 3880203 - RNA, 20 nt, Shigella flexneri 2a str. 2457T
ucggcaccauuuaaaucaau

SEQ ID NO: 3880204 - RNA, 16 nt, Shigella flexneri 2a str. 2457T
ucggcacugaccacuu

SEQ ID NO: 3880205 - RNA, 20 nt, Shigella flexneri 2a str. 2457T
ucggcagcggcgaucgugag

SEQ ID NO: 3880206 - RNA, 22 nt, Shigella flexneri 2a str. 2457T
ucggcaguaucagagauaacca

SEQ ID NO: 3880207 - RNA, 14 nt, Shigella flexneri 2a str. 2457T
ucggcagucugcug

SEQ ID NO: 3880208 - RNA, 17 nt, Shigella flexneri 2a str. 2457T
ucggcagugaaaacgca

SEQ ID NO: 3880209 - RNA, 13 nt, Shigella flexneri 2a str. 2457T
ucggcauaaucau

SEQ ID NO: 3880210 - RNA, 13 nt, Shigella flexneri 2a str. 2457T
ucggcauacagcg

SEQ ID NO: 3880211 - RNA, 22 nt, Shigella flexneri 2a str. 2457T
ucggcaucaaaccauucccugc

SEQ ID NO: 3880212 - RNA, 14 nt, Shigella flexneri 2a str. 2457T
ucggcaucgcucca

SEQ ID NO: 3880213 - RNA, 16 nt, Shigella flexneri 2a str. 2457T
ucggcauggggucagg

SEQ ID NO: 3880214 - RNA, 18 nt, Shigella flexneri 2a str. 2457T
ucggccaguaaccuuuca

SEQ ID NO: 3880215 - RNA, 20 nt, Shigella flexneri 2a str. 2457T
ucggccaugauaaacgguac

SEQ ID NO: 3880216 - RNA, 20 nt, Shigella flexneri 2a str. 2457T
ucgugcgucgcauccggcaa

SEQ ID NO: 3880217 - RNA, 15 nt, Shigella flexneri 2a str. 2457T
ucgugcguuuguagg

SEQ ID NO: 3880218 - RNA, 17 nt, Shigella flexneri 2a str. 2457T
ucgugcuaacguuuagu

SEQ ID NO: 3880219 - RNA, 17 nt, Shigella flexneri 2a str. 2457T
ucgugcucgacagcgcu

SEQ ID NO: 3880220 - RNA, 12 nt, Shigella flexneri 2a str. 2457T
ucgugcucgcuu

SEQ ID NO: 3880221 - RNA, 20 nt, Shigella flexneri 2a str. 2457T
ucgugcuggauuugugucag

SEQ ID NO: 3880222 - RNA, 16 nt, Shigella flexneri 2a str. 2457T
ucgugguaagaaggcc

SEQ ID NO: 3880223 - RNA, 18 nt, Shigella flexneri 2a str. 2457T
ucguguggaguaauaauu

SEQ ID NO: 3880224 - RNA, 22 nt, Shigella flexneri 2a str. 2457T
ucguguggaguaauaauuucug

SEQ ID NO: 3880225 - RNA, 11 nt, Shigella flexneri 2a str. 2457T
ucguguuaaca

SEQ ID NO: 3880226 - RNA, 21 nt, Shigella flexneri 2a str. 2457T
ucguguugaugcuccuggcga

SEQ ID NO: 3880227 - RNA, 15 nt, Shigella flexneri 2a str. 2457T
ucguuaaauucuaau

SEQ ID NO: 3880228 - RNA, 18 nt, Shigella flexneri 2a str. 2457T
ucguuaagcgauucagca

SEQ ID NO: 3880229 - RNA, 12 nt, Shigella flexneri 2a str. 2457T
ucguuauauaga

SEQ ID NO: 3880230 - RNA, 21 nt, Shigella flexneri 2a str. 2457T
ucguuauauagaacaagugcc

SEQ ID NO: 3880231 - RNA, 19 nt, Shigella flexneri 2a str. 2457T
ucguuauccgaugguacgc

SEQ ID NO: 3880232 - RNA, 12 nt, Shigella flexneri 2a str. 2457T
ucguucagaucu

SEQ ID NO: 3880233 - RNA, 17 nt, Shigella flexneri 2a str. 2457T
ucguucagcggcccguu

SEQ ID NO: 3880234 - RNA, 22 nt, Shigella flexneri 2a str. 2457T
ucguucauaccacgccaucaac

SEQ ID NO: 3880235 - RNA, 18 nt, Shigella flexneri 2a str. 2457T
ucguucgcaccaaaucca

SEQ ID NO: 3880236 - RNA, 12 nt, Shigella flexneri 2a str. 2457T
ucguucgccguu

SEQ ID NO: 3880237 - RNA, 14 nt, Shigella flexneri 2a str. 2457T
ucguugaagucagg

SEQ ID NO: 3880238 - RNA, 19 nt, Shigella flexneri 2a str. 2457T
ucguugauaauaaagcuac

SEQ ID NO: 3880239 - RNA, 16 nt, Shigella flexneri 2a str. 2457T
ucguugccaccaaagu

SEQ ID NO: 3880240 - RNA, 17 nt, Shigella flexneri 2a str. 2457T
ucguugccgaagcggcg

SEQ ID NO: 3880241 - RNA, 23 nt, Shigella flexneri 2a str. 2457T
ucguugccugcgaagcucuuucg

SEQ ID NO: 3880242 - RNA, 14 nt, Shigella flexneri 2a str. 2457T
ucguuggauauuuu

SEQ ID NO: 3880243 - RNA, 23 nt, Shigella flexneri 2a str. 2457T
ucguuggucgcgcacugcgggau

SEQ ID NO: 3880244 - RNA, 15 nt, Shigella flexneri 2a str. 2457T
ucguuguaacugucu

SEQ ID NO: 3880245 - RNA, 18 nt, Shigella flexneri 2a str. 2457T
ucguuguuuaugccggau

SEQ ID NO: 3880246 - RNA, 17 nt, Shigella flexneri 2a str. 2457T
ucguuugcauccagcuc

SEQ ID NO: 3880247 - RNA, 14 nt, Shigella flexneri 2a str. 2457T
ucguuugcugccuu

SEQ ID NO: 3880248 - RNA, 18 nt, Shigella flexneri 2a str. 2457T
ucguuuggggcauauuau

SEQ ID NO: 3880249 - RNA, 22 nt, Shigella flexneri 2a str. 2457T
ucguuuuaaugcgauccugagc

SEQ ID NO: 3880250 - RNA, 14 nt, Shigella flexneri 2a str. 2457T
ucguuuuuuauucc

SEQ ID NO: 3880251 - RNA, 13 nt, Shigella flexneri 2a str. 2457T
ucuaaauuuugca

SEQ ID NO: 3880252 - RNA, 21 nt, Shigella flexneri 2a str. 2457T
ucuaacaaccuugccauucca

SEQ ID NO: 3880253 - RNA, 15 nt, Shigella flexneri 2a str. 2457T
ucuaacagaucaucc

SEQ ID NO: 3880254 - RNA, 16 nt, Shigella flexneri 2a str. 2457T
ucuaaccauuauuaaa

SEQ ID NO: 3880255 - RNA, 20 nt, Shigella flexneri 2a str. 2457T
ucuaagcugccuguacggca

SEQ ID NO: 3880256 - RNA, 21 nt, Shigella flexneri 2a str. 2457T
ucuaaucgcacaaaaucauga

SEQ ID NO: 3880257 - RNA, 20 nt, Shigella flexneri 2a str. 2457T
ucuaaugcguagaccggaaa

SEQ ID NO: 3880258 - RNA, 22 nt, Shigella flexneri 2a str. 2457T
ucuaauggugaacugacagcca

SEQ ID NO: 3880259 - RNA, 21 nt, Shigella flexneri 2a str. 2457T
ucuacaaccagcuuaugccug

SEQ ID NO: 3880260 - RNA, 12 nt, Shigella flexneri 2a str. 2457T
ucuacaccaacg

SEQ ID NO: 3880261 - RNA, 17 nt, Shigella flexneri 2a str. 2457T
ucuacacgcuaccaaaa

SEQ ID NO: 3880262 - RNA, 22 nt, Shigella flexneri 2a str. 2457T
ucuacacgcuaccaaaaaauca

SEQ ID NO: 3880263 - RNA, 14 nt, Shigella flexneri 2a str. 2457T
ucuacagaaaugaa

SEQ ID NO: 3880264 - RNA, 19 nt, Shigella flexneri 2a str. 2457T
ucuacagaaaugaaaaaau

SEQ ID NO: 3880265 - RNA, 17 nt, Shigella flexneri 2a str. 2457T
ucuacagcauuuccuua

SEQ ID NO: 3880266 - RNA, 11 nt, Shigella flexneri 2a str. 2457T
ucuacaguacg

SEQ ID NO: 3880267 - RNA, 14 nt, Shigella flexneri 2a str. 2457T
ucuacauucauaga

SEQ ID NO: 3880268 - RNA, 13 nt, Shigella flexneri 2a str. 2457T
ucuaccagcaccu

SEQ ID NO: 3880269 - RNA, 16 nt, Shigella flexneri 2a str. 2457T
ucuaccagcaccugcu

SEQ ID NO: 3880270 - RNA, 15 nt, Shigella flexneri 2a str. 2457T
ucuaccaucaauggc

SEQ ID NO: 3880271 - RNA, 22 nt, Shigella flexneri 2a str. 2457T
ucuaccaugaugauaucacugg

SEQ ID NO: 3880272 - RNA, 23 nt, Shigella flexneri 2a str. 2457T
ucuaccccagugguuucgccagc

SEQ ID NO: 3880273 - RNA, 14 nt, Shigella flexneri 2a str. 2457T
ucuaccgcaccuuc

SEQ ID NO: 3880274 - RNA, 19 nt, Shigella flexneri 2a str. 2457T
ucuaccgucuguaaccaga

SEQ ID NO: 3880275 - RNA, 22 nt, Shigella flexneri 2a str. 2457T
ucuaccuuaacgguaucuuucc

SEQ ID NO: 3880276 - RNA, 17 nt, Shigella flexneri 2a str. 2457T
ucuacucguuuauuaug

SEQ ID NO: 3880277 - RNA, 21 nt, Shigella flexneri 2a str. 2457T
ucuauaccgugcacaauauuu

SEQ ID NO: 3880278 - RNA, 22 nt, Shigella flexneri 2a str. 2457T
ucuauaccgugcacaauauuuu

SEQ ID NO: 3880279 - RNA, 18 nt, Shigella flexneri 2a str. 2457T
ucuauacuuaucuuuuug

SEQ ID NO: 3880280 - RNA, 16 nt, Shigella flexneri 2a str. 2457T
ucuaucaacaguuugu

SEQ ID NO: 3880281 - RNA, 21 nt, Shigella flexneri 2a str. 2457T
ucuaucaaggcgauguuccuu

SEQ ID NO: 3880282 - RNA, 18 nt, Shigella flexneri 2a str. 2457T
ucuaucaggacgaaaaau

SEQ ID NO: 3880283 - RNA, 13 nt, Shigella flexneri 2a str. 2457T
ucuaucuuucaga

SEQ ID NO: 3880284 - RNA, 16 nt, Shigella flexneri 2a str. 2457T
ucuaugagaaaauuuc

SEQ ID NO: 3880285 - RNA, 20 nt, Shigella flexneri 2a str. 2457T
ucuaugagaaaauuucauua

SEQ ID NO: 3880286 - RNA, 23 nt, Shigella flexneri 2a str. 2457T
ucuaugccagcuuucaccugcgc

SEQ ID NO: 3880287 - RNA, 17 nt, Shigella flexneri 2a str. 2457T
ucuaugguuuugaagaa

SEQ ID NO: 3880288 - RNA, 20 nt, Shigella flexneri 2a str. 2457T
ucuaugguuuugaagaagac

SEQ ID NO: 3880289 - RNA, 17 nt, Shigella flexneri 2a str. 2457T
ucuaugguuuuuucuac

SEQ ID NO: 3880290 - RNA, 18 nt, Shigella flexneri 2a str. 2457T
ucuaugucgcauccggca

SEQ ID NO: 3880291 - RNA, 21 nt, Shigella flexneri 2a str. 2457T
ucuauucaccgcaucaauauu

SEQ ID NO: 3880292 - RNA, 20 nt, Shigella flexneri 2a str. 2457T
ucuauuccgcgugaaaugcc

SEQ ID NO: 3880293 - RNA, 17 nt, Shigella flexneri 2a str. 2457T
ucuauugcaacauguug

SEQ ID NO: 3880294 - RNA, 12 nt, Shigella flexneri 2a str. 2457T
ucucaacacacg

SEQ ID NO: 3880295 - RNA, 13 nt, Shigella flexneri 2a str. 2457T
ucucaauaaaagg

SEQ ID NO: 3880296 - RNA, 15 nt, Shigella flexneri 2a str. 2457T
ucucaauaucaucau

SEQ ID NO: 3880297 - RNA, 12 nt, Shigella flexneri 2a str. 2457T
ucucaaucccuu

SEQ ID NO: 3880298 - RNA, 22 nt, Shigella flexneri 2a str. 2457T
ucucaaucccuuucucuucaaa

SEQ ID NO: 3880299 - RNA, 18 nt, Shigella flexneri 2a str. 2457T
ucucaaucucuuuuucca

SEQ ID NO: 3880300 - RNA, 17 nt, Shigella flexneri 2a str. 2457T
ucucaauuacugucguu

SEQ ID NO: 3880301 - RNA, 14 nt, Shigella flexneri 2a str. 2457T
ucucaauuuucacu

SEQ ID NO: 3880302 - RNA, 13 nt, Shigella flexneri 2a str. 2457T
ucucaccccauuu

SEQ ID NO: 3880303 - RNA, 22 nt, Shigella flexneri 2a str. 2457T
ucucacccggaggaaagcaccu

SEQ ID NO: 3880304 - RNA, 19 nt, Shigella flexneri 2a str. 2457T
ucucacuccagccagagcc

SEQ ID NO: 3880305 - RNA, 18 nt, Shigella flexneri 2a str. 2457T
ucucacuuggguaacagc

SEQ ID NO: 3880306 - RNA, 20 nt, Shigella flexneri 2a str. 2457T
ucucacuuggguaacagccc

SEQ ID NO: 3880307 - RNA, 21 nt, Shigella flexneri 2a str. 2457T
ucucagagagaaccucaacag

SEQ ID NO: 3880308 - RNA, 15 nt, Shigella flexneri 2a str. 2457T
ucucagauaaaugca

SEQ ID NO: 3880309 - RNA, 11 nt, Shigella flexneri 2a str. 2457T
ucucagcagac

SEQ ID NO: 3880310 - RNA, 18 nt, Shigella flexneri 2a str. 2457T
ucucagccagcuggcaga

SEQ ID NO: 3880311 - RNA, 18 nt, Shigella flexneri 2a str. 2457T
ucucagcucauuaaaaau

SEQ ID NO: 3880312 - RNA, 19 nt, Shigella flexneri 2a str. 2457T
ucucagcucauuaaaaaua

SEQ ID NO: 3880313 - RNA, 12 nt, Shigella flexneri 2a str. 2457T
ucugauccugca

SEQ ID NO: 3880314 - RNA, 20 nt, Shigella flexneri 2a str. 2457T
ucugaugaggcauaagcgac

SEQ ID NO: 3880315 - RNA, 14 nt, Shigella flexneri 2a str. 2457T
ucugaugauauuuu

SEQ ID NO: 3880316 - RNA, 15 nt, Shigella flexneri 2a str. 2457T
ucugaugcauaaaaa

SEQ ID NO: 3880317 - RNA, 16 nt, Shigella flexneri 2a str. 2457T
ucugaugcauaaaaaa

SEQ ID NO: 3880318 - RNA, 17 nt, Shigella flexneri 2a str. 2457T
ucugauguuguuuuuaa

SEQ ID NO: 3880319 - RNA, 18 nt, Shigella flexneri 2a str. 2457T
ucugauguuguuuuuaac

SEQ ID NO: 3880320 - RNA, 13 nt, Shigella flexneri 2a str. 2457T
ucugauugccgcu

SEQ ID NO: 3880321 - RNA, 14 nt, Shigella flexneri 2a str. 2457T
ucugcaaaaaugcc

SEQ ID NO: 3880322 - RNA, 16 nt, Shigella flexneri 2a str. 2457T
ucugcaaaaaugccuu

SEQ ID NO: 3880323 - RNA, 16 nt, Shigella flexneri 2a str. 2457T
ucugcaaaauaccaau

SEQ ID NO: 3880324 - RNA, 21 nt, Shigella flexneri 2a str. 2457T
ucugcaagaggaaauaagcau

SEQ ID NO: 3880325 - RNA, 12 nt, Shigella flexneri 2a str. 2457T
ucugcaaggcga

SEQ ID NO: 3880326 - RNA, 19 nt, Shigella flexneri 2a str. 2457T
ucugcaagguucuuugcug

SEQ ID NO: 3880327 - RNA, 13 nt, Shigella flexneri 2a str. 2457T
ucugcauuuucuc

SEQ ID NO: 3880328 - RNA, 13 nt, Shigella flexneri 2a str. 2457T
ucugccacgccac

SEQ ID NO: 3880329 - RNA, 18 nt, Shigella flexneri 2a str. 2457T
ucugccacgccacgcugc

SEQ ID NO: 3880330 - RNA, 13 nt, Shigella flexneri 2a str. 2457T
ucugccagaccca

SEQ ID NO: 3880331 - RNA, 22 nt, Shigella flexneri 2a str. 2457T
ucugccagacgguaaccccucu

SEQ ID NO: 3880332 - RNA, 19 nt, Shigella flexneri 2a str. 2457T
ucugccagccauaaaaaag

SEQ ID NO: 3880333 - RNA, 21 nt, Shigella flexneri 2a str. 2457T
ucugccaucauggcauccugu

SEQ ID NO: 3880334 - RNA, 23 nt, Shigella flexneri 2a str. 2457T
ucugccauccguaauuuuuacuc

SEQ ID NO: 3880335 - RNA, 22 nt, Shigella flexneri 2a str. 2457T
ucugccauccugauuuauccca

SEQ ID NO: 3880336 - RNA, 17 nt, Shigella flexneri 2a str. 2457T
ucugcccgagauacauc

SEQ ID NO: 3880337 - RNA, 21 nt, Shigella flexneri 2a str. 2457T
ucugcccgagauacaucaccg

SEQ ID NO: 3880338 - RNA, 13 nt, Shigella flexneri 2a str. 2457T
ucugccgcaauuc

SEQ ID NO: 3880339 - RNA, 22 nt, Shigella flexneri 2a str. 2457T
ucugccgcauggaaccaguuca

SEQ ID NO: 3880340 - RNA, 17 nt, Shigella flexneri 2a str. 2457T
ucugccgcuuccagcag

SEQ ID NO: 3880341 - RNA, 16 nt, Shigella flexneri 2a str. 2457T
ucugccggaagacaca

SEQ ID NO: 3880342 - RNA, 17 nt, Shigella flexneri 2a str. 2457T
ucugccgggaagcucuc

SEQ ID NO: 3880343 - RNA, 22 nt, Shigella flexneri 2a str. 2457T
ucugccgggaagcucucuucca

SEQ ID NO: 3880344 - RNA, 23 nt, Shigella flexneri 2a str. 2457T
ucugccgggaagcucucuuccag

SEQ ID NO: 3880345 - RNA, 17 nt, Shigella flexneri 2a str. 2457T
ucugccugauccugggc

SEQ ID NO: 3880346 - RNA, 20 nt, Shigella flexneri 2a str. 2457T
ucugccugcugggcgcaccu

SEQ ID NO: 3880347 - RNA, 23 nt, Shigella flexneri 2a str. 2457T
ucugccuugaguuuuucaucccu

SEQ ID NO: 3880348 - RNA, 21 nt, Shigella flexneri 2a str. 2457T
ucugcgagcuuucgaccagcc

SEQ ID NO: 3880349 - RNA, 16 nt, Shigella flexneri 2a str. 2457T
ucugcgcacacacgcc

SEQ ID NO: 3880350 - RNA, 20 nt, Shigella flexneri 2a str. 2457T
ucugcgcauaacugccggau

SEQ ID NO: 3880351 - RNA, 23 nt, Shigella flexneri 2a str. 2457T
ucugcgccaccacaacauuccca

SEQ ID NO: 3880352 - RNA, 13 nt, Shigella flexneri 2a str. 2457T
ucugcgccagcga

SEQ ID NO: 3880353 - RNA, 20 nt, Shigella flexneri 2a str. 2457T
ucugcgccgagggaaauaga

SEQ ID NO: 3880354 - RNA, 21 nt, Shigella flexneri 2a str. 2457T
ucugcgccuuuuuucgccgca

SEQ ID NO: 3880355 - RNA, 14 nt, Shigella flexneri 2a str. 2457T
ucugcgcgugcagu

SEQ ID NO: 3880356 - RNA, 19 nt, Shigella flexneri 2a str. 2457T
ucugcggguuagucugcau

SEQ ID NO: 3880357 - RNA, 22 nt, Shigella flexneri 2a str. 2457T
ucugcgguacggauagccgccc

SEQ ID NO: 3880358 - RNA, 17 nt, Shigella flexneri 2a str. 2457T
ucugcguaucgcccugc

SEQ ID NO: 3880359 - RNA, 19 nt, Shigella flexneri 2a str. 2457T
ucugcguaucgcccugcca

SEQ ID NO: 3880360 - RNA, 18 nt, Shigella flexneri 2a str. 2457T
ucugcguuccuggggaaa

SEQ ID NO: 3880361 - RNA, 19 nt, Shigella flexneri 2a str. 2457T
ucugcguuccuggggaaaa

SEQ ID NO: 3880362 - RNA, 12 nt, Shigella flexneri 2a str. 2457T
ucugcguucuga

SEQ ID NO: 3880363 - RNA, 12 nt, Shigella flexneri 2a str. 2457T
ucugcugccuga

SEQ ID NO: 3880364 - RNA, 12 nt, Shigella flexneri 2a str. 2457T
ucugcuggcaaa

SEQ ID NO: 3880365 - RNA, 19 nt, Shigella flexneri 2a str. 2457T
ucugcuucgccugagcggc

SEQ ID NO: 3880366 - RNA, 20 nt, Shigella flexneri 2a str. 2457T
ucugcuucugccugggccug

SEQ ID NO: 3880367 - RNA, 22 nt, Shigella flexneri 2a str. 2457T
ucugcuuucauucgguuuucaa

SEQ ID NO: 3880368 - RNA, 17 nt, Shigella flexneri 2a str. 2457T
ucugcuuucucagcaaa

SEQ ID NO: 3880369 - RNA, 18 nt, Shigella flexneri 2a str. 2457T
ucugcuuuucccuccacu

SEQ ID NO: 3880370 - RNA, 20 nt, Shigella flexneri 2a str. 2457T
ucuggaaauuaaacggcaaa

SEQ ID NO: 3880371 - RNA, 14 nt, Shigella flexneri 2a str. 2457T
ucuggaagaggcug

SEQ ID NO: 3880372 - RNA, 13 nt, Shigella flexneri 2a str. 2457T
ucuggaagcaaaa

SEQ ID NO: 3880373 - RNA, 20 nt, Shigella flexneri 2a str. 2457T
ucuggacaaagagcuuucau

SEQ ID NO: 3880374 - RNA, 19 nt, Shigella flexneri 2a str. 2457T
ucuggacgauugugcuggu

SEQ ID NO: 3880375 - RNA, 16 nt, Shigella flexneri 2a str. 2457T
ucuggaguuccuggau

SEQ ID NO: 3880376 - RNA, 17 nt, Shigella flexneri 2a str. 2457T
ucuggauaaucaaugac

SEQ ID NO: 3880377 - RNA, 21 nt, Shigella flexneri 2a str. 2457T
ucuggauagagcucauuucau

SEQ ID NO: 3880378 - RNA, 23 nt, Shigella flexneri 2a str. 2457T
ucuggauccacgauuaucaccug

SEQ ID NO: 3880379 - RNA, 15 nt, Shigella flexneri 2a str. 2457T
ucuggauuuggcugc

SEQ ID NO: 3880380 - RNA, 15 nt, Shigella flexneri 2a str. 2457T
ucuggcaccuguacc

SEQ ID NO: 3880381 - RNA, 21 nt, Shigella flexneri 2a str. 2457T
ucuggcaccuguaccagcccg

SEQ ID NO: 3880382 - RNA, 16 nt, Shigella flexneri 2a str. 2457T
ucuggcaucacuucuu

SEQ ID NO: 3880383 - RNA, 15 nt, Shigella flexneri 2a str. 2457T
ucuggcauuuggcuc

SEQ ID NO: 3880384 - RNA, 13 nt, Shigella flexneri 2a str. 2457T
ucuggccaugcgg

SEQ ID NO: 3880385 - RNA, 18 nt, Shigella flexneri 2a str. 2457T
ucuggccugagacugaug

SEQ ID NO: 3880386 - RNA, 19 nt, Shigella flexneri 2a str. 2457T
ucuggcgacauuuucucua

SEQ ID NO: 3880387 - RNA, 22 nt, Shigella flexneri 2a str. 2457T
ucuggcgcgaacagcacaucag

SEQ ID NO: 3880388 - RNA, 23 nt, Shigella flexneri 2a str. 2457T
ucuggcguacagagggcaggcaa

SEQ ID NO: 3880389 - RNA, 19 nt, Shigella flexneri 2a str. 2457T
ucuggcucaucgccuucca

SEQ ID NO: 3880390 - RNA, 23 nt, Shigella flexneri 2a str. 2457T
ucuggcugacauaaacaccagca

SEQ ID NO: 3880391 - RNA, 15 nt, Shigella flexneri 2a str. 2457T
ucuggcuucccggca

SEQ ID NO: 3880392 - RNA, 20 nt, Shigella flexneri 2a str. 2457T
ucugggcaaaaucaucacuc

SEQ ID NO: 3880393 - RNA, 14 nt, Shigella flexneri 2a str. 2457T
ucugggcugaagag

SEQ ID NO: 3880394 - RNA, 16 nt, Shigella flexneri 2a str. 2457T
ucuggguugccugaug

SEQ ID NO: 3880395 - RNA, 15 nt, Shigella flexneri 2a str. 2457T
ucuggguuucgccag

SEQ ID NO: 3880396 - RNA, 17 nt, Shigella flexneri 2a str. 2457T
ucugguaaaccuuccac

SEQ ID NO: 3880397 - RNA, 14 nt, Shigella flexneri 2a str. 2457T
ucuggugaccuggg

SEQ ID NO: 3880398 - RNA, 20 nt, Shigella flexneri 2a str. 2457T
ucuggugaccugggaaaucc

SEQ ID NO: 3880399 - RNA, 19 nt, Shigella flexneri 2a str. 2457T
ucuggugggugcuuuaaaa

SEQ ID NO: 3880400 - RNA, 22 nt, Shigella flexneri 2a str. 2457T
ucuggugggugcuuuaaaaaag

SEQ ID NO: 3880401 - RNA, 20 nt, Shigella flexneri 2a str. 2457T
ucugguucgccaaaugucac

SEQ ID NO: 3880402 - RNA, 23 nt, Shigella flexneri 2a str. 2457T
ucugguucgccaaaugucaccag

SEQ ID NO: 3880403 - RNA, 13 nt, Shigella flexneri 2a str. 2457T
ucugguugagcag

SEQ ID NO: 3880404 - RNA, 21 nt, Shigella flexneri 2a str. 2457T
ucugguuucaguaauccuuuc

SEQ ID NO: 3880405 - RNA, 20 nt, Shigella flexneri 2a str. 2457T
ucugguuugccacguucuga

SEQ ID NO: 3880406 - RNA, 21 nt, Shigella flexneri 2a str. 2457T
ucuguaaauugaugugaaaac

SEQ ID NO: 3880407 - RNA, 13 nt, Shigella flexneri 2a str. 2457T
ucuguaacaaggu

SEQ ID NO: 3880408 - RNA, 18 nt, Shigella flexneri 2a str. 2457T
ucuguaacgcacuggugg

SEQ ID NO: 3880409 - RNA, 15 nt, Shigella flexneri 2a str. 2457T
ucugucagaaaugau

SEQ ID NO: 3880410 - RNA, 13 nt, Shigella flexneri 2a str. 2457T
ucuugcuggaugc

SEQ ID NO: 3880411 - RNA, 15 nt, Shigella flexneri 2a str. 2457T
ucuuggcugcucauu

SEQ ID NO: 3880412 - RNA, 12 nt, Shigella flexneri 2a str. 2457T
ucuuguaggcca

SEQ ID NO: 3880413 - RNA, 16 nt, Shigella flexneri 2a str. 2457T
ucuuguaggccugaua

SEQ ID NO: 3880414 - RNA, 14 nt, Shigella flexneri 2a str. 2457T
ucuuguugaacagg

SEQ ID NO: 3880415 - RNA, 14 nt, Shigella flexneri 2a str. 2457T
ucuuguuugaugag

SEQ ID NO: 3880416 - RNA, 15 nt, Shigella flexneri 2a str. 2457T
ucuuuaaaaaguaaa

SEQ ID NO: 3880417 - RNA, 11 nt, Shigella flexneri 2a str. 2457T
ucuuuaaacag

SEQ ID NO: 3880418 - RNA, 15 nt, Shigella flexneri 2a str. 2457T
ucuuuaaacaguuuu

SEQ ID NO: 3880419 - RNA, 12 nt, Shigella flexneri 2a str. 2457T
ucuuuaaugaca

SEQ ID NO: 3880420 - RNA, 17 nt, Shigella flexneri 2a str. 2457T
ucuuuaaugcacggcag

SEQ ID NO: 3880421 - RNA, 15 nt, Shigella flexneri 2a str. 2457T
ucuuuacgcaaaauc

SEQ ID NO: 3880422 - RNA, 21 nt, Shigella flexneri 2a str. 2457T
ucuuuacuaaacggucccuca

SEQ ID NO: 3880423 - RNA, 15 nt, Shigella flexneri 2a str. 2457T
ucuuuacugauaauu

SEQ ID NO: 3880424 - RNA, 17 nt, Shigella flexneri 2a str. 2457T
ucuuuaguuaauuucgc

SEQ ID NO: 3880425 - RNA, 23 nt, Shigella flexneri 2a str. 2457T
ucuuuauaaauuccuaaaguugu

SEQ ID NO: 3880426 - RNA, 13 nt, Shigella flexneri 2a str. 2457T
ucuuuauccugac

SEQ ID NO: 3880427 - RNA, 22 nt, Shigella flexneri 2a str. 2457T
ucuuuaucggucuuagcaaagg

SEQ ID NO: 3880428 - RNA, 15 nt, Shigella flexneri 2a str. 2457T
ucuuuaucuauuaau

SEQ ID NO: 3880429 - RNA, 11 nt, Shigella flexneri 2a str. 2457T
ucuuuaucugc

SEQ ID NO: 3880430 - RNA, 16 nt, Shigella flexneri 2a str. 2457T
ucuuuaucugccggac

SEQ ID NO: 3880431 - RNA, 14 nt, Shigella flexneri 2a str. 2457T
ucuuucaaugcuuu

SEQ ID NO: 3880432 - RNA, 13 nt, Shigella flexneri 2a str. 2457T
ucuuucacaaaga

SEQ ID NO: 3880433 - RNA, 18 nt, Shigella flexneri 2a str. 2457T
ucuuucacgaacacagug

SEQ ID NO: 3880434 - RNA, 12 nt, Shigella flexneri 2a str. 2457T
ucuuucagcaac

SEQ ID NO: 3880435 - RNA, 13 nt, Shigella flexneri 2a str. 2457T
ucuuucaucuccc

SEQ ID NO: 3880436 - RNA, 22 nt, Shigella flexneri 2a str. 2457T
ucuuuccagacucaacaggccc

SEQ ID NO: 3880437 - RNA, 23 nt, Shigella flexneri 2a str. 2457T
ucuuuccagcaaccaaugccacc

SEQ ID NO: 3880438 - RNA, 19 nt, Shigella flexneri 2a str. 2457T
ucuuucccggcaaucaccg

SEQ ID NO: 3880439 - RNA, 20 nt, Shigella flexneri 2a str. 2457T
ucuuucgacggcaucagaaa

SEQ ID NO: 3880440 - RNA, 17 nt, Shigella flexneri 2a str. 2457T
ucuuucgugcuauucga

SEQ ID NO: 3880441 - RNA, 11 nt, Shigella flexneri 2a str. 2457T
ucuuucucauc

SEQ ID NO: 3880442 - RNA, 21 nt, Shigella flexneri 2a str. 2457T
ucuuucucugcaaauauuaau

SEQ ID NO: 3880443 - RNA, 17 nt, Shigella flexneri 2a str. 2457T
ucuuugacaaauuccgu

SEQ ID NO: 3880444 - RNA, 21 nt, Shigella flexneri 2a str. 2457T
ucuuugauugaagaaaucagu

SEQ ID NO: 3880445 - RNA, 17 nt, Shigella flexneri 2a str. 2457T
ucuuugcagcuuugcug

SEQ ID NO: 3880446 - RNA, 22 nt, Shigella flexneri 2a str. 2457T
ucuuugcccgcagauccagugc

SEQ ID NO: 3880447 - RNA, 12 nt, Shigella flexneri 2a str. 2457T
ucuuugccugau

SEQ ID NO: 3880448 - RNA, 18 nt, Shigella flexneri 2a str. 2457T
ucuuugccugaucgguga

SEQ ID NO: 3880449 - RNA, 23 nt, Shigella flexneri 2a str. 2457T
ucuuugccugaucggugaaagua

SEQ ID NO: 3880450 - RNA, 15 nt, Shigella flexneri 2a str. 2457T
ucuuuggcaucaauc

SEQ ID NO: 3880451 - RNA, 23 nt, Shigella flexneri 2a str. 2457T
ucuuuguaucgcugaaagauggc

SEQ ID NO: 3880452 - RNA, 13 nt, Shigella flexneri 2a str. 2457T
ucuuuguucggca

SEQ ID NO: 3880453 - RNA, 19 nt, Shigella flexneri 2a str. 2457T
ucuuuuacagcgccagaag

SEQ ID NO: 3880454 - RNA, 20 nt, Shigella flexneri 2a str. 2457T
ucuuuuacagcgccagaagg

SEQ ID NO: 3880455 - RNA, 14 nt, Shigella flexneri 2a str. 2457T
ucuuuucacgcaau

SEQ ID NO: 3880456 - RNA, 14 nt, Shigella flexneri 2a str. 2457T
ucuuuugcagcagc

SEQ ID NO: 3880457 - RNA, 23 nt, Shigella flexneri 2a str. 2457T
ucuuuugcuaucgggaauauuaa

SEQ ID NO: 3880458 - RNA, 20 nt, Shigella flexneri 2a str. 2457T
ucuuuugcuugacaaaaaga

SEQ ID NO: 3880459 - RNA, 21 nt, Shigella flexneri 2a str. 2457T
ucuuuuucauuaugaucaaaa

SEQ ID NO: 3880460 - RNA, 15 nt, Shigella flexneri 2a str. 2457T
ucuuuuuucacuggc

SEQ ID NO: 3880461 - RNA, 15 nt, Shigella flexneri 2a str. 2457T
ugaaaaaaccagaaa

SEQ ID NO: 3880462 - RNA, 12 nt, Shigella flexneri 2a str. 2457T
ugaaaaaaguuu

SEQ ID NO: 3880463 - RNA, 14 nt, Shigella flexneri 2a str. 2457T
ugaaaaaccaaucu

SEQ ID NO: 3880464 - RNA, 20 nt, Shigella flexneri 2a str. 2457T
ugaaaaagccaaaacugcac

SEQ ID NO: 3880465 - RNA, 20 nt, Shigella flexneri 2a str. 2457T
ugaaaaagcucccuaaaaua

SEQ ID NO: 3880466 - RNA, 12 nt, Shigella flexneri 2a str. 2457T
ugaaaaauaaaa

SEQ ID NO: 3880467 - RNA, 22 nt, Shigella flexneri 2a str. 2457T
ugaaaacccuauuuuuggaggu

SEQ ID NO: 3880468 - RNA, 15 nt, Shigella flexneri 2a str. 2457T
ugaaaacccugcgca

SEQ ID NO: 3880469 - RNA, 17 nt, Shigella flexneri 2a str. 2457T
ugaaaaccucucuggaa

SEQ ID NO: 3880470 - RNA, 17 nt, Shigella flexneri 2a str. 2457T
ugaaaagaguaguaauu

SEQ ID NO: 3880471 - RNA, 21 nt, Shigella flexneri 2a str. 2457T
ugaaaagaguaguaauugcuu

SEQ ID NO: 3880472 - RNA, 20 nt, Shigella flexneri 2a str. 2457T
ugaaaaggucacucccggau

SEQ ID NO: 3880473 - RNA, 18 nt, Shigella flexneri 2a str. 2457T
ugaaaagguugccugucu

SEQ ID NO: 3880474 - RNA, 16 nt, Shigella flexneri 2a str. 2457T
ugaaaagucauccggc

SEQ ID NO: 3880475 - RNA, 17 nt, Shigella flexneri 2a str. 2457T
ugaaaaguccaggcugc

SEQ ID NO: 3880476 - RNA, 13 nt, Shigella flexneri 2a str. 2457T
ugaaaaucaccau

SEQ ID NO: 3880477 - RNA, 13 nt, Shigella flexneri 2a str. 2457T
ugaaaauguggua

SEQ ID NO: 3880478 - RNA, 14 nt, Shigella flexneri 2a str. 2457T
ugaaaauuauaucu

SEQ ID NO: 3880479 - RNA, 19 nt, Shigella flexneri 2a str. 2457T
ugaaaauucgcggcauggg

SEQ ID NO: 3880480 - RNA, 20 nt, Shigella flexneri 2a str. 2457T
ugaaacaacguggaacaaau

SEQ ID NO: 3880481 - RNA, 17 nt, Shigella flexneri 2a str. 2457T
ugaaaccagacacuuca

SEQ ID NO: 3880482 - RNA, 16 nt, Shigella flexneri 2a str. 2457T
ugaaaccuuuaugcag

SEQ ID NO: 3880483 - RNA, 15 nt, Shigella flexneri 2a str. 2457T
ugaaacgaaaucuug

SEQ ID NO: 3880484 - RNA, 21 nt, Shigella flexneri 2a str. 2457T
ugaaacggaaucgcccgcugu

SEQ ID NO: 3880485 - RNA, 13 nt, Shigella flexneri 2a str. 2457T
ugaaacucagcca

SEQ ID NO: 3880486 - RNA, 15 nt, Shigella flexneri 2a str. 2457T
ugaaacucgaccagc

SEQ ID NO: 3880487 - RNA, 17 nt, Shigella flexneri 2a str. 2457T
ugaaacugauaauuuuc

SEQ ID NO: 3880488 - RNA, 13 nt, Shigella flexneri 2a str. 2457T
ugaaacuguuaau

SEQ ID NO: 3880489 - RNA, 22 nt, Shigella flexneri 2a str. 2457T
ugaaagaaaaucaauccagugu

SEQ ID NO: 3880490 - RNA, 19 nt, Shigella flexneri 2a str. 2457T
ugaaagaagcggugaaaaa

SEQ ID NO: 3880491 - RNA, 21 nt, Shigella flexneri 2a str. 2457T
ugaaagauaaucacacagcgg

SEQ ID NO: 3880492 - RNA, 17 nt, Shigella flexneri 2a str. 2457T
ugaaagccccaccagca

SEQ ID NO: 3880493 - RNA, 19 nt, Shigella flexneri 2a str. 2457T
ugaaagccccaccagcaaa

SEQ ID NO: 3880494 - RNA, 24 nt, Shigella flexneri 2a str. 2457T
ugaaagcguuuaugcgcauugcca

SEQ ID NO: 3880495 - RNA, 22 nt, Shigella flexneri 2a str. 2457T
ugaaaggcgcucauuuucucuu

SEQ ID NO: 3880496 - RNA, 16 nt, Shigella flexneri 2a str. 2457T
ugaaaguaaaaaagaa

SEQ ID NO: 3880497 - RNA, 20 nt, Shigella flexneri 2a str. 2457T
ugaaaguauuugacuguucu

SEQ ID NO: 3880498 - RNA, 22 nt, Shigella flexneri 2a str. 2457T
ugaaagugggggauuuacucuc

SEQ ID NO: 3880499 - RNA, 18 nt, Shigella flexneri 2a str. 2457T
ugaaaguucaugauuuaa

SEQ ID NO: 3880500 - RNA, 20 nt, Shigella flexneri 2a str. 2457T
ugaaaguuuaacuaccgugu

SEQ ID NO: 3880501 - RNA, 15 nt, Shigella flexneri 2a str. 2457T
ugaaauaaugcagcg

SEQ ID NO: 3880502 - RNA, 20 nt, Shigella flexneri 2a str. 2457T
ugaaauacccgcucauucgu

SEQ ID NO: 3880503 - RNA, 12 nt, Shigella flexneri 2a str. 2457T
ugaaaucacuaa

SEQ ID NO: 3880504 - RNA, 22 nt, Shigella flexneri 2a str. 2457T
ugaaaucguuugcauccagcuc

SEQ ID NO: 3880505 - RNA, 16 nt, Shigella flexneri 2a str. 2457T
ugaaaucugaaaucau

SEQ ID NO: 3880506 - RNA, 19 nt, Shigella flexneri 2a str. 2457T
ugaaaucugaaaucaucaa

SEQ ID NO: 3880507 - RNA, 14 nt, Shigella flexneri 2a str. 2457T
ugaaaugaaaauca

SEQ ID NO: 3880508 - RNA, 23 nt, Shigella flexneri 2a str. 2457T
ugaccagugaauuucacuucgcc

SEQ ID NO: 3880509 - RNA, 20 nt, Shigella flexneri 2a str. 2457T
ugaccaguugcuccagcaau

SEQ ID NO: 3880510 - RNA, 14 nt, Shigella flexneri 2a str. 2457T
ugaccauaaaaggc

SEQ ID NO: 3880511 - RNA, 17 nt, Shigella flexneri 2a str. 2457T
ugaccauuaucaaacag

SEQ ID NO: 3880512 - RNA, 15 nt, Shigella flexneri 2a str. 2457T
ugacccaccccagca

SEQ ID NO: 3880513 - RNA, 22 nt, Shigella flexneri 2a str. 2457T
ugacccaccccagcagcagccg

SEQ ID NO: 3880514 - RNA, 12 nt, Shigella flexneri 2a str. 2457T
ugacccagaccg

SEQ ID NO: 3880515 - RNA, 13 nt, Shigella flexneri 2a str. 2457T
ugacccagcacca

SEQ ID NO: 3880516 - RNA, 16 nt, Shigella flexneri 2a str. 2457T
ugacccaucugccagc

SEQ ID NO: 3880517 - RNA, 22 nt, Shigella flexneri 2a str. 2457T
ugacccgcaccguccucacugu

SEQ ID NO: 3880518 - RNA, 18 nt, Shigella flexneri 2a str. 2457T
ugacccgcagccagcacu

SEQ ID NO: 3880519 - RNA, 21 nt, Shigella flexneri 2a str. 2457T
ugaccgaaccuguuuucaccg

SEQ ID NO: 3880520 - RNA, 14 nt, Shigella flexneri 2a str. 2457T
ugaccgaaugcagu

SEQ ID NO: 3880521 - RNA, 19 nt, Shigella flexneri 2a str. 2457T
ugaccgaaugcagucgcgu

SEQ ID NO: 3880522 - RNA, 21 nt, Shigella flexneri 2a str. 2457T
ugaccgaugcaucggccucaa

SEQ ID NO: 3880523 - RNA, 15 nt, Shigella flexneri 2a str. 2457T
ugaccgcgaguaauc

SEQ ID NO: 3880524 - RNA, 18 nt, Shigella flexneri 2a str. 2457T
ugaccgcgaguaaucaca

SEQ ID NO: 3880525 - RNA, 20 nt, Shigella flexneri 2a str. 2457T
ugaccgcgaguaaucacauc

SEQ ID NO: 3880526 - RNA, 16 nt, Shigella flexneri 2a str. 2457T
ugaccgcgccauccau

SEQ ID NO: 3880527 - RNA, 14 nt, Shigella flexneri 2a str. 2457T
ugaccgcuccgcca

SEQ ID NO: 3880528 - RNA, 16 nt, Shigella flexneri 2a str. 2457T
ugaccuacgcuuucga

SEQ ID NO: 3880529 - RNA, 15 nt, Shigella flexneri 2a str. 2457T
ugaccugacauuaag

SEQ ID NO: 3880530 - RNA, 11 nt, Shigella flexneri 2a str. 2457T
ugaccugcaaa

SEQ ID NO: 3880531 - RNA, 14 nt, Shigella flexneri 2a str. 2457T
ugaccugcagcguu

SEQ ID NO: 3880532 - RNA, 18 nt, Shigella flexneri 2a str. 2457T
ugaccugugccagccauu

SEQ ID NO: 3880533 - RNA, 15 nt, Shigella flexneri 2a str. 2457T
ugacgaaggucgagg

SEQ ID NO: 3880534 - RNA, 17 nt, Shigella flexneri 2a str. 2457T
ugacgacuuuuuccauu

SEQ ID NO: 3880535 - RNA, 13 nt, Shigella flexneri 2a str. 2457T
ugacgaugacugg

SEQ ID NO: 3880536 - RNA, 15 nt, Shigella flexneri 2a str. 2457T
ugacgauuguagaaa

SEQ ID NO: 3880537 - RNA, 21 nt, Shigella flexneri 2a str. 2457T
ugacgcauccgaucgcgcauc

SEQ ID NO: 3880538 - RNA, 23 nt, Shigella flexneri 2a str. 2457T
ugacgcauccgaucgcgcaucag

SEQ ID NO: 3880539 - RNA, 21 nt, Shigella flexneri 2a str. 2457T
ugacgccaaaauaacuuaaug

SEQ ID NO: 3880540 - RNA, 15 nt, Shigella flexneri 2a str. 2457T
ugacgcccccaaacu

SEQ ID NO: 3880541 - RNA, 21 nt, Shigella flexneri 2a str. 2457T
ugacgcgcauacucuccucca

SEQ ID NO: 3880542 - RNA, 15 nt, Shigella flexneri 2a str. 2457T
ugacgcgggcagcag

SEQ ID NO: 3880543 - RNA, 17 nt, Shigella flexneri 2a str. 2457T
ugacgcgggcagcagaa

SEQ ID NO: 3880544 - RNA, 14 nt, Shigella flexneri 2a str. 2457T
ugacgcgucuuauc

SEQ ID NO: 3880545 - RNA, 20 nt, Shigella flexneri 2a str. 2457T
ugacgcgucuuaucaggccu

SEQ ID NO: 3880546 - RNA, 21 nt, Shigella flexneri 2a str. 2457T
ugacgcgucuuaucaggccua

SEQ ID NO: 3880547 - RNA, 20 nt, Shigella flexneri 2a str. 2457T
ugacgcgucuuaucuggccu

SEQ ID NO: 3880548 - RNA, 21 nt, Shigella flexneri 2a str. 2457T
ugacgcgucuuaucuggccua

SEQ ID NO: 3880549 - RNA, 21 nt, Shigella flexneri 2a str. 2457T
ugacgcucucuacgcccugua

SEQ ID NO: 3880550 - RNA, 16 nt, Shigella flexneri 2a str. 2457T
ugacgcuggcagaaag

SEQ ID NO: 3880551 - RNA, 16 nt, Shigella flexneri 2a str. 2457T
ugacggaaaucaucca

SEQ ID NO: 3880552 - RNA, 19 nt, Shigella flexneri 2a str. 2457T
ugacggaucccgccaacag

SEQ ID NO: 3880553 - RNA, 15 nt, Shigella flexneri 2a str. 2457T
ugacgggcaaggcug

SEQ ID NO: 3880554 - RNA, 20 nt, Shigella flexneri 2a str. 2457T
ugacggucuggugcuguugc

SEQ ID NO: 3880555 - RNA, 16 nt, Shigella flexneri 2a str. 2457T
ugacggugauaaucau

SEQ ID NO: 3880556 - RNA, 16 nt, Shigella flexneri 2a str. 2457T
ugacggugauacagca

SEQ ID NO: 3880557 - RNA, 22 nt, Shigella flexneri 2a str. 2457T
ugacguagcagcuccgccagcu

SEQ ID NO: 3880558 - RNA, 18 nt, Shigella flexneri 2a str. 2457T
ugacguaucaccgagaca

SEQ ID NO: 3880559 - RNA, 17 nt, Shigella flexneri 2a str. 2457T
ugacgucuuaauaaaug

SEQ ID NO: 3880560 - RNA, 13 nt, Shigella flexneri 2a str. 2457T
ugacgugauuuag

SEQ ID NO: 3880561 - RNA, 19 nt, Shigella flexneri 2a str. 2457T
ugacgugccugugcagcga

SEQ ID NO: 3880562 - RNA, 21 nt, Shigella flexneri 2a str. 2457T
ugacgugccugugcagcgacg

SEQ ID NO: 3880563 - RNA, 21 nt, Shigella flexneri 2a str. 2457T
ugacgugucuuaucaggccua

SEQ ID NO: 3880564 - RNA, 14 nt, Shigella flexneri 2a str. 2457T
ugacguucaguuca

SEQ ID NO: 3880565 - RNA, 18 nt, Shigella flexneri 2a str. 2457T
ugacguuuacuucgcuuu

SEQ ID NO: 3880566 - RNA, 17 nt, Shigella flexneri 2a str. 2457T
ugacuaaaguuucuuua

SEQ ID NO: 3880567 - RNA, 13 nt, Shigella flexneri 2a str. 2457T
ugacuacaccauu

SEQ ID NO: 3880568 - RNA, 16 nt, Shigella flexneri 2a str. 2457T
ugacuaucaucgccgu

SEQ ID NO: 3880569 - RNA, 21 nt, Shigella flexneri 2a str. 2457T
ugacuauccuggacuuuaaac

SEQ ID NO: 3880570 - RNA, 20 nt, Shigella flexneri 2a str. 2457T
ugacucaauggcauccgcca

SEQ ID NO: 3880571 - RNA, 20 nt, Shigella flexneri 2a str. 2457T
ugacucagcggcugccagca

SEQ ID NO: 3880572 - RNA, 21 nt, Shigella flexneri 2a str. 2457T
ugacucggcucauuauuugcc

SEQ ID NO: 3880573 - RNA, 18 nt, Shigella flexneri 2a str. 2457T
ugacucuacgcaagucau

SEQ ID NO: 3880574 - RNA, 16 nt, Shigella flexneri 2a str. 2457T
ugacugccccaguucc

SEQ ID NO: 3880575 - RNA, 20 nt, Shigella flexneri 2a str. 2457T
ugacugcgccacuucccagc

SEQ ID NO: 3880576 - RNA, 19 nt, Shigella flexneri 2a str. 2457T
ugacugcuuugcacaggca

SEQ ID NO: 3880577 - RNA, 22 nt, Shigella flexneri 2a str. 2457T
ugacugcuuuuacaaaaucuuc

SEQ ID NO: 3880578 - RNA, 23 nt, Shigella flexneri 2a str. 2457T
ugacuggcaacaacgcaacucca

SEQ ID NO: 3880579 - RNA, 14 nt, Shigella flexneri 2a str. 2457T
ugacuggcagguaa

SEQ ID NO: 3880580 - RNA, 16 nt, Shigella flexneri 2a str. 2457T
ugacuggcucuuuuuc

SEQ ID NO: 3880581 - RNA, 13 nt, Shigella flexneri 2a str. 2457T
ugacuguacagau

SEQ ID NO: 3880582 - RNA, 16 nt, Shigella flexneri 2a str. 2457T
ugacuguacagauccg

SEQ ID NO: 3880583 - RNA, 17 nt, Shigella flexneri 2a str. 2457T
ugacuguaggccggaua

SEQ ID NO: 3880584 - RNA, 19 nt, Shigella flexneri 2a str. 2457T
ugacuguaggccggauaag

SEQ ID NO: 3880585 - RNA, 19 nt, Shigella flexneri 2a str. 2457T
ugacuucaauuugagcgaa

SEQ ID NO: 3880586 - RNA, 14 nt, Shigella flexneri 2a str. 2457T
ugacuuccacuucc

SEQ ID NO: 3880587 - RNA, 22 nt, Shigella flexneri 2a str. 2457T
ugacuuccacuuccugcggagc

SEQ ID NO: 3880588 - RNA, 20 nt, Shigella flexneri 2a str. 2457T
ugacuuccguaccagccuug

SEQ ID NO: 3880589 - RNA, 18 nt, Shigella flexneri 2a str. 2457T
ugacuucgccgugaaagu

SEQ ID NO: 3880590 - RNA, 17 nt, Shigella flexneri 2a str. 2457T
ugacuucugccagcugc

SEQ ID NO: 3880591 - RNA, 21 nt, Shigella flexneri 2a str. 2457T
ugacuuucuggcacgaccugg

SEQ ID NO: 3880592 - RNA, 18 nt, Shigella flexneri 2a str. 2457T
ugacuuuuacagcuuagc

SEQ ID NO: 3880593 - RNA, 14 nt, Shigella flexneri 2a str. 2457T
ugagaaaauuucau

SEQ ID NO: 3880594 - RNA, 13 nt, Shigella flexneri 2a str. 2457T
ugagaacaccacc

SEQ ID NO: 3880595 - RNA, 17 nt, Shigella flexneri 2a str. 2457T
ugagaacaguucagcag

SEQ ID NO: 3880596 - RNA, 19 nt, Shigella flexneri 2a str. 2457T
ugagaaccuuuaucacugu

SEQ ID NO: 3880597 - RNA, 21 nt, Shigella flexneri 2a str. 2457T
ugagaacgacagugacuuccg

SEQ ID NO: 3880598 - RNA, 11 nt, Shigella flexneri 2a str. 2457T
ugagaagcuuc

SEQ ID NO: 3880599 - RNA, 22 nt, Shigella flexneri 2a str. 2457T
ugagaauaaucaccuuuaaccu

SEQ ID NO: 3880600 - RNA, 19 nt, Shigella flexneri 2a str. 2457T
ugagaauuccgacagagaa

SEQ ID NO: 3880601 - RNA, 21 nt, Shigella flexneri 2a str. 2457T
ugagaauuccggcagagaaag

SEQ ID NO: 3880602 - RNA, 17 nt, Shigella flexneri 2a str. 2457T
ugagagggcgauaaauc

SEQ ID NO: 3880603 - RNA, 19 nt, Shigella flexneri 2a str. 2457T
ugagagugaagccugauca

SEQ ID NO: 3880604 - RNA, 20 nt, Shigella flexneri 2a str. 2457T
ugagagugauuaacuguucu

SEQ ID NO: 3880605 - RNA, 16 nt, Shigella flexneri 2a str. 2457T
ugauaugccugcuggc

SEQ ID NO: 3880606 - RNA, 12 nt, Shigella flexneri 2a str. 2457T
ugauauggucaa

SEQ ID NO: 3880607 - RNA, 12 nt, Shigella flexneri 2a str. 2457T
ugauauguuuau

SEQ ID NO: 3880608 - RNA, 15 nt, Shigella flexneri 2a str. 2457T
ugauauguuuauuag

SEQ ID NO: 3880609 - RNA, 18 nt, Shigella flexneri 2a str. 2457T
ugauauguuuuaaagcga

SEQ ID NO: 3880610 - RNA, 14 nt, Shigella flexneri 2a str. 2457T
ugauauuuucugcc

SEQ ID NO: 3880611 - RNA, 15 nt, Shigella flexneri 2a str. 2457T
ugauauuuuucccug

SEQ ID NO: 3880612 - RNA, 22 nt, Shigella flexneri 2a str. 2457T
ugaucaaaaucauauaauuguu

SEQ ID NO: 3880613 - RNA, 14 nt, Shigella flexneri 2a str. 2457T
ugaucaaacacaaa

SEQ ID NO: 3880614 - RNA, 21 nt, Shigella flexneri 2a str. 2457T
ugaucaaacacaaaguccuga

SEQ ID NO: 3880615 - RNA, 20 nt, Shigella flexneri 2a str. 2457T
ugaucaaaucaugccugcga

SEQ ID NO: 3880616 - RNA, 12 nt, Shigella flexneri 2a str. 2457T
ugaucaccagua

SEQ ID NO: 3880617 - RNA, 19 nt, Shigella flexneri 2a str. 2457T
ugaucacccacaucagcgg

SEQ ID NO: 3880618 - RNA, 23 nt, Shigella flexneri 2a str. 2457T
ugaucaccguaaugaugauccag

SEQ ID NO: 3880619 - RNA, 18 nt, Shigella flexneri 2a str. 2457T
ugaucaccugcauacaaa

SEQ ID NO: 3880620 - RNA, 18 nt, Shigella flexneri 2a str. 2457T
ugaucacuuucaccggcg

SEQ ID NO: 3880621 - RNA, 23 nt, Shigella flexneri 2a str. 2457T
ugaucagacacguuaauggcuuu

SEQ ID NO: 3880622 - RNA, 16 nt, Shigella flexneri 2a str. 2457T
ugaucagcaaucugaa

SEQ ID NO: 3880623 - RNA, 11 nt, Shigella flexneri 2a str. 2457T
ugaucaucauu

SEQ ID NO: 3880624 - RNA, 22 nt, Shigella flexneri 2a str. 2457T
ugauccaacaaggcaucgugau

SEQ ID NO: 3880625 - RNA, 19 nt, Shigella flexneri 2a str. 2457T
ugauccagccauugccaua

SEQ ID NO: 3880626 - RNA, 19 nt, Shigella flexneri 2a str. 2457T
ugauccaucagguaguguu

SEQ ID NO: 3880627 - RNA, 17 nt, Shigella flexneri 2a str. 2457T
ugauccccgcuuccugc

SEQ ID NO: 3880628 - RNA, 23 nt, Shigella flexneri 2a str. 2457T
ugaucccgauggucagcuucacc

SEQ ID NO: 3880629 - RNA, 20 nt, Shigella flexneri 2a str. 2457T
ugauccgccgcgcggugggc

SEQ ID NO: 3880630 - RNA, 21 nt, Shigella flexneri 2a str. 2457T
ugauccugcaacagcaccagc

SEQ ID NO: 3880631 - RNA, 18 nt, Shigella flexneri 2a str. 2457T
ugauccuggauuuccucg

SEQ ID NO: 3880632 - RNA, 13 nt, Shigella flexneri 2a str. 2457T
ugaucgauccacg

SEQ ID NO: 3880633 - RNA, 19 nt, Shigella flexneri 2a str. 2457T
ugaucgcaccuuaucgauu

SEQ ID NO: 3880634 - RNA, 13 nt, Shigella flexneri 2a str. 2457T
ugaucgccauauu

SEQ ID NO: 3880635 - RNA, 15 nt, Shigella flexneri 2a str. 2457T
ugaucgccauauuuc

SEQ ID NO: 3880636 - RNA, 19 nt, Shigella flexneri 2a str. 2457T
ugaucgcgccgccgcccau

SEQ ID NO: 3880637 - RNA, 15 nt, Shigella flexneri 2a str. 2457T
ugaucggcgcgaaag

SEQ ID NO: 3880638 - RNA, 23 nt, Shigella flexneri 2a str. 2457T
ugaucuaaaaucgcuucagccgg

SEQ ID NO: 3880639 - RNA, 18 nt, Shigella flexneri 2a str. 2457T
ugaucuauaccaccgcuc

SEQ ID NO: 3880640 - RNA, 18 nt, Shigella flexneri 2a str. 2457T
ugaucuccuuuguaccag

SEQ ID NO: 3880641 - RNA, 13 nt, Shigella flexneri 2a str. 2457T
ugaucucuuucca

SEQ ID NO: 3880642 - RNA, 19 nt, Shigella flexneri 2a str. 2457T
ugaucugaccgaaugcagu

SEQ ID NO: 3880643 - RNA, 21 nt, Shigella flexneri 2a str. 2457T
ugaucugcgucgcuuuccagu

SEQ ID NO: 3880644 - RNA, 15 nt, Shigella flexneri 2a str. 2457T
ugaucuggcgcguua

SEQ ID NO: 3880645 - RNA, 22 nt, Shigella flexneri 2a str. 2457T
ugaucuuaauggacgaacuggc

SEQ ID NO: 3880646 - RNA, 18 nt, Shigella flexneri 2a str. 2457T
ugaucuuuaucacacaga

SEQ ID NO: 3880647 - RNA, 14 nt, Shigella flexneri 2a str. 2457T
ugaucuuucuucag

SEQ ID NO: 3880648 - RNA, 11 nt, Shigella flexneri 2a str. 2457T
ugaucuuuuuu

SEQ ID NO: 3880649 - RNA, 13 nt, Shigella flexneri 2a str. 2457T
ugaugaaaaaagu

SEQ ID NO: 3880650 - RNA, 14 nt, Shigella flexneri 2a str. 2457T
ugaugaacccgguc

SEQ ID NO: 3880651 - RNA, 13 nt, Shigella flexneri 2a str. 2457T
ugaugaagcaagc

SEQ ID NO: 3880652 - RNA, 11 nt, Shigella flexneri 2a str. 2457T
ugaugaccaga

SEQ ID NO: 3880653 - RNA, 16 nt, Shigella flexneri 2a str. 2457T
ugaugagcgauaaaca

SEQ ID NO: 3880654 - RNA, 17 nt, Shigella flexneri 2a str. 2457T
ugaugaggcauaagcga

SEQ ID NO: 3880655 - RNA, 23 nt, Shigella flexneri 2a str. 2457T
ugaugagggcgcuaaaugccgcg

SEQ ID NO: 3880656 - RNA, 15 nt, Shigella flexneri 2a str. 2457T
ugaugaguugaaaac

SEQ ID NO: 3880657 - RNA, 14 nt, Shigella flexneri 2a str. 2457T
ugaugauacugaca

SEQ ID NO: 3880658 - RNA, 14 nt, Shigella flexneri 2a str. 2457T
ugaugaugccuaca

SEQ ID NO: 3880659 - RNA, 16 nt, Shigella flexneri 2a str. 2457T
ugaugauuaacagcaa

SEQ ID NO: 3880660 - RNA, 18 nt, Shigella flexneri 2a str. 2457T
ugaugauugguaugccug

SEQ ID NO: 3880661 - RNA, 15 nt, Shigella flexneri 2a str. 2457T
ugaugcacaccaucg

SEQ ID NO: 3880662 - RNA, 17 nt, Shigella flexneri 2a str. 2457T
ugaugcagccagugauu

SEQ ID NO: 3880663 - RNA, 14 nt, Shigella flexneri 2a str. 2457T
ugaugcauccggca

SEQ ID NO: 3880664 - RNA, 21 nt, Shigella flexneri 2a str. 2457T
ugaugccgauuguauacgcug

SEQ ID NO: 3880665 - RNA, 14 nt, Shigella flexneri 2a str. 2457T
ugaugccgugcagc

SEQ ID NO: 3880666 - RNA, 15 nt, Shigella flexneri 2a str. 2457T
ugaugccguuuaugc

SEQ ID NO: 3880667 - RNA, 15 nt, Shigella flexneri 2a str. 2457T
ugaugcgacgcuggc

SEQ ID NO: 3880668 - RNA, 14 nt, Shigella flexneri 2a str. 2457T
ugaugcgacuuguc

SEQ ID NO: 3880669 - RNA, 17 nt, Shigella flexneri 2a str. 2457T
ugaugcgaugcuugacg

SEQ ID NO: 3880670 - RNA, 12 nt, Shigella flexneri 2a str. 2457T
ugaugcguaccu

SEQ ID NO: 3880671 - RNA, 22 nt, Shigella flexneri 2a str. 2457T
ugaugcgugagguaacaauaaa

SEQ ID NO: 3880672 - RNA, 20 nt, Shigella flexneri 2a str. 2457T
ugaugcguugcgcuucucag

SEQ ID NO: 3880673 - RNA, 17 nt, Shigella flexneri 2a str. 2457T
ugauggaauuucaucau

SEQ ID NO: 3880674 - RNA, 21 nt, Shigella flexneri 2a str. 2457T
ugauggcauucucacuccagc

SEQ ID NO: 3880675 - RNA, 16 nt, Shigella flexneri 2a str. 2457T
ugauggcccguuuuag

SEQ ID NO: 3880676 - RNA, 14 nt, Shigella flexneri 2a str. 2457T
ugauggcuggcuuc

SEQ ID NO: 3880677 - RNA, 16 nt, Shigella flexneri 2a str. 2457T
ugaugggcagaauaac

SEQ ID NO: 3880678 - RNA, 19 nt, Shigella flexneri 2a str. 2457T
ugaugguaaaauaucacuc

SEQ ID NO: 3880679 - RNA, 21 nt, Shigella flexneri 2a str. 2457T
ugaugguaacgcgccaggauc

SEQ ID NO: 3880680 - RNA, 20 nt, Shigella flexneri 2a str. 2457T
ugaugucagcacuuccagcu

SEQ ID NO: 3880681 - RNA, 22 nt, Shigella flexneri 2a str. 2457T
ugaugucagcacuuccagcucc

SEQ ID NO: 3880682 - RNA, 19 nt, Shigella flexneri 2a str. 2457T
ugaugucggcauaaagcug

SEQ ID NO: 3880683 - RNA, 21 nt, Shigella flexneri 2a str. 2457T
ugaugucguguuaauuaccua

SEQ ID NO: 3880684 - RNA, 16 nt, Shigella flexneri 2a str. 2457T
ugaugucucuguuuug

SEQ ID NO: 3880685 - RNA, 21 nt, Shigella flexneri 2a str. 2457T
ugaugugacgcugucuuauca

SEQ ID NO: 3880686 - RNA, 15 nt, Shigella flexneri 2a str. 2457T
ugaugugauccauca

SEQ ID NO: 3880687 - RNA, 16 nt, Shigella flexneri 2a str. 2457T
ugaugugcuucaucag

SEQ ID NO: 3880688 - RNA, 20 nt, Shigella flexneri 2a str. 2457T
ugauguuugagcuaagccgu

SEQ ID NO: 3880689 - RNA, 13 nt, Shigella flexneri 2a str. 2457T
ugauuaaagaaaa

SEQ ID NO: 3880690 - RNA, 16 nt, Shigella flexneri 2a str. 2457T
ugauuaaagcaucugc

SEQ ID NO: 3880691 - RNA, 14 nt, Shigella flexneri 2a str. 2457T
ugauuaacgccaga

SEQ ID NO: 3880692 - RNA, 19 nt, Shigella flexneri 2a str. 2457T
ugauuaacgcuuguaaaug

SEQ ID NO: 3880693 - RNA, 20 nt, Shigella flexneri 2a str. 2457T
ugauuaacgcuuguaaauga

SEQ ID NO: 3880694 - RNA, 21 nt, Shigella flexneri 2a str. 2457T
ugauuaacgcuuguaaaugaa

SEQ ID NO: 3880695 - RNA, 20 nt, Shigella flexneri 2a str. 2457T
ugauuaacuguucugaaaac

SEQ ID NO: 3880696 - RNA, 20 nt, Shigella flexneri 2a str. 2457T
ugauuaccaauaucaaauaa

SEQ ID NO: 3880697 - RNA, 18 nt, Shigella flexneri 2a str. 2457T
ugauuacgguauugcuau

SEQ ID NO: 3880698 - RNA, 13 nt, Shigella flexneri 2a str. 2457T
ugauuacuaaaug

SEQ ID NO: 3880699 - RNA, 23 nt, Shigella flexneri 2a str. 2457T
ugauuacuuccuucauggggaug

SEQ ID NO: 3880700 - RNA, 22 nt, Shigella flexneri 2a str. 2457T
ugauuauuggacgguaaaaaga

SEQ ID NO: 3880701 - RNA, 11 nt, Shigella flexneri 2a str. 2457T
ugauucacaag

SEQ ID NO: 3880702 - RNA, 14 nt, Shigella flexneri 2a str. 2457T
ugauucacaguuaa

SEQ ID NO: 3880703 - RNA, 22 nt, Shigella flexneri 2a str. 2457T
ugcacaagcgauaacucgcuuu

SEQ ID NO: 3880704 - RNA, 19 nt, Shigella flexneri 2a str. 2457T
ugcacacagggcgcuagcc

SEQ ID NO: 3880705 - RNA, 18 nt, Shigella flexneri 2a str. 2457T
ugcacaccccgcgcagcu

SEQ ID NO: 3880706 - RNA, 20 nt, Shigella flexneri 2a str. 2457T
ugcacagacuuaauauugcc

SEQ ID NO: 3880707 - RNA, 12 nt, Shigella flexneri 2a str. 2457T
ugcacaggcaac

SEQ ID NO: 3880708 - RNA, 14 nt, Shigella flexneri 2a str. 2457T
ugcacaggcaacuu

SEQ ID NO: 3880709 - RNA, 12 nt, Shigella flexneri 2a str. 2457T
ugcacaggcaau

SEQ ID NO: 3880710 - RNA, 21 nt, Shigella flexneri 2a str. 2457T
ugcacagguggcaaacgccac

SEQ ID NO: 3880711 - RNA, 16 nt, Shigella flexneri 2a str. 2457T
ugcacauauucuggag

SEQ ID NO: 3880712 - RNA, 14 nt, Shigella flexneri 2a str. 2457T
ugcacaucuaacca

SEQ ID NO: 3880713 - RNA, 19 nt, Shigella flexneri 2a str. 2457T
ugcacaucuaaccauuauu

SEQ ID NO: 3880714 - RNA, 22 nt, Shigella flexneri 2a str. 2457T
ugcacaugaugauggcuaucaa

SEQ ID NO: 3880715 - RNA, 14 nt, Shigella flexneri 2a str. 2457T
ugcacauuccagau

SEQ ID NO: 3880716 - RNA, 22 nt, Shigella flexneri 2a str. 2457T
ugcacauucccugcagucaccu

SEQ ID NO: 3880717 - RNA, 22 nt, Shigella flexneri 2a str. 2457T
ugcaccaacccuaacccaacau

SEQ ID NO: 3880718 - RNA, 16 nt, Shigella flexneri 2a str. 2457T
ugcaccagcaacaagc

SEQ ID NO: 3880719 - RNA, 19 nt, Shigella flexneri 2a str. 2457T
ugcaccagcaacaagccag

SEQ ID NO: 3880720 - RNA, 18 nt, Shigella flexneri 2a str. 2457T
ugcaccauaugagcggaa

SEQ ID NO: 3880721 - RNA, 18 nt, Shigella flexneri 2a str. 2457T
ugcaccaucaggcauauu

SEQ ID NO: 3880722 - RNA, 22 nt, Shigella flexneri 2a str. 2457T
ugcacccuuuuuuuaaauuuau

SEQ ID NO: 3880723 - RNA, 15 nt, Shigella flexneri 2a str. 2457T
ugcaccgacaauccg

SEQ ID NO: 3880724 - RNA, 14 nt, Shigella flexneri 2a str. 2457T
ugcaccgaguucuu

SEQ ID NO: 3880725 - RNA, 20 nt, Shigella flexneri 2a str. 2457T
ugcaccggcgacaucccagg

SEQ ID NO: 3880726 - RNA, 13 nt, Shigella flexneri 2a str. 2457T
ugcaccgggcuuu

SEQ ID NO: 3880727 - RNA, 16 nt, Shigella flexneri 2a str. 2457T
ugcaccucgagaucau

SEQ ID NO: 3880728 - RNA, 18 nt, Shigella flexneri 2a str. 2457T
ugcaccugauccagcucu

SEQ ID NO: 3880729 - RNA, 17 nt, Shigella flexneri 2a str. 2457T
ugcaccuuuuccaccaa

SEQ ID NO: 3880730 - RNA, 16 nt, Shigella flexneri 2a str. 2457T
ugcacgaaccagagac

SEQ ID NO: 3880731 - RNA, 23 nt, Shigella flexneri 2a str. 2457T
ugcacgaccggguuuucaaugau

SEQ ID NO: 3880732 - RNA, 16 nt, Shigella flexneri 2a str. 2457T
ugcacgaggcuggcuu

SEQ ID NO: 3880733 - RNA, 20 nt, Shigella flexneri 2a str. 2457T
ugcacgaggcuggcuuuauc

SEQ ID NO: 3880734 - RNA, 17 nt, Shigella flexneri 2a str. 2457T
ugcacgauauaccgugc

SEQ ID NO: 3880735 - RNA, 22 nt, Shigella flexneri 2a str. 2457T
ugcacgaugacugaacaggcaa

SEQ ID NO: 3880736 - RNA, 21 nt, Shigella flexneri 2a str. 2457T
ugcacgcagacacugcugaua

SEQ ID NO: 3880737 - RNA, 17 nt, Shigella flexneri 2a str. 2457T
ugcacggagauauccag

SEQ ID NO: 3880738 - RNA, 19 nt, Shigella flexneri 2a str. 2457T
ugcacggagauauccagcg

SEQ ID NO: 3880739 - RNA, 21 nt, Shigella flexneri 2a str. 2457T
ugcacggagauauccagcgcc

SEQ ID NO: 3880740 - RNA, 22 nt, Shigella flexneri 2a str. 2457T
ugcacggagauauccagcgccg

SEQ ID NO: 3880741 - RNA, 13 nt, Shigella flexneri 2a str. 2457T
ugcacgucauacu

SEQ ID NO: 3880742 - RNA, 14 nt, Shigella flexneri 2a str. 2457T
ugcacgucauacug

SEQ ID NO: 3880743 - RNA, 20 nt, Shigella flexneri 2a str. 2457T
ugcacguccgguggcauccg

SEQ ID NO: 3880744 - RNA, 17 nt, Shigella flexneri 2a str. 2457T
ugcacguuaucagacac

SEQ ID NO: 3880745 - RNA, 19 nt, Shigella flexneri 2a str. 2457T
ugcacguuccguauaccgu

SEQ ID NO: 3880746 - RNA, 17 nt, Shigella flexneri 2a str. 2457T
ugcacguuguuauccag

SEQ ID NO: 3880747 - RNA, 12 nt, Shigella flexneri 2a str. 2457T
ugcacuggcuuc

SEQ ID NO: 3880748 - RNA, 13 nt, Shigella flexneri 2a str. 2457T
ugcacugggagaa

SEQ ID NO: 3880749 - RNA, 19 nt, Shigella flexneri 2a str. 2457T
ugcacuugcuuaaaauccc

SEQ ID NO: 3880750 - RNA, 19 nt, Shigella flexneri 2a str. 2457T
ugcacuuucucgacaucca

SEQ ID NO: 3880751 - RNA, 17 nt, Shigella flexneri 2a str. 2457T
ugcacuuugucaauaau

SEQ ID NO: 3880752 - RNA, 14 nt, Shigella flexneri 2a str. 2457T
ugcacuuuucuggg

SEQ ID NO: 3880753 - RNA, 14 nt, Shigella flexneri 2a str. 2457T
ugcagaaucaaucu

SEQ ID NO: 3880754 - RNA, 14 nt, Shigella flexneri 2a str. 2457T
ugcagacaaaguga

SEQ ID NO: 3880755 - RNA, 21 nt, Shigella flexneri 2a str. 2457T
ugcagacaugacgcccggcaa

SEQ ID NO: 3880756 - RNA, 22 nt, Shigella flexneri 2a str. 2457T
ugcagacaugacgcccggcaag

SEQ ID NO: 3880757 - RNA, 18 nt, Shigella flexneri 2a str. 2457T
ugcagaccgcugacggca

SEQ ID NO: 3880758 - RNA, 22 nt, Shigella flexneri 2a str. 2457T
ugcagaccgcugacggcagcga

SEQ ID NO: 3880759 - RNA, 16 nt, Shigella flexneri 2a str. 2457T
ugcagacggcucauca

SEQ ID NO: 3880760 - RNA, 17 nt, Shigella flexneri 2a str. 2457T
ugcagauaccacaucaa

SEQ ID NO: 3880761 - RNA, 22 nt, Shigella flexneri 2a str. 2457T
ugcagaucguuuuccugcauua

SEQ ID NO: 3880762 - RNA, 14 nt, Shigella flexneri 2a str. 2457T
ugcagcaagccauc

SEQ ID NO: 3880763 - RNA, 22 nt, Shigella flexneri 2a str. 2457T
ugcagcacacauuauaggccug

SEQ ID NO: 3880764 - RNA, 20 nt, Shigella flexneri 2a str. 2457T
ugcagcacggagagacguug

SEQ ID NO: 3880765 - RNA, 16 nt, Shigella flexneri 2a str. 2457T
ugcagcagcuguuucu

SEQ ID NO: 3880766 - RNA, 21 nt, Shigella flexneri 2a str. 2457T
ugcagcagcuguuucugcuuu

SEQ ID NO: 3880767 - RNA, 20 nt, Shigella flexneri 2a str. 2457T
ugcagcaguauuaacgccau

SEQ ID NO: 3880768 - RNA, 14 nt, Shigella flexneri 2a str. 2457T
ugcagcaugcaccc

SEQ ID NO: 3880769 - RNA, 14 nt, Shigella flexneri 2a str. 2457T
ugcagccaggguca

SEQ ID NO: 3880770 - RNA, 14 nt, Shigella flexneri 2a str. 2457T
ugcagcgccuguua

SEQ ID NO: 3880771 - RNA, 16 nt, Shigella flexneri 2a str. 2457T
ugcagcgguaauuccg

SEQ ID NO: 3880772 - RNA, 21 nt, Shigella flexneri 2a str. 2457T
ugcagcggucacauguuccag

SEQ ID NO: 3880773 - RNA, 18 nt, Shigella flexneri 2a str. 2457T
ugcagcguaaaccccuua

SEQ ID NO: 3880774 - RNA, 13 nt, Shigella flexneri 2a str. 2457T
ugcagcguuucca

SEQ ID NO: 3880775 - RNA, 14 nt, Shigella flexneri 2a str. 2457T
ugcagcguuuccag

SEQ ID NO: 3880776 - RNA, 21 nt, Shigella flexneri 2a str. 2457T
ugcagcucaucuaaugcaggg

SEQ ID NO: 3880777 - RNA, 19 nt, Shigella flexneri 2a str. 2457T
ugcagcucuugcagcagcu

SEQ ID NO: 3880778 - RNA, 22 nt, Shigella flexneri 2a str. 2457T
ugcaggaaaagguaggccugau

SEQ ID NO: 3880779 - RNA, 16 nt, Shigella flexneri 2a str. 2457T
ugcaggaacagaaugg

SEQ ID NO: 3880780 - RNA, 21 nt, Shigella flexneri 2a str. 2457T
ugcaggaagguuuuaaucgcu

SEQ ID NO: 3880781 - RNA, 17 nt, Shigella flexneri 2a str. 2457T
ugcaggacuuaaccguu

SEQ ID NO: 3880782 - RNA, 20 nt, Shigella flexneri 2a str. 2457T
ugcaggccagauaaggcguu

SEQ ID NO: 3880783 - RNA, 17 nt, Shigella flexneri 2a str. 2457T
ugcaggccugauaagcg

SEQ ID NO: 3880784 - RNA, 18 nt, Shigella flexneri 2a str. 2457T
ugcagggcuuucacgccg

SEQ ID NO: 3880785 - RNA, 14 nt, Shigella flexneri 2a str. 2457T
ugcaggucguccug

SEQ ID NO: 3880786 - RNA, 14 nt, Shigella flexneri 2a str. 2457T
ugcagguucgacug

SEQ ID NO: 3880787 - RNA, 23 nt, Shigella flexneri 2a str. 2457T
ugcaguacaucguagugaugcca

SEQ ID NO: 3880788 - RNA, 17 nt, Shigella flexneri 2a str. 2457T
ugcagucauaaccaguc

SEQ ID NO: 3880789 - RNA, 19 nt, Shigella flexneri 2a str. 2457T
ugcagugcauccagcagcc

SEQ ID NO: 3880790 - RNA, 15 nt, Shigella flexneri 2a str. 2457T
ugcaguuaaaauagg

SEQ ID NO: 3880791 - RNA, 15 nt, Shigella flexneri 2a str. 2457T
ugcaguuccugcaac

SEQ ID NO: 3880792 - RNA, 17 nt, Shigella flexneri 2a str. 2457T
ugcaguuccugcaacuu

SEQ ID NO: 3880793 - RNA, 21 nt, Shigella flexneri 2a str. 2457T
ugcauaaacgccgucaucaca

SEQ ID NO: 3880794 - RNA, 14 nt, Shigella flexneri 2a str. 2457T
ugcauaauccugcc

SEQ ID NO: 3880795 - RNA, 23 nt, Shigella flexneri 2a str. 2457T
ugcauaaucgcaacgccuuccgu

SEQ ID NO: 3880796 - RNA, 18 nt, Shigella flexneri 2a str. 2457T
ugcauagcagcacaccac

SEQ ID NO: 3880797 - RNA, 16 nt, Shigella flexneri 2a str. 2457T
ugcauagcgauaagaa

SEQ ID NO: 3880798 - RNA, 13 nt, Shigella flexneri 2a str. 2457T
ugcauaggcggca

SEQ ID NO: 3880799 - RNA, 15 nt, Shigella flexneri 2a str. 2457T
ugcauauaaucgauc

SEQ ID NO: 3880800 - RNA, 18 nt, Shigella flexneri 2a str. 2457T
ugccaggaauauucaccg

SEQ ID NO: 3880801 - RNA, 23 nt, Shigella flexneri 2a str. 2457T
ugccaggcuggcagaugcgucuu

SEQ ID NO: 3880802 - RNA, 20 nt, Shigella flexneri 2a str. 2457T
ugccagggcuuuuuuauuuc

SEQ ID NO: 3880803 - RNA, 21 nt, Shigella flexneri 2a str. 2457T
ugccagguaaacaccuucauc

SEQ ID NO: 3880804 - RNA, 20 nt, Shigella flexneri 2a str. 2457T
ugccagguagucacgguagu

SEQ ID NO: 3880805 - RNA, 22 nt, Shigella flexneri 2a str. 2457T
ugccaggucaucauugcaguca

SEQ ID NO: 3880806 - RNA, 19 nt, Shigella flexneri 2a str. 2457T
ugccaguaauccggcuucc

SEQ ID NO: 3880807 - RNA, 15 nt, Shigella flexneri 2a str. 2457T
ugccagucagcucca

SEQ ID NO: 3880808 - RNA, 14 nt, Shigella flexneri 2a str. 2457T
ugccagucuggcuu

SEQ ID NO: 3880809 - RNA, 16 nt, Shigella flexneri 2a str. 2457T
ugccagugaaaguuuu

SEQ ID NO: 3880810 - RNA, 19 nt, Shigella flexneri 2a str. 2457T
ugccagugccguuccagcc

SEQ ID NO: 3880811 - RNA, 13 nt, Shigella flexneri 2a str. 2457T
ugccaguuuuucc

SEQ ID NO: 3880812 - RNA, 21 nt, Shigella flexneri 2a str. 2457T
ugccauaaccugugcaccaga

SEQ ID NO: 3880813 - RNA, 23 nt, Shigella flexneri 2a str. 2457T
ugccauauucgcuuucagcgagu

SEQ ID NO: 3880814 - RNA, 17 nt, Shigella flexneri 2a str. 2457T
ugccaucaacuucucgc

SEQ ID NO: 3880815 - RNA, 16 nt, Shigella flexneri 2a str. 2457T
ugccaucagcgccuga

SEQ ID NO: 3880816 - RNA, 19 nt, Shigella flexneri 2a str. 2457T
ugccaucauaaaucggaaa

SEQ ID NO: 3880817 - RNA, 22 nt, Shigella flexneri 2a str. 2457T
ugccaucauacagccggcaaua

SEQ ID NO: 3880818 - RNA, 14 nt, Shigella flexneri 2a str. 2457T
ugccauccagcuuu

SEQ ID NO: 3880819 - RNA, 17 nt, Shigella flexneri 2a str. 2457T
ugccauccguaauuuuu

SEQ ID NO: 3880820 - RNA, 18 nt, Shigella flexneri 2a str. 2457T
ugccaucugccagcaagc

SEQ ID NO: 3880821 - RNA, 13 nt, Shigella flexneri 2a str. 2457T
ugccaugcauauc

SEQ ID NO: 3880822 - RNA, 22 nt, Shigella flexneri 2a str. 2457T
ugccaugguuuggaucuguugc

SEQ ID NO: 3880823 - RNA, 16 nt, Shigella flexneri 2a str. 2457T
ugccauguucaucaag

SEQ ID NO: 3880824 - RNA, 15 nt, Shigella flexneri 2a str. 2457T
ugccauuaaaccaac

SEQ ID NO: 3880825 - RNA, 21 nt, Shigella flexneri 2a str. 2457T
ugccauuaacaggccaaaugc

SEQ ID NO: 3880826 - RNA, 17 nt, Shigella flexneri 2a str. 2457T
ugccauuucugcugcca

SEQ ID NO: 3880827 - RNA, 24 nt, Shigella flexneri 2a str. 2457T
ugccauuucuggcgucaaagcugc

SEQ ID NO: 3880828 - RNA, 16 nt, Shigella flexneri 2a str. 2457T
ugccauuugccagacu

SEQ ID NO: 3880829 - RNA, 21 nt, Shigella flexneri 2a str. 2457T
ugcccaacaggcgcuggucag

SEQ ID NO: 3880830 - RNA, 14 nt, Shigella flexneri 2a str. 2457T
ugcccaacauacug

SEQ ID NO: 3880831 - RNA, 13 nt, Shigella flexneri 2a str. 2457T
ugcccaacugccu

SEQ ID NO: 3880832 - RNA, 17 nt, Shigella flexneri 2a str. 2457T
ugcccaacugccugaug

SEQ ID NO: 3880833 - RNA, 17 nt, Shigella flexneri 2a str. 2457T
ugcccacgcgcacgcug

SEQ ID NO: 3880834 - RNA, 15 nt, Shigella flexneri 2a str. 2457T
ugcccagaaaccagu

SEQ ID NO: 3880835 - RNA, 22 nt, Shigella flexneri 2a str. 2457T
ugcccagcucaaucaacuccau

SEQ ID NO: 3880836 - RNA, 19 nt, Shigella flexneri 2a str. 2457T
ugcccaggugugucucaag

SEQ ID NO: 3880837 - RNA, 15 nt, Shigella flexneri 2a str. 2457T
ugcccagugaccaaa

SEQ ID NO: 3880838 - RNA, 13 nt, Shigella flexneri 2a str. 2457T
ugcccaugcgcuc

SEQ ID NO: 3880839 - RNA, 19 nt, Shigella flexneri 2a str. 2457T
ugcccaugcgcucgacgau

SEQ ID NO: 3880840 - RNA, 12 nt, Shigella flexneri 2a str. 2457T
ugcccaugcuuc

SEQ ID NO: 3880841 - RNA, 13 nt, Shigella flexneri 2a str. 2457T
ugcccauggcaag

SEQ ID NO: 3880842 - RNA, 16 nt, Shigella flexneri 2a str. 2457T
ugcccauggcaagaau

SEQ ID NO: 3880843 - RNA, 14 nt, Shigella flexneri 2a str. 2457T
ugccccagugggcu

SEQ ID NO: 3880844 - RNA, 14 nt, Shigella flexneri 2a str. 2457T
ugccccauauggcc

SEQ ID NO: 3880845 - RNA, 18 nt, Shigella flexneri 2a str. 2457T
ugccccauugcugaugca

SEQ ID NO: 3880846 - RNA, 19 nt, Shigella flexneri 2a str. 2457T
ugcccccgcucuuccaggc

SEQ ID NO: 3880847 - RNA, 15 nt, Shigella flexneri 2a str. 2457T
ugccccugaauaauc

SEQ ID NO: 3880848 - RNA, 13 nt, Shigella flexneri 2a str. 2457T
ugcccgaagccaa

SEQ ID NO: 3880849 - RNA, 14 nt, Shigella flexneri 2a str. 2457T
ugcccgaagccaau

SEQ ID NO: 3880850 - RNA, 16 nt, Shigella flexneri 2a str. 2457T
ugcccgaccacuucau

SEQ ID NO: 3880851 - RNA, 22 nt, Shigella flexneri 2a str. 2457T
ugcccgagauacaucaccgcca

SEQ ID NO: 3880852 - RNA, 19 nt, Shigella flexneri 2a str. 2457T
ugcccgagcgccauuucuu

SEQ ID NO: 3880853 - RNA, 19 nt, Shigella flexneri 2a str. 2457T
ugcccgaugcgcaaacuua

SEQ ID NO: 3880854 - RNA, 14 nt, Shigella flexneri 2a str. 2457T
ugcccgcagaucca

SEQ ID NO: 3880855 - RNA, 17 nt, Shigella flexneri 2a str. 2457T
ugcccgccaaccguggc

SEQ ID NO: 3880856 - RNA, 16 nt, Shigella flexneri 2a str. 2457T
ugcccgccgugcugcc

SEQ ID NO: 3880857 - RNA, 16 nt, Shigella flexneri 2a str. 2457T
ugcccgcgauccagcg

SEQ ID NO: 3880858 - RNA, 17 nt, Shigella flexneri 2a str. 2457T
ugcccgcuuaacguacu

SEQ ID NO: 3880859 - RNA, 21 nt, Shigella flexneri 2a str. 2457T
ugcccggaaguaccaauggca

SEQ ID NO: 3880860 - RNA, 16 nt, Shigella flexneri 2a str. 2457T
ugcccggagcagcagu

SEQ ID NO: 3880861 - RNA, 18 nt, Shigella flexneri 2a str. 2457T
ugcccggcaaaauagagu

SEQ ID NO: 3880862 - RNA, 22 nt, Shigella flexneri 2a str. 2457T
ugcccggcugcgcgacuucauu

SEQ ID NO: 3880863 - RNA, 17 nt, Shigella flexneri 2a str. 2457T
ugcccgggucagcgcca

SEQ ID NO: 3880864 - RNA, 15 nt, Shigella flexneri 2a str. 2457T
ugcccggucaggaug

SEQ ID NO: 3880865 - RNA, 18 nt, Shigella flexneri 2a str. 2457T
ugcccggucgggugcuca

SEQ ID NO: 3880866 - RNA, 23 nt, Shigella flexneri 2a str. 2457T
ugcccguaaaaaauggcuggcua

SEQ ID NO: 3880867 - RNA, 14 nt, Shigella flexneri 2a str. 2457T
ugcccgugaugcaa

SEQ ID NO: 3880868 - RNA, 16 nt, Shigella flexneri 2a str. 2457T
ugcccguuaaccauaa

SEQ ID NO: 3880869 - RNA, 14 nt, Shigella flexneri 2a str. 2457T
ugcccucugaauaa

SEQ ID NO: 3880870 - RNA, 16 nt, Shigella flexneri 2a str. 2457T
ugcccugcugguuagc

SEQ ID NO: 3880871 - RNA, 12 nt, Shigella flexneri 2a str. 2457T
ugcccuuucaac

SEQ ID NO: 3880872 - RNA, 19 nt, Shigella flexneri 2a str. 2457T
ugcccuuuucaccaugggc

SEQ ID NO: 3880873 - RNA, 12 nt, Shigella flexneri 2a str. 2457T
ugccgaaaaaag

SEQ ID NO: 3880874 - RNA, 14 nt, Shigella flexneri 2a str. 2457T
ugccgaaaugucuu

SEQ ID NO: 3880875 - RNA, 22 nt, Shigella flexneri 2a str. 2457T
ugccgaacguaggcuggauaag

SEQ ID NO: 3880876 - RNA, 22 nt, Shigella flexneri 2a str. 2457T
ugccgaagccuguaaagucauc

SEQ ID NO: 3880877 - RNA, 23 nt, Shigella flexneri 2a str. 2457T
ugccgaauaaagcauucacgccg

SEQ ID NO: 3880878 - RNA, 16 nt, Shigella flexneri 2a str. 2457T
ugccgacaaaugcagu

SEQ ID NO: 3880879 - RNA, 17 nt, Shigella flexneri 2a str. 2457T
ugccgaccaucuguucu

SEQ ID NO: 3880880 - RNA, 17 nt, Shigella flexneri 2a str. 2457T
ugccgagaguaacacau

SEQ ID NO: 3880881 - RNA, 14 nt, Shigella flexneri 2a str. 2457T
ugccgagauacagg

SEQ ID NO: 3880882 - RNA, 14 nt, Shigella flexneri 2a str. 2457T
ugccgauaaauaca

SEQ ID NO: 3880883 - RNA, 16 nt, Shigella flexneri 2a str. 2457T
ugccgauaaauacagc

SEQ ID NO: 3880884 - RNA, 18 nt, Shigella flexneri 2a str. 2457T
ugccgaucaauuucacag

SEQ ID NO: 3880885 - RNA, 23 nt, Shigella flexneri 2a str. 2457T
ugccgaugaacggcggcggcgcg

SEQ ID NO: 3880886 - RNA, 16 nt, Shigella flexneri 2a str. 2457T
ugccgaugauucccag

SEQ ID NO: 3880887 - RNA, 13 nt, Shigella flexneri 2a str. 2457T
ugccgauggucac

SEQ ID NO: 3880888 - RNA, 17 nt, Shigella flexneri 2a str. 2457T
ugccgauuacguaauuc

SEQ ID NO: 3880889 - RNA, 20 nt, Shigella flexneri 2a str. 2457T
ugccgcaauugucuguuugc

SEQ ID NO: 3880890 - RNA, 13 nt, Shigella flexneri 2a str. 2457T
ugccgcagaagau

SEQ ID NO: 3880891 - RNA, 20 nt, Shigella flexneri 2a str. 2457T
ugccgcagaagaucagaaau

SEQ ID NO: 3880892 - RNA, 22 nt, Shigella flexneri 2a str. 2457T
ugccgcagccccagagccugaa

SEQ ID NO: 3880893 - RNA, 13 nt, Shigella flexneri 2a str. 2457T
ugccgcagcuucu

SEQ ID NO: 3880894 - RNA, 16 nt, Shigella flexneri 2a str. 2457T
ugccgcauccugcacc

SEQ ID NO: 3880895 - RNA, 20 nt, Shigella flexneri 2a str. 2457T
ugccgcauggaaccaguuca

SEQ ID NO: 3880896 - RNA, 21 nt, Shigella flexneri 2a str. 2457T
ugccgcauuucgugcggguaa

SEQ ID NO: 3880897 - RNA, 15 nt, Shigella flexneri 2a str. 2457T
ugcgaauacacccug

SEQ ID NO: 3880898 - RNA, 21 nt, Shigella flexneri 2a str. 2457T
ugcgacaaacauugcugccag

SEQ ID NO: 3880899 - RNA, 16 nt, Shigella flexneri 2a str. 2457T
ugcgacagauucgcgg

SEQ ID NO: 3880900 - RNA, 16 nt, Shigella flexneri 2a str. 2457T
ugcgacaggagccgca

SEQ ID NO: 3880901 - RNA, 21 nt, Shigella flexneri 2a str. 2457T
ugcgacagggaucucuuccag

SEQ ID NO: 3880902 - RNA, 14 nt, Shigella flexneri 2a str. 2457T
ugcgacaucaucag

SEQ ID NO: 3880903 - RNA, 16 nt, Shigella flexneri 2a str. 2457T
ugcgacaucaucagcg

SEQ ID NO: 3880904 - RNA, 14 nt, Shigella flexneri 2a str. 2457T
ugcgaccaaacugc

SEQ ID NO: 3880905 - RNA, 12 nt, Shigella flexneri 2a str. 2457T
ugcgaccgcucu

SEQ ID NO: 3880906 - RNA, 21 nt, Shigella flexneri 2a str. 2457T
ugcgaccggcguaacggccac

SEQ ID NO: 3880907 - RNA, 19 nt, Shigella flexneri 2a str. 2457T
ugcgacgcaacgcgcguga

SEQ ID NO: 3880908 - RNA, 23 nt, Shigella flexneri 2a str. 2457T
ugcgacgcuuacgcgucuuauca

SEQ ID NO: 3880909 - RNA, 16 nt, Shigella flexneri 2a str. 2457T
ugcgacgcuugacgcg

SEQ ID NO: 3880910 - RNA, 16 nt, Shigella flexneri 2a str. 2457T
ugcgacgcuugccgcg

SEQ ID NO: 3880911 - RNA, 18 nt, Shigella flexneri 2a str. 2457T
ugcgagaaguucugcagc

SEQ ID NO: 3880912 - RNA, 15 nt, Shigella flexneri 2a str. 2457T
ugcgagcgccuuauc

SEQ ID NO: 3880913 - RNA, 21 nt, Shigella flexneri 2a str. 2457T
ugcgagguuauccgccagcgc

SEQ ID NO: 3880914 - RNA, 19 nt, Shigella flexneri 2a str. 2457T
ugcgauaaagcauaccgug

SEQ ID NO: 3880915 - RNA, 15 nt, Shigella flexneri 2a str. 2457T
ugcgauauucuucag

SEQ ID NO: 3880916 - RNA, 16 nt, Shigella flexneri 2a str. 2457T
ugcgaucgcaaaucca

SEQ ID NO: 3880917 - RNA, 18 nt, Shigella flexneri 2a str. 2457T
ugcgaugcugacgcaucu

SEQ ID NO: 3880918 - RNA, 16 nt, Shigella flexneri 2a str. 2457T
ugcgaugcuggcggcg

SEQ ID NO: 3880919 - RNA, 14 nt, Shigella flexneri 2a str. 2457T
ugcgauggauuauc

SEQ ID NO: 3880920 - RNA, 15 nt, Shigella flexneri 2a str. 2457T
ugcgauguucuucac

SEQ ID NO: 3880921 - RNA, 17 nt, Shigella flexneri 2a str. 2457T
ugcgcaaacuucuucag

SEQ ID NO: 3880922 - RNA, 11 nt, Shigella flexneri 2a str. 2457T
ugcgcaauaac

SEQ ID NO: 3880923 - RNA, 12 nt, Shigella flexneri 2a str. 2457T
ugcgcaauuaaa

SEQ ID NO: 3880924 - RNA, 15 nt, Shigella flexneri 2a str. 2457T
ugcgcagauuagccg

SEQ ID NO: 3880925 - RNA, 14 nt, Shigella flexneri 2a str. 2457T
ugcgcaucaaagcc

SEQ ID NO: 3880926 - RNA, 15 nt, Shigella flexneri 2a str. 2457T
ugcgcaucaaagcca

SEQ ID NO: 3880927 - RNA, 14 nt, Shigella flexneri 2a str. 2457T
ugcgcaucaugcca

SEQ ID NO: 3880928 - RNA, 20 nt, Shigella flexneri 2a str. 2457T
ugcgcauuucccagcaagaa

SEQ ID NO: 3880929 - RNA, 12 nt, Shigella flexneri 2a str. 2457T
ugcgccaauacc

SEQ ID NO: 3880930 - RNA, 18 nt, Shigella flexneri 2a str. 2457T
ugcgccacaaccguccuc

SEQ ID NO: 3880931 - RNA, 17 nt, Shigella flexneri 2a str. 2457T
ugcgccacaggucagca

SEQ ID NO: 3880932 - RNA, 19 nt, Shigella flexneri 2a str. 2457T
ugcgccacaggucagcagg

SEQ ID NO: 3880933 - RNA, 12 nt, Shigella flexneri 2a str. 2457T
ugcgccacaucc

SEQ ID NO: 3880934 - RNA, 18 nt, Shigella flexneri 2a str. 2457T
ugcgccacauccggcaua

SEQ ID NO: 3880935 - RNA, 16 nt, Shigella flexneri 2a str. 2457T
ugcgccacgcagcgau

SEQ ID NO: 3880936 - RNA, 13 nt, Shigella flexneri 2a str. 2457T
ugcgccagcaucc

SEQ ID NO: 3880937 - RNA, 21 nt, Shigella flexneri 2a str. 2457T
ugcgccaggauaagcgccgcu

SEQ ID NO: 3880938 - RNA, 22 nt, Shigella flexneri 2a str. 2457T
ugcgccauaccaugcaccaacc

SEQ ID NO: 3880939 - RNA, 15 nt, Shigella flexneri 2a str. 2457T
ugcgccauauaagca

SEQ ID NO: 3880940 - RNA, 15 nt, Shigella flexneri 2a str. 2457T
ugcgccaucaaugcc

SEQ ID NO: 3880941 - RNA, 21 nt, Shigella flexneri 2a str. 2457T
ugcgccaucgccacaccagua

SEQ ID NO: 3880942 - RNA, 16 nt, Shigella flexneri 2a str. 2457T
ugcgccaugcuucaau

SEQ ID NO: 3880943 - RNA, 12 nt, Shigella flexneri 2a str. 2457T
ugcgcccagcgu

SEQ ID NO: 3880944 - RNA, 11 nt, Shigella flexneri 2a str. 2457T
ugcgcccaguu

SEQ ID NO: 3880945 - RNA, 16 nt, Shigella flexneri 2a str. 2457T
ugcgcccaucaucauc

SEQ ID NO: 3880946 - RNA, 21 nt, Shigella flexneri 2a str. 2457T
ugcgccccacaccaccaugcu

SEQ ID NO: 3880947 - RNA, 18 nt, Shigella flexneri 2a str. 2457T
ugcgcccccgauccagcg

SEQ ID NO: 3880948 - RNA, 20 nt, Shigella flexneri 2a str. 2457T
ugcgcccccgauccagcggu

SEQ ID NO: 3880949 - RNA, 23 nt, Shigella flexneri 2a str. 2457T
ugcgcccgaaugcgaaaauccuc

SEQ ID NO: 3880950 - RNA, 21 nt, Shigella flexneri 2a str. 2457T
ugcgcccugggcuucauccag

SEQ ID NO: 3880951 - RNA, 14 nt, Shigella flexneri 2a str. 2457T
ugcgcccuguucug

SEQ ID NO: 3880952 - RNA, 17 nt, Shigella flexneri 2a str. 2457T
ugcgccgaaaucgcauc

SEQ ID NO: 3880953 - RNA, 17 nt, Shigella flexneri 2a str. 2457T
ugcgccuggauuuucuc

SEQ ID NO: 3880954 - RNA, 19 nt, Shigella flexneri 2a str. 2457T
ugcgccuguucccuucuca

SEQ ID NO: 3880955 - RNA, 21 nt, Shigella flexneri 2a str. 2457T
ugcgcgaccaacugcaaggcc

SEQ ID NO: 3880956 - RNA, 14 nt, Shigella flexneri 2a str. 2457T
ugcgcgaccacgau

SEQ ID NO: 3880957 - RNA, 17 nt, Shigella flexneri 2a str. 2457T
ugcgcgacucccugacu

SEQ ID NO: 3880958 - RNA, 13 nt, Shigella flexneri 2a str. 2457T
ugcgcggcuccag

SEQ ID NO: 3880959 - RNA, 17 nt, Shigella flexneri 2a str. 2457T
ugcgcuaaacaggaucu

SEQ ID NO: 3880960 - RNA, 16 nt, Shigella flexneri 2a str. 2457T
ugcgcuaaauguuuag

SEQ ID NO: 3880961 - RNA, 21 nt, Shigella flexneri 2a str. 2457T
ugcgcuacgcucaucaggccu

SEQ ID NO: 3880962 - RNA, 21 nt, Shigella flexneri 2a str. 2457T
ugcgcuacgcuuaucaggccu

SEQ ID NO: 3880963 - RNA, 18 nt, Shigella flexneri 2a str. 2457T
ugcgcuauaucgcugaua

SEQ ID NO: 3880964 - RNA, 22 nt, Shigella flexneri 2a str. 2457T
ugcgcuccgcuuaucaggccua

SEQ ID NO: 3880965 - RNA, 21 nt, Shigella flexneri 2a str. 2457T
ugcgcucuucaacuucagcag

SEQ ID NO: 3880966 - RNA, 12 nt, Shigella flexneri 2a str. 2457T
ugcgcucuuccg

SEQ ID NO: 3880967 - RNA, 17 nt, Shigella flexneri 2a str. 2457T
ugcgcucuucgaggccg

SEQ ID NO: 3880968 - RNA, 16 nt, Shigella flexneri 2a str. 2457T
ugcgcugacucuacug

SEQ ID NO: 3880969 - RNA, 22 nt, Shigella flexneri 2a str. 2457T
ugcgcugcuuguuccacuucau

SEQ ID NO: 3880970 - RNA, 15 nt, Shigella flexneri 2a str. 2457T
ugcgcugggcaacaa

SEQ ID NO: 3880971 - RNA, 16 nt, Shigella flexneri 2a str. 2457T
ugcgcuuauccggccc

SEQ ID NO: 3880972 - RNA, 12 nt, Shigella flexneri 2a str. 2457T
ugcgcuuccagc

SEQ ID NO: 3880973 - RNA, 21 nt, Shigella flexneri 2a str. 2457T
ugcgcuuccagcuccauccac

SEQ ID NO: 3880974 - RNA, 24 nt, Shigella flexneri 2a str. 2457T
ugcgcuuccugcaacgagugcauc

SEQ ID NO: 3880975 - RNA, 14 nt, Shigella flexneri 2a str. 2457T
ugcgcuuccugcag

SEQ ID NO: 3880976 - RNA, 18 nt, Shigella flexneri 2a str. 2457T
ugcgcuuccugcagcuuc

SEQ ID NO: 3880977 - RNA, 19 nt, Shigella flexneri 2a str. 2457T
ugcgcuuccugcagcuuca

SEQ ID NO: 3880978 - RNA, 15 nt, Shigella flexneri 2a str. 2457T
ugcgcuucgcuuauc

SEQ ID NO: 3880979 - RNA, 22 nt, Shigella flexneri 2a str. 2457T
ugcgcuucucgcucgcuaucau

SEQ ID NO: 3880980 - RNA, 17 nt, Shigella flexneri 2a str. 2457T
ugcgcuuuaucgccgcu

SEQ ID NO: 3880981 - RNA, 15 nt, Shigella flexneri 2a str. 2457T
ugcgcuuucuuaaau

SEQ ID NO: 3880982 - RNA, 19 nt, Shigella flexneri 2a str. 2457T
ugcggaaagcuugcgucgc

SEQ ID NO: 3880983 - RNA, 14 nt, Shigella flexneri 2a str. 2457T
ugcggaaauuccag

SEQ ID NO: 3880984 - RNA, 17 nt, Shigella flexneri 2a str. 2457T
ugcggaaauuccagcgg

SEQ ID NO: 3880985 - RNA, 17 nt, Shigella flexneri 2a str. 2457T
ugcggaacccagcgcga

SEQ ID NO: 3880986 - RNA, 16 nt, Shigella flexneri 2a str. 2457T
ugcggacaaaacguga

SEQ ID NO: 3880987 - RNA, 22 nt, Shigella flexneri 2a str. 2457T
ugcggacaaaacgugacagcau

SEQ ID NO: 3880988 - RNA, 22 nt, Shigella flexneri 2a str. 2457T
ugcggacagucacguagcggcg

SEQ ID NO: 3880989 - RNA, 19 nt, Shigella flexneri 2a str. 2457T
ugcggagacucaaaccccg

SEQ ID NO: 3880990 - RNA, 18 nt, Shigella flexneri 2a str. 2457T
ugcggagguuucuuuuua

SEQ ID NO: 3880991 - RNA, 15 nt, Shigella flexneri 2a str. 2457T
ugcggauauugccgg

SEQ ID NO: 3880992 - RNA, 13 nt, Shigella flexneri 2a str. 2457T
ugcggaucugcuc

SEQ ID NO: 3880993 - RNA, 17 nt, Shigella flexneri 2a str. 2457T
ugcggauuccggagcaa

SEQ ID NO: 3880994 - RNA, 21 nt, Shigella flexneri 2a str. 2457T
ugcggauuuguaauuucagcg

SEQ ID NO: 3880995 - RNA, 16 nt, Shigella flexneri 2a str. 2457T
ugcuccagugcgcuuu

SEQ ID NO: 3880996 - RNA, 14 nt, Shigella flexneri 2a str. 2457T
ugcucccagcgcau

SEQ ID NO: 3880997 - RNA, 20 nt, Shigella flexneri 2a str. 2457T
ugcuccccagaauccaggaa

SEQ ID NO: 3880998 - RNA, 22 nt, Shigella flexneri 2a str. 2457T
ugcucccgcugcggugacgcaa

SEQ ID NO: 3880999 - RNA, 19 nt, Shigella flexneri 2a str. 2457T
ugcucccggcaaugcgccg

SEQ ID NO: 3881000 - RNA, 23 nt, Shigella flexneri 2a str. 2457T
ugcuccgccgcagccgcauuuuu

SEQ ID NO: 3881001 - RNA, 23 nt, Shigella flexneri 2a str. 2457T
ugcuccggcgcgauaucgacgac

SEQ ID NO: 3881002 - RNA, 16 nt, Shigella flexneri 2a str. 2457T
ugcuccuccuucucac

SEQ ID NO: 3881003 - RNA, 23 nt, Shigella flexneri 2a str. 2457T
ugcucgacagcgcuaauacgaug

SEQ ID NO: 3881004 - RNA, 20 nt, Shigella flexneri 2a str. 2457T
ugcucgccacgucacucuuu

SEQ ID NO: 3881005 - RNA, 12 nt, Shigella flexneri 2a str. 2457T
ugcucguacguu

SEQ ID NO: 3881006 - RNA, 22 nt, Shigella flexneri 2a str. 2457T
ugcucguuauucagccugacag

SEQ ID NO: 3881007 - RNA, 22 nt, Shigella flexneri 2a str. 2457T
ugcucucaucacuacagcgaaa

SEQ ID NO: 3881008 - RNA, 17 nt, Shigella flexneri 2a str. 2457T
ugcucucgggcaguaaa

SEQ ID NO: 3881009 - RNA, 22 nt, Shigella flexneri 2a str. 2457T
ugcucugaggcugaugacaaac

SEQ ID NO: 3881010 - RNA, 20 nt, Shigella flexneri 2a str. 2457T
ugcucuggugcggcaaaaac

SEQ ID NO: 3881011 - RNA, 13 nt, Shigella flexneri 2a str. 2457T
ugcucuucuuuca

SEQ ID NO: 3881012 - RNA, 14 nt, Shigella flexneri 2a str. 2457T
ugcucuucuuucau

SEQ ID NO: 3881013 - RNA, 12 nt, Shigella flexneri 2a str. 2457T
ugcucuuucagc

SEQ ID NO: 3881014 - RNA, 22 nt, Shigella flexneri 2a str. 2457T
ugcucuuuucuuuaucuauuaa

SEQ ID NO: 3881015 - RNA, 16 nt, Shigella flexneri 2a str. 2457T
ugcucuuuuugcauaa

SEQ ID NO: 3881016 - RNA, 18 nt, Shigella flexneri 2a str. 2457T
ugcugaaagggcaaauaa

SEQ ID NO: 3881017 - RNA, 19 nt, Shigella flexneri 2a str. 2457T
ugcugacauaauuggcacu

SEQ ID NO: 3881018 - RNA, 14 nt, Shigella flexneri 2a str. 2457T
ugcugaccaccagc

SEQ ID NO: 3881019 - RNA, 17 nt, Shigella flexneri 2a str. 2457T
ugcugacgcaucuucuc

SEQ ID NO: 3881020 - RNA, 15 nt, Shigella flexneri 2a str. 2457T
ugcugacggcacuac

SEQ ID NO: 3881021 - RNA, 19 nt, Shigella flexneri 2a str. 2457T
ugcugacuuugauccagcc

SEQ ID NO: 3881022 - RNA, 21 nt, Shigella flexneri 2a str. 2457T
ugcugacuuugauccagccau

SEQ ID NO: 3881023 - RNA, 21 nt, Shigella flexneri 2a str. 2457T
ugcugagcggcguaccuucag

SEQ ID NO: 3881024 - RNA, 19 nt, Shigella flexneri 2a str. 2457T
ugcugauaacgugcagcuu

SEQ ID NO: 3881025 - RNA, 23 nt, Shigella flexneri 2a str. 2457T
ugcugauacuccaugaguaacag

SEQ ID NO: 3881026 - RNA, 17 nt, Shigella flexneri 2a str. 2457T
ugcugauguucgccaga

SEQ ID NO: 3881027 - RNA, 17 nt, Shigella flexneri 2a str. 2457T
ugcugauucgucaauau

SEQ ID NO: 3881028 - RNA, 19 nt, Shigella flexneri 2a str. 2457T
ugcugcaauaaaauaucuu

SEQ ID NO: 3881029 - RNA, 16 nt, Shigella flexneri 2a str. 2457T
ugcugcaauugcggca

SEQ ID NO: 3881030 - RNA, 17 nt, Shigella flexneri 2a str. 2457T
ugcugcacgcccugaua

SEQ ID NO: 3881031 - RNA, 19 nt, Shigella flexneri 2a str. 2457T
ugcugccaaagugacacaa

SEQ ID NO: 3881032 - RNA, 15 nt, Shigella flexneri 2a str. 2457T
ugcugccaucuucuu

SEQ ID NO: 3881033 - RNA, 19 nt, Shigella flexneri 2a str. 2457T
ugcugccgacaaaugcagu

SEQ ID NO: 3881034 - RNA, 16 nt, Shigella flexneri 2a str. 2457T
ugcugccgauggcaca

SEQ ID NO: 3881035 - RNA, 20 nt, Shigella flexneri 2a str. 2457T
ugcugcgccaguugcuuauc

SEQ ID NO: 3881036 - RNA, 17 nt, Shigella flexneri 2a str. 2457T
ugcugcgccgagcaaua

SEQ ID NO: 3881037 - RNA, 19 nt, Shigella flexneri 2a str. 2457T
ugcugcggcggcggaaaaa

SEQ ID NO: 3881038 - RNA, 18 nt, Shigella flexneri 2a str. 2457T
ugcugcucaaaggcauua

SEQ ID NO: 3881039 - RNA, 23 nt, Shigella flexneri 2a str. 2457T
ugcugcugauccagcuuccaggc

SEQ ID NO: 3881040 - RNA, 19 nt, Shigella flexneri 2a str. 2457T
ugcugcuuuugcuucuaug

SEQ ID NO: 3881041 - RNA, 18 nt, Shigella flexneri 2a str. 2457T
ugcuggaaccacagcgcc

SEQ ID NO: 3881042 - RNA, 13 nt, Shigella flexneri 2a str. 2457T
ugcuggaagcugg

SEQ ID NO: 3881043 - RNA, 20 nt, Shigella flexneri 2a str. 2457T
ugcuggaccuuaucgaagag

SEQ ID NO: 3881044 - RNA, 20 nt, Shigella flexneri 2a str. 2457T
ugcuggacgcauugcauuuc

SEQ ID NO: 3881045 - RNA, 20 nt, Shigella flexneri 2a str. 2457T
ugcuggacucccagaacaac

SEQ ID NO: 3881046 - RNA, 19 nt, Shigella flexneri 2a str. 2457T
ugcuggaucaaggauugca

SEQ ID NO: 3881047 - RNA, 21 nt, Shigella flexneri 2a str. 2457T
ugcuggaucugcggguuaguc

SEQ ID NO: 3881048 - RNA, 12 nt, Shigella flexneri 2a str. 2457T
ugcuggaugaag

SEQ ID NO: 3881049 - RNA, 23 nt, Shigella flexneri 2a str. 2457T
ugcuggcagaagcccagcgacug

SEQ ID NO: 3881050 - RNA, 22 nt, Shigella flexneri 2a str. 2457T
ugcuggcgcaucuuauccggcc

SEQ ID NO: 3881051 - RNA, 22 nt, Shigella flexneri 2a str. 2457T
ugcuggcgcucaccauuuccgg

SEQ ID NO: 3881052 - RNA, 22 nt, Shigella flexneri 2a str. 2457T
ugcuggcugcgggaguugcucc

SEQ ID NO: 3881053 - RNA, 16 nt, Shigella flexneri 2a str. 2457T
ugcugggauaauugcg

SEQ ID NO: 3881054 - RNA, 19 nt, Shigella flexneri 2a str. 2457T
ugcugguaauccgagaauc

SEQ ID NO: 3881055 - RNA, 14 nt, Shigella flexneri 2a str. 2457T
ugcugguacuggug

SEQ ID NO: 3881056 - RNA, 15 nt, Shigella flexneri 2a str. 2457T
ugcugguacuuucac

SEQ ID NO: 3881057 - RNA, 22 nt, Shigella flexneri 2a str. 2457T
ugcugguuuuguaggccggaua

SEQ ID NO: 3881058 - RNA, 14 nt, Shigella flexneri 2a str. 2457T
ugcuguaauuucac

SEQ ID NO: 3881059 - RNA, 17 nt, Shigella flexneri 2a str. 2457T
ugcuguacauauccagu

SEQ ID NO: 3881060 - RNA, 22 nt, Shigella flexneri 2a str. 2457T
ugcuguaguuguucaacaguaa

SEQ ID NO: 3881061 - RNA, 17 nt, Shigella flexneri 2a str. 2457T
ugcugucggcaaaucaa

SEQ ID NO: 3881062 - RNA, 17 nt, Shigella flexneri 2a str. 2457T
ugcugucggcugccagc

SEQ ID NO: 3881063 - RNA, 20 nt, Shigella flexneri 2a str. 2457T
ugcugucuuuuuacucccgc

SEQ ID NO: 3881064 - RNA, 20 nt, Shigella flexneri 2a str. 2457T
ugcugugaagauggcuaacu

SEQ ID NO: 3881065 - RNA, 19 nt, Shigella flexneri 2a str. 2457T
ugcugugacagauuuugcc

SEQ ID NO: 3881066 - RNA, 21 nt, Shigella flexneri 2a str. 2457T
ugcugugcgccacagacauaa

SEQ ID NO: 3881067 - RNA, 14 nt, Shigella flexneri 2a str. 2457T
ugcugugugccgcg

SEQ ID NO: 3881068 - RNA, 16 nt, Shigella flexneri 2a str. 2457T
ugcuguguucaauauc

SEQ ID NO: 3881069 - RNA, 20 nt, Shigella flexneri 2a str. 2457T
ugcuguuaauucaggauucg

SEQ ID NO: 3881070 - RNA, 22 nt, Shigella flexneri 2a str. 2457T
ugcuguuacgccagaacagcua

SEQ ID NO: 3881071 - RNA, 18 nt, Shigella flexneri 2a str. 2457T
ugcuguuccuaucuucau

SEQ ID NO: 3881072 - RNA, 19 nt, Shigella flexneri 2a str. 2457T
ugcuguucgagcaucacau

SEQ ID NO: 3881073 - RNA, 20 nt, Shigella flexneri 2a str. 2457T
ugcuguucgguuuugcccac

SEQ ID NO: 3881074 - RNA, 16 nt, Shigella flexneri 2a str. 2457T
ugcuguucuucugcug

SEQ ID NO: 3881075 - RNA, 16 nt, Shigella flexneri 2a str. 2457T
ugcuguugcgucucga

SEQ ID NO: 3881076 - RNA, 22 nt, Shigella flexneri 2a str. 2457T
ugcuuaacauuggucagagcau

SEQ ID NO: 3881077 - RNA, 14 nt, Shigella flexneri 2a str. 2457T
ugcuuauccagcac

SEQ ID NO: 3881078 - RNA, 14 nt, Shigella flexneri 2a str. 2457T
ugcuuauccucugu

SEQ ID NO: 3881079 - RNA, 17 nt, Shigella flexneri 2a str. 2457T
ugcuucaauuuccugac

SEQ ID NO: 3881080 - RNA, 19 nt, Shigella flexneri 2a str. 2457T
ugcuucaauuuccugacgu

SEQ ID NO: 3881081 - RNA, 13 nt, Shigella flexneri 2a str. 2457T
ugcuucaccagca

SEQ ID NO: 3881082 - RNA, 16 nt, Shigella flexneri 2a str. 2457T
ugcuucaccagcagcg

SEQ ID NO: 3881083 - RNA, 22 nt, Shigella flexneri 2a str. 2457T
ugcuucagccgcacuuuuuaaa

SEQ ID NO: 3881084 - RNA, 15 nt, Shigella flexneri 2a str. 2457T
ugcuuccgccagcgg

SEQ ID NO: 3881085 - RNA, 15 nt, Shigella flexneri 2a str. 2457T
ugcuuccggcaagca

SEQ ID NO: 3881086 - RNA, 19 nt, Shigella flexneri 2a str. 2457T
ugcuuccggcaagcaaaug

SEQ ID NO: 3881087 - RNA, 19 nt, Shigella flexneri 2a str. 2457T
ugcuucguuaacgugucau

SEQ ID NO: 3881088 - RNA, 13 nt, Shigella flexneri 2a str. 2457T
ugcuucugccugg

SEQ ID NO: 3881089 - RNA, 14 nt, Shigella flexneri 2a str. 2457T
ugcuugaagggcug

SEQ ID NO: 3881090 - RNA, 12 nt, Shigella flexneri 2a str. 2457T
ugcuugaggcug

SEQ ID NO: 3881091 - RNA, 20 nt, Shigella flexneri 2a str. 2457T
ugcuugccggaagcaaaaua

SEQ ID NO: 3881092 - RNA, 20 nt, Shigella flexneri 2a str. 2457T
uggcaacuaacugacuuccg

SEQ ID NO: 3881093 - RNA, 10 nt, Shigella flexneri 2a str. 2457T
uggcaagcag

SEQ ID NO: 3881094 - RNA, 20 nt, Shigella flexneri 2a str. 2457T
uggcaauacgauccugagca

SEQ ID NO: 3881095 - RNA, 21 nt, Shigella flexneri 2a str. 2457T
uggcaauagcuucuuccacau

SEQ ID NO: 3881096 - RNA, 19 nt, Shigella flexneri 2a str. 2457T
uggcaaucagcggcaguuc

SEQ ID NO: 3881097 - RNA, 14 nt, Shigella flexneri 2a str. 2457T
uggcaaucaguggc

SEQ ID NO: 3881098 - RNA, 16 nt, Shigella flexneri 2a str. 2457T
uggcaaucaguggcuu

SEQ ID NO: 3881099 - RNA, 18 nt, Shigella flexneri 2a str. 2457T
uggcaaucuuccucgcca

SEQ ID NO: 3881100 - RNA, 18 nt, Shigella flexneri 2a str. 2457T
uggcaauggcgacuucug

SEQ ID NO: 3881101 - RNA, 20 nt, Shigella flexneri 2a str. 2457T
uggcacaaauggcaaugacu

SEQ ID NO: 3881102 - RNA, 22 nt, Shigella flexneri 2a str. 2457T
uggcacaaucucggcgcucaau

SEQ ID NO: 3881103 - RNA, 18 nt, Shigella flexneri 2a str. 2457T
uggcacaugcauaaagcg

SEQ ID NO: 3881104 - RNA, 18 nt, Shigella flexneri 2a str. 2457T
uggcacauucugacuggg

SEQ ID NO: 3881105 - RNA, 17 nt, Shigella flexneri 2a str. 2457T
uggcaccaguaaaccaa

SEQ ID NO: 3881106 - RNA, 22 nt, Shigella flexneri 2a str. 2457T
uggcaccaucccuaugcauaau

SEQ ID NO: 3881107 - RNA, 14 nt, Shigella flexneri 2a str. 2457T
uggcacccagcgcu

SEQ ID NO: 3881108 - RNA, 16 nt, Shigella flexneri 2a str. 2457T
uggcaccguucuuuau

SEQ ID NO: 3881109 - RNA, 20 nt, Shigella flexneri 2a str. 2457T
uggcaccguucuuuauuggc

SEQ ID NO: 3881110 - RNA, 18 nt, Shigella flexneri 2a str. 2457T
uggcaccuguaccagccc

SEQ ID NO: 3881111 - RNA, 23 nt, Shigella flexneri 2a str. 2457T
uggcacgaccgccuuucacgccg

SEQ ID NO: 3881112 - RNA, 13 nt, Shigella flexneri 2a str. 2457T
uggcacugucgag

SEQ ID NO: 3881113 - RNA, 18 nt, Shigella flexneri 2a str. 2457T
uggcagcaagugcggcgc

SEQ ID NO: 3881114 - RNA, 21 nt, Shigella flexneri 2a str. 2457T
uggcagcaccgauccuggcgg

SEQ ID NO: 3881115 - RNA, 14 nt, Shigella flexneri 2a str. 2457T
uggcagccagccau

SEQ ID NO: 3881116 - RNA, 13 nt, Shigella flexneri 2a str. 2457T
uggcagccaggcg

SEQ ID NO: 3881117 - RNA, 20 nt, Shigella flexneri 2a str. 2457T
uggcagcgcgaagcuggcgg

SEQ ID NO: 3881118 - RNA, 22 nt, Shigella flexneri 2a str. 2457T
uggcagcgcgaagcuggcggcg

SEQ ID NO: 3881119 - RNA, 19 nt, Shigella flexneri 2a str. 2457T
uggcagcgcgcauucagca

SEQ ID NO: 3881120 - RNA, 22 nt, Shigella flexneri 2a str. 2457T
uggcagcgcgcauucagcagca

SEQ ID NO: 3881121 - RNA, 22 nt, Shigella flexneri 2a str. 2457T
uggcagcguuaugucccgcugg

SEQ ID NO: 3881122 - RNA, 17 nt, Shigella flexneri 2a str. 2457T
uggcaggaguggcagca

SEQ ID NO: 3881123 - RNA, 13 nt, Shigella flexneri 2a str. 2457T
uggcaggcucaga

SEQ ID NO: 3881124 - RNA, 19 nt, Shigella flexneri 2a str. 2457T
uggcagggaaucagauuca

SEQ ID NO: 3881125 - RNA, 23 nt, Shigella flexneri 2a str. 2457T
uggcagguaaucggcauuggcau

SEQ ID NO: 3881126 - RNA, 20 nt, Shigella flexneri 2a str. 2457T
uggcaguagcgccucuucca

SEQ ID NO: 3881127 - RNA, 23 nt, Shigella flexneri 2a str. 2457T
uggcagugggccagaaaaaacgu

SEQ ID NO: 3881128 - RNA, 18 nt, Shigella flexneri 2a str. 2457T
uggcauaaacaaagcgca

SEQ ID NO: 3881129 - RNA, 14 nt, Shigella flexneri 2a str. 2457T
uggcauaucgccgu

SEQ ID NO: 3881130 - RNA, 21 nt, Shigella flexneri 2a str. 2457T
uggcaucagaggaaugauuuc

SEQ ID NO: 3881131 - RNA, 17 nt, Shigella flexneri 2a str. 2457T
uggcauccgugguggca

SEQ ID NO: 3881132 - RNA, 19 nt, Shigella flexneri 2a str. 2457T
uggcaucgauaucaaccag

SEQ ID NO: 3881133 - RNA, 18 nt, Shigella flexneri 2a str. 2457T
uggcaucugauaagccca

SEQ ID NO: 3881134 - RNA, 20 nt, Shigella flexneri 2a str. 2457T
uggcaucugauaagcccagc

SEQ ID NO: 3881135 - RNA, 20 nt, Shigella flexneri 2a str. 2457T
uggcaugccgguagaagcca

SEQ ID NO: 3881136 - RNA, 14 nt, Shigella flexneri 2a str. 2457T
uggcauucucacuc

SEQ ID NO: 3881137 - RNA, 20 nt, Shigella flexneri 2a str. 2457T
uggcauucucacuccagcca

SEQ ID NO: 3881138 - RNA, 17 nt, Shigella flexneri 2a str. 2457T
uggcauuggcagagcga

SEQ ID NO: 3881139 - RNA, 22 nt, Shigella flexneri 2a str. 2457T
uggcauuuuuaucucaaaaauu

SEQ ID NO: 3881140 - RNA, 19 nt, Shigella flexneri 2a str. 2457T
uggccacuucuguuacucc

SEQ ID NO: 3881141 - RNA, 20 nt, Shigella flexneri 2a str. 2457T
uggccagagugcguucaccg

SEQ ID NO: 3881142 - RNA, 21 nt, Shigella flexneri 2a str. 2457T
uggccagagugcguucaccga

SEQ ID NO: 3881143 - RNA, 18 nt, Shigella flexneri 2a str. 2457T
uggcccagccuuuccggc

SEQ ID NO: 3881144 - RNA, 21 nt, Shigella flexneri 2a str. 2457T
uggcccaguugauucgcgcgu

SEQ ID NO: 3881145 - RNA, 13 nt, Shigella flexneri 2a str. 2457T
uggcccaucaucu

SEQ ID NO: 3881146 - RNA, 17 nt, Shigella flexneri 2a str. 2457T
uggcccuaggcauagaa

SEQ ID NO: 3881147 - RNA, 15 nt, Shigella flexneri 2a str. 2457T
uggcccuugcucaau

SEQ ID NO: 3881148 - RNA, 22 nt, Shigella flexneri 2a str. 2457T
uggccgaaaaaggaucaaccga

SEQ ID NO: 3881149 - RNA, 13 nt, Shigella flexneri 2a str. 2457T
uggccgaagagga

SEQ ID NO: 3881150 - RNA, 16 nt, Shigella flexneri 2a str. 2457T
uggccgauaccaucac

SEQ ID NO: 3881151 - RNA, 23 nt, Shigella flexneri 2a str. 2457T
uggccgcaguacugggccgccug

SEQ ID NO: 3881152 - RNA, 14 nt, Shigella flexneri 2a str. 2457T
uggccgccacgcgu

SEQ ID NO: 3881153 - RNA, 16 nt, Shigella flexneri 2a str. 2457T
uggccgcuuccagcau

SEQ ID NO: 3881154 - RNA, 23 nt, Shigella flexneri 2a str. 2457T
uggccguacccagcugucaaacu

SEQ ID NO: 3881155 - RNA, 21 nt, Shigella flexneri 2a str. 2457T
uggccgugaauuacugcugcg

SEQ ID NO: 3881156 - RNA, 21 nt, Shigella flexneri 2a str. 2457T
uggccugagacugaugacaaa

SEQ ID NO: 3881157 - RNA, 18 nt, Shigella flexneri 2a str. 2457T
uggccugcucaacugcca

SEQ ID NO: 3881158 - RNA, 23 nt, Shigella flexneri 2a str. 2457T
uggcgaaauguguuggcaccauc

SEQ ID NO: 3881159 - RNA, 19 nt, Shigella flexneri 2a str. 2457T
uggcgaacccaaccgugag

SEQ ID NO: 3881160 - RNA, 20 nt, Shigella flexneri 2a str. 2457T
uggcgaaccuugcgcggugu

SEQ ID NO: 3881161 - RNA, 18 nt, Shigella flexneri 2a str. 2457T
uggcgaagaacgcauugc

SEQ ID NO: 3881162 - RNA, 12 nt, Shigella flexneri 2a str. 2457T
uggcgaauagaa

SEQ ID NO: 3881163 - RNA, 14 nt, Shigella flexneri 2a str. 2457T
uggcgacaaggcgu

SEQ ID NO: 3881164 - RNA, 20 nt, Shigella flexneri 2a str. 2457T
uggcgacggcgaaucaaccg

SEQ ID NO: 3881165 - RNA, 16 nt, Shigella flexneri 2a str. 2457T
uggcgacggcggaaca

SEQ ID NO: 3881166 - RNA, 15 nt, Shigella flexneri 2a str. 2457T
uggcgacuucugcuu

SEQ ID NO: 3881167 - RNA, 13 nt, Shigella flexneri 2a str. 2457T
uggcgaggaacga

SEQ ID NO: 3881168 - RNA, 15 nt, Shigella flexneri 2a str. 2457T
uggcgauaaucagcg

SEQ ID NO: 3881169 - RNA, 22 nt, Shigella flexneri 2a str. 2457T
uggcgauaaucgaaccaaacag

SEQ ID NO: 3881170 - RNA, 22 nt, Shigella flexneri 2a str. 2457T
uggcgaucgucgcuccaugaga

SEQ ID NO: 3881171 - RNA, 16 nt, Shigella flexneri 2a str. 2457T
uggcgauguaauucag

SEQ ID NO: 3881172 - RNA, 18 nt, Shigella flexneri 2a str. 2457T
uggcgauguaauucagcc

SEQ ID NO: 3881173 - RNA, 19 nt, Shigella flexneri 2a str. 2457T
uggcgauguaauucagcca

SEQ ID NO: 3881174 - RNA, 16 nt, Shigella flexneri 2a str. 2457T
uggcgauuauuuuccg

SEQ ID NO: 3881175 - RNA, 19 nt, Shigella flexneri 2a str. 2457T
uggcgauuuugaagucuuu

SEQ ID NO: 3881176 - RNA, 21 nt, Shigella flexneri 2a str. 2457T
uggcgcaaguuacuccuggua

SEQ ID NO: 3881177 - RNA, 17 nt, Shigella flexneri 2a str. 2457T
uggcgcacauccgcguc

SEQ ID NO: 3881178 - RNA, 21 nt, Shigella flexneri 2a str. 2457T
uggcgcauaacucaccaucaa

SEQ ID NO: 3881179 - RNA, 18 nt, Shigella flexneri 2a str. 2457T
uggcgcgaacagcacauc

SEQ ID NO: 3881180 - RNA, 14 nt, Shigella flexneri 2a str. 2457T
uggcgcgacauccg

SEQ ID NO: 3881181 - RNA, 19 nt, Shigella flexneri 2a str. 2457T
uggcgcgaccaaugucagg

SEQ ID NO: 3881182 - RNA, 15 nt, Shigella flexneri 2a str. 2457T
uggcgcguaccgccg

SEQ ID NO: 3881183 - RNA, 17 nt, Shigella flexneri 2a str. 2457T
uggcgcguuuaaucaca

SEQ ID NO: 3881184 - RNA, 18 nt, Shigella flexneri 2a str. 2457T
uggcgcguuuaaucacac

SEQ ID NO: 3881185 - RNA, 16 nt, Shigella flexneri 2a str. 2457T
uggcgcuaucaauacu

SEQ ID NO: 3881186 - RNA, 17 nt, Shigella flexneri 2a str. 2457T
uggcgcuaugcuggaug

SEQ ID NO: 3881187 - RNA, 20 nt, Shigella flexneri 2a str. 2457T
uggcgcugauaaaucccgcc

SEQ ID NO: 3881188 - RNA, 16 nt, Shigella flexneri 2a str. 2457T
uggguuucuaauuuuu

SEQ ID NO: 3881189 - RNA, 23 nt, Shigella flexneri 2a str. 2457T
ugguaaagccgauuaaucuucca

SEQ ID NO: 3881190 - RNA, 20 nt, Shigella flexneri 2a str. 2457T
ugguaaagccgguuuugguu

SEQ ID NO: 3881191 - RNA, 21 nt, Shigella flexneri 2a str. 2457T
ugguaacagugcaccggacac

SEQ ID NO: 3881192 - RNA, 18 nt, Shigella flexneri 2a str. 2457T
ugguaacgccccacaaac

SEQ ID NO: 3881193 - RNA, 21 nt, Shigella flexneri 2a str. 2457T
ugguaccguguaaaaugacuc

SEQ ID NO: 3881194 - RNA, 22 nt, Shigella flexneri 2a str. 2457T
ugguacgucaccacacgccgca

SEQ ID NO: 3881195 - RNA, 15 nt, Shigella flexneri 2a str. 2457T
ugguacuggugcaaa

SEQ ID NO: 3881196 - RNA, 17 nt, Shigella flexneri 2a str. 2457T
ugguacuggugcaaaac

SEQ ID NO: 3881197 - RNA, 14 nt, Shigella flexneri 2a str. 2457T
ugguacuuucacag

SEQ ID NO: 3881198 - RNA, 16 nt, Shigella flexneri 2a str. 2457T
ugguagauaagcaagg

SEQ ID NO: 3881199 - RNA, 20 nt, Shigella flexneri 2a str. 2457T
ugguaggccggauaaggcgu

SEQ ID NO: 3881200 - RNA, 16 nt, Shigella flexneri 2a str. 2457T
ugguauuaaauuugcu

SEQ ID NO: 3881201 - RNA, 19 nt, Shigella flexneri 2a str. 2457T
uggucaaugauuucugcca

SEQ ID NO: 3881202 - RNA, 12 nt, Shigella flexneri 2a str. 2457T
uggucaccacgg

SEQ ID NO: 3881203 - RNA, 13 nt, Shigella flexneri 2a str. 2457T
uggucagagcauu

SEQ ID NO: 3881204 - RNA, 12 nt, Shigella flexneri 2a str. 2457T
uggucagcaucg

SEQ ID NO: 3881205 - RNA, 15 nt, Shigella flexneri 2a str. 2457T
uggucaguuggcugg

SEQ ID NO: 3881206 - RNA, 19 nt, Shigella flexneri 2a str. 2457T
uggucaguuguggcagaau

SEQ ID NO: 3881207 - RNA, 22 nt, Shigella flexneri 2a str. 2457T
uggucaucacuuuugaaaucaa

SEQ ID NO: 3881208 - RNA, 21 nt, Shigella flexneri 2a str. 2457T
uggucauucggcgcagguuua

SEQ ID NO: 3881209 - RNA, 14 nt, Shigella flexneri 2a str. 2457T
uggucauuuuauug

SEQ ID NO: 3881210 - RNA, 19 nt, Shigella flexneri 2a str. 2457T
ugguccgcuuguaggccug

SEQ ID NO: 3881211 - RNA, 19 nt, Shigella flexneri 2a str. 2457T
ugguccuggcugauugaua

SEQ ID NO: 3881212 - RNA, 23 nt, Shigella flexneri 2a str. 2457T
ugguccuucaucuucaacugcca

SEQ ID NO: 3881213 - RNA, 14 nt, Shigella flexneri 2a str. 2457T
uggucgauuccucg

SEQ ID NO: 3881214 - RNA, 15 nt, Shigella flexneri 2a str. 2457T
uggucucaagcaagu

SEQ ID NO: 3881215 - RNA, 21 nt, Shigella flexneri 2a str. 2457T
uggucuccacgcuuaacaacc

SEQ ID NO: 3881216 - RNA, 23 nt, Shigella flexneri 2a str. 2457T
uggucugacgcugaauacgcacc

SEQ ID NO: 3881217 - RNA, 16 nt, Shigella flexneri 2a str. 2457T
uggucugcaugacggc

SEQ ID NO: 3881218 - RNA, 13 nt, Shigella flexneri 2a str. 2457T
uggucugccauca

SEQ ID NO: 3881219 - RNA, 18 nt, Shigella flexneri 2a str. 2457T
uggucuggaacuggcugc

SEQ ID NO: 3881220 - RNA, 19 nt, Shigella flexneri 2a str. 2457T
uggucuggaacuggcugcc

SEQ ID NO: 3881221 - RNA, 23 nt, Shigella flexneri 2a str. 2457T
uggugaccuguaacguugcugcg

SEQ ID NO: 3881222 - RNA, 15 nt, Shigella flexneri 2a str. 2457T
uggugacgcauuuua

SEQ ID NO: 3881223 - RNA, 20 nt, Shigella flexneri 2a str. 2457T
uggugacuuuugcccggcau

SEQ ID NO: 3881224 - RNA, 22 nt, Shigella flexneri 2a str. 2457T
uggugagccacauugcaucuga

SEQ ID NO: 3881225 - RNA, 16 nt, Shigella flexneri 2a str. 2457T
uggugaggccagagca

SEQ ID NO: 3881226 - RNA, 23 nt, Shigella flexneri 2a str. 2457T
uggugauaaaacgcagucuuccc

SEQ ID NO: 3881227 - RNA, 19 nt, Shigella flexneri 2a str. 2457T
uggugaugagcugaccaga

SEQ ID NO: 3881228 - RNA, 12 nt, Shigella flexneri 2a str. 2457T
uggugauuuucg

SEQ ID NO: 3881229 - RNA, 20 nt, Shigella flexneri 2a str. 2457T
uggugcaagaaaugacagag

SEQ ID NO: 3881230 - RNA, 22 nt, Shigella flexneri 2a str. 2457T
uggugccagauuuaacggcagc

SEQ ID NO: 3881231 - RNA, 15 nt, Shigella flexneri 2a str. 2457T
ugguggagauaaacu

SEQ ID NO: 3881232 - RNA, 21 nt, Shigella flexneri 2a str. 2457T
uggugggugcuuuaaaaaaga

SEQ ID NO: 3881233 - RNA, 23 nt, Shigella flexneri 2a str. 2457T
ugguggucuccacgcuuaacaac

SEQ ID NO: 3881234 - RNA, 18 nt, Shigella flexneri 2a str. 2457T
ugguguuaaaucuguuca

SEQ ID NO: 3881235 - RNA, 23 nt, Shigella flexneri 2a str. 2457T
ugguguuauaggccccugccuca

SEQ ID NO: 3881236 - RNA, 23 nt, Shigella flexneri 2a str. 2457T
ugguguugcguuuuuaucuucac

SEQ ID NO: 3881237 - RNA, 22 nt, Shigella flexneri 2a str. 2457T
ugguuaacaaucacaauagaaa

SEQ ID NO: 3881238 - RNA, 15 nt, Shigella flexneri 2a str. 2457T
ugguuacgcagauau

SEQ ID NO: 3881239 - RNA, 21 nt, Shigella flexneri 2a str. 2457T
ugguuagagcacaucacucau

SEQ ID NO: 3881240 - RNA, 19 nt, Shigella flexneri 2a str. 2457T
ugguuagcggcgguaaaau

SEQ ID NO: 3881241 - RNA, 23 nt, Shigella flexneri 2a str. 2457T
ugguuagcggcgguaaaaucauc

SEQ ID NO: 3881242 - RNA, 19 nt, Shigella flexneri 2a str. 2457T
ugguuauccagcaaccagg

SEQ ID NO: 3881243 - RNA, 20 nt, Shigella flexneri 2a str. 2457T
ugguuauccagcaaccaggu

SEQ ID NO: 3881244 - RNA, 17 nt, Shigella flexneri 2a str. 2457T
ugguuauuucacuucaa

SEQ ID NO: 3881245 - RNA, 14 nt, Shigella flexneri 2a str. 2457T
ugguucaagagaga

SEQ ID NO: 3881246 - RNA, 21 nt, Shigella flexneri 2a str. 2457T
ugguucagugggcgcugcugu

SEQ ID NO: 3881247 - RNA, 18 nt, Shigella flexneri 2a str. 2457T
ugguucccaacaacagcg

SEQ ID NO: 3881248 - RNA, 21 nt, Shigella flexneri 2a str. 2457T
ugguuccgguuuauccauccc

SEQ ID NO: 3881249 - RNA, 15 nt, Shigella flexneri 2a str. 2457T
ugguucgcaacggcu

SEQ ID NO: 3881250 - RNA, 22 nt, Shigella flexneri 2a str. 2457T
ugguucggcaaaaucuuccaga

SEQ ID NO: 3881251 - RNA, 20 nt, Shigella flexneri 2a str. 2457T
ugguugccagccacaccugg

SEQ ID NO: 3881252 - RNA, 13 nt, Shigella flexneri 2a str. 2457T
ugguuguaaucca

SEQ ID NO: 3881253 - RNA, 15 nt, Shigella flexneri 2a str. 2457T
ugguuuaugcaauau

SEQ ID NO: 3881254 - RNA, 14 nt, Shigella flexneri 2a str. 2457T
ugguuucaaugcuc

SEQ ID NO: 3881255 - RNA, 15 nt, Shigella flexneri 2a str. 2457T
ugguuuccagcaucg

SEQ ID NO: 3881256 - RNA, 16 nt, Shigella flexneri 2a str. 2457T
ugguuucgccagcacc

SEQ ID NO: 3881257 - RNA, 20 nt, Shigella flexneri 2a str. 2457T
ugguuucugguggaaaagaa

SEQ ID NO: 3881258 - RNA, 14 nt, Shigella flexneri 2a str. 2457T
ugguuugcauccac

SEQ ID NO: 3881259 - RNA, 17 nt, Shigella flexneri 2a str. 2457T
ugguuuucaauuaucac

SEQ ID NO: 3881260 - RNA, 16 nt, Shigella flexneri 2a str. 2457T
ugguuuuccugagcaa

SEQ ID NO: 3881261 - RNA, 17 nt, Shigella flexneri 2a str. 2457T
ugguuuugcuuuauuaa

SEQ ID NO: 3881262 - RNA, 15 nt, Shigella flexneri 2a str. 2457T
ugguuuuguaggcug

SEQ ID NO: 3881263 - RNA, 19 nt, Shigella flexneri 2a str. 2457T
uguaaaacagcacuccugc

SEQ ID NO: 3881264 - RNA, 13 nt, Shigella flexneri 2a str. 2457T
uguaaaccucuuu

SEQ ID NO: 3881265 - RNA, 22 nt, Shigella flexneri 2a str. 2457T
uguaaagauugauuauugagcg

SEQ ID NO: 3881266 - RNA, 22 nt, Shigella flexneri 2a str. 2457T
uguaaauacucuugugccaguu

SEQ ID NO: 3881267 - RNA, 13 nt, Shigella flexneri 2a str. 2457T
uguaaaugcugcu

SEQ ID NO: 3881268 - RNA, 19 nt, Shigella flexneri 2a str. 2457T
uguaaaugcugcuccagcg

SEQ ID NO: 3881269 - RNA, 13 nt, Shigella flexneri 2a str. 2457T
uguaacaacuggc

SEQ ID NO: 3881270 - RNA, 20 nt, Shigella flexneri 2a str. 2457T
uguaacacugauaacgggac

SEQ ID NO: 3881271 - RNA, 17 nt, Shigella flexneri 2a str. 2457T
uguaaccuaauuuauua

SEQ ID NO: 3881272 - RNA, 18 nt, Shigella flexneri 2a str. 2457T
uguaacgccggguaaaug

SEQ ID NO: 3881273 - RNA, 18 nt, Shigella flexneri 2a str. 2457T
uguaacgccuuuuccagc

SEQ ID NO: 3881274 - RNA, 17 nt, Shigella flexneri 2a str. 2457T
uguaacggagguacaac

SEQ ID NO: 3881275 - RNA, 23 nt, Shigella flexneri 2a str. 2457T
uguaacugcgccagacccagacg

SEQ ID NO: 3881276 - RNA, 21 nt, Shigella flexneri 2a str. 2457T
uguaacugcguuucuggcuua

SEQ ID NO: 3881277 - RNA, 21 nt, Shigella flexneri 2a str. 2457T
uguaagacauuuaacccuuca

SEQ ID NO: 3881278 - RNA, 22 nt, Shigella flexneri 2a str. 2457T
uguaagccaagcgccgccucag

SEQ ID NO: 3881279 - RNA, 16 nt, Shigella flexneri 2a str. 2457T
uguaagucggucacag

SEQ ID NO: 3881280 - RNA, 20 nt, Shigella flexneri 2a str. 2457T
uguaaguggggguuuuauuu

SEQ ID NO: 3881281 - RNA, 22 nt, Shigella flexneri 2a str. 2457T
uguaauaguguauuaaucuauu

SEQ ID NO: 3881282 - RNA, 11 nt, Shigella flexneri 2a str. 2457T
uguaaucaacu

SEQ ID NO: 3881283 - RNA, 18 nt, Shigella flexneri 2a str. 2457T
uguaaucauauuaaauuu

SEQ ID NO: 3881284 - RNA, 14 nt, Shigella flexneri 2a str. 2457T
uguaauccucuuug

SEQ ID NO: 3881285 - RNA, 16 nt, Shigella flexneri 2a str. 2457T
uguaaugacaacauuu

SEQ ID NO: 3881286 - RNA, 19 nt, Shigella flexneri 2a str. 2457T
uguaaugagaauaaucacc

SEQ ID NO: 3881287 - RNA, 23 nt, Shigella flexneri 2a str. 2457T
uguaauuaggcuaaauaaccagc

SEQ ID NO: 3881288 - RNA, 18 nt, Shigella flexneri 2a str. 2457T
uguaauuuuuuuauugau

SEQ ID NO: 3881289 - RNA, 22 nt, Shigella flexneri 2a str. 2457T
uguacagauccgccauuucucc

SEQ ID NO: 3881290 - RNA, 20 nt, Shigella flexneri 2a str. 2457T
uguacaggauauauuucauc

SEQ ID NO: 3881291 - RNA, 21 nt, Shigella flexneri 2a str. 2457T
uguacaggauauauuucauca

SEQ ID NO: 3881292 - RNA, 16 nt, Shigella flexneri 2a str. 2457T
uguacaggcuccugua

SEQ ID NO: 3881293 - RNA, 17 nt, Shigella flexneri 2a str. 2457T
uguacauggugcacauu

SEQ ID NO: 3881294 - RNA, 22 nt, Shigella flexneri 2a str. 2457T
uguacauuaccacgauuuugac

SEQ ID NO: 3881295 - RNA, 19 nt, Shigella flexneri 2a str. 2457T
uguacauuaucuuuauuau

SEQ ID NO: 3881296 - RNA, 13 nt, Shigella flexneri 2a str. 2457T
uguacauuuugac

SEQ ID NO: 3881297 - RNA, 14 nt, Shigella flexneri 2a str. 2457T
uguaccacaaccug

SEQ ID NO: 3881298 - RNA, 20 nt, Shigella flexneri 2a str. 2457T
uguacccgcugcagcucuuu

SEQ ID NO: 3881299 - RNA, 17 nt, Shigella flexneri 2a str. 2457T
uguaccguugcugccag

SEQ ID NO: 3881300 - RNA, 20 nt, Shigella flexneri 2a str. 2457T
uguaccuucacgcgcuccag

SEQ ID NO: 3881301 - RNA, 23 nt, Shigella flexneri 2a str. 2457T
uguaccuucacgcgcuccaggag

SEQ ID NO: 3881302 - RNA, 14 nt, Shigella flexneri 2a str. 2457T
uguacgacaaaaga

SEQ ID NO: 3881303 - RNA, 13 nt, Shigella flexneri 2a str. 2457T
uguacggcaguga

SEQ ID NO: 3881304 - RNA, 15 nt, Shigella flexneri 2a str. 2457T
uguacggcagugaac

SEQ ID NO: 3881305 - RNA, 20 nt, Shigella flexneri 2a str. 2457T
uguacuccagcagaccagca

SEQ ID NO: 3881306 - RNA, 22 nt, Shigella flexneri 2a str. 2457T
uguacuuccggacguucagcca

SEQ ID NO: 3881307 - RNA, 18 nt, Shigella flexneri 2a str. 2457T
uguacuuuccagccacag

SEQ ID NO: 3881308 - RNA, 19 nt, Shigella flexneri 2a str. 2457T
uguagaaaaucucaaugua

SEQ ID NO: 3881309 - RNA, 20 nt, Shigella flexneri 2a str. 2457T
uguagaccggaaaagguguu

SEQ ID NO: 3881310 - RNA, 18 nt, Shigella flexneri 2a str. 2457T
uguagauaaaacacucuu

SEQ ID NO: 3881311 - RNA, 19 nt, Shigella flexneri 2a str. 2457T
uguagccaauaaaugccac

SEQ ID NO: 3881312 - RNA, 20 nt, Shigella flexneri 2a str. 2457T
uguagcgcaucacuuccagu

SEQ ID NO: 3881313 - RNA, 16 nt, Shigella flexneri 2a str. 2457T
uguagcuacgcaucaa

SEQ ID NO: 3881314 - RNA, 19 nt, Shigella flexneri 2a str. 2457T
uguaggccagauaagacgc

SEQ ID NO: 3881315 - RNA, 20 nt, Shigella flexneri 2a str. 2457T
uguaggccagauaagacguu

SEQ ID NO: 3881316 - RNA, 23 nt, Shigella flexneri 2a str. 2457T
uguaggccagauaagacguucac

SEQ ID NO: 3881317 - RNA, 20 nt, Shigella flexneri 2a str. 2457T
uguaggccggauaaagcguu

SEQ ID NO: 3881318 - RNA, 19 nt, Shigella flexneri 2a str. 2457T
uguaggccggauaagcgua

SEQ ID NO: 3881319 - RNA, 20 nt, Shigella flexneri 2a str. 2457T
uguaggccggauaaggcauu

SEQ ID NO: 3881320 - RNA, 20 nt, Shigella flexneri 2a str. 2457T
uguaggccggauaaggcgcu

SEQ ID NO: 3881321 - RNA, 19 nt, Shigella flexneri 2a str. 2457T
uguaggccggauaaggcgu

SEQ ID NO: 3881322 - RNA, 19 nt, Shigella flexneri 2a str. 2457T
uguaggccugauaagacgc

SEQ ID NO: 3881323 - RNA, 18 nt, Shigella flexneri 2a str. 2457T
uguaggcggauaaggcgu

SEQ ID NO: 3881324 - RNA, 14 nt, Shigella flexneri 2a str. 2457T
uguaggguggggaa

SEQ ID NO: 3881325 - RNA, 20 nt, Shigella flexneri 2a str. 2457T
uguaggguggggaaaaacac

SEQ ID NO: 3881326 - RNA, 17 nt, Shigella flexneri 2a str. 2457T
uguagguuuuggcgcaa

SEQ ID NO: 3881327 - RNA, 18 nt, Shigella flexneri 2a str. 2457T
uguaguccuaacagagca

SEQ ID NO: 3881328 - RNA, 21 nt, Shigella flexneri 2a str. 2457T
uguaguccuaacagagcacug

SEQ ID NO: 3881329 - RNA, 15 nt, Shigella flexneri 2a str. 2457T
uguaguucuggccuu

SEQ ID NO: 3881330 - RNA, 13 nt, Shigella flexneri 2a str. 2457T
uguauacggcaac

SEQ ID NO: 3881331 - RNA, 18 nt, Shigella flexneri 2a str. 2457T
uguauauuauccaucaaa

SEQ ID NO: 3881332 - RNA, 12 nt, Shigella flexneri 2a str. 2457T
uguaucccaguu

SEQ ID NO: 3881333 - RNA, 13 nt, Shigella flexneri 2a str. 2457T
uguauccggcaaa

SEQ ID NO: 3881334 - RNA, 21 nt, Shigella flexneri 2a str. 2457T
uguaucggcggcgauguccag

SEQ ID NO: 3881335 - RNA, 16 nt, Shigella flexneri 2a str. 2457T
uguaucgucacugguu

SEQ ID NO: 3881336 - RNA, 18 nt, Shigella flexneri 2a str. 2457T
uguaugccgaauaaagca

SEQ ID NO: 3881337 - RNA, 18 nt, Shigella flexneri 2a str. 2457T
uguauggcgauagcccag

SEQ ID NO: 3881338 - RNA, 21 nt, Shigella flexneri 2a str. 2457T
uguauguaggguacagcacga

SEQ ID NO: 3881339 - RNA, 13 nt, Shigella flexneri 2a str. 2457T
uguauuaacauua

SEQ ID NO: 3881340 - RNA, 21 nt, Shigella flexneri 2a str. 2457T
uguauuaaucgugaaaagcug

SEQ ID NO: 3881341 - RNA, 16 nt, Shigella flexneri 2a str. 2457T
uguauuacaacgugcu

SEQ ID NO: 3881342 - RNA, 14 nt, Shigella flexneri 2a str. 2457T
uguauucaugcccu

SEQ ID NO: 3881343 - RNA, 17 nt, Shigella flexneri 2a str. 2457T
uguauucaugcccugcc

SEQ ID NO: 3881344 - RNA, 14 nt, Shigella flexneri 2a str. 2457T
uguauugauuuagc

SEQ ID NO: 3881345 - RNA, 18 nt, Shigella flexneri 2a str. 2457T
ugucaaaaucaaaauaau

SEQ ID NO: 3881346 - RNA, 18 nt, Shigella flexneri 2a str. 2457T
ugucaaacgggcuucuaa

SEQ ID NO: 3881347 - RNA, 11 nt, Shigella flexneri 2a str. 2457T
ugucaaaucca

SEQ ID NO: 3881348 - RNA, 20 nt, Shigella flexneri 2a str. 2457T
ugucaacugcgccacucgau

SEQ ID NO: 3881349 - RNA, 14 nt, Shigella flexneri 2a str. 2457T
ugucaauaaacgcc

SEQ ID NO: 3881350 - RNA, 14 nt, Shigella flexneri 2a str. 2457T
ugucaaucagggcg

SEQ ID NO: 3881351 - RNA, 23 nt, Shigella flexneri 2a str. 2457T
ugucacaaauaaaaaaugagaau

SEQ ID NO: 3881352 - RNA, 16 nt, Shigella flexneri 2a str. 2457T
ugucacgucucaucag

SEQ ID NO: 3881353 - RNA, 14 nt, Shigella flexneri 2a str. 2457T
ugucacguuuugug

SEQ ID NO: 3881354 - RNA, 11 nt, Shigella flexneri 2a str. 2457T
ugucacuuuga

SEQ ID NO: 3881355 - RNA, 15 nt, Shigella flexneri 2a str. 2457T
ugucacuuugaccgc

SEQ ID NO: 3881356 - RNA, 16 nt, Shigella flexneri 2a str. 2457T
ugucagaaaugauggg

SEQ ID NO: 3881357 - RNA, 14 nt, Shigella flexneri 2a str. 2457T
ugucagaaguugca

SEQ ID NO: 3881358 - RNA, 19 nt, Shigella flexneri 2a str. 2457T
ugucagcaaucugauugac

SEQ ID NO: 3881359 - RNA, 15 nt, Shigella flexneri 2a str. 2457T
ugucagcccuuuuuc

SEQ ID NO: 3881360 - RNA, 15 nt, Shigella flexneri 2a str. 2457T
ugucagcucauccag

SEQ ID NO: 3881361 - RNA, 16 nt, Shigella flexneri 2a str. 2457T
ugucagcucauccagc

SEQ ID NO: 3881362 - RNA, 20 nt, Shigella flexneri 2a str. 2457T
ugucauaacuggucaucaaa

SEQ ID NO: 3881363 - RNA, 17 nt, Shigella flexneri 2a str. 2457T
ugucauacgcguaaaac

SEQ ID NO: 3881364 - RNA, 15 nt, Shigella flexneri 2a str. 2457T
ugucauauuaucuau

SEQ ID NO: 3881365 - RNA, 23 nt, Shigella flexneri 2a str. 2457T
ugucaucagcauucucaucacca

SEQ ID NO: 3881366 - RNA, 18 nt, Shigella flexneri 2a str. 2457T
ugucaucagucuagcccg

SEQ ID NO: 3881367 - RNA, 21 nt, Shigella flexneri 2a str. 2457T
ugucaucgaauaaauugagcu

SEQ ID NO: 3881368 - RNA, 20 nt, Shigella flexneri 2a str. 2457T
ugucaucggucagaucggca

SEQ ID NO: 3881369 - RNA, 18 nt, Shigella flexneri 2a str. 2457T
ugucaugacuacacuaaa

SEQ ID NO: 3881370 - RNA, 20 nt, Shigella flexneri 2a str. 2457T
ugucaugaguaaacuuuugg

SEQ ID NO: 3881371 - RNA, 13 nt, Shigella flexneri 2a str. 2457T
ugucaugauuccg

SEQ ID NO: 3881372 - RNA, 14 nt, Shigella flexneri 2a str. 2457T
ugucaugcagcucc

SEQ ID NO: 3881373 - RNA, 22 nt, Shigella flexneri 2a str. 2457T
ugucauguauauuauccaucaa

SEQ ID NO: 3881374 - RNA, 21 nt, Shigella flexneri 2a str. 2457T
ugucauuaaagccgccaaacg

SEQ ID NO: 3881375 - RNA, 22 nt, Shigella flexneri 2a str. 2457T
uguccaaauccuucagcaacuu

SEQ ID NO: 3881376 - RNA, 13 nt, Shigella flexneri 2a str. 2457T
uguccacaggaaa

SEQ ID NO: 3881377 - RNA, 15 nt, Shigella flexneri 2a str. 2457T
uguccagcacgccgc

SEQ ID NO: 3881378 - RNA, 15 nt, Shigella flexneri 2a str. 2457T
uguccagcggcauaa

SEQ ID NO: 3881379 - RNA, 20 nt, Shigella flexneri 2a str. 2457T
uguccagcuugaucaauaac

SEQ ID NO: 3881380 - RNA, 22 nt, Shigella flexneri 2a str. 2457T
uguccauaccggacuccagaca

SEQ ID NO: 3881381 - RNA, 16 nt, Shigella flexneri 2a str. 2457T
uguuaugagauaauuc

SEQ ID NO: 3881382 - RNA, 19 nt, Shigella flexneri 2a str. 2457T
uguuauuuaauuacugaga

SEQ ID NO: 3881383 - RNA, 12 nt, Shigella flexneri 2a str. 2457T
uguucaacaauu

SEQ ID NO: 3881384 - RNA, 13 nt, Shigella flexneri 2a str. 2457T
uguucaauaucga

SEQ ID NO: 3881385 - RNA, 16 nt, Shigella flexneri 2a str. 2457T
uguucacccaacucuc

SEQ ID NO: 3881386 - RNA, 11 nt, Shigella flexneri 2a str. 2457T
uguucacugcc

SEQ ID NO: 3881387 - RNA, 12 nt, Shigella flexneri 2a str. 2457T
uguucacugccg

SEQ ID NO: 3881388 - RNA, 13 nt, Shigella flexneri 2a str. 2457T
uguucacugccgu

SEQ ID NO: 3881389 - RNA, 13 nt, Shigella flexneri 2a str. 2457T
uguucacugugcu

SEQ ID NO: 3881390 - RNA, 17 nt, Shigella flexneri 2a str. 2457T
uguucagaaugcccacg

SEQ ID NO: 3881391 - RNA, 13 nt, Shigella flexneri 2a str. 2457T
uguucagauaaug

SEQ ID NO: 3881392 - RNA, 14 nt, Shigella flexneri 2a str. 2457T
uguucagauggcca

SEQ ID NO: 3881393 - RNA, 18 nt, Shigella flexneri 2a str. 2457T
uguucagccugaccgcac

SEQ ID NO: 3881394 - RNA, 22 nt, Shigella flexneri 2a str. 2457T
uguucagcgggcagggcaucaa

SEQ ID NO: 3881395 - RNA, 12 nt, Shigella flexneri 2a str. 2457T
uguucaggagaa

SEQ ID NO: 3881396 - RNA, 20 nt, Shigella flexneri 2a str. 2457T
uguucaggugaugccgauug

SEQ ID NO: 3881397 - RNA, 21 nt, Shigella flexneri 2a str. 2457T
uguuccacucuuucagcacca

SEQ ID NO: 3881398 - RNA, 21 nt, Shigella flexneri 2a str. 2457T
uguuccagaccauauuuucau

SEQ ID NO: 3881399 - RNA, 23 nt, Shigella flexneri 2a str. 2457T
uguuccagacgcugcauugacaa

SEQ ID NO: 3881400 - RNA, 12 nt, Shigella flexneri 2a str. 2457T
uguuccagugcg

SEQ ID NO: 3881401 - RNA, 18 nt, Shigella flexneri 2a str. 2457T
uguuccaguugauacagg

SEQ ID NO: 3881402 - RNA, 22 nt, Shigella flexneri 2a str. 2457T
uguuccauaccgucgccagacg

SEQ ID NO: 3881403 - RNA, 19 nt, Shigella flexneri 2a str. 2457T
uguuccaucgcguugguga

SEQ ID NO: 3881404 - RNA, 18 nt, Shigella flexneri 2a str. 2457T
uguucccgcgccucaggc

SEQ ID NO: 3881405 - RNA, 20 nt, Shigella flexneri 2a str. 2457T
uguuccgccagcgacugcgc

SEQ ID NO: 3881406 - RNA, 22 nt, Shigella flexneri 2a str. 2457T
uguuccggcuuucugggaugau

SEQ ID NO: 3881407 - RNA, 14 nt, Shigella flexneri 2a str. 2457T
uguuccucugcucc

SEQ ID NO: 3881408 - RNA, 20 nt, Shigella flexneri 2a str. 2457T
uguuccugaacgcccgcaua

SEQ ID NO: 3881409 - RNA, 15 nt, Shigella flexneri 2a str. 2457T
uguucgagcaucaca

SEQ ID NO: 3881410 - RNA, 21 nt, Shigella flexneri 2a str. 2457T
uguucgcccacgcgcauuccc

SEQ ID NO: 3881411 - RNA, 22 nt, Shigella flexneri 2a str. 2457T
uguucgcccacgcgcauuccca

SEQ ID NO: 3881412 - RNA, 17 nt, Shigella flexneri 2a str. 2457T
uguucguccauuucagc

SEQ ID NO: 3881413 - RNA, 14 nt, Shigella flexneri 2a str. 2457T
uguucguuauuggg

SEQ ID NO: 3881414 - RNA, 13 nt, Shigella flexneri 2a str. 2457T
uguucucagcaca

SEQ ID NO: 3881415 - RNA, 19 nt, Shigella flexneri 2a str. 2457T
uguucugcgcuugguuuug

SEQ ID NO: 3881416 - RNA, 15 nt, Shigella flexneri 2a str. 2457T
uguugaaugccgguu

SEQ ID NO: 3881417 - RNA, 21 nt, Shigella flexneri 2a str. 2457T
uguugagaugguuacuuuuua

SEQ ID NO: 3881418 - RNA, 15 nt, Shigella flexneri 2a str. 2457T
uguugaggaagcgca

SEQ ID NO: 3881419 - RNA, 14 nt, Shigella flexneri 2a str. 2457T
uguugauaaggaaa

SEQ ID NO: 3881420 - RNA, 17 nt, Shigella flexneri 2a str. 2457T
uguugauggggguccug

SEQ ID NO: 3881421 - RNA, 20 nt, Shigella flexneri 2a str. 2457T
uguugcaccgaguucuucac

SEQ ID NO: 3881422 - RNA, 23 nt, Shigella flexneri 2a str. 2457T
uguugcaggaaaagguaggccug

SEQ ID NO: 3881423 - RNA, 15 nt, Shigella flexneri 2a str. 2457T
uguugcaucgccugc

SEQ ID NO: 3881424 - RNA, 15 nt, Shigella flexneri 2a str. 2457T
uguugccauuucugc

SEQ ID NO: 3881425 - RNA, 21 nt, Shigella flexneri 2a str. 2457T
uguugccauuucugcugccac

SEQ ID NO: 3881426 - RNA, 22 nt, Shigella flexneri 2a str. 2457T
uguugccgccgugugcaauauc

SEQ ID NO: 3881427 - RNA, 19 nt, Shigella flexneri 2a str. 2457T
uguugccguuuaccgccau

SEQ ID NO: 3881428 - RNA, 20 nt, Shigella flexneri 2a str. 2457T
uguugcgccaguaaauuuau

SEQ ID NO: 3881429 - RNA, 17 nt, Shigella flexneri 2a str. 2457T
uguugcgcugaaacuuu

SEQ ID NO: 3881430 - RNA, 20 nt, Shigella flexneri 2a str. 2457T
uguugcguaauggugguguu

SEQ ID NO: 3881431 - RNA, 18 nt, Shigella flexneri 2a str. 2457T
uguugcugccgacaaaug

SEQ ID NO: 3881432 - RNA, 22 nt, Shigella flexneri 2a str. 2457T
uguuggauccccugcccggcaa

SEQ ID NO: 3881433 - RNA, 20 nt, Shigella flexneri 2a str. 2457T
uguuggcaaaaaaauucaga

SEQ ID NO: 3881434 - RNA, 14 nt, Shigella flexneri 2a str. 2457T
uguuggugccagau

SEQ ID NO: 3881435 - RNA, 17 nt, Shigella flexneri 2a str. 2457T
uguuguaauaguguauu

SEQ ID NO: 3881436 - RNA, 13 nt, Shigella flexneri 2a str. 2457T
uguuguacaguac

SEQ ID NO: 3881437 - RNA, 16 nt, Shigella flexneri 2a str. 2457T
uguuguagaccggaaa

SEQ ID NO: 3881438 - RNA, 20 nt, Shigella flexneri 2a str. 2457T
uguuguagaccggaaaaggu

SEQ ID NO: 3881439 - RNA, 15 nt, Shigella flexneri 2a str. 2457T
uguugucugaaugau

SEQ ID NO: 3881440 - RNA, 15 nt, Shigella flexneri 2a str. 2457T
uguugugcucgccgg

SEQ ID NO: 3881441 - RNA, 13 nt, Shigella flexneri 2a str. 2457T
uguuuaaccaaca

SEQ ID NO: 3881442 - RNA, 21 nt, Shigella flexneri 2a str. 2457T
uguuuaacuccuucuaaagca

SEQ ID NO: 3881443 - RNA, 23 nt, Shigella flexneri 2a str. 2457T
uguuuagccgcuucugcagcuuu

SEQ ID NO: 3881444 - RNA, 20 nt, Shigella flexneri 2a str. 2457T
uguuuauaacuucccgcauc

SEQ ID NO: 3881445 - RNA, 14 nt, Shigella flexneri 2a str. 2457T
uguuuauaagccau

SEQ ID NO: 3881446 - RNA, 22 nt, Shigella flexneri 2a str. 2457T
uguuuaucuauaacaaaacuga

SEQ ID NO: 3881447 - RNA, 15 nt, Shigella flexneri 2a str. 2457T
uguuuaucuucccag

SEQ ID NO: 3881448 - RNA, 14 nt, Shigella flexneri 2a str. 2457T
uguuuaugccggau

SEQ ID NO: 3881449 - RNA, 23 nt, Shigella flexneri 2a str. 2457T
uguuuaugccugguugaguaaau

SEQ ID NO: 3881450 - RNA, 13 nt, Shigella flexneri 2a str. 2457T
uguuuauguugug

SEQ ID NO: 3881451 - RNA, 18 nt, Shigella flexneri 2a str. 2457T
uguuuauuuauacaguga

SEQ ID NO: 3881452 - RNA, 14 nt, Shigella flexneri 2a str. 2457T
uguuucaggaacac

SEQ ID NO: 3881453 - RNA, 16 nt, Shigella flexneri 2a str. 2457T
uguuucauaucaccgu

SEQ ID NO: 3881454 - RNA, 16 nt, Shigella flexneri 2a str. 2457T
uguuuccauauguacg

SEQ ID NO: 3881455 - RNA, 13 nt, Shigella flexneri 2a str. 2457T
uguuucucuuucu

SEQ ID NO: 3881456 - RNA, 15 nt, Shigella flexneri 2a str. 2457T
uguuugacaacucau

SEQ ID NO: 3881457 - RNA, 21 nt, Shigella flexneri 2a str. 2457T
uguuugcagugaucgugugcc

SEQ ID NO: 3881458 - RNA, 23 nt, Shigella flexneri 2a str. 2457T
uguuugcauccggcacaaugcuu

SEQ ID NO: 3881459 - RNA, 16 nt, Shigella flexneri 2a str. 2457T
uguuugccaucgggau

SEQ ID NO: 3881460 - RNA, 18 nt, Shigella flexneri 2a str. 2457T
uguuugugcugugacaga

SEQ ID NO: 3881461 - RNA, 16 nt, Shigella flexneri 2a str. 2457T
uguuuuagagaauuaa

SEQ ID NO: 3881462 - RNA, 13 nt, Shigella flexneri 2a str. 2457T
uguuuuauaaaga

SEQ ID NO: 3881463 - RNA, 23 nt, Shigella flexneri 2a str. 2457T
uguuuuaucucccuguaucccag

SEQ ID NO: 3881464 - RNA, 13 nt, Shigella flexneri 2a str. 2457T
uguuuuauguuca

SEQ ID NO: 3881465 - RNA, 22 nt, Shigella flexneri 2a str. 2457T
uguuuuccguugugcgauccac

SEQ ID NO: 3881466 - RNA, 15 nt, Shigella flexneri 2a str. 2457T
uguuuuuaagguuuc

SEQ ID NO: 3881467 - RNA, 20 nt, Shigella flexneri 2a str. 2457T
uguuuuucaucgcuaauaau

SEQ ID NO: 3881468 - RNA, 12 nt, Shigella flexneri 2a str. 2457T
uuaaaaaaacac

SEQ ID NO: 3881469 - RNA, 11 nt, Shigella flexneri 2a str. 2457T
uuaaaaaagaa

SEQ ID NO: 3881470 - RNA, 10 nt, Shigella flexneri 2a str. 2457T
uuaaaaacag

SEQ ID NO: 3881471 - RNA, 18 nt, Shigella flexneri 2a str. 2457T
uuaaaaacccugcagaaa

SEQ ID NO: 3881472 - RNA, 21 nt, Shigella flexneri 2a str. 2457T
uuaaaaacuucguuagguucu

SEQ ID NO: 3881473 - RNA, 18 nt, Shigella flexneri 2a str. 2457T
uuaaaacgcacgcuguca

SEQ ID NO: 3881474 - RNA, 13 nt, Shigella flexneri 2a str. 2457T
uuaaaacuaaaaa

SEQ ID NO: 3881475 - RNA, 21 nt, Shigella flexneri 2a str. 2457T
uuaaaacuaaaaacagcauca

SEQ ID NO: 3881476 - RNA, 20 nt, Shigella flexneri 2a str. 2457T
uuaaaauucaagacaucaau

SEQ ID NO: 3881477 - RNA, 15 nt, Shigella flexneri 2a str. 2457T
uuaaaauugcaugaa

SEQ ID NO: 3881478 - RNA, 18 nt, Shigella flexneri 2a str. 2457T
uuaaacaagguuugaaaa

SEQ ID NO: 3881479 - RNA, 11 nt, Shigella flexneri 2a str. 2457T
uuaaucaucaa

SEQ ID NO: 3881480 - RNA, 18 nt, Shigella flexneri 2a str. 2457T
uuaauccacagcaaugca

SEQ ID NO: 3881481 - RNA, 22 nt, Shigella flexneri 2a str. 2457T
uuaaucgccguauaauaucuuu

SEQ ID NO: 3881482 - RNA, 23 nt, Shigella flexneri 2a str. 2457T
uuaaucggcgucauuuuuucgac

SEQ ID NO: 3881483 - RNA, 13 nt, Shigella flexneri 2a str. 2457T
uuaaucugguauc

SEQ ID NO: 3881484 - RNA, 17 nt, Shigella flexneri 2a str. 2457T
uuaaucuuccagaucac

SEQ ID NO: 3881485 - RNA, 20 nt, Shigella flexneri 2a str. 2457T
uuaaugaacucgagaacacg

SEQ ID NO: 3881486 - RNA, 18 nt, Shigella flexneri 2a str. 2457T
uuaaugcaaucaaaaaug

SEQ ID NO: 3881487 - RNA, 22 nt, Shigella flexneri 2a str. 2457T
uuaaugccacauuagauaaaaa

SEQ ID NO: 3881488 - RNA, 19 nt, Shigella flexneri 2a str. 2457T
uuaaugccucuccccagcg

SEQ ID NO: 3881489 - RNA, 15 nt, Shigella flexneri 2a str. 2457T
uuaaugcgcccagcg

SEQ ID NO: 3881490 - RNA, 20 nt, Shigella flexneri 2a str. 2457T
uuaaugcgcuuccugcagcu

SEQ ID NO: 3881491 - RNA, 20 nt, Shigella flexneri 2a str. 2457T
uuaauggcgauaaucgaacc

SEQ ID NO: 3881492 - RNA, 22 nt, Shigella flexneri 2a str. 2457T
uuaauguuguaagcuugacaua

SEQ ID NO: 3881493 - RNA, 14 nt, Shigella flexneri 2a str. 2457T
uuaauuccggugaa

SEQ ID NO: 3881494 - RNA, 12 nt, Shigella flexneri 2a str. 2457T
uuaauucuaaaa

SEQ ID NO: 3881495 - RNA, 19 nt, Shigella flexneri 2a str. 2457T
uuaauugaaccuaagcuuu

SEQ ID NO: 3881496 - RNA, 21 nt, Shigella flexneri 2a str. 2457T
uuaauugcccgaagccaauuu

SEQ ID NO: 3881497 - RNA, 17 nt, Shigella flexneri 2a str. 2457T
uuaauugccguuaaaac

SEQ ID NO: 3881498 - RNA, 16 nt, Shigella flexneri 2a str. 2457T
uuaauuuucgcccguu

SEQ ID NO: 3881499 - RNA, 20 nt, Shigella flexneri 2a str. 2457T
uuaauuuugugcagcaugca

SEQ ID NO: 3881500 - RNA, 16 nt, Shigella flexneri 2a str. 2457T
uuacaacacauuauua

SEQ ID NO: 3881501 - RNA, 21 nt, Shigella flexneri 2a str. 2457T
uuacaaucaccguuucuggug

SEQ ID NO: 3881502 - RNA, 13 nt, Shigella flexneri 2a str. 2457T
uuacacaauuuug

SEQ ID NO: 3881503 - RNA, 22 nt, Shigella flexneri 2a str. 2457T
uuacacagcgacguaaaaaaca

SEQ ID NO: 3881504 - RNA, 19 nt, Shigella flexneri 2a str. 2457T
uuacaccaauaccgcccac

SEQ ID NO: 3881505 - RNA, 13 nt, Shigella flexneri 2a str. 2457T
uuacagcaacgcc

SEQ ID NO: 3881506 - RNA, 21 nt, Shigella flexneri 2a str. 2457T
uuacagcaacgggcugaagaa

SEQ ID NO: 3881507 - RNA, 13 nt, Shigella flexneri 2a str. 2457T
uuacagcaccuua

SEQ ID NO: 3881508 - RNA, 14 nt, Shigella flexneri 2a str. 2457T
uuacagcucucacu

SEQ ID NO: 3881509 - RNA, 23 nt, Shigella flexneri 2a str. 2457T
uuacaggguaaaaccaugccauc

SEQ ID NO: 3881510 - RNA, 21 nt, Shigella flexneri 2a str. 2457T
uuacaguaugagcaaacaaua

SEQ ID NO: 3881511 - RNA, 20 nt, Shigella flexneri 2a str. 2457T
uuacaucagcguaggacaca

SEQ ID NO: 3881512 - RNA, 22 nt, Shigella flexneri 2a str. 2457T
uuacaucagcguaggacacaga

SEQ ID NO: 3881513 - RNA, 12 nt, Shigella flexneri 2a str. 2457T
uuacaucaucag

SEQ ID NO: 3881514 - RNA, 15 nt, Shigella flexneri 2a str. 2457T
uuacaucaucagaaa

SEQ ID NO: 3881515 - RNA, 16 nt, Shigella flexneri 2a str. 2457T
uuacaucaucagaaau

SEQ ID NO: 3881516 - RNA, 18 nt, Shigella flexneri 2a str. 2457T
uuacaugcgcgacaaaaa

SEQ ID NO: 3881517 - RNA, 20 nt, Shigella flexneri 2a str. 2457T
uuacaugcgcgacaaaaauu

SEQ ID NO: 3881518 - RNA, 19 nt, Shigella flexneri 2a str. 2457T
uuacaugcugguguaacuu

SEQ ID NO: 3881519 - RNA, 22 nt, Shigella flexneri 2a str. 2457T
uuaccaaauaaacgaaucugca

SEQ ID NO: 3881520 - RNA, 23 nt, Shigella flexneri 2a str. 2457T
uuaccagcauuuaagcauuagca

SEQ ID NO: 3881521 - RNA, 14 nt, Shigella flexneri 2a str. 2457T
uuaccagcccuaau

SEQ ID NO: 3881522 - RNA, 16 nt, Shigella flexneri 2a str. 2457T
uuaccagcggccggau

SEQ ID NO: 3881523 - RNA, 13 nt, Shigella flexneri 2a str. 2457T
uuacccagcagca

SEQ ID NO: 3881524 - RNA, 21 nt, Shigella flexneri 2a str. 2457T
uuacccaggaagaccugcagc

SEQ ID NO: 3881525 - RNA, 13 nt, Shigella flexneri 2a str. 2457T
uuacccaggccug

SEQ ID NO: 3881526 - RNA, 13 nt, Shigella flexneri 2a str. 2457T
uuacccauucaag

SEQ ID NO: 3881527 - RNA, 22 nt, Shigella flexneri 2a str. 2457T
uuaccccacgucaucugucaua

SEQ ID NO: 3881528 - RNA, 23 nt, Shigella flexneri 2a str. 2457T
uuacccuacaccaugccggugau

SEQ ID NO: 3881529 - RNA, 15 nt, Shigella flexneri 2a str. 2457T
uuacccugugacaga

SEQ ID NO: 3881530 - RNA, 18 nt, Shigella flexneri 2a str. 2457T
uuacccugugacagacua

SEQ ID NO: 3881531 - RNA, 20 nt, Shigella flexneri 2a str. 2457T
uuaccgacgcugcucaaagc

SEQ ID NO: 3881532 - RNA, 19 nt, Shigella flexneri 2a str. 2457T
uuaccgagauaacguuuug

SEQ ID NO: 3881533 - RNA, 15 nt, Shigella flexneri 2a str. 2457T
uuaccgaucgccagc

SEQ ID NO: 3881534 - RNA, 16 nt, Shigella flexneri 2a str. 2457T
uuaccgcaaagcccac

SEQ ID NO: 3881535 - RNA, 17 nt, Shigella flexneri 2a str. 2457T
uuaccgcaccaccagca

SEQ ID NO: 3881536 - RNA, 23 nt, Shigella flexneri 2a str. 2457T
uuaccgccacagcagccuucgcc

SEQ ID NO: 3881537 - RNA, 14 nt, Shigella flexneri 2a str. 2457T
uuaccgccaccagg

SEQ ID NO: 3881538 - RNA, 19 nt, Shigella flexneri 2a str. 2457T
uuaccgcccccgcuaucca

SEQ ID NO: 3881539 - RNA, 19 nt, Shigella flexneri 2a str. 2457T
uuaccgcuauuugcgccug

SEQ ID NO: 3881540 - RNA, 19 nt, Shigella flexneri 2a str. 2457T
uuaccggucccuucaaucu

SEQ ID NO: 3881541 - RNA, 19 nt, Shigella flexneri 2a str. 2457T
uuaccggugccagcaacug

SEQ ID NO: 3881542 - RNA, 22 nt, Shigella flexneri 2a str. 2457T
uuaccguaccaaccgcaauugc

SEQ ID NO: 3881543 - RNA, 14 nt, Shigella flexneri 2a str. 2457T
uuaccucaccgggc

SEQ ID NO: 3881544 - RNA, 14 nt, Shigella flexneri 2a str. 2457T
uuaccucaggcacc

SEQ ID NO: 3881545 - RNA, 23 nt, Shigella flexneri 2a str. 2457T
uuaccugaaugcucugaggcuga

SEQ ID NO: 3881546 - RNA, 13 nt, Shigella flexneri 2a str. 2457T
uuaccuucauuug

SEQ ID NO: 3881547 - RNA, 15 nt, Shigella flexneri 2a str. 2457T
uuaccuucgcuuugu

SEQ ID NO: 3881548 - RNA, 17 nt, Shigella flexneri 2a str. 2457T
uuaccuuuaugacgauc

SEQ ID NO: 3881549 - RNA, 19 nt, Shigella flexneri 2a str. 2457T
uuacgacgcaaucaaaaaa

SEQ ID NO: 3881550 - RNA, 21 nt, Shigella flexneri 2a str. 2457T
uuacgacucaaccccagccau

SEQ ID NO: 3881551 - RNA, 22 nt, Shigella flexneri 2a str. 2457T
uuacgacucaaccccagccauu

SEQ ID NO: 3881552 - RNA, 16 nt, Shigella flexneri 2a str. 2457T
uuacgagucacaaaca

SEQ ID NO: 3881553 - RNA, 13 nt, Shigella flexneri 2a str. 2457T
uuacgauagaaua

SEQ ID NO: 3881554 - RNA, 20 nt, Shigella flexneri 2a str. 2457T
uuacgcaaaaccucuuccag

SEQ ID NO: 3881555 - RNA, 17 nt, Shigella flexneri 2a str. 2457T
uuacgcagcgguauaau

SEQ ID NO: 3881556 - RNA, 16 nt, Shigella flexneri 2a str. 2457T
uuacgccaccagcuga

SEQ ID NO: 3881557 - RNA, 13 nt, Shigella flexneri 2a str. 2457T
uuacgccaccgca

SEQ ID NO: 3881558 - RNA, 13 nt, Shigella flexneri 2a str. 2457T
uuacgccaggcau

SEQ ID NO: 3881559 - RNA, 17 nt, Shigella flexneri 2a str. 2457T
uuacgccccaacacaau

SEQ ID NO: 3881560 - RNA, 14 nt, Shigella flexneri 2a str. 2457T
uuacgcccgugaug

SEQ ID NO: 3881561 - RNA, 23 nt, Shigella flexneri 2a str. 2457T
uuacgccgagcgccagccauuca

SEQ ID NO: 3881562 - RNA, 14 nt, Shigella flexneri 2a str. 2457T
uuacgccgcaucag

SEQ ID NO: 3881563 - RNA, 17 nt, Shigella flexneri 2a str. 2457T
uuacgccgcauccaaca

SEQ ID NO: 3881564 - RNA, 18 nt, Shigella flexneri 2a str. 2457T
uuacgccgcauccggcaa

SEQ ID NO: 3881565 - RNA, 19 nt, Shigella flexneri 2a str. 2457T
uuacgccgcauccggcaua

SEQ ID NO: 3881566 - RNA, 20 nt, Shigella flexneri 2a str. 2457T
uuacgccgcauccggcauaa

SEQ ID NO: 3881567 - RNA, 19 nt, Shigella flexneri 2a str. 2457T
uuacgcggaucgagaaucu

SEQ ID NO: 3881568 - RNA, 16 nt, Shigella flexneri 2a str. 2457T
uuacgcucacugcaaa

SEQ ID NO: 3881569 - RNA, 21 nt, Shigella flexneri 2a str. 2457T
uuacgcucccacggaauagaa

SEQ ID NO: 3881570 - RNA, 14 nt, Shigella flexneri 2a str. 2457T
uuacggcacuccuc

SEQ ID NO: 3881571 - RNA, 17 nt, Shigella flexneri 2a str. 2457T
uuacgggcgauauaccu

SEQ ID NO: 3881572 - RNA, 23 nt, Shigella flexneri 2a str. 2457T
uuacggguucaagucccguccuc

SEQ ID NO: 3881573 - RNA, 16 nt, Shigella flexneri 2a str. 2457T
uuacgguuacgcaucu

SEQ ID NO: 3881574 - RNA, 17 nt, Shigella flexneri 2a str. 2457T
uuacgugcacaggcaac

SEQ ID NO: 3881575 - RNA, 15 nt, Shigella flexneri 2a str. 2457T
uuacguuacccagca

SEQ ID NO: 3881576 - RNA, 17 nt, Shigella flexneri 2a str. 2457T
uuaucagguauugaucu

SEQ ID NO: 3881577 - RNA, 11 nt, Shigella flexneri 2a str. 2457T
uuaucaugccu

SEQ ID NO: 3881578 - RNA, 21 nt, Shigella flexneri 2a str. 2457T
uuauccaccgaaauaaucaga

SEQ ID NO: 3881579 - RNA, 18 nt, Shigella flexneri 2a str. 2457T
uuauccacgaaacggcgu

SEQ ID NO: 3881580 - RNA, 11 nt, Shigella flexneri 2a str. 2457T
uuauccagcaa

SEQ ID NO: 3881581 - RNA, 17 nt, Shigella flexneri 2a str. 2457T
uuauccagccuacaaaa

SEQ ID NO: 3881582 - RNA, 22 nt, Shigella flexneri 2a str. 2457T
uuauccagccuacaaaaacuca

SEQ ID NO: 3881583 - RNA, 23 nt, Shigella flexneri 2a str. 2457T
uuauccaucaaagguuuuucagu

SEQ ID NO: 3881584 - RNA, 12 nt, Shigella flexneri 2a str. 2457T
uuaucccauccc

SEQ ID NO: 3881585 - RNA, 22 nt, Shigella flexneri 2a str. 2457T
uuaucccaucccacucaucgca

SEQ ID NO: 3881586 - RNA, 21 nt, Shigella flexneri 2a str. 2457T
uuaucccgauuaaucagugca

SEQ ID NO: 3881587 - RNA, 16 nt, Shigella flexneri 2a str. 2457T
uuaucccuguuaaaac

SEQ ID NO: 3881588 - RNA, 22 nt, Shigella flexneri 2a str. 2457T
uuauccgcaucacuccacacca

SEQ ID NO: 3881589 - RNA, 15 nt, Shigella flexneri 2a str. 2457T
uuauccgccagcgcc

SEQ ID NO: 3881590 - RNA, 23 nt, Shigella flexneri 2a str. 2457T
uuauccgccagugccaaagccag

SEQ ID NO: 3881591 - RNA, 17 nt, Shigella flexneri 2a str. 2457T
uuauccggccuacaaaa

SEQ ID NO: 3881592 - RNA, 17 nt, Shigella flexneri 2a str. 2457T
uuauccggcuaacaaaa

SEQ ID NO: 3881593 - RNA, 13 nt, Shigella flexneri 2a str. 2457T
uuauccggcuaua

SEQ ID NO: 3881594 - RNA, 17 nt, Shigella flexneri 2a str. 2457T
uuauccgucagccacuc

SEQ ID NO: 3881595 - RNA, 16 nt, Shigella flexneri 2a str. 2457T
uuauccucuguaaacu

SEQ ID NO: 3881596 - RNA, 22 nt, Shigella flexneri 2a str. 2457T
uuauccuucgauaaaagccauc

SEQ ID NO: 3881597 - RNA, 19 nt, Shigella flexneri 2a str. 2457T
uuaucgauuuucaaaauau

SEQ ID NO: 3881598 - RNA, 23 nt, Shigella flexneri 2a str. 2457T
uuaucgauuuucaaaauaucgac

SEQ ID NO: 3881599 - RNA, 18 nt, Shigella flexneri 2a str. 2457T
uuaucgcagggagccaca

SEQ ID NO: 3881600 - RNA, 14 nt, Shigella flexneri 2a str. 2457T
uuaucgccagcgcc

SEQ ID NO: 3881601 - RNA, 22 nt, Shigella flexneri 2a str. 2457T
uuaucgcccugcuccagcaacu

SEQ ID NO: 3881602 - RNA, 18 nt, Shigella flexneri 2a str. 2457T
uuaucgcgaugauuuucg

SEQ ID NO: 3881603 - RNA, 16 nt, Shigella flexneri 2a str. 2457T
uuaucgcgccaucaaa

SEQ ID NO: 3881604 - RNA, 18 nt, Shigella flexneri 2a str. 2457T
uuaucgcgucaacagggc

SEQ ID NO: 3881605 - RNA, 22 nt, Shigella flexneri 2a str. 2457T
uuaucgcgucuaaauuuugcau

SEQ ID NO: 3881606 - RNA, 17 nt, Shigella flexneri 2a str. 2457T
uuaucguaaugcucgac

SEQ ID NO: 3881607 - RNA, 20 nt, Shigella flexneri 2a str. 2457T
uuaucgugaauucacucuau

SEQ ID NO: 3881608 - RNA, 24 nt, Shigella flexneri 2a str. 2457T
uuaucgugccuacacauuaucuca

SEQ ID NO: 3881609 - RNA, 20 nt, Shigella flexneri 2a str. 2457T
uuaucuacagcauuuccuua

SEQ ID NO: 3881610 - RNA, 17 nt, Shigella flexneri 2a str. 2457T
uuaucuauaacaaaacu

SEQ ID NO: 3881611 - RNA, 18 nt, Shigella flexneri 2a str. 2457T
uuaucuauuaauuaugau

SEQ ID NO: 3881612 - RNA, 19 nt, Shigella flexneri 2a str. 2457T
uuaucuccauccgggauca

SEQ ID NO: 3881613 - RNA, 13 nt, Shigella flexneri 2a str. 2457T
uuaucuccuugcu

SEQ ID NO: 3881614 - RNA, 17 nt, Shigella flexneri 2a str. 2457T
uuaucugaucaauauag

SEQ ID NO: 3881615 - RNA, 20 nt, Shigella flexneri 2a str. 2457T
uuaucugccgaacaggcugc

SEQ ID NO: 3881616 - RNA, 21 nt, Shigella flexneri 2a str. 2457T
uuaucuggcauuugcacugaa

SEQ ID NO: 3881617 - RNA, 11 nt, Shigella flexneri 2a str. 2457T
uuaugaauaac

SEQ ID NO: 3881618 - RNA, 13 nt, Shigella flexneri 2a str. 2457T
uuaugaucaucaa

SEQ ID NO: 3881619 - RNA, 23 nt, Shigella flexneri 2a str. 2457T
uuaugcaauagcgccugcugcug

SEQ ID NO: 3881620 - RNA, 14 nt, Shigella flexneri 2a str. 2457T
uuaugcaauauauu

SEQ ID NO: 3881621 - RNA, 19 nt, Shigella flexneri 2a str. 2457T
uuaugcagccuuuuuuauu

SEQ ID NO: 3881622 - RNA, 13 nt, Shigella flexneri 2a str. 2457T
uuaugcagcugcu

SEQ ID NO: 3881623 - RNA, 19 nt, Shigella flexneri 2a str. 2457T
uuaugcagugcauccagca

SEQ ID NO: 3881624 - RNA, 21 nt, Shigella flexneri 2a str. 2457T
uuauggauaaaggccugccgc

SEQ ID NO: 3881625 - RNA, 14 nt, Shigella flexneri 2a str. 2457T
uuauggaucuggag

SEQ ID NO: 3881626 - RNA, 19 nt, Shigella flexneri 2a str. 2457T
uuauggcaaucguggucug

SEQ ID NO: 3881627 - RNA, 21 nt, Shigella flexneri 2a str. 2457T
uuauggcuggcuggcaucuug

SEQ ID NO: 3881628 - RNA, 20 nt, Shigella flexneri 2a str. 2457T
uuaugguagugccgucagca

SEQ ID NO: 3881629 - RNA, 13 nt, Shigella flexneri 2a str. 2457T
uuauggugcuagu

SEQ ID NO: 3881630 - RNA, 19 nt, Shigella flexneri 2a str. 2457T
uuauguggcccuauugauu

SEQ ID NO: 3881631 - RNA, 20 nt, Shigella flexneri 2a str. 2457T
uuauguucagccgucaucca

SEQ ID NO: 3881632 - RNA, 13 nt, Shigella flexneri 2a str. 2457T
uuauuaaauuuaa

SEQ ID NO: 3881633 - RNA, 17 nt, Shigella flexneri 2a str. 2457T
uuauuaaauuuaauaau

SEQ ID NO: 3881634 - RNA, 18 nt, Shigella flexneri 2a str. 2457T
uuauuaaauuuaauaaua

SEQ ID NO: 3881635 - RNA, 15 nt, Shigella flexneri 2a str. 2457T
uuauuaacuucccac

SEQ ID NO: 3881636 - RNA, 14 nt, Shigella flexneri 2a str. 2457T
uuauuacugcguau

SEQ ID NO: 3881637 - RNA, 11 nt, Shigella flexneri 2a str. 2457T
uuauuaucagg

SEQ ID NO: 3881638 - RNA, 22 nt, Shigella flexneri 2a str. 2457T
uuauuaucuggcaagccugaaa

SEQ ID NO: 3881639 - RNA, 14 nt, Shigella flexneri 2a str. 2457T
uuauuauuuacuug

SEQ ID NO: 3881640 - RNA, 15 nt, Shigella flexneri 2a str. 2457T
uuauucaucguccuu

SEQ ID NO: 3881641 - RNA, 22 nt, Shigella flexneri 2a str. 2457T
uuauucaugccuguauugguuu

SEQ ID NO: 3881642 - RNA, 16 nt, Shigella flexneri 2a str. 2457T
uuauuccauccugcuc

SEQ ID NO: 3881643 - RNA, 20 nt, Shigella flexneri 2a str. 2457T
uuauugauuccagcauaaug

SEQ ID NO: 3881644 - RNA, 19 nt, Shigella flexneri 2a str. 2457T
uuauugggcgaaagaaaag

SEQ ID NO: 3881645 - RNA, 20 nt, Shigella flexneri 2a str. 2457T
uuauugguaguguguuugau

SEQ ID NO: 3881646 - RNA, 14 nt, Shigella flexneri 2a str. 2457T
uuauuguagccugc

SEQ ID NO: 3881647 - RNA, 19 nt, Shigella flexneri 2a str. 2457T
uuauuucaaugcauuauca

SEQ ID NO: 3881648 - RNA, 14 nt, Shigella flexneri 2a str. 2457T
uuauuuccugcauu

SEQ ID NO: 3881649 - RNA, 14 nt, Shigella flexneri 2a str. 2457T
uuauuucuguauua

SEQ ID NO: 3881650 - RNA, 12 nt, Shigella flexneri 2a str. 2457T
uuauuugcugca

SEQ ID NO: 3881651 - RNA, 11 nt, Shigella flexneri 2a str. 2457T
uuauuuuauuu

SEQ ID NO: 3881652 - RNA, 17 nt, Shigella flexneri 2a str. 2457T
uuauuuugcccugcuau

SEQ ID NO: 3881653 - RNA, 12 nt, Shigella flexneri 2a str. 2457T
uuauuuuuaaac

SEQ ID NO: 3881654 - RNA, 15 nt, Shigella flexneri 2a str. 2457T
uucaaaaacaaagaa

SEQ ID NO: 3881655 - RNA, 16 nt, Shigella flexneri 2a str. 2457T
uucaaaaacuaauuca

SEQ ID NO: 3881656 - RNA, 20 nt, Shigella flexneri 2a str. 2457T
uucaaaaacuaauucaccuu

SEQ ID NO: 3881657 - RNA, 16 nt, Shigella flexneri 2a str. 2457T
uucaaaagaugagaaa

SEQ ID NO: 3881658 - RNA, 19 nt, Shigella flexneri 2a str. 2457T
uucaaaagaugagaaaaau

SEQ ID NO: 3881659 - RNA, 21 nt, Shigella flexneri 2a str. 2457T
uucaaacgcuucuggcgacau

SEQ ID NO: 3881660 - RNA, 18 nt, Shigella flexneri 2a str. 2457T
uucaaacguuuugcaauu

SEQ ID NO: 3881661 - RNA, 22 nt, Shigella flexneri 2a str. 2457T
uucaaacugaagauugaacagc

SEQ ID NO: 3881662 - RNA, 13 nt, Shigella flexneri 2a str. 2457T
uucaaaguugcau

SEQ ID NO: 3881663 - RNA, 14 nt, Shigella flexneri 2a str. 2457T
uucaaauccuucag

SEQ ID NO: 3881664 - RNA, 16 nt, Shigella flexneri 2a str. 2457T
uucaaaucgaaaucaa

SEQ ID NO: 3881665 - RNA, 21 nt, Shigella flexneri 2a str. 2457T
uucaaaucgacgcgugaaaau

SEQ ID NO: 3881666 - RNA, 22 nt, Shigella flexneri 2a str. 2457T
uucaaauuacgauccaccaccg

SEQ ID NO: 3881667 - RNA, 14 nt, Shigella flexneri 2a str. 2457T
uucaaauuaugucu

SEQ ID NO: 3881668 - RNA, 16 nt, Shigella flexneri 2a str. 2457T
uucaaauuaugucuca

SEQ ID NO: 3881669 - RNA, 18 nt, Shigella flexneri 2a str. 2457T
uucaacacacugaauaaa

SEQ ID NO: 3881670 - RNA, 19 nt, Shigella flexneri 2a str. 2457T
uucaacagauuacauuaaa

SEQ ID NO: 3881671 - RNA, 13 nt, Shigella flexneri 2a str. 2457T
uucaacagauuuc

SEQ ID NO: 3881672 - RNA, 16 nt, Shigella flexneri 2a str. 2457T
uucaacagcgugaacu

SEQ ID NO: 3881673 - RNA, 12 nt, Shigella flexneri 2a str. 2457T
uucacugcccac

SEQ ID NO: 3881674 - RNA, 21 nt, Shigella flexneri 2a str. 2457T
uucacugccguacaggcagcu

SEQ ID NO: 3881675 - RNA, 12 nt, Shigella flexneri 2a str. 2457T
uucacugccugc

SEQ ID NO: 3881676 - RNA, 20 nt, Shigella flexneri 2a str. 2457T
uucacugggcgauuaauaaa

SEQ ID NO: 3881677 - RNA, 17 nt, Shigella flexneri 2a str. 2457T
uucacuucaaccacauu

SEQ ID NO: 3881678 - RNA, 13 nt, Shigella flexneri 2a str. 2457T
uucacuuucugaa

SEQ ID NO: 3881679 - RNA, 20 nt, Shigella flexneri 2a str. 2457T
uucacuuuugccagacgaau

SEQ ID NO: 3881680 - RNA, 17 nt, Shigella flexneri 2a str. 2457T
uucacuuuugcugcaaa

SEQ ID NO: 3881681 - RNA, 23 nt, Shigella flexneri 2a str. 2457T
uucagaaagcccgaaucaguaau

SEQ ID NO: 3881682 - RNA, 12 nt, Shigella flexneri 2a str. 2457T
uucagaaaguaa

SEQ ID NO: 3881683 - RNA, 17 nt, Shigella flexneri 2a str. 2457T
uucagaagcugaagcag

SEQ ID NO: 3881684 - RNA, 16 nt, Shigella flexneri 2a str. 2457T
uucagaauagacaaaa

SEQ ID NO: 3881685 - RNA, 14 nt, Shigella flexneri 2a str. 2457T
uucagaaucaaguc

SEQ ID NO: 3881686 - RNA, 15 nt, Shigella flexneri 2a str. 2457T
uucagaccuguugcc

SEQ ID NO: 3881687 - RNA, 16 nt, Shigella flexneri 2a str. 2457T
uucagauaauagguaa

SEQ ID NO: 3881688 - RNA, 23 nt, Shigella flexneri 2a str. 2457T
uucagauaauccccaaugaccuu

SEQ ID NO: 3881689 - RNA, 15 nt, Shigella flexneri 2a str. 2457T
uucagauaaugcccg

SEQ ID NO: 3881690 - RNA, 23 nt, Shigella flexneri 2a str. 2457T
uucagaucgguuuuuuucgaacc

SEQ ID NO: 3881691 - RNA, 23 nt, Shigella flexneri 2a str. 2457T
uucagauuaugucgcucaaugug

SEQ ID NO: 3881692 - RNA, 20 nt, Shigella flexneri 2a str. 2457T
uucagauucagcgucgucag

SEQ ID NO: 3881693 - RNA, 15 nt, Shigella flexneri 2a str. 2457T
uucagauugcagaca

SEQ ID NO: 3881694 - RNA, 20 nt, Shigella flexneri 2a str. 2457T
uucagauugcagacaaagug

SEQ ID NO: 3881695 - RNA, 21 nt, Shigella flexneri 2a str. 2457T
uucagauuguugacaaagugc

SEQ ID NO: 3881696 - RNA, 21 nt, Shigella flexneri 2a str. 2457T
uucagcaaaccacugauaagc

SEQ ID NO: 3881697 - RNA, 22 nt, Shigella flexneri 2a str. 2457T
uucagcaagcgauaauuuaugc

SEQ ID NO: 3881698 - RNA, 17 nt, Shigella flexneri 2a str. 2457T
uucagcaaucucuucaa

SEQ ID NO: 3881699 - RNA, 23 nt, Shigella flexneri 2a str. 2457T
uucagcaauucucucuucagcuu

SEQ ID NO: 3881700 - RNA, 12 nt, Shigella flexneri 2a str. 2457T
uucagcaccaga

SEQ ID NO: 3881701 - RNA, 13 nt, Shigella flexneri 2a str. 2457T
uucagcagcccau

SEQ ID NO: 3881702 - RNA, 18 nt, Shigella flexneri 2a str. 2457T
uucagcagcggcacacaa

SEQ ID NO: 3881703 - RNA, 20 nt, Shigella flexneri 2a str. 2457T
uucagcagcucaucaagcug

SEQ ID NO: 3881704 - RNA, 17 nt, Shigella flexneri 2a str. 2457T
uucagcaguucugccag

SEQ ID NO: 3881705 - RNA, 22 nt, Shigella flexneri 2a str. 2457T
uucagcaugcauuuaagaaaaa

SEQ ID NO: 3881706 - RNA, 21 nt, Shigella flexneri 2a str. 2457T
uucagccauacguugcauaaa

SEQ ID NO: 3881707 - RNA, 14 nt, Shigella flexneri 2a str. 2457T
uucagccccagcac

SEQ ID NO: 3881708 - RNA, 15 nt, Shigella flexneri 2a str. 2457T
uucagccccagcacu

SEQ ID NO: 3881709 - RNA, 21 nt, Shigella flexneri 2a str. 2457T
uucagccccagcacuucgcug

SEQ ID NO: 3881710 - RNA, 17 nt, Shigella flexneri 2a str. 2457T
uucagccggaauaauca

SEQ ID NO: 3881711 - RNA, 13 nt, Shigella flexneri 2a str. 2457T
uucagccguaacu

SEQ ID NO: 3881712 - RNA, 17 nt, Shigella flexneri 2a str. 2457T
uucagcgauauccagcg

SEQ ID NO: 3881713 - RNA, 11 nt, Shigella flexneri 2a str. 2457T
uucagcggcag

SEQ ID NO: 3881714 - RNA, 15 nt, Shigella flexneri 2a str. 2457T
uucagcguaucccag

SEQ ID NO: 3881715 - RNA, 16 nt, Shigella flexneri 2a str. 2457T
uucagcguuccccaga

SEQ ID NO: 3881716 - RNA, 16 nt, Shigella flexneri 2a str. 2457T
uucagcucaagaaucu

SEQ ID NO: 3881717 - RNA, 14 nt, Shigella flexneri 2a str. 2457T
uucaggaaauaaau

SEQ ID NO: 3881718 - RNA, 21 nt, Shigella flexneri 2a str. 2457T
uucaggaacaccgcacgcaga

SEQ ID NO: 3881719 - RNA, 15 nt, Shigella flexneri 2a str. 2457T
uucaggaugguauug

SEQ ID NO: 3881720 - RNA, 17 nt, Shigella flexneri 2a str. 2457T
uucaggaugguauugga

SEQ ID NO: 3881721 - RNA, 22 nt, Shigella flexneri 2a str. 2457T
uucaggcaguaugcucagaaua

SEQ ID NO: 3881722 - RNA, 17 nt, Shigella flexneri 2a str. 2457T
uucaggccgcgcaguuc

SEQ ID NO: 3881723 - RNA, 15 nt, Shigella flexneri 2a str. 2457T
uucagguaauuaaca

SEQ ID NO: 3881724 - RNA, 10 nt, Shigella flexneri 2a str. 2457T
uucaggucag

SEQ ID NO: 3881725 - RNA, 20 nt, Shigella flexneri 2a str. 2457T
uucagguuacgcccuucacc

SEQ ID NO: 3881726 - RNA, 14 nt, Shigella flexneri 2a str. 2457T
uucaguacguucac

SEQ ID NO: 3881727 - RNA, 18 nt, Shigella flexneri 2a str. 2457T
uucagugacuucugccag

SEQ ID NO: 3881728 - RNA, 19 nt, Shigella flexneri 2a str. 2457T
uucagugacuucugccagc

SEQ ID NO: 3881729 - RNA, 20 nt, Shigella flexneri 2a str. 2457T
uucagugauggugauaauca

SEQ ID NO: 3881730 - RNA, 14 nt, Shigella flexneri 2a str. 2457T
uucagugcaaaugc

SEQ ID NO: 3881731 - RNA, 15 nt, Shigella flexneri 2a str. 2457T
uucagugcaaaugcc

SEQ ID NO: 3881732 - RNA, 16 nt, Shigella flexneri 2a str. 2457T
uucagugcaaaugcca

SEQ ID NO: 3881733 - RNA, 17 nt, Shigella flexneri 2a str. 2457T
uucaguuaccugaaugc

SEQ ID NO: 3881734 - RNA, 14 nt, Shigella flexneri 2a str. 2457T
uucaguugcucugc

SEQ ID NO: 3881735 - RNA, 23 nt, Shigella flexneri 2a str. 2457T
uucauaaacacgguuuuucauug

SEQ ID NO: 3881736 - RNA, 22 nt, Shigella flexneri 2a str. 2457T
uucauacggcacuuucaucgcg

SEQ ID NO: 3881737 - RNA, 12 nt, Shigella flexneri 2a str. 2457T
uucauacugccg

SEQ ID NO: 3881738 - RNA, 21 nt, Shigella flexneri 2a str. 2457T
uucauacugccgaccaucugu

SEQ ID NO: 3881739 - RNA, 19 nt, Shigella flexneri 2a str. 2457T
uucauaguaagcagauucu

SEQ ID NO: 3881740 - RNA, 16 nt, Shigella flexneri 2a str. 2457T
uucauauccgucauau

SEQ ID NO: 3881741 - RNA, 14 nt, Shigella flexneri 2a str. 2457T
uucauaucugccag

SEQ ID NO: 3881742 - RNA, 20 nt, Shigella flexneri 2a str. 2457T
uucauauuccugacccagca

SEQ ID NO: 3881743 - RNA, 15 nt, Shigella flexneri 2a str. 2457T
uucaucaaaaaauga

SEQ ID NO: 3881744 - RNA, 16 nt, Shigella flexneri 2a str. 2457T
uucaucaaaaaaugaa

SEQ ID NO: 3881745 - RNA, 22 nt, Shigella flexneri 2a str. 2457T
uucaucaagcugugccugaaua

SEQ ID NO: 3881746 - RNA, 18 nt, Shigella flexneri 2a str. 2457T
uucaucacgaaaaucauu

SEQ ID NO: 3881747 - RNA, 20 nt, Shigella flexneri 2a str. 2457T
uucaucacuugauccauauc

SEQ ID NO: 3881748 - RNA, 22 nt, Shigella flexneri 2a str. 2457T
uucaucauccgugaauaaugca

SEQ ID NO: 3881749 - RNA, 17 nt, Shigella flexneri 2a str. 2457T
uucaucauccucuucag

SEQ ID NO: 3881750 - RNA, 24 nt, Shigella flexneri 2a str. 2457T
uucaucauccuuugggcauuugca

SEQ ID NO: 3881751 - RNA, 12 nt, Shigella flexneri 2a str. 2457T
uucauccagcag

SEQ ID NO: 3881752 - RNA, 14 nt, Shigella flexneri 2a str. 2457T
uucauccagcauca

SEQ ID NO: 3881753 - RNA, 22 nt, Shigella flexneri 2a str. 2457T
uucaucccgguuauuaaaacga

SEQ ID NO: 3881754 - RNA, 17 nt, Shigella flexneri 2a str. 2457T
uucaucccucucaucca

SEQ ID NO: 3881755 - RNA, 20 nt, Shigella flexneri 2a str. 2457T
uucauccggcuguuccagca

SEQ ID NO: 3881756 - RNA, 14 nt, Shigella flexneri 2a str. 2457T
uucauccguuuccc

SEQ ID NO: 3881757 - RNA, 20 nt, Shigella flexneri 2a str. 2457T
uucauccguuucucuguuca

SEQ ID NO: 3881758 - RNA, 22 nt, Shigella flexneri 2a str. 2457T
uucauccguuucucuguucagc

SEQ ID NO: 3881759 - RNA, 19 nt, Shigella flexneri 2a str. 2457T
uucauccuggcacagcagu

SEQ ID NO: 3881760 - RNA, 19 nt, Shigella flexneri 2a str. 2457T
uucauccuguacgacaaaa

SEQ ID NO: 3881761 - RNA, 19 nt, Shigella flexneri 2a str. 2457T
uucaucgcacgagaaaaaa

SEQ ID NO: 3881762 - RNA, 12 nt, Shigella flexneri 2a str. 2457T
uucaucgccagc

SEQ ID NO: 3881763 - RNA, 13 nt, Shigella flexneri 2a str. 2457T
uucaucgcccaca

SEQ ID NO: 3881764 - RNA, 15 nt, Shigella flexneri 2a str. 2457T
uucaucgcccuuuuu

SEQ ID NO: 3881765 - RNA, 19 nt, Shigella flexneri 2a str. 2457T
uucaucgcggucagcugcu

SEQ ID NO: 3881766 - RNA, 23 nt, Shigella flexneri 2a str. 2457T
uucaucggcggugaccagcagca

SEQ ID NO: 3881767 - RNA, 17 nt, Shigella flexneri 2a str. 2457T
uucaucggcguuuucug

SEQ ID NO: 3881768 - RNA, 14 nt, Shigella flexneri 2a str. 2457T
uucaucgugcucgc

SEQ ID NO: 3881769 - RNA, 17 nt, Shigella flexneri 2a str. 2457T
uucaucgugcucgcuuu

SEQ ID NO: 3881770 - RNA, 16 nt, Shigella flexneri 2a str. 2457T
uuccggcaacaaugcc

SEQ ID NO: 3881771 - RNA, 15 nt, Shigella flexneri 2a str. 2457T
uuccggcaagcaaau

SEQ ID NO: 3881772 - RNA, 17 nt, Shigella flexneri 2a str. 2457T
uuccggcaaucgucgau

SEQ ID NO: 3881773 - RNA, 17 nt, Shigella flexneri 2a str. 2457T
uuccggcaccacaaacu

SEQ ID NO: 3881774 - RNA, 23 nt, Shigella flexneri 2a str. 2457T
uuccggcagaagcaaucauccca

SEQ ID NO: 3881775 - RNA, 19 nt, Shigella flexneri 2a str. 2457T
uuccggcaucacaucgcug

SEQ ID NO: 3881776 - RNA, 20 nt, Shigella flexneri 2a str. 2457T
uuccgggaucugauucugau

SEQ ID NO: 3881777 - RNA, 20 nt, Shigella flexneri 2a str. 2457T
uuccgggguaaauuucuucc

SEQ ID NO: 3881778 - RNA, 21 nt, Shigella flexneri 2a str. 2457T
uuccggguuugccacaucacu

SEQ ID NO: 3881779 - RNA, 15 nt, Shigella flexneri 2a str. 2457T
uuccgucagcaaagu

SEQ ID NO: 3881780 - RNA, 15 nt, Shigella flexneri 2a str. 2457T
uuccgucagcggcaa

SEQ ID NO: 3881781 - RNA, 14 nt, Shigella flexneri 2a str. 2457T
uuccgucagucaca

SEQ ID NO: 3881782 - RNA, 19 nt, Shigella flexneri 2a str. 2457T
uuccuaaccgaauucaaau

SEQ ID NO: 3881783 - RNA, 22 nt, Shigella flexneri 2a str. 2457T
uuccuaugcaacaacugaaaaa

SEQ ID NO: 3881784 - RNA, 11 nt, Shigella flexneri 2a str. 2457T
uuccuccauuu

SEQ ID NO: 3881785 - RNA, 20 nt, Shigella flexneri 2a str. 2457T
uuccuccugucuucccugcu

SEQ ID NO: 3881786 - RNA, 18 nt, Shigella flexneri 2a str. 2457T
uuccucgucccaaaagcu

SEQ ID NO: 3881787 - RNA, 24 nt, Shigella flexneri 2a str. 2457T
uuccucuucgcguaacugaagcau

SEQ ID NO: 3881788 - RNA, 22 nt, Shigella flexneri 2a str. 2457T
uuccugacccagcaccaguacc

SEQ ID NO: 3881789 - RNA, 12 nt, Shigella flexneri 2a str. 2457T
uuccugacuccu

SEQ ID NO: 3881790 - RNA, 22 nt, Shigella flexneri 2a str. 2457T
uuccugaguaauaacuuccuga

SEQ ID NO: 3881791 - RNA, 20 nt, Shigella flexneri 2a str. 2457T
uuccugauaaccuuccagcu

SEQ ID NO: 3881792 - RNA, 16 nt, Shigella flexneri 2a str. 2457T
uuccugcaacuucucu

SEQ ID NO: 3881793 - RNA, 19 nt, Shigella flexneri 2a str. 2457T
uuccugcaacuucucuuuc

SEQ ID NO: 3881794 - RNA, 14 nt, Shigella flexneri 2a str. 2457T
uuccugcaucgccu

SEQ ID NO: 3881795 - RNA, 15 nt, Shigella flexneri 2a str. 2457T
uuccugccaguuuuu

SEQ ID NO: 3881796 - RNA, 15 nt, Shigella flexneri 2a str. 2457T
uuccugcgcuuccag

SEQ ID NO: 3881797 - RNA, 17 nt, Shigella flexneri 2a str. 2457T
uuccugcgcuuccagcu

SEQ ID NO: 3881798 - RNA, 22 nt, Shigella flexneri 2a str. 2457T
uuccugcggagcaaccugcacg

SEQ ID NO: 3881799 - RNA, 23 nt, Shigella flexneri 2a str. 2457T
uuccugcggcagacgcucgccau

SEQ ID NO: 3881800 - RNA, 20 nt, Shigella flexneri 2a str. 2457T
uuccugcuuuauaaucccuc

SEQ ID NO: 3881801 - RNA, 21 nt, Shigella flexneri 2a str. 2457T
uuccuggaaccagugaauacu

SEQ ID NO: 3881802 - RNA, 15 nt, Shigella flexneri 2a str. 2457T
uuccuggagcaggag

SEQ ID NO: 3881803 - RNA, 15 nt, Shigella flexneri 2a str. 2457T
uuccuggcuuggcug

SEQ ID NO: 3881804 - RNA, 20 nt, Shigella flexneri 2a str. 2457T
uuccugggauaugagcgauu

SEQ ID NO: 3881805 - RNA, 17 nt, Shigella flexneri 2a str. 2457T
uuccuggucggcaaacu

SEQ ID NO: 3881806 - RNA, 22 nt, Shigella flexneri 2a str. 2457T
uuccuggucggcaaacugcuga

SEQ ID NO: 3881807 - RNA, 21 nt, Shigella flexneri 2a str. 2457T
uuccugguucucacuguucac

SEQ ID NO: 3881808 - RNA, 20 nt, Shigella flexneri 2a str. 2457T
uuccuguagcguuaccagca

SEQ ID NO: 3881809 - RNA, 15 nt, Shigella flexneri 2a str. 2457T
uuccuucagcagcag

SEQ ID NO: 3881810 - RNA, 12 nt, Shigella flexneri 2a str. 2457T
uuccuugaaaaa

SEQ ID NO: 3881811 - RNA, 15 nt, Shigella flexneri 2a str. 2457T
uuccuugaaaaagag

SEQ ID NO: 3881812 - RNA, 19 nt, Shigella flexneri 2a str. 2457T
uuccuugaaaaagagguug

SEQ ID NO: 3881813 - RNA, 16 nt, Shigella flexneri 2a str. 2457T
uucgaaaaucucauau

SEQ ID NO: 3881814 - RNA, 19 nt, Shigella flexneri 2a str. 2457T
uucgaaauagagaaaguaa

SEQ ID NO: 3881815 - RNA, 22 nt, Shigella flexneri 2a str. 2457T
uucgaaccacaaaagacgauag

SEQ ID NO: 3881816 - RNA, 17 nt, Shigella flexneri 2a str. 2457T
uucgaagaguuccaacg

SEQ ID NO: 3881817 - RNA, 18 nt, Shigella flexneri 2a str. 2457T
uucgaauauucugaagca

SEQ ID NO: 3881818 - RNA, 22 nt, Shigella flexneri 2a str. 2457T
uucgaaugccgucgaggaacau

SEQ ID NO: 3881819 - RNA, 15 nt, Shigella flexneri 2a str. 2457T
uucgacaacugcuga

SEQ ID NO: 3881820 - RNA, 13 nt, Shigella flexneri 2a str. 2457T
uucgacaccaucu

SEQ ID NO: 3881821 - RNA, 22 nt, Shigella flexneri 2a str. 2457T
uucgacagaaaccugauuacgc

SEQ ID NO: 3881822 - RNA, 18 nt, Shigella flexneri 2a str. 2457T
uucgaccagccaggccgc

SEQ ID NO: 3881823 - RNA, 17 nt, Shigella flexneri 2a str. 2457T
uucgaccggguuucuua

SEQ ID NO: 3881824 - RNA, 17 nt, Shigella flexneri 2a str. 2457T
uucgacgacaacgcggc

SEQ ID NO: 3881825 - RNA, 14 nt, Shigella flexneri 2a str. 2457T
uucgacggcaucag

SEQ ID NO: 3881826 - RNA, 17 nt, Shigella flexneri 2a str. 2457T
uucgacuuuaccgccuu

SEQ ID NO: 3881827 - RNA, 15 nt, Shigella flexneri 2a str. 2457T
uucgagauucuuaaa

SEQ ID NO: 3881828 - RNA, 15 nt, Shigella flexneri 2a str. 2457T
uucgaguacauccac

SEQ ID NO: 3881829 - RNA, 23 nt, Shigella flexneri 2a str. 2457T
uucgaguacauccacugcauacu

SEQ ID NO: 3881830 - RNA, 23 nt, Shigella flexneri 2a str. 2457T
uucgauaaacucaaucaggcuau

SEQ ID NO: 3881831 - RNA, 16 nt, Shigella flexneri 2a str. 2457T
uucgauagcaaauugc

SEQ ID NO: 3881832 - RNA, 16 nt, Shigella flexneri 2a str. 2457T
uucgaugcggcucagc

SEQ ID NO: 3881833 - RNA, 14 nt, Shigella flexneri 2a str. 2457T
uucgauugcacaaa

SEQ ID NO: 3881834 - RNA, 15 nt, Shigella flexneri 2a str. 2457T
uucgcaaaaaaccau

SEQ ID NO: 3881835 - RNA, 21 nt, Shigella flexneri 2a str. 2457T
uucgcaauaaucaucucuccu

SEQ ID NO: 3881836 - RNA, 20 nt, Shigella flexneri 2a str. 2457T
uucgcacaccgcugacuuuc

SEQ ID NO: 3881837 - RNA, 15 nt, Shigella flexneri 2a str. 2457T
uucgcaccaaaucca

SEQ ID NO: 3881838 - RNA, 20 nt, Shigella flexneri 2a str. 2457T
uucgcagagugauucuuugu

SEQ ID NO: 3881839 - RNA, 20 nt, Shigella flexneri 2a str. 2457T
uucgcagcuuauuucuguga

SEQ ID NO: 3881840 - RNA, 14 nt, Shigella flexneri 2a str. 2457T
uucgcaucggugau

SEQ ID NO: 3881841 - RNA, 20 nt, Shigella flexneri 2a str. 2457T
uucgccaaaugucaccagcc

SEQ ID NO: 3881842 - RNA, 21 nt, Shigella flexneri 2a str. 2457T
uucgccacccagcgccgccau

SEQ ID NO: 3881843 - RNA, 13 nt, Shigella flexneri 2a str. 2457T
uucgccaggcacu

SEQ ID NO: 3881844 - RNA, 18 nt, Shigella flexneri 2a str. 2457T
uucgccaggcacuuucag

SEQ ID NO: 3881845 - RNA, 14 nt, Shigella flexneri 2a str. 2457T
uucgcccgucguga

SEQ ID NO: 3881846 - RNA, 12 nt, Shigella flexneri 2a str. 2457T
uucgcccugcag

SEQ ID NO: 3881847 - RNA, 17 nt, Shigella flexneri 2a str. 2457T
uucgcccuggacaacau

SEQ ID NO: 3881848 - RNA, 20 nt, Shigella flexneri 2a str. 2457T
uucgcccuggacaacauucc

SEQ ID NO: 3881849 - RNA, 12 nt, Shigella flexneri 2a str. 2457T
uucgcccuucgg

SEQ ID NO: 3881850 - RNA, 15 nt, Shigella flexneri 2a str. 2457T
uucgccgaacacaca

SEQ ID NO: 3881851 - RNA, 23 nt, Shigella flexneri 2a str. 2457T
uucgccgcagcaucgucaucauu

SEQ ID NO: 3881852 - RNA, 19 nt, Shigella flexneri 2a str. 2457T
uucgccgguuccagcuuca

SEQ ID NO: 3881853 - RNA, 20 nt, Shigella flexneri 2a str. 2457T
uucgccuccuguucugugcg

SEQ ID NO: 3881854 - RNA, 15 nt, Shigella flexneri 2a str. 2457T
uucgccugaaauaau

SEQ ID NO: 3881855 - RNA, 15 nt, Shigella flexneri 2a str. 2457T
uucgccugccugcag

SEQ ID NO: 3881856 - RNA, 19 nt, Shigella flexneri 2a str. 2457T
uucgccugcguacuggcau

SEQ ID NO: 3881857 - RNA, 16 nt, Shigella flexneri 2a str. 2457T
uucgccuuucaguuca

SEQ ID NO: 3881858 - RNA, 19 nt, Shigella flexneri 2a str. 2457T
uucgcgaaucgccacaacu

SEQ ID NO: 3881859 - RNA, 22 nt, Shigella flexneri 2a str. 2457T
uucgcgaucaaacgccagauca

SEQ ID NO: 3881860 - RNA, 21 nt, Shigella flexneri 2a str. 2457T
uucgcgauucugauugccgcu

SEQ ID NO: 3881861 - RNA, 18 nt, Shigella flexneri 2a str. 2457T
uucgcgccgcauccggca

SEQ ID NO: 3881862 - RNA, 16 nt, Shigella flexneri 2a str. 2457T
uucgcggaauuucaga

SEQ ID NO: 3881863 - RNA, 19 nt, Shigella flexneri 2a str. 2457T
uucgcguaacugaagcauu

SEQ ID NO: 3881864 - RNA, 22 nt, Shigella flexneri 2a str. 2457T
uucgcuaaagacuuugcugccu

SEQ ID NO: 3881865 - RNA, 23 nt, Shigella flexneri 2a str. 2457T
uucgcuaagauaccccagcgcaa

SEQ ID NO: 3881866 - RNA, 21 nt, Shigella flexneri 2a str. 2457T
uucgcuaccugagucaucaac

SEQ ID NO: 3881867 - RNA, 19 nt, Shigella flexneri 2a str. 2457T
uucuggucgagaucgccaa

SEQ ID NO: 3881868 - RNA, 23 nt, Shigella flexneri 2a str. 2457T
uucuguaugccggauaagguguu

SEQ ID NO: 3881869 - RNA, 11 nt, Shigella flexneri 2a str. 2457T
uucugucauga

SEQ ID NO: 3881870 - RNA, 20 nt, Shigella flexneri 2a str. 2457T
uucugucgauaaacucaugg

SEQ ID NO: 3881871 - RNA, 19 nt, Shigella flexneri 2a str. 2457T
uucugugcagccaaaaaug

SEQ ID NO: 3881872 - RNA, 22 nt, Shigella flexneri 2a str. 2457T
uucuguguaaaugccuuucuca

SEQ ID NO: 3881873 - RNA, 19 nt, Shigella flexneri 2a str. 2457T
uucuuaccccugauuuugu

SEQ ID NO: 3881874 - RNA, 23 nt, Shigella flexneri 2a str. 2457T
uucuuaccggucccuucaaucuc

SEQ ID NO: 3881875 - RNA, 24 nt, Shigella flexneri 2a str. 2457T
uucuuacuucaacacauaaccgua

SEQ ID NO: 3881876 - RNA, 20 nt, Shigella flexneri 2a str. 2457T
uucuuagucccaaacagcag

SEQ ID NO: 3881877 - RNA, 15 nt, Shigella flexneri 2a str. 2457T
uucuucaacaauuga

SEQ ID NO: 3881878 - RNA, 16 nt, Shigella flexneri 2a str. 2457T
uucuucaacgaagaaa

SEQ ID NO: 3881879 - RNA, 23 nt, Shigella flexneri 2a str. 2457T
uucuucaaguguggccgccagug

SEQ ID NO: 3881880 - RNA, 21 nt, Shigella flexneri 2a str. 2457T
uucuucaauuuccgucgcaug

SEQ ID NO: 3881881 - RNA, 21 nt, Shigella flexneri 2a str. 2457T
uucuucacaccaucaaagaag

SEQ ID NO: 3881882 - RNA, 17 nt, Shigella flexneri 2a str. 2457T
uucuucacggaaaauau

SEQ ID NO: 3881883 - RNA, 12 nt, Shigella flexneri 2a str. 2457T
uucuucacugac

SEQ ID NO: 3881884 - RNA, 22 nt, Shigella flexneri 2a str. 2457T
uucuucagcgacagggccagga

SEQ ID NO: 3881885 - RNA, 22 nt, Shigella flexneri 2a str. 2457T
uucuucagcguccgggaaaucc

SEQ ID NO: 3881886 - RNA, 20 nt, Shigella flexneri 2a str. 2457T
uucuucggucagagaaucga

SEQ ID NO: 3881887 - RNA, 21 nt, Shigella flexneri 2a str. 2457T
uucuucguuaaacagcuugga

SEQ ID NO: 3881888 - RNA, 14 nt, Shigella flexneri 2a str. 2457T
uucuucuuucagua

SEQ ID NO: 3881889 - RNA, 21 nt, Shigella flexneri 2a str. 2457T
uucuugcuccacguucagaga

SEQ ID NO: 3881890 - RNA, 16 nt, Shigella flexneri 2a str. 2457T
uucuugcuguuugcga

SEQ ID NO: 3881891 - RNA, 20 nt, Shigella flexneri 2a str. 2457T
uucuuggcacccagcgcuuu

SEQ ID NO: 3881892 - RNA, 14 nt, Shigella flexneri 2a str. 2457T
uucuuuaaauaugg

SEQ ID NO: 3881893 - RNA, 22 nt, Shigella flexneri 2a str. 2457T
uucuuuacugcccgcuugcgcc

SEQ ID NO: 3881894 - RNA, 21 nt, Shigella flexneri 2a str. 2457T
uucuuuauaucugguuugcca

SEQ ID NO: 3881895 - RNA, 21 nt, Shigella flexneri 2a str. 2457T
uucuuuauugauuaaaggaag

SEQ ID NO: 3881896 - RNA, 17 nt, Shigella flexneri 2a str. 2457T
uucuuucucgccuuucu

SEQ ID NO: 3881897 - RNA, 18 nt, Shigella flexneri 2a str. 2457T
uucuuucucgcucaguuu

SEQ ID NO: 3881898 - RNA, 21 nt, Shigella flexneri 2a str. 2457T
uucuuugagcuucgccuggac

SEQ ID NO: 3881899 - RNA, 23 nt, Shigella flexneri 2a str. 2457T
uucuuugcgcccccgauccagcg

SEQ ID NO: 3881900 - RNA, 15 nt, Shigella flexneri 2a str. 2457T
uucuuuuaccuucag

SEQ ID NO: 3881901 - RNA, 11 nt, Shigella flexneri 2a str. 2457T
uucuuuuucau

SEQ ID NO: 3881902 - RNA, 12 nt, Shigella flexneri 2a str. 2457T
uugaaaaacaug

SEQ ID NO: 3881903 - RNA, 12 nt, Shigella flexneri 2a str. 2457T
uugaaaagguac

SEQ ID NO: 3881904 - RNA, 17 nt, Shigella flexneri 2a str. 2457T
uugaaacacuuaauggu

SEQ ID NO: 3881905 - RNA, 23 nt, Shigella flexneri 2a str. 2457T
uugaaacgaguggugucgucaaa

SEQ ID NO: 3881906 - RNA, 14 nt, Shigella flexneri 2a str. 2457T
uugaaauaccaggu

SEQ ID NO: 3881907 - RNA, 13 nt, Shigella flexneri 2a str. 2457T
uugaaauagccaa

SEQ ID NO: 3881908 - RNA, 16 nt, Shigella flexneri 2a str. 2457T
uugaaauauauccuau

SEQ ID NO: 3881909 - RNA, 13 nt, Shigella flexneri 2a str. 2457T
uugaaaucgaaca

SEQ ID NO: 3881910 - RNA, 18 nt, Shigella flexneri 2a str. 2457T
uugaaaucgaacagguug

SEQ ID NO: 3881911 - RNA, 21 nt, Shigella flexneri 2a str. 2457T
uugaacaaccagaaagaugca

SEQ ID NO: 3881912 - RNA, 19 nt, Shigella flexneri 2a str. 2457T
uugaacauaucagcgcaaa

SEQ ID NO: 3881913 - RNA, 19 nt, Shigella flexneri 2a str. 2457T
uugaacccggcaucaacca

SEQ ID NO: 3881914 - RNA, 21 nt, Shigella flexneri 2a str. 2457T
uugaaccuaagcuuucgagca

SEQ ID NO: 3881915 - RNA, 15 nt, Shigella flexneri 2a str. 2457T
uugaacucugaaucg

SEQ ID NO: 3881916 - RNA, 15 nt, Shigella flexneri 2a str. 2457T
uugaacuguggcgcg

SEQ ID NO: 3881917 - RNA, 16 nt, Shigella flexneri 2a str. 2457T
uugaacuuuaagcuga

SEQ ID NO: 3881918 - RNA, 16 nt, Shigella flexneri 2a str. 2457T
uugaagaguuugauca

SEQ ID NO: 3881919 - RNA, 22 nt, Shigella flexneri 2a str. 2457T
uugaagauguugccacacgccc

SEQ ID NO: 3881920 - RNA, 12 nt, Shigella flexneri 2a str. 2457T
uugaagauuagc

SEQ ID NO: 3881921 - RNA, 19 nt, Shigella flexneri 2a str. 2457T
uugaagauuuugcugugcu

SEQ ID NO: 3881922 - RNA, 16 nt, Shigella flexneri 2a str. 2457T
uugaaggcagcauucg

SEQ ID NO: 3881923 - RNA, 11 nt, Shigella flexneri 2a str. 2457T
uugaagucagg

SEQ ID NO: 3881924 - RNA, 17 nt, Shigella flexneri 2a str. 2457T
uugaagucuuuuuucaa

SEQ ID NO: 3881925 - RNA, 15 nt, Shigella flexneri 2a str. 2457T
uugaauaucuccucu

SEQ ID NO: 3881926 - RNA, 15 nt, Shigella flexneri 2a str. 2457T
uugaauugcucagua

SEQ ID NO: 3881927 - RNA, 19 nt, Shigella flexneri 2a str. 2457T
uugacaagcucaccucuuu

SEQ ID NO: 3881928 - RNA, 22 nt, Shigella flexneri 2a str. 2457T
uugaccacacggucuaucauca

SEQ ID NO: 3881929 - RNA, 12 nt, Shigella flexneri 2a str. 2457T
uugaccugaaua

SEQ ID NO: 3881930 - RNA, 15 nt, Shigella flexneri 2a str. 2457T
uugacgaaaaggccu

SEQ ID NO: 3881931 - RNA, 21 nt, Shigella flexneri 2a str. 2457T
uugacgagauagcgaaguaga

SEQ ID NO: 3881932 - RNA, 22 nt, Shigella flexneri 2a str. 2457T
uugacgagauagcgaaguagac

SEQ ID NO: 3881933 - RNA, 15 nt, Shigella flexneri 2a str. 2457T
uugacgccaaggagu

SEQ ID NO: 3881934 - RNA, 18 nt, Shigella flexneri 2a str. 2457T
uugacgcgucuuaucagg

SEQ ID NO: 3881935 - RNA, 19 nt, Shigella flexneri 2a str. 2457T
uugacgcgucuuaucaggc

SEQ ID NO: 3881936 - RNA, 21 nt, Shigella flexneri 2a str. 2457T
uugacgcgucuuaucaggccu

SEQ ID NO: 3881937 - RNA, 13 nt, Shigella flexneri 2a str. 2457T
uugacguccagcc

SEQ ID NO: 3881938 - RNA, 19 nt, Shigella flexneri 2a str. 2457T
uugacgugucuuaucaggc

SEQ ID NO: 3881939 - RNA, 23 nt, Shigella flexneri 2a str. 2457T
uugacucgccuucaggaauacgc

SEQ ID NO: 3881940 - RNA, 22 nt, Shigella flexneri 2a str. 2457T
uugacucggagucgacuucaga

SEQ ID NO: 3881941 - RNA, 14 nt, Shigella flexneri 2a str. 2457T
uugacucucaucca

SEQ ID NO: 3881942 - RNA, 23 nt, Shigella flexneri 2a str. 2457T
uugacuuauaugcgcgaauacga

SEQ ID NO: 3881943 - RNA, 12 nt, Shigella flexneri 2a str. 2457T
uugagaaaaacc

SEQ ID NO: 3881944 - RNA, 13 nt, Shigella flexneri 2a str. 2457T
uugagaaaaaccu

SEQ ID NO: 3881945 - RNA, 21 nt, Shigella flexneri 2a str. 2457T
uugagaacgacagugacuucc

SEQ ID NO: 3881946 - RNA, 17 nt, Shigella flexneri 2a str. 2457T
uugagagugcgaaacga

SEQ ID NO: 3881947 - RNA, 22 nt, Shigella flexneri 2a str. 2457T
uugagaugguuacuuuuuaugu

SEQ ID NO: 3881948 - RNA, 14 nt, Shigella flexneri 2a str. 2457T
uugaggaucacaaa

SEQ ID NO: 3881949 - RNA, 15 nt, Shigella flexneri 2a str. 2457T
uugaggcacaucuua

SEQ ID NO: 3881950 - RNA, 15 nt, Shigella flexneri 2a str. 2457T
uugaguucacugccg

SEQ ID NO: 3881951 - RNA, 19 nt, Shigella flexneri 2a str. 2457T
uugaguuuuucaucccucu

SEQ ID NO: 3881952 - RNA, 17 nt, Shigella flexneri 2a str. 2457T
uugauaaggaaauucag

SEQ ID NO: 3881953 - RNA, 13 nt, Shigella flexneri 2a str. 2457T
uugauacugaaca

SEQ ID NO: 3881954 - RNA, 13 nt, Shigella flexneri 2a str. 2457T
uugauagaacaaa

SEQ ID NO: 3881955 - RNA, 12 nt, Shigella flexneri 2a str. 2457T
uugauauccgca

SEQ ID NO: 3881956 - RNA, 18 nt, Shigella flexneri 2a str. 2457T
uugauauuuauuuccuuc

SEQ ID NO: 3881957 - RNA, 19 nt, Shigella flexneri 2a str. 2457T
uugaucaaauacuucaaua

SEQ ID NO: 3881958 - RNA, 13 nt, Shigella flexneri 2a str. 2457T
uugaucaaucugc

SEQ ID NO: 3881959 - RNA, 19 nt, Shigella flexneri 2a str. 2457T
uugaucaauucuaaauguu

SEQ ID NO: 3881960 - RNA, 16 nt, Shigella flexneri 2a str. 2457T
uugaucacuuccagca

SEQ ID NO: 3881961 - RNA, 23 nt, Shigella flexneri 2a str. 2457T
uugaucagccaggcgaugaaauu

SEQ ID NO: 3881962 - RNA, 13 nt, Shigella flexneri 2a str. 2457T
uugauccaggagc

SEQ ID NO: 3881963 - RNA, 17 nt, Shigella flexneri 2a str. 2457T
uugauccaggagcucca

SEQ ID NO: 3881964 - RNA, 13 nt, Shigella flexneri 2a str. 2457T
uugcgccugcagg

SEQ ID NO: 3881965 - RNA, 15 nt, Shigella flexneri 2a str. 2457T
uugcgccuuuaauau

SEQ ID NO: 3881966 - RNA, 15 nt, Shigella flexneri 2a str. 2457T
uugcgcgacuuuuuc

SEQ ID NO: 3881967 - RNA, 18 nt, Shigella flexneri 2a str. 2457T
uugcgcguaacgaucgcc

SEQ ID NO: 3881968 - RNA, 24 nt, Shigella flexneri 2a str. 2457T
uugcgcgucgcccaguucuacaau

SEQ ID NO: 3881969 - RNA, 17 nt, Shigella flexneri 2a str. 2457T
uugcgcuaaaaaguucc

SEQ ID NO: 3881970 - RNA, 14 nt, Shigella flexneri 2a str. 2457T
uugcgcuggcaccg

SEQ ID NO: 3881971 - RNA, 20 nt, Shigella flexneri 2a str. 2457T
uugcggaaauuccagcggca

SEQ ID NO: 3881972 - RNA, 18 nt, Shigella flexneri 2a str. 2457T
uugcggcggcgcaaagcg

SEQ ID NO: 3881973 - RNA, 19 nt, Shigella flexneri 2a str. 2457T
uugcgguaagcugaugacg

SEQ ID NO: 3881974 - RNA, 20 nt, Shigella flexneri 2a str. 2457T
uugcguacaccaacaucacg

SEQ ID NO: 3881975 - RNA, 12 nt, Shigella flexneri 2a str. 2457T
uugcgucauggu

SEQ ID NO: 3881976 - RNA, 13 nt, Shigella flexneri 2a str. 2457T
uugcgucgccagu

SEQ ID NO: 3881977 - RNA, 18 nt, Shigella flexneri 2a str. 2457T
uugcuaacuggaaaggaa

SEQ ID NO: 3881978 - RNA, 19 nt, Shigella flexneri 2a str. 2457T
uugcuaucgcgaaucccua

SEQ ID NO: 3881979 - RNA, 15 nt, Shigella flexneri 2a str. 2457T
uugcuaucgggaaua

SEQ ID NO: 3881980 - RNA, 21 nt, Shigella flexneri 2a str. 2457T
uugcuauuuccaccucccccu

SEQ ID NO: 3881981 - RNA, 15 nt, Shigella flexneri 2a str. 2457T
uugcucaagcugaac

SEQ ID NO: 3881982 - RNA, 19 nt, Shigella flexneri 2a str. 2457T
uugcucagaaucacgccaa

SEQ ID NO: 3881983 - RNA, 13 nt, Shigella flexneri 2a str. 2457T
uugcucauaaaau

SEQ ID NO: 3881984 - RNA, 16 nt, Shigella flexneri 2a str. 2457T
uugcucauaaaaugau

SEQ ID NO: 3881985 - RNA, 16 nt, Shigella flexneri 2a str. 2457T
uugcucauccauugcu

SEQ ID NO: 3881986 - RNA, 12 nt, Shigella flexneri 2a str. 2457T
uugcuccagaaa

SEQ ID NO: 3881987 - RNA, 16 nt, Shigella flexneri 2a str. 2457T
uugcuccugcucauca

SEQ ID NO: 3881988 - RNA, 23 nt, Shigella flexneri 2a str. 2457T
uugcucgacaagauacugccgau

SEQ ID NO: 3881989 - RNA, 23 nt, Shigella flexneri 2a str. 2457T
uugcucuaacggucgcggaacau

SEQ ID NO: 3881990 - RNA, 16 nt, Shigella flexneri 2a str. 2457T
uugcucucgggcagua

SEQ ID NO: 3881991 - RNA, 16 nt, Shigella flexneri 2a str. 2457T
uugcucugcagcagcc

SEQ ID NO: 3881992 - RNA, 23 nt, Shigella flexneri 2a str. 2457T
uugcucuucuccggcuguuucag

SEQ ID NO: 3881993 - RNA, 15 nt, Shigella flexneri 2a str. 2457T
uugcugaaauacaga

SEQ ID NO: 3881994 - RNA, 23 nt, Shigella flexneri 2a str. 2457T
uugcugagaucaaacucuuucaa

SEQ ID NO: 3881995 - RNA, 19 nt, Shigella flexneri 2a str. 2457T
uugcugccguuuucaaagg

SEQ ID NO: 3881996 - RNA, 13 nt, Shigella flexneri 2a str. 2457T
uugcugccuucac

SEQ ID NO: 3881997 - RNA, 15 nt, Shigella flexneri 2a str. 2457T
uugcugcguggaauu

SEQ ID NO: 3881998 - RNA, 19 nt, Shigella flexneri 2a str. 2457T
uugcugcguggaauuuguc

SEQ ID NO: 3881999 - RNA, 17 nt, Shigella flexneri 2a str. 2457T
uugcugcugauccagcu

SEQ ID NO: 3882000 - RNA, 18 nt, Shigella flexneri 2a str. 2457T
uugcuggacgcauugcau

SEQ ID NO: 3882001 - RNA, 21 nt, Shigella flexneri 2a str. 2457T
uugcuggacgcauugcauuuc

SEQ ID NO: 3882002 - RNA, 18 nt, Shigella flexneri 2a str. 2457T
uugcuguucgagcaucac

SEQ ID NO: 3882003 - RNA, 14 nt, Shigella flexneri 2a str. 2457T
uugcuguuguucaa

SEQ ID NO: 3882004 - RNA, 23 nt, Shigella flexneri 2a str. 2457T
uugcuucaauacgcuccaguacc

SEQ ID NO: 3882005 - RNA, 21 nt, Shigella flexneri 2a str. 2457T
uugcuucgaucucaaucuuca

SEQ ID NO: 3882006 - RNA, 13 nt, Shigella flexneri 2a str. 2457T
uugcuucgccagu

SEQ ID NO: 3882007 - RNA, 18 nt, Shigella flexneri 2a str. 2457T
uugcuucuaugaguggaa

SEQ ID NO: 3882008 - RNA, 12 nt, Shigella flexneri 2a str. 2457T
uugcuucugcuu

SEQ ID NO: 3882009 - RNA, 13 nt, Shigella flexneri 2a str. 2457T
uugcuuuccagcu

SEQ ID NO: 3882010 - RNA, 11 nt, Shigella flexneri 2a str. 2457T
uugcuuugcaa

SEQ ID NO: 3882011 - RNA, 12 nt, Shigella flexneri 2a str. 2457T
uugcuuugcaac

SEQ ID NO: 3882012 - RNA, 17 nt, Shigella flexneri 2a str. 2457T
uugcuuuugauguuuga

SEQ ID NO: 3882013 - RNA, 16 nt, Shigella flexneri 2a str. 2457T
uuggauaggcaccgcc

SEQ ID NO: 3882014 - RNA, 17 nt, Shigella flexneri 2a str. 2457T
uuggaucugauccaaca

SEQ ID NO: 3882015 - RNA, 14 nt, Shigella flexneri 2a str. 2457T
uuggcaccaucccu

SEQ ID NO: 3882016 - RNA, 15 nt, Shigella flexneri 2a str. 2457T
uuggcaccaucccua

SEQ ID NO: 3882017 - RNA, 17 nt, Shigella flexneri 2a str. 2457T
uuggcaccauuaccgcc

SEQ ID NO: 3882018 - RNA, 15 nt, Shigella flexneri 2a str. 2457T
uuggcaucaucagcg

SEQ ID NO: 3882019 - RNA, 19 nt, Shigella flexneri 2a str. 2457T
uuggcaucgauaucaacca

SEQ ID NO: 3882020 - RNA, 21 nt, Shigella flexneri 2a str. 2457T
uuggcaucguauuucagaccu

SEQ ID NO: 3882021 - RNA, 20 nt, Shigella flexneri 2a str. 2457T
uuggcccgacgcuugaagca

SEQ ID NO: 3882022 - RNA, 16 nt, Shigella flexneri 2a str. 2457T
uuggccgaagaggaac

SEQ ID NO: 3882023 - RNA, 16 nt, Shigella flexneri 2a str. 2457T
uuggcgcaauagcacu

SEQ ID NO: 3882024 - RNA, 21 nt, Shigella flexneri 2a str. 2457T
uuggcgcauaacucaccauca

SEQ ID NO: 3882025 - RNA, 20 nt, Shigella flexneri 2a str. 2457T
uuggcgcucugacaccauca

SEQ ID NO: 3882026 - RNA, 20 nt, Shigella flexneri 2a str. 2457T
uuggcuauauaaagcaucaa

SEQ ID NO: 3882027 - RNA, 12 nt, Shigella flexneri 2a str. 2457T
uuggcuggcccu

SEQ ID NO: 3882028 - RNA, 17 nt, Shigella flexneri 2a str. 2457T
uuggcuucguguacaaa

SEQ ID NO: 3882029 - RNA, 17 nt, Shigella flexneri 2a str. 2457T
uugggaugccgaaaaaa

SEQ ID NO: 3882030 - RNA, 23 nt, Shigella flexneri 2a str. 2457T
uuggggaggggucguuuuuuauu

SEQ ID NO: 3882031 - RNA, 23 nt, Shigella flexneri 2a str. 2457T
uuggggaucgucaggaucagcca

SEQ ID NO: 3882032 - RNA, 13 nt, Shigella flexneri 2a str. 2457T
uuggguaacagcc

SEQ ID NO: 3882033 - RNA, 15 nt, Shigella flexneri 2a str. 2457T
uugggugacaaucac

SEQ ID NO: 3882034 - RNA, 15 nt, Shigella flexneri 2a str. 2457T
uuggguuucgaauua

SEQ ID NO: 3882035 - RNA, 18 nt, Shigella flexneri 2a str. 2457T
uugguaaaugcgaauagc

SEQ ID NO: 3882036 - RNA, 17 nt, Shigella flexneri 2a str. 2457T
uugguaacaugcucuuu

SEQ ID NO: 3882037 - RNA, 15 nt, Shigella flexneri 2a str. 2457T
uugguaaugacucca

SEQ ID NO: 3882038 - RNA, 17 nt, Shigella flexneri 2a str. 2457T
uuggucagcucaaagcg

SEQ ID NO: 3882039 - RNA, 14 nt, Shigella flexneri 2a str. 2457T
uuggucgaaauaau

SEQ ID NO: 3882040 - RNA, 16 nt, Shigella flexneri 2a str. 2457T
uuggucucaagcaagu

SEQ ID NO: 3882041 - RNA, 16 nt, Shigella flexneri 2a str. 2457T
uuggugaaaaaaugau

SEQ ID NO: 3882042 - RNA, 22 nt, Shigella flexneri 2a str. 2457T
uuggugauauucauggugaaua

SEQ ID NO: 3882043 - RNA, 14 nt, Shigella flexneri 2a str. 2457T
uugguuucgucgug

SEQ ID NO: 3882044 - RNA, 12 nt, Shigella flexneri 2a str. 2457T
uuguaaaugaac

SEQ ID NO: 3882045 - RNA, 21 nt, Shigella flexneri 2a str. 2457T
uuguaagccggaucggaggca

SEQ ID NO: 3882046 - RNA, 16 nt, Shigella flexneri 2a str. 2457T
uuguaagucagaaagc

SEQ ID NO: 3882047 - RNA, 16 nt, Shigella flexneri 2a str. 2457T
uuguacuccagcagac

SEQ ID NO: 3882048 - RNA, 16 nt, Shigella flexneri 2a str. 2457T
uuguacuuuccagcca

SEQ ID NO: 3882049 - RNA, 13 nt, Shigella flexneri 2a str. 2457T
uuguagaccugau

SEQ ID NO: 3882050 - RNA, 13 nt, Shigella flexneri 2a str. 2457T
uuguagagcagca

SEQ ID NO: 3882051 - RNA, 15 nt, Shigella flexneri 2a str. 2457T
uuguaggaaucaggc

SEQ ID NO: 3882052 - RNA, 20 nt, Shigella flexneri 2a str. 2457T
uuguaggacggauaaggcgu

SEQ ID NO: 3882053 - RNA, 20 nt, Shigella flexneri 2a str. 2457T
uuguaggccagauaagacgu

SEQ ID NO: 3882054 - RNA, 20 nt, Shigella flexneri 2a str. 2457T
uuguaggccggauaaagcgu

SEQ ID NO: 3882055 - RNA, 20 nt, Shigella flexneri 2a str. 2457T
uuguaggccggauaaggcgu

SEQ ID NO: 3882056 - RNA, 19 nt, Shigella flexneri 2a str. 2457T
uuguaggccugauaagcgu

SEQ ID NO: 3882057 - RNA, 20 nt, Shigella flexneri 2a str. 2457T
uuguaggcuggauaaggcgu

SEQ ID NO: 3882058 - RNA, 20 nt, Shigella flexneri 2a str. 2457T
uuguaggucggauaaggcgu

SEQ ID NO: 3882059 - RNA, 19 nt, Shigella flexneri 2a str. 2457T
uuguaggucugauagcgua

SEQ ID NO: 3882060 - RNA, 16 nt, Shigella flexneri 2a str. 2457T
uuguauaacgugguga

SEQ ID NO: 3882061 - RNA, 15 nt, Shigella flexneri 2a str. 2457T
uuguauccuguuuuu

SEQ ID NO: 3882062 - RNA, 11 nt, Shigella flexneri 2a str. 2457T
uuucagcagcg

SEQ ID NO: 3882063 - RNA, 15 nt, Shigella flexneri 2a str. 2457T
uuucagcagcggcac

SEQ ID NO: 3882064 - RNA, 23 nt, Shigella flexneri 2a str. 2457T
uuucagcgaaaaagucccuuccc

SEQ ID NO: 3882065 - RNA, 15 nt, Shigella flexneri 2a str. 2457T
uuucagcgccagauc

SEQ ID NO: 3882066 - RNA, 18 nt, Shigella flexneri 2a str. 2457T
uuucagcggcguguuauu

SEQ ID NO: 3882067 - RNA, 12 nt, Shigella flexneri 2a str. 2457T
uuucagcugccc

SEQ ID NO: 3882068 - RNA, 16 nt, Shigella flexneri 2a str. 2457T
uuucaggccagcggcu

SEQ ID NO: 3882069 - RNA, 14 nt, Shigella flexneri 2a str. 2457T
uuucaguaacauca

SEQ ID NO: 3882070 - RNA, 15 nt, Shigella flexneri 2a str. 2457T
uuucaguaauccuuu

SEQ ID NO: 3882071 - RNA, 21 nt, Shigella flexneri 2a str. 2457T
uuucaguaauccuuucucaau

SEQ ID NO: 3882072 - RNA, 17 nt, Shigella flexneri 2a str. 2457T
uuucaguauuuccacaa

SEQ ID NO: 3882073 - RNA, 19 nt, Shigella flexneri 2a str. 2457T
uuucaguggggcaggggcu

SEQ ID NO: 3882074 - RNA, 13 nt, Shigella flexneri 2a str. 2457T
uuucaguuggcug

SEQ ID NO: 3882075 - RNA, 17 nt, Shigella flexneri 2a str. 2457T
uuucaguuuuacucuuu

SEQ ID NO: 3882076 - RNA, 14 nt, Shigella flexneri 2a str. 2457T
uuucauacugccga

SEQ ID NO: 3882077 - RNA, 20 nt, Shigella flexneri 2a str. 2457T
uuucauagauuaauuuccca

SEQ ID NO: 3882078 - RNA, 19 nt, Shigella flexneri 2a str. 2457T
uuucauaucugccagauaa

SEQ ID NO: 3882079 - RNA, 18 nt, Shigella flexneri 2a str. 2457T
uuucauauuauuugcuau

SEQ ID NO: 3882080 - RNA, 16 nt, Shigella flexneri 2a str. 2457T
uuucaucaaaaaauga

SEQ ID NO: 3882081 - RNA, 19 nt, Shigella flexneri 2a str. 2457T
uuucaucccgagucgcuga

SEQ ID NO: 3882082 - RNA, 15 nt, Shigella flexneri 2a str. 2457T
uuucauccuucauua

SEQ ID NO: 3882083 - RNA, 23 nt, Shigella flexneri 2a str. 2457T
uuucaucgcuuacccuaaauccg

SEQ ID NO: 3882084 - RNA, 21 nt, Shigella flexneri 2a str. 2457T
uuucaucgcuuucuuuauaga

SEQ ID NO: 3882085 - RNA, 17 nt, Shigella flexneri 2a str. 2457T
uuucaugccauccgcau

SEQ ID NO: 3882086 - RNA, 18 nt, Shigella flexneri 2a str. 2457T
uuucaugcuauuccuuga

SEQ ID NO: 3882087 - RNA, 16 nt, Shigella flexneri 2a str. 2457T
uuucaugguugucacc

SEQ ID NO: 3882088 - RNA, 22 nt, Shigella flexneri 2a str. 2457T
uuucauucagaacacuucuucu

SEQ ID NO: 3882089 - RNA, 17 nt, Shigella flexneri 2a str. 2457T
uuucauuuauuaccucc

SEQ ID NO: 3882090 - RNA, 18 nt, Shigella flexneri 2a str. 2457T
uuuccaagcgcggcaggc

SEQ ID NO: 3882091 - RNA, 14 nt, Shigella flexneri 2a str. 2457T
uuuccagcaguucc

SEQ ID NO: 3882092 - RNA, 22 nt, Shigella flexneri 2a str. 2457T
uuuccagccgagccgacgguuu

SEQ ID NO: 3882093 - RNA, 21 nt, Shigella flexneri 2a str. 2457T
uuuccagcucaaccagauucg

SEQ ID NO: 3882094 - RNA, 17 nt, Shigella flexneri 2a str. 2457T
uuuccaggcaucagcaa

SEQ ID NO: 3882095 - RNA, 21 nt, Shigella flexneri 2a str. 2457T
uuuccaggcuggcaggccuca

SEQ ID NO: 3882096 - RNA, 17 nt, Shigella flexneri 2a str. 2457T
uuuccagguuauuuuau

SEQ ID NO: 3882097 - RNA, 23 nt, Shigella flexneri 2a str. 2457T
uuuccaguucacgaauauuuccc

SEQ ID NO: 3882098 - RNA, 16 nt, Shigella flexneri 2a str. 2457T
uuuccaguuugcguuc

SEQ ID NO: 3882099 - RNA, 21 nt, Shigella flexneri 2a str. 2457T
uuuccaucauuagugugauca

SEQ ID NO: 3882100 - RNA, 14 nt, Shigella flexneri 2a str. 2457T
uuuccauccggcaa

SEQ ID NO: 3882101 - RNA, 16 nt, Shigella flexneri 2a str. 2457T
uuuccaucuuuccuca

SEQ ID NO: 3882102 - RNA, 13 nt, Shigella flexneri 2a str. 2457T
uuucccaccacua

SEQ ID NO: 3882103 - RNA, 21 nt, Shigella flexneri 2a str. 2457T
uuucccagcaagaaccaugca

SEQ ID NO: 3882104 - RNA, 17 nt, Shigella flexneri 2a str. 2457T
uuucccauuaccauucc

SEQ ID NO: 3882105 - RNA, 14 nt, Shigella flexneri 2a str. 2457T
uuuccccaacgaug

SEQ ID NO: 3882106 - RNA, 14 nt, Shigella flexneri 2a str. 2457T
uuucccccacagcu

SEQ ID NO: 3882107 - RNA, 15 nt, Shigella flexneri 2a str. 2457T
uuucccccuggcgag

SEQ ID NO: 3882108 - RNA, 23 nt, Shigella flexneri 2a str. 2457T
uuucccgcacguuggcggugcca

SEQ ID NO: 3882109 - RNA, 19 nt, Shigella flexneri 2a str. 2457T
uuucccgcuucguuuucag

SEQ ID NO: 3882110 - RNA, 19 nt, Shigella flexneri 2a str. 2457T
uuucccuauuuuuucgugu

SEQ ID NO: 3882111 - RNA, 16 nt, Shigella flexneri 2a str. 2457T
uuucccuguucagccu

SEQ ID NO: 3882112 - RNA, 21 nt, Shigella flexneri 2a str. 2457T
uuuccgcgaauuaugcagccu

SEQ ID NO: 3882113 - RNA, 14 nt, Shigella flexneri 2a str. 2457T
uuuccgcuucugcu

SEQ ID NO: 3882114 - RNA, 23 nt, Shigella flexneri 2a str. 2457T
uuuccggaucgccaaagcggcag

SEQ ID NO: 3882115 - RNA, 14 nt, Shigella flexneri 2a str. 2457T
uuuccggcagaagc

SEQ ID NO: 3882116 - RNA, 17 nt, Shigella flexneri 2a str. 2457T
uuuccggcagaagcaau

SEQ ID NO: 3882117 - RNA, 17 nt, Shigella flexneri 2a str. 2457T
uuuccgggagcaauuug

SEQ ID NO: 3882118 - RNA, 20 nt, Shigella flexneri 2a str. 2457T
uuuccggguuguacauuuug

SEQ ID NO: 3882119 - RNA, 14 nt, Shigella flexneri 2a str. 2457T
uuuccguuaaccua

SEQ ID NO: 3882120 - RNA, 16 nt, Shigella flexneri 2a str. 2457T
uuuccguuuuccagcc

SEQ ID NO: 3882121 - RNA, 21 nt, Shigella flexneri 2a str. 2457T
uuuccucaguaccgugcagcg

SEQ ID NO: 3882122 - RNA, 18 nt, Shigella flexneri 2a str. 2457T
uuuccuccugucuucccu

SEQ ID NO: 3882123 - RNA, 18 nt, Shigella flexneri 2a str. 2457T
uuuccugacgucuggccu

SEQ ID NO: 3882124 - RNA, 16 nt, Shigella flexneri 2a str. 2457T
uuuccugagcacuggg

SEQ ID NO: 3882125 - RNA, 19 nt, Shigella flexneri 2a str. 2457T
uuuccugcggaugcgccau

SEQ ID NO: 3882126 - RNA, 19 nt, Shigella flexneri 2a str. 2457T
uuuccugcugcaucugaaa

SEQ ID NO: 3882127 - RNA, 18 nt, Shigella flexneri 2a str. 2457T
uuuccugcuucacgccca

SEQ ID NO: 3882128 - RNA, 24 nt, Shigella flexneri 2a str. 2457T
uuuccuggucggcaaacugcugau

SEQ ID NO: 3882129 - RNA, 18 nt, Shigella flexneri 2a str. 2457T
uuuccuuaaacaccuggc

SEQ ID NO: 3882130 - RNA, 18 nt, Shigella flexneri 2a str. 2457T
uuuccuuaacuccucgcc

SEQ ID NO: 3882131 - RNA, 20 nt, Shigella flexneri 2a str. 2457T
uuuccuucaggaucaaccgc

SEQ ID NO: 3882132 - RNA, 15 nt, Shigella flexneri 2a str. 2457T
uuuccuuccuuggau

SEQ ID NO: 3882133 - RNA, 20 nt, Shigella flexneri 2a str. 2457T
uuucgaaccacaaaagacga

SEQ ID NO: 3882134 - RNA, 19 nt, Shigella flexneri 2a str. 2457T
uuucgaaugcucaugaucg

SEQ ID NO: 3882135 - RNA, 18 nt, Shigella flexneri 2a str. 2457T
uuucgagaaugucgauaa

SEQ ID NO: 3882136 - RNA, 22 nt, Shigella flexneri 2a str. 2457T
uuucgaggauccaugacaucuc

SEQ ID NO: 3882137 - RNA, 13 nt, Shigella flexneri 2a str. 2457T
uuucgauugcaca

SEQ ID NO: 3882138 - RNA, 15 nt, Shigella flexneri 2a str. 2457T
uuucgcaaaccaaac

SEQ ID NO: 3882139 - RNA, 15 nt, Shigella flexneri 2a str. 2457T
uuucgccacccaguc

SEQ ID NO: 3882140 - RNA, 14 nt, Shigella flexneri 2a str. 2457T
uuucgccagcaccg

SEQ ID NO: 3882141 - RNA, 16 nt, Shigella flexneri 2a str. 2457T
uuucgccaguuuuuuc

SEQ ID NO: 3882142 - RNA, 19 nt, Shigella flexneri 2a str. 2457T
uuucgcggcauaacagaau

SEQ ID NO: 3882143 - RNA, 22 nt, Shigella flexneri 2a str. 2457T
uuucgcuucaaccaccucagua

SEQ ID NO: 3882144 - RNA, 13 nt, Shigella flexneri 2a str. 2457T
uuucgcuucuuca

SEQ ID NO: 3882145 - RNA, 17 nt, Shigella flexneri 2a str. 2457T
uuucgcuuuacucccgu

SEQ ID NO: 3882146 - RNA, 19 nt, Shigella flexneri 2a str. 2457T
uuucggacgauauuuuucc

SEQ ID NO: 3882147 - RNA, 16 nt, Shigella flexneri 2a str. 2457T
uuucggcaucagcaga

SEQ ID NO: 3882148 - RNA, 16 nt, Shigella flexneri 2a str. 2457T
uuucgguauacaacau

SEQ ID NO: 3882149 - RNA, 23 nt, Shigella flexneri 2a str. 2457T
uuucguagacugcagcggucaca

SEQ ID NO: 3882150 - RNA, 15 nt, Shigella flexneri 2a str. 2457T
uuucgucguacugac

SEQ ID NO: 3882151 - RNA, 21 nt, Shigella flexneri 2a str. 2457T
uuucguguggaguaauaauuu

SEQ ID NO: 3882152 - RNA, 17 nt, Shigella flexneri 2a str. 2457T
uuucguuacguggcaca

SEQ ID NO: 3882153 - RNA, 17 nt, Shigella flexneri 2a str. 2457T
uuucguuugaaaacugg

SEQ ID NO: 3882154 - RNA, 22 nt, Shigella flexneri 2a str. 2457T
uuucuaucaaggcgauguuccu

SEQ ID NO: 3882155 - RNA, 19 nt, Shigella flexneri 2a str. 2457T
uuucuaugagaaaauuuca

SEQ ID NO: 3882156 - RNA, 11 nt, Shigella flexneri 2a str. 2457T
uuucucccucg

SEQ ID NO: 3882157 - RNA, 15 nt, Shigella flexneri 2a str. 2457T
uuucuccuucacucu

SEQ ID NO: 3882158 - RNA, 17 nt, Shigella flexneri 2a str. 2457T
uuucuccuucacucuau

SEQ ID NO: 3882159 - RNA, 13 nt, Shigella flexneri 2a str. 2457T
uuugugcauagca

SEQ ID NO: 3882160 - RNA, 20 nt, Shigella flexneri 2a str. 2457T
uuugugccugaauuuugguc

SEQ ID NO: 3882161 - RNA, 16 nt, Shigella flexneri 2a str. 2457T
uuugugggaauaacca

SEQ ID NO: 3882162 - RNA, 16 nt, Shigella flexneri 2a str. 2457T
uuuguuacgauagaau

SEQ ID NO: 3882163 - RNA, 22 nt, Shigella flexneri 2a str. 2457T
uuuguuacgauagaauauuucu

SEQ ID NO: 3882164 - RNA, 23 nt, Shigella flexneri 2a str. 2457T
uuuguuauuacugcguauuuccu

SEQ ID NO: 3882165 - RNA, 14 nt, Shigella flexneri 2a str. 2457T
uuuguugauuuccc

SEQ ID NO: 3882166 - RNA, 12 nt, Shigella flexneri 2a str. 2457T
uuuguugccgcc

SEQ ID NO: 3882167 - RNA, 19 nt, Shigella flexneri 2a str. 2457T
uuuguuggcgaaaaucuuu

SEQ ID NO: 3882168 - RNA, 20 nt, Shigella flexneri 2a str. 2457T
uuuguuguucugucagccca

SEQ ID NO: 3882169 - RNA, 17 nt, Shigella flexneri 2a str. 2457T
uuuuaaacgaauaguuu

SEQ ID NO: 3882170 - RNA, 15 nt, Shigella flexneri 2a str. 2457T
uuuuaaagcaaaaaa

SEQ ID NO: 3882171 - RNA, 22 nt, Shigella flexneri 2a str. 2457T
uuuuaacgccugacuggcuacu

SEQ ID NO: 3882172 - RNA, 13 nt, Shigella flexneri 2a str. 2457T
uuuuaacuuuaau

SEQ ID NO: 3882173 - RNA, 20 nt, Shigella flexneri 2a str. 2457T
uuuuaagauccaguugaccu

SEQ ID NO: 3882174 - RNA, 23 nt, Shigella flexneri 2a str. 2457T
uuuuaagauccaguugaccugcg

SEQ ID NO: 3882175 - RNA, 21 nt, Shigella flexneri 2a str. 2457T
uuuuaaucaucugauaucuca

SEQ ID NO: 3882176 - RNA, 22 nt, Shigella flexneri 2a str. 2457T
uuuuaauggcuggggaauauuu

SEQ ID NO: 3882177 - RNA, 12 nt, Shigella flexneri 2a str. 2457T
uuuuacaucauc

SEQ ID NO: 3882178 - RNA, 20 nt, Shigella flexneri 2a str. 2457T
uuuuacauuauccagcgacu

SEQ ID NO: 3882179 - RNA, 14 nt, Shigella flexneri 2a str. 2457T
uuuuaccagcgccu

SEQ ID NO: 3882180 - RNA, 20 nt, Shigella flexneri 2a str. 2457T
uuuuacccagcagcagcggu

SEQ ID NO: 3882181 - RNA, 16 nt, Shigella flexneri 2a str. 2457T
uuuuacccaugacuuu

SEQ ID NO: 3882182 - RNA, 18 nt, Shigella flexneri 2a str. 2457T
uuuuacgucugcaauuua

SEQ ID NO: 3882183 - RNA, 15 nt, Shigella flexneri 2a str. 2457T
uuuuacguuuuaauc

SEQ ID NO: 3882184 - RNA, 23 nt, Shigella flexneri 2a str. 2457T
uuuuacucuuucucggaguaacu

SEQ ID NO: 3882185 - RNA, 12 nt, Shigella flexneri 2a str. 2457T
uuuuacugggaa

SEQ ID NO: 3882186 - RNA, 21 nt, Shigella flexneri 2a str. 2457T
uuuuacugggaagaauggaaa

SEQ ID NO: 3882187 - RNA, 17 nt, Shigella flexneri 2a str. 2457T
uuuuaguaucuauucau

SEQ ID NO: 3882188 - RNA, 21 nt, Shigella flexneri 2a str. 2457T
uuuuauaaagaacucgaggau

SEQ ID NO: 3882189 - RNA, 20 nt, Shigella flexneri 2a str. 2457T
uuuuaucggagaacaggaau

SEQ ID NO: 3882190 - RNA, 18 nt, Shigella flexneri 2a str. 2457T
uuuuaucucuuacagaaa

SEQ ID NO: 3882191 - RNA, 18 nt, Shigella flexneri 2a str. 2457T
uuuuaucugaggcagugc

SEQ ID NO: 3882192 - RNA, 14 nt, Shigella flexneri 2a str. 2457T
uuuuaucugugaac

SEQ ID NO: 3882193 - RNA, 21 nt, Shigella flexneri 2a str. 2457T
uuuuauuauucgcuaaucaau

SEQ ID NO: 3882194 - RNA, 11 nt, Shigella flexneri 2a str. 2457T
uuuuauuuaac

SEQ ID NO: 3882195 - RNA, 18 nt, Shigella flexneri 2a str. 2457T
uuuucaacauguugaaau

SEQ ID NO: 3882196 - RNA, 21 nt, Shigella flexneri 2a str. 2457T
uuuucaaccauccuaaaaaag

SEQ ID NO: 3882197 - RNA, 23 nt, Shigella flexneri 2a str. 2457T
uuuucaaccauccuaaaaaagca

SEQ ID NO: 3882198 - RNA, 22 nt, Shigella flexneri 2a str. 2457T
uuuucaauucacgaauauuucc

SEQ ID NO: 3882199 - RNA, 23 nt, Shigella flexneri 2a str. 2457T
uuuucaauucacgaauauuuccc

SEQ ID NO: 3882200 - RNA, 13 nt, Shigella flexneri 2a str. 2457T
uuuucaauucucu

SEQ ID NO: 3882201 - RNA, 12 nt, Shigella flexneri 2a str. 2457T
uuuucaccaguu

SEQ ID NO: 3882202 - RNA, 17 nt, Shigella flexneri 2a str. 2457T
uuuucacuccgaaguaa

SEQ ID NO: 3882203 - RNA, 22 nt, Shigella flexneri 2a str. 2457T
uuuucagcaaccggaggucagu

SEQ ID NO: 3882204 - RNA, 16 nt, Shigella flexneri 2a str. 2457T
uuuucagccaucaucc

SEQ ID NO: 3882205 - RNA, 20 nt, Shigella flexneri 2a str. 2457T
uuuucaguagacucaagcag

SEQ ID NO: 3882206 - RNA, 15 nt, Shigella flexneri 2a str. 2457T
uuuucauugccgcau

SEQ ID NO: 3882207 - RNA, 14 nt, Shigella flexneri 2a str. 2457T
uuuuccacaaugcc

SEQ ID NO: 3882208 - RNA, 16 nt, Shigella flexneri 2a str. 2457T
uuuuccagcugugcca

SEQ ID NO: 3882209 - RNA, 19 nt, Shigella flexneri 2a str. 2457T
uuuuccaguagauucaaca

SEQ ID NO: 3882210 - RNA, 20 nt, Shigella flexneri 2a str. 2457T
uuuucccaacgugaccagua

SEQ ID NO: 3882211 - RNA, 18 nt, Shigella flexneri 2a str. 2457T
uuuucccuuccgccauca

SEQ ID NO: 3882212 - RNA, 14 nt, Shigella flexneri 2a str. 2457T
uuuuccugcugcau

SEQ ID NO: 3882213 - RNA, 21 nt, Shigella flexneri 2a str. 2457T
uuuuccugcugcaucugaaac

SEQ ID NO: 3882214 - RNA, 22 nt, Shigella flexneri 2a str. 2457T
uuuuccugcugcaucugaaacu

SEQ ID NO: 3882215 - RNA, 16 nt, Shigella flexneri 2a str. 2457T
uuuucgccacuucagc

SEQ ID NO: 3882216 - RNA, 15 nt, Shigella flexneri 2a str. 2457T
uuuucgcuggcagac

SEQ ID NO: 3882217 - RNA, 15 nt, Shigella flexneri 2a str. 2457T
uuuucggauuuaccg

SEQ ID NO: 3882218 - RNA, 19 nt, Shigella flexneri 2a str. 2457T
uuuucggcaaccgcaucca

SEQ ID NO: 3882219 - RNA, 22 nt, Shigella flexneri 2a str. 2457T
uuuucgucguacccggcgacuu

SEQ ID NO: 3882220 - RNA, 22 nt, Shigella flexneri 2a str. 2457T
uuuucguuacguggcacauucu

SEQ ID NO: 3882221 - RNA, 19 nt, Shigella flexneri 2a str. 2457T
uuuucguuuggggcauauu

SEQ ID NO: 3882222 - RNA, 15 nt, Shigella flexneri 2a str. 2457T
uuuucuacacagacg

SEQ ID NO: 3882223 - RNA, 14 nt, Shigella flexneri 2a str. 2457T
uuuucuaugaguaa

SEQ ID NO: 3882224 - RNA, 16 nt, Shigella flexneri 2a str. 2457T
uuuucuggaugccauc

SEQ ID NO: 3882225 - RNA, 15 nt, Shigella flexneri 2a str. 2457T
uuuucuggcacaacu

SEQ ID NO: 3882226 - RNA, 24 nt, Shigella flexneri 2a str. 2457T
uuuucugucacaccuuauuuacau

SEQ ID NO: 3882227 - RNA, 17 nt, Shigella flexneri 2a str. 2457T
uuuucuuaacaaaaacu

SEQ ID NO: 3882228 - RNA, 21 nt, Shigella flexneri 2a str. 2457T
uuuucuuaacaaaaacuuuug

SEQ ID NO: 3882229 - RNA, 21 nt, Shigella flexneri 2a str. 2457T
uuuucuucagccccuccacau

SEQ ID NO: 3882230 - RNA, 13 nt, Shigella flexneri 2a str. 2457T
uuuucuuccaacc

SEQ ID NO: 3882231 - RNA, 16 nt, Shigella flexneri 2a str. 2457T
uuuugaacagaccaca

SEQ ID NO: 3882232 - RNA, 17 nt, Shigella flexneri 2a str. 2457T
uuuugacgcccccaaac

SEQ ID NO: 3882233 - RNA, 14 nt, Shigella flexneri 2a str. 2457T
uuuugauagugcgu

SEQ ID NO: 3882234 - RNA, 17 nt, Shigella flexneri 2a str. 2457T
uuuugcaacgcuuugcu

SEQ ID NO: 3882235 - RNA, 22 nt, Shigella flexneri 2a str. 2457T
uuuugcaaucagauaaaauaca

SEQ ID NO: 3882236 - RNA, 17 nt, Shigella flexneri 2a str. 2457T
uuuugcagaaacauaau

SEQ ID NO: 3882237 - RNA, 21 nt, Shigella flexneri 2a str. 2457T
uuuugcagaaacauaauauaa

SEQ ID NO: 3882238 - RNA, 17 nt, Shigella flexneri 2a str. 2457T
uuuugcagaucgccaau

SEQ ID NO: 3882239 - RNA, 15 nt, Shigella flexneri 2a str. 2457T
uuuugccaaauaucu

SEQ ID NO: 3882240 - RNA, 22 nt, Shigella flexneri 2a str. 2457T
uuuugccaccccuuuugacuuu

SEQ ID NO: 3882241 - RNA, 23 nt, Shigella flexneri 2a str. 2457T
uuuugcugcaaaauuauuccguu

SEQ ID NO: 3882242 - RNA, 16 nt, Shigella flexneri 2a str. 2457T
uuuugcuugaauguuc

SEQ ID NO: 3882243 - RNA, 22 nt, Shigella flexneri 2a str. 2457T
uuuugcuugaauguuccgucaa

SEQ ID NO: 3882244 - RNA, 18 nt, Shigella flexneri 2a str. 2457T
uuuuggagaucacgccac

SEQ ID NO: 3882245 - RNA, 17 nt, Shigella flexneri 2a str. 2457T
uuuuggcgagagacgcu

SEQ ID NO: 3882246 - RNA, 12 nt, Shigella flexneri 2a str. 2457T
uuuuggugcuuu

SEQ ID NO: 3882247 - RNA, 17 nt, Shigella flexneri 2a str. 2457T
uuuuguaucgaacaaga

SEQ ID NO: 3882248 - RNA, 22 nt, Shigella flexneri 2a str. 2457T
uuuuuaaaauaucgcugcuuau

SEQ ID NO: 3882249 - RNA, 14 nt, Shigella flexneri 2a str. 2457T
uuuuuaaacauuaa

SEQ ID NO: 3882250 - RNA, 22 nt, Shigella flexneri 2a str. 2457T
uuuuuaacgccgcuauacgccu

SEQ ID NO: 3882251 - RNA, 19 nt, Shigella flexneri 2a str. 2457T
uuuuuaaggguauuuuucu

SEQ ID NO: 3882252 - RNA, 19 nt, Shigella flexneri 2a str. 2457T
uuuuuacaucaucagaaau

SEQ ID NO: 3882253 - RNA, 13 nt, Shigella flexneri 2a str. 2457T
uuuuuacccagca

SEQ ID NO: 3882254 - RNA, 14 nt, Shigella flexneri 2a str. 2457T
uuuuuaguuagcaa

SEQ ID NO: 3882255 - RNA, 17 nt, Shigella flexneri 2a str. 2457T
uuuuuauagcuuauucu

SEQ ID NO: 3882256 - RNA, 12 nt, Shigella flexneri 2a str. 301
aaaacagccccu

SEQ ID NO: 3882257 - RNA, 23 nt, Shigella flexneri 2a str. 301
aaaacagcgaguucaggcgcugc

SEQ ID NO: 3882258 - RNA, 20 nt, Shigella flexneri 2a str. 301
aaaacagcgcccaacacuuc

SEQ ID NO: 3882259 - RNA, 20 nt, Shigella flexneri 2a str. 301
aaaacaggcagcugccagac

SEQ ID NO: 3882260 - RNA, 12 nt, Shigella flexneri 2a str. 301
aaaacagggcuu

SEQ ID NO: 3882261 - RNA, 20 nt, Shigella flexneri 2a str. 301
aaaacagggcuuacugaaaa

SEQ ID NO: 3882262 - RNA, 20 nt, Shigella flexneri 2a str. 301
aaaacaggucgccagucccu

SEQ ID NO: 3882263 - RNA, 20 nt, Shigella flexneri 2a str. 301
aaaacaguaccagaccaaca

SEQ ID NO: 3882264 - RNA, 20 nt, Shigella flexneri 2a str. 301
aaaacauacccaguuucaug

SEQ ID NO: 3882265 - RNA, 13 nt, Shigella flexneri 2a str. 301
aaaacaucaugau

SEQ ID NO: 3882266 - RNA, 18 nt, Shigella flexneri 2a str. 301
aaaacauugccguaagca

SEQ ID NO: 3882267 - RNA, 20 nt, Shigella flexneri 2a str. 301
aaaaccaacaguaucugaau

SEQ ID NO: 3882268 - RNA, 22 nt, Shigella flexneri 2a str. 301
aaaaccacacuucuucagccag

SEQ ID NO: 3882269 - RNA, 14 nt, Shigella flexneri 2a str. 301
aaaaccaguaauga

SEQ ID NO: 3882270 - RNA, 13 nt, Shigella flexneri 2a str. 301
aaaacccgcuucg

SEQ ID NO: 3882271 - RNA, 23 nt, Shigella flexneri 2a str. 301
aaaacccggccugcucccgaacc

SEQ ID NO: 3882272 - RNA, 15 nt, Shigella flexneri 2a str. 301
aaaacccguacugcc

SEQ ID NO: 3882273 - RNA, 15 nt, Shigella flexneri 2a str. 301
aaaaccgacuuaaaa

SEQ ID NO: 3882274 - RNA, 18 nt, Shigella flexneri 2a str. 301
aaaaccgagaagcagcaa

SEQ ID NO: 3882275 - RNA, 14 nt, Shigella flexneri 2a str. 301
aaaaccgaggggcu

SEQ ID NO: 3882276 - RNA, 22 nt, Shigella flexneri 2a str. 301
aaaaccgcaccguauugcgccg

SEQ ID NO: 3882277 - RNA, 18 nt, Shigella flexneri 2a str. 301
aaaaccgccucaggcaac

SEQ ID NO: 3882278 - RNA, 20 nt, Shigella flexneri 2a str. 301
aaaaccgcgaugaccaaaaa

SEQ ID NO: 3882279 - RNA, 13 nt, Shigella flexneri 2a str. 301
aaaaccgcugauu

SEQ ID NO: 3882280 - RNA, 23 nt, Shigella flexneri 2a str. 301
aaaaccguauucgcggugcuuca

SEQ ID NO: 3882281 - RNA, 21 nt, Shigella flexneri 2a str. 301
aaaaccguucuuuucgagcag

SEQ ID NO: 3882282 - RNA, 19 nt, Shigella flexneri 2a str. 301
aaaaccuccgccucuuuca

SEQ ID NO: 3882283 - RNA, 20 nt, Shigella flexneri 2a str. 301
aaaaccucucuggaagaggc

SEQ ID NO: 3882284 - RNA, 13 nt, Shigella flexneri 2a str. 301
aaaaccucuucca

SEQ ID NO: 3882285 - RNA, 15 nt, Shigella flexneri 2a str. 301
aaaaccugacaacaa

SEQ ID NO: 3882286 - RNA, 21 nt, Shigella flexneri 2a str. 301
aaaaccugaccuagcaaacua

SEQ ID NO: 3882287 - RNA, 19 nt, Shigella flexneri 2a str. 301
aaaacgcagucuucccagc

SEQ ID NO: 3882288 - RNA, 22 nt, Shigella flexneri 2a str. 301
aaaacgccggagugaaaauucu

SEQ ID NO: 3882289 - RNA, 11 nt, Shigella flexneri 2a str. 301
aaaacgccugc

SEQ ID NO: 3882290 - RNA, 18 nt, Shigella flexneri 2a str. 301
aaaacgcgacugcaaaaa

SEQ ID NO: 3882291 - RNA, 18 nt, Shigella flexneri 2a str. 301
aaaacgcuuacgcuucau

SEQ ID NO: 3882292 - RNA, 16 nt, Shigella flexneri 2a str. 301
aaaacggaaagcagau

SEQ ID NO: 3882293 - RNA, 22 nt, Shigella flexneri 2a str. 301
aaaacggauugcuuguucgaug

SEQ ID NO: 3882294 - RNA, 18 nt, Shigella flexneri 2a str. 301
aaaacgggucaccuucug

SEQ ID NO: 3882295 - RNA, 19 nt, Shigella flexneri 2a str. 301
aaaacgguaguugaacucg

SEQ ID NO: 3882296 - RNA, 23 nt, Shigella flexneri 2a str. 301
aaaacgguccggcauccagccaa

SEQ ID NO: 3882297 - RNA, 17 nt, Shigella flexneri 2a str. 301
aaaacggugaucaaaac

SEQ ID NO: 3882298 - RNA, 22 nt, Shigella flexneri 2a str. 301
aaaacggugaucaaaacgggca

SEQ ID NO: 3882299 - RNA, 16 nt, Shigella flexneri 2a str. 301
aaaacgucaugguuau

SEQ ID NO: 3882300 - RNA, 23 nt, Shigella flexneri 2a str. 301
aaaacgugacagcauaccuucac

SEQ ID NO: 3882301 - RNA, 13 nt, Shigella flexneri 2a str. 301
aaaacgugcagcu

SEQ ID NO: 3882302 - RNA, 17 nt, Shigella flexneri 2a str. 301
aaaacguggccuccaaa

SEQ ID NO: 3882303 - RNA, 19 nt, Shigella flexneri 2a str. 301
aaaacguggccuccaaaaa

SEQ ID NO: 3882304 - RNA, 22 nt, Shigella flexneri 2a str. 301
aaaacguugucaguucuuuuau

SEQ ID NO: 3882305 - RNA, 13 nt, Shigella flexneri 2a str. 301
aaaacuaaaaaca

SEQ ID NO: 3882306 - RNA, 15 nt, Shigella flexneri 2a str. 301
aaaacuaaaaacagc

SEQ ID NO: 3882307 - RNA, 13 nt, Shigella flexneri 2a str. 301
aaaacuacaggca

SEQ ID NO: 3882308 - RNA, 21 nt, Shigella flexneri 2a str. 301
aaaacugcccgugaugcaacu

SEQ ID NO: 3882309 - RNA, 12 nt, Shigella flexneri 2a str. 301
aaaacugccgca

SEQ ID NO: 3882310 - RNA, 16 nt, Shigella flexneri 2a str. 301
aaaacugccugauacu

SEQ ID NO: 3882311 - RNA, 19 nt, Shigella flexneri 2a str. 301
aaaacugccugauacugaa

SEQ ID NO: 3882312 - RNA, 14 nt, Shigella flexneri 2a str. 301
aaaacuggaaaaau

SEQ ID NO: 3882313 - RNA, 20 nt, Shigella flexneri 2a str. 301
aaaacuggauuacaaauaaa

SEQ ID NO: 3882314 - RNA, 22 nt, Shigella flexneri 2a str. 301
aaaacuuccauguguuuaucua

SEQ ID NO: 3882315 - RNA, 11 nt, Shigella flexneri 2a str. 301
aaaacuuucca

SEQ ID NO: 3882316 - RNA, 19 nt, Shigella flexneri 2a str. 301
aaaacuuuuagcaucuuau

SEQ ID NO: 3882317 - RNA, 11 nt, Shigella flexneri 2a str. 301
aaaagaaaaaa

SEQ ID NO: 3882318 - RNA, 14 nt, Shigella flexneri 2a str. 301
aaaagaaaaaauga

SEQ ID NO: 3882319 - RNA, 12 nt, Shigella flexneri 2a str. 301
aaaagaaagaag

SEQ ID NO: 3882320 - RNA, 23 nt, Shigella flexneri 2a str. 301
aaaagaaaucagaccauguuuga

SEQ ID NO: 3882321 - RNA, 18 nt, Shigella flexneri 2a str. 301
aaaagaauggacacuauu

SEQ ID NO: 3882322 - RNA, 15 nt, Shigella flexneri 2a str. 301
aaaagagcaucagca

SEQ ID NO: 3882323 - RNA, 10 nt, Shigella flexneri 2a str. 301
aaaagagcgu

SEQ ID NO: 3882324 - RNA, 16 nt, Shigella flexneri 2a str. 301
aaaagaugagaaaaau

SEQ ID NO: 3882325 - RNA, 18 nt, Shigella flexneri 2a str. 301
aaaagauggauugcugaa

SEQ ID NO: 3882326 - RNA, 14 nt, Shigella flexneri 2a str. 301
aaaagauggucauc

SEQ ID NO: 3882327 - RNA, 15 nt, Shigella flexneri 2a str. 301
aaaagauuaaaaaaa

SEQ ID NO: 3882328 - RNA, 15 nt, Shigella flexneri 2a str. 301
aaaagcaaaaauaag

SEQ ID NO: 3882329 - RNA, 16 nt, Shigella flexneri 2a str. 301
aaaagcacgccagaca

SEQ ID NO: 3882330 - RNA, 21 nt, Shigella flexneri 2a str. 301
aaaagcauagccccagcgcag

SEQ ID NO: 3882331 - RNA, 15 nt, Shigella flexneri 2a str. 301
aaaagccugccaucu

SEQ ID NO: 3882332 - RNA, 22 nt, Shigella flexneri 2a str. 301
aaaagcggcuaaccacgccgcu

SEQ ID NO: 3882333 - RNA, 19 nt, Shigella flexneri 2a str. 301
aaaagggcgaucuugcgac

SEQ ID NO: 3882334 - RNA, 15 nt, Shigella flexneri 2a str. 301
aaaagggcuggaagc

SEQ ID NO: 3882335 - RNA, 17 nt, Shigella flexneri 2a str. 301
aaaagguugccugucuu

SEQ ID NO: 3882336 - RNA, 21 nt, Shigella flexneri 2a str. 301
aaaaguaagauugccugaugc

SEQ ID NO: 3882337 - RNA, 20 nt, Shigella flexneri 2a str. 301
aaaaguaguuccagcaugau

SEQ ID NO: 3882338 - RNA, 22 nt, Shigella flexneri 2a str. 301
aaaagugguguugaagaaacau

SEQ ID NO: 3882339 - RNA, 13 nt, Shigella flexneri 2a str. 301
aaaaguuuuagca

SEQ ID NO: 3882340 - RNA, 20 nt, Shigella flexneri 2a str. 301
aaaaguuuuaucggagaaca

SEQ ID NO: 3882341 - RNA, 24 nt, Shigella flexneri 2a str. 301
aaaaguuuuaucggagaacaggaa

SEQ ID NO: 3882342 - RNA, 21 nt, Shigella flexneri 2a str. 301
aaaauaaauguguuuuuauuu

SEQ ID NO: 3882343 - RNA, 23 nt, Shigella flexneri 2a str. 301
aaaauaacagcggcaaccagccc

SEQ ID NO: 3882344 - RNA, 21 nt, Shigella flexneri 2a str. 301
aaaauaacuuaaugucauaca

SEQ ID NO: 3882345 - RNA, 18 nt, Shigella flexneri 2a str. 301
aaaauaaucuauugauuu

SEQ ID NO: 3882346 - RNA, 19 nt, Shigella flexneri 2a str. 301
aaaauaaugcgacaacaga

SEQ ID NO: 3882347 - RNA, 12 nt, Shigella flexneri 2a str. 301
aaaauacaugac

SEQ ID NO: 3882348 - RNA, 15 nt, Shigella flexneri 2a str. 301
aaaauaccaccaaug

SEQ ID NO: 3882349 - RNA, 16 nt, Shigella flexneri 2a str. 301
aaaauaccgagcagcc

SEQ ID NO: 3882350 - RNA, 15 nt, Shigella flexneri 2a str. 301
aaaauacguucucac

SEQ ID NO: 3882351 - RNA, 20 nt, Shigella flexneri 2a str. 301
aaaauagauaaucgcuuucg

SEQ ID NO: 3882352 - RNA, 16 nt, Shigella flexneri 2a str. 301
aaaauagcaauauuuu

SEQ ID NO: 3882353 - RNA, 13 nt, Shigella flexneri 2a str. 301
aaaauagcauaau

SEQ ID NO: 3882354 - RNA, 19 nt, Shigella flexneri 2a str. 301
aaaauagccaaucauuccc

SEQ ID NO: 3882355 - RNA, 13 nt, Shigella flexneri 2a str. 301
aaaauaucacucg

SEQ ID NO: 3882356 - RNA, 19 nt, Shigella flexneri 2a str. 301
aaacaugccaacaaaaucu

SEQ ID NO: 3882357 - RNA, 20 nt, Shigella flexneri 2a str. 301
aaacaugccaacaaaaucuu

SEQ ID NO: 3882358 - RNA, 16 nt, Shigella flexneri 2a str. 301
aaacauggaaaccauc

SEQ ID NO: 3882359 - RNA, 14 nt, Shigella flexneri 2a str. 301
aaacauuagcgcau

SEQ ID NO: 3882360 - RNA, 23 nt, Shigella flexneri 2a str. 301
aaacauuagcgcaugaccaguga

SEQ ID NO: 3882361 - RNA, 21 nt, Shigella flexneri 2a str. 301
aaacauuucacguucacguaa

SEQ ID NO: 3882362 - RNA, 16 nt, Shigella flexneri 2a str. 301
aaacauuucagggaug

SEQ ID NO: 3882363 - RNA, 22 nt, Shigella flexneri 2a str. 301
aaaccaacgcuguccggcgcac

SEQ ID NO: 3882364 - RNA, 19 nt, Shigella flexneri 2a str. 301
aaaccacagaccggacuga

SEQ ID NO: 3882365 - RNA, 17 nt, Shigella flexneri 2a str. 301
aaaccaccacuccccuc

SEQ ID NO: 3882366 - RNA, 17 nt, Shigella flexneri 2a str. 301
aaaccacgacuuuuugu

SEQ ID NO: 3882367 - RNA, 15 nt, Shigella flexneri 2a str. 301
aaaccacuccugacg

SEQ ID NO: 3882368 - RNA, 16 nt, Shigella flexneri 2a str. 301
aaaccacuccugacga

SEQ ID NO: 3882369 - RNA, 17 nt, Shigella flexneri 2a str. 301
aaaccacugcaacagcu

SEQ ID NO: 3882370 - RNA, 16 nt, Shigella flexneri 2a str. 301
aaaccacuuaauuauu

SEQ ID NO: 3882371 - RNA, 21 nt, Shigella flexneri 2a str. 301
aaaccacuuaauuauuaacaa

SEQ ID NO: 3882372 - RNA, 15 nt, Shigella flexneri 2a str. 301
aaaccagaaagggaa

SEQ ID NO: 3882373 - RNA, 19 nt, Shigella flexneri 2a str. 301
aaaccagaaagggaagaac

SEQ ID NO: 3882374 - RNA, 21 nt, Shigella flexneri 2a str. 301
aaaccagacacuucaagaaua

SEQ ID NO: 3882375 - RNA, 17 nt, Shigella flexneri 2a str. 301
aaaccagacagcacauu

SEQ ID NO: 3882376 - RNA, 15 nt, Shigella flexneri 2a str. 301
aaaccagagaauauu

SEQ ID NO: 3882377 - RNA, 14 nt, Shigella flexneri 2a str. 301
aaaccaguaaugau

SEQ ID NO: 3882378 - RNA, 16 nt, Shigella flexneri 2a str. 301
aaaccaucaauccacu

SEQ ID NO: 3882379 - RNA, 18 nt, Shigella flexneri 2a str. 301
aaaccaucaggaugacaa

SEQ ID NO: 3882380 - RNA, 22 nt, Shigella flexneri 2a str. 301
aaaccaugacgcacuuucgcuu

SEQ ID NO: 3882381 - RNA, 14 nt, Shigella flexneri 2a str. 301
aaacccaggcuuaa

SEQ ID NO: 3882382 - RNA, 20 nt, Shigella flexneri 2a str. 301
aaaccccaaaaagauuaaaa

SEQ ID NO: 3882383 - RNA, 15 nt, Shigella flexneri 2a str. 301
aaacccgcaggcgca

SEQ ID NO: 3882384 - RNA, 11 nt, Shigella flexneri 2a str. 301
aaacccgcuca

SEQ ID NO: 3882385 - RNA, 18 nt, Shigella flexneri 2a str. 301
aaacccgguaagcauuua

SEQ ID NO: 3882386 - RNA, 21 nt, Shigella flexneri 2a str. 301
aaacccgugugguaaaguuug

SEQ ID NO: 3882387 - RNA, 13 nt, Shigella flexneri 2a str. 301
aaacccugcguca

SEQ ID NO: 3882388 - RNA, 23 nt, Shigella flexneri 2a str. 301
aaaccgaaguuguagcuggcuuc

SEQ ID NO: 3882389 - RNA, 13 nt, Shigella flexneri 2a str. 301
aaaccgacugccu

SEQ ID NO: 3882390 - RNA, 14 nt, Shigella flexneri 2a str. 301
aaaccgacuuaaaa

SEQ ID NO: 3882391 - RNA, 23 nt, Shigella flexneri 2a str. 301
aaaccgcaccguauugcgccggu

SEQ ID NO: 3882392 - RNA, 12 nt, Shigella flexneri 2a str. 301
aaaccgcgcagc

SEQ ID NO: 3882393 - RNA, 23 nt, Shigella flexneri 2a str. 301
aaaccgcgcagcgggcauuuuca

SEQ ID NO: 3882394 - RNA, 19 nt, Shigella flexneri 2a str. 301
aaaccgcucgugggcaucg

SEQ ID NO: 3882395 - RNA, 13 nt, Shigella flexneri 2a str. 301
aaaccgcugggca

SEQ ID NO: 3882396 - RNA, 18 nt, Shigella flexneri 2a str. 301
aaaccguaagcgccccga

SEQ ID NO: 3882397 - RNA, 23 nt, Shigella flexneri 2a str. 301
aaaccguaaguaagauaaaagca

SEQ ID NO: 3882398 - RNA, 14 nt, Shigella flexneri 2a str. 301
aaaccguauccauc

SEQ ID NO: 3882399 - RNA, 17 nt, Shigella flexneri 2a str. 301
aaaccgucagcaccagg

SEQ ID NO: 3882400 - RNA, 23 nt, Shigella flexneri 2a str. 301
aaaccguucuuuucgagcagguc

SEQ ID NO: 3882401 - RNA, 15 nt, Shigella flexneri 2a str. 301
aaaccucacgcaucc

SEQ ID NO: 3882402 - RNA, 17 nt, Shigella flexneri 2a str. 301
aaaccuccagcaucaga

SEQ ID NO: 3882403 - RNA, 16 nt, Shigella flexneri 2a str. 301
aaaccuccgcaaugcg

SEQ ID NO: 3882404 - RNA, 14 nt, Shigella flexneri 2a str. 301
aaaccucuuccagc

SEQ ID NO: 3882405 - RNA, 18 nt, Shigella flexneri 2a str. 301
aaaccucuuccagcagau

SEQ ID NO: 3882406 - RNA, 17 nt, Shigella flexneri 2a str. 301
aaaccugacaacaaaac

SEQ ID NO: 3882407 - RNA, 16 nt, Shigella flexneri 2a str. 301
aaaccugauuacgcac

SEQ ID NO: 3882408 - RNA, 17 nt, Shigella flexneri 2a str. 301
aaaccugauuacgcacc

SEQ ID NO: 3882409 - RNA, 20 nt, Shigella flexneri 2a str. 301
aaaccuguauacgcauauca

SEQ ID NO: 3882410 - RNA, 16 nt, Shigella flexneri 2a str. 301
aaaccuguugaaauua

SEQ ID NO: 3882411 - RNA, 21 nt, Shigella flexneri 2a str. 301
aaaccuucuugacgcugauuu

SEQ ID NO: 3882412 - RNA, 21 nt, Shigella flexneri 2a str. 301
aaaccuugugcacgcgcuuca

SEQ ID NO: 3882413 - RNA, 16 nt, Shigella flexneri 2a str. 301
aaacgaaccauaaaau

SEQ ID NO: 3882414 - RNA, 18 nt, Shigella flexneri 2a str. 301
aaacgaaccauaaaauca

SEQ ID NO: 3882415 - RNA, 16 nt, Shigella flexneri 2a str. 301
aaacgaaucugcaaau

SEQ ID NO: 3882416 - RNA, 18 nt, Shigella flexneri 2a str. 301
aaacgacacugcucgcag

SEQ ID NO: 3882417 - RNA, 18 nt, Shigella flexneri 2a str. 301
aaacgauuaauuacacag

SEQ ID NO: 3882418 - RNA, 15 nt, Shigella flexneri 2a str. 301
aaacgcaacauugcc

SEQ ID NO: 3882419 - RNA, 16 nt, Shigella flexneri 2a str. 301
aaacgcacgucugaug

SEQ ID NO: 3882420 - RNA, 16 nt, Shigella flexneri 2a str. 301
aaacgcagucuuccca

SEQ ID NO: 3882421 - RNA, 17 nt, Shigella flexneri 2a str. 301
aaacgcagucuucccag

SEQ ID NO: 3882422 - RNA, 16 nt, Shigella flexneri 2a str. 301
aaacgcauacggguaa

SEQ ID NO: 3882423 - RNA, 19 nt, Shigella flexneri 2a str. 301
aaacgccacauccggccua

SEQ ID NO: 3882424 - RNA, 13 nt, Shigella flexneri 2a str. 301
aaacgccagcagc

SEQ ID NO: 3882425 - RNA, 17 nt, Shigella flexneri 2a str. 301
aaacgcccaaugcccag

SEQ ID NO: 3882426 - RNA, 17 nt, Shigella flexneri 2a str. 301
aaacgccguucuucagc

SEQ ID NO: 3882427 - RNA, 19 nt, Shigella flexneri 2a str. 301
aaacgccuuauccggccua

SEQ ID NO: 3882428 - RNA, 17 nt, Shigella flexneri 2a str. 301
aaacgccuuauccgucc

SEQ ID NO: 3882429 - RNA, 20 nt, Shigella flexneri 2a str. 301
aaacgccuugcgcgcagugc

SEQ ID NO: 3882430 - RNA, 14 nt, Shigella flexneri 2a str. 301
aaacgcgccaggua

SEQ ID NO: 3882431 - RNA, 16 nt, Shigella flexneri 2a str. 301
aaacgcucccugccag

SEQ ID NO: 3882432 - RNA, 12 nt, Shigella flexneri 2a str. 301
aaacgcucggca

SEQ ID NO: 3882433 - RNA, 15 nt, Shigella flexneri 2a str. 301
aaacggaaagcagau

SEQ ID NO: 3882434 - RNA, 22 nt, Shigella flexneri 2a str. 301
aaacggaaagcagauaacccag

SEQ ID NO: 3882435 - RNA, 15 nt, Shigella flexneri 2a str. 301
aaacggcacgaugag

SEQ ID NO: 3882436 - RNA, 20 nt, Shigella flexneri 2a str. 301
aaacggcauaugccaugcga

SEQ ID NO: 3882437 - RNA, 21 nt, Shigella flexneri 2a str. 301
aaacgguaccguugaccaguc

SEQ ID NO: 3882438 - RNA, 17 nt, Shigella flexneri 2a str. 301
aaacggucccucaacaa

SEQ ID NO: 3882439 - RNA, 17 nt, Shigella flexneri 2a str. 301
aaacgguuuauccccaa

SEQ ID NO: 3882440 - RNA, 20 nt, Shigella flexneri 2a str. 301
aaacgguuucagcagcggca

SEQ ID NO: 3882441 - RNA, 20 nt, Shigella flexneri 2a str. 301
aaacguaaaacugccugaug

SEQ ID NO: 3882442 - RNA, 15 nt, Shigella flexneri 2a str. 301
aaacgucucacuaac

SEQ ID NO: 3882443 - RNA, 22 nt, Shigella flexneri 2a str. 301
aaacgucucacuaacgguguaa

SEQ ID NO: 3882444 - RNA, 16 nt, Shigella flexneri 2a str. 301
aaacguuaugcaccga

SEQ ID NO: 3882445 - RNA, 21 nt, Shigella flexneri 2a str. 301
aaacguuccccaggguuucuc

SEQ ID NO: 3882446 - RNA, 20 nt, Shigella flexneri 2a str. 301
aaacguugucaguucuuuua

SEQ ID NO: 3882447 - RNA, 22 nt, Shigella flexneri 2a str. 301
aaacguugucaguucuuuuauu

SEQ ID NO: 3882448 - RNA, 13 nt, Shigella flexneri 2a str. 301
aaacguuuaaaaa

SEQ ID NO: 3882449 - RNA, 15 nt, Shigella flexneri 2a str. 301
aaacguuuaaaaacu

SEQ ID NO: 3882450 - RNA, 14 nt, Shigella flexneri 2a str. 301
aaacguuucaaaca

SEQ ID NO: 3882451 - RNA, 17 nt, Shigella flexneri 2a str. 301
aaacguuucaaacaggc

SEQ ID NO: 3882452 - RNA, 14 nt, Shigella flexneri 2a str. 301
aaacuaaaaacagc

SEQ ID NO: 3882453 - RNA, 17 nt, Shigella flexneri 2a str. 301
aaacuaucccagccuau

SEQ ID NO: 3882454 - RNA, 22 nt, Shigella flexneri 2a str. 301
aaacuaucccagccuauaacga

SEQ ID NO: 3882455 - RNA, 23 nt, Shigella flexneri 2a str. 301
aaacuaucccagccuauaacgaa

SEQ ID NO: 3882456 - RNA, 21 nt, Shigella flexneri 2a str. 301
aaagcggcccuuuuuuuacuu

SEQ ID NO: 3882457 - RNA, 21 nt, Shigella flexneri 2a str. 301
aaagcguuuaucaauuaacug

SEQ ID NO: 3882458 - RNA, 16 nt, Shigella flexneri 2a str. 301
aaagcguuuaugcgca

SEQ ID NO: 3882459 - RNA, 13 nt, Shigella flexneri 2a str. 301
aaagcuaacagag

SEQ ID NO: 3882460 - RNA, 15 nt, Shigella flexneri 2a str. 301
aaagcuaacagagcc

SEQ ID NO: 3882461 - RNA, 13 nt, Shigella flexneri 2a str. 301
aaagcucccuaaa

SEQ ID NO: 3882462 - RNA, 14 nt, Shigella flexneri 2a str. 301
aaagcucccuaaaa

SEQ ID NO: 3882463 - RNA, 20 nt, Shigella flexneri 2a str. 301
aaagcugcaaggugaaagca

SEQ ID NO: 3882464 - RNA, 23 nt, Shigella flexneri 2a str. 301
aaagcugccgucaauuuuaagca

SEQ ID NO: 3882465 - RNA, 19 nt, Shigella flexneri 2a str. 301
aaagcugcugaccaccagc

SEQ ID NO: 3882466 - RNA, 21 nt, Shigella flexneri 2a str. 301
aaagcugcugaccaccagcac

SEQ ID NO: 3882467 - RNA, 21 nt, Shigella flexneri 2a str. 301
aaagcugggauggcaaaaccu

SEQ ID NO: 3882468 - RNA, 16 nt, Shigella flexneri 2a str. 301
aaagcuguaucccagc

SEQ ID NO: 3882469 - RNA, 18 nt, Shigella flexneri 2a str. 301
aaagcuucucagagaacu

SEQ ID NO: 3882470 - RNA, 23 nt, Shigella flexneri 2a str. 301
aaaggaacaaggguaagggagga

SEQ ID NO: 3882471 - RNA, 23 nt, Shigella flexneri 2a str. 301
aaaggacagugggauuaaaaagu

SEQ ID NO: 3882472 - RNA, 22 nt, Shigella flexneri 2a str. 301
aaaggcaccaauauugacugau

SEQ ID NO: 3882473 - RNA, 23 nt, Shigella flexneri 2a str. 301
aaaggcaccaauauugacugaug

SEQ ID NO: 3882474 - RNA, 17 nt, Shigella flexneri 2a str. 301
aaaggccagcaaucccc

SEQ ID NO: 3882475 - RNA, 18 nt, Shigella flexneri 2a str. 301
aaaggccagcaaucccca

SEQ ID NO: 3882476 - RNA, 23 nt, Shigella flexneri 2a str. 301
aaaggccgcaggcuguuaccccu

SEQ ID NO: 3882477 - RNA, 21 nt, Shigella flexneri 2a str. 301
aaaggcgagguauaaaaugag

SEQ ID NO: 3882478 - RNA, 14 nt, Shigella flexneri 2a str. 301
aaaggcgaugcugu

SEQ ID NO: 3882479 - RNA, 18 nt, Shigella flexneri 2a str. 301
aaaggcggcagaacagaa

SEQ ID NO: 3882480 - RNA, 19 nt, Shigella flexneri 2a str. 301
aaaggcggcagaacagaac

SEQ ID NO: 3882481 - RNA, 20 nt, Shigella flexneri 2a str. 301
aaaggcggcagaacagaaca

SEQ ID NO: 3882482 - RNA, 19 nt, Shigella flexneri 2a str. 301
aaaggcgugaacuucgcca

SEQ ID NO: 3882483 - RNA, 16 nt, Shigella flexneri 2a str. 301
aaaggcugacaaauca

SEQ ID NO: 3882484 - RNA, 13 nt, Shigella flexneri 2a str. 301
aaaggcugaggga

SEQ ID NO: 3882485 - RNA, 17 nt, Shigella flexneri 2a str. 301
aaaggcuuugacuaaca

SEQ ID NO: 3882486 - RNA, 14 nt, Shigella flexneri 2a str. 301
aaagggagcuaucu

SEQ ID NO: 3882487 - RNA, 15 nt, Shigella flexneri 2a str. 301
aaagggaugccccca

SEQ ID NO: 3882488 - RNA, 15 nt, Shigella flexneri 2a str. 301
aaaggggugaaaaaa

SEQ ID NO: 3882489 - RNA, 19 nt, Shigella flexneri 2a str. 301
aaaggucauugcgacgaga

SEQ ID NO: 3882490 - RNA, 14 nt, Shigella flexneri 2a str. 301
aaaguaaaaaagaa

SEQ ID NO: 3882491 - RNA, 10 nt, Shigella flexneri 2a str. 301
aaaguaaauu

SEQ ID NO: 3882492 - RNA, 21 nt, Shigella flexneri 2a str. 301
aaaguaagaauugauaaaaaa

SEQ ID NO: 3882493 - RNA, 18 nt, Shigella flexneri 2a str. 301
aaaguaagauugccugau

SEQ ID NO: 3882494 - RNA, 18 nt, Shigella flexneri 2a str. 301
aaaguacuucacaaucag

SEQ ID NO: 3882495 - RNA, 17 nt, Shigella flexneri 2a str. 301
aaaguagaaauuauuuc

SEQ ID NO: 3882496 - RNA, 23 nt, Shigella flexneri 2a str. 301
aaaguagggcugauaaacaagcg

SEQ ID NO: 3882497 - RNA, 18 nt, Shigella flexneri 2a str. 301
aaaguauauaaaaaacaa

SEQ ID NO: 3882498 - RNA, 22 nt, Shigella flexneri 2a str. 301
aaagucacgccaauaaucgauu

SEQ ID NO: 3882499 - RNA, 22 nt, Shigella flexneri 2a str. 301
aaagucauccuuaaagaaaaag

SEQ ID NO: 3882500 - RNA, 20 nt, Shigella flexneri 2a str. 301
aaagucccuucccagccggg

SEQ ID NO: 3882501 - RNA, 23 nt, Shigella flexneri 2a str. 301
aaaguccggguucaaaucgaaau

SEQ ID NO: 3882502 - RNA, 19 nt, Shigella flexneri 2a str. 301
aaagucguaggccugauaa

SEQ ID NO: 3882503 - RNA, 13 nt, Shigella flexneri 2a str. 301
aaagucuccuuug

SEQ ID NO: 3882504 - RNA, 13 nt, Shigella flexneri 2a str. 301
aaagugaaaaaca

SEQ ID NO: 3882505 - RNA, 16 nt, Shigella flexneri 2a str. 301
aaagugaauacagaac

SEQ ID NO: 3882506 - RNA, 17 nt, Shigella flexneri 2a str. 301
aaagugaauacagaaca

SEQ ID NO: 3882507 - RNA, 15 nt, Shigella flexneri 2a str. 301
aaagugaguuuugca

SEQ ID NO: 3882508 - RNA, 16 nt, Shigella flexneri 2a str. 301
aaagugcccccaacuu

SEQ ID NO: 3882509 - RNA, 14 nt, Shigella flexneri 2a str. 301
aaaguggaaaaaua

SEQ ID NO: 3882510 - RNA, 17 nt, Shigella flexneri 2a str. 301
aaaguggaaaaauaaca

SEQ ID NO: 3882511 - RNA, 17 nt, Shigella flexneri 2a str. 301
aaagugguguucuuugu

SEQ ID NO: 3882512 - RNA, 21 nt, Shigella flexneri 2a str. 301
aaagugguguugaagaaacau

SEQ ID NO: 3882513 - RNA, 14 nt, Shigella flexneri 2a str. 301
aaaguguugcagga

SEQ ID NO: 3882514 - RNA, 17 nt, Shigella flexneri 2a str. 301
aaaguuaccuucgaaga

SEQ ID NO: 3882515 - RNA, 16 nt, Shigella flexneri 2a str. 301
aaaguuagagccaggg

SEQ ID NO: 3882516 - RNA, 17 nt, Shigella flexneri 2a str. 301
aaaguugcucucaaaga

SEQ ID NO: 3882517 - RNA, 14 nt, Shigella flexneri 2a str. 301
aaaguuugcaacuu

SEQ ID NO: 3882518 - RNA, 18 nt, Shigella flexneri 2a str. 301
aaaguuuuucaacaccau

SEQ ID NO: 3882519 - RNA, 21 nt, Shigella flexneri 2a str. 301
aaauaaaaaaaguauuuuuaa

SEQ ID NO: 3882520 - RNA, 20 nt, Shigella flexneri 2a str. 301
aaauaaaaaacauucaagua

SEQ ID NO: 3882521 - RNA, 12 nt, Shigella flexneri 2a str. 301
aaauaaaaauaa

SEQ ID NO: 3882522 - RNA, 23 nt, Shigella flexneri 2a str. 301
aaauaaacucucuauuccaccau

SEQ ID NO: 3882523 - RNA, 22 nt, Shigella flexneri 2a str. 301
aaauaaaucaaagucagaucaa

SEQ ID NO: 3882524 - RNA, 14 nt, Shigella flexneri 2a str. 301
aaauaaauguguuu

SEQ ID NO: 3882525 - RNA, 14 nt, Shigella flexneri 2a str. 301
aaauaacaucgcca

SEQ ID NO: 3882526 - RNA, 12 nt, Shigella flexneri 2a str. 301
aaauaaccacaa

SEQ ID NO: 3882527 - RNA, 16 nt, Shigella flexneri 2a str. 301
aaauaaccacaacggc

SEQ ID NO: 3882528 - RNA, 20 nt, Shigella flexneri 2a str. 301
aaauaacgccccggcaaaac

SEQ ID NO: 3882529 - RNA, 16 nt, Shigella flexneri 2a str. 301
aaauaacguaaaaacc

SEQ ID NO: 3882530 - RNA, 13 nt, Shigella flexneri 2a str. 301
aaauaagaaaagc

SEQ ID NO: 3882531 - RNA, 22 nt, Shigella flexneri 2a str. 301
aaauaagcgacguuguuuucau

SEQ ID NO: 3882532 - RNA, 21 nt, Shigella flexneri 2a str. 301
aaauaauaagagcguccagau

SEQ ID NO: 3882533 - RNA, 13 nt, Shigella flexneri 2a str. 301
aaauaauacacac

SEQ ID NO: 3882534 - RNA, 12 nt, Shigella flexneri 2a str. 301
aaauaaucaaau

SEQ ID NO: 3882535 - RNA, 23 nt, Shigella flexneri 2a str. 301
aaauaaucccgcgcaacaaauaa

SEQ ID NO: 3882536 - RNA, 14 nt, Shigella flexneri 2a str. 301
aaauaauccgcugu

SEQ ID NO: 3882537 - RNA, 13 nt, Shigella flexneri 2a str. 301
aaauaaugcagcg

SEQ ID NO: 3882538 - RNA, 23 nt, Shigella flexneri 2a str. 301
aaauaaugcgacaacagaaauaa

SEQ ID NO: 3882539 - RNA, 21 nt, Shigella flexneri 2a str. 301
aaauaauuuucguaguauaga

SEQ ID NO: 3882540 - RNA, 14 nt, Shigella flexneri 2a str. 301
aaauacaauucuca

SEQ ID NO: 3882541 - RNA, 18 nt, Shigella flexneri 2a str. 301
aaauacaccuauacuuuu

SEQ ID NO: 3882542 - RNA, 18 nt, Shigella flexneri 2a str. 301
aaauacauuaguaauuuc

SEQ ID NO: 3882543 - RNA, 14 nt, Shigella flexneri 2a str. 301
aaauacccaaaaaa

SEQ ID NO: 3882544 - RNA, 17 nt, Shigella flexneri 2a str. 301
aaauacccaaaaaauag

SEQ ID NO: 3882545 - RNA, 22 nt, Shigella flexneri 2a str. 301
aaauacccaaaaaauagcaaag

SEQ ID NO: 3882546 - RNA, 22 nt, Shigella flexneri 2a str. 301
aaauaccccgccagcagaauga

SEQ ID NO: 3882547 - RNA, 14 nt, Shigella flexneri 2a str. 301
aaauaccguucauu

SEQ ID NO: 3882548 - RNA, 20 nt, Shigella flexneri 2a str. 301
aaauacgcuggcugaacauu

SEQ ID NO: 3882549 - RNA, 19 nt, Shigella flexneri 2a str. 301
aaauacguaggccugauaa

SEQ ID NO: 3882550 - RNA, 16 nt, Shigella flexneri 2a str. 301
aaauacguucucaccu

SEQ ID NO: 3882551 - RNA, 16 nt, Shigella flexneri 2a str. 301
aaauacugacuggcaa

SEQ ID NO: 3882552 - RNA, 16 nt, Shigella flexneri 2a str. 301
aaauacugauguuugu

SEQ ID NO: 3882553 - RNA, 16 nt, Shigella flexneri 2a str. 301
aaauacuggcuaagaa

SEQ ID NO: 3882554 - RNA, 17 nt, Shigella flexneri 2a str. 301
aaauacuggcuaagaag

SEQ ID NO: 3882555 - RNA, 18 nt, Shigella flexneri 2a str. 301
aaauacuggcuaagaagc

SEQ ID NO: 3882556 - RNA, 19 nt, Shigella flexneri 2a str. 301
aaaugacgaugacugguag

SEQ ID NO: 3882557 - RNA, 22 nt, Shigella flexneri 2a str. 301
aaaugacucgccgcuguggaua

SEQ ID NO: 3882558 - RNA, 19 nt, Shigella flexneri 2a str. 301
aaaugagugccaaaaaaau

SEQ ID NO: 3882559 - RNA, 14 nt, Shigella flexneri 2a str. 301
aaaugauagccagg

SEQ ID NO: 3882560 - RNA, 18 nt, Shigella flexneri 2a str. 301
aaaugauguagaccugau

SEQ ID NO: 3882561 - RNA, 12 nt, Shigella flexneri 2a str. 301
aaaugauuuccu

SEQ ID NO: 3882562 - RNA, 13 nt, Shigella flexneri 2a str. 301
aaaugauuuccug

SEQ ID NO: 3882563 - RNA, 19 nt, Shigella flexneri 2a str. 301
aaaugcagcauugccugau

SEQ ID NO: 3882564 - RNA, 20 nt, Shigella flexneri 2a str. 301
aaaugcagcauugccugaug

SEQ ID NO: 3882565 - RNA, 14 nt, Shigella flexneri 2a str. 301
aaaugcaucaguga

SEQ ID NO: 3882566 - RNA, 21 nt, Shigella flexneri 2a str. 301
aaaugcaugcucagucacuuc

SEQ ID NO: 3882567 - RNA, 20 nt, Shigella flexneri 2a str. 301
aaaugccaaauauuucuuua

SEQ ID NO: 3882568 - RNA, 11 nt, Shigella flexneri 2a str. 301
aaaugccagau

SEQ ID NO: 3882569 - RNA, 19 nt, Shigella flexneri 2a str. 301
aaaugccagauaagacacu

SEQ ID NO: 3882570 - RNA, 18 nt, Shigella flexneri 2a str. 301
aaaugcccgauaagcaaa

SEQ ID NO: 3882571 - RNA, 13 nt, Shigella flexneri 2a str. 301
aaaugccgcacau

SEQ ID NO: 3882572 - RNA, 16 nt, Shigella flexneri 2a str. 301
aaaugccgcacaucac

SEQ ID NO: 3882573 - RNA, 14 nt, Shigella flexneri 2a str. 301
aaaugccuuucuca

SEQ ID NO: 3882574 - RNA, 19 nt, Shigella flexneri 2a str. 301
aaaugccuuucucagaagu

SEQ ID NO: 3882575 - RNA, 14 nt, Shigella flexneri 2a str. 301
aaaugcgcaugaug

SEQ ID NO: 3882576 - RNA, 15 nt, Shigella flexneri 2a str. 301
aaaugcgcucagggu

SEQ ID NO: 3882577 - RNA, 19 nt, Shigella flexneri 2a str. 301
aaaugcugcuuuauauucu

SEQ ID NO: 3882578 - RNA, 18 nt, Shigella flexneri 2a str. 301
aaauggccagccagcaga

SEQ ID NO: 3882579 - RNA, 22 nt, Shigella flexneri 2a str. 301
aaauggcccuucuggucaugaa

SEQ ID NO: 3882580 - RNA, 12 nt, Shigella flexneri 2a str. 301
aaauggcgcuuu

SEQ ID NO: 3882581 - RNA, 19 nt, Shigella flexneri 2a str. 301
aaauggcguuagucaugaa

SEQ ID NO: 3882582 - RNA, 15 nt, Shigella flexneri 2a str. 301
aaaugggagcuggga

SEQ ID NO: 3882583 - RNA, 19 nt, Shigella flexneri 2a str. 301
aaaugggugucgccuucca

SEQ ID NO: 3882584 - RNA, 17 nt, Shigella flexneri 2a str. 301
aaaugguuucugauugg

SEQ ID NO: 3882585 - RNA, 14 nt, Shigella flexneri 2a str. 301
aaaugguuuugcgu

SEQ ID NO: 3882586 - RNA, 12 nt, Shigella flexneri 2a str. 301
aaaugucacugc

SEQ ID NO: 3882587 - RNA, 17 nt, Shigella flexneri 2a str. 301
aaaugucagcugccagu

SEQ ID NO: 3882588 - RNA, 18 nt, Shigella flexneri 2a str. 301
aaaugugaagaggaacaa

SEQ ID NO: 3882589 - RNA, 22 nt, Shigella flexneri 2a str. 301
aaaugugaagaggaacaaauuu

SEQ ID NO: 3882590 - RNA, 20 nt, Shigella flexneri 2a str. 301
aaaugugcaaucacaguuaa

SEQ ID NO: 3882591 - RNA, 19 nt, Shigella flexneri 2a str. 301
aaaugugccggaugcauca

SEQ ID NO: 3882592 - RNA, 21 nt, Shigella flexneri 2a str. 301
aaaugugccggaugcaucaca

SEQ ID NO: 3882593 - RNA, 19 nt, Shigella flexneri 2a str. 301
aaauguuaucgggcauagg

SEQ ID NO: 3882594 - RNA, 23 nt, Shigella flexneri 2a str. 301
aaauuaaacugucgucgcuuuca

SEQ ID NO: 3882595 - RNA, 20 nt, Shigella flexneri 2a str. 301
aaauuaaaucgguauuucca

SEQ ID NO: 3882596 - RNA, 16 nt, Shigella flexneri 2a str. 301
aaauuaacaaaacaau

SEQ ID NO: 3882597 - RNA, 16 nt, Shigella flexneri 2a str. 301
aaauuaacgucaccau

SEQ ID NO: 3882598 - RNA, 15 nt, Shigella flexneri 2a str. 301
aaauuaauccgguaa

SEQ ID NO: 3882599 - RNA, 16 nt, Shigella flexneri 2a str. 301
aaauuacccuuuauuu

SEQ ID NO: 3882600 - RNA, 12 nt, Shigella flexneri 2a str. 301
aaauuacgaucc

SEQ ID NO: 3882601 - RNA, 22 nt, Shigella flexneri 2a str. 301
aaauuacugccuugaugaaaaa

SEQ ID NO: 3882602 - RNA, 23 nt, Shigella flexneri 2a str. 301
aaauuacugccuugaugaaaaaa

SEQ ID NO: 3882603 - RNA, 16 nt, Shigella flexneri 2a str. 301
aaauuaggucaaagaa

SEQ ID NO: 3882604 - RNA, 20 nt, Shigella flexneri 2a str. 301
aaauuauccagcuuuuccca

SEQ ID NO: 3882605 - RNA, 19 nt, Shigella flexneri 2a str. 301
aaauuaucucuguuuugca

SEQ ID NO: 3882606 - RNA, 21 nt, Shigella flexneri 2a str. 301
aaauuauuucuuuuacauuau

SEQ ID NO: 3882607 - RNA, 14 nt, Shigella flexneri 2a str. 301
aaauuauuuuaaau

SEQ ID NO: 3882608 - RNA, 20 nt, Shigella flexneri 2a str. 301
aaauucaagacaucaauaaa

SEQ ID NO: 3882609 - RNA, 18 nt, Shigella flexneri 2a str. 301
aaauucagcaguuuuugc

SEQ ID NO: 3882610 - RNA, 19 nt, Shigella flexneri 2a str. 301
aaauucagcaguuuuugca

SEQ ID NO: 3882611 - RNA, 15 nt, Shigella flexneri 2a str. 301
aaauucagcauuacc

SEQ ID NO: 3882612 - RNA, 21 nt, Shigella flexneri 2a str. 301
aaauucagcauuacccgucug

SEQ ID NO: 3882613 - RNA, 18 nt, Shigella flexneri 2a str. 301
aaauucaggaauucagaa

SEQ ID NO: 3882614 - RNA, 17 nt, Shigella flexneri 2a str. 301
aaauucauuaccaaccu

SEQ ID NO: 3882615 - RNA, 19 nt, Shigella flexneri 2a str. 301
aaauucauucaauuaauaa

SEQ ID NO: 3882616 - RNA, 22 nt, Shigella flexneri 2a str. 301
aaauucauucaauuaauaacac

SEQ ID NO: 3882617 - RNA, 15 nt, Shigella flexneri 2a str. 301
aaauucauuugaaua

SEQ ID NO: 3882618 - RNA, 13 nt, Shigella flexneri 2a str. 301
aaauuccagaaaa

SEQ ID NO: 3882619 - RNA, 21 nt, Shigella flexneri 2a str. 301
aaauuccuaaccgaauucaaa

SEQ ID NO: 3882620 - RNA, 19 nt, Shigella flexneri 2a str. 301
aaauuccuaugcaacaacu

SEQ ID NO: 3882621 - RNA, 15 nt, Shigella flexneri 2a str. 301
aaauucgaaauagag

SEQ ID NO: 3882622 - RNA, 22 nt, Shigella flexneri 2a str. 301
aaauucuacagaaaugaaaaaa

SEQ ID NO: 3882623 - RNA, 14 nt, Shigella flexneri 2a str. 301
aaauucuggcacca

SEQ ID NO: 3882624 - RNA, 17 nt, Shigella flexneri 2a str. 301
aaauucuggcaccaccu

SEQ ID NO: 3882625 - RNA, 18 nt, Shigella flexneri 2a str. 301
aaauucuggcggcaauaa

SEQ ID NO: 3882626 - RNA, 14 nt, Shigella flexneri 2a str. 301
aaauucuuaaugau

SEQ ID NO: 3882627 - RNA, 19 nt, Shigella flexneri 2a str. 301
aaauucuuacguaauuuau

SEQ ID NO: 3882628 - RNA, 20 nt, Shigella flexneri 2a str. 301
aaauucuucugaaugugccu

SEQ ID NO: 3882629 - RNA, 13 nt, Shigella flexneri 2a str. 301
aaauugaagaguu

SEQ ID NO: 3882630 - RNA, 15 nt, Shigella flexneri 2a str. 301
aaauugcaggaaaua

SEQ ID NO: 3882631 - RNA, 17 nt, Shigella flexneri 2a str. 301
aaauugcguaaagccug

SEQ ID NO: 3882632 - RNA, 16 nt, Shigella flexneri 2a str. 301
aaauugcugguuuugu

SEQ ID NO: 3882633 - RNA, 19 nt, Shigella flexneri 2a str. 301
aaauugcuguuacgccaga

SEQ ID NO: 3882634 - RNA, 16 nt, Shigella flexneri 2a str. 301
aaauugguacagcaua

SEQ ID NO: 3882635 - RNA, 21 nt, Shigella flexneri 2a str. 301
aaauugugauaaaaaucggca

SEQ ID NO: 3882636 - RNA, 18 nt, Shigella flexneri 2a str. 301
aaauuguggcguccagga

SEQ ID NO: 3882637 - RNA, 22 nt, Shigella flexneri 2a str. 301
aaauuguuuaaucaacugccca

SEQ ID NO: 3882638 - RNA, 22 nt, Shigella flexneri 2a str. 301
aaauuuacaguauaaguaauga

SEQ ID NO: 3882639 - RNA, 21 nt, Shigella flexneri 2a str. 301
aaauuuaccugauccuuugga

SEQ ID NO: 3882640 - RNA, 18 nt, Shigella flexneri 2a str. 301
aaauuuagcaaauuuuua

SEQ ID NO: 3882641 - RNA, 21 nt, Shigella flexneri 2a str. 301
aaauuuaugcgcuaaauguuu

SEQ ID NO: 3882642 - RNA, 17 nt, Shigella flexneri 2a str. 301
aaauuucacugcuuaau

SEQ ID NO: 3882643 - RNA, 15 nt, Shigella flexneri 2a str. 301
aaauuucauuaauau

SEQ ID NO: 3882644 - RNA, 17 nt, Shigella flexneri 2a str. 301
aaauuucccacucuuga

SEQ ID NO: 3882645 - RNA, 12 nt, Shigella flexneri 2a str. 301
aaauuucuccuu

SEQ ID NO: 3882646 - RNA, 19 nt, Shigella flexneri 2a str. 301
aaauuucuuaccacugccg

SEQ ID NO: 3882647 - RNA, 15 nt, Shigella flexneri 2a str. 301
aaauuucuucccuuu

SEQ ID NO: 3882648 - RNA, 16 nt, Shigella flexneri 2a str. 301
aaauuucuucccuuuc

SEQ ID NO: 3882649 - RNA, 18 nt, Shigella flexneri 2a str. 301
aaauuucuucccuuucug

SEQ ID NO: 3882650 - RNA, 17 nt, Shigella flexneri 2a str. 301
aaauuugcggauaaagc

SEQ ID NO: 3882651 - RNA, 23 nt, Shigella flexneri 2a str. 301
aaauuugcucaucgauaucgacc

SEQ ID NO: 3882652 - RNA, 16 nt, Shigella flexneri 2a str. 301
aaauuuggcuccucug

SEQ ID NO: 3882653 - RNA, 21 nt, Shigella flexneri 2a str. 301
aaauuuucagcgugcccacgu

SEQ ID NO: 3882654 - RNA, 21 nt, Shigella flexneri 2a str. 301
aaauuuugugggcaggagaaa

SEQ ID NO: 3882655 - RNA, 18 nt, Shigella flexneri 2a str. 301
aaauuuuuccguuuucca

SEQ ID NO: 3882656 - RNA, 13 nt, Shigella flexneri 2a str. 301
aacagaccagcac

SEQ ID NO: 3882657 - RNA, 13 nt, Shigella flexneri 2a str. 301
aacagaccauaac

SEQ ID NO: 3882658 - RNA, 17 nt, Shigella flexneri 2a str. 301
aacagagccgcgauaaa

SEQ ID NO: 3882659 - RNA, 21 nt, Shigella flexneri 2a str. 301
aacagagguuucucauaauua

SEQ ID NO: 3882660 - RNA, 15 nt, Shigella flexneri 2a str. 301
aacagcaaucccaaa

SEQ ID NO: 3882661 - RNA, 18 nt, Shigella flexneri 2a str. 301
aacagcaauuuugucauu

SEQ ID NO: 3882662 - RNA, 16 nt, Shigella flexneri 2a str. 301
aacagcacaucagcca

SEQ ID NO: 3882663 - RNA, 13 nt, Shigella flexneri 2a str. 301
aacagcaccaucc

SEQ ID NO: 3882664 - RNA, 13 nt, Shigella flexneri 2a str. 301
aacagcagcaggu

SEQ ID NO: 3882665 - RNA, 14 nt, Shigella flexneri 2a str. 301
aacagcagcagguc

SEQ ID NO: 3882666 - RNA, 17 nt, Shigella flexneri 2a str. 301
aacagcaggcagaucca

SEQ ID NO: 3882667 - RNA, 11 nt, Shigella flexneri 2a str. 301
aacagcaguug

SEQ ID NO: 3882668 - RNA, 15 nt, Shigella flexneri 2a str. 301
aacagccacugguga

SEQ ID NO: 3882669 - RNA, 19 nt, Shigella flexneri 2a str. 301
aacagccauaaccccacca

SEQ ID NO: 3882670 - RNA, 18 nt, Shigella flexneri 2a str. 301
aacagccggaugucugga

SEQ ID NO: 3882671 - RNA, 22 nt, Shigella flexneri 2a str. 301
aacagccugugccugagccgga

SEQ ID NO: 3882672 - RNA, 22 nt, Shigella flexneri 2a str. 301
aacagccuuaaacucaauauua

SEQ ID NO: 3882673 - RNA, 14 nt, Shigella flexneri 2a str. 301
aacagcgacaccag

SEQ ID NO: 3882674 - RNA, 20 nt, Shigella flexneri 2a str. 301
aacagcgacaccagccaucu

SEQ ID NO: 3882675 - RNA, 22 nt, Shigella flexneri 2a str. 301
aacagcgaguucaggcgcugca

SEQ ID NO: 3882676 - RNA, 17 nt, Shigella flexneri 2a str. 301
aacagcgcaaaacgcag

SEQ ID NO: 3882677 - RNA, 13 nt, Shigella flexneri 2a str. 301
aacagcgcaccag

SEQ ID NO: 3882678 - RNA, 14 nt, Shigella flexneri 2a str. 301
aacagcggcauuac

SEQ ID NO: 3882679 - RNA, 16 nt, Shigella flexneri 2a str. 301
aacagcucgacaccaa

SEQ ID NO: 3882680 - RNA, 15 nt, Shigella flexneri 2a str. 301
aacagcuuuuuccug

SEQ ID NO: 3882681 - RNA, 22 nt, Shigella flexneri 2a str. 301
aacaggaauaaaucuaaaagau

SEQ ID NO: 3882682 - RNA, 16 nt, Shigella flexneri 2a str. 301
aacaggaguagcucug

SEQ ID NO: 3882683 - RNA, 14 nt, Shigella flexneri 2a str. 301
aacaggcagcugcc

SEQ ID NO: 3882684 - RNA, 19 nt, Shigella flexneri 2a str. 301
aacaggcccaggcggccug

SEQ ID NO: 3882685 - RNA, 21 nt, Shigella flexneri 2a str. 301
aacagggaggggugcaugaaa

SEQ ID NO: 3882686 - RNA, 19 nt, Shigella flexneri 2a str. 301
aacagggcaauuaaaaauu

SEQ ID NO: 3882687 - RNA, 22 nt, Shigella flexneri 2a str. 301
aacagguugcgcuggauuucaa

SEQ ID NO: 3882688 - RNA, 14 nt, Shigella flexneri 2a str. 301
aacagguuuaaaca

SEQ ID NO: 3882689 - RNA, 16 nt, Shigella flexneri 2a str. 301
aacagguuuaaacaga

SEQ ID NO: 3882690 - RNA, 11 nt, Shigella flexneri 2a str. 301
aacaguaaccc

SEQ ID NO: 3882691 - RNA, 18 nt, Shigella flexneri 2a str. 301
aacaguacacagacgaag

SEQ ID NO: 3882692 - RNA, 20 nt, Shigella flexneri 2a str. 301
aacaguacauuguuuuccag

SEQ ID NO: 3882693 - RNA, 17 nt, Shigella flexneri 2a str. 301
aacaguacuggccucca

SEQ ID NO: 3882694 - RNA, 21 nt, Shigella flexneri 2a str. 301
aacaguagacaauuuuucaua

SEQ ID NO: 3882695 - RNA, 19 nt, Shigella flexneri 2a str. 301
aacaguagccucgccgagc

SEQ ID NO: 3882696 - RNA, 20 nt, Shigella flexneri 2a str. 301
aacaguaucugaaucaaaau

SEQ ID NO: 3882697 - RNA, 18 nt, Shigella flexneri 2a str. 301
aacagucuggagcaaaaa

SEQ ID NO: 3882698 - RNA, 22 nt, Shigella flexneri 2a str. 301
aacagugaccaucuuccagcau

SEQ ID NO: 3882699 - RNA, 14 nt, Shigella flexneri 2a str. 301
aacagugcaccgga

SEQ ID NO: 3882700 - RNA, 21 nt, Shigella flexneri 2a str. 301
aacagugcugauccccggaau

SEQ ID NO: 3882701 - RNA, 12 nt, Shigella flexneri 2a str. 301
aacaguuaccuu

SEQ ID NO: 3882702 - RNA, 22 nt, Shigella flexneri 2a str. 301
aacaguucaacgccgcuaucag

SEQ ID NO: 3882703 - RNA, 13 nt, Shigella flexneri 2a str. 301
aacaguuucgcca

SEQ ID NO: 3882704 - RNA, 12 nt, Shigella flexneri 2a str. 301
aacaguuuucaa

SEQ ID NO: 3882705 - RNA, 13 nt, Shigella flexneri 2a str. 301
aacauacaaauag

SEQ ID NO: 3882706 - RNA, 17 nt, Shigella flexneri 2a str. 301
aacauacccaguuucau

SEQ ID NO: 3882707 - RNA, 20 nt, Shigella flexneri 2a str. 301
aacauaccuaaaagcacgcc

SEQ ID NO: 3882708 - RNA, 16 nt, Shigella flexneri 2a str. 301
aacauacgcugcacaa

SEQ ID NO: 3882709 - RNA, 22 nt, Shigella flexneri 2a str. 301
aacauacugcccgagcgccauu

SEQ ID NO: 3882710 - RNA, 15 nt, Shigella flexneri 2a str. 301
aacauagcuuggcag

SEQ ID NO: 3882711 - RNA, 20 nt, Shigella flexneri 2a str. 301
aacauagcuuggcagagcaa

SEQ ID NO: 3882712 - RNA, 22 nt, Shigella flexneri 2a str. 301
aacauagguacagcaccaaaag

SEQ ID NO: 3882713 - RNA, 19 nt, Shigella flexneri 2a str. 301
aacauagucauccucucgg

SEQ ID NO: 3882714 - RNA, 17 nt, Shigella flexneri 2a str. 301
aacauauccuucacaca

SEQ ID NO: 3882715 - RNA, 16 nt, Shigella flexneri 2a str. 301
aacaucaaaugcgcag

SEQ ID NO: 3882716 - RNA, 17 nt, Shigella flexneri 2a str. 301
aacaucaccaagucccu

SEQ ID NO: 3882717 - RNA, 12 nt, Shigella flexneri 2a str. 301
aacaucagauaa

SEQ ID NO: 3882718 - RNA, 20 nt, Shigella flexneri 2a str. 301
aacaucaugccggccagcgc

SEQ ID NO: 3882719 - RNA, 13 nt, Shigella flexneri 2a str. 301
aacauccagauca

SEQ ID NO: 3882720 - RNA, 16 nt, Shigella flexneri 2a str. 301
aacauccaucgccagc

SEQ ID NO: 3882721 - RNA, 13 nt, Shigella flexneri 2a str. 301
aacaucccuguaa

SEQ ID NO: 3882722 - RNA, 21 nt, Shigella flexneri 2a str. 301
aacauccgcuuucgguuuuuc

SEQ ID NO: 3882723 - RNA, 21 nt, Shigella flexneri 2a str. 301
aacauccguuuugugguguuu

SEQ ID NO: 3882724 - RNA, 22 nt, Shigella flexneri 2a str. 301
aacaucgccgccguugcgggaa

SEQ ID NO: 3882725 - RNA, 21 nt, Shigella flexneri 2a str. 301
aacaucgccugccgcaggacg

SEQ ID NO: 3882726 - RNA, 17 nt, Shigella flexneri 2a str. 301
aacaucguuagcggcaa

SEQ ID NO: 3882727 - RNA, 15 nt, Shigella flexneri 2a str. 301
aacaucuuaccucug

SEQ ID NO: 3882728 - RNA, 13 nt, Shigella flexneri 2a str. 301
aacaugaaaauaa

SEQ ID NO: 3882729 - RNA, 16 nt, Shigella flexneri 2a str. 301
aacaugaaacagaaaa

SEQ ID NO: 3882730 - RNA, 20 nt, Shigella flexneri 2a str. 301
aacaugagguccagcgagcc

SEQ ID NO: 3882731 - RNA, 17 nt, Shigella flexneri 2a str. 301
aacaugcaaaccaucac

SEQ ID NO: 3882732 - RNA, 18 nt, Shigella flexneri 2a str. 301
aacaugccaacaaaaucu

SEQ ID NO: 3882733 - RNA, 17 nt, Shigella flexneri 2a str. 301
aacaugcggugauuuug

SEQ ID NO: 3882734 - RNA, 23 nt, Shigella flexneri 2a str. 301
aacauggugggcggguggaguau

SEQ ID NO: 3882735 - RNA, 12 nt, Shigella flexneri 2a str. 301
aacauguugaau

SEQ ID NO: 3882736 - RNA, 14 nt, Shigella flexneri 2a str. 301
aacauuacgugggc

SEQ ID NO: 3882737 - RNA, 13 nt, Shigella flexneri 2a str. 301
aacauuagcgcau

SEQ ID NO: 3882738 - RNA, 14 nt, Shigella flexneri 2a str. 301
aacauuaugucugu

SEQ ID NO: 3882739 - RNA, 19 nt, Shigella flexneri 2a str. 301
aacauucgccgcugugauu

SEQ ID NO: 3882740 - RNA, 21 nt, Shigella flexneri 2a str. 301
aacauucgccgcugugauuuc

SEQ ID NO: 3882741 - RNA, 12 nt, Shigella flexneri 2a str. 301
aacauugcaaga

SEQ ID NO: 3882742 - RNA, 18 nt, Shigella flexneri 2a str. 301
aacauugcaagauuuuug

SEQ ID NO: 3882743 - RNA, 12 nt, Shigella flexneri 2a str. 301
aacauugcugcu

SEQ ID NO: 3882744 - RNA, 19 nt, Shigella flexneri 2a str. 301
aacauugcugcugaagcaa

SEQ ID NO: 3882745 - RNA, 18 nt, Shigella flexneri 2a str. 301
aacauuguuauucuccuu

SEQ ID NO: 3882746 - RNA, 11 nt, Shigella flexneri 2a str. 301
aacauuuucau

SEQ ID NO: 3882747 - RNA, 16 nt, Shigella flexneri 2a str. 301
aaccaaagcgguugaa

SEQ ID NO: 3882748 - RNA, 11 nt, Shigella flexneri 2a str. 301
aaccaaagcgu

SEQ ID NO: 3882749 - RNA, 19 nt, Shigella flexneri 2a str. 301
aaccaacaauugcccccca

SEQ ID NO: 3882750 - RNA, 21 nt, Shigella flexneri 2a str. 301
aaccaacaccuguuccagugg

SEQ ID NO: 3882751 - RNA, 17 nt, Shigella flexneri 2a str. 301
aaccaacgccagcagca

SEQ ID NO: 3882752 - RNA, 19 nt, Shigella flexneri 2a str. 301
aaccaacgcugccagccgc

SEQ ID NO: 3882753 - RNA, 13 nt, Shigella flexneri 2a str. 301
aaccaacggccuu

SEQ ID NO: 3882754 - RNA, 14 nt, Shigella flexneri 2a str. 301
aaccaaucugugcc

SEQ ID NO: 3882755 - RNA, 17 nt, Shigella flexneri 2a str. 301
aaccacaaaacacucuu

SEQ ID NO: 3882756 - RNA, 15 nt, Shigella flexneri 2a str. 301
aaccacaaccacuuu

SEQ ID NO: 3882757 - RNA, 18 nt, Shigella flexneri 2a str. 301
aaccggcacaauaucuuu

SEQ ID NO: 3882758 - RNA, 16 nt, Shigella flexneri 2a str. 301
aaccggcacuucaacu

SEQ ID NO: 3882759 - RNA, 12 nt, Shigella flexneri 2a str. 301
aaccggcucacc

SEQ ID NO: 3882760 - RNA, 17 nt, Shigella flexneri 2a str. 301
aaccgggcgaauuuacc

SEQ ID NO: 3882761 - RNA, 17 nt, Shigella flexneri 2a str. 301
aaccgggucgauaaaca

SEQ ID NO: 3882762 - RNA, 14 nt, Shigella flexneri 2a str. 301
aaccgguaccggac

SEQ ID NO: 3882763 - RNA, 23 nt, Shigella flexneri 2a str. 301
aaccguaaacagauaggcaucag

SEQ ID NO: 3882764 - RNA, 13 nt, Shigella flexneri 2a str. 301
aaccguaaacgau

SEQ ID NO: 3882765 - RNA, 23 nt, Shigella flexneri 2a str. 301
aaccguaguccauacccagcauc

SEQ ID NO: 3882766 - RNA, 22 nt, Shigella flexneri 2a str. 301
aaccguaguggccacagauaau

SEQ ID NO: 3882767 - RNA, 12 nt, Shigella flexneri 2a str. 301
aaccgucagcac

SEQ ID NO: 3882768 - RNA, 15 nt, Shigella flexneri 2a str. 301
aaccgucagcaccag

SEQ ID NO: 3882769 - RNA, 15 nt, Shigella flexneri 2a str. 301
aaccgucgagauaca

SEQ ID NO: 3882770 - RNA, 13 nt, Shigella flexneri 2a str. 301
aaccgucgccggg

SEQ ID NO: 3882771 - RNA, 20 nt, Shigella flexneri 2a str. 301
aaccgucugugugccugucg

SEQ ID NO: 3882772 - RNA, 14 nt, Shigella flexneri 2a str. 301
aaccgugggaaaca

SEQ ID NO: 3882773 - RNA, 16 nt, Shigella flexneri 2a str. 301
aaccguuuacgucauu

SEQ ID NO: 3882774 - RNA, 20 nt, Shigella flexneri 2a str. 301
aaccuaaagccuguaacgcc

SEQ ID NO: 3882775 - RNA, 13 nt, Shigella flexneri 2a str. 301
aaccuaaaguaaa

SEQ ID NO: 3882776 - RNA, 18 nt, Shigella flexneri 2a str. 301
aaccuaagaaccagaauu

SEQ ID NO: 3882777 - RNA, 14 nt, Shigella flexneri 2a str. 301
aaccuacuuuuuaa

SEQ ID NO: 3882778 - RNA, 20 nt, Shigella flexneri 2a str. 301
aaccuauuguuuuaaugaca

SEQ ID NO: 3882779 - RNA, 21 nt, Shigella flexneri 2a str. 301
aaccucacagaggucuuuucu

SEQ ID NO: 3882780 - RNA, 22 nt, Shigella flexneri 2a str. 301
aaccucacagaggucuuuucuc

SEQ ID NO: 3882781 - RNA, 18 nt, Shigella flexneri 2a str. 301
aaccuccucggcaaaaca

SEQ ID NO: 3882782 - RNA, 21 nt, Shigella flexneri 2a str. 301
aaccucgcccauuuuucauga

SEQ ID NO: 3882783 - RNA, 23 nt, Shigella flexneri 2a str. 301
aaccucucugcuagcuggcucga

SEQ ID NO: 3882784 - RNA, 24 nt, Shigella flexneri 2a str. 301
aaccugaccuuuuuucagcggugc

SEQ ID NO: 3882785 - RNA, 17 nt, Shigella flexneri 2a str. 301
aaccugacucgguucaa

SEQ ID NO: 3882786 - RNA, 17 nt, Shigella flexneri 2a str. 301
aaccugauuacgcaccg

SEQ ID NO: 3882787 - RNA, 19 nt, Shigella flexneri 2a str. 301
aaccugauuacgcaccggg

SEQ ID NO: 3882788 - RNA, 13 nt, Shigella flexneri 2a str. 301
aaccugcaaaaua

SEQ ID NO: 3882789 - RNA, 19 nt, Shigella flexneri 2a str. 301
aaccugcacgaaaccacug

SEQ ID NO: 3882790 - RNA, 21 nt, Shigella flexneri 2a str. 301
aaccugccgcgucgggcauca

SEQ ID NO: 3882791 - RNA, 12 nt, Shigella flexneri 2a str. 301
aaccugccuuac

SEQ ID NO: 3882792 - RNA, 18 nt, Shigella flexneri 2a str. 301
aaccugcuccucaguuuc

SEQ ID NO: 3882793 - RNA, 18 nt, Shigella flexneri 2a str. 301
aaccuggauauugcggaa

SEQ ID NO: 3882794 - RNA, 17 nt, Shigella flexneri 2a str. 301
aaccuguggugcaggcg

SEQ ID NO: 3882795 - RNA, 19 nt, Shigella flexneri 2a str. 301
aaccuguugaaauuauugc

SEQ ID NO: 3882796 - RNA, 13 nt, Shigella flexneri 2a str. 301
aaccuguuuucac

SEQ ID NO: 3882797 - RNA, 20 nt, Shigella flexneri 2a str. 301
aaccuucacccucacgcauu

SEQ ID NO: 3882798 - RNA, 19 nt, Shigella flexneri 2a str. 301
aaccuucaucguuucugcu

SEQ ID NO: 3882799 - RNA, 20 nt, Shigella flexneri 2a str. 301
aaccuucccgucuacaaaaa

SEQ ID NO: 3882800 - RNA, 18 nt, Shigella flexneri 2a str. 301
aaccuucuucauuaugaa

SEQ ID NO: 3882801 - RNA, 16 nt, Shigella flexneri 2a str. 301
aaccuucuugacgcug

SEQ ID NO: 3882802 - RNA, 15 nt, Shigella flexneri 2a str. 301
aaccuugccauucca

SEQ ID NO: 3882803 - RNA, 19 nt, Shigella flexneri 2a str. 301
aaccuugccauuccacaaa

SEQ ID NO: 3882804 - RNA, 21 nt, Shigella flexneri 2a str. 301
aaccuuguuucugagcaugaa

SEQ ID NO: 3882805 - RNA, 10 nt, Shigella flexneri 2a str. 301
aaccuuuaau

SEQ ID NO: 3882806 - RNA, 13 nt, Shigella flexneri 2a str. 301
aaccuuuaaucag

SEQ ID NO: 3882807 - RNA, 16 nt, Shigella flexneri 2a str. 301
aaccuuuaaucaggcu

SEQ ID NO: 3882808 - RNA, 16 nt, Shigella flexneri 2a str. 301
aaccuuuaugcagcuc

SEQ ID NO: 3882809 - RNA, 16 nt, Shigella flexneri 2a str. 301
aaccuuuccuuguaac

SEQ ID NO: 3882810 - RNA, 21 nt, Shigella flexneri 2a str. 301
aaccuuuucucaaucaaaaga

SEQ ID NO: 3882811 - RNA, 21 nt, Shigella flexneri 2a str. 301
aacgaaagucccgauaaccgc

SEQ ID NO: 3882812 - RNA, 20 nt, Shigella flexneri 2a str. 301
aacgaaaguuaauccacagc

SEQ ID NO: 3882813 - RNA, 12 nt, Shigella flexneri 2a str. 301
aacgaagaaaac

SEQ ID NO: 3882814 - RNA, 18 nt, Shigella flexneri 2a str. 301
aacgaaucugcaaaucug

SEQ ID NO: 3882815 - RNA, 21 nt, Shigella flexneri 2a str. 301
aacgacaccguuaaauaacug

SEQ ID NO: 3882816 - RNA, 22 nt, Shigella flexneri 2a str. 301
aacgacaccguuaaauaacugg

SEQ ID NO: 3882817 - RNA, 22 nt, Shigella flexneri 2a str. 301
aacgacacugcucgcagaaaua

SEQ ID NO: 3882818 - RNA, 19 nt, Shigella flexneri 2a str. 301
aacgacauauacaaacggc

SEQ ID NO: 3882819 - RNA, 17 nt, Shigella flexneri 2a str. 301
aacgacauuuucugccc

SEQ ID NO: 3882820 - RNA, 22 nt, Shigella flexneri 2a str. 301
aacgaccagaucggucagugcc

SEQ ID NO: 3882821 - RNA, 18 nt, Shigella flexneri 2a str. 301
aacgaccaguucacacca

SEQ ID NO: 3882822 - RNA, 13 nt, Shigella flexneri 2a str. 301
aacgaccaucagc

SEQ ID NO: 3882823 - RNA, 17 nt, Shigella flexneri 2a str. 301
aacgaccuugcaauaau

SEQ ID NO: 3882824 - RNA, 19 nt, Shigella flexneri 2a str. 301
aacgacgcauacucuuuga

SEQ ID NO: 3882825 - RNA, 14 nt, Shigella flexneri 2a str. 301
aacgacggcguggu

SEQ ID NO: 3882826 - RNA, 15 nt, Shigella flexneri 2a str. 301
aacgacgguaaacca

SEQ ID NO: 3882827 - RNA, 15 nt, Shigella flexneri 2a str. 301
aacgagcgcaaugaa

SEQ ID NO: 3882828 - RNA, 23 nt, Shigella flexneri 2a str. 301
aacgauaacguuccggggccucu

SEQ ID NO: 3882829 - RNA, 18 nt, Shigella flexneri 2a str. 301
aacgaucgcccagaccac

SEQ ID NO: 3882830 - RNA, 20 nt, Shigella flexneri 2a str. 301
aacgaugucgcccacuuuca

SEQ ID NO: 3882831 - RNA, 21 nt, Shigella flexneri 2a str. 301
aacgauuuuagcaaacugauc

SEQ ID NO: 3882832 - RNA, 12 nt, Shigella flexneri 2a str. 301
aacgcaaaauuc

SEQ ID NO: 3882833 - RNA, 20 nt, Shigella flexneri 2a str. 301
aacgcaaacaccagcgaaug

SEQ ID NO: 3882834 - RNA, 17 nt, Shigella flexneri 2a str. 301
aacgcaaacuguuucag

SEQ ID NO: 3882835 - RNA, 14 nt, Shigella flexneri 2a str. 301
aacgcaaagagaga

SEQ ID NO: 3882836 - RNA, 20 nt, Shigella flexneri 2a str. 301
aacgcaaagagagaagccag

SEQ ID NO: 3882837 - RNA, 21 nt, Shigella flexneri 2a str. 301
aacgcaaagagagaagccaga

SEQ ID NO: 3882838 - RNA, 23 nt, Shigella flexneri 2a str. 301
aacgcaaagagagaagccagaua

SEQ ID NO: 3882839 - RNA, 16 nt, Shigella flexneri 2a str. 301
aacgcaaauacugacu

SEQ ID NO: 3882840 - RNA, 20 nt, Shigella flexneri 2a str. 301
aacgcaaauguaaaaccaac

SEQ ID NO: 3882841 - RNA, 15 nt, Shigella flexneri 2a str. 301
aacgcaacaucgcaa

SEQ ID NO: 3882842 - RNA, 21 nt, Shigella flexneri 2a str. 301
aacgcaaucaaauaccaccag

SEQ ID NO: 3882843 - RNA, 16 nt, Shigella flexneri 2a str. 301
aacgcacacauccaca

SEQ ID NO: 3882844 - RNA, 13 nt, Shigella flexneri 2a str. 301
aacgcaccaauag

SEQ ID NO: 3882845 - RNA, 14 nt, Shigella flexneri 2a str. 301
aacgcacgcuguca

SEQ ID NO: 3882846 - RNA, 15 nt, Shigella flexneri 2a str. 301
aacgcagucuuccca

SEQ ID NO: 3882847 - RNA, 17 nt, Shigella flexneri 2a str. 301
aacgcagucuucccagc

SEQ ID NO: 3882848 - RNA, 17 nt, Shigella flexneri 2a str. 301
aacgcaguuccgccagc

SEQ ID NO: 3882849 - RNA, 18 nt, Shigella flexneri 2a str. 301
aacgcauaccccaucagc

SEQ ID NO: 3882850 - RNA, 20 nt, Shigella flexneri 2a str. 301
aacgcauaccccaucagcgu

SEQ ID NO: 3882851 - RNA, 13 nt, Shigella flexneri 2a str. 301
aacgccaaauucu

SEQ ID NO: 3882852 - RNA, 22 nt, Shigella flexneri 2a str. 301
aacgccaauucauuccuugaaa

SEQ ID NO: 3882853 - RNA, 15 nt, Shigella flexneri 2a str. 301
aacgccacgcucacu

SEQ ID NO: 3882854 - RNA, 20 nt, Shigella flexneri 2a str. 301
aacgccagauccgggcuaau

SEQ ID NO: 3882855 - RNA, 23 nt, Shigella flexneri 2a str. 301
aacgccagcagaguuuuuuaugc

SEQ ID NO: 3882856 - RNA, 13 nt, Shigella flexneri 2a str. 301
aacgccagcagca

SEQ ID NO: 3882857 - RNA, 16 nt, Shigella flexneri 2a str. 301
aacguccaucacuucg

SEQ ID NO: 3882858 - RNA, 15 nt, Shigella flexneri 2a str. 301
aacgucccccagauc

SEQ ID NO: 3882859 - RNA, 13 nt, Shigella flexneri 2a str. 301
aacgucgccagcg

SEQ ID NO: 3882860 - RNA, 22 nt, Shigella flexneri 2a str. 301
aacgucggaaaccgcuuugcca

SEQ ID NO: 3882861 - RNA, 18 nt, Shigella flexneri 2a str. 301
aacgucgguuucaucaca

SEQ ID NO: 3882862 - RNA, 18 nt, Shigella flexneri 2a str. 301
aacgucucuauuucaccc

SEQ ID NO: 3882863 - RNA, 12 nt, Shigella flexneri 2a str. 301
aacgucuucccg

SEQ ID NO: 3882864 - RNA, 19 nt, Shigella flexneri 2a str. 301
aacgugcaaaaucaaacag

SEQ ID NO: 3882865 - RNA, 12 nt, Shigella flexneri 2a str. 301
aacgugcagcuu

SEQ ID NO: 3882866 - RNA, 20 nt, Shigella flexneri 2a str. 301
aacgugcggggguuuucucu

SEQ ID NO: 3882867 - RNA, 22 nt, Shigella flexneri 2a str. 301
aacgugcuacgguugacugaaa

SEQ ID NO: 3882868 - RNA, 16 nt, Shigella flexneri 2a str. 301
aacgugcuucgcgcug

SEQ ID NO: 3882869 - RNA, 21 nt, Shigella flexneri 2a str. 301
aacguggccuccaaaaaacaa

SEQ ID NO: 3882870 - RNA, 15 nt, Shigella flexneri 2a str. 301
aacgugggccuggcg

SEQ ID NO: 3882871 - RNA, 20 nt, Shigella flexneri 2a str. 301
aacguguuuauauuugaaca

SEQ ID NO: 3882872 - RNA, 21 nt, Shigella flexneri 2a str. 301
aacguguuuauauuugaacau

SEQ ID NO: 3882873 - RNA, 12 nt, Shigella flexneri 2a str. 301
aacguuccagca

SEQ ID NO: 3882874 - RNA, 13 nt, Shigella flexneri 2a str. 301
aacguuccagcaa

SEQ ID NO: 3882875 - RNA, 18 nt, Shigella flexneri 2a str. 301
aacguugaauuucagguu

SEQ ID NO: 3882876 - RNA, 16 nt, Shigella flexneri 2a str. 301
aacguugggaucagua

SEQ ID NO: 3882877 - RNA, 22 nt, Shigella flexneri 2a str. 301
aacguugggaucaguaaacgcu

SEQ ID NO: 3882878 - RNA, 15 nt, Shigella flexneri 2a str. 301
aacguuuaaaaacuu

SEQ ID NO: 3882879 - RNA, 19 nt, Shigella flexneri 2a str. 301
aacguuuacagggauggcu

SEQ ID NO: 3882880 - RNA, 17 nt, Shigella flexneri 2a str. 301
aacguuugauuaacgcc

SEQ ID NO: 3882881 - RNA, 22 nt, Shigella flexneri 2a str. 301
aacuaaaaacagcaucaauaau

SEQ ID NO: 3882882 - RNA, 16 nt, Shigella flexneri 2a str. 301
aacuaacugacuuccg

SEQ ID NO: 3882883 - RNA, 18 nt, Shigella flexneri 2a str. 301
aacuaagcgcacuuuguc

SEQ ID NO: 3882884 - RNA, 22 nt, Shigella flexneri 2a str. 301
aacuacauagcguguugauuau

SEQ ID NO: 3882885 - RNA, 23 nt, Shigella flexneri 2a str. 301
aacuacauagcguguugauuaua

SEQ ID NO: 3882886 - RNA, 20 nt, Shigella flexneri 2a str. 301
aacuaccagcaguuugguaa

SEQ ID NO: 3882887 - RNA, 23 nt, Shigella flexneri 2a str. 301
aacuacggcuccgcaagcgaaug

SEQ ID NO: 3882888 - RNA, 15 nt, Shigella flexneri 2a str. 301
aacuaucccagccua

SEQ ID NO: 3882889 - RNA, 21 nt, Shigella flexneri 2a str. 301
aacuaucccagccuauaacga

SEQ ID NO: 3882890 - RNA, 21 nt, Shigella flexneri 2a str. 301
aacuauugacgaaaagcugaa

SEQ ID NO: 3882891 - RNA, 19 nt, Shigella flexneri 2a str. 301
aacucaaaaauaaucaucu

SEQ ID NO: 3882892 - RNA, 20 nt, Shigella flexneri 2a str. 301
aacucaaaaauaaucaucuc

SEQ ID NO: 3882893 - RNA, 19 nt, Shigella flexneri 2a str. 301
aacucacgauuguuaauca

SEQ ID NO: 3882894 - RNA, 18 nt, Shigella flexneri 2a str. 301
aacucagcauuauuuuua

SEQ ID NO: 3882895 - RNA, 20 nt, Shigella flexneri 2a str. 301
aacucagcauuauuuuuaaa

SEQ ID NO: 3882896 - RNA, 18 nt, Shigella flexneri 2a str. 301
aacucauacaccagcggc

SEQ ID NO: 3882897 - RNA, 19 nt, Shigella flexneri 2a str. 301
aacucauacaccagcggca

SEQ ID NO: 3882898 - RNA, 14 nt, Shigella flexneri 2a str. 301
aacucauacugagc

SEQ ID NO: 3882899 - RNA, 20 nt, Shigella flexneri 2a str. 301
aacucauugccaguccuaaa

SEQ ID NO: 3882900 - RNA, 18 nt, Shigella flexneri 2a str. 301
aacucauuuacagaaacu

SEQ ID NO: 3882901 - RNA, 20 nt, Shigella flexneri 2a str. 301
aacucauuuuuuaauaugcu

SEQ ID NO: 3882902 - RNA, 13 nt, Shigella flexneri 2a str. 301
aacuccagaauac

SEQ ID NO: 3882903 - RNA, 18 nt, Shigella flexneri 2a str. 301
aacuccagaauaccgcca

SEQ ID NO: 3882904 - RNA, 16 nt, Shigella flexneri 2a str. 301
aacuccagcggcgcgu

SEQ ID NO: 3882905 - RNA, 16 nt, Shigella flexneri 2a str. 301
aacuccccgagaaaua

SEQ ID NO: 3882906 - RNA, 17 nt, Shigella flexneri 2a str. 301
aacuccccgagaaauac

SEQ ID NO: 3882907 - RNA, 22 nt, Shigella flexneri 2a str. 301
aacuccgccagcaacugauaaa

SEQ ID NO: 3882908 - RNA, 24 nt, Shigella flexneri 2a str. 301
aacuccgcguggugagugugcugu

SEQ ID NO: 3882909 - RNA, 15 nt, Shigella flexneri 2a str. 301
aacuccggcgaaaau

SEQ ID NO: 3882910 - RNA, 14 nt, Shigella flexneri 2a str. 301
aacuccguugaaau

SEQ ID NO: 3882911 - RNA, 21 nt, Shigella flexneri 2a str. 301
aacuccugaaagcgaaccaua

SEQ ID NO: 3882912 - RNA, 16 nt, Shigella flexneri 2a str. 301
aacucgccagccacca

SEQ ID NO: 3882913 - RNA, 22 nt, Shigella flexneri 2a str. 301
aacucgcguaaauccagcggca

SEQ ID NO: 3882914 - RNA, 18 nt, Shigella flexneri 2a str. 301
aacucgcugaauaaacuc

SEQ ID NO: 3882915 - RNA, 12 nt, Shigella flexneri 2a str. 301
aacucgcugcca

SEQ ID NO: 3882916 - RNA, 16 nt, Shigella flexneri 2a str. 301
aacucgcuuaagccau

SEQ ID NO: 3882917 - RNA, 22 nt, Shigella flexneri 2a str. 301
aacucgcuuaagccaucaucaa

SEQ ID NO: 3882918 - RNA, 19 nt, Shigella flexneri 2a str. 301
aacucucaaaacaacacaa

SEQ ID NO: 3882919 - RNA, 20 nt, Shigella flexneri 2a str. 301
aacucucaaaacaacacaaa

SEQ ID NO: 3882920 - RNA, 22 nt, Shigella flexneri 2a str. 301
aacucucaucuuugaaaucacg

SEQ ID NO: 3882921 - RNA, 19 nt, Shigella flexneri 2a str. 301
aacucucuuuugcuugaca

SEQ ID NO: 3882922 - RNA, 20 nt, Shigella flexneri 2a str. 301
aacucuuccugauacaugaa

SEQ ID NO: 3882923 - RNA, 17 nt, Shigella flexneri 2a str. 301
aacucuuccuuaacauc

SEQ ID NO: 3882924 - RNA, 14 nt, Shigella flexneri 2a str. 301
aacugaacaaaaaa

SEQ ID NO: 3882925 - RNA, 15 nt, Shigella flexneri 2a str. 301
aacugaacaaaaaag

SEQ ID NO: 3882926 - RNA, 23 nt, Shigella flexneri 2a str. 301
aacugaagauugaacagcagaac

SEQ ID NO: 3882927 - RNA, 15 nt, Shigella flexneri 2a str. 301
aacugaauaauacac

SEQ ID NO: 3882928 - RNA, 15 nt, Shigella flexneri 2a str. 301
aacugacgaaucaaa

SEQ ID NO: 3882929 - RNA, 17 nt, Shigella flexneri 2a str. 301
aacugacggcaugacca

SEQ ID NO: 3882930 - RNA, 17 nt, Shigella flexneri 2a str. 301
aacugacugaaugccac

SEQ ID NO: 3882931 - RNA, 14 nt, Shigella flexneri 2a str. 301
aacugacuggcucu

SEQ ID NO: 3882932 - RNA, 15 nt, Shigella flexneri 2a str. 301
aacugacuggcucuu

SEQ ID NO: 3882933 - RNA, 22 nt, Shigella flexneri 2a str. 301
aacugacuuucguuugaaaacu

SEQ ID NO: 3882934 - RNA, 19 nt, Shigella flexneri 2a str. 301
aacugaggcaauaaugacg

SEQ ID NO: 3882935 - RNA, 15 nt, Shigella flexneri 2a str. 301
aacugauccugacaa

SEQ ID NO: 3882936 - RNA, 14 nt, Shigella flexneri 2a str. 301
aacugauugccacc

SEQ ID NO: 3882937 - RNA, 16 nt, Shigella flexneri 2a str. 301
aacugauuuucaucuu

SEQ ID NO: 3882938 - RNA, 20 nt, Shigella flexneri 2a str. 301
aacugauuuucaucuucuuc

SEQ ID NO: 3882939 - RNA, 14 nt, Shigella flexneri 2a str. 301
aacugcacaccgcg

SEQ ID NO: 3882940 - RNA, 13 nt, Shigella flexneri 2a str. 301
aacugccagggcu

SEQ ID NO: 3882941 - RNA, 18 nt, Shigella flexneri 2a str. 301
aacugccaguucccccug

SEQ ID NO: 3882942 - RNA, 22 nt, Shigella flexneri 2a str. 301
aacugccaugaccgcuccgcca

SEQ ID NO: 3882943 - RNA, 14 nt, Shigella flexneri 2a str. 301
aacugcccgaucaa

SEQ ID NO: 3882944 - RNA, 21 nt, Shigella flexneri 2a str. 301
aacugccggaacugccugcuc

SEQ ID NO: 3882945 - RNA, 15 nt, Shigella flexneri 2a str. 301
aacugccggaaggcg

SEQ ID NO: 3882946 - RNA, 22 nt, Shigella flexneri 2a str. 301
aacugccggaaggcgauuaaac

SEQ ID NO: 3882947 - RNA, 15 nt, Shigella flexneri 2a str. 301
aacugccguugcugc

SEQ ID NO: 3882948 - RNA, 20 nt, Shigella flexneri 2a str. 301
aacugccucgggauccaugc

SEQ ID NO: 3882949 - RNA, 11 nt, Shigella flexneri 2a str. 301
aacugccugau

SEQ ID NO: 3882950 - RNA, 16 nt, Shigella flexneri 2a str. 301
aacugcgccagaccca

SEQ ID NO: 3882951 - RNA, 21 nt, Shigella flexneri 2a str. 301
aacugcggucuaaaucuuccg

SEQ ID NO: 3882952 - RNA, 15 nt, Shigella flexneri 2a str. 301
aacugcguucugucg

SEQ ID NO: 3882953 - RNA, 16 nt, Shigella flexneri 2a str. 301
aacugcucaaaggcga

SEQ ID NO: 3882954 - RNA, 15 nt, Shigella flexneri 2a str. 301
aacugcuccgggaau

SEQ ID NO: 3882955 - RNA, 14 nt, Shigella flexneri 2a str. 301
aacugcugacgcag

SEQ ID NO: 3882956 - RNA, 14 nt, Shigella flexneri 2a str. 301
aacuggaaaaauaa

SEQ ID NO: 3882957 - RNA, 22 nt, Shigella flexneri 2a str. 301
aagacacuaacgcgucuuaucu

SEQ ID NO: 3882958 - RNA, 20 nt, Shigella flexneri 2a str. 301
aagacacugacgcgucuuau

SEQ ID NO: 3882959 - RNA, 17 nt, Shigella flexneri 2a str. 301
aagacagcgucacauca

SEQ ID NO: 3882960 - RNA, 18 nt, Shigella flexneri 2a str. 301
aagacaucaauaaacaau

SEQ ID NO: 3882961 - RNA, 16 nt, Shigella flexneri 2a str. 301
aagaccauugaugcuc

SEQ ID NO: 3882962 - RNA, 19 nt, Shigella flexneri 2a str. 301
aagaccguuucggugauga

SEQ ID NO: 3882963 - RNA, 20 nt, Shigella flexneri 2a str. 301
aagaccugacuguuccagca

SEQ ID NO: 3882964 - RNA, 14 nt, Shigella flexneri 2a str. 301
aagacgaaaaauga

SEQ ID NO: 3882965 - RNA, 14 nt, Shigella flexneri 2a str. 301
aagacgccguccau

SEQ ID NO: 3882966 - RNA, 21 nt, Shigella flexneri 2a str. 301
aagacgcgacaagcgucgcau

SEQ ID NO: 3882967 - RNA, 21 nt, Shigella flexneri 2a str. 301
aagacgcgaccagcgucgcau

SEQ ID NO: 3882968 - RNA, 19 nt, Shigella flexneri 2a str. 301
aagacgcgcagcgucgcau

SEQ ID NO: 3882969 - RNA, 14 nt, Shigella flexneri 2a str. 301
aagacgcgccagcg

SEQ ID NO: 3882970 - RNA, 20 nt, Shigella flexneri 2a str. 301
aagacgcggcagcgucgcau

SEQ ID NO: 3882971 - RNA, 16 nt, Shigella flexneri 2a str. 301
aagacgcguaaagcgu

SEQ ID NO: 3882972 - RNA, 21 nt, Shigella flexneri 2a str. 301
aagacgcgucaagcgucgcau

SEQ ID NO: 3882973 - RNA, 20 nt, Shigella flexneri 2a str. 301
aagacgcgucagcgucgcau

SEQ ID NO: 3882974 - RNA, 20 nt, Shigella flexneri 2a str. 301
aagacgcguuagcaucgcau

SEQ ID NO: 3882975 - RNA, 18 nt, Shigella flexneri 2a str. 301
aagacguuaaaaaaggug

SEQ ID NO: 3882976 - RNA, 23 nt, Shigella flexneri 2a str. 301
aagacguucacgucgcauccggc

SEQ ID NO: 3882977 - RNA, 17 nt, Shigella flexneri 2a str. 301
aagacguugauucacuu

SEQ ID NO: 3882978 - RNA, 23 nt, Shigella flexneri 2a str. 301
aagacguugauucacuuucugaa

SEQ ID NO: 3882979 - RNA, 17 nt, Shigella flexneri 2a str. 301
aagacguuuugugagaa

SEQ ID NO: 3882980 - RNA, 22 nt, Shigella flexneri 2a str. 301
aagacucuuacucuuucaauuu

SEQ ID NO: 3882981 - RNA, 20 nt, Shigella flexneri 2a str. 301
aagagaaagaacgaguaaaa

SEQ ID NO: 3882982 - RNA, 15 nt, Shigella flexneri 2a str. 301
aagagaacucuuuuu

SEQ ID NO: 3882983 - RNA, 17 nt, Shigella flexneri 2a str. 301
aagagacaaaaaaggug

SEQ ID NO: 3882984 - RNA, 13 nt, Shigella flexneri 2a str. 301
aagagagaagcca

SEQ ID NO: 3882985 - RNA, 15 nt, Shigella flexneri 2a str. 301
aagagagaagccaga

SEQ ID NO: 3882986 - RNA, 18 nt, Shigella flexneri 2a str. 301
aagagaggcgugccaggu

SEQ ID NO: 3882987 - RNA, 14 nt, Shigella flexneri 2a str. 301
aagagaucgaacag

SEQ ID NO: 3882988 - RNA, 20 nt, Shigella flexneri 2a str. 301
aagagaucgaacagcagcag

SEQ ID NO: 3882989 - RNA, 19 nt, Shigella flexneri 2a str. 301
aagagauggaaugagcauc

SEQ ID NO: 3882990 - RNA, 16 nt, Shigella flexneri 2a str. 301
aagagcagcugauuga

SEQ ID NO: 3882991 - RNA, 21 nt, Shigella flexneri 2a str. 301
aagagccgauaaacaccguuu

SEQ ID NO: 3882992 - RNA, 17 nt, Shigella flexneri 2a str. 301
aagagcgacaaucccug

SEQ ID NO: 3882993 - RNA, 15 nt, Shigella flexneri 2a str. 301
aagagcgccucccuu

SEQ ID NO: 3882994 - RNA, 15 nt, Shigella flexneri 2a str. 301
aagagcgucuggaag

SEQ ID NO: 3882995 - RNA, 18 nt, Shigella flexneri 2a str. 301
aagagcgucuggaagaag

SEQ ID NO: 3882996 - RNA, 13 nt, Shigella flexneri 2a str. 301
aagaggcgcagau

SEQ ID NO: 3882997 - RNA, 15 nt, Shigella flexneri 2a str. 301
aagaggcgcagauga

SEQ ID NO: 3882998 - RNA, 20 nt, Shigella flexneri 2a str. 301
aagaguaaagcccgccaucg

SEQ ID NO: 3882999 - RNA, 14 nt, Shigella flexneri 2a str. 301
aagaguaaauugca

SEQ ID NO: 3883000 - RNA, 21 nt, Shigella flexneri 2a str. 301
aagaguaaauugcaaaccuca

SEQ ID NO: 3883001 - RNA, 15 nt, Shigella flexneri 2a str. 301
aagaguaaccaaacg

SEQ ID NO: 3883002 - RNA, 23 nt, Shigella flexneri 2a str. 301
aagaguugccccucuaacucuuc

SEQ ID NO: 3883003 - RNA, 15 nt, Shigella flexneri 2a str. 301
aagauaauccaggac

SEQ ID NO: 3883004 - RNA, 18 nt, Shigella flexneri 2a str. 301
aagauacggauucuuaac

SEQ ID NO: 3883005 - RNA, 18 nt, Shigella flexneri 2a str. 301
aagauagcgucauuucua

SEQ ID NO: 3883006 - RNA, 19 nt, Shigella flexneri 2a str. 301
aagauagcgucauuucuac

SEQ ID NO: 3883007 - RNA, 19 nt, Shigella flexneri 2a str. 301
aagauauuucaccagcgca

SEQ ID NO: 3883008 - RNA, 16 nt, Shigella flexneri 2a str. 301
aagaucaucaaacuuu

SEQ ID NO: 3883009 - RNA, 22 nt, Shigella flexneri 2a str. 301
aagauccagguuacgcaccaga

SEQ ID NO: 3883010 - RNA, 17 nt, Shigella flexneri 2a str. 301
aagauccguaaugccug

SEQ ID NO: 3883011 - RNA, 18 nt, Shigella flexneri 2a str. 301
aagaucgacggcuuuuag

SEQ ID NO: 3883012 - RNA, 21 nt, Shigella flexneri 2a str. 301
aagaucgcccuuuuuuacuuu

SEQ ID NO: 3883013 - RNA, 19 nt, Shigella flexneri 2a str. 301
aagaucuuugcgcuuauac

SEQ ID NO: 3883014 - RNA, 19 nt, Shigella flexneri 2a str. 301
aagaugaaauaguugcauu

SEQ ID NO: 3883015 - RNA, 19 nt, Shigella flexneri 2a str. 301
aagaugcaucauuaaugug

SEQ ID NO: 3883016 - RNA, 15 nt, Shigella flexneri 2a str. 301
aagaugcauuuauau

SEQ ID NO: 3883017 - RNA, 14 nt, Shigella flexneri 2a str. 301
aagaugccugaugc

SEQ ID NO: 3883018 - RNA, 14 nt, Shigella flexneri 2a str. 301
aagaugcuacaaca

SEQ ID NO: 3883019 - RNA, 23 nt, Shigella flexneri 2a str. 301
aagauggauugcugaaauacaga

SEQ ID NO: 3883020 - RNA, 17 nt, Shigella flexneri 2a str. 301
aagaugguuauccagcu

SEQ ID NO: 3883021 - RNA, 22 nt, Shigella flexneri 2a str. 301
aagaugugagcgauacccauuu

SEQ ID NO: 3883022 - RNA, 19 nt, Shigella flexneri 2a str. 301
aagauguucuaucuuucag

SEQ ID NO: 3883023 - RNA, 14 nt, Shigella flexneri 2a str. 301
aagauguugccaca

SEQ ID NO: 3883024 - RNA, 19 nt, Shigella flexneri 2a str. 301
aagauguuguacagcgaaa

SEQ ID NO: 3883025 - RNA, 14 nt, Shigella flexneri 2a str. 301
aagauguuucuggu

SEQ ID NO: 3883026 - RNA, 18 nt, Shigella flexneri 2a str. 301
aagauguuucuggucugc

SEQ ID NO: 3883027 - RNA, 22 nt, Shigella flexneri 2a str. 301
aagauuagcgacgaacagcgau

SEQ ID NO: 3883028 - RNA, 15 nt, Shigella flexneri 2a str. 301
aagauuccagugccg

SEQ ID NO: 3883029 - RNA, 14 nt, Shigella flexneri 2a str. 301
aagauugccugaug

SEQ ID NO: 3883030 - RNA, 20 nt, Shigella flexneri 2a str. 301
aagauuuaaacaccugggca

SEQ ID NO: 3883031 - RNA, 14 nt, Shigella flexneri 2a str. 301
aagcaaauguuaau

SEQ ID NO: 3883032 - RNA, 15 nt, Shigella flexneri 2a str. 301
aagcaacaaaguuug

SEQ ID NO: 3883033 - RNA, 21 nt, Shigella flexneri 2a str. 301
aagcaaccgccauccgcgaau

SEQ ID NO: 3883034 - RNA, 14 nt, Shigella flexneri 2a str. 301
aagcaagaacagcc

SEQ ID NO: 3883035 - RNA, 13 nt, Shigella flexneri 2a str. 301
aagcaauccauac

SEQ ID NO: 3883036 - RNA, 21 nt, Shigella flexneri 2a str. 301
aagcaauccauaccagcacau

SEQ ID NO: 3883037 - RNA, 15 nt, Shigella flexneri 2a str. 301
aagcacaugcugaca

SEQ ID NO: 3883038 - RNA, 13 nt, Shigella flexneri 2a str. 301
aagcaccacuccu

SEQ ID NO: 3883039 - RNA, 15 nt, Shigella flexneri 2a str. 301
aagcaccacuccuca

SEQ ID NO: 3883040 - RNA, 21 nt, Shigella flexneri 2a str. 301
aagcaccauccuguuccacug

SEQ ID NO: 3883041 - RNA, 18 nt, Shigella flexneri 2a str. 301
aagcacgguuaacaccag

SEQ ID NO: 3883042 - RNA, 20 nt, Shigella flexneri 2a str. 301
aagcacucugacggauagua

SEQ ID NO: 3883043 - RNA, 16 nt, Shigella flexneri 2a str. 301
aagcacugcaucaaug

SEQ ID NO: 3883044 - RNA, 20 nt, Shigella flexneri 2a str. 301
aagcacugcaucaaugccgg

SEQ ID NO: 3883045 - RNA, 24 nt, Shigella flexneri 2a str. 301
aagcacuggcggcagcaggugcgc

SEQ ID NO: 3883046 - RNA, 17 nt, Shigella flexneri 2a str. 301
aagcacuuuuuguaauu

SEQ ID NO: 3883047 - RNA, 18 nt, Shigella flexneri 2a str. 301
aagcagaaaaagaagccg

SEQ ID NO: 3883048 - RNA, 13 nt, Shigella flexneri 2a str. 301
aagcagacaaccc

SEQ ID NO: 3883049 - RNA, 15 nt, Shigella flexneri 2a str. 301
aagcagauaacccag

SEQ ID NO: 3883050 - RNA, 16 nt, Shigella flexneri 2a str. 301
aagcagauaacccagc

SEQ ID NO: 3883051 - RNA, 18 nt, Shigella flexneri 2a str. 301
aagcagaucggcauucac

SEQ ID NO: 3883052 - RNA, 12 nt, Shigella flexneri 2a str. 301
aagcagaucugg

SEQ ID NO: 3883053 - RNA, 17 nt, Shigella flexneri 2a str. 301
aagcagcauacccaccg

SEQ ID NO: 3883054 - RNA, 19 nt, Shigella flexneri 2a str. 301
aagcagcauguagaugccg

SEQ ID NO: 3883055 - RNA, 13 nt, Shigella flexneri 2a str. 301
aagcagccaucug

SEQ ID NO: 3883056 - RNA, 19 nt, Shigella flexneri 2a str. 301
aagcagccuauuucgucgc

SEQ ID NO: 3883057 - RNA, 14 nt, Shigella flexneri 2a str. 301
aagcugcaggacca

SEQ ID NO: 3883058 - RNA, 20 nt, Shigella flexneri 2a str. 301
aagcugcguagcucaucuuc

SEQ ID NO: 3883059 - RNA, 13 nt, Shigella flexneri 2a str. 301
aagcuggaagggu

SEQ ID NO: 3883060 - RNA, 14 nt, Shigella flexneri 2a str. 301
aagcuguagaggcg

SEQ ID NO: 3883061 - RNA, 17 nt, Shigella flexneri 2a str. 301
aagcugucaccaaucag

SEQ ID NO: 3883062 - RNA, 16 nt, Shigella flexneri 2a str. 301
aagcugugccugaaua

SEQ ID NO: 3883063 - RNA, 21 nt, Shigella flexneri 2a str. 301
aaggaaauccugccgcaguuu

SEQ ID NO: 3883064 - RNA, 22 nt, Shigella flexneri 2a str. 301
aaggaaucgcaaagccgauacc

SEQ ID NO: 3883065 - RNA, 20 nt, Shigella flexneri 2a str. 301
aaggaauggucgggcugcuc

SEQ ID NO: 3883066 - RNA, 19 nt, Shigella flexneri 2a str. 301
aaggaauuuuacagcccug

SEQ ID NO: 3883067 - RNA, 20 nt, Shigella flexneri 2a str. 301
aaggacagugggauuaaaaa

SEQ ID NO: 3883068 - RNA, 15 nt, Shigella flexneri 2a str. 301
aaggacauuauucag

SEQ ID NO: 3883069 - RNA, 18 nt, Shigella flexneri 2a str. 301
aaggaccaaagaaugaca

SEQ ID NO: 3883070 - RNA, 13 nt, Shigella flexneri 2a str. 301
aaggagagccaua

SEQ ID NO: 3883071 - RNA, 20 nt, Shigella flexneri 2a str. 301
aaggaggcgugcuuuuauua

SEQ ID NO: 3883072 - RNA, 13 nt, Shigella flexneri 2a str. 301
aaggauaaaaaag

SEQ ID NO: 3883073 - RNA, 16 nt, Shigella flexneri 2a str. 301
aaggauggucgcuuug

SEQ ID NO: 3883074 - RNA, 13 nt, Shigella flexneri 2a str. 301
aaggauuacucag

SEQ ID NO: 3883075 - RNA, 15 nt, Shigella flexneri 2a str. 301
aaggauucgaaccuu

SEQ ID NO: 3883076 - RNA, 18 nt, Shigella flexneri 2a str. 301
aaggauugaucaauucua

SEQ ID NO: 3883077 - RNA, 12 nt, Shigella flexneri 2a str. 301
aaggcaaacugu

SEQ ID NO: 3883078 - RNA, 17 nt, Shigella flexneri 2a str. 301
aaggcacaagggugagg

SEQ ID NO: 3883079 - RNA, 19 nt, Shigella flexneri 2a str. 301
aaggcaccaauauugacug

SEQ ID NO: 3883080 - RNA, 23 nt, Shigella flexneri 2a str. 301
aaggcaccuggaaauuuugcuga

SEQ ID NO: 3883081 - RNA, 19 nt, Shigella flexneri 2a str. 301
aaggcagaaacaaacgcaa

SEQ ID NO: 3883082 - RNA, 12 nt, Shigella flexneri 2a str. 301
aaggcagccuuu

SEQ ID NO: 3883083 - RNA, 20 nt, Shigella flexneri 2a str. 301
aaggcagccuuucucagaga

SEQ ID NO: 3883084 - RNA, 12 nt, Shigella flexneri 2a str. 301
aaggcaguucag

SEQ ID NO: 3883085 - RNA, 11 nt, Shigella flexneri 2a str. 301
aaggccagcaa

SEQ ID NO: 3883086 - RNA, 18 nt, Shigella flexneri 2a str. 301
aaggccagcaauccccag

SEQ ID NO: 3883087 - RNA, 15 nt, Shigella flexneri 2a str. 301
aaggcccuuccccuu

SEQ ID NO: 3883088 - RNA, 22 nt, Shigella flexneri 2a str. 301
aaggccgcgaaccggaccagca

SEQ ID NO: 3883089 - RNA, 14 nt, Shigella flexneri 2a str. 301
aaggcgaaacgccu

SEQ ID NO: 3883090 - RNA, 18 nt, Shigella flexneri 2a str. 301
aaggcgcgagguuuuccu

SEQ ID NO: 3883091 - RNA, 22 nt, Shigella flexneri 2a str. 301
aaggcgcucauuuucucuuuca

SEQ ID NO: 3883092 - RNA, 21 nt, Shigella flexneri 2a str. 301
aaggcgcugaaggcacagaaa

SEQ ID NO: 3883093 - RNA, 15 nt, Shigella flexneri 2a str. 301
aaggcggcagaacag

SEQ ID NO: 3883094 - RNA, 18 nt, Shigella flexneri 2a str. 301
aaggcguacacgccgcau

SEQ ID NO: 3883095 - RNA, 11 nt, Shigella flexneri 2a str. 301
aaggcgugauc

SEQ ID NO: 3883096 - RNA, 22 nt, Shigella flexneri 2a str. 301
aaggcgugaucuccuuggagaa

SEQ ID NO: 3883097 - RNA, 15 nt, Shigella flexneri 2a str. 301
aaggcguucacgcca

SEQ ID NO: 3883098 - RNA, 18 nt, Shigella flexneri 2a str. 301
aaggcguucacgccgcau

SEQ ID NO: 3883099 - RNA, 20 nt, Shigella flexneri 2a str. 301
aaggcguucgcgccgcaucc

SEQ ID NO: 3883100 - RNA, 18 nt, Shigella flexneri 2a str. 301
aaggcguuuucgccgcau

SEQ ID NO: 3883101 - RNA, 19 nt, Shigella flexneri 2a str. 301
aaggcugagggauccccag

SEQ ID NO: 3883102 - RNA, 13 nt, Shigella flexneri 2a str. 301
aaggcuguuccca

SEQ ID NO: 3883103 - RNA, 12 nt, Shigella flexneri 2a str. 301
aaggcuucaacg

SEQ ID NO: 3883104 - RNA, 22 nt, Shigella flexneri 2a str. 301
aaggcuucguaaguggcguuua

SEQ ID NO: 3883105 - RNA, 15 nt, Shigella flexneri 2a str. 301
aagggacaaaccaca

SEQ ID NO: 3883106 - RNA, 23 nt, Shigella flexneri 2a str. 301
aagggagagggauucucuuuguu

SEQ ID NO: 3883107 - RNA, 23 nt, Shigella flexneri 2a str. 301
aagggccgcaguggauaauacac

SEQ ID NO: 3883108 - RNA, 15 nt, Shigella flexneri 2a str. 301
aagggccuuaaguau

SEQ ID NO: 3883109 - RNA, 17 nt, Shigella flexneri 2a str. 301
aaggggacguaaagaag

SEQ ID NO: 3883110 - RNA, 15 nt, Shigella flexneri 2a str. 301
aaggggugaaaaaaa

SEQ ID NO: 3883111 - RNA, 14 nt, Shigella flexneri 2a str. 301
aagggguuguaauc

SEQ ID NO: 3883112 - RNA, 14 nt, Shigella flexneri 2a str. 301
aaggguaagggagg

SEQ ID NO: 3883113 - RNA, 22 nt, Shigella flexneri 2a str. 301
aaggguaagggaggauuucucc

SEQ ID NO: 3883114 - RNA, 13 nt, Shigella flexneri 2a str. 301
aaggguaugcugu

SEQ ID NO: 3883115 - RNA, 19 nt, Shigella flexneri 2a str. 301
aaggguaugcuguaaacaa

SEQ ID NO: 3883116 - RNA, 14 nt, Shigella flexneri 2a str. 301
aaggguauugccga

SEQ ID NO: 3883117 - RNA, 14 nt, Shigella flexneri 2a str. 301
aagggugagggagg

SEQ ID NO: 3883118 - RNA, 22 nt, Shigella flexneri 2a str. 301
aagggugagggaggauuucucc

SEQ ID NO: 3883119 - RNA, 22 nt, Shigella flexneri 2a str. 301
aagggugucuguuaaucgcauu

SEQ ID NO: 3883120 - RNA, 16 nt, Shigella flexneri 2a str. 301
aaggguuuuuuuaugc

SEQ ID NO: 3883121 - RNA, 18 nt, Shigella flexneri 2a str. 301
aagguaaggauaaaaaag

SEQ ID NO: 3883122 - RNA, 13 nt, Shigella flexneri 2a str. 301
aagguacgaaaaa

SEQ ID NO: 3883123 - RNA, 17 nt, Shigella flexneri 2a str. 301
aagguaucgcgaaaaaa

SEQ ID NO: 3883124 - RNA, 22 nt, Shigella flexneri 2a str. 301
aagguaucgcgaaaaaaaagau

SEQ ID NO: 3883125 - RNA, 16 nt, Shigella flexneri 2a str. 301
aaggucaccaguucac

SEQ ID NO: 3883126 - RNA, 23 nt, Shigella flexneri 2a str. 301
aaggucacucccggauaaaucuc

SEQ ID NO: 3883127 - RNA, 18 nt, Shigella flexneri 2a str. 301
aaggucaucaaucauuuu

SEQ ID NO: 3883128 - RNA, 16 nt, Shigella flexneri 2a str. 301
aaggucgacagcagcc

SEQ ID NO: 3883129 - RNA, 18 nt, Shigella flexneri 2a str. 301
aaggucggcuuugaauau

SEQ ID NO: 3883130 - RNA, 23 nt, Shigella flexneri 2a str. 301
aaggucggcuuugaauaucuccu

SEQ ID NO: 3883131 - RNA, 21 nt, Shigella flexneri 2a str. 301
aagguggcgucaaaaagcuca

SEQ ID NO: 3883132 - RNA, 14 nt, Shigella flexneri 2a str. 301
aaggugggaggcgg

SEQ ID NO: 3883133 - RNA, 22 nt, Shigella flexneri 2a str. 301
aagguggucagacggaacaucu

SEQ ID NO: 3883134 - RNA, 18 nt, Shigella flexneri 2a str. 301
aagguuaauaaauauuaa

SEQ ID NO: 3883135 - RNA, 19 nt, Shigella flexneri 2a str. 301
aagguucacuuaaucucug

SEQ ID NO: 3883136 - RNA, 17 nt, Shigella flexneri 2a str. 301
aagguucuuugcugccg

SEQ ID NO: 3883137 - RNA, 19 nt, Shigella flexneri 2a str. 301
aagguugccauaucuuccc

SEQ ID NO: 3883138 - RNA, 14 nt, Shigella flexneri 2a str. 301
aagguugccugucu

SEQ ID NO: 3883139 - RNA, 23 nt, Shigella flexneri 2a str. 301
aagguugucgauaccaauauccu

SEQ ID NO: 3883140 - RNA, 14 nt, Shigella flexneri 2a str. 301
aagguuguugaaag

SEQ ID NO: 3883141 - RNA, 22 nt, Shigella flexneri 2a str. 301
aagguuuaauacgcuuaaucug

SEQ ID NO: 3883142 - RNA, 12 nt, Shigella flexneri 2a str. 301
aagguuucugca

SEQ ID NO: 3883143 - RNA, 16 nt, Shigella flexneri 2a str. 301
aaguaagcaacauaag

SEQ ID NO: 3883144 - RNA, 19 nt, Shigella flexneri 2a str. 301
aaguaaggcgggaauaauu

SEQ ID NO: 3883145 - RNA, 23 nt, Shigella flexneri 2a str. 301
aaguaaugcggcaagggcgaauc

SEQ ID NO: 3883146 - RNA, 20 nt, Shigella flexneri 2a str. 301
aaguacacauaaacagguaa

SEQ ID NO: 3883147 - RNA, 13 nt, Shigella flexneri 2a str. 301
aaguacauuaaaa

SEQ ID NO: 3883148 - RNA, 19 nt, Shigella flexneri 2a str. 301
aaguaccaucguccagcag

SEQ ID NO: 3883149 - RNA, 21 nt, Shigella flexneri 2a str. 301
aaguacgcggcaauccccgcc

SEQ ID NO: 3883150 - RNA, 21 nt, Shigella flexneri 2a str. 301
aaguacucuuugaacagccag

SEQ ID NO: 3883151 - RNA, 16 nt, Shigella flexneri 2a str. 301
aaguacugauugacgc

SEQ ID NO: 3883152 - RNA, 19 nt, Shigella flexneri 2a str. 301
aaguacuucacaaucagcg

SEQ ID NO: 3883153 - RNA, 20 nt, Shigella flexneri 2a str. 301
aaguagagcgaaacgaaagu

SEQ ID NO: 3883154 - RNA, 21 nt, Shigella flexneri 2a str. 301
aaguagagugguuuuucaaca

SEQ ID NO: 3883155 - RNA, 14 nt, Shigella flexneri 2a str. 301
aaguagcagguaau

SEQ ID NO: 3883156 - RNA, 13 nt, Shigella flexneri 2a str. 301
aaguagccaguac

SEQ ID NO: 3883157 - RNA, 24 nt, Shigella flexneri 2a str. 301
aauaacugguguaagucggucaca

SEQ ID NO: 3883158 - RNA, 18 nt, Shigella flexneri 2a str. 301
aauaacuuccugagugaa

SEQ ID NO: 3883159 - RNA, 18 nt, Shigella flexneri 2a str. 301
aauaagcacgguuaacac

SEQ ID NO: 3883160 - RNA, 20 nt, Shigella flexneri 2a str. 301
aauaagggugucuguuaauc

SEQ ID NO: 3883161 - RNA, 13 nt, Shigella flexneri 2a str. 301
aauaagguuaauu

SEQ ID NO: 3883162 - RNA, 17 nt, Shigella flexneri 2a str. 301
aauaaguacgauacaga

SEQ ID NO: 3883163 - RNA, 13 nt, Shigella flexneri 2a str. 301
aauaauacacaca

SEQ ID NO: 3883164 - RNA, 15 nt, Shigella flexneri 2a str. 301
aauaauauccuuucc

SEQ ID NO: 3883165 - RNA, 12 nt, Shigella flexneri 2a str. 301
aauaauaucuuu

SEQ ID NO: 3883166 - RNA, 20 nt, Shigella flexneri 2a str. 301
aauaaucaaaugaaugccaa

SEQ ID NO: 3883167 - RNA, 14 nt, Shigella flexneri 2a str. 301
aauaaucaacgcga

SEQ ID NO: 3883168 - RNA, 17 nt, Shigella flexneri 2a str. 301
aauaaucaacgcggcaa

SEQ ID NO: 3883169 - RNA, 22 nt, Shigella flexneri 2a str. 301
aauaaucacauaauccagacac

SEQ ID NO: 3883170 - RNA, 14 nt, Shigella flexneri 2a str. 301
aauaaucaccacac

SEQ ID NO: 3883171 - RNA, 22 nt, Shigella flexneri 2a str. 301
aauaaucaccacacaaccgagg

SEQ ID NO: 3883172 - RNA, 11 nt, Shigella flexneri 2a str. 301
aauaaucagau

SEQ ID NO: 3883173 - RNA, 14 nt, Shigella flexneri 2a str. 301
aauaauccgcugca

SEQ ID NO: 3883174 - RNA, 22 nt, Shigella flexneri 2a str. 301
aauaaucgcgcuaauuccaguc

SEQ ID NO: 3883175 - RNA, 22 nt, Shigella flexneri 2a str. 301
aauaaucgggaauacagaaaau

SEQ ID NO: 3883176 - RNA, 14 nt, Shigella flexneri 2a str. 301
aauaaucguaauca

SEQ ID NO: 3883177 - RNA, 18 nt, Shigella flexneri 2a str. 301
aauaaucguaaucagcau

SEQ ID NO: 3883178 - RNA, 15 nt, Shigella flexneri 2a str. 301
aauaaucucuacacc

SEQ ID NO: 3883179 - RNA, 16 nt, Shigella flexneri 2a str. 301
aauaaucucuacacca

SEQ ID NO: 3883180 - RNA, 24 nt, Shigella flexneri 2a str. 301
aauaaucucuuuacccagcggaug

SEQ ID NO: 3883181 - RNA, 23 nt, Shigella flexneri 2a str. 301
aauaaugaucaguggaagacguu

SEQ ID NO: 3883182 - RNA, 13 nt, Shigella flexneri 2a str. 301
aauaaugcaaaaa

SEQ ID NO: 3883183 - RNA, 12 nt, Shigella flexneri 2a str. 301
aauaaugcagau

SEQ ID NO: 3883184 - RNA, 13 nt, Shigella flexneri 2a str. 301
aauaaugcagauc

SEQ ID NO: 3883185 - RNA, 20 nt, Shigella flexneri 2a str. 301
aauaaugcgacaacagaaau

SEQ ID NO: 3883186 - RNA, 19 nt, Shigella flexneri 2a str. 301
aauaauggccuuuucgcca

SEQ ID NO: 3883187 - RNA, 21 nt, Shigella flexneri 2a str. 301
aauaauggccuuuucgccacc

SEQ ID NO: 3883188 - RNA, 16 nt, Shigella flexneri 2a str. 301
aauaauucaaaaaccu

SEQ ID NO: 3883189 - RNA, 20 nt, Shigella flexneri 2a str. 301
aauaauuuacagccugccag

SEQ ID NO: 3883190 - RNA, 21 nt, Shigella flexneri 2a str. 301
aauaauuuacagccugccagc

SEQ ID NO: 3883191 - RNA, 14 nt, Shigella flexneri 2a str. 301
aauaauuucauuua

SEQ ID NO: 3883192 - RNA, 20 nt, Shigella flexneri 2a str. 301
aauaauuucauuuacuggau

SEQ ID NO: 3883193 - RNA, 15 nt, Shigella flexneri 2a str. 301
aauaauuuuaaauau

SEQ ID NO: 3883194 - RNA, 17 nt, Shigella flexneri 2a str. 301
aauacaacaacacccau

SEQ ID NO: 3883195 - RNA, 14 nt, Shigella flexneri 2a str. 301
aauacaaccugcug

SEQ ID NO: 3883196 - RNA, 12 nt, Shigella flexneri 2a str. 301
aauacacccuga

SEQ ID NO: 3883197 - RNA, 17 nt, Shigella flexneri 2a str. 301
aauacacuaacagaaca

SEQ ID NO: 3883198 - RNA, 19 nt, Shigella flexneri 2a str. 301
aauacacuaacagaacaau

SEQ ID NO: 3883199 - RNA, 21 nt, Shigella flexneri 2a str. 301
aauacacuaacagaacaauaa

SEQ ID NO: 3883200 - RNA, 15 nt, Shigella flexneri 2a str. 301
aauacagcaauggaa

SEQ ID NO: 3883201 - RNA, 16 nt, Shigella flexneri 2a str. 301
aauacagcaauggaaa

SEQ ID NO: 3883202 - RNA, 18 nt, Shigella flexneri 2a str. 301
aauacagcaauggaaaaa

SEQ ID NO: 3883203 - RNA, 19 nt, Shigella flexneri 2a str. 301
aauacagcaauggaaaaag

SEQ ID NO: 3883204 - RNA, 23 nt, Shigella flexneri 2a str. 301
aauacagccagccagcaccaggc

SEQ ID NO: 3883205 - RNA, 21 nt, Shigella flexneri 2a str. 301
aauacagcccagacaaaugaa

SEQ ID NO: 3883206 - RNA, 19 nt, Shigella flexneri 2a str. 301
aauacagcuuaaucaccag

SEQ ID NO: 3883207 - RNA, 21 nt, Shigella flexneri 2a str. 301
aauacaggcgacgaguugcuu

SEQ ID NO: 3883208 - RNA, 18 nt, Shigella flexneri 2a str. 301
aauacaggcuacucccag

SEQ ID NO: 3883209 - RNA, 19 nt, Shigella flexneri 2a str. 301
aauacagguccccgcuucg

SEQ ID NO: 3883210 - RNA, 21 nt, Shigella flexneri 2a str. 301
aauacagguuucaaugcacaa

SEQ ID NO: 3883211 - RNA, 22 nt, Shigella flexneri 2a str. 301
aauacagucacuuugcccuuca

SEQ ID NO: 3883212 - RNA, 11 nt, Shigella flexneri 2a str. 301
aauacauauau

SEQ ID NO: 3883213 - RNA, 23 nt, Shigella flexneri 2a str. 301
aauacaucaauuuucccuucuga

SEQ ID NO: 3883214 - RNA, 12 nt, Shigella flexneri 2a str. 301
aauaccaauaau

SEQ ID NO: 3883215 - RNA, 19 nt, Shigella flexneri 2a str. 301
aauaccaauaaucaauuua

SEQ ID NO: 3883216 - RNA, 22 nt, Shigella flexneri 2a str. 301
aauaccagaucucaccacgaug

SEQ ID NO: 3883217 - RNA, 12 nt, Shigella flexneri 2a str. 301
aauaccagccuu

SEQ ID NO: 3883218 - RNA, 17 nt, Shigella flexneri 2a str. 301
aauaccagccuucuuca

SEQ ID NO: 3883219 - RNA, 21 nt, Shigella flexneri 2a str. 301
aauaccagccuucuucaucca

SEQ ID NO: 3883220 - RNA, 14 nt, Shigella flexneri 2a str. 301
aauaccaucaccaa

SEQ ID NO: 3883221 - RNA, 18 nt, Shigella flexneri 2a str. 301
aauaccaucggcagcgcc

SEQ ID NO: 3883222 - RNA, 19 nt, Shigella flexneri 2a str. 301
aauaccaucggcagcgcca

SEQ ID NO: 3883223 - RNA, 19 nt, Shigella flexneri 2a str. 301
aauaccauggcucaccagc

SEQ ID NO: 3883224 - RNA, 21 nt, Shigella flexneri 2a str. 301
aauacccuugcagauauugca

SEQ ID NO: 3883225 - RNA, 15 nt, Shigella flexneri 2a str. 301
aauaccgaagaguaa

SEQ ID NO: 3883226 - RNA, 23 nt, Shigella flexneri 2a str. 301
aauaccgaagaguaaccaaacgu

SEQ ID NO: 3883227 - RNA, 15 nt, Shigella flexneri 2a str. 301
aauaccgacaucacg

SEQ ID NO: 3883228 - RNA, 14 nt, Shigella flexneri 2a str. 301
aauaccgcccacca

SEQ ID NO: 3883229 - RNA, 19 nt, Shigella flexneri 2a str. 301
aauaccgcccaccaccagc

SEQ ID NO: 3883230 - RNA, 14 nt, Shigella flexneri 2a str. 301
aauaccgcccagac

SEQ ID NO: 3883231 - RNA, 19 nt, Shigella flexneri 2a str. 301
aauaccgccugcaaauaaa

SEQ ID NO: 3883232 - RNA, 15 nt, Shigella flexneri 2a str. 301
aauaccggaugccaa

SEQ ID NO: 3883233 - RNA, 20 nt, Shigella flexneri 2a str. 301
aauaccguucucuuuaaaaa

SEQ ID NO: 3883234 - RNA, 21 nt, Shigella flexneri 2a str. 301
aauaccugccugucacgcagg

SEQ ID NO: 3883235 - RNA, 15 nt, Shigella flexneri 2a str. 301
aauaccuuacacuca

SEQ ID NO: 3883236 - RNA, 19 nt, Shigella flexneri 2a str. 301
aauaccuucuuccugcgcc

SEQ ID NO: 3883237 - RNA, 19 nt, Shigella flexneri 2a str. 301
aauacgauccugagcagcc

SEQ ID NO: 3883238 - RNA, 17 nt, Shigella flexneri 2a str. 301
aauacgauuaacgccag

SEQ ID NO: 3883239 - RNA, 15 nt, Shigella flexneri 2a str. 301
aauacgcaucgacau

SEQ ID NO: 3883240 - RNA, 17 nt, Shigella flexneri 2a str. 301
aauacgcccaucauuca

SEQ ID NO: 3883241 - RNA, 17 nt, Shigella flexneri 2a str. 301
aauacgccggucacgcc

SEQ ID NO: 3883242 - RNA, 20 nt, Shigella flexneri 2a str. 301
aauacgcucacgcgcugccu

SEQ ID NO: 3883243 - RNA, 18 nt, Shigella flexneri 2a str. 301
aauacgcucgaacagcug

SEQ ID NO: 3883244 - RNA, 20 nt, Shigella flexneri 2a str. 301
aauacgcucgaacagcuggu

SEQ ID NO: 3883245 - RNA, 23 nt, Shigella flexneri 2a str. 301
aauacgcuggcugaacauuaaau

SEQ ID NO: 3883246 - RNA, 21 nt, Shigella flexneri 2a str. 301
aauacggauauucaucuccag

SEQ ID NO: 3883247 - RNA, 21 nt, Shigella flexneri 2a str. 301
aauacggcaaguaauaauauc

SEQ ID NO: 3883248 - RNA, 15 nt, Shigella flexneri 2a str. 301
aauacguaggccuga

SEQ ID NO: 3883249 - RNA, 15 nt, Shigella flexneri 2a str. 301
aauacgucuuuagga

SEQ ID NO: 3883250 - RNA, 19 nt, Shigella flexneri 2a str. 301
aauacguugcuucaugccg

SEQ ID NO: 3883251 - RNA, 19 nt, Shigella flexneri 2a str. 301
aauacuccccuuucuuauu

SEQ ID NO: 3883252 - RNA, 22 nt, Shigella flexneri 2a str. 301
aauacugaagucgaacuucucu

SEQ ID NO: 3883253 - RNA, 17 nt, Shigella flexneri 2a str. 301
aauacugacaucagcau

SEQ ID NO: 3883254 - RNA, 15 nt, Shigella flexneri 2a str. 301
aauacuuccgcuucc

SEQ ID NO: 3883255 - RNA, 17 nt, Shigella flexneri 2a str. 301
aauacuuucacaaaaau

SEQ ID NO: 3883256 - RNA, 13 nt, Shigella flexneri 2a str. 301
aauauuuuuaugc

SEQ ID NO: 3883257 - RNA, 17 nt, Shigella flexneri 2a str. 301
aauauuuuucgucaguu

SEQ ID NO: 3883258 - RNA, 12 nt, Shigella flexneri 2a str. 301
aaucaaaaaacu

SEQ ID NO: 3883259 - RNA, 20 nt, Shigella flexneri 2a str. 301
aaucaaaaaacuggaaaaau

SEQ ID NO: 3883260 - RNA, 22 nt, Shigella flexneri 2a str. 301
aaucaaaaaacuggaaaaauaa

SEQ ID NO: 3883261 - RNA, 19 nt, Shigella flexneri 2a str. 301
aaucaaaaaaggcugacaa

SEQ ID NO: 3883262 - RNA, 23 nt, Shigella flexneri 2a str. 301
aaucaaaaaaggcugacaaauca

SEQ ID NO: 3883263 - RNA, 17 nt, Shigella flexneri 2a str. 301
aaucaaaccaagcagca

SEQ ID NO: 3883264 - RNA, 22 nt, Shigella flexneri 2a str. 301
aaucaaagaugaugucacagcc

SEQ ID NO: 3883265 - RNA, 14 nt, Shigella flexneri 2a str. 301
aaucaaagucagau

SEQ ID NO: 3883266 - RNA, 16 nt, Shigella flexneri 2a str. 301
aaucaaauacaccuau

SEQ ID NO: 3883267 - RNA, 19 nt, Shigella flexneri 2a str. 301
aaucaaauagccugccaga

SEQ ID NO: 3883268 - RNA, 12 nt, Shigella flexneri 2a str. 301
aaucaaaugacu

SEQ ID NO: 3883269 - RNA, 14 nt, Shigella flexneri 2a str. 301
aaucaacaaaccaa

SEQ ID NO: 3883270 - RNA, 15 nt, Shigella flexneri 2a str. 301
aaucaacaaacgcug

SEQ ID NO: 3883271 - RNA, 23 nt, Shigella flexneri 2a str. 301
aaucaacaauugcgggccaaaga

SEQ ID NO: 3883272 - RNA, 19 nt, Shigella flexneri 2a str. 301
aaucaacaccaaacccgga

SEQ ID NO: 3883273 - RNA, 16 nt, Shigella flexneri 2a str. 301
aaucaacauauucccc

SEQ ID NO: 3883274 - RNA, 16 nt, Shigella flexneri 2a str. 301
aaucaacaugaaaaua

SEQ ID NO: 3883275 - RNA, 22 nt, Shigella flexneri 2a str. 301
aaucaacaugaaaauaaccaua

SEQ ID NO: 3883276 - RNA, 16 nt, Shigella flexneri 2a str. 301
aaucaacgaugucaau

SEQ ID NO: 3883277 - RNA, 21 nt, Shigella flexneri 2a str. 301
aaucaacuuauugguaaacuc

SEQ ID NO: 3883278 - RNA, 22 nt, Shigella flexneri 2a str. 301
aaucaacuuauugguaaacuca

SEQ ID NO: 3883279 - RNA, 15 nt, Shigella flexneri 2a str. 301
aaucaagucuauuug

SEQ ID NO: 3883280 - RNA, 20 nt, Shigella flexneri 2a str. 301
aaucaauaaguuacacauca

SEQ ID NO: 3883281 - RNA, 16 nt, Shigella flexneri 2a str. 301
aaucaauaugcauaaa

SEQ ID NO: 3883282 - RNA, 15 nt, Shigella flexneri 2a str. 301
aaucaaucgccccuu

SEQ ID NO: 3883283 - RNA, 17 nt, Shigella flexneri 2a str. 301
aaucaaugcccaucacu

SEQ ID NO: 3883284 - RNA, 12 nt, Shigella flexneri 2a str. 301
aaucaauuuuuc

SEQ ID NO: 3883285 - RNA, 18 nt, Shigella flexneri 2a str. 301
aaucacaagaccgcuucc

SEQ ID NO: 3883286 - RNA, 16 nt, Shigella flexneri 2a str. 301
aaucacaauggucaac

SEQ ID NO: 3883287 - RNA, 16 nt, Shigella flexneri 2a str. 301
aaucacacaaccaugc

SEQ ID NO: 3883288 - RNA, 14 nt, Shigella flexneri 2a str. 301
aaucacaucaccau

SEQ ID NO: 3883289 - RNA, 16 nt, Shigella flexneri 2a str. 301
aaucacaucaccauaa

SEQ ID NO: 3883290 - RNA, 17 nt, Shigella flexneri 2a str. 301
aaucacaucaccauaaa

SEQ ID NO: 3883291 - RNA, 14 nt, Shigella flexneri 2a str. 301
aaucacauccggau

SEQ ID NO: 3883292 - RNA, 22 nt, Shigella flexneri 2a str. 301
aaucaccacaggccugauaaga

SEQ ID NO: 3883293 - RNA, 19 nt, Shigella flexneri 2a str. 301
aaucaccacccauuuuaau

SEQ ID NO: 3883294 - RNA, 15 nt, Shigella flexneri 2a str. 301
aaucaccacugccag

SEQ ID NO: 3883295 - RNA, 19 nt, Shigella flexneri 2a str. 301
aaucaccaggucaccagac

SEQ ID NO: 3883296 - RNA, 22 nt, Shigella flexneri 2a str. 301
aaucaccauauucagcagcaga

SEQ ID NO: 3883297 - RNA, 17 nt, Shigella flexneri 2a str. 301
aaucaccaucagcagca

SEQ ID NO: 3883298 - RNA, 23 nt, Shigella flexneri 2a str. 301
aaucaccaugccgugaugcgcaa

SEQ ID NO: 3883299 - RNA, 15 nt, Shigella flexneri 2a str. 301
aaucacccagcgaag

SEQ ID NO: 3883300 - RNA, 20 nt, Shigella flexneri 2a str. 301
aaucacccccaccccggccc

SEQ ID NO: 3883301 - RNA, 20 nt, Shigella flexneri 2a str. 301
aaucacccgugagaacugcu

SEQ ID NO: 3883302 - RNA, 14 nt, Shigella flexneri 2a str. 301
aaucaccgccacca

SEQ ID NO: 3883303 - RNA, 19 nt, Shigella flexneri 2a str. 301
aaucaccgccaccagcguc

SEQ ID NO: 3883304 - RNA, 21 nt, Shigella flexneri 2a str. 301
aaucaccgccacgcccuccug

SEQ ID NO: 3883305 - RNA, 15 nt, Shigella flexneri 2a str. 301
aaucaccgccagcaa

SEQ ID NO: 3883306 - RNA, 17 nt, Shigella flexneri 2a str. 301
aaucaccucaucaccac

SEQ ID NO: 3883307 - RNA, 16 nt, Shigella flexneri 2a str. 301
aaucaccucuuuuucc

SEQ ID NO: 3883308 - RNA, 15 nt, Shigella flexneri 2a str. 301
aaucacgauugcugc

SEQ ID NO: 3883309 - RNA, 16 nt, Shigella flexneri 2a str. 301
aaucacgccgcccaua

SEQ ID NO: 3883310 - RNA, 23 nt, Shigella flexneri 2a str. 301
aaucacgcuucacccuugaugca

SEQ ID NO: 3883311 - RNA, 22 nt, Shigella flexneri 2a str. 301
aaucacuauuaaagaaaguaau

SEQ ID NO: 3883312 - RNA, 13 nt, Shigella flexneri 2a str. 301
aaucacucaucau

SEQ ID NO: 3883313 - RNA, 23 nt, Shigella flexneri 2a str. 301
aaucacucuuccccgcuucagcc

SEQ ID NO: 3883314 - RNA, 13 nt, Shigella flexneri 2a str. 301
aaucacugccaga

SEQ ID NO: 3883315 - RNA, 15 nt, Shigella flexneri 2a str. 301
aaucacugccagaau

SEQ ID NO: 3883316 - RNA, 17 nt, Shigella flexneri 2a str. 301
aaucacugucauuagcc

SEQ ID NO: 3883317 - RNA, 20 nt, Shigella flexneri 2a str. 301
aaucacuucuucuuguucau

SEQ ID NO: 3883318 - RNA, 19 nt, Shigella flexneri 2a str. 301
aaucacuugcgcauaauaa

SEQ ID NO: 3883319 - RNA, 13 nt, Shigella flexneri 2a str. 301
aaucagaaaggcg

SEQ ID NO: 3883320 - RNA, 18 nt, Shigella flexneri 2a str. 301
aaucagaacggaauguca

SEQ ID NO: 3883321 - RNA, 21 nt, Shigella flexneri 2a str. 301
aaucagaagacgauaauuagg

SEQ ID NO: 3883322 - RNA, 15 nt, Shigella flexneri 2a str. 301
aaucagaauuuuucg

SEQ ID NO: 3883323 - RNA, 22 nt, Shigella flexneri 2a str. 301
aaucagagccauccaguuuaau

SEQ ID NO: 3883324 - RNA, 12 nt, Shigella flexneri 2a str. 301
aaucagauaaaa

SEQ ID NO: 3883325 - RNA, 14 nt, Shigella flexneri 2a str. 301
aaucagauaaaaua

SEQ ID NO: 3883326 - RNA, 16 nt, Shigella flexneri 2a str. 301
aaucagauaaaauaca

SEQ ID NO: 3883327 - RNA, 23 nt, Shigella flexneri 2a str. 301
aaucagauaaaauacacuuuaau

SEQ ID NO: 3883328 - RNA, 22 nt, Shigella flexneri 2a str. 301
aaucagaucguugaccugaaua

SEQ ID NO: 3883329 - RNA, 17 nt, Shigella flexneri 2a str. 301
aaucagauugccacagg

SEQ ID NO: 3883330 - RNA, 22 nt, Shigella flexneri 2a str. 301
aaucagcaaggaaagccacugu

SEQ ID NO: 3883331 - RNA, 11 nt, Shigella flexneri 2a str. 301
aaucagcacac

SEQ ID NO: 3883332 - RNA, 14 nt, Shigella flexneri 2a str. 301
aaucagcaucaacc

SEQ ID NO: 3883333 - RNA, 20 nt, Shigella flexneri 2a str. 301
aaucagcaucucauccauca

SEQ ID NO: 3883334 - RNA, 20 nt, Shigella flexneri 2a str. 301
aaucagccagaacagcggug

SEQ ID NO: 3883335 - RNA, 15 nt, Shigella flexneri 2a str. 301
aaucagcgccagcgc

SEQ ID NO: 3883336 - RNA, 12 nt, Shigella flexneri 2a str. 301
aaucagcggcag

SEQ ID NO: 3883337 - RNA, 17 nt, Shigella flexneri 2a str. 301
aaucagcguaugcagcc

SEQ ID NO: 3883338 - RNA, 17 nt, Shigella flexneri 2a str. 301
aaucagcuuuuccauau

SEQ ID NO: 3883339 - RNA, 19 nt, Shigella flexneri 2a str. 301
aaucagcuuuuccauauca

SEQ ID NO: 3883340 - RNA, 21 nt, Shigella flexneri 2a str. 301
aaucaggaacuggaagcugcc

SEQ ID NO: 3883341 - RNA, 14 nt, Shigella flexneri 2a str. 301
aaucaggccgaggc

SEQ ID NO: 3883342 - RNA, 22 nt, Shigella flexneri 2a str. 301
aaucagguaagcgauaaaaaua

SEQ ID NO: 3883343 - RNA, 21 nt, Shigella flexneri 2a str. 301
aaucagguacuguaacgcuac

SEQ ID NO: 3883344 - RNA, 22 nt, Shigella flexneri 2a str. 301
aaucagugguguagggcaggcg

SEQ ID NO: 3883345 - RNA, 17 nt, Shigella flexneri 2a str. 301
aaucaguucaccacuuu

SEQ ID NO: 3883346 - RNA, 15 nt, Shigella flexneri 2a str. 301
aaucauauucaccac

SEQ ID NO: 3883347 - RNA, 15 nt, Shigella flexneri 2a str. 301
aaucaucacgccaau

SEQ ID NO: 3883348 - RNA, 17 nt, Shigella flexneri 2a str. 301
aaucaucaucuuuauau

SEQ ID NO: 3883349 - RNA, 19 nt, Shigella flexneri 2a str. 301
aaucaucauuaauaucuuu

SEQ ID NO: 3883350 - RNA, 15 nt, Shigella flexneri 2a str. 301
aaucaucauugcugu

SEQ ID NO: 3883351 - RNA, 15 nt, Shigella flexneri 2a str. 301
aaucaucauuuuuuc

SEQ ID NO: 3883352 - RNA, 22 nt, Shigella flexneri 2a str. 301
aaucaucauuuuuucaccaaag

SEQ ID NO: 3883353 - RNA, 19 nt, Shigella flexneri 2a str. 301
aaucauccaccuuaaaaca

SEQ ID NO: 3883354 - RNA, 21 nt, Shigella flexneri 2a str. 301
aaucauccaccuuaaaacaau

SEQ ID NO: 3883355 - RNA, 22 nt, Shigella flexneri 2a str. 301
aaucauccauauuuucagcagu

SEQ ID NO: 3883356 - RNA, 13 nt, Shigella flexneri 2a str. 301
aaucgugaaaaau

SEQ ID NO: 3883357 - RNA, 23 nt, Shigella flexneri 2a str. 301
aaucguucugugccgucugcccc

SEQ ID NO: 3883358 - RNA, 18 nt, Shigella flexneri 2a str. 301
aaucuaaccuacuuuuua

SEQ ID NO: 3883359 - RNA, 20 nt, Shigella flexneri 2a str. 301
aaucuaccgucaugcugacc

SEQ ID NO: 3883360 - RNA, 14 nt, Shigella flexneri 2a str. 301
aaucuauucauuua

SEQ ID NO: 3883361 - RNA, 15 nt, Shigella flexneri 2a str. 301
aaucuauucauuuau

SEQ ID NO: 3883362 - RNA, 15 nt, Shigella flexneri 2a str. 301
aaucuauugcaacau

SEQ ID NO: 3883363 - RNA, 15 nt, Shigella flexneri 2a str. 301
aaucucaauguauuc

SEQ ID NO: 3883364 - RNA, 14 nt, Shigella flexneri 2a str. 301
aaucucacccgcuu

SEQ ID NO: 3883365 - RNA, 21 nt, Shigella flexneri 2a str. 301
aaucucacccgguacaucaau

SEQ ID NO: 3883366 - RNA, 12 nt, Shigella flexneri 2a str. 301
aaucucacuccg

SEQ ID NO: 3883367 - RNA, 20 nt, Shigella flexneri 2a str. 301
aaucucacuccggccagagc

SEQ ID NO: 3883368 - RNA, 16 nt, Shigella flexneri 2a str. 301
aaucucagcccgauga

SEQ ID NO: 3883369 - RNA, 20 nt, Shigella flexneri 2a str. 301
aaucucagcccgaugauaaa

SEQ ID NO: 3883370 - RNA, 23 nt, Shigella flexneri 2a str. 301
aaucucccguuccugguuuucca

SEQ ID NO: 3883371 - RNA, 19 nt, Shigella flexneri 2a str. 301
aaucuccugccaauacaaa

SEQ ID NO: 3883372 - RNA, 13 nt, Shigella flexneri 2a str. 301
aaucuccugcgca

SEQ ID NO: 3883373 - RNA, 19 nt, Shigella flexneri 2a str. 301
aaucucgccguggauggga

SEQ ID NO: 3883374 - RNA, 14 nt, Shigella flexneri 2a str. 301
aaucucuacaccaa

SEQ ID NO: 3883375 - RNA, 16 nt, Shigella flexneri 2a str. 301
aaucucuucacagaca

SEQ ID NO: 3883376 - RNA, 13 nt, Shigella flexneri 2a str. 301
aaucucuuccaga

SEQ ID NO: 3883377 - RNA, 21 nt, Shigella flexneri 2a str. 301
aaucucuuuuuccaccgcaaa

SEQ ID NO: 3883378 - RNA, 13 nt, Shigella flexneri 2a str. 301
aaucugaaaucau

SEQ ID NO: 3883379 - RNA, 16 nt, Shigella flexneri 2a str. 301
aaucugaauggcugca

SEQ ID NO: 3883380 - RNA, 22 nt, Shigella flexneri 2a str. 301
aaucugaauuguuuuucguugc

SEQ ID NO: 3883381 - RNA, 12 nt, Shigella flexneri 2a str. 301
aaucugaguauu

SEQ ID NO: 3883382 - RNA, 11 nt, Shigella flexneri 2a str. 301
aaucugcaaau

SEQ ID NO: 3883383 - RNA, 18 nt, Shigella flexneri 2a str. 301
aaucugccagaaggauug

SEQ ID NO: 3883384 - RNA, 20 nt, Shigella flexneri 2a str. 301
aaucugccagcguaaauccu

SEQ ID NO: 3883385 - RNA, 21 nt, Shigella flexneri 2a str. 301
aaucuguaacaaggugaauca

SEQ ID NO: 3883386 - RNA, 19 nt, Shigella flexneri 2a str. 301
aaucugucguaacugcgcc

SEQ ID NO: 3883387 - RNA, 13 nt, Shigella flexneri 2a str. 301
aaucuguugaaau

SEQ ID NO: 3883388 - RNA, 17 nt, Shigella flexneri 2a str. 301
aaucuguuucaucucuu

SEQ ID NO: 3883389 - RNA, 18 nt, Shigella flexneri 2a str. 301
aaucuucacuaaaaucau

SEQ ID NO: 3883390 - RNA, 11 nt, Shigella flexneri 2a str. 301
aaucuucuucg

SEQ ID NO: 3883391 - RNA, 21 nt, Shigella flexneri 2a str. 301
aaucuuuagcauaaaaacucg

SEQ ID NO: 3883392 - RNA, 19 nt, Shigella flexneri 2a str. 301
aaucuuugcagcuuugcug

SEQ ID NO: 3883393 - RNA, 14 nt, Shigella flexneri 2a str. 301
aaugaaaaaauaga

SEQ ID NO: 3883394 - RNA, 14 nt, Shigella flexneri 2a str. 301
aaugaaaaucacca

SEQ ID NO: 3883395 - RNA, 16 nt, Shigella flexneri 2a str. 301
aaugaaacaggggcug

SEQ ID NO: 3883396 - RNA, 22 nt, Shigella flexneri 2a str. 301
aaugaaagaagcuuuccacgca

SEQ ID NO: 3883397 - RNA, 23 nt, Shigella flexneri 2a str. 301
aaugaaagccccaccagcaaaua

SEQ ID NO: 3883398 - RNA, 13 nt, Shigella flexneri 2a str. 301
aaugaacaccaaa

SEQ ID NO: 3883399 - RNA, 18 nt, Shigella flexneri 2a str. 301
aaugaacgccaccccaca

SEQ ID NO: 3883400 - RNA, 13 nt, Shigella flexneri 2a str. 301
aaugaaugaugcg

SEQ ID NO: 3883401 - RNA, 15 nt, Shigella flexneri 2a str. 301
aaugacaaaauugcu

SEQ ID NO: 3883402 - RNA, 14 nt, Shigella flexneri 2a str. 301
aaugacccacccca

SEQ ID NO: 3883403 - RNA, 20 nt, Shigella flexneri 2a str. 301
aaugacccaccccagcagca

SEQ ID NO: 3883404 - RNA, 14 nt, Shigella flexneri 2a str. 301
aaugaccggccagc

SEQ ID NO: 3883405 - RNA, 17 nt, Shigella flexneri 2a str. 301
aaugacguuaauaaaau

SEQ ID NO: 3883406 - RNA, 17 nt, Shigella flexneri 2a str. 301
aaugacuaucauugcgu

SEQ ID NO: 3883407 - RNA, 20 nt, Shigella flexneri 2a str. 301
aaugacuccaacuuacugau

SEQ ID NO: 3883408 - RNA, 16 nt, Shigella flexneri 2a str. 301
aaugacugauugccga

SEQ ID NO: 3883409 - RNA, 17 nt, Shigella flexneri 2a str. 301
aaugagauauuucagag

SEQ ID NO: 3883410 - RNA, 18 nt, Shigella flexneri 2a str. 301
aaugaggcagcaaggaaa

SEQ ID NO: 3883411 - RNA, 23 nt, Shigella flexneri 2a str. 301
aaugaggcagcaaggaaaaccag

SEQ ID NO: 3883412 - RNA, 13 nt, Shigella flexneri 2a str. 301
aaugaguacugau

SEQ ID NO: 3883413 - RNA, 20 nt, Shigella flexneri 2a str. 301
aaugaguacugaugaauaaa

SEQ ID NO: 3883414 - RNA, 13 nt, Shigella flexneri 2a str. 301
aaugaguauuacu

SEQ ID NO: 3883415 - RNA, 17 nt, Shigella flexneri 2a str. 301
aaugagugccaaaaaaa

SEQ ID NO: 3883416 - RNA, 19 nt, Shigella flexneri 2a str. 301
aaugagugccaaaaaaaua

SEQ ID NO: 3883417 - RNA, 18 nt, Shigella flexneri 2a str. 301
aaugaguggugaaaaaaa

SEQ ID NO: 3883418 - RNA, 20 nt, Shigella flexneri 2a str. 301
aaugaucagcgguuuugcca

SEQ ID NO: 3883419 - RNA, 13 nt, Shigella flexneri 2a str. 301
aaugaucagugga

SEQ ID NO: 3883420 - RNA, 19 nt, Shigella flexneri 2a str. 301
aaugaugcccgguugcuuu

SEQ ID NO: 3883421 - RNA, 21 nt, Shigella flexneri 2a str. 301
aaugaugcggcgcuuucagca

SEQ ID NO: 3883422 - RNA, 12 nt, Shigella flexneri 2a str. 301
aaugauggcuga

SEQ ID NO: 3883423 - RNA, 17 nt, Shigella flexneri 2a str. 301
aaugaugucggcauaaa

SEQ ID NO: 3883424 - RNA, 21 nt, Shigella flexneri 2a str. 301
aaugaugucggcauaaagcug

SEQ ID NO: 3883425 - RNA, 22 nt, Shigella flexneri 2a str. 301
aaugauugggauuaaagcgcuc

SEQ ID NO: 3883426 - RNA, 16 nt, Shigella flexneri 2a str. 301
aaugauuuacggaaau

SEQ ID NO: 3883427 - RNA, 22 nt, Shigella flexneri 2a str. 301
aaugauuuccugcgugacuaaa

SEQ ID NO: 3883428 - RNA, 20 nt, Shigella flexneri 2a str. 301
aaugauuuugauggaagaaa

SEQ ID NO: 3883429 - RNA, 15 nt, Shigella flexneri 2a str. 301
aaugcaaaaugccgu

SEQ ID NO: 3883430 - RNA, 20 nt, Shigella flexneri 2a str. 301
aaugcaauaauguggccccu

SEQ ID NO: 3883431 - RNA, 17 nt, Shigella flexneri 2a str. 301
aaugcaccaacaaauag

SEQ ID NO: 3883432 - RNA, 17 nt, Shigella flexneri 2a str. 301
aaugcacuuccagcggc

SEQ ID NO: 3883433 - RNA, 16 nt, Shigella flexneri 2a str. 301
aaugcagcauugccug

SEQ ID NO: 3883434 - RNA, 15 nt, Shigella flexneri 2a str. 301
aaugcagcggguuaa

SEQ ID NO: 3883435 - RNA, 18 nt, Shigella flexneri 2a str. 301
aaugcagcguuuccagcc

SEQ ID NO: 3883436 - RNA, 14 nt, Shigella flexneri 2a str. 301
aaugcaggcaccug

SEQ ID NO: 3883437 - RNA, 19 nt, Shigella flexneri 2a str. 301
aaugcaggggcguccagau

SEQ ID NO: 3883438 - RNA, 22 nt, Shigella flexneri 2a str. 301
aaugcaggggcguccagaugcg

SEQ ID NO: 3883439 - RNA, 23 nt, Shigella flexneri 2a str. 301
aaugcagucgcguagguaaucau

SEQ ID NO: 3883440 - RNA, 15 nt, Shigella flexneri 2a str. 301
aaugcaguuccauau

SEQ ID NO: 3883441 - RNA, 23 nt, Shigella flexneri 2a str. 301
aaugcaguuccauaugaauuccu

SEQ ID NO: 3883442 - RNA, 21 nt, Shigella flexneri 2a str. 301
aaugcaguuuuuaauuuucgu

SEQ ID NO: 3883443 - RNA, 22 nt, Shigella flexneri 2a str. 301
aaugcaucagugacaaauuccg

SEQ ID NO: 3883444 - RNA, 22 nt, Shigella flexneri 2a str. 301
aaugcaucgcgaccaaucacac

SEQ ID NO: 3883445 - RNA, 19 nt, Shigella flexneri 2a str. 301
aaugccaaauauuucuuua

SEQ ID NO: 3883446 - RNA, 23 nt, Shigella flexneri 2a str. 301
aaugccacaaacgccgugcacac

SEQ ID NO: 3883447 - RNA, 19 nt, Shigella flexneri 2a str. 301
aaugccacauuagauaaaa

SEQ ID NO: 3883448 - RNA, 13 nt, Shigella flexneri 2a str. 301
aaugccagauaag

SEQ ID NO: 3883449 - RNA, 14 nt, Shigella flexneri 2a str. 301
aaugccagauaaga

SEQ ID NO: 3883450 - RNA, 17 nt, Shigella flexneri 2a str. 301
aaugccagauaagacac

SEQ ID NO: 3883451 - RNA, 22 nt, Shigella flexneri 2a str. 301
aaugccaguuccgcuaccggau

SEQ ID NO: 3883452 - RNA, 13 nt, Shigella flexneri 2a str. 301
aaugcccacgccg

SEQ ID NO: 3883453 - RNA, 17 nt, Shigella flexneri 2a str. 301
aaugccccuuuaaauac

SEQ ID NO: 3883454 - RNA, 21 nt, Shigella flexneri 2a str. 301
aaugccccuuuaaauaccuua

SEQ ID NO: 3883455 - RNA, 17 nt, Shigella flexneri 2a str. 301
aaugcccgaaugcagcu

SEQ ID NO: 3883456 - RNA, 22 nt, Shigella flexneri 2a str. 301
aauuaccgcaccaccagcagcu

SEQ ID NO: 3883457 - RNA, 18 nt, Shigella flexneri 2a str. 301
aauuaccuaugccgauca

SEQ ID NO: 3883458 - RNA, 20 nt, Shigella flexneri 2a str. 301
aauuaccugucgccagagcg

SEQ ID NO: 3883459 - RNA, 21 nt, Shigella flexneri 2a str. 301
aauuacgcaggcaauccauaa

SEQ ID NO: 3883460 - RNA, 19 nt, Shigella flexneri 2a str. 301
aauuacugagagaaaaaaa

SEQ ID NO: 3883461 - RNA, 21 nt, Shigella flexneri 2a str. 301
aauuacugagagaaaaaaaag

SEQ ID NO: 3883462 - RNA, 22 nt, Shigella flexneri 2a str. 301
aauuacugagagaaaaaaaagc

SEQ ID NO: 3883463 - RNA, 23 nt, Shigella flexneri 2a str. 301
aauuacugagagaaaaaaaagca

SEQ ID NO: 3883464 - RNA, 20 nt, Shigella flexneri 2a str. 301
aauuacugccgcuguugcaa

SEQ ID NO: 3883465 - RNA, 18 nt, Shigella flexneri 2a str. 301
aauuacugccuugaugaa

SEQ ID NO: 3883466 - RNA, 19 nt, Shigella flexneri 2a str. 301
aauuacugccuugaugaaa

SEQ ID NO: 3883467 - RNA, 22 nt, Shigella flexneri 2a str. 301
aauuacugccuugaugaaaaaa

SEQ ID NO: 3883468 - RNA, 18 nt, Shigella flexneri 2a str. 301
aauuacugggaugugaaa

SEQ ID NO: 3883469 - RNA, 19 nt, Shigella flexneri 2a str. 301
aauuacugggaugugaaaa

SEQ ID NO: 3883470 - RNA, 23 nt, Shigella flexneri 2a str. 301
aauuacuuacaucugucugauaa

SEQ ID NO: 3883471 - RNA, 15 nt, Shigella flexneri 2a str. 301
aauuacuucucuuuc

SEQ ID NO: 3883472 - RNA, 16 nt, Shigella flexneri 2a str. 301
aauuagcacgauuuug

SEQ ID NO: 3883473 - RNA, 18 nt, Shigella flexneri 2a str. 301
aauuagcacgauuuugua

SEQ ID NO: 3883474 - RNA, 14 nt, Shigella flexneri 2a str. 301
aauuaguaaugaua

SEQ ID NO: 3883475 - RNA, 16 nt, Shigella flexneri 2a str. 301
aauuauaauuccuuca

SEQ ID NO: 3883476 - RNA, 20 nt, Shigella flexneri 2a str. 301
aauuauaguaucguuaaauu

SEQ ID NO: 3883477 - RNA, 20 nt, Shigella flexneri 2a str. 301
aauuaucaccgcaccuguaa

SEQ ID NO: 3883478 - RNA, 20 nt, Shigella flexneri 2a str. 301
aauuaucccugcggaaaaaa

SEQ ID NO: 3883479 - RNA, 19 nt, Shigella flexneri 2a str. 301
aauuaucucuguuuugcau

SEQ ID NO: 3883480 - RNA, 20 nt, Shigella flexneri 2a str. 301
aauuaucuuuacugauaauu

SEQ ID NO: 3883481 - RNA, 12 nt, Shigella flexneri 2a str. 301
aauuaugcagcc

SEQ ID NO: 3883482 - RNA, 18 nt, Shigella flexneri 2a str. 301
aauuaugccgaucaucau

SEQ ID NO: 3883483 - RNA, 19 nt, Shigella flexneri 2a str. 301
aauuauggcgauaucaaaa

SEQ ID NO: 3883484 - RNA, 13 nt, Shigella flexneri 2a str. 301
aauuauuauaaua

SEQ ID NO: 3883485 - RNA, 22 nt, Shigella flexneri 2a str. 301
aauuauuguaagcugucgaaaa

SEQ ID NO: 3883486 - RNA, 15 nt, Shigella flexneri 2a str. 301
aauuauuucuuuuac

SEQ ID NO: 3883487 - RNA, 16 nt, Shigella flexneri 2a str. 301
aauucaagacaucaau

SEQ ID NO: 3883488 - RNA, 20 nt, Shigella flexneri 2a str. 301
aauucaccaguuuacugaua

SEQ ID NO: 3883489 - RNA, 22 nt, Shigella flexneri 2a str. 301
aauucaccguaauaguuucuga

SEQ ID NO: 3883490 - RNA, 18 nt, Shigella flexneri 2a str. 301
aauucacgaauauuuccc

SEQ ID NO: 3883491 - RNA, 14 nt, Shigella flexneri 2a str. 301
aauucacgccgcau

SEQ ID NO: 3883492 - RNA, 18 nt, Shigella flexneri 2a str. 301
aauucagaccauuccucu

SEQ ID NO: 3883493 - RNA, 17 nt, Shigella flexneri 2a str. 301
aauucagccgcgcgcuu

SEQ ID NO: 3883494 - RNA, 12 nt, Shigella flexneri 2a str. 301
aauucaggaaau

SEQ ID NO: 3883495 - RNA, 15 nt, Shigella flexneri 2a str. 301
aauucaggagcaggc

SEQ ID NO: 3883496 - RNA, 20 nt, Shigella flexneri 2a str. 301
aauucauuacgaaguuuaau

SEQ ID NO: 3883497 - RNA, 21 nt, Shigella flexneri 2a str. 301
aauucauucaauuaauaacac

SEQ ID NO: 3883498 - RNA, 22 nt, Shigella flexneri 2a str. 301
aauucauucaauuaauaacaca

SEQ ID NO: 3883499 - RNA, 14 nt, Shigella flexneri 2a str. 301
aauucauuccugga

SEQ ID NO: 3883500 - RNA, 23 nt, Shigella flexneri 2a str. 301
aauuccaccccuuuacugacugu

SEQ ID NO: 3883501 - RNA, 15 nt, Shigella flexneri 2a str. 301
aauuccagaaaagag

SEQ ID NO: 3883502 - RNA, 20 nt, Shigella flexneri 2a str. 301
aauuccauuucccugacaaa

SEQ ID NO: 3883503 - RNA, 16 nt, Shigella flexneri 2a str. 301
aauuccccgcaggaug

SEQ ID NO: 3883504 - RNA, 20 nt, Shigella flexneri 2a str. 301
aauucccgcagcuccagccc

SEQ ID NO: 3883505 - RNA, 21 nt, Shigella flexneri 2a str. 301
aauucccgcagcuccagcccg

SEQ ID NO: 3883506 - RNA, 18 nt, Shigella flexneri 2a str. 301
aauucccgcuucuucugc

SEQ ID NO: 3883507 - RNA, 19 nt, Shigella flexneri 2a str. 301
aauucccgcuucuucugcc

SEQ ID NO: 3883508 - RNA, 13 nt, Shigella flexneri 2a str. 301
aauuccgaacaaa

SEQ ID NO: 3883509 - RNA, 17 nt, Shigella flexneri 2a str. 301
aauuccgcuucucuuuc

SEQ ID NO: 3883510 - RNA, 22 nt, Shigella flexneri 2a str. 301
aauuccggcuuguucaucacca

SEQ ID NO: 3883511 - RNA, 17 nt, Shigella flexneri 2a str. 301
aauuccggugcgccaga

SEQ ID NO: 3883512 - RNA, 19 nt, Shigella flexneri 2a str. 301
aauuccuaaccgaauucaa

SEQ ID NO: 3883513 - RNA, 20 nt, Shigella flexneri 2a str. 301
aauuccuaaccgaauucaaa

SEQ ID NO: 3883514 - RNA, 16 nt, Shigella flexneri 2a str. 301
aauuccuaugcaacaa

SEQ ID NO: 3883515 - RNA, 21 nt, Shigella flexneri 2a str. 301
aauuccuaugcaacaacugaa

SEQ ID NO: 3883516 - RNA, 21 nt, Shigella flexneri 2a str. 301
aauuccuuucccuauuuuuuc

SEQ ID NO: 3883517 - RNA, 14 nt, Shigella flexneri 2a str. 301
aauucgaagcugua

SEQ ID NO: 3883518 - RNA, 18 nt, Shigella flexneri 2a str. 301
aauucgacuuucucuggc

SEQ ID NO: 3883519 - RNA, 13 nt, Shigella flexneri 2a str. 301
aauucgcccuucg

SEQ ID NO: 3883520 - RNA, 23 nt, Shigella flexneri 2a str. 301
aauucgcccuucggcaucacgaa

SEQ ID NO: 3883521 - RNA, 23 nt, Shigella flexneri 2a str. 301
aauucgcggauguugcugcacca

SEQ ID NO: 3883522 - RNA, 23 nt, Shigella flexneri 2a str. 301
aauucggauggcgauacucugcc

SEQ ID NO: 3883523 - RNA, 20 nt, Shigella flexneri 2a str. 301
aauucguaaguacauuaaaa

SEQ ID NO: 3883524 - RNA, 13 nt, Shigella flexneri 2a str. 301
aauucuaaaacgg

SEQ ID NO: 3883525 - RNA, 14 nt, Shigella flexneri 2a str. 301
aauucuaaauguuc

SEQ ID NO: 3883526 - RNA, 15 nt, Shigella flexneri 2a str. 301
aauucuaauguuaaa

SEQ ID NO: 3883527 - RNA, 17 nt, Shigella flexneri 2a str. 301
aauucuacagaaaugaa

SEQ ID NO: 3883528 - RNA, 22 nt, Shigella flexneri 2a str. 301
aauucuacagaaaugaaaaaau

SEQ ID NO: 3883529 - RNA, 18 nt, Shigella flexneri 2a str. 301
aauucuccagcgccgcau

SEQ ID NO: 3883530 - RNA, 17 nt, Shigella flexneri 2a str. 301
aauucuccgcucucaau

SEQ ID NO: 3883531 - RNA, 18 nt, Shigella flexneri 2a str. 301
aauucucuauuucacccg

SEQ ID NO: 3883532 - RNA, 23 nt, Shigella flexneri 2a str. 301
aauucucucuucagcuuccauca

SEQ ID NO: 3883533 - RNA, 20 nt, Shigella flexneri 2a str. 301
aauucugagagcaugaaaug

SEQ ID NO: 3883534 - RNA, 22 nt, Shigella flexneri 2a str. 301
aauucugagagcaugaaaugaa

SEQ ID NO: 3883535 - RNA, 23 nt, Shigella flexneri 2a str. 301
aauucugagagcaugaaaugaaa

SEQ ID NO: 3883536 - RNA, 15 nt, Shigella flexneri 2a str. 301
aauucuguaauccuc

SEQ ID NO: 3883537 - RNA, 20 nt, Shigella flexneri 2a str. 301
aauugaaaaguccaggcugc

SEQ ID NO: 3883538 - RNA, 22 nt, Shigella flexneri 2a str. 301
aauugaagaguuugaucauggc

SEQ ID NO: 3883539 - RNA, 15 nt, Shigella flexneri 2a str. 301
aauugaagguuuaau

SEQ ID NO: 3883540 - RNA, 14 nt, Shigella flexneri 2a str. 301
aauugaaucacgac

SEQ ID NO: 3883541 - RNA, 23 nt, Shigella flexneri 2a str. 301
aauugagaaccacaaugaagaaa

SEQ ID NO: 3883542 - RNA, 22 nt, Shigella flexneri 2a str. 301
aauugaggcccggcguauauug

SEQ ID NO: 3883543 - RNA, 20 nt, Shigella flexneri 2a str. 301
aauugauuuucgaaaaaaaa

SEQ ID NO: 3883544 - RNA, 21 nt, Shigella flexneri 2a str. 301
aauugauuuucgaaaaaaaag

SEQ ID NO: 3883545 - RNA, 22 nt, Shigella flexneri 2a str. 301
aauugcacguccgguggcaucc

SEQ ID NO: 3883546 - RNA, 23 nt, Shigella flexneri 2a str. 301
aauugcagacccguuaagcguuc

SEQ ID NO: 3883547 - RNA, 23 nt, Shigella flexneri 2a str. 301
aauugcaggguuuuguuuaaaua

SEQ ID NO: 3883548 - RNA, 19 nt, Shigella flexneri 2a str. 301
aauugccaccauccgcuca

SEQ ID NO: 3883549 - RNA, 18 nt, Shigella flexneri 2a str. 301
aauugccugauggccugc

SEQ ID NO: 3883550 - RNA, 15 nt, Shigella flexneri 2a str. 301
aauugcgaacugugc

SEQ ID NO: 3883551 - RNA, 17 nt, Shigella flexneri 2a str. 301
aauugcgaauuauaauu

SEQ ID NO: 3883552 - RNA, 23 nt, Shigella flexneri 2a str. 301
aauugcgagccuguaccacaacc

SEQ ID NO: 3883553 - RNA, 18 nt, Shigella flexneri 2a str. 301
aauugcgcaacugaggca

SEQ ID NO: 3883554 - RNA, 17 nt, Shigella flexneri 2a str. 301
acaaacugguguugaaa

SEQ ID NO: 3883555 - RNA, 21 nt, Shigella flexneri 2a str. 301
acaaacuugauagaacaaaag

SEQ ID NO: 3883556 - RNA, 15 nt, Shigella flexneri 2a str. 301
acaaagaagggaaug

SEQ ID NO: 3883557 - RNA, 14 nt, Shigella flexneri 2a str. 301
acaaagacaucaaa

SEQ ID NO: 3883558 - RNA, 18 nt, Shigella flexneri 2a str. 301
acaaagacaucaaacccu

SEQ ID NO: 3883559 - RNA, 13 nt, Shigella flexneri 2a str. 301
acaaagagcuuuc

SEQ ID NO: 3883560 - RNA, 15 nt, Shigella flexneri 2a str. 301
acaaagccaacagca

SEQ ID NO: 3883561 - RNA, 18 nt, Shigella flexneri 2a str. 301
acaaagcgcacuuugcca

SEQ ID NO: 3883562 - RNA, 16 nt, Shigella flexneri 2a str. 301
acaaaggcuugcugca

SEQ ID NO: 3883563 - RNA, 20 nt, Shigella flexneri 2a str. 301
acaaagggcgucgcuuaauu

SEQ ID NO: 3883564 - RNA, 15 nt, Shigella flexneri 2a str. 301
acaaaguuugcaacu

SEQ ID NO: 3883565 - RNA, 18 nt, Shigella flexneri 2a str. 301
acaaauaaaagcaaaaau

SEQ ID NO: 3883566 - RNA, 19 nt, Shigella flexneri 2a str. 301
acaaauaaauagauccagg

SEQ ID NO: 3883567 - RNA, 21 nt, Shigella flexneri 2a str. 301
acaaauaaauagauccaggaa

SEQ ID NO: 3883568 - RNA, 15 nt, Shigella flexneri 2a str. 301
acaaauacaugaugu

SEQ ID NO: 3883569 - RNA, 13 nt, Shigella flexneri 2a str. 301
acaaauagacaca

SEQ ID NO: 3883570 - RNA, 21 nt, Shigella flexneri 2a str. 301
acaaauagacacaagaaauau

SEQ ID NO: 3883571 - RNA, 21 nt, Shigella flexneri 2a str. 301
acaaauagagauagaaugcca

SEQ ID NO: 3883572 - RNA, 23 nt, Shigella flexneri 2a str. 301
acaaauagagauagaaugccaag

SEQ ID NO: 3883573 - RNA, 20 nt, Shigella flexneri 2a str. 301
acaaauagagcgccggaaau

SEQ ID NO: 3883574 - RNA, 15 nt, Shigella flexneri 2a str. 301
acaaauagccagcag

SEQ ID NO: 3883575 - RNA, 16 nt, Shigella flexneri 2a str. 301
acaaauagccagcaga

SEQ ID NO: 3883576 - RNA, 17 nt, Shigella flexneri 2a str. 301
acaaaucagaacggaau

SEQ ID NO: 3883577 - RNA, 13 nt, Shigella flexneri 2a str. 301
acaaauccagcac

SEQ ID NO: 3883578 - RNA, 15 nt, Shigella flexneri 2a str. 301
acaaauccagcaccg

SEQ ID NO: 3883579 - RNA, 21 nt, Shigella flexneri 2a str. 301
acaaauccuucacuuuugcca

SEQ ID NO: 3883580 - RNA, 16 nt, Shigella flexneri 2a str. 301
acaaaugaacaccaaa

SEQ ID NO: 3883581 - RNA, 18 nt, Shigella flexneri 2a str. 301
acaaaugcaguuuuuaau

SEQ ID NO: 3883582 - RNA, 17 nt, Shigella flexneri 2a str. 301
acaaauggcaaugacua

SEQ ID NO: 3883583 - RNA, 23 nt, Shigella flexneri 2a str. 301
acaaauggcaguaucggcaaggu

SEQ ID NO: 3883584 - RNA, 19 nt, Shigella flexneri 2a str. 301
acaaaugggcacaauucau

SEQ ID NO: 3883585 - RNA, 23 nt, Shigella flexneri 2a str. 301
acaaaugucacugcuuuggcucu

SEQ ID NO: 3883586 - RNA, 21 nt, Shigella flexneri 2a str. 301
acaaauucacgccuucuucca

SEQ ID NO: 3883587 - RNA, 18 nt, Shigella flexneri 2a str. 301
acaaauuccgaacaaaac

SEQ ID NO: 3883588 - RNA, 21 nt, Shigella flexneri 2a str. 301
acaaauucuggcggcaauaac

SEQ ID NO: 3883589 - RNA, 18 nt, Shigella flexneri 2a str. 301
acaacaacuucuaauuuu

SEQ ID NO: 3883590 - RNA, 17 nt, Shigella flexneri 2a str. 301
acaacacauucaauaac

SEQ ID NO: 3883591 - RNA, 15 nt, Shigella flexneri 2a str. 301
acaacacccggucag

SEQ ID NO: 3883592 - RNA, 22 nt, Shigella flexneri 2a str. 301
acaacacccggucagccauugc

SEQ ID NO: 3883593 - RNA, 13 nt, Shigella flexneri 2a str. 301
acaacacucucug

SEQ ID NO: 3883594 - RNA, 16 nt, Shigella flexneri 2a str. 301
acaacacucucugaag

SEQ ID NO: 3883595 - RNA, 19 nt, Shigella flexneri 2a str. 301
acaacagaaauaaucgcaa

SEQ ID NO: 3883596 - RNA, 19 nt, Shigella flexneri 2a str. 301
acaacagucccaggcagaa

SEQ ID NO: 3883597 - RNA, 12 nt, Shigella flexneri 2a str. 301
acaacaucaaca

SEQ ID NO: 3883598 - RNA, 20 nt, Shigella flexneri 2a str. 301
acaacaucacaccugcucag

SEQ ID NO: 3883599 - RNA, 13 nt, Shigella flexneri 2a str. 301
acaacaucaucug

SEQ ID NO: 3883600 - RNA, 14 nt, Shigella flexneri 2a str. 301
acaacaucaucugc

SEQ ID NO: 3883601 - RNA, 15 nt, Shigella flexneri 2a str. 301
acaacaucaucugcc

SEQ ID NO: 3883602 - RNA, 18 nt, Shigella flexneri 2a str. 301
acaacaugagaacaguuc

SEQ ID NO: 3883603 - RNA, 21 nt, Shigella flexneri 2a str. 301
acaacaugcagcccagcauca

SEQ ID NO: 3883604 - RNA, 22 nt, Shigella flexneri 2a str. 301
acaacauuccugcugacggcac

SEQ ID NO: 3883605 - RNA, 13 nt, Shigella flexneri 2a str. 301
acaaccacuuugu

SEQ ID NO: 3883606 - RNA, 12 nt, Shigella flexneri 2a str. 301
acaaccaucccu

SEQ ID NO: 3883607 - RNA, 18 nt, Shigella flexneri 2a str. 301
acaacccaagcgcgcugu

SEQ ID NO: 3883608 - RNA, 21 nt, Shigella flexneri 2a str. 301
acaacccgugagucuccuuua

SEQ ID NO: 3883609 - RNA, 16 nt, Shigella flexneri 2a str. 301
acaacccuaaagcacc

SEQ ID NO: 3883610 - RNA, 18 nt, Shigella flexneri 2a str. 301
acaaccugaccuuuuuuc

SEQ ID NO: 3883611 - RNA, 19 nt, Shigella flexneri 2a str. 301
acaacgaagccgugccaca

SEQ ID NO: 3883612 - RNA, 13 nt, Shigella flexneri 2a str. 301
acaacgagcgcaa

SEQ ID NO: 3883613 - RNA, 23 nt, Shigella flexneri 2a str. 301
acaacgagcgcaaugaaaaccgu

SEQ ID NO: 3883614 - RNA, 20 nt, Shigella flexneri 2a str. 301
acaacgcaauauccgccacu

SEQ ID NO: 3883615 - RNA, 19 nt, Shigella flexneri 2a str. 301
acaacgccauauaaauuuc

SEQ ID NO: 3883616 - RNA, 17 nt, Shigella flexneri 2a str. 301
acaacgcuuucaacaac

SEQ ID NO: 3883617 - RNA, 17 nt, Shigella flexneri 2a str. 301
acaacggaacgaaaaaa

SEQ ID NO: 3883618 - RNA, 19 nt, Shigella flexneri 2a str. 301
acaacggaacgaaaaaaau

SEQ ID NO: 3883619 - RNA, 16 nt, Shigella flexneri 2a str. 301
acaacggguuuggccg

SEQ ID NO: 3883620 - RNA, 17 nt, Shigella flexneri 2a str. 301
acaacgucgccaguccu

SEQ ID NO: 3883621 - RNA, 16 nt, Shigella flexneri 2a str. 301
acaacgugguuauacg

SEQ ID NO: 3883622 - RNA, 15 nt, Shigella flexneri 2a str. 301
acaacgugugcuuug

SEQ ID NO: 3883623 - RNA, 18 nt, Shigella flexneri 2a str. 301
acaacuaagccaguucau

SEQ ID NO: 3883624 - RNA, 19 nt, Shigella flexneri 2a str. 301
acaacucaucacuguaggc

SEQ ID NO: 3883625 - RNA, 20 nt, Shigella flexneri 2a str. 301
acaacuccguugaaauugcu

SEQ ID NO: 3883626 - RNA, 23 nt, Shigella flexneri 2a str. 301
acaacucgcuuaagccaucauca

SEQ ID NO: 3883627 - RNA, 14 nt, Shigella flexneri 2a str. 301
acaacugaaaaaaa

SEQ ID NO: 3883628 - RNA, 15 nt, Shigella flexneri 2a str. 301
acaacugcauuuuca

SEQ ID NO: 3883629 - RNA, 14 nt, Shigella flexneri 2a str. 301
acaagaaauauaca

SEQ ID NO: 3883630 - RNA, 18 nt, Shigella flexneri 2a str. 301
acaagaaauauacaggcg

SEQ ID NO: 3883631 - RNA, 20 nt, Shigella flexneri 2a str. 301
acaagaaauauacaggcggg

SEQ ID NO: 3883632 - RNA, 17 nt, Shigella flexneri 2a str. 301
acaagaaucaugccaaa

SEQ ID NO: 3883633 - RNA, 23 nt, Shigella flexneri 2a str. 301
acaagaaugccugccagcuugcg

SEQ ID NO: 3883634 - RNA, 13 nt, Shigella flexneri 2a str. 301
acaagacuguaaa

SEQ ID NO: 3883635 - RNA, 17 nt, Shigella flexneri 2a str. 301
acaagauacggaacugc

SEQ ID NO: 3883636 - RNA, 14 nt, Shigella flexneri 2a str. 301
acaagaucgcccug

SEQ ID NO: 3883637 - RNA, 17 nt, Shigella flexneri 2a str. 301
acaagaucgcccugagg

SEQ ID NO: 3883638 - RNA, 22 nt, Shigella flexneri 2a str. 301
acaagcauuaaggcaagaaaau

SEQ ID NO: 3883639 - RNA, 14 nt, Shigella flexneri 2a str. 301
acaagccaccaucc

SEQ ID NO: 3883640 - RNA, 17 nt, Shigella flexneri 2a str. 301
acaagcguaugauugcc

SEQ ID NO: 3883641 - RNA, 17 nt, Shigella flexneri 2a str. 301
acaagcgucgcaucagg

SEQ ID NO: 3883642 - RNA, 14 nt, Shigella flexneri 2a str. 301
acaagcguuagcgu

SEQ ID NO: 3883643 - RNA, 15 nt, Shigella flexneri 2a str. 301
acaagcuaccagccc

SEQ ID NO: 3883644 - RNA, 22 nt, Shigella flexneri 2a str. 301
acaagggaaauaagaaaagcga

SEQ ID NO: 3883645 - RNA, 22 nt, Shigella flexneri 2a str. 301
acaagggcauauuucgucagca

SEQ ID NO: 3883646 - RNA, 20 nt, Shigella flexneri 2a str. 301
acaagguuugaaaaaaccug

SEQ ID NO: 3883647 - RNA, 23 nt, Shigella flexneri 2a str. 301
acaaguccgggauuaucccgcag

SEQ ID NO: 3883648 - RNA, 20 nt, Shigella flexneri 2a str. 301
acaaguccguugaaaaugcu

SEQ ID NO: 3883649 - RNA, 18 nt, Shigella flexneri 2a str. 301
acaaguuguuuacaguau

SEQ ID NO: 3883650 - RNA, 16 nt, Shigella flexneri 2a str. 301
acaauaaacuggcugu

SEQ ID NO: 3883651 - RNA, 17 nt, Shigella flexneri 2a str. 301
acaauaauacccagcac

SEQ ID NO: 3883652 - RNA, 12 nt, Shigella flexneri 2a str. 301
acaauaauaucu

SEQ ID NO: 3883653 - RNA, 13 nt, Shigella flexneri 2a str. 301
acaauaauaucuu

SEQ ID NO: 3883654 - RNA, 18 nt, Shigella flexneri 2a str. 301
acacuaacagaacaauaa

SEQ ID NO: 3883655 - RNA, 23 nt, Shigella flexneri 2a str. 301
acacuaaccguuucuaauauuag

SEQ ID NO: 3883656 - RNA, 18 nt, Shigella flexneri 2a str. 301
acacuaacgcgucuuauc

SEQ ID NO: 3883657 - RNA, 22 nt, Shigella flexneri 2a str. 301
acacuauuuccccggaaccuga

SEQ ID NO: 3883658 - RNA, 12 nt, Shigella flexneri 2a str. 301
acacuauuuccu

SEQ ID NO: 3883659 - RNA, 15 nt, Shigella flexneri 2a str. 301
acacucaaauaucua

SEQ ID NO: 3883660 - RNA, 17 nt, Shigella flexneri 2a str. 301
acacuccagucccaguu

SEQ ID NO: 3883661 - RNA, 19 nt, Shigella flexneri 2a str. 301
acacucgugcgucgcaucc

SEQ ID NO: 3883662 - RNA, 19 nt, Shigella flexneri 2a str. 301
acacucugaccugccgcag

SEQ ID NO: 3883663 - RNA, 20 nt, Shigella flexneri 2a str. 301
acacucuuccagucgccugc

SEQ ID NO: 3883664 - RNA, 18 nt, Shigella flexneri 2a str. 301
acacugacgcgucuuauc

SEQ ID NO: 3883665 - RNA, 18 nt, Shigella flexneri 2a str. 301
acacugaugacaggcuac

SEQ ID NO: 3883666 - RNA, 17 nt, Shigella flexneri 2a str. 301
acacugcguacagcgcg

SEQ ID NO: 3883667 - RNA, 15 nt, Shigella flexneri 2a str. 301
acacugcucgcagaa

SEQ ID NO: 3883668 - RNA, 13 nt, Shigella flexneri 2a str. 301
acacugcuuacag

SEQ ID NO: 3883669 - RNA, 20 nt, Shigella flexneri 2a str. 301
acacugguucccaacaacag

SEQ ID NO: 3883670 - RNA, 23 nt, Shigella flexneri 2a str. 301
acacugguucccaacaacagcgc

SEQ ID NO: 3883671 - RNA, 18 nt, Shigella flexneri 2a str. 301
acacuguuaccgcugcug

SEQ ID NO: 3883672 - RNA, 14 nt, Shigella flexneri 2a str. 301
acacuuaacuguau

SEQ ID NO: 3883673 - RNA, 19 nt, Shigella flexneri 2a str. 301
acacuucaauauuaaugcu

SEQ ID NO: 3883674 - RNA, 13 nt, Shigella flexneri 2a str. 301
acacuucuucagc

SEQ ID NO: 3883675 - RNA, 18 nt, Shigella flexneri 2a str. 301
acacuucuucagccaguu

SEQ ID NO: 3883676 - RNA, 15 nt, Shigella flexneri 2a str. 301
acacuucuucugucg

SEQ ID NO: 3883677 - RNA, 22 nt, Shigella flexneri 2a str. 301
acacuuuaaugccacauuagau

SEQ ID NO: 3883678 - RNA, 19 nt, Shigella flexneri 2a str. 301
acacuuugccgucagccac

SEQ ID NO: 3883679 - RNA, 18 nt, Shigella flexneri 2a str. 301
acacuuuuauuaacucag

SEQ ID NO: 3883680 - RNA, 14 nt, Shigella flexneri 2a str. 301
acagaaaacucacg

SEQ ID NO: 3883681 - RNA, 22 nt, Shigella flexneri 2a str. 301
acagaaacgccauccagccggg

SEQ ID NO: 3883682 - RNA, 19 nt, Shigella flexneri 2a str. 301
acagaaaugaaaaaauaga

SEQ ID NO: 3883683 - RNA, 14 nt, Shigella flexneri 2a str. 301
acagaacagugcca

SEQ ID NO: 3883684 - RNA, 23 nt, Shigella flexneri 2a str. 301
acagaacagugccaugccaauca

SEQ ID NO: 3883685 - RNA, 23 nt, Shigella flexneri 2a str. 301
acagaacgcgccuuaaaaaccag

SEQ ID NO: 3883686 - RNA, 19 nt, Shigella flexneri 2a str. 301
acagaagaaagcaaugaaa

SEQ ID NO: 3883687 - RNA, 18 nt, Shigella flexneri 2a str. 301
acagaauauaagucaggg

SEQ ID NO: 3883688 - RNA, 15 nt, Shigella flexneri 2a str. 301
acagaauggcaucug

SEQ ID NO: 3883689 - RNA, 21 nt, Shigella flexneri 2a str. 301
acagaauucccccauugaaac

SEQ ID NO: 3883690 - RNA, 12 nt, Shigella flexneri 2a str. 301
acagacaaacag

SEQ ID NO: 3883691 - RNA, 12 nt, Shigella flexneri 2a str. 301
acagaccaucaa

SEQ ID NO: 3883692 - RNA, 20 nt, Shigella flexneri 2a str. 301
acagaccuuucgaacccaac

SEQ ID NO: 3883693 - RNA, 11 nt, Shigella flexneri 2a str. 301
acagacgacga

SEQ ID NO: 3883694 - RNA, 16 nt, Shigella flexneri 2a str. 301
acagacuaauugagcg

SEQ ID NO: 3883695 - RNA, 19 nt, Shigella flexneri 2a str. 301
acagacucaaaccaauggc

SEQ ID NO: 3883696 - RNA, 16 nt, Shigella flexneri 2a str. 301
acagagacgcacugcu

SEQ ID NO: 3883697 - RNA, 21 nt, Shigella flexneri 2a str. 301
acagagauuacuuuauuuaua

SEQ ID NO: 3883698 - RNA, 22 nt, Shigella flexneri 2a str. 301
acagagcaauaaaagaugguca

SEQ ID NO: 3883699 - RNA, 23 nt, Shigella flexneri 2a str. 301
acagagcacuguuacugucggca

SEQ ID NO: 3883700 - RNA, 16 nt, Shigella flexneri 2a str. 301
acagagcgagggagaa

SEQ ID NO: 3883701 - RNA, 20 nt, Shigella flexneri 2a str. 301
acagaggguuuuuuaucuuc

SEQ ID NO: 3883702 - RNA, 16 nt, Shigella flexneri 2a str. 301
acagaggucuuuucuc

SEQ ID NO: 3883703 - RNA, 17 nt, Shigella flexneri 2a str. 301
acagagguuuuaugaua

SEQ ID NO: 3883704 - RNA, 24 nt, Shigella flexneri 2a str. 301
acagauauuuauuucagaacaguu

SEQ ID NO: 3883705 - RNA, 12 nt, Shigella flexneri 2a str. 301
acagauucaggc

SEQ ID NO: 3883706 - RNA, 14 nt, Shigella flexneri 2a str. 301
acagauucaggcgc

SEQ ID NO: 3883707 - RNA, 20 nt, Shigella flexneri 2a str. 301
acagauucgcuugucacuuc

SEQ ID NO: 3883708 - RNA, 14 nt, Shigella flexneri 2a str. 301
acagauuuugccag

SEQ ID NO: 3883709 - RNA, 18 nt, Shigella flexneri 2a str. 301
acagauuuugccagcaug

SEQ ID NO: 3883710 - RNA, 22 nt, Shigella flexneri 2a str. 301
acagauuuugccagcaugacua

SEQ ID NO: 3883711 - RNA, 12 nt, Shigella flexneri 2a str. 301
acagcaaaacac

SEQ ID NO: 3883712 - RNA, 12 nt, Shigella flexneri 2a str. 301
acagcaaaacgc

SEQ ID NO: 3883713 - RNA, 20 nt, Shigella flexneri 2a str. 301
acagcaaagcgugcaaauau

SEQ ID NO: 3883714 - RNA, 21 nt, Shigella flexneri 2a str. 301
acagcaaagcgugcaaauaua

SEQ ID NO: 3883715 - RNA, 16 nt, Shigella flexneri 2a str. 301
acagcaccagcaggug

SEQ ID NO: 3883716 - RNA, 23 nt, Shigella flexneri 2a str. 301
acagcaccauccgcccacaccag

SEQ ID NO: 3883717 - RNA, 20 nt, Shigella flexneri 2a str. 301
acagcacgaugaaucuguua

SEQ ID NO: 3883718 - RNA, 19 nt, Shigella flexneri 2a str. 301
acagcacgcuuuucagugc

SEQ ID NO: 3883719 - RNA, 12 nt, Shigella flexneri 2a str. 301
acagcagcaacg

SEQ ID NO: 3883720 - RNA, 12 nt, Shigella flexneri 2a str. 301
acagcagcagcg

SEQ ID NO: 3883721 - RNA, 19 nt, Shigella flexneri 2a str. 301
acagcagccacaccaauca

SEQ ID NO: 3883722 - RNA, 13 nt, Shigella flexneri 2a str. 301
acagcagcccuug

SEQ ID NO: 3883723 - RNA, 18 nt, Shigella flexneri 2a str. 301
acagcagcccuugugccg

SEQ ID NO: 3883724 - RNA, 19 nt, Shigella flexneri 2a str. 301
acagcaggcagauccaguu

SEQ ID NO: 3883725 - RNA, 21 nt, Shigella flexneri 2a str. 301
acagcaguacgccgagaauaa

SEQ ID NO: 3883726 - RNA, 19 nt, Shigella flexneri 2a str. 301
acagcaguuguuuaauggc

SEQ ID NO: 3883727 - RNA, 21 nt, Shigella flexneri 2a str. 301
acagcauaccuucacagaagg

SEQ ID NO: 3883728 - RNA, 17 nt, Shigella flexneri 2a str. 301
acagcauauaaugcaac

SEQ ID NO: 3883729 - RNA, 17 nt, Shigella flexneri 2a str. 301
acagcaucaucgcaaug

SEQ ID NO: 3883730 - RNA, 20 nt, Shigella flexneri 2a str. 301
acagcaucguccgccagccu

SEQ ID NO: 3883731 - RNA, 15 nt, Shigella flexneri 2a str. 301
acagcaucuggauga

SEQ ID NO: 3883732 - RNA, 22 nt, Shigella flexneri 2a str. 301
acagccacacaccgcaaacugc

SEQ ID NO: 3883733 - RNA, 22 nt, Shigella flexneri 2a str. 301
acagccacagggugaucaccag

SEQ ID NO: 3883734 - RNA, 23 nt, Shigella flexneri 2a str. 301
acagccacagggugaucaccagu

SEQ ID NO: 3883735 - RNA, 18 nt, Shigella flexneri 2a str. 301
acagccagauuaaaagug

SEQ ID NO: 3883736 - RNA, 23 nt, Shigella flexneri 2a str. 301
acagccagauuaaaagugcuggg

SEQ ID NO: 3883737 - RNA, 13 nt, Shigella flexneri 2a str. 301
acagccagcagcg

SEQ ID NO: 3883738 - RNA, 12 nt, Shigella flexneri 2a str. 301
acagccagccag

SEQ ID NO: 3883739 - RNA, 15 nt, Shigella flexneri 2a str. 301
acagccagccagcac

SEQ ID NO: 3883740 - RNA, 17 nt, Shigella flexneri 2a str. 301
acagccagccagcacca

SEQ ID NO: 3883741 - RNA, 18 nt, Shigella flexneri 2a str. 301
acagccagccagcaccag

SEQ ID NO: 3883742 - RNA, 22 nt, Shigella flexneri 2a str. 301
acagccagccagcaccaggcuu

SEQ ID NO: 3883743 - RNA, 16 nt, Shigella flexneri 2a str. 301
acagccauccgucauc

SEQ ID NO: 3883744 - RNA, 18 nt, Shigella flexneri 2a str. 301
acagccauccgucaucca

SEQ ID NO: 3883745 - RNA, 16 nt, Shigella flexneri 2a str. 301
acagccccugagcguu

SEQ ID NO: 3883746 - RNA, 22 nt, Shigella flexneri 2a str. 301
acagcccgccaaccaccgccag

SEQ ID NO: 3883747 - RNA, 18 nt, Shigella flexneri 2a str. 301
acagccgacaaugccaca

SEQ ID NO: 3883748 - RNA, 23 nt, Shigella flexneri 2a str. 301
acagccgucgagggcaaccugcu

SEQ ID NO: 3883749 - RNA, 13 nt, Shigella flexneri 2a str. 301
acagccuaccaga

SEQ ID NO: 3883750 - RNA, 22 nt, Shigella flexneri 2a str. 301
acagccuaccagaccgcacacc

SEQ ID NO: 3883751 - RNA, 20 nt, Shigella flexneri 2a str. 301
acagccugauacaggaaggc

SEQ ID NO: 3883752 - RNA, 17 nt, Shigella flexneri 2a str. 301
acagccugccagcaugc

SEQ ID NO: 3883753 - RNA, 18 nt, Shigella flexneri 2a str. 301
acauagguacagcaccaa

SEQ ID NO: 3883754 - RNA, 13 nt, Shigella flexneri 2a str. 301
acauagucaucau

SEQ ID NO: 3883755 - RNA, 20 nt, Shigella flexneri 2a str. 301
acauauaaccggcaacagaa

SEQ ID NO: 3883756 - RNA, 20 nt, Shigella flexneri 2a str. 301
acauauaucgaaaaaucgac

SEQ ID NO: 3883757 - RNA, 22 nt, Shigella flexneri 2a str. 301
acauauauuacaacguauuaua

SEQ ID NO: 3883758 - RNA, 14 nt, Shigella flexneri 2a str. 301
acauauuccccugg

SEQ ID NO: 3883759 - RNA, 22 nt, Shigella flexneri 2a str. 301
acauauucgauacauucagaau

SEQ ID NO: 3883760 - RNA, 14 nt, Shigella flexneri 2a str. 301
acauauugcagcuu

SEQ ID NO: 3883761 - RNA, 22 nt, Shigella flexneri 2a str. 301
acauauuuuuguugaaauaaua

SEQ ID NO: 3883762 - RNA, 17 nt, Shigella flexneri 2a str. 301
acaucaaaugcgcagcc

SEQ ID NO: 3883763 - RNA, 19 nt, Shigella flexneri 2a str. 301
acaucaaauuacagcaccu

SEQ ID NO: 3883764 - RNA, 16 nt, Shigella flexneri 2a str. 301
acaucaacucugcaau

SEQ ID NO: 3883765 - RNA, 15 nt, Shigella flexneri 2a str. 301
acaucaagauaacua

SEQ ID NO: 3883766 - RNA, 13 nt, Shigella flexneri 2a str. 301
acaucacaugcug

SEQ ID NO: 3883767 - RNA, 13 nt, Shigella flexneri 2a str. 301
acaucaccaacac

SEQ ID NO: 3883768 - RNA, 18 nt, Shigella flexneri 2a str. 301
acaucaccaauacgcaua

SEQ ID NO: 3883769 - RNA, 21 nt, Shigella flexneri 2a str. 301
acaucaccaaugaaagcccca

SEQ ID NO: 3883770 - RNA, 19 nt, Shigella flexneri 2a str. 301
acaucaccccgccgggcuu

SEQ ID NO: 3883771 - RNA, 13 nt, Shigella flexneri 2a str. 301
acaucaccgccac

SEQ ID NO: 3883772 - RNA, 13 nt, Shigella flexneri 2a str. 301
acaucacucauaa

SEQ ID NO: 3883773 - RNA, 19 nt, Shigella flexneri 2a str. 301
acaucacuccauccagcaa

SEQ ID NO: 3883774 - RNA, 15 nt, Shigella flexneri 2a str. 301
acaucacugcaaaua

SEQ ID NO: 3883775 - RNA, 19 nt, Shigella flexneri 2a str. 301
acaucagaggcgaaccgcu

SEQ ID NO: 3883776 - RNA, 13 nt, Shigella flexneri 2a str. 301
acaucagcgacaa

SEQ ID NO: 3883777 - RNA, 21 nt, Shigella flexneri 2a str. 301
acaucagcuaaaucacaccau

SEQ ID NO: 3883778 - RNA, 18 nt, Shigella flexneri 2a str. 301
acaucaguuggaugcugc

SEQ ID NO: 3883779 - RNA, 14 nt, Shigella flexneri 2a str. 301
acaucaucacugcc

SEQ ID NO: 3883780 - RNA, 13 nt, Shigella flexneri 2a str. 301
acaucaucugcca

SEQ ID NO: 3883781 - RNA, 16 nt, Shigella flexneri 2a str. 301
acaucaugccagugau

SEQ ID NO: 3883782 - RNA, 20 nt, Shigella flexneri 2a str. 301
acaucaugcgucaccaacag

SEQ ID NO: 3883783 - RNA, 15 nt, Shigella flexneri 2a str. 301
acaucaugcugccgg

SEQ ID NO: 3883784 - RNA, 20 nt, Shigella flexneri 2a str. 301
acaucaugguuugcauccac

SEQ ID NO: 3883785 - RNA, 23 nt, Shigella flexneri 2a str. 301
acaucauuuuuucccauuaccau

SEQ ID NO: 3883786 - RNA, 14 nt, Shigella flexneri 2a str. 301
acauccaccgccac

SEQ ID NO: 3883787 - RNA, 22 nt, Shigella flexneri 2a str. 301
acauccagacggguacaguuuu

SEQ ID NO: 3883788 - RNA, 15 nt, Shigella flexneri 2a str. 301
acauccagcagcaau

SEQ ID NO: 3883789 - RNA, 14 nt, Shigella flexneri 2a str. 301
acauccaucugcuu

SEQ ID NO: 3883790 - RNA, 23 nt, Shigella flexneri 2a str. 301
acauccaugcacugcaacgccuu

SEQ ID NO: 3883791 - RNA, 18 nt, Shigella flexneri 2a str. 301
acauccgaggacagcauc

SEQ ID NO: 3883792 - RNA, 15 nt, Shigella flexneri 2a str. 301
acauccgccaucgac

SEQ ID NO: 3883793 - RNA, 11 nt, Shigella flexneri 2a str. 301
acauccggcaa

SEQ ID NO: 3883794 - RNA, 17 nt, Shigella flexneri 2a str. 301
acauccggcaauauuca

SEQ ID NO: 3883795 - RNA, 11 nt, Shigella flexneri 2a str. 301
acauccggcuu

SEQ ID NO: 3883796 - RNA, 19 nt, Shigella flexneri 2a str. 301
acauccgggcgaacuggcg

SEQ ID NO: 3883797 - RNA, 15 nt, Shigella flexneri 2a str. 301
acauccugcguuaau

SEQ ID NO: 3883798 - RNA, 13 nt, Shigella flexneri 2a str. 301
acaucgauaaggu

SEQ ID NO: 3883799 - RNA, 14 nt, Shigella flexneri 2a str. 301
acaucgcagcaaac

SEQ ID NO: 3883800 - RNA, 18 nt, Shigella flexneri 2a str. 301
acaucgcagggaucaucc

SEQ ID NO: 3883801 - RNA, 22 nt, Shigella flexneri 2a str. 301
acaucgcauaaaccacagaccg

SEQ ID NO: 3883802 - RNA, 20 nt, Shigella flexneri 2a str. 301
acaucgcauucgacauugaa

SEQ ID NO: 3883803 - RNA, 14 nt, Shigella flexneri 2a str. 301
acaucgccagaaau

SEQ ID NO: 3883804 - RNA, 21 nt, Shigella flexneri 2a str. 301
acaucgcguugacguucaugc

SEQ ID NO: 3883805 - RNA, 23 nt, Shigella flexneri 2a str. 301
acaucgcugauuucaccaucuuc

SEQ ID NO: 3883806 - RNA, 13 nt, Shigella flexneri 2a str. 301
acaucgcugugcu

SEQ ID NO: 3883807 - RNA, 13 nt, Shigella flexneri 2a str. 301
acaucgcuuucca

SEQ ID NO: 3883808 - RNA, 14 nt, Shigella flexneri 2a str. 301
acaucgcuuuccag

SEQ ID NO: 3883809 - RNA, 16 nt, Shigella flexneri 2a str. 301
acaucguaucuggcaa

SEQ ID NO: 3883810 - RNA, 14 nt, Shigella flexneri 2a str. 301
acaucgucaggggc

SEQ ID NO: 3883811 - RNA, 21 nt, Shigella flexneri 2a str. 301
acaucgucaggggcauuuuca

SEQ ID NO: 3883812 - RNA, 14 nt, Shigella flexneri 2a str. 301
acaucgucgccaga

SEQ ID NO: 3883813 - RNA, 20 nt, Shigella flexneri 2a str. 301
acaucgucuuuuucucccuu

SEQ ID NO: 3883814 - RNA, 21 nt, Shigella flexneri 2a str. 301
acaucguugacauuugcuuuu

SEQ ID NO: 3883815 - RNA, 14 nt, Shigella flexneri 2a str. 301
acaucuaccgccag

SEQ ID NO: 3883816 - RNA, 16 nt, Shigella flexneri 2a str. 301
acaucuaccgccagcc

SEQ ID NO: 3883817 - RNA, 18 nt, Shigella flexneri 2a str. 301
acaucuaccgccagccag

SEQ ID NO: 3883818 - RNA, 13 nt, Shigella flexneri 2a str. 301
acaucucaacaac

SEQ ID NO: 3883819 - RNA, 24 nt, Shigella flexneri 2a str. 301
acaucucaacaacuuuaccgcuca

SEQ ID NO: 3883820 - RNA, 12 nt, Shigella flexneri 2a str. 301
acaucucuuccc

SEQ ID NO: 3883821 - RNA, 19 nt, Shigella flexneri 2a str. 301
acaucuggcgagucaccau

SEQ ID NO: 3883822 - RNA, 19 nt, Shigella flexneri 2a str. 301
acaucugucugauaaaaaa

SEQ ID NO: 3883823 - RNA, 14 nt, Shigella flexneri 2a str. 301
acaucuucaucauc

SEQ ID NO: 3883824 - RNA, 14 nt, Shigella flexneri 2a str. 301
acaucuuccagaau

SEQ ID NO: 3883825 - RNA, 15 nt, Shigella flexneri 2a str. 301
acaucuuugcggcua

SEQ ID NO: 3883826 - RNA, 15 nt, Shigella flexneri 2a str. 301
acaugaaacagaaaa

SEQ ID NO: 3883827 - RNA, 21 nt, Shigella flexneri 2a str. 301
acaugaaccgugucgccauca

SEQ ID NO: 3883828 - RNA, 16 nt, Shigella flexneri 2a str. 301
acaugaagcacugcau

SEQ ID NO: 3883829 - RNA, 23 nt, Shigella flexneri 2a str. 301
acaugaaugaugauuugguggcc

SEQ ID NO: 3883830 - RNA, 15 nt, Shigella flexneri 2a str. 301
acaugacgcgcauca

SEQ ID NO: 3883831 - RNA, 17 nt, Shigella flexneri 2a str. 301
acaugacuaaucugaca

SEQ ID NO: 3883832 - RNA, 15 nt, Shigella flexneri 2a str. 301
acaugagaacaguuc

SEQ ID NO: 3883833 - RNA, 19 nt, Shigella flexneri 2a str. 301
acaugagaacaguucagca

SEQ ID NO: 3883834 - RNA, 12 nt, Shigella flexneri 2a str. 301
acaugagagaaa

SEQ ID NO: 3883835 - RNA, 16 nt, Shigella flexneri 2a str. 301
acaugaguugcuggac

SEQ ID NO: 3883836 - RNA, 17 nt, Shigella flexneri 2a str. 301
acaugaugaucuuauga

SEQ ID NO: 3883837 - RNA, 23 nt, Shigella flexneri 2a str. 301
acaugaugaucuuaugauguaaa

SEQ ID NO: 3883838 - RNA, 17 nt, Shigella flexneri 2a str. 301
acaugaugauggcuauc

SEQ ID NO: 3883839 - RNA, 15 nt, Shigella flexneri 2a str. 301
acaugauguggaucg

SEQ ID NO: 3883840 - RNA, 21 nt, Shigella flexneri 2a str. 301
acaugauguggugcaaggaaa

SEQ ID NO: 3883841 - RNA, 18 nt, Shigella flexneri 2a str. 301
acaugcagcccagcauca

SEQ ID NO: 3883842 - RNA, 14 nt, Shigella flexneri 2a str. 301
acaugcagggcaaa

SEQ ID NO: 3883843 - RNA, 18 nt, Shigella flexneri 2a str. 301
acaugcauaaagcgguuu

SEQ ID NO: 3883844 - RNA, 15 nt, Shigella flexneri 2a str. 301
acaugccugcauaaa

SEQ ID NO: 3883845 - RNA, 12 nt, Shigella flexneri 2a str. 301
acaugcgauaaa

SEQ ID NO: 3883846 - RNA, 17 nt, Shigella flexneri 2a str. 301
acaugcgauaaagcaua

SEQ ID NO: 3883847 - RNA, 18 nt, Shigella flexneri 2a str. 301
acaugcgauaaagcauac

SEQ ID NO: 3883848 - RNA, 20 nt, Shigella flexneri 2a str. 301
acaugcgaucccacgccgaa

SEQ ID NO: 3883849 - RNA, 21 nt, Shigella flexneri 2a str. 301
acaugcgcgacaaaaauuacu

SEQ ID NO: 3883850 - RNA, 16 nt, Shigella flexneri 2a str. 301
acaugcuggaaccaca

SEQ ID NO: 3883851 - RNA, 13 nt, Shigella flexneri 2a str. 301
acaugcuguugga

SEQ ID NO: 3883852 - RNA, 22 nt, Shigella flexneri 2a str. 301
acaugcuucaggacuucuuugc

SEQ ID NO: 3883853 - RNA, 22 nt, Shigella flexneri 2a str. 301
acaugugccagcgauuuugcca

SEQ ID NO: 3883854 - RNA, 17 nt, Shigella flexneri 2a str. 301
acauguuaguugaagca

SEQ ID NO: 3883855 - RNA, 15 nt, Shigella flexneri 2a str. 301
acauguucaaaaaaa

SEQ ID NO: 3883856 - RNA, 13 nt, Shigella flexneri 2a str. 301
acauguucauuua

SEQ ID NO: 3883857 - RNA, 19 nt, Shigella flexneri 2a str. 301
acauguucggcgguuuuuu

SEQ ID NO: 3883858 - RNA, 16 nt, Shigella flexneri 2a str. 301
acauguugaaucuuca

SEQ ID NO: 3883859 - RNA, 23 nt, Shigella flexneri 2a str. 301
acauguugaaucuucaugcguuu

SEQ ID NO: 3883860 - RNA, 16 nt, Shigella flexneri 2a str. 301
acauguugaaucuucg

SEQ ID NO: 3883861 - RNA, 16 nt, Shigella flexneri 2a str. 301
acauguuuuccagcac

SEQ ID NO: 3883862 - RNA, 18 nt, Shigella flexneri 2a str. 301
acauguuuuccagcacau

SEQ ID NO: 3883863 - RNA, 21 nt, Shigella flexneri 2a str. 301
acauuaucgcgucuaaauuuu

SEQ ID NO: 3883864 - RNA, 13 nt, Shigella flexneri 2a str. 301
acauuauuaagaa

SEQ ID NO: 3883865 - RNA, 20 nt, Shigella flexneri 2a str. 301
acauuauuuuugcgacaguu

SEQ ID NO: 3883866 - RNA, 22 nt, Shigella flexneri 2a str. 301
acauucaauaacacauugcugu

SEQ ID NO: 3883867 - RNA, 14 nt, Shigella flexneri 2a str. 301
acauuccacuuuca

SEQ ID NO: 3883868 - RNA, 12 nt, Shigella flexneri 2a str. 301
acauucccauca

SEQ ID NO: 3883869 - RNA, 14 nt, Shigella flexneri 2a str. 301
acauucuccggcag

SEQ ID NO: 3883870 - RNA, 18 nt, Shigella flexneri 2a str. 301
acauugaaggauaagacg

SEQ ID NO: 3883871 - RNA, 21 nt, Shigella flexneri 2a str. 301
acauugacgauagcgccgcca

SEQ ID NO: 3883872 - RNA, 15 nt, Shigella flexneri 2a str. 301
acauugagcuugcgu

SEQ ID NO: 3883873 - RNA, 21 nt, Shigella flexneri 2a str. 301
acauugagcuuugacgaccuu

SEQ ID NO: 3883874 - RNA, 18 nt, Shigella flexneri 2a str. 301
acauugcaguggcgugcc

SEQ ID NO: 3883875 - RNA, 16 nt, Shigella flexneri 2a str. 301
acauugcaucugauaa

SEQ ID NO: 3883876 - RNA, 17 nt, Shigella flexneri 2a str. 301
acauugcaucugauaac

SEQ ID NO: 3883877 - RNA, 21 nt, Shigella flexneri 2a str. 301
acauugccguaagcaacgcca

SEQ ID NO: 3883878 - RNA, 15 nt, Shigella flexneri 2a str. 301
acauugcugcacauc

SEQ ID NO: 3883879 - RNA, 20 nt, Shigella flexneri 2a str. 301
acauugcuguaucacuauga

SEQ ID NO: 3883880 - RNA, 14 nt, Shigella flexneri 2a str. 301
acauugguaaucag

SEQ ID NO: 3883881 - RNA, 20 nt, Shigella flexneri 2a str. 301
acauuguuauucuccuucac

SEQ ID NO: 3883882 - RNA, 14 nt, Shigella flexneri 2a str. 301
acauuguuuuccag

SEQ ID NO: 3883883 - RNA, 21 nt, Shigella flexneri 2a str. 301
acauuuaccgcaacucauuua

SEQ ID NO: 3883884 - RNA, 19 nt, Shigella flexneri 2a str. 301
acauuucagaaaguauaua

SEQ ID NO: 3883885 - RNA, 14 nt, Shigella flexneri 2a str. 301
acauuucugcugcc

SEQ ID NO: 3883886 - RNA, 19 nt, Shigella flexneri 2a str. 301
acauuucugcugccuacac

SEQ ID NO: 3883887 - RNA, 12 nt, Shigella flexneri 2a str. 301
acauuucuuuug

SEQ ID NO: 3883888 - RNA, 20 nt, Shigella flexneri 2a str. 301
acauuugcggcgaacugccg

SEQ ID NO: 3883889 - RNA, 18 nt, Shigella flexneri 2a str. 301
acauuugcuuuuguuaau

SEQ ID NO: 3883890 - RNA, 12 nt, Shigella flexneri 2a str. 301
acauuuucucua

SEQ ID NO: 3883891 - RNA, 12 nt, Shigella flexneri 2a str. 301
acauuuugaccc

SEQ ID NO: 3883892 - RNA, 16 nt, Shigella flexneri 2a str. 301
accaaaaaaucaaugc

SEQ ID NO: 3883893 - RNA, 15 nt, Shigella flexneri 2a str. 301
accaaaaacgccaug

SEQ ID NO: 3883894 - RNA, 15 nt, Shigella flexneri 2a str. 301
accaaaacaccagcc

SEQ ID NO: 3883895 - RNA, 17 nt, Shigella flexneri 2a str. 301
accaaaacagcgacacc

SEQ ID NO: 3883896 - RNA, 12 nt, Shigella flexneri 2a str. 301
accaaaaucauc

SEQ ID NO: 3883897 - RNA, 16 nt, Shigella flexneri 2a str. 301
accaaaaucaucaauu

SEQ ID NO: 3883898 - RNA, 20 nt, Shigella flexneri 2a str. 301
accaaaaucaucaauugcca

SEQ ID NO: 3883899 - RNA, 14 nt, Shigella flexneri 2a str. 301
accaaacagcgcca

SEQ ID NO: 3883900 - RNA, 16 nt, Shigella flexneri 2a str. 301
accaaacuucagcccu

SEQ ID NO: 3883901 - RNA, 15 nt, Shigella flexneri 2a str. 301
accaaagaaugacac

SEQ ID NO: 3883902 - RNA, 21 nt, Shigella flexneri 2a str. 301
accaaagaaugacacuuucag

SEQ ID NO: 3883903 - RNA, 14 nt, Shigella flexneri 2a str. 301
accaaauaaacgaa

SEQ ID NO: 3883904 - RNA, 19 nt, Shigella flexneri 2a str. 301
accaaauaaacgaaucugc

SEQ ID NO: 3883905 - RNA, 13 nt, Shigella flexneri 2a str. 301
accaaauacacgc

SEQ ID NO: 3883906 - RNA, 12 nt, Shigella flexneri 2a str. 301
accaaaugacuc

SEQ ID NO: 3883907 - RNA, 18 nt, Shigella flexneri 2a str. 301
accaaauuccagaaaaga

SEQ ID NO: 3883908 - RNA, 14 nt, Shigella flexneri 2a str. 301
accaacaaagccac

SEQ ID NO: 3883909 - RNA, 22 nt, Shigella flexneri 2a str. 301
accaacaaauagagauagaaug

SEQ ID NO: 3883910 - RNA, 19 nt, Shigella flexneri 2a str. 301
accaacaauaaaauugagg

SEQ ID NO: 3883911 - RNA, 18 nt, Shigella flexneri 2a str. 301
accaacaauugucgccac

SEQ ID NO: 3883912 - RNA, 22 nt, Shigella flexneri 2a str. 301
accaacaguaucugaaucaaaa

SEQ ID NO: 3883913 - RNA, 13 nt, Shigella flexneri 2a str. 301
accaacaucacgc

SEQ ID NO: 3883914 - RNA, 13 nt, Shigella flexneri 2a str. 301
accaacgaggaga

SEQ ID NO: 3883915 - RNA, 13 nt, Shigella flexneri 2a str. 301
accaacgcacaca

SEQ ID NO: 3883916 - RNA, 23 nt, Shigella flexneri 2a str. 301
accaacgcaccggcuuguugccc

SEQ ID NO: 3883917 - RNA, 16 nt, Shigella flexneri 2a str. 301
accaacgcugccagcc

SEQ ID NO: 3883918 - RNA, 24 nt, Shigella flexneri 2a str. 301
accaacggacgagucgcuucaugc

SEQ ID NO: 3883919 - RNA, 23 nt, Shigella flexneri 2a str. 301
accaacggucgugcgagauaacc

SEQ ID NO: 3883920 - RNA, 14 nt, Shigella flexneri 2a str. 301
accaagaaagagaa

SEQ ID NO: 3883921 - RNA, 12 nt, Shigella flexneri 2a str. 301
accaagcagcau

SEQ ID NO: 3883922 - RNA, 14 nt, Shigella flexneri 2a str. 301
accaagcgauuaug

SEQ ID NO: 3883923 - RNA, 16 nt, Shigella flexneri 2a str. 301
accaagucucaagagu

SEQ ID NO: 3883924 - RNA, 16 nt, Shigella flexneri 2a str. 301
accaauaaacgccagg

SEQ ID NO: 3883925 - RNA, 17 nt, Shigella flexneri 2a str. 301
accaauaacgcuuuucu

SEQ ID NO: 3883926 - RNA, 14 nt, Shigella flexneri 2a str. 301
accaauaccaauga

SEQ ID NO: 3883927 - RNA, 18 nt, Shigella flexneri 2a str. 301
accaauaccgcccaccac

SEQ ID NO: 3883928 - RNA, 19 nt, Shigella flexneri 2a str. 301
accaauaccgcccaccacc

SEQ ID NO: 3883929 - RNA, 20 nt, Shigella flexneri 2a str. 301
accaauauaauuccauucac

SEQ ID NO: 3883930 - RNA, 16 nt, Shigella flexneri 2a str. 301
accaauaucaaauaaa

SEQ ID NO: 3883931 - RNA, 20 nt, Shigella flexneri 2a str. 301
accaauaucaaauaaaaagg

SEQ ID NO: 3883932 - RNA, 18 nt, Shigella flexneri 2a str. 301
accaauaucaacguaaug

SEQ ID NO: 3883933 - RNA, 14 nt, Shigella flexneri 2a str. 301
accaauauccugaa

SEQ ID NO: 3883934 - RNA, 15 nt, Shigella flexneri 2a str. 301
accaaucaccgccac

SEQ ID NO: 3883935 - RNA, 19 nt, Shigella flexneri 2a str. 301
accaaucaccgccagcaag

SEQ ID NO: 3883936 - RNA, 20 nt, Shigella flexneri 2a str. 301
accaaucaccgccagcaagg

SEQ ID NO: 3883937 - RNA, 21 nt, Shigella flexneri 2a str. 301
accaaucaccgccagcaaggc

SEQ ID NO: 3883938 - RNA, 13 nt, Shigella flexneri 2a str. 301
accaauccagccg

SEQ ID NO: 3883939 - RNA, 14 nt, Shigella flexneri 2a str. 301
accaauccagccgg

SEQ ID NO: 3883940 - RNA, 23 nt, Shigella flexneri 2a str. 301
accaaucgcaauaccggcaaaga

SEQ ID NO: 3883941 - RNA, 20 nt, Shigella flexneri 2a str. 301
accaaucgcggcgauaucca

SEQ ID NO: 3883942 - RNA, 16 nt, Shigella flexneri 2a str. 301
accaaucucccagccg

SEQ ID NO: 3883943 - RNA, 17 nt, Shigella flexneri 2a str. 301
accaaucucccagccgg

SEQ ID NO: 3883944 - RNA, 17 nt, Shigella flexneri 2a str. 301
accaaugacguuaauaa

SEQ ID NO: 3883945 - RNA, 14 nt, Shigella flexneri 2a str. 301
accaaugccgcggc

SEQ ID NO: 3883946 - RNA, 16 nt, Shigella flexneri 2a str. 301
accaaugucgaaagcc

SEQ ID NO: 3883947 - RNA, 22 nt, Shigella flexneri 2a str. 301
accacaaacucuuuuccggaac

SEQ ID NO: 3883948 - RNA, 21 nt, Shigella flexneri 2a str. 301
accacaccggaccagacgauc

SEQ ID NO: 3883949 - RNA, 15 nt, Shigella flexneri 2a str. 301
accacacgaauucca

SEQ ID NO: 3883950 - RNA, 14 nt, Shigella flexneri 2a str. 301
accacacuucuuca

SEQ ID NO: 3883951 - RNA, 17 nt, Shigella flexneri 2a str. 301
accacagacaaucgcca

SEQ ID NO: 3883952 - RNA, 20 nt, Shigella flexneri 2a str. 301
accacaggccggagccagcc

SEQ ID NO: 3883953 - RNA, 13 nt, Shigella flexneri 2a str. 301
accagcaucaaca

SEQ ID NO: 3883954 - RNA, 17 nt, Shigella flexneri 2a str. 301
accagcaucaacaacaa

SEQ ID NO: 3883955 - RNA, 23 nt, Shigella flexneri 2a str. 301
accagcaucaacaacaauuucac

SEQ ID NO: 3883956 - RNA, 17 nt, Shigella flexneri 2a str. 301
accagcaucccggcagc

SEQ ID NO: 3883957 - RNA, 18 nt, Shigella flexneri 2a str. 301
accagcaugaucagcgca

SEQ ID NO: 3883958 - RNA, 19 nt, Shigella flexneri 2a str. 301
accagcaugaucagcgcau

SEQ ID NO: 3883959 - RNA, 17 nt, Shigella flexneri 2a str. 301
accagccagaauuaccc

SEQ ID NO: 3883960 - RNA, 15 nt, Shigella flexneri 2a str. 301
accagccagcgcuga

SEQ ID NO: 3883961 - RNA, 16 nt, Shigella flexneri 2a str. 301
accagccaggccgcca

SEQ ID NO: 3883962 - RNA, 17 nt, Shigella flexneri 2a str. 301
accagccaggccgccag

SEQ ID NO: 3883963 - RNA, 19 nt, Shigella flexneri 2a str. 301
accagccauuaaccagcca

SEQ ID NO: 3883964 - RNA, 20 nt, Shigella flexneri 2a str. 301
accagccgcgacaucuucuc

SEQ ID NO: 3883965 - RNA, 22 nt, Shigella flexneri 2a str. 301
accagccgcuaccagcgcggca

SEQ ID NO: 3883966 - RNA, 23 nt, Shigella flexneri 2a str. 301
accagccguugucagucaucacu

SEQ ID NO: 3883967 - RNA, 20 nt, Shigella flexneri 2a str. 301
accagccuggcggaaagcca

SEQ ID NO: 3883968 - RNA, 15 nt, Shigella flexneri 2a str. 301
accagccuucuucau

SEQ ID NO: 3883969 - RNA, 12 nt, Shigella flexneri 2a str. 301
accagccuugcc

SEQ ID NO: 3883970 - RNA, 20 nt, Shigella flexneri 2a str. 301
accagcgaaaucaccgccac

SEQ ID NO: 3883971 - RNA, 22 nt, Shigella flexneri 2a str. 301
accagcgaaaucaccgccacca

SEQ ID NO: 3883972 - RNA, 22 nt, Shigella flexneri 2a str. 301
accagcgaauggguaaaaccgc

SEQ ID NO: 3883973 - RNA, 13 nt, Shigella flexneri 2a str. 301
accagcgacauca

SEQ ID NO: 3883974 - RNA, 19 nt, Shigella flexneri 2a str. 301
accagcgacggaugacacg

SEQ ID NO: 3883975 - RNA, 18 nt, Shigella flexneri 2a str. 301
accagcgaggucaaaauc

SEQ ID NO: 3883976 - RNA, 20 nt, Shigella flexneri 2a str. 301
accagcgcagauagcccgga

SEQ ID NO: 3883977 - RNA, 18 nt, Shigella flexneri 2a str. 301
accagcgccuggcugauu

SEQ ID NO: 3883978 - RNA, 22 nt, Shigella flexneri 2a str. 301
accagcgcggcgauaaugccca

SEQ ID NO: 3883979 - RNA, 14 nt, Shigella flexneri 2a str. 301
accagcgucagcca

SEQ ID NO: 3883980 - RNA, 16 nt, Shigella flexneri 2a str. 301
accagcgucaucggau

SEQ ID NO: 3883981 - RNA, 19 nt, Shigella flexneri 2a str. 301
accagcgucgcaucaggca

SEQ ID NO: 3883982 - RNA, 13 nt, Shigella flexneri 2a str. 301
accagcguuucca

SEQ ID NO: 3883983 - RNA, 17 nt, Shigella flexneri 2a str. 301
accagcguuuccagcac

SEQ ID NO: 3883984 - RNA, 11 nt, Shigella flexneri 2a str. 301
accagcugccg

SEQ ID NO: 3883985 - RNA, 23 nt, Shigella flexneri 2a str. 301
accagcuuucgcuuaacgcccau

SEQ ID NO: 3883986 - RNA, 14 nt, Shigella flexneri 2a str. 301
accaggaaacccaa

SEQ ID NO: 3883987 - RNA, 20 nt, Shigella flexneri 2a str. 301
accaggaagcgacccgguuc

SEQ ID NO: 3883988 - RNA, 18 nt, Shigella flexneri 2a str. 301
accaggccaucagcagcg

SEQ ID NO: 3883989 - RNA, 18 nt, Shigella flexneri 2a str. 301
accaggcgaccguuuuca

SEQ ID NO: 3883990 - RNA, 19 nt, Shigella flexneri 2a str. 301
accaggcgaccguuuucac

SEQ ID NO: 3883991 - RNA, 20 nt, Shigella flexneri 2a str. 301
accaggcggauaauuucacu

SEQ ID NO: 3883992 - RNA, 19 nt, Shigella flexneri 2a str. 301
accaggcguuuacccuucg

SEQ ID NO: 3883993 - RNA, 20 nt, Shigella flexneri 2a str. 301
accaggcucuuuaaacaguu

SEQ ID NO: 3883994 - RNA, 17 nt, Shigella flexneri 2a str. 301
accagggcgucaccuug

SEQ ID NO: 3883995 - RNA, 15 nt, Shigella flexneri 2a str. 301
accagguucaacagc

SEQ ID NO: 3883996 - RNA, 14 nt, Shigella flexneri 2a str. 301
accaguaccauuuu

SEQ ID NO: 3883997 - RNA, 16 nt, Shigella flexneri 2a str. 301
accaguaccgccacca

SEQ ID NO: 3883998 - RNA, 22 nt, Shigella flexneri 2a str. 301
accaguaccgccgccauaaaca

SEQ ID NO: 3883999 - RNA, 18 nt, Shigella flexneri 2a str. 301
accaguacgcccacgcca

SEQ ID NO: 3884000 - RNA, 19 nt, Shigella flexneri 2a str. 301
accaguacgcccacgccag

SEQ ID NO: 3884001 - RNA, 23 nt, Shigella flexneri 2a str. 301
accagucagcgaacaccagcagu

SEQ ID NO: 3884002 - RNA, 14 nt, Shigella flexneri 2a str. 301
accaguccacccac

SEQ ID NO: 3884003 - RNA, 16 nt, Shigella flexneri 2a str. 301
accaguccaucggcau

SEQ ID NO: 3884004 - RNA, 23 nt, Shigella flexneri 2a str. 301
accaguccugugacucaaugaaa

SEQ ID NO: 3884005 - RNA, 16 nt, Shigella flexneri 2a str. 301
accagucgcugacacu

SEQ ID NO: 3884006 - RNA, 20 nt, Shigella flexneri 2a str. 301
accagugcaggcaccagccc

SEQ ID NO: 3884007 - RNA, 20 nt, Shigella flexneri 2a str. 301
accagugcggauaccaccag

SEQ ID NO: 3884008 - RNA, 17 nt, Shigella flexneri 2a str. 301
accagugguaagaggaa

SEQ ID NO: 3884009 - RNA, 19 nt, Shigella flexneri 2a str. 301
accaguucacaccagccac

SEQ ID NO: 3884010 - RNA, 16 nt, Shigella flexneri 2a str. 301
accaguugcuccagca

SEQ ID NO: 3884011 - RNA, 19 nt, Shigella flexneri 2a str. 301
accaguugcuccagcaaua

SEQ ID NO: 3884012 - RNA, 21 nt, Shigella flexneri 2a str. 301
accauaaaacaaauccgcuug

SEQ ID NO: 3884013 - RNA, 20 nt, Shigella flexneri 2a str. 301
accauaaauccaacaacaca

SEQ ID NO: 3884014 - RNA, 15 nt, Shigella flexneri 2a str. 301
accauaaauuucacg

SEQ ID NO: 3884015 - RNA, 20 nt, Shigella flexneri 2a str. 301
accauaacccgcuuccagaa

SEQ ID NO: 3884016 - RNA, 18 nt, Shigella flexneri 2a str. 301
accauaaucucaucagcg

SEQ ID NO: 3884017 - RNA, 19 nt, Shigella flexneri 2a str. 301
accauaaucucaucagcgu

SEQ ID NO: 3884018 - RNA, 15 nt, Shigella flexneri 2a str. 301
accauacagcagcaa

SEQ ID NO: 3884019 - RNA, 16 nt, Shigella flexneri 2a str. 301
accauacagcagcaac

SEQ ID NO: 3884020 - RNA, 19 nt, Shigella flexneri 2a str. 301
accauacagcagcaacgau

SEQ ID NO: 3884021 - RNA, 15 nt, Shigella flexneri 2a str. 301
accauagcaucccaa

SEQ ID NO: 3884022 - RNA, 16 nt, Shigella flexneri 2a str. 301
accauauagcgcacau

SEQ ID NO: 3884023 - RNA, 20 nt, Shigella flexneri 2a str. 301
accauauaugauaauuauua

SEQ ID NO: 3884024 - RNA, 21 nt, Shigella flexneri 2a str. 301
accauauaugauaauuauuau

SEQ ID NO: 3884025 - RNA, 18 nt, Shigella flexneri 2a str. 301
accauauguguuugugcc

SEQ ID NO: 3884026 - RNA, 15 nt, Shigella flexneri 2a str. 301
accauauucagcagc

SEQ ID NO: 3884027 - RNA, 18 nt, Shigella flexneri 2a str. 301
accaucaacaaacgccag

SEQ ID NO: 3884028 - RNA, 22 nt, Shigella flexneri 2a str. 301
accaucaaguagcagguaaucu

SEQ ID NO: 3884029 - RNA, 11 nt, Shigella flexneri 2a str. 301
accaucaaucc

SEQ ID NO: 3884030 - RNA, 22 nt, Shigella flexneri 2a str. 301
accaucaauccacuucgccaga

SEQ ID NO: 3884031 - RNA, 23 nt, Shigella flexneri 2a str. 301
accaucaauggcugcaaagcauu

SEQ ID NO: 3884032 - RNA, 13 nt, Shigella flexneri 2a str. 301
accaucaccucuu

SEQ ID NO: 3884033 - RNA, 13 nt, Shigella flexneri 2a str. 301
accaucagcauga

SEQ ID NO: 3884034 - RNA, 20 nt, Shigella flexneri 2a str. 301
accaucagcugccagggcac

SEQ ID NO: 3884035 - RNA, 19 nt, Shigella flexneri 2a str. 301
accaucaggaugacaaacu

SEQ ID NO: 3884036 - RNA, 16 nt, Shigella flexneri 2a str. 301
accaucauaccgauca

SEQ ID NO: 3884037 - RNA, 21 nt, Shigella flexneri 2a str. 301
accaucauaccgaucaccgau

SEQ ID NO: 3884038 - RNA, 13 nt, Shigella flexneri 2a str. 301
accauccaggaga

SEQ ID NO: 3884039 - RNA, 14 nt, Shigella flexneri 2a str. 301
accauccaggagau

SEQ ID NO: 3884040 - RNA, 11 nt, Shigella flexneri 2a str. 301
accauccauac

SEQ ID NO: 3884041 - RNA, 16 nt, Shigella flexneri 2a str. 301
accauccauucagugc

SEQ ID NO: 3884042 - RNA, 15 nt, Shigella flexneri 2a str. 301
accauccauuuuuca

SEQ ID NO: 3884043 - RNA, 16 nt, Shigella flexneri 2a str. 301
accaucccaccaccag

SEQ ID NO: 3884044 - RNA, 18 nt, Shigella flexneri 2a str. 301
accauccgcucacugaua

SEQ ID NO: 3884045 - RNA, 12 nt, Shigella flexneri 2a str. 301
accauccggcau

SEQ ID NO: 3884046 - RNA, 14 nt, Shigella flexneri 2a str. 301
accauccugcuccu

SEQ ID NO: 3884047 - RNA, 14 nt, Shigella flexneri 2a str. 301
accaucgccagccc

SEQ ID NO: 3884048 - RNA, 16 nt, Shigella flexneri 2a str. 301
accaucgccauuuaac

SEQ ID NO: 3884049 - RNA, 21 nt, Shigella flexneri 2a str. 301
accaucgcuacauaacgcagc

SEQ ID NO: 3884050 - RNA, 16 nt, Shigella flexneri 2a str. 301
accaucggcagcgcca

SEQ ID NO: 3884051 - RNA, 17 nt, Shigella flexneri 2a str. 301
accaucguaagcgccag

SEQ ID NO: 3884052 - RNA, 16 nt, Shigella flexneri 2a str. 301
accaucugcgccgcca

SEQ ID NO: 3884053 - RNA, 21 nt, Shigella flexneri 2a str. 301
accgcaucggcaucaaaccau

SEQ ID NO: 3884054 - RNA, 22 nt, Shigella flexneri 2a str. 301
accgcaucggcaucaaaccauu

SEQ ID NO: 3884055 - RNA, 15 nt, Shigella flexneri 2a str. 301
accgcauugagggca

SEQ ID NO: 3884056 - RNA, 17 nt, Shigella flexneri 2a str. 301
accgcauugagggcauu

SEQ ID NO: 3884057 - RNA, 19 nt, Shigella flexneri 2a str. 301
accgcauuggacagauuca

SEQ ID NO: 3884058 - RNA, 16 nt, Shigella flexneri 2a str. 301
accgccaaagauaaaa

SEQ ID NO: 3884059 - RNA, 13 nt, Shigella flexneri 2a str. 301
accgccagcaagg

SEQ ID NO: 3884060 - RNA, 15 nt, Shigella flexneri 2a str. 301
accgccagcaggaac

SEQ ID NO: 3884061 - RNA, 13 nt, Shigella flexneri 2a str. 301
accgccagcggcg

SEQ ID NO: 3884062 - RNA, 15 nt, Shigella flexneri 2a str. 301
accgccagugcagcg

SEQ ID NO: 3884063 - RNA, 20 nt, Shigella flexneri 2a str. 301
accgccaguguggcggcuaa

SEQ ID NO: 3884064 - RNA, 15 nt, Shigella flexneri 2a str. 301
accgccaucauggau

SEQ ID NO: 3884065 - RNA, 16 nt, Shigella flexneri 2a str. 301
accgccaucauggaug

SEQ ID NO: 3884066 - RNA, 20 nt, Shigella flexneri 2a str. 301
accgcccagugccagcacca

SEQ ID NO: 3884067 - RNA, 22 nt, Shigella flexneri 2a str. 301
accgcccagugcggugccgcga

SEQ ID NO: 3884068 - RNA, 15 nt, Shigella flexneri 2a str. 301
accgccgaggaacau

SEQ ID NO: 3884069 - RNA, 21 nt, Shigella flexneri 2a str. 301
accgccgauuuccugcgucgc

SEQ ID NO: 3884070 - RNA, 15 nt, Shigella flexneri 2a str. 301
accgccgccgcuucu

SEQ ID NO: 3884071 - RNA, 21 nt, Shigella flexneri 2a str. 301
accgccgcuccagaaucucaa

SEQ ID NO: 3884072 - RNA, 17 nt, Shigella flexneri 2a str. 301
accgccuaccauaauca

SEQ ID NO: 3884073 - RNA, 20 nt, Shigella flexneri 2a str. 301
accgccuccaccugaggggc

SEQ ID NO: 3884074 - RNA, 17 nt, Shigella flexneri 2a str. 301
accgccugauaacgaau

SEQ ID NO: 3884075 - RNA, 16 nt, Shigella flexneri 2a str. 301
accgccugcaaauaaa

SEQ ID NO: 3884076 - RNA, 16 nt, Shigella flexneri 2a str. 301
accgccuggcgcugcu

SEQ ID NO: 3884077 - RNA, 17 nt, Shigella flexneri 2a str. 301
accgcgaaauaaucaaa

SEQ ID NO: 3884078 - RNA, 13 nt, Shigella flexneri 2a str. 301
accgcgaagaaca

SEQ ID NO: 3884079 - RNA, 15 nt, Shigella flexneri 2a str. 301
accgcgacaguauca

SEQ ID NO: 3884080 - RNA, 22 nt, Shigella flexneri 2a str. 301
accgcgaggccuaacaccauca

SEQ ID NO: 3884081 - RNA, 14 nt, Shigella flexneri 2a str. 301
accgcgaucuucca

SEQ ID NO: 3884082 - RNA, 15 nt, Shigella flexneri 2a str. 301
accgcgaucuuccac

SEQ ID NO: 3884083 - RNA, 17 nt, Shigella flexneri 2a str. 301
accgcgcagcgggcauu

SEQ ID NO: 3884084 - RNA, 17 nt, Shigella flexneri 2a str. 301
accgcgccauguugccu

SEQ ID NO: 3884085 - RNA, 14 nt, Shigella flexneri 2a str. 301
accgcgcucagcca

SEQ ID NO: 3884086 - RNA, 17 nt, Shigella flexneri 2a str. 301
accgcgcucagccagcc

SEQ ID NO: 3884087 - RNA, 16 nt, Shigella flexneri 2a str. 301
accgcguaauacauca

SEQ ID NO: 3884088 - RNA, 15 nt, Shigella flexneri 2a str. 301
accgcguagcaucug

SEQ ID NO: 3884089 - RNA, 15 nt, Shigella flexneri 2a str. 301
accgcguaugcccag

SEQ ID NO: 3884090 - RNA, 21 nt, Shigella flexneri 2a str. 301
accgcguaugcccagcgcaga

SEQ ID NO: 3884091 - RNA, 19 nt, Shigella flexneri 2a str. 301
accgcguuuugucgcgcca

SEQ ID NO: 3884092 - RNA, 15 nt, Shigella flexneri 2a str. 301
accgcuacuggcaau

SEQ ID NO: 3884093 - RNA, 21 nt, Shigella flexneri 2a str. 301
accgcuauuugcgccuggauu

SEQ ID NO: 3884094 - RNA, 12 nt, Shigella flexneri 2a str. 301
accgcuccgcca

SEQ ID NO: 3884095 - RNA, 13 nt, Shigella flexneri 2a str. 301
accgcucgcgcuu

SEQ ID NO: 3884096 - RNA, 22 nt, Shigella flexneri 2a str. 301
accgcucuucauacgcggcaga

SEQ ID NO: 3884097 - RNA, 15 nt, Shigella flexneri 2a str. 301
accgcugacggcagc

SEQ ID NO: 3884098 - RNA, 21 nt, Shigella flexneri 2a str. 301
accgcugcuuaauuacugccu

SEQ ID NO: 3884099 - RNA, 23 nt, Shigella flexneri 2a str. 301
accgcugcuuaauuacugccuua

SEQ ID NO: 3884100 - RNA, 20 nt, Shigella flexneri 2a str. 301
accgcuucaacagcggcauu

SEQ ID NO: 3884101 - RNA, 12 nt, Shigella flexneri 2a str. 301
accgcuucccuu

SEQ ID NO: 3884102 - RNA, 12 nt, Shigella flexneri 2a str. 301
accgcuuggcga

SEQ ID NO: 3884103 - RNA, 12 nt, Shigella flexneri 2a str. 301
accgcuuuucca

SEQ ID NO: 3884104 - RNA, 21 nt, Shigella flexneri 2a str. 301
accgcuuuuccagcauaaugu

SEQ ID NO: 3884105 - RNA, 20 nt, Shigella flexneri 2a str. 301
accgcuuuuucaauuuccag

SEQ ID NO: 3884106 - RNA, 22 nt, Shigella flexneri 2a str. 301
accggaaaaggcguucacgccg

SEQ ID NO: 3884107 - RNA, 13 nt, Shigella flexneri 2a str. 301
accggaacaucac

SEQ ID NO: 3884108 - RNA, 16 nt, Shigella flexneri 2a str. 301
accggaacaucaccaa

SEQ ID NO: 3884109 - RNA, 12 nt, Shigella flexneri 2a str. 301
accggaacccac

SEQ ID NO: 3884110 - RNA, 14 nt, Shigella flexneri 2a str. 301
accggaacccaccg

SEQ ID NO: 3884111 - RNA, 16 nt, Shigella flexneri 2a str. 301
accggacgacggcauc

SEQ ID NO: 3884112 - RNA, 24 nt, Shigella flexneri 2a str. 301
accggauaaauuuaaaacugccug

SEQ ID NO: 3884113 - RNA, 16 nt, Shigella flexneri 2a str. 301
accggauaugcgggga

SEQ ID NO: 3884114 - RNA, 15 nt, Shigella flexneri 2a str. 301
accggcaaccagcac

SEQ ID NO: 3884115 - RNA, 13 nt, Shigella flexneri 2a str. 301
accggcacccaau

SEQ ID NO: 3884116 - RNA, 19 nt, Shigella flexneri 2a str. 301
accggcacuucaacuucgc

SEQ ID NO: 3884117 - RNA, 14 nt, Shigella flexneri 2a str. 301
accggcaggugacu

SEQ ID NO: 3884118 - RNA, 19 nt, Shigella flexneri 2a str. 301
accggcauauccaccaccc

SEQ ID NO: 3884119 - RNA, 18 nt, Shigella flexneri 2a str. 301
accggcguaacggccacg

SEQ ID NO: 3884120 - RNA, 18 nt, Shigella flexneri 2a str. 301
accggcuucucgccuacc

SEQ ID NO: 3884121 - RNA, 16 nt, Shigella flexneri 2a str. 301
accgggaagauccagg

SEQ ID NO: 3884122 - RNA, 14 nt, Shigella flexneri 2a str. 301
accgggaugcugau

SEQ ID NO: 3884123 - RNA, 14 nt, Shigella flexneri 2a str. 301
accgggcaguacca

SEQ ID NO: 3884124 - RNA, 17 nt, Shigella flexneri 2a str. 301
accgggcguccugcuug

SEQ ID NO: 3884125 - RNA, 23 nt, Shigella flexneri 2a str. 301
accgggugguaauaccacccggu

SEQ ID NO: 3884126 - RNA, 15 nt, Shigella flexneri 2a str. 301
accgguaaagaagag

SEQ ID NO: 3884127 - RNA, 19 nt, Shigella flexneri 2a str. 301
accgguaaagaagagcggc

SEQ ID NO: 3884128 - RNA, 20 nt, Shigella flexneri 2a str. 301
accgguaaagaagagcggca

SEQ ID NO: 3884129 - RNA, 20 nt, Shigella flexneri 2a str. 301
accggucccuucaaucucaa

SEQ ID NO: 3884130 - RNA, 18 nt, Shigella flexneri 2a str. 301
accggugcggcagcccau

SEQ ID NO: 3884131 - RNA, 19 nt, Shigella flexneri 2a str. 301
accgguuacggaucucccg

SEQ ID NO: 3884132 - RNA, 22 nt, Shigella flexneri 2a str. 301
accgguucggacauguuuucca

SEQ ID NO: 3884133 - RNA, 19 nt, Shigella flexneri 2a str. 301
accgguuucaauccaggua

SEQ ID NO: 3884134 - RNA, 15 nt, Shigella flexneri 2a str. 301
accguaaaagccugg

SEQ ID NO: 3884135 - RNA, 18 nt, Shigella flexneri 2a str. 301
accguaaacccuaacauc

SEQ ID NO: 3884136 - RNA, 17 nt, Shigella flexneri 2a str. 301
accguacaaccaaaucu

SEQ ID NO: 3884137 - RNA, 18 nt, Shigella flexneri 2a str. 301
accguacauugccgggcg

SEQ ID NO: 3884138 - RNA, 13 nt, Shigella flexneri 2a str. 301
accguaccggcac

SEQ ID NO: 3884139 - RNA, 17 nt, Shigella flexneri 2a str. 301
accguacgcaucaccag

SEQ ID NO: 3884140 - RNA, 19 nt, Shigella flexneri 2a str. 301
accguacgcaucaccagac

SEQ ID NO: 3884141 - RNA, 12 nt, Shigella flexneri 2a str. 301
accguaggccgg

SEQ ID NO: 3884142 - RNA, 15 nt, Shigella flexneri 2a str. 301
accguaguccauacc

SEQ ID NO: 3884143 - RNA, 22 nt, Shigella flexneri 2a str. 301
accguaguccauacccagcauc

SEQ ID NO: 3884144 - RNA, 20 nt, Shigella flexneri 2a str. 301
accguaucccccagagcaaa

SEQ ID NO: 3884145 - RNA, 20 nt, Shigella flexneri 2a str. 301
accguaucuucauugugcgg

SEQ ID NO: 3884146 - RNA, 11 nt, Shigella flexneri 2a str. 301
accguauuuug

SEQ ID NO: 3884147 - RNA, 15 nt, Shigella flexneri 2a str. 301
accgucaaacacagc

SEQ ID NO: 3884148 - RNA, 18 nt, Shigella flexneri 2a str. 301
accgucaaacacagcacu

SEQ ID NO: 3884149 - RNA, 20 nt, Shigella flexneri 2a str. 301
accgucaccccauugaagaa

SEQ ID NO: 3884150 - RNA, 16 nt, Shigella flexneri 2a str. 301
accgucagauccgcca

SEQ ID NO: 3884151 - RNA, 18 nt, Shigella flexneri 2a str. 301
accgucagauccgccagu

SEQ ID NO: 3884152 - RNA, 14 nt, Shigella flexneri 2a str. 301
accgucagcaccag

SEQ ID NO: 3884153 - RNA, 12 nt, Shigella flexneri 2a str. 301
accgucagccug

SEQ ID NO: 3884154 - RNA, 13 nt, Shigella flexneri 2a str. 301
accgucagccuga

SEQ ID NO: 3884155 - RNA, 15 nt, Shigella flexneri 2a str. 301
accgucaucgacaaa

SEQ ID NO: 3884156 - RNA, 13 nt, Shigella flexneri 2a str. 301
accguccucacug

SEQ ID NO: 3884157 - RNA, 14 nt, Shigella flexneri 2a str. 301
accguccucacugu

SEQ ID NO: 3884158 - RNA, 17 nt, Shigella flexneri 2a str. 301
accguccucuucccaga

SEQ ID NO: 3884159 - RNA, 20 nt, Shigella flexneri 2a str. 301
accguccucuucccagaccc

SEQ ID NO: 3884160 - RNA, 22 nt, Shigella flexneri 2a str. 301
accguccucuucccagacccag

SEQ ID NO: 3884161 - RNA, 14 nt, Shigella flexneri 2a str. 301
accgucgaugaaag

SEQ ID NO: 3884162 - RNA, 16 nt, Shigella flexneri 2a str. 301
accgucucugcgcccu

SEQ ID NO: 3884163 - RNA, 20 nt, Shigella flexneri 2a str. 301
accgucuggcagauccugaa

SEQ ID NO: 3884164 - RNA, 23 nt, Shigella flexneri 2a str. 301
accgucuggcagauccugaaauu

SEQ ID NO: 3884165 - RNA, 23 nt, Shigella flexneri 2a str. 301
accgucugugugccugucgggac

SEQ ID NO: 3884166 - RNA, 20 nt, Shigella flexneri 2a str. 301
accgucuucccgcagccacg

SEQ ID NO: 3884167 - RNA, 14 nt, Shigella flexneri 2a str. 301
accgugauccgccg

SEQ ID NO: 3884168 - RNA, 18 nt, Shigella flexneri 2a str. 301
accgugaucguggccaug

SEQ ID NO: 3884169 - RNA, 21 nt, Shigella flexneri 2a str. 301
accgugcgggcgaaagcagaa

SEQ ID NO: 3884170 - RNA, 23 nt, Shigella flexneri 2a str. 301
accgugcugacucagcggcugcc

SEQ ID NO: 3884171 - RNA, 20 nt, Shigella flexneri 2a str. 301
accgugggaaacaguaagca

SEQ ID NO: 3884172 - RNA, 16 nt, Shigella flexneri 2a str. 301
accgugguugcgccug

SEQ ID NO: 3884173 - RNA, 13 nt, Shigella flexneri 2a str. 301
accguuaaaacca

SEQ ID NO: 3884174 - RNA, 15 nt, Shigella flexneri 2a str. 301
accguuccauucaaa

SEQ ID NO: 3884175 - RNA, 22 nt, Shigella flexneri 2a str. 301
accguucgccaggucagagagc

SEQ ID NO: 3884176 - RNA, 15 nt, Shigella flexneri 2a str. 301
accguuggccugaua

SEQ ID NO: 3884177 - RNA, 21 nt, Shigella flexneri 2a str. 301
accguuuacgucauuaccgcg

SEQ ID NO: 3884178 - RNA, 19 nt, Shigella flexneri 2a str. 301
accguuucuuugccgagga

SEQ ID NO: 3884179 - RNA, 22 nt, Shigella flexneri 2a str. 301
accguuucuuugccgaggaaga

SEQ ID NO: 3884180 - RNA, 18 nt, Shigella flexneri 2a str. 301
accguuugauugaaaaau

SEQ ID NO: 3884181 - RNA, 22 nt, Shigella flexneri 2a str. 301
accguuugccccggcugcgcga

SEQ ID NO: 3884182 - RNA, 23 nt, Shigella flexneri 2a str. 301
accguuuugugcgcgugagcugg

SEQ ID NO: 3884183 - RNA, 18 nt, Shigella flexneri 2a str. 301
accuaaaguaaaggaaca

SEQ ID NO: 3884184 - RNA, 12 nt, Shigella flexneri 2a str. 301
accuaauuuuuu

SEQ ID NO: 3884185 - RNA, 17 nt, Shigella flexneri 2a str. 301
accuacaaaaccugcac

SEQ ID NO: 3884186 - RNA, 18 nt, Shigella flexneri 2a str. 301
accuacaaacguugcuga

SEQ ID NO: 3884187 - RNA, 19 nt, Shigella flexneri 2a str. 301
accuacgugcgcaauaacc

SEQ ID NO: 3884188 - RNA, 22 nt, Shigella flexneri 2a str. 301
accuaugccgaucaauuucaca

SEQ ID NO: 3884189 - RNA, 11 nt, Shigella flexneri 2a str. 301
accucaccgcu

SEQ ID NO: 3884190 - RNA, 13 nt, Shigella flexneri 2a str. 301
accucacugaaaa

SEQ ID NO: 3884191 - RNA, 12 nt, Shigella flexneri 2a str. 301
accucagcgaac

SEQ ID NO: 3884192 - RNA, 16 nt, Shigella flexneri 2a str. 301
accucaggaaaagcaa

SEQ ID NO: 3884193 - RNA, 17 nt, Shigella flexneri 2a str. 301
accucaggaaaagcaaa

SEQ ID NO: 3884194 - RNA, 19 nt, Shigella flexneri 2a str. 301
accucaggaaaagcaaaau

SEQ ID NO: 3884195 - RNA, 23 nt, Shigella flexneri 2a str. 301
accucaguacccgcguucuggau

SEQ ID NO: 3884196 - RNA, 21 nt, Shigella flexneri 2a str. 301
accucaucaccacagacaaac

SEQ ID NO: 3884197 - RNA, 15 nt, Shigella flexneri 2a str. 301
accuccacgcccagc

SEQ ID NO: 3884198 - RNA, 18 nt, Shigella flexneri 2a str. 301
accuccacgcccagcgca

SEQ ID NO: 3884199 - RNA, 20 nt, Shigella flexneri 2a str. 301
accuccagccugaugaugag

SEQ ID NO: 3884200 - RNA, 18 nt, Shigella flexneri 2a str. 301
accuccauguccagcuug

SEQ ID NO: 3884201 - RNA, 23 nt, Shigella flexneri 2a str. 301
accucccgucgcccacaccagau

SEQ ID NO: 3884202 - RNA, 16 nt, Shigella flexneri 2a str. 301
accuccgccucuuuca

SEQ ID NO: 3884203 - RNA, 18 nt, Shigella flexneri 2a str. 301
accuccggcguuucagau

SEQ ID NO: 3884204 - RNA, 15 nt, Shigella flexneri 2a str. 301
accuccguuuuucug

SEQ ID NO: 3884205 - RNA, 15 nt, Shigella flexneri 2a str. 301
accucgagaucauca

SEQ ID NO: 3884206 - RNA, 17 nt, Shigella flexneri 2a str. 301
accucgcccauuuuuca

SEQ ID NO: 3884207 - RNA, 23 nt, Shigella flexneri 2a str. 301
accucguccuguugaaaaaccag

SEQ ID NO: 3884208 - RNA, 12 nt, Shigella flexneri 2a str. 301
accucucaacgu

SEQ ID NO: 3884209 - RNA, 20 nt, Shigella flexneri 2a str. 301
accucuuaaugcaggcagca

SEQ ID NO: 3884210 - RNA, 11 nt, Shigella flexneri 2a str. 301
accucuuccag

SEQ ID NO: 3884211 - RNA, 19 nt, Shigella flexneri 2a str. 301
accucuuguaaauuuccca

SEQ ID NO: 3884212 - RNA, 13 nt, Shigella flexneri 2a str. 301
accucuuucuaga

SEQ ID NO: 3884213 - RNA, 14 nt, Shigella flexneri 2a str. 301
accugacauuaagu

SEQ ID NO: 3884214 - RNA, 13 nt, Shigella flexneri 2a str. 301
accugacugugac

SEQ ID NO: 3884215 - RNA, 19 nt, Shigella flexneri 2a str. 301
accugacuguuccagcacg

SEQ ID NO: 3884216 - RNA, 23 nt, Shigella flexneri 2a str. 301
accugagcuugauccuacacaua

SEQ ID NO: 3884217 - RNA, 13 nt, Shigella flexneri 2a str. 301
accugauccaucg

SEQ ID NO: 3884218 - RNA, 16 nt, Shigella flexneri 2a str. 301
accugauuacgcaccg

SEQ ID NO: 3884219 - RNA, 17 nt, Shigella flexneri 2a str. 301
accugcacgaaaccacu

SEQ ID NO: 3884220 - RNA, 22 nt, Shigella flexneri 2a str. 301
accugcacgaaaccacugcaac

SEQ ID NO: 3884221 - RNA, 20 nt, Shigella flexneri 2a str. 301
accugcaguucaucaacgcc

SEQ ID NO: 3884222 - RNA, 16 nt, Shigella flexneri 2a str. 301
accugcauuugcugca

SEQ ID NO: 3884223 - RNA, 19 nt, Shigella flexneri 2a str. 301
accugccagaacaaccaga

SEQ ID NO: 3884224 - RNA, 21 nt, Shigella flexneri 2a str. 301
accugccagcgccgacagcag

SEQ ID NO: 3884225 - RNA, 13 nt, Shigella flexneri 2a str. 301
accugccagggag

SEQ ID NO: 3884226 - RNA, 23 nt, Shigella flexneri 2a str. 301
accugccaggugagauccgggaa

SEQ ID NO: 3884227 - RNA, 19 nt, Shigella flexneri 2a str. 301
accugcccgguauccauca

SEQ ID NO: 3884228 - RNA, 15 nt, Shigella flexneri 2a str. 301
accugcccuccggua

SEQ ID NO: 3884229 - RNA, 16 nt, Shigella flexneri 2a str. 301
accugccgccaccaug

SEQ ID NO: 3884230 - RNA, 14 nt, Shigella flexneri 2a str. 301
accugccuggcagu

SEQ ID NO: 3884231 - RNA, 20 nt, Shigella flexneri 2a str. 301
accugcgcaggcauucagau

SEQ ID NO: 3884232 - RNA, 15 nt, Shigella flexneri 2a str. 301
accugcggugcagcc

SEQ ID NO: 3884233 - RNA, 16 nt, Shigella flexneri 2a str. 301
accugcggugcagccg

SEQ ID NO: 3884234 - RNA, 11 nt, Shigella flexneri 2a str. 301
accugcucagc

SEQ ID NO: 3884235 - RNA, 15 nt, Shigella flexneri 2a str. 301
accugcucgucaucc

SEQ ID NO: 3884236 - RNA, 17 nt, Shigella flexneri 2a str. 301
accugcucgucauccgc

SEQ ID NO: 3884237 - RNA, 21 nt, Shigella flexneri 2a str. 301
accugcugauuauccgcauca

SEQ ID NO: 3884238 - RNA, 23 nt, Shigella flexneri 2a str. 301
accugcugauuaucggcaucgcu

SEQ ID NO: 3884239 - RNA, 18 nt, Shigella flexneri 2a str. 301
accugcuggaaaggccgc

SEQ ID NO: 3884240 - RNA, 20 nt, Shigella flexneri 2a str. 301
accugcuggaaaggccgcga

SEQ ID NO: 3884241 - RNA, 22 nt, Shigella flexneri 2a str. 301
accugcuggacgcgccaacaaa

SEQ ID NO: 3884242 - RNA, 22 nt, Shigella flexneri 2a str. 301
accugcuuaaggcagaaacaaa

SEQ ID NO: 3884243 - RNA, 16 nt, Shigella flexneri 2a str. 301
accugcuuuguucagc

SEQ ID NO: 3884244 - RNA, 19 nt, Shigella flexneri 2a str. 301
accugcuuuguucagcccu

SEQ ID NO: 3884245 - RNA, 18 nt, Shigella flexneri 2a str. 301
accuggaaccaggcgcga

SEQ ID NO: 3884246 - RNA, 16 nt, Shigella flexneri 2a str. 301
accuggauauugcgga

SEQ ID NO: 3884247 - RNA, 14 nt, Shigella flexneri 2a str. 301
accuggauugccug

SEQ ID NO: 3884248 - RNA, 14 nt, Shigella flexneri 2a str. 301
accuggccugggau

SEQ ID NO: 3884249 - RNA, 22 nt, Shigella flexneri 2a str. 301
accuggccugggaucaucagca

SEQ ID NO: 3884250 - RNA, 17 nt, Shigella flexneri 2a str. 301
accuggcgcaguggaua

SEQ ID NO: 3884251 - RNA, 16 nt, Shigella flexneri 2a str. 301
accugguccuucaucu

SEQ ID NO: 3884252 - RNA, 16 nt, Shigella flexneri 2a str. 301
accuggugcagcggcu

SEQ ID NO: 3884253 - RNA, 18 nt, Shigella flexneri 2a str. 301
acgauacggcccagaccc

SEQ ID NO: 3884254 - RNA, 22 nt, Shigella flexneri 2a str. 301
acgauagauagagaaguaaccg

SEQ ID NO: 3884255 - RNA, 14 nt, Shigella flexneri 2a str. 301
acgauauuuuuccg

SEQ ID NO: 3884256 - RNA, 22 nt, Shigella flexneri 2a str. 301
acgaucaagauugauccccgcu

SEQ ID NO: 3884257 - RNA, 11 nt, Shigella flexneri 2a str. 301
acgaucaccac

SEQ ID NO: 3884258 - RNA, 23 nt, Shigella flexneri 2a str. 301
acgaucccaaccauuucaucuuc

SEQ ID NO: 3884259 - RNA, 17 nt, Shigella flexneri 2a str. 301
acgaucccagcguggag

SEQ ID NO: 3884260 - RNA, 15 nt, Shigella flexneri 2a str. 301
acgaucgaagccguc

SEQ ID NO: 3884261 - RNA, 16 nt, Shigella flexneri 2a str. 301
acgaucgcccagacca

SEQ ID NO: 3884262 - RNA, 18 nt, Shigella flexneri 2a str. 301
acgaucgccugguaccag

SEQ ID NO: 3884263 - RNA, 15 nt, Shigella flexneri 2a str. 301
acgaucgcgccagcc

SEQ ID NO: 3884264 - RNA, 15 nt, Shigella flexneri 2a str. 301
acgaucgcuuucaac

SEQ ID NO: 3884265 - RNA, 16 nt, Shigella flexneri 2a str. 301
acgaucgcuuucaacg

SEQ ID NO: 3884266 - RNA, 18 nt, Shigella flexneri 2a str. 301
acgaucucgccagugacc

SEQ ID NO: 3884267 - RNA, 19 nt, Shigella flexneri 2a str. 301
acgaucuucggcgucagaa

SEQ ID NO: 3884268 - RNA, 17 nt, Shigella flexneri 2a str. 301
acgaugaaagaaaaaac

SEQ ID NO: 3884269 - RNA, 20 nt, Shigella flexneri 2a str. 301
acgaugaaagaaaaaacgau

SEQ ID NO: 3884270 - RNA, 14 nt, Shigella flexneri 2a str. 301
acgaugcagcguuu

SEQ ID NO: 3884271 - RNA, 17 nt, Shigella flexneri 2a str. 301
acgauggcaauuuucac

SEQ ID NO: 3884272 - RNA, 18 nt, Shigella flexneri 2a str. 301
acgauggcaauuuucacu

SEQ ID NO: 3884273 - RNA, 17 nt, Shigella flexneri 2a str. 301
acgauggccaaccaugu

SEQ ID NO: 3884274 - RNA, 13 nt, Shigella flexneri 2a str. 301
acgaugguuuuug

SEQ ID NO: 3884275 - RNA, 15 nt, Shigella flexneri 2a str. 301
acgauguaggccuga

SEQ ID NO: 3884276 - RNA, 16 nt, Shigella flexneri 2a str. 301
acgauguaggccugau

SEQ ID NO: 3884277 - RNA, 13 nt, Shigella flexneri 2a str. 301
acgaugucaauca

SEQ ID NO: 3884278 - RNA, 15 nt, Shigella flexneri 2a str. 301
acgaugucaaucagg

SEQ ID NO: 3884279 - RNA, 15 nt, Shigella flexneri 2a str. 301
acgauguuugcugcg

SEQ ID NO: 3884280 - RNA, 19 nt, Shigella flexneri 2a str. 301
acgauuaacgcuucuccca

SEQ ID NO: 3884281 - RNA, 13 nt, Shigella flexneri 2a str. 301
acgauuaauuaca

SEQ ID NO: 3884282 - RNA, 16 nt, Shigella flexneri 2a str. 301
acgauuaauuacacag

SEQ ID NO: 3884283 - RNA, 23 nt, Shigella flexneri 2a str. 301
acgauucgcccgcagccaucacu

SEQ ID NO: 3884284 - RNA, 18 nt, Shigella flexneri 2a str. 301
acgauucggcaaucacca

SEQ ID NO: 3884285 - RNA, 22 nt, Shigella flexneri 2a str. 301
acgauuugcggcguauccggcu

SEQ ID NO: 3884286 - RNA, 22 nt, Shigella flexneri 2a str. 301
acgcaaaaccucuuccagcaga

SEQ ID NO: 3884287 - RNA, 15 nt, Shigella flexneri 2a str. 301
acgcaaacuucgguu

SEQ ID NO: 3884288 - RNA, 19 nt, Shigella flexneri 2a str. 301
acgcaaagagagaagccag

SEQ ID NO: 3884289 - RNA, 18 nt, Shigella flexneri 2a str. 301
acgcaaauguaaaaccaa

SEQ ID NO: 3884290 - RNA, 22 nt, Shigella flexneri 2a str. 301
acgcaacaugucagcaaucacc

SEQ ID NO: 3884291 - RNA, 22 nt, Shigella flexneri 2a str. 301
acgcaaccacaacgcacuggcg

SEQ ID NO: 3884292 - RNA, 22 nt, Shigella flexneri 2a str. 301
acgcaacugccaguaaagcagc

SEQ ID NO: 3884293 - RNA, 18 nt, Shigella flexneri 2a str. 301
acgcaacugguccagccc

SEQ ID NO: 3884294 - RNA, 15 nt, Shigella flexneri 2a str. 301
acgcaacuuccccuc

SEQ ID NO: 3884295 - RNA, 16 nt, Shigella flexneri 2a str. 301
acgcaauaaacaugau

SEQ ID NO: 3884296 - RNA, 18 nt, Shigella flexneri 2a str. 301
acgcaauaaacaugauga

SEQ ID NO: 3884297 - RNA, 15 nt, Shigella flexneri 2a str. 301
acgcaauauccgcca

SEQ ID NO: 3884298 - RNA, 22 nt, Shigella flexneri 2a str. 301
acgcaaucaaauaccaccagcg

SEQ ID NO: 3884299 - RNA, 20 nt, Shigella flexneri 2a str. 301
acgcaauccccucuucagcc

SEQ ID NO: 3884300 - RNA, 18 nt, Shigella flexneri 2a str. 301
acgcaaucgaguuugccg

SEQ ID NO: 3884301 - RNA, 16 nt, Shigella flexneri 2a str. 301
acgcaaugccagugga

SEQ ID NO: 3884302 - RNA, 22 nt, Shigella flexneri 2a str. 301
acgcacacaugcgauaaagcau

SEQ ID NO: 3884303 - RNA, 22 nt, Shigella flexneri 2a str. 301
acgcaccaauagccgcgccgag

SEQ ID NO: 3884304 - RNA, 21 nt, Shigella flexneri 2a str. 301
acgcacccguaacauggcggu

SEQ ID NO: 3884305 - RNA, 15 nt, Shigella flexneri 2a str. 301
acgcacgccugcauc

SEQ ID NO: 3884306 - RNA, 17 nt, Shigella flexneri 2a str. 301
acgcacgcgggugccug

SEQ ID NO: 3884307 - RNA, 14 nt, Shigella flexneri 2a str. 301
acgcacgcugucac

SEQ ID NO: 3884308 - RNA, 12 nt, Shigella flexneri 2a str. 301
acgcacggcgua

SEQ ID NO: 3884309 - RNA, 23 nt, Shigella flexneri 2a str. 301
acgcacuggcgagcgccagcaug

SEQ ID NO: 3884310 - RNA, 22 nt, Shigella flexneri 2a str. 301
acgcacuguuggcgaaaauccu

SEQ ID NO: 3884311 - RNA, 16 nt, Shigella flexneri 2a str. 301
acgcacuucuuccggg

SEQ ID NO: 3884312 - RNA, 13 nt, Shigella flexneri 2a str. 301
acgcagaccaaag

SEQ ID NO: 3884313 - RNA, 14 nt, Shigella flexneri 2a str. 301
acgcagacuggauu

SEQ ID NO: 3884314 - RNA, 16 nt, Shigella flexneri 2a str. 301
acgcagagacaucacc

SEQ ID NO: 3884315 - RNA, 14 nt, Shigella flexneri 2a str. 301
acgcagcgguauaa

SEQ ID NO: 3884316 - RNA, 15 nt, Shigella flexneri 2a str. 301
acgcagcucacuucg

SEQ ID NO: 3884317 - RNA, 14 nt, Shigella flexneri 2a str. 301
acgcagcugaccuu

SEQ ID NO: 3884318 - RNA, 18 nt, Shigella flexneri 2a str. 301
acgcaggccacgaaucag

SEQ ID NO: 3884319 - RNA, 22 nt, Shigella flexneri 2a str. 301
acgcaggucgucuuuuacagcg

SEQ ID NO: 3884320 - RNA, 15 nt, Shigella flexneri 2a str. 301
acgcagucuucccag

SEQ ID NO: 3884321 - RNA, 16 nt, Shigella flexneri 2a str. 301
acgcagugguuaacaa

SEQ ID NO: 3884322 - RNA, 14 nt, Shigella flexneri 2a str. 301
acgcaguuaacgcg

SEQ ID NO: 3884323 - RNA, 23 nt, Shigella flexneri 2a str. 301
acgcaguuaacgcggauccccug

SEQ ID NO: 3884324 - RNA, 17 nt, Shigella flexneri 2a str. 301
acgcaguuccgccagcu

SEQ ID NO: 3884325 - RNA, 13 nt, Shigella flexneri 2a str. 301
acgcauaaaacca

SEQ ID NO: 3884326 - RNA, 22 nt, Shigella flexneri 2a str. 301
acgcauaaugcgccccgcaacg

SEQ ID NO: 3884327 - RNA, 16 nt, Shigella flexneri 2a str. 301
acgcauaccagucuau

SEQ ID NO: 3884328 - RNA, 21 nt, Shigella flexneri 2a str. 301
acgcauacucuuugacaacau

SEQ ID NO: 3884329 - RNA, 22 nt, Shigella flexneri 2a str. 301
acgcauacucuuugacaacauc

SEQ ID NO: 3884330 - RNA, 15 nt, Shigella flexneri 2a str. 301
acgcauaugcaucag

SEQ ID NO: 3884331 - RNA, 21 nt, Shigella flexneri 2a str. 301
acgcaucacgaaucgccgcau

SEQ ID NO: 3884332 - RNA, 20 nt, Shigella flexneri 2a str. 301
acgcaucacuacaaccggga

SEQ ID NO: 3884333 - RNA, 21 nt, Shigella flexneri 2a str. 301
acgcauccgaucgcgcaucag

SEQ ID NO: 3884334 - RNA, 21 nt, Shigella flexneri 2a str. 301
acgcauccgcuggcccaucag

SEQ ID NO: 3884335 - RNA, 15 nt, Shigella flexneri 2a str. 301
acgcaucgcccgguu

SEQ ID NO: 3884336 - RNA, 13 nt, Shigella flexneri 2a str. 301
acgcaucgccggg

SEQ ID NO: 3884337 - RNA, 14 nt, Shigella flexneri 2a str. 301
acgcaucgccggga

SEQ ID NO: 3884338 - RNA, 18 nt, Shigella flexneri 2a str. 301
acgcaucggcuaaaccau

SEQ ID NO: 3884339 - RNA, 14 nt, Shigella flexneri 2a str. 301
acgcauucgcgguu

SEQ ID NO: 3884340 - RNA, 21 nt, Shigella flexneri 2a str. 301
acgcauucucuuuucacgcaa

SEQ ID NO: 3884341 - RNA, 13 nt, Shigella flexneri 2a str. 301
acgcauugcauuu

SEQ ID NO: 3884342 - RNA, 17 nt, Shigella flexneri 2a str. 301
acgccaagaaacaccag

SEQ ID NO: 3884343 - RNA, 18 nt, Shigella flexneri 2a str. 301
acgccaauaccgcccaga

SEQ ID NO: 3884344 - RNA, 20 nt, Shigella flexneri 2a str. 301
acgccaauaccgcccagacc

SEQ ID NO: 3884345 - RNA, 14 nt, Shigella flexneri 2a str. 301
acgccacagcaauu

SEQ ID NO: 3884346 - RNA, 20 nt, Shigella flexneri 2a str. 301
acgccacccgaaggaggcgu

SEQ ID NO: 3884347 - RNA, 16 nt, Shigella flexneri 2a str. 301
acgccacgacucaaau

SEQ ID NO: 3884348 - RNA, 16 nt, Shigella flexneri 2a str. 301
acgccacgcucacuca

SEQ ID NO: 3884349 - RNA, 14 nt, Shigella flexneri 2a str. 301
acgccacugcggcu

SEQ ID NO: 3884350 - RNA, 23 nt, Shigella flexneri 2a str. 301
acgccagaaacgcguugucuuuc

SEQ ID NO: 3884351 - RNA, 17 nt, Shigella flexneri 2a str. 301
acgccagaacagcuaca

SEQ ID NO: 3884352 - RNA, 20 nt, Shigella flexneri 2a str. 301
acgccagacugcgcuaccag

SEQ ID NO: 3884353 - RNA, 19 nt, Shigella flexneri 2a str. 301
acgcggcagcgucgcauca

SEQ ID NO: 3884354 - RNA, 20 nt, Shigella flexneri 2a str. 301
acgcggcagcgucgcaucag

SEQ ID NO: 3884355 - RNA, 21 nt, Shigella flexneri 2a str. 301
acgcggcagcgucgcauccga

SEQ ID NO: 3884356 - RNA, 20 nt, Shigella flexneri 2a str. 301
acgcgggccauccaccagug

SEQ ID NO: 3884357 - RNA, 20 nt, Shigella flexneri 2a str. 301
acgcgguauggucacgguga

SEQ ID NO: 3884358 - RNA, 22 nt, Shigella flexneri 2a str. 301
acgcggucaauggucagcgcca

SEQ ID NO: 3884359 - RNA, 19 nt, Shigella flexneri 2a str. 301
acgcgguguuuuaaccguu

SEQ ID NO: 3884360 - RNA, 13 nt, Shigella flexneri 2a str. 301
acgcgguuacgca

SEQ ID NO: 3884361 - RNA, 15 nt, Shigella flexneri 2a str. 301
acgcgguugccagau

SEQ ID NO: 3884362 - RNA, 21 nt, Shigella flexneri 2a str. 301
acgcguaaagcgucgcaucag

SEQ ID NO: 3884363 - RNA, 20 nt, Shigella flexneri 2a str. 301
acgcgucagugucuuaucug

SEQ ID NO: 3884364 - RNA, 16 nt, Shigella flexneri 2a str. 301
acgcgucugaccgucu

SEQ ID NO: 3884365 - RNA, 12 nt, Shigella flexneri 2a str. 301
acgcgucuuauc

SEQ ID NO: 3884366 - RNA, 17 nt, Shigella flexneri 2a str. 301
acgcgucuuaucaggcc

SEQ ID NO: 3884367 - RNA, 22 nt, Shigella flexneri 2a str. 301
acgcgucuuaucaggccuacaa

SEQ ID NO: 3884368 - RNA, 22 nt, Shigella flexneri 2a str. 301
acgcgucuuaucaugccuacag

SEQ ID NO: 3884369 - RNA, 14 nt, Shigella flexneri 2a str. 301
acgcgucuuaucug

SEQ ID NO: 3884370 - RNA, 17 nt, Shigella flexneri 2a str. 301
acgcguggacuggcugc

SEQ ID NO: 3884371 - RNA, 14 nt, Shigella flexneri 2a str. 301
acgcguuaauaccu

SEQ ID NO: 3884372 - RNA, 17 nt, Shigella flexneri 2a str. 301
acgcguuaauaccugau

SEQ ID NO: 3884373 - RNA, 19 nt, Shigella flexneri 2a str. 301
acgcguuagcaucgcauca

SEQ ID NO: 3884374 - RNA, 20 nt, Shigella flexneri 2a str. 301
acgcguuagugucuuaucug

SEQ ID NO: 3884375 - RNA, 20 nt, Shigella flexneri 2a str. 301
acgcguuauccggcuaacaa

SEQ ID NO: 3884376 - RNA, 18 nt, Shigella flexneri 2a str. 301
acgcguucauacuuuuca

SEQ ID NO: 3884377 - RNA, 23 nt, Shigella flexneri 2a str. 301
acgcguucgcaaagguuuuaccg

SEQ ID NO: 3884378 - RNA, 19 nt, Shigella flexneri 2a str. 301
acgcguugcgcaugaccuu

SEQ ID NO: 3884379 - RNA, 15 nt, Shigella flexneri 2a str. 301
acgcguuuuucagaa

SEQ ID NO: 3884380 - RNA, 14 nt, Shigella flexneri 2a str. 301
acgcuaccaaaaaa

SEQ ID NO: 3884381 - RNA, 18 nt, Shigella flexneri 2a str. 301
acgcuaccaaaaaaucaa

SEQ ID NO: 3884382 - RNA, 16 nt, Shigella flexneri 2a str. 301
acgcuaccggacaguu

SEQ ID NO: 3884383 - RNA, 17 nt, Shigella flexneri 2a str. 301
acgcuacuuuuuucacc

SEQ ID NO: 3884384 - RNA, 14 nt, Shigella flexneri 2a str. 301
acgcucaacguuua

SEQ ID NO: 3884385 - RNA, 15 nt, Shigella flexneri 2a str. 301
acgcucacugcaaaa

SEQ ID NO: 3884386 - RNA, 18 nt, Shigella flexneri 2a str. 301
acgcucaggcuacuuuuc

SEQ ID NO: 3884387 - RNA, 23 nt, Shigella flexneri 2a str. 301
acgcucaggcuacuuuuccaggu

SEQ ID NO: 3884388 - RNA, 14 nt, Shigella flexneri 2a str. 301
acgcucaguauggu

SEQ ID NO: 3884389 - RNA, 19 nt, Shigella flexneri 2a str. 301
acgcucaucaggccuacaa

SEQ ID NO: 3884390 - RNA, 20 nt, Shigella flexneri 2a str. 301
acgcuccaguguggccagag

SEQ ID NO: 3884391 - RNA, 21 nt, Shigella flexneri 2a str. 301
acgcuccaguguggccagagu

SEQ ID NO: 3884392 - RNA, 18 nt, Shigella flexneri 2a str. 301
acgcuccccggcacuuaa

SEQ ID NO: 3884393 - RNA, 19 nt, Shigella flexneri 2a str. 301
acgcuccgcaccugaguaa

SEQ ID NO: 3884394 - RNA, 16 nt, Shigella flexneri 2a str. 301
acgcucgaacagcugg

SEQ ID NO: 3884395 - RNA, 17 nt, Shigella flexneri 2a str. 301
acgcucgaacagcuggu

SEQ ID NO: 3884396 - RNA, 17 nt, Shigella flexneri 2a str. 301
acgcucgccauuuuuca

SEQ ID NO: 3884397 - RNA, 19 nt, Shigella flexneri 2a str. 301
acgcucgccauuuuucaga

SEQ ID NO: 3884398 - RNA, 21 nt, Shigella flexneri 2a str. 301
acgcucgcgcaguuugccaug

SEQ ID NO: 3884399 - RNA, 22 nt, Shigella flexneri 2a str. 301
acgcucggcuguuucuggauga

SEQ ID NO: 3884400 - RNA, 22 nt, Shigella flexneri 2a str. 301
acgcucuauggcaccuguugcc

SEQ ID NO: 3884401 - RNA, 16 nt, Shigella flexneri 2a str. 301
acgcucuccugcggaa

SEQ ID NO: 3884402 - RNA, 17 nt, Shigella flexneri 2a str. 301
acgcucuguucugcgcu

SEQ ID NO: 3884403 - RNA, 22 nt, Shigella flexneri 2a str. 301
acgcucuguucugcgcuugguu

SEQ ID NO: 3884404 - RNA, 18 nt, Shigella flexneri 2a str. 301
acgcucuuccaggguaaa

SEQ ID NO: 3884405 - RNA, 22 nt, Shigella flexneri 2a str. 301
acgcugaaaagcgucucuuuuc

SEQ ID NO: 3884406 - RNA, 22 nt, Shigella flexneri 2a str. 301
acgcugaauaauccccauauca

SEQ ID NO: 3884407 - RNA, 19 nt, Shigella flexneri 2a str. 301
acgcugaauacgcaccgcu

SEQ ID NO: 3884408 - RNA, 23 nt, Shigella flexneri 2a str. 301
acgcugaauacgcaccgcuccau

SEQ ID NO: 3884409 - RNA, 15 nt, Shigella flexneri 2a str. 301
acgcugacgcgucuu

SEQ ID NO: 3884410 - RNA, 19 nt, Shigella flexneri 2a str. 301
acgcugauauuucggcauu

SEQ ID NO: 3884411 - RNA, 19 nt, Shigella flexneri 2a str. 301
acgcugaugucagcacuuc

SEQ ID NO: 3884412 - RNA, 19 nt, Shigella flexneri 2a str. 301
acgcugauuuuuuuucaac

SEQ ID NO: 3884413 - RNA, 20 nt, Shigella flexneri 2a str. 301
acgcugauuuuuuuucaacc

SEQ ID NO: 3884414 - RNA, 15 nt, Shigella flexneri 2a str. 301
acgcugcacaauuua

SEQ ID NO: 3884415 - RNA, 15 nt, Shigella flexneri 2a str. 301
acgcugcaucgccaa

SEQ ID NO: 3884416 - RNA, 22 nt, Shigella flexneri 2a str. 301
acgcugcaucgccaaucugcug

SEQ ID NO: 3884417 - RNA, 14 nt, Shigella flexneri 2a str. 301
acgcugccagccau

SEQ ID NO: 3884418 - RNA, 14 nt, Shigella flexneri 2a str. 301
acgcugccgcuucu

SEQ ID NO: 3884419 - RNA, 22 nt, Shigella flexneri 2a str. 301
acgcugcgcacauugguaauca

SEQ ID NO: 3884420 - RNA, 20 nt, Shigella flexneri 2a str. 301
acgcugcggucgaacauaca

SEQ ID NO: 3884421 - RNA, 16 nt, Shigella flexneri 2a str. 301
acgcugcugccggcac

SEQ ID NO: 3884422 - RNA, 19 nt, Shigella flexneri 2a str. 301
acgcugcugcguacugaga

SEQ ID NO: 3884423 - RNA, 20 nt, Shigella flexneri 2a str. 301
acgcuggccgcgucuuaucc

SEQ ID NO: 3884424 - RNA, 23 nt, Shigella flexneri 2a str. 301
acgcuggcgcgucuuaucaggcc

SEQ ID NO: 3884425 - RNA, 19 nt, Shigella flexneri 2a str. 301
acgcugggcgaucgccuga

SEQ ID NO: 3884426 - RNA, 22 nt, Shigella flexneri 2a str. 301
acgcuggguuucgccugccaga

SEQ ID NO: 3884427 - RNA, 17 nt, Shigella flexneri 2a str. 301
acgcugguaacggcguc

SEQ ID NO: 3884428 - RNA, 23 nt, Shigella flexneri 2a str. 301
acgcugguaguuguacaacugcu

SEQ ID NO: 3884429 - RNA, 12 nt, Shigella flexneri 2a str. 301
acgcuggugagu

SEQ ID NO: 3884430 - RNA, 13 nt, Shigella flexneri 2a str. 301
acgcugucggcac

SEQ ID NO: 3884431 - RNA, 18 nt, Shigella flexneri 2a str. 301
acgcugucuuuugaucaa

SEQ ID NO: 3884432 - RNA, 21 nt, Shigella flexneri 2a str. 301
acgcuguucaucccgaccaau

SEQ ID NO: 3884433 - RNA, 15 nt, Shigella flexneri 2a str. 301
acgcuuaacaacccg

SEQ ID NO: 3884434 - RNA, 16 nt, Shigella flexneri 2a str. 301
acgcuuaacgcgucuu

SEQ ID NO: 3884435 - RNA, 19 nt, Shigella flexneri 2a str. 301
acgcuuaucaggccuacaa

SEQ ID NO: 3884436 - RNA, 19 nt, Shigella flexneri 2a str. 301
acgcuucaaucugauauuu

SEQ ID NO: 3884437 - RNA, 13 nt, Shigella flexneri 2a str. 301
acgcuucuggcga

SEQ ID NO: 3884438 - RNA, 14 nt, Shigella flexneri 2a str. 301
acgcuugagcagga

SEQ ID NO: 3884439 - RNA, 15 nt, Shigella flexneri 2a str. 301
acgcuugauuucucg

SEQ ID NO: 3884440 - RNA, 14 nt, Shigella flexneri 2a str. 301
acgcuugcugauaa

SEQ ID NO: 3884441 - RNA, 22 nt, Shigella flexneri 2a str. 301
acgcuugcugauaacgugcagc

SEQ ID NO: 3884442 - RNA, 19 nt, Shigella flexneri 2a str. 301
acgcuuguacggcuccgcc

SEQ ID NO: 3884443 - RNA, 12 nt, Shigella flexneri 2a str. 301
acgcuugucauc

SEQ ID NO: 3884444 - RNA, 20 nt, Shigella flexneri 2a str. 301
acgcuuuacguuccuggcuu

SEQ ID NO: 3884445 - RNA, 22 nt, Shigella flexneri 2a str. 301
acgcuuucaacaaccuugcguu

SEQ ID NO: 3884446 - RNA, 14 nt, Shigella flexneri 2a str. 301
acgcuuucacccgg

SEQ ID NO: 3884447 - RNA, 16 nt, Shigella flexneri 2a str. 301
acgcuuugcaggcugg

SEQ ID NO: 3884448 - RNA, 19 nt, Shigella flexneri 2a str. 301
acgcuuuuucccugguaaa

SEQ ID NO: 3884449 - RNA, 22 nt, Shigella flexneri 2a str. 301
acgcuuuuucccugguaaaaaa

SEQ ID NO: 3884450 - RNA, 15 nt, Shigella flexneri 2a str. 301
acggaacgaaaaaaa

SEQ ID NO: 3884451 - RNA, 19 nt, Shigella flexneri 2a str. 301
acggaagacguucaguuca

SEQ ID NO: 3884452 - RNA, 22 nt, Shigella flexneri 2a str. 301
acgguucauuggguucaucuga

SEQ ID NO: 3884453 - RNA, 16 nt, Shigella flexneri 2a str. 301
acgguugaugccguuc

SEQ ID NO: 3884454 - RNA, 21 nt, Shigella flexneri 2a str. 301
acgguugcgaagucguucaga

SEQ ID NO: 3884455 - RNA, 17 nt, Shigella flexneri 2a str. 301
acgguugcggcuuacca

SEQ ID NO: 3884456 - RNA, 20 nt, Shigella flexneri 2a str. 301
acgguuuaucucaucuucca

SEQ ID NO: 3884457 - RNA, 14 nt, Shigella flexneri 2a str. 301
acgguuucagcagc

SEQ ID NO: 3884458 - RNA, 13 nt, Shigella flexneri 2a str. 301
acgguuucagugg

SEQ ID NO: 3884459 - RNA, 17 nt, Shigella flexneri 2a str. 301
acgguuuuuugaacaga

SEQ ID NO: 3884460 - RNA, 13 nt, Shigella flexneri 2a str. 301
acguaaaaacccg

SEQ ID NO: 3884461 - RNA, 14 nt, Shigella flexneri 2a str. 301
acguaaagaagaug

SEQ ID NO: 3884462 - RNA, 15 nt, Shigella flexneri 2a str. 301
acguaacaaaacuca

SEQ ID NO: 3884463 - RNA, 16 nt, Shigella flexneri 2a str. 301
acguaacaaaacucag

SEQ ID NO: 3884464 - RNA, 13 nt, Shigella flexneri 2a str. 301
acguaacccacca

SEQ ID NO: 3884465 - RNA, 17 nt, Shigella flexneri 2a str. 301
acguaacgaccaccacc

SEQ ID NO: 3884466 - RNA, 19 nt, Shigella flexneri 2a str. 301
acguaaguuagaggcacau

SEQ ID NO: 3884467 - RNA, 24 nt, Shigella flexneri 2a str. 301
acguaaguuagaggcacauagcca

SEQ ID NO: 3884468 - RNA, 16 nt, Shigella flexneri 2a str. 301
acguaaugauguaaaa

SEQ ID NO: 3884469 - RNA, 17 nt, Shigella flexneri 2a str. 301
acguaauggaugcccgc

SEQ ID NO: 3884470 - RNA, 16 nt, Shigella flexneri 2a str. 301
acguaaugucggugaa

SEQ ID NO: 3884471 - RNA, 13 nt, Shigella flexneri 2a str. 301
acguaauuucaau

SEQ ID NO: 3884472 - RNA, 15 nt, Shigella flexneri 2a str. 301
acguaccagcgucgg

SEQ ID NO: 3884473 - RNA, 20 nt, Shigella flexneri 2a str. 301
acguagcguaaggauuauuu

SEQ ID NO: 3884474 - RNA, 15 nt, Shigella flexneri 2a str. 301
acguagcuauauuuu

SEQ ID NO: 3884475 - RNA, 15 nt, Shigella flexneri 2a str. 301
acguaggccugauaa

SEQ ID NO: 3884476 - RNA, 24 nt, Shigella flexneri 2a str. 301
acguagugaaaucgccaacaaucu

SEQ ID NO: 3884477 - RNA, 22 nt, Shigella flexneri 2a str. 301
acguaguugcccuuuucaccau

SEQ ID NO: 3884478 - RNA, 19 nt, Shigella flexneri 2a str. 301
acgucaaauaauuccugcg

SEQ ID NO: 3884479 - RNA, 14 nt, Shigella flexneri 2a str. 301
acgucaacuuuguu

SEQ ID NO: 3884480 - RNA, 15 nt, Shigella flexneri 2a str. 301
acgucaauggugaga

SEQ ID NO: 3884481 - RNA, 15 nt, Shigella flexneri 2a str. 301
acgucaccucaggaa

SEQ ID NO: 3884482 - RNA, 16 nt, Shigella flexneri 2a str. 301
acgucacucuuuauga

SEQ ID NO: 3884483 - RNA, 18 nt, Shigella flexneri 2a str. 301
acgucacuggugugucau

SEQ ID NO: 3884484 - RNA, 12 nt, Shigella flexneri 2a str. 301
acgucagcguca

SEQ ID NO: 3884485 - RNA, 17 nt, Shigella flexneri 2a str. 301
acgucaguaagaaacag

SEQ ID NO: 3884486 - RNA, 17 nt, Shigella flexneri 2a str. 301
acgucaguuuccagcau

SEQ ID NO: 3884487 - RNA, 18 nt, Shigella flexneri 2a str. 301
acgucaucaccggcuucu

SEQ ID NO: 3884488 - RNA, 19 nt, Shigella flexneri 2a str. 301
acgucaucugucauaacac

SEQ ID NO: 3884489 - RNA, 17 nt, Shigella flexneri 2a str. 301
acgucauuaccgcgaag

SEQ ID NO: 3884490 - RNA, 21 nt, Shigella flexneri 2a str. 301
acgucauugcuaucuccuguu

SEQ ID NO: 3884491 - RNA, 23 nt, Shigella flexneri 2a str. 301
acguccagcgauuugcggaagua

SEQ ID NO: 3884492 - RNA, 15 nt, Shigella flexneri 2a str. 301
acgucccaugaugcg

SEQ ID NO: 3884493 - RNA, 14 nt, Shigella flexneri 2a str. 301
acguccccugggga

SEQ ID NO: 3884494 - RNA, 23 nt, Shigella flexneri 2a str. 301
acgucccgccgcuaucccaugcc

SEQ ID NO: 3884495 - RNA, 22 nt, Shigella flexneri 2a str. 301
acgucgauauaauugaccagau

SEQ ID NO: 3884496 - RNA, 22 nt, Shigella flexneri 2a str. 301
acgucgauuucuggguggcguu

SEQ ID NO: 3884497 - RNA, 17 nt, Shigella flexneri 2a str. 301
acgucgcaacuccacca

SEQ ID NO: 3884498 - RNA, 20 nt, Shigella flexneri 2a str. 301
acgucgcaacuccaccagca

SEQ ID NO: 3884499 - RNA, 14 nt, Shigella flexneri 2a str. 301
acgucgcuuuauag

SEQ ID NO: 3884500 - RNA, 19 nt, Shigella flexneri 2a str. 301
acgucgucgugaagcagag

SEQ ID NO: 3884501 - RNA, 19 nt, Shigella flexneri 2a str. 301
acgucguuccccauuaccu

SEQ ID NO: 3884502 - RNA, 14 nt, Shigella flexneri 2a str. 301
acgucuacaguacg

SEQ ID NO: 3884503 - RNA, 18 nt, Shigella flexneri 2a str. 301
acgucucaaucaccacca

SEQ ID NO: 3884504 - RNA, 12 nt, Shigella flexneri 2a str. 301
acgucucaucag

SEQ ID NO: 3884505 - RNA, 13 nt, Shigella flexneri 2a str. 301
acgucucaucagg

SEQ ID NO: 3884506 - RNA, 15 nt, Shigella flexneri 2a str. 301
acgucuuaauguaau

SEQ ID NO: 3884507 - RNA, 23 nt, Shigella flexneri 2a str. 301
acgucuuccauugccgcuuucca

SEQ ID NO: 3884508 - RNA, 20 nt, Shigella flexneri 2a str. 301
acgucuuugcguuccaucag

SEQ ID NO: 3884509 - RNA, 17 nt, Shigella flexneri 2a str. 301
acgugacagcauaccuu

SEQ ID NO: 3884510 - RNA, 14 nt, Shigella flexneri 2a str. 301
acgugagagauaau

SEQ ID NO: 3884511 - RNA, 16 nt, Shigella flexneri 2a str. 301
acgugagcuuuucugc

SEQ ID NO: 3884512 - RNA, 18 nt, Shigella flexneri 2a str. 301
acgugaucgaacaucugc

SEQ ID NO: 3884513 - RNA, 23 nt, Shigella flexneri 2a str. 301
acgugaucgucuucaaccgcagu

SEQ ID NO: 3884514 - RNA, 15 nt, Shigella flexneri 2a str. 301
acgugcaaaaucaaa

SEQ ID NO: 3884515 - RNA, 20 nt, Shigella flexneri 2a str. 301
acgugcaaaaucaaacagaa

SEQ ID NO: 3884516 - RNA, 14 nt, Shigella flexneri 2a str. 301
acgugcacaggcaa

SEQ ID NO: 3884517 - RNA, 15 nt, Shigella flexneri 2a str. 301
acgugcacaggcaac

SEQ ID NO: 3884518 - RNA, 18 nt, Shigella flexneri 2a str. 301
acgugccagauguuugaa

SEQ ID NO: 3884519 - RNA, 18 nt, Shigella flexneri 2a str. 301
acgugccugugcagcgac

SEQ ID NO: 3884520 - RNA, 20 nt, Shigella flexneri 2a str. 301
acgugcuacgguugacugaa

SEQ ID NO: 3884521 - RNA, 19 nt, Shigella flexneri 2a str. 301
acgugcucugcgccgccuu

SEQ ID NO: 3884522 - RNA, 21 nt, Shigella flexneri 2a str. 301
acguggauaccgauagauuca

SEQ ID NO: 3884523 - RNA, 19 nt, Shigella flexneri 2a str. 301
acguggcagggaaucagau

SEQ ID NO: 3884524 - RNA, 16 nt, Shigella flexneri 2a str. 301
acguggucgccagcau

SEQ ID NO: 3884525 - RNA, 15 nt, Shigella flexneri 2a str. 301
acguguaaguacagu

SEQ ID NO: 3884526 - RNA, 18 nt, Shigella flexneri 2a str. 301
acguguggucuuuucaac

SEQ ID NO: 3884527 - RNA, 22 nt, Shigella flexneri 2a str. 301
acguguggucuuuucaacaguu

SEQ ID NO: 3884528 - RNA, 23 nt, Shigella flexneri 2a str. 301
acguguggucuuuucaacaguuu

SEQ ID NO: 3884529 - RNA, 18 nt, Shigella flexneri 2a str. 301
acguguguugagauaaug

SEQ ID NO: 3884530 - RNA, 16 nt, Shigella flexneri 2a str. 301
acguuaaagaaagugg

SEQ ID NO: 3884531 - RNA, 20 nt, Shigella flexneri 2a str. 301
acguuaacuacaaucacgau

SEQ ID NO: 3884532 - RNA, 16 nt, Shigella flexneri 2a str. 301
acguuaccggguguuc

SEQ ID NO: 3884533 - RNA, 15 nt, Shigella flexneri 2a str. 301
acguuacuaauaaau

SEQ ID NO: 3884534 - RNA, 16 nt, Shigella flexneri 2a str. 301
acguuagaaacaaaaa

SEQ ID NO: 3884535 - RNA, 16 nt, Shigella flexneri 2a str. 301
acguuagcccuuugua

SEQ ID NO: 3884536 - RNA, 22 nt, Shigella flexneri 2a str. 301
acguuaguucgcguaacugcug

SEQ ID NO: 3884537 - RNA, 20 nt, Shigella flexneri 2a str. 301
acguuaucgcgccaucaaau

SEQ ID NO: 3884538 - RNA, 16 nt, Shigella flexneri 2a str. 301
acguuauggugccuug

SEQ ID NO: 3884539 - RNA, 24 nt, Shigella flexneri 2a str. 301
acguuauucgcuuccucaaccacu

SEQ ID NO: 3884540 - RNA, 16 nt, Shigella flexneri 2a str. 301
acguucacgcagcuca

SEQ ID NO: 3884541 - RNA, 13 nt, Shigella flexneri 2a str. 301
acguucagcgcaa

SEQ ID NO: 3884542 - RNA, 12 nt, Shigella flexneri 2a str. 301
acguucaguucc

SEQ ID NO: 3884543 - RNA, 15 nt, Shigella flexneri 2a str. 301
acguucauggcgcga

SEQ ID NO: 3884544 - RNA, 12 nt, Shigella flexneri 2a str. 301
acguuccagcaa

SEQ ID NO: 3884545 - RNA, 17 nt, Shigella flexneri 2a str. 301
acguuccccaggguuuc

SEQ ID NO: 3884546 - RNA, 12 nt, Shigella flexneri 2a str. 301
acguuccuuucu

SEQ ID NO: 3884547 - RNA, 13 nt, Shigella flexneri 2a str. 301
acguucgcccacu

SEQ ID NO: 3884548 - RNA, 14 nt, Shigella flexneri 2a str. 301
acguucgcccacuu

SEQ ID NO: 3884549 - RNA, 15 nt, Shigella flexneri 2a str. 301
acguucuccugaagu

SEQ ID NO: 3884550 - RNA, 19 nt, Shigella flexneri 2a str. 301
acguucucuuucaggccgc

SEQ ID NO: 3884551 - RNA, 18 nt, Shigella flexneri 2a str. 301
acguucugaucuuucuuc

SEQ ID NO: 3884552 - RNA, 15 nt, Shigella flexneri 2a str. 301
acuccagccagagcc

SEQ ID NO: 3884553 - RNA, 11 nt, Shigella flexneri 2a str. 301
acuccagcccu

SEQ ID NO: 3884554 - RNA, 15 nt, Shigella flexneri 2a str. 301
acuccagcgcuucgc

SEQ ID NO: 3884555 - RNA, 20 nt, Shigella flexneri 2a str. 301
acuccagcuaucguuaucca

SEQ ID NO: 3884556 - RNA, 16 nt, Shigella flexneri 2a str. 301
acuccagucccaguuc

SEQ ID NO: 3884557 - RNA, 16 nt, Shigella flexneri 2a str. 301
acuccauccagcaaca

SEQ ID NO: 3884558 - RNA, 17 nt, Shigella flexneri 2a str. 301
acucccagaacaacccg

SEQ ID NO: 3884559 - RNA, 12 nt, Shigella flexneri 2a str. 301
acucccagccuc

SEQ ID NO: 3884560 - RNA, 14 nt, Shigella flexneri 2a str. 301
acucccccuuucug

SEQ ID NO: 3884561 - RNA, 14 nt, Shigella flexneri 2a str. 301
acuccccgcacaac

SEQ ID NO: 3884562 - RNA, 17 nt, Shigella flexneri 2a str. 301
acuccccgcacaacggc

SEQ ID NO: 3884563 - RNA, 14 nt, Shigella flexneri 2a str. 301
acucccgcgccgca

SEQ ID NO: 3884564 - RNA, 21 nt, Shigella flexneri 2a str. 301
acuccgagaaucauaaauaca

SEQ ID NO: 3884565 - RNA, 22 nt, Shigella flexneri 2a str. 301
acuccgcauuuguaggcaggau

SEQ ID NO: 3884566 - RNA, 19 nt, Shigella flexneri 2a str. 301
acuccgccccggcaauaaa

SEQ ID NO: 3884567 - RNA, 20 nt, Shigella flexneri 2a str. 301
acuccggcuugaaccagcca

SEQ ID NO: 3884568 - RNA, 21 nt, Shigella flexneri 2a str. 301
acuccgguuauuauuuacuug

SEQ ID NO: 3884569 - RNA, 21 nt, Shigella flexneri 2a str. 301
acuccguugaaauugcugguu

SEQ ID NO: 3884570 - RNA, 13 nt, Shigella flexneri 2a str. 301
acuccugccacca

SEQ ID NO: 3884571 - RNA, 14 nt, Shigella flexneri 2a str. 301
acuccugccaccac

SEQ ID NO: 3884572 - RNA, 18 nt, Shigella flexneri 2a str. 301
acuccuuccugaaauaga

SEQ ID NO: 3884573 - RNA, 20 nt, Shigella flexneri 2a str. 301
acucgacgcccuggaagaaa

SEQ ID NO: 3884574 - RNA, 21 nt, Shigella flexneri 2a str. 301
acucgacgcccuggaagaaaa

SEQ ID NO: 3884575 - RNA, 13 nt, Shigella flexneri 2a str. 301
acucgagcagcug

SEQ ID NO: 3884576 - RNA, 23 nt, Shigella flexneri 2a str. 301
acucgauaccagauuaauuauug

SEQ ID NO: 3884577 - RNA, 22 nt, Shigella flexneri 2a str. 301
acucgaugcugccgucuucguu

SEQ ID NO: 3884578 - RNA, 13 nt, Shigella flexneri 2a str. 301
acucgcagaagca

SEQ ID NO: 3884579 - RNA, 14 nt, Shigella flexneri 2a str. 301
acucgcagaagcag

SEQ ID NO: 3884580 - RNA, 20 nt, Shigella flexneri 2a str. 301
acucgccagaccgcagaagc

SEQ ID NO: 3884581 - RNA, 23 nt, Shigella flexneri 2a str. 301
acucgccauuaacauuaacucca

SEQ ID NO: 3884582 - RNA, 24 nt, Shigella flexneri 2a str. 301
acucgccccgagaaaaauagcauu

SEQ ID NO: 3884583 - RNA, 18 nt, Shigella flexneri 2a str. 301
acucgcguucuguugccg

SEQ ID NO: 3884584 - RNA, 22 nt, Shigella flexneri 2a str. 301
acucgcugaauaaacucaccaa

SEQ ID NO: 3884585 - RNA, 15 nt, Shigella flexneri 2a str. 301
acucgcugccagcac

SEQ ID NO: 3884586 - RNA, 17 nt, Shigella flexneri 2a str. 301
acucggcggcuuaaccg

SEQ ID NO: 3884587 - RNA, 16 nt, Shigella flexneri 2a str. 301
acucggggcuuuucuc

SEQ ID NO: 3884588 - RNA, 20 nt, Shigella flexneri 2a str. 301
acucggugaccgaucgcccg

SEQ ID NO: 3884589 - RNA, 15 nt, Shigella flexneri 2a str. 301
acucguaagaggcgu

SEQ ID NO: 3884590 - RNA, 18 nt, Shigella flexneri 2a str. 301
acucguaagaggcgugug

SEQ ID NO: 3884591 - RNA, 21 nt, Shigella flexneri 2a str. 301
acucgugcgucgcauccggca

SEQ ID NO: 3884592 - RNA, 14 nt, Shigella flexneri 2a str. 301
acucguucagcgca

SEQ ID NO: 3884593 - RNA, 19 nt, Shigella flexneri 2a str. 301
acucuaccguuaaaauacg

SEQ ID NO: 3884594 - RNA, 23 nt, Shigella flexneri 2a str. 301
acucuacugaaggcgcauugcug

SEQ ID NO: 3884595 - RNA, 11 nt, Shigella flexneri 2a str. 301
acucuauggcu

SEQ ID NO: 3884596 - RNA, 14 nt, Shigella flexneri 2a str. 301
acucucaaaacaac

SEQ ID NO: 3884597 - RNA, 17 nt, Shigella flexneri 2a str. 301
acucucaccacgcucca

SEQ ID NO: 3884598 - RNA, 14 nt, Shigella flexneri 2a str. 301
acucucgaaaucca

SEQ ID NO: 3884599 - RNA, 20 nt, Shigella flexneri 2a str. 301
acucucgacccgacagaugc

SEQ ID NO: 3884600 - RNA, 15 nt, Shigella flexneri 2a str. 301
acucugaaaacgcug

SEQ ID NO: 3884601 - RNA, 19 nt, Shigella flexneri 2a str. 301
acucugaccugacaaccgg

SEQ ID NO: 3884602 - RNA, 23 nt, Shigella flexneri 2a str. 301
acucugaccugccgcagauauug

SEQ ID NO: 3884603 - RNA, 19 nt, Shigella flexneri 2a str. 301
acucugccguaccaucgcc

SEQ ID NO: 3884604 - RNA, 21 nt, Shigella flexneri 2a str. 301
acucugccguaccaucgccag

SEQ ID NO: 3884605 - RNA, 18 nt, Shigella flexneri 2a str. 301
acucugcugccacauucc

SEQ ID NO: 3884606 - RNA, 16 nt, Shigella flexneri 2a str. 301
acucugguauuaaccg

SEQ ID NO: 3884607 - RNA, 21 nt, Shigella flexneri 2a str. 301
acucuuaagguucacuuaauc

SEQ ID NO: 3884608 - RNA, 18 nt, Shigella flexneri 2a str. 301
acucuuauuuaaauccua

SEQ ID NO: 3884609 - RNA, 17 nt, Shigella flexneri 2a str. 301
acucuuccccgcuucag

SEQ ID NO: 3884610 - RNA, 17 nt, Shigella flexneri 2a str. 301
acucuuuauuucauuuu

SEQ ID NO: 3884611 - RNA, 22 nt, Shigella flexneri 2a str. 301
acucuuuauuucauuuuuuaau

SEQ ID NO: 3884612 - RNA, 23 nt, Shigella flexneri 2a str. 301
acucuuucucggaguaacuauaa

SEQ ID NO: 3884613 - RNA, 23 nt, Shigella flexneri 2a str. 301
acucuuuggcaaccguggugagu

SEQ ID NO: 3884614 - RNA, 18 nt, Shigella flexneri 2a str. 301
acucuuuuuccugcugca

SEQ ID NO: 3884615 - RNA, 13 nt, Shigella flexneri 2a str. 301
acugaacaaaaaa

SEQ ID NO: 3884616 - RNA, 23 nt, Shigella flexneri 2a str. 301
acugaagauugaacagcagaaca

SEQ ID NO: 3884617 - RNA, 14 nt, Shigella flexneri 2a str. 301
acugaaggcgcauu

SEQ ID NO: 3884618 - RNA, 18 nt, Shigella flexneri 2a str. 301
acugaauaugagucguaa

SEQ ID NO: 3884619 - RNA, 19 nt, Shigella flexneri 2a str. 301
acugaaugaucacuuguuc

SEQ ID NO: 3884620 - RNA, 19 nt, Shigella flexneri 2a str. 301
acugacacaggcagcaauc

SEQ ID NO: 3884621 - RNA, 21 nt, Shigella flexneri 2a str. 301
acugacagggugagcagggca

SEQ ID NO: 3884622 - RNA, 16 nt, Shigella flexneri 2a str. 301
acugacauacagaucg

SEQ ID NO: 3884623 - RNA, 18 nt, Shigella flexneri 2a str. 301
acugacauuacggauuaa

SEQ ID NO: 3884624 - RNA, 15 nt, Shigella flexneri 2a str. 301
acugacauugccuuc

SEQ ID NO: 3884625 - RNA, 15 nt, Shigella flexneri 2a str. 301
acugaccaccaccac

SEQ ID NO: 3884626 - RNA, 17 nt, Shigella flexneri 2a str. 301
acugaccccaaaaaguu

SEQ ID NO: 3884627 - RNA, 23 nt, Shigella flexneri 2a str. 301
acugacgcccguuaaccgcucug

SEQ ID NO: 3884628 - RNA, 22 nt, Shigella flexneri 2a str. 301
acugacggaucccgccaacagg

SEQ ID NO: 3884629 - RNA, 20 nt, Shigella flexneri 2a str. 301
acugacgggaaacucugcug

SEQ ID NO: 3884630 - RNA, 13 nt, Shigella flexneri 2a str. 301
acugacuauccug

SEQ ID NO: 3884631 - RNA, 18 nt, Shigella flexneri 2a str. 301
acugacuaugguguaacg

SEQ ID NO: 3884632 - RNA, 15 nt, Shigella flexneri 2a str. 301
acugacugacuucaa

SEQ ID NO: 3884633 - RNA, 13 nt, Shigella flexneri 2a str. 301
acugagagaaaaa

SEQ ID NO: 3884634 - RNA, 22 nt, Shigella flexneri 2a str. 301
acugagccaaacgcccagcuaa

SEQ ID NO: 3884635 - RNA, 21 nt, Shigella flexneri 2a str. 301
acugagucagcccaacaaagc

SEQ ID NO: 3884636 - RNA, 18 nt, Shigella flexneri 2a str. 301
acugauaauaaauaacag

SEQ ID NO: 3884637 - RNA, 23 nt, Shigella flexneri 2a str. 301
acugauaauuuucgguaaugacu

SEQ ID NO: 3884638 - RNA, 16 nt, Shigella flexneri 2a str. 301
acugauaguguuuuau

SEQ ID NO: 3884639 - RNA, 13 nt, Shigella flexneri 2a str. 301
acugaucaucauu

SEQ ID NO: 3884640 - RNA, 22 nt, Shigella flexneri 2a str. 301
acugaucccgauggucagcuuc

SEQ ID NO: 3884641 - RNA, 15 nt, Shigella flexneri 2a str. 301
acugaugacaaacgc

SEQ ID NO: 3884642 - RNA, 21 nt, Shigella flexneri 2a str. 301
acugaugcacacacgcgcuga

SEQ ID NO: 3884643 - RNA, 15 nt, Shigella flexneri 2a str. 301
acugauuaucgauca

SEQ ID NO: 3884644 - RNA, 21 nt, Shigella flexneri 2a str. 301
acugauugccacccugcggcu

SEQ ID NO: 3884645 - RNA, 13 nt, Shigella flexneri 2a str. 301
acugcaaaccaug

SEQ ID NO: 3884646 - RNA, 20 nt, Shigella flexneri 2a str. 301
acugcaaauacccaaaaaau

SEQ ID NO: 3884647 - RNA, 14 nt, Shigella flexneri 2a str. 301
acugcaaaucacca

SEQ ID NO: 3884648 - RNA, 15 nt, Shigella flexneri 2a str. 301
acugcaaaucaccac

SEQ ID NO: 3884649 - RNA, 19 nt, Shigella flexneri 2a str. 301
acugcaacagcuguugaaa

SEQ ID NO: 3884650 - RNA, 15 nt, Shigella flexneri 2a str. 301
acugcaacucaccuu

SEQ ID NO: 3884651 - RNA, 16 nt, Shigella flexneri 2a str. 301
acuguagacaaaaugu

SEQ ID NO: 3884652 - RNA, 21 nt, Shigella flexneri 2a str. 301
acuguauacgggcuuuuuaau

SEQ ID NO: 3884653 - RNA, 12 nt, Shigella flexneri 2a str. 301
acugucagaugc

SEQ ID NO: 3884654 - RNA, 14 nt, Shigella flexneri 2a str. 301
acugucccauccac

SEQ ID NO: 3884655 - RNA, 18 nt, Shigella flexneri 2a str. 301
acugucgaacuggcagga

SEQ ID NO: 3884656 - RNA, 18 nt, Shigella flexneri 2a str. 301
acugucgucgcuuucacu

SEQ ID NO: 3884657 - RNA, 21 nt, Shigella flexneri 2a str. 301
acugucguuaaauccagaucc

SEQ ID NO: 3884658 - RNA, 16 nt, Shigella flexneri 2a str. 301
acugucuaauggugaa

SEQ ID NO: 3884659 - RNA, 20 nt, Shigella flexneri 2a str. 301
acugucuccacuauaaaaaa

SEQ ID NO: 3884660 - RNA, 22 nt, Shigella flexneri 2a str. 301
acugucuccacuauaaaaaaac

SEQ ID NO: 3884661 - RNA, 22 nt, Shigella flexneri 2a str. 301
acugucugcucggaaauauuca

SEQ ID NO: 3884662 - RNA, 18 nt, Shigella flexneri 2a str. 301
acugucugcuucugccug

SEQ ID NO: 3884663 - RNA, 14 nt, Shigella flexneri 2a str. 301
acugucuucaccau

SEQ ID NO: 3884664 - RNA, 23 nt, Shigella flexneri 2a str. 301
acugugaaccucgaucagagugg

SEQ ID NO: 3884665 - RNA, 13 nt, Shigella flexneri 2a str. 301
acugugcacccgc

SEQ ID NO: 3884666 - RNA, 21 nt, Shigella flexneri 2a str. 301
acugugcacccgcuucaguga

SEQ ID NO: 3884667 - RNA, 23 nt, Shigella flexneri 2a str. 301
acugugcacccgcuucagugacu

SEQ ID NO: 3884668 - RNA, 17 nt, Shigella flexneri 2a str. 301
acugugggauugcuuca

SEQ ID NO: 3884669 - RNA, 22 nt, Shigella flexneri 2a str. 301
acuguuaccucgauauucaggc

SEQ ID NO: 3884670 - RNA, 16 nt, Shigella flexneri 2a str. 301
acuguugauccaggag

SEQ ID NO: 3884671 - RNA, 16 nt, Shigella flexneri 2a str. 301
acuguuuaucuuccca

SEQ ID NO: 3884672 - RNA, 13 nt, Shigella flexneri 2a str. 301
acuguuucacugu

SEQ ID NO: 3884673 - RNA, 22 nt, Shigella flexneri 2a str. 301
acuguuucgcgguaaacugcau

SEQ ID NO: 3884674 - RNA, 21 nt, Shigella flexneri 2a str. 301
acuguuugacaacucaucacu

SEQ ID NO: 3884675 - RNA, 22 nt, Shigella flexneri 2a str. 301
acuguuuuaccaaauuggcaaa

SEQ ID NO: 3884676 - RNA, 18 nt, Shigella flexneri 2a str. 301
acuguuuucuaacucauu

SEQ ID NO: 3884677 - RNA, 21 nt, Shigella flexneri 2a str. 301
acuuaaauccguuaugucucc

SEQ ID NO: 3884678 - RNA, 12 nt, Shigella flexneri 2a str. 301
acuuaagucucc

SEQ ID NO: 3884679 - RNA, 16 nt, Shigella flexneri 2a str. 301
acuuaauaaacaucag

SEQ ID NO: 3884680 - RNA, 20 nt, Shigella flexneri 2a str. 301
acuuaauaacgacauauaca

SEQ ID NO: 3884681 - RNA, 22 nt, Shigella flexneri 2a str. 301
acuuaaucaucaaugccagcau

SEQ ID NO: 3884682 - RNA, 14 nt, Shigella flexneri 2a str. 301
acuuaaugaaucau

SEQ ID NO: 3884683 - RNA, 14 nt, Shigella flexneri 2a str. 301
acuuaauugguugc

SEQ ID NO: 3884684 - RNA, 21 nt, Shigella flexneri 2a str. 301
acuuacaucugucugauaaaa

SEQ ID NO: 3884685 - RNA, 14 nt, Shigella flexneri 2a str. 301
acuuaccuucacga

SEQ ID NO: 3884686 - RNA, 19 nt, Shigella flexneri 2a str. 301
acuuacugaugcacacacg

SEQ ID NO: 3884687 - RNA, 14 nt, Shigella flexneri 2a str. 301
acuuacuucagcaa

SEQ ID NO: 3884688 - RNA, 13 nt, Shigella flexneri 2a str. 301
acuuacuuuccuu

SEQ ID NO: 3884689 - RNA, 15 nt, Shigella flexneri 2a str. 301
acuuauaaaccacgc

SEQ ID NO: 3884690 - RNA, 18 nt, Shigella flexneri 2a str. 301
acuuauaagucucagaaa

SEQ ID NO: 3884691 - RNA, 18 nt, Shigella flexneri 2a str. 301
acuuaucacugccaguac

SEQ ID NO: 3884692 - RNA, 13 nt, Shigella flexneri 2a str. 301
acuuaucggaaca

SEQ ID NO: 3884693 - RNA, 17 nt, Shigella flexneri 2a str. 301
acuuaucgugccuacac

SEQ ID NO: 3884694 - RNA, 22 nt, Shigella flexneri 2a str. 301
acuuaucuggauuuaacgauaa

SEQ ID NO: 3884695 - RNA, 18 nt, Shigella flexneri 2a str. 301
acuuaugcaaaauuuuuu

SEQ ID NO: 3884696 - RNA, 16 nt, Shigella flexneri 2a str. 301
acuuauggcuggcugg

SEQ ID NO: 3884697 - RNA, 14 nt, Shigella flexneri 2a str. 301
acuucaaucgccac

SEQ ID NO: 3884698 - RNA, 17 nt, Shigella flexneri 2a str. 301
acuucaaucgccaccac

SEQ ID NO: 3884699 - RNA, 22 nt, Shigella flexneri 2a str. 301
acuucacaaucagcgcgauaaa

SEQ ID NO: 3884700 - RNA, 12 nt, Shigella flexneri 2a str. 301
acuucacacacu

SEQ ID NO: 3884701 - RNA, 15 nt, Shigella flexneri 2a str. 301
acuucacaucaccau

SEQ ID NO: 3884702 - RNA, 20 nt, Shigella flexneri 2a str. 301
acuucacggcugcuaauauu

SEQ ID NO: 3884703 - RNA, 13 nt, Shigella flexneri 2a str. 301
acuucacuucccc

SEQ ID NO: 3884704 - RNA, 16 nt, Shigella flexneri 2a str. 301
acuucagacggucagc

SEQ ID NO: 3884705 - RNA, 22 nt, Shigella flexneri 2a str. 301
acuucagauaaaucacgcuuca

SEQ ID NO: 3884706 - RNA, 15 nt, Shigella flexneri 2a str. 301
acuucagcaacaaaa

SEQ ID NO: 3884707 - RNA, 21 nt, Shigella flexneri 2a str. 301
acuucagcaagcgauaauuua

SEQ ID NO: 3884708 - RNA, 12 nt, Shigella flexneri 2a str. 301
acuucagcagca

SEQ ID NO: 3884709 - RNA, 13 nt, Shigella flexneri 2a str. 301
acuucaucagcaa

SEQ ID NO: 3884710 - RNA, 23 nt, Shigella flexneri 2a str. 301
acuucaucgcccacguuuacugc

SEQ ID NO: 3884711 - RNA, 14 nt, Shigella flexneri 2a str. 301
acuucaucgccguu

SEQ ID NO: 3884712 - RNA, 19 nt, Shigella flexneri 2a str. 301
acuucaucggaaugcaccg

SEQ ID NO: 3884713 - RNA, 12 nt, Shigella flexneri 2a str. 301
acuucaugcccc

SEQ ID NO: 3884714 - RNA, 14 nt, Shigella flexneri 2a str. 301
acuuccaccacuuc

SEQ ID NO: 3884715 - RNA, 20 nt, Shigella flexneri 2a str. 301
acuuccagcagaccagcaau

SEQ ID NO: 3884716 - RNA, 13 nt, Shigella flexneri 2a str. 301
acuuccccucugc

SEQ ID NO: 3884717 - RNA, 14 nt, Shigella flexneri 2a str. 301
acuuccccucugcg

SEQ ID NO: 3884718 - RNA, 17 nt, Shigella flexneri 2a str. 301
acuuccccucugcggcu

SEQ ID NO: 3884719 - RNA, 15 nt, Shigella flexneri 2a str. 301
acuucccgcauccag

SEQ ID NO: 3884720 - RNA, 18 nt, Shigella flexneri 2a str. 301
acuuccgaacaguacugg

SEQ ID NO: 3884721 - RNA, 22 nt, Shigella flexneri 2a str. 301
acuuccgacagaauauaaguca

SEQ ID NO: 3884722 - RNA, 18 nt, Shigella flexneri 2a str. 301
acuuccgcgucaaucugc

SEQ ID NO: 3884723 - RNA, 20 nt, Shigella flexneri 2a str. 301
acuuccgcgucaaucugccc

SEQ ID NO: 3884724 - RNA, 21 nt, Shigella flexneri 2a str. 301
acuuccgggauuucccggcac

SEQ ID NO: 3884725 - RNA, 15 nt, Shigella flexneri 2a str. 301
acuuccugcggagca

SEQ ID NO: 3884726 - RNA, 21 nt, Shigella flexneri 2a str. 301
acuuccugcggagcaaccugc

SEQ ID NO: 3884727 - RNA, 17 nt, Shigella flexneri 2a str. 301
acuucgaguacauccac

SEQ ID NO: 3884728 - RNA, 18 nt, Shigella flexneri 2a str. 301
acuucgauguccgcucca

SEQ ID NO: 3884729 - RNA, 20 nt, Shigella flexneri 2a str. 301
acuucgcuaaaucuggugcu

SEQ ID NO: 3884730 - RNA, 18 nt, Shigella flexneri 2a str. 301
acuucgcugguguacugc

SEQ ID NO: 3884731 - RNA, 19 nt, Shigella flexneri 2a str. 301
acuucgcuuacgccugcca

SEQ ID NO: 3884732 - RNA, 16 nt, Shigella flexneri 2a str. 301
acuucggucaccguca

SEQ ID NO: 3884733 - RNA, 15 nt, Shigella flexneri 2a str. 301
acuucgguuaccaca

SEQ ID NO: 3884734 - RNA, 20 nt, Shigella flexneri 2a str. 301
acuucucgguuugcggcagg

SEQ ID NO: 3884735 - RNA, 23 nt, Shigella flexneri 2a str. 301
acuucucuucuuccgcuucaauc

SEQ ID NO: 3884736 - RNA, 18 nt, Shigella flexneri 2a str. 301
acuucugauguuguuuuu

SEQ ID NO: 3884737 - RNA, 16 nt, Shigella flexneri 2a str. 301
acuucugccagcugcu

SEQ ID NO: 3884738 - RNA, 23 nt, Shigella flexneri 2a str. 301
acuucugcucgcgguuaaguucc

SEQ ID NO: 3884739 - RNA, 20 nt, Shigella flexneri 2a str. 301
acuucuuaaugcccaucucu

SEQ ID NO: 3884740 - RNA, 16 nt, Shigella flexneri 2a str. 301
acuucuuaccgcuuca

SEQ ID NO: 3884741 - RNA, 23 nt, Shigella flexneri 2a str. 301
acuucuucccaccauacugcuua

SEQ ID NO: 3884742 - RNA, 17 nt, Shigella flexneri 2a str. 301
acuucuucugucgggca

SEQ ID NO: 3884743 - RNA, 14 nt, Shigella flexneri 2a str. 301
acuucuucuucgcu

SEQ ID NO: 3884744 - RNA, 16 nt, Shigella flexneri 2a str. 301
acuucuuuuaccuuca

SEQ ID NO: 3884745 - RNA, 14 nt, Shigella flexneri 2a str. 301
acuucuuuuugaac

SEQ ID NO: 3884746 - RNA, 17 nt, Shigella flexneri 2a str. 301
acuugaacgcgagaaaa

SEQ ID NO: 3884747 - RNA, 13 nt, Shigella flexneri 2a str. 301
acuugagcccugg

SEQ ID NO: 3884748 - RNA, 13 nt, Shigella flexneri 2a str. 301
acuugcagcuccu

SEQ ID NO: 3884749 - RNA, 18 nt, Shigella flexneri 2a str. 301
acuugccagauaaacaua

SEQ ID NO: 3884750 - RNA, 20 nt, Shigella flexneri 2a str. 301
acuugccgcaaaacccaggc

SEQ ID NO: 3884751 - RNA, 16 nt, Shigella flexneri 2a str. 301
agaaaugguaaagaag

SEQ ID NO: 3884752 - RNA, 15 nt, Shigella flexneri 2a str. 301
agaaauuauuucuuu

SEQ ID NO: 3884753 - RNA, 20 nt, Shigella flexneri 2a str. 301
agaaauugucuccaccaaug

SEQ ID NO: 3884754 - RNA, 21 nt, Shigella flexneri 2a str. 301
agaaauugucuccaccaauga

SEQ ID NO: 3884755 - RNA, 14 nt, Shigella flexneri 2a str. 301
agaaauuuuuauua

SEQ ID NO: 3884756 - RNA, 14 nt, Shigella flexneri 2a str. 301
agaacaaauaaaua

SEQ ID NO: 3884757 - RNA, 20 nt, Shigella flexneri 2a str. 301
agaacaacccggcgaaagag

SEQ ID NO: 3884758 - RNA, 17 nt, Shigella flexneri 2a str. 301
agaacaaggcuuuaaua

SEQ ID NO: 3884759 - RNA, 12 nt, Shigella flexneri 2a str. 301
agaacaccaccu

SEQ ID NO: 3884760 - RNA, 19 nt, Shigella flexneri 2a str. 301
agaacacgcucccagcaga

SEQ ID NO: 3884761 - RNA, 21 nt, Shigella flexneri 2a str. 301
agaacacgcucccagcagaga

SEQ ID NO: 3884762 - RNA, 19 nt, Shigella flexneri 2a str. 301
agaacacuguuaccgcugc

SEQ ID NO: 3884763 - RNA, 13 nt, Shigella flexneri 2a str. 301
agaacagaacauc

SEQ ID NO: 3884764 - RNA, 16 nt, Shigella flexneri 2a str. 301
agaacaguucagcagc

SEQ ID NO: 3884765 - RNA, 14 nt, Shigella flexneri 2a str. 301
agaacaguuuucag

SEQ ID NO: 3884766 - RNA, 19 nt, Shigella flexneri 2a str. 301
agaacauaaaaaccuguau

SEQ ID NO: 3884767 - RNA, 21 nt, Shigella flexneri 2a str. 301
agaaccacaaugaagaaagua

SEQ ID NO: 3884768 - RNA, 16 nt, Shigella flexneri 2a str. 301
agaaccguaaacagau

SEQ ID NO: 3884769 - RNA, 19 nt, Shigella flexneri 2a str. 301
agaacgaccaucagcugcc

SEQ ID NO: 3884770 - RNA, 16 nt, Shigella flexneri 2a str. 301
agaacguaaacgcagc

SEQ ID NO: 3884771 - RNA, 21 nt, Shigella flexneri 2a str. 301
agaacgugccgggaaaguggc

SEQ ID NO: 3884772 - RNA, 16 nt, Shigella flexneri 2a str. 301
agaacuccagcccgga

SEQ ID NO: 3884773 - RNA, 18 nt, Shigella flexneri 2a str. 301
agaacuccugaaagcgaa

SEQ ID NO: 3884774 - RNA, 20 nt, Shigella flexneri 2a str. 301
agaacucgaacccgucagag

SEQ ID NO: 3884775 - RNA, 19 nt, Shigella flexneri 2a str. 301
agaacugagcgaucauuag

SEQ ID NO: 3884776 - RNA, 20 nt, Shigella flexneri 2a str. 301
agaacugauaacgcauuuca

SEQ ID NO: 3884777 - RNA, 14 nt, Shigella flexneri 2a str. 301
agaacugcgccaga

SEQ ID NO: 3884778 - RNA, 19 nt, Shigella flexneri 2a str. 301
agaacugcuugcccagcaa

SEQ ID NO: 3884779 - RNA, 17 nt, Shigella flexneri 2a str. 301
agaacuguagacaaaau

SEQ ID NO: 3884780 - RNA, 21 nt, Shigella flexneri 2a str. 301
agaacuguagacaaaauguuc

SEQ ID NO: 3884781 - RNA, 14 nt, Shigella flexneri 2a str. 301
agaacuucugcaac

SEQ ID NO: 3884782 - RNA, 21 nt, Shigella flexneri 2a str. 301
agaacuuuaucgaucacaucc

SEQ ID NO: 3884783 - RNA, 10 nt, Shigella flexneri 2a str. 301
agaagaccug

SEQ ID NO: 3884784 - RNA, 15 nt, Shigella flexneri 2a str. 301
agaagagagauaauu

SEQ ID NO: 3884785 - RNA, 21 nt, Shigella flexneri 2a str. 301
agaagagcucguacgaaagug

SEQ ID NO: 3884786 - RNA, 22 nt, Shigella flexneri 2a str. 301
agaagaucagaaauuuccugag

SEQ ID NO: 3884787 - RNA, 19 nt, Shigella flexneri 2a str. 301
agaagaugcgucagcaucg

SEQ ID NO: 3884788 - RNA, 18 nt, Shigella flexneri 2a str. 301
agaagcaagcauuauaua

SEQ ID NO: 3884789 - RNA, 19 nt, Shigella flexneri 2a str. 301
agaagcacguucaucccac

SEQ ID NO: 3884790 - RNA, 22 nt, Shigella flexneri 2a str. 301
agaagcagcaacacaaucagac

SEQ ID NO: 3884791 - RNA, 17 nt, Shigella flexneri 2a str. 301
agaagcaguaagugcgc

SEQ ID NO: 3884792 - RNA, 22 nt, Shigella flexneri 2a str. 301
agaagcauuuuacauccugaua

SEQ ID NO: 3884793 - RNA, 22 nt, Shigella flexneri 2a str. 301
agaagccauuaaacaccaguac

SEQ ID NO: 3884794 - RNA, 15 nt, Shigella flexneri 2a str. 301
agaagcccauacccg

SEQ ID NO: 3884795 - RNA, 18 nt, Shigella flexneri 2a str. 301
agaagccgaucgugcuaa

SEQ ID NO: 3884796 - RNA, 16 nt, Shigella flexneri 2a str. 301
agaagcggaaaucacg

SEQ ID NO: 3884797 - RNA, 20 nt, Shigella flexneri 2a str. 301
agaagcggaaaucacgcauc

SEQ ID NO: 3884798 - RNA, 22 nt, Shigella flexneri 2a str. 301
agaagcguaaaucccagcaccg

SEQ ID NO: 3884799 - RNA, 14 nt, Shigella flexneri 2a str. 301
agaagcguuccauu

SEQ ID NO: 3884800 - RNA, 13 nt, Shigella flexneri 2a str. 301
agaagcugcagga

SEQ ID NO: 3884801 - RNA, 13 nt, Shigella flexneri 2a str. 301
agaagcuggaagg

SEQ ID NO: 3884802 - RNA, 12 nt, Shigella flexneri 2a str. 301
agaagcuggcga

SEQ ID NO: 3884803 - RNA, 19 nt, Shigella flexneri 2a str. 301
agaagcuuuccacgcaggc

SEQ ID NO: 3884804 - RNA, 20 nt, Shigella flexneri 2a str. 301
agaagcuuuucucaauauaa

SEQ ID NO: 3884805 - RNA, 23 nt, Shigella flexneri 2a str. 301
agaaggaaaauacagcaauggaa

SEQ ID NO: 3884806 - RNA, 23 nt, Shigella flexneri 2a str. 301
agaaggauugaucaauucuaaau

SEQ ID NO: 3884807 - RNA, 23 nt, Shigella flexneri 2a str. 301
agaaggcauaacuccccgagaaa

SEQ ID NO: 3884808 - RNA, 14 nt, Shigella flexneri 2a str. 301
agaagggcuggcca

SEQ ID NO: 3884809 - RNA, 20 nt, Shigella flexneri 2a str. 301
agaagguuauccuucugcgu

SEQ ID NO: 3884810 - RNA, 22 nt, Shigella flexneri 2a str. 301
agaaguaaacgccgagcuggaa

SEQ ID NO: 3884811 - RNA, 23 nt, Shigella flexneri 2a str. 301
agaaguaaucuacugcaccgcag

SEQ ID NO: 3884812 - RNA, 20 nt, Shigella flexneri 2a str. 301
agaaguacguagcguaagga

SEQ ID NO: 3884813 - RNA, 23 nt, Shigella flexneri 2a str. 301
agaagucgcaaugaguauuacuu

SEQ ID NO: 3884814 - RNA, 23 nt, Shigella flexneri 2a str. 301
agaaguucaggguuaaaucucag

SEQ ID NO: 3884815 - RNA, 13 nt, Shigella flexneri 2a str. 301
agaaguucugcag

SEQ ID NO: 3884816 - RNA, 13 nt, Shigella flexneri 2a str. 301
agaauaaaacagg

SEQ ID NO: 3884817 - RNA, 15 nt, Shigella flexneri 2a str. 301
agaauaauaccgucc

SEQ ID NO: 3884818 - RNA, 22 nt, Shigella flexneri 2a str. 301
agaauaccuugcugcuccagcg

SEQ ID NO: 3884819 - RNA, 14 nt, Shigella flexneri 2a str. 301
agaauagacaaaaa

SEQ ID NO: 3884820 - RNA, 17 nt, Shigella flexneri 2a str. 301
agaauagacaaaaauuu

SEQ ID NO: 3884821 - RNA, 19 nt, Shigella flexneri 2a str. 301
agaauaguuugauuaacgc

SEQ ID NO: 3884822 - RNA, 18 nt, Shigella flexneri 2a str. 301
agaauaucgguaucagcc

SEQ ID NO: 3884823 - RNA, 14 nt, Shigella flexneri 2a str. 301
agaauaugcuuugc

SEQ ID NO: 3884824 - RNA, 19 nt, Shigella flexneri 2a str. 301
agaauauugccgaagacca

SEQ ID NO: 3884825 - RNA, 14 nt, Shigella flexneri 2a str. 301
agaauauuugauug

SEQ ID NO: 3884826 - RNA, 14 nt, Shigella flexneri 2a str. 301
agaaucaagucuau

SEQ ID NO: 3884827 - RNA, 16 nt, Shigella flexneri 2a str. 301
agaaucaagucuauuu

SEQ ID NO: 3884828 - RNA, 19 nt, Shigella flexneri 2a str. 301
agaaucaaucucagcgaug

SEQ ID NO: 3884829 - RNA, 13 nt, Shigella flexneri 2a str. 301
agaaucaccucuu

SEQ ID NO: 3884830 - RNA, 20 nt, Shigella flexneri 2a str. 301
agaaucaccucuuuuuccac

SEQ ID NO: 3884831 - RNA, 17 nt, Shigella flexneri 2a str. 301
agaaucacgccaacaaa

SEQ ID NO: 3884832 - RNA, 17 nt, Shigella flexneri 2a str. 301
agaaucacuucaucgcc

SEQ ID NO: 3884833 - RNA, 18 nt, Shigella flexneri 2a str. 301
agaaucagcgagacaaca

SEQ ID NO: 3884834 - RNA, 16 nt, Shigella flexneri 2a str. 301
agaaucaugccaaaaa

SEQ ID NO: 3884835 - RNA, 15 nt, Shigella flexneri 2a str. 301
agaauccaggaaagc

SEQ ID NO: 3884836 - RNA, 16 nt, Shigella flexneri 2a str. 301
agaauccccacugcau

SEQ ID NO: 3884837 - RNA, 19 nt, Shigella flexneri 2a str. 301
agaauccccacugcauggc

SEQ ID NO: 3884838 - RNA, 16 nt, Shigella flexneri 2a str. 301
agaauccggugccuua

SEQ ID NO: 3884839 - RNA, 14 nt, Shigella flexneri 2a str. 301
agaaucgccagcau

SEQ ID NO: 3884840 - RNA, 17 nt, Shigella flexneri 2a str. 301
agaaucgggaaauaaca

SEQ ID NO: 3884841 - RNA, 13 nt, Shigella flexneri 2a str. 301
agaaucgguccac

SEQ ID NO: 3884842 - RNA, 18 nt, Shigella flexneri 2a str. 301
agaaucuaagaucccugc

SEQ ID NO: 3884843 - RNA, 14 nt, Shigella flexneri 2a str. 301
agaaucucugacag

SEQ ID NO: 3884844 - RNA, 19 nt, Shigella flexneri 2a str. 301
agaaucucuuuuguuuccc

SEQ ID NO: 3884845 - RNA, 20 nt, Shigella flexneri 2a str. 301
agaaucugcguaaauauggc

SEQ ID NO: 3884846 - RNA, 18 nt, Shigella flexneri 2a str. 301
agaaucuggcgcagguga

SEQ ID NO: 3884847 - RNA, 14 nt, Shigella flexneri 2a str. 301
agaaugauggcuga

SEQ ID NO: 3884848 - RNA, 17 nt, Shigella flexneri 2a str. 301
agaaugauggcugacgg

SEQ ID NO: 3884849 - RNA, 11 nt, Shigella flexneri 2a str. 301
agaaugcccca

SEQ ID NO: 3884850 - RNA, 22 nt, Shigella flexneri 2a str. 301
agaaugccgcaaaacuuccaug

SEQ ID NO: 3884851 - RNA, 14 nt, Shigella flexneri 2a str. 301
agacgccagccaca

SEQ ID NO: 3884852 - RNA, 17 nt, Shigella flexneri 2a str. 301
agacgcgcuagccucag

SEQ ID NO: 3884853 - RNA, 18 nt, Shigella flexneri 2a str. 301
agacgcgcuugcauuacu

SEQ ID NO: 3884854 - RNA, 21 nt, Shigella flexneri 2a str. 301
agacgcggcagcgucgcaucc

SEQ ID NO: 3884855 - RNA, 14 nt, Shigella flexneri 2a str. 301
agacgcgucagcgu

SEQ ID NO: 3884856 - RNA, 16 nt, Shigella flexneri 2a str. 301
agacgcgucagugucu

SEQ ID NO: 3884857 - RNA, 19 nt, Shigella flexneri 2a str. 301
agacgcucgccauuuuuca

SEQ ID NO: 3884858 - RNA, 21 nt, Shigella flexneri 2a str. 301
agacgcucguuaaaacgcgcg

SEQ ID NO: 3884859 - RNA, 17 nt, Shigella flexneri 2a str. 301
agacgcugcauugacaa

SEQ ID NO: 3884860 - RNA, 20 nt, Shigella flexneri 2a str. 301
agacgguuaaaaacagccag

SEQ ID NO: 3884861 - RNA, 23 nt, Shigella flexneri 2a str. 301
agacgguuuaucucaucuuccac

SEQ ID NO: 3884862 - RNA, 12 nt, Shigella flexneri 2a str. 301
agacgguuuuuc

SEQ ID NO: 3884863 - RNA, 22 nt, Shigella flexneri 2a str. 301
agacgucccgccgcuaucccau

SEQ ID NO: 3884864 - RNA, 21 nt, Shigella flexneri 2a str. 301
agacguguugucagcucaucc

SEQ ID NO: 3884865 - RNA, 16 nt, Shigella flexneri 2a str. 301
agacguugauucacuu

SEQ ID NO: 3884866 - RNA, 23 nt, Shigella flexneri 2a str. 301
agacguugauucacuuucugaag

SEQ ID NO: 3884867 - RNA, 17 nt, Shigella flexneri 2a str. 301
agacuaaauuucacugc

SEQ ID NO: 3884868 - RNA, 16 nt, Shigella flexneri 2a str. 301
agacuaauugagcgug

SEQ ID NO: 3884869 - RNA, 14 nt, Shigella flexneri 2a str. 301
agacucaaaccaau

SEQ ID NO: 3884870 - RNA, 12 nt, Shigella flexneri 2a str. 301
agacucaagcag

SEQ ID NO: 3884871 - RNA, 17 nt, Shigella flexneri 2a str. 301
agacucauauaaaaacc

SEQ ID NO: 3884872 - RNA, 14 nt, Shigella flexneri 2a str. 301
agacucccagccuc

SEQ ID NO: 3884873 - RNA, 19 nt, Shigella flexneri 2a str. 301
agacugauaucccgcgcgu

SEQ ID NO: 3884874 - RNA, 14 nt, Shigella flexneri 2a str. 301
agacugaugacaaa

SEQ ID NO: 3884875 - RNA, 18 nt, Shigella flexneri 2a str. 301
agacugaugacaaacaca

SEQ ID NO: 3884876 - RNA, 19 nt, Shigella flexneri 2a str. 301
agacugaugacaaacggaa

SEQ ID NO: 3884877 - RNA, 16 nt, Shigella flexneri 2a str. 301
agacugaugacuaaag

SEQ ID NO: 3884878 - RNA, 17 nt, Shigella flexneri 2a str. 301
agacugaugugauccau

SEQ ID NO: 3884879 - RNA, 14 nt, Shigella flexneri 2a str. 301
agacugcaagaaua

SEQ ID NO: 3884880 - RNA, 15 nt, Shigella flexneri 2a str. 301
agacugcgcuaccag

SEQ ID NO: 3884881 - RNA, 22 nt, Shigella flexneri 2a str. 301
agacuggaaacucacgccagca

SEQ ID NO: 3884882 - RNA, 16 nt, Shigella flexneri 2a str. 301
agacuggauugccagc

SEQ ID NO: 3884883 - RNA, 21 nt, Shigella flexneri 2a str. 301
agacuggcaaagcaggccaga

SEQ ID NO: 3884884 - RNA, 21 nt, Shigella flexneri 2a str. 301
agacuggcaaaugacauaaac

SEQ ID NO: 3884885 - RNA, 13 nt, Shigella flexneri 2a str. 301
agacugggcaaga

SEQ ID NO: 3884886 - RNA, 14 nt, Shigella flexneri 2a str. 301
agacugggcaagau

SEQ ID NO: 3884887 - RNA, 20 nt, Shigella flexneri 2a str. 301
agacuguagaugaucgccgc

SEQ ID NO: 3884888 - RNA, 14 nt, Shigella flexneri 2a str. 301
agacugugaaucau

SEQ ID NO: 3884889 - RNA, 21 nt, Shigella flexneri 2a str. 301
agacuucccucccguuucccu

SEQ ID NO: 3884890 - RNA, 16 nt, Shigella flexneri 2a str. 301
agacuuugcugccuuu

SEQ ID NO: 3884891 - RNA, 13 nt, Shigella flexneri 2a str. 301
agagaaaaccaau

SEQ ID NO: 3884892 - RNA, 16 nt, Shigella flexneri 2a str. 301
agagaaaagcaaaaga

SEQ ID NO: 3884893 - RNA, 14 nt, Shigella flexneri 2a str. 301
agagaaaaucacac

SEQ ID NO: 3884894 - RNA, 22 nt, Shigella flexneri 2a str. 301
agagaaaaugccgcacaucacc

SEQ ID NO: 3884895 - RNA, 16 nt, Shigella flexneri 2a str. 301
agagaaaccacaucaa

SEQ ID NO: 3884896 - RNA, 21 nt, Shigella flexneri 2a str. 301
agagaaagaacgaguaaaagg

SEQ ID NO: 3884897 - RNA, 15 nt, Shigella flexneri 2a str. 301
agagaaagcaaaaau

SEQ ID NO: 3884898 - RNA, 12 nt, Shigella flexneri 2a str. 301
agagaaaguaaa

SEQ ID NO: 3884899 - RNA, 13 nt, Shigella flexneri 2a str. 301
agagaagguaaag

SEQ ID NO: 3884900 - RNA, 21 nt, Shigella flexneri 2a str. 301
agagaauauuaacggucauuc

SEQ ID NO: 3884901 - RNA, 16 nt, Shigella flexneri 2a str. 301
agagacgcugaaaagc

SEQ ID NO: 3884902 - RNA, 21 nt, Shigella flexneri 2a str. 301
agagacguucgcguacugcug

SEQ ID NO: 3884903 - RNA, 13 nt, Shigella flexneri 2a str. 301
agagagccagccc

SEQ ID NO: 3884904 - RNA, 20 nt, Shigella flexneri 2a str. 301
agagagccagccccacagca

SEQ ID NO: 3884905 - RNA, 16 nt, Shigella flexneri 2a str. 301
agagagcgccagaagu

SEQ ID NO: 3884906 - RNA, 18 nt, Shigella flexneri 2a str. 301
agagauaaacgaccacuc

SEQ ID NO: 3884907 - RNA, 14 nt, Shigella flexneri 2a str. 301
agagauaauaaaac

SEQ ID NO: 3884908 - RNA, 22 nt, Shigella flexneri 2a str. 301
agagauagcacgacguuucuuu

SEQ ID NO: 3884909 - RNA, 13 nt, Shigella flexneri 2a str. 301
agagaucagauaa

SEQ ID NO: 3884910 - RNA, 16 nt, Shigella flexneri 2a str. 301
agagaucauacagaug

SEQ ID NO: 3884911 - RNA, 19 nt, Shigella flexneri 2a str. 301
agagaucgaacagcagcag

SEQ ID NO: 3884912 - RNA, 22 nt, Shigella flexneri 2a str. 301
agagaucgauguuuucugccuc

SEQ ID NO: 3884913 - RNA, 15 nt, Shigella flexneri 2a str. 301
agagauguugaagaa

SEQ ID NO: 3884914 - RNA, 22 nt, Shigella flexneri 2a str. 301
agagauuacuuuauuuauauca

SEQ ID NO: 3884915 - RNA, 16 nt, Shigella flexneri 2a str. 301
agagauucuuuuccuu

SEQ ID NO: 3884916 - RNA, 22 nt, Shigella flexneri 2a str. 301
agagcaaaaaucgacagcagga

SEQ ID NO: 3884917 - RNA, 15 nt, Shigella flexneri 2a str. 301
agagcaaauaaaaca

SEQ ID NO: 3884918 - RNA, 20 nt, Shigella flexneri 2a str. 301
agagcaaauaaaacaucacc

SEQ ID NO: 3884919 - RNA, 14 nt, Shigella flexneri 2a str. 301
agagcaacauacag

SEQ ID NO: 3884920 - RNA, 13 nt, Shigella flexneri 2a str. 301
agagcaaccaccu

SEQ ID NO: 3884921 - RNA, 17 nt, Shigella flexneri 2a str. 301
agagcaacggcgaaucu

SEQ ID NO: 3884922 - RNA, 15 nt, Shigella flexneri 2a str. 301
agagcagcaucaaua

SEQ ID NO: 3884923 - RNA, 22 nt, Shigella flexneri 2a str. 301
agagcaucaguuaacggcacca

SEQ ID NO: 3884924 - RNA, 19 nt, Shigella flexneri 2a str. 301
agagcaucaugaauauaua

SEQ ID NO: 3884925 - RNA, 20 nt, Shigella flexneri 2a str. 301
agagcaucgguaucuuccca

SEQ ID NO: 3884926 - RNA, 18 nt, Shigella flexneri 2a str. 301
agagcaugaaaugaaaau

SEQ ID NO: 3884927 - RNA, 23 nt, Shigella flexneri 2a str. 301
agagccaccaacucugggcugaa

SEQ ID NO: 3884928 - RNA, 13 nt, Shigella flexneri 2a str. 301
agagccagcccca

SEQ ID NO: 3884929 - RNA, 16 nt, Shigella flexneri 2a str. 301
agagccggacugacau

SEQ ID NO: 3884930 - RNA, 22 nt, Shigella flexneri 2a str. 301
agagccucgucggcgguuuuca

SEQ ID NO: 3884931 - RNA, 22 nt, Shigella flexneri 2a str. 301
agagccugccaauggcaggcuc

SEQ ID NO: 3884932 - RNA, 14 nt, Shigella flexneri 2a str. 301
agagcgagggagaa

SEQ ID NO: 3884933 - RNA, 14 nt, Shigella flexneri 2a str. 301
agagcgcggcgcag

SEQ ID NO: 3884934 - RNA, 15 nt, Shigella flexneri 2a str. 301
agagcggagcaauga

SEQ ID NO: 3884935 - RNA, 12 nt, Shigella flexneri 2a str. 301
agagcgucugga

SEQ ID NO: 3884936 - RNA, 13 nt, Shigella flexneri 2a str. 301
agagcgucuggaa

SEQ ID NO: 3884937 - RNA, 13 nt, Shigella flexneri 2a str. 301
agagcuaacugga

SEQ ID NO: 3884938 - RNA, 19 nt, Shigella flexneri 2a str. 301
agagcuacaaaguguuguu

SEQ ID NO: 3884939 - RNA, 17 nt, Shigella flexneri 2a str. 301
agagcugaagcauggug

SEQ ID NO: 3884940 - RNA, 19 nt, Shigella flexneri 2a str. 301
agagcugaauaucacgggc

SEQ ID NO: 3884941 - RNA, 14 nt, Shigella flexneri 2a str. 301
agagcugauuuccg

SEQ ID NO: 3884942 - RNA, 21 nt, Shigella flexneri 2a str. 301
agagcuggcgaacgugcagga

SEQ ID NO: 3884943 - RNA, 22 nt, Shigella flexneri 2a str. 301
agagcuugugcaccagcuggcu

SEQ ID NO: 3884944 - RNA, 15 nt, Shigella flexneri 2a str. 301
agaggaaucgcuguu

SEQ ID NO: 3884945 - RNA, 17 nt, Shigella flexneri 2a str. 301
agaggagccaucaccau

SEQ ID NO: 3884946 - RNA, 22 nt, Shigella flexneri 2a str. 301
agaggcacauagccaccuuaua

SEQ ID NO: 3884947 - RNA, 13 nt, Shigella flexneri 2a str. 301
agaggcccuggaa

SEQ ID NO: 3884948 - RNA, 14 nt, Shigella flexneri 2a str. 301
agaggcgugccagg

SEQ ID NO: 3884949 - RNA, 19 nt, Shigella flexneri 2a str. 301
agaggcguguggugaggug

SEQ ID NO: 3884950 - RNA, 18 nt, Shigella flexneri 2a str. 301
agaggcguuccugcaacg

SEQ ID NO: 3884951 - RNA, 16 nt, Shigella flexneri 2a str. 301
agaugaaaacgccgga

SEQ ID NO: 3884952 - RNA, 23 nt, Shigella flexneri 2a str. 301
agaugaaauaguugcauuccagu

SEQ ID NO: 3884953 - RNA, 18 nt, Shigella flexneri 2a str. 301
agaugaagcuggcaaagu

SEQ ID NO: 3884954 - RNA, 23 nt, Shigella flexneri 2a str. 301
agaugacuugccgcaaaacccag

SEQ ID NO: 3884955 - RNA, 13 nt, Shigella flexneri 2a str. 301
agaugauaacccc

SEQ ID NO: 3884956 - RNA, 22 nt, Shigella flexneri 2a str. 301
agaugauaaccccgcaauuuca

SEQ ID NO: 3884957 - RNA, 18 nt, Shigella flexneri 2a str. 301
agaugauggcauucucac

SEQ ID NO: 3884958 - RNA, 19 nt, Shigella flexneri 2a str. 301
agaugauggcauucucacu

SEQ ID NO: 3884959 - RNA, 19 nt, Shigella flexneri 2a str. 301
agaugaugucacagccgca

SEQ ID NO: 3884960 - RNA, 23 nt, Shigella flexneri 2a str. 301
agaugcaccguuucuuugccgag

SEQ ID NO: 3884961 - RNA, 15 nt, Shigella flexneri 2a str. 301
agaugccaaucaguu

SEQ ID NO: 3884962 - RNA, 15 nt, Shigella flexneri 2a str. 301
agaugccauuggcau

SEQ ID NO: 3884963 - RNA, 19 nt, Shigella flexneri 2a str. 301
agaugcgacggcaccacau

SEQ ID NO: 3884964 - RNA, 21 nt, Shigella flexneri 2a str. 301
agaugcggcgugaacgccuua

SEQ ID NO: 3884965 - RNA, 12 nt, Shigella flexneri 2a str. 301
agaugcguucac

SEQ ID NO: 3884966 - RNA, 16 nt, Shigella flexneri 2a str. 301
agaugcuacaacaucg

SEQ ID NO: 3884967 - RNA, 22 nt, Shigella flexneri 2a str. 301
agaugcuugcgauauucuucag

SEQ ID NO: 3884968 - RNA, 14 nt, Shigella flexneri 2a str. 301
agauggcggcuggc

SEQ ID NO: 3884969 - RNA, 12 nt, Shigella flexneri 2a str. 301
agauggcuucau

SEQ ID NO: 3884970 - RNA, 20 nt, Shigella flexneri 2a str. 301
agauggcuuugcccuuucug

SEQ ID NO: 3884971 - RNA, 22 nt, Shigella flexneri 2a str. 301
agauggucuguaccaccagaau

SEQ ID NO: 3884972 - RNA, 17 nt, Shigella flexneri 2a str. 301
agaugguggucauauca

SEQ ID NO: 3884973 - RNA, 20 nt, Shigella flexneri 2a str. 301
agaugguuacgcauaaaacc

SEQ ID NO: 3884974 - RNA, 21 nt, Shigella flexneri 2a str. 301
agauguacgccagugcucccg

SEQ ID NO: 3884975 - RNA, 21 nt, Shigella flexneri 2a str. 301
agaugucggggccagaacaaa

SEQ ID NO: 3884976 - RNA, 23 nt, Shigella flexneri 2a str. 301
agaugucggggccagaacaaacu

SEQ ID NO: 3884977 - RNA, 14 nt, Shigella flexneri 2a str. 301
agaugucuuuaccc

SEQ ID NO: 3884978 - RNA, 20 nt, Shigella flexneri 2a str. 301
agaugugagcgauacccauu

SEQ ID NO: 3884979 - RNA, 19 nt, Shigella flexneri 2a str. 301
agaugugggcaaucucacu

SEQ ID NO: 3884980 - RNA, 20 nt, Shigella flexneri 2a str. 301
agauguucuaucuuucagac

SEQ ID NO: 3884981 - RNA, 16 nt, Shigella flexneri 2a str. 301
agauguugucucagau

SEQ ID NO: 3884982 - RNA, 21 nt, Shigella flexneri 2a str. 301
agauguugucucagauucaga

SEQ ID NO: 3884983 - RNA, 23 nt, Shigella flexneri 2a str. 301
agauguugucucagcuucagauu

SEQ ID NO: 3884984 - RNA, 13 nt, Shigella flexneri 2a str. 301
agauuaaaaguga

SEQ ID NO: 3884985 - RNA, 15 nt, Shigella flexneri 2a str. 301
agauuaaaccaguuc

SEQ ID NO: 3884986 - RNA, 18 nt, Shigella flexneri 2a str. 301
agauuaaucagcagauau

SEQ ID NO: 3884987 - RNA, 13 nt, Shigella flexneri 2a str. 301
agauuacaauucu

SEQ ID NO: 3884988 - RNA, 18 nt, Shigella flexneri 2a str. 301
agauuacgcucugacgac

SEQ ID NO: 3884989 - RNA, 23 nt, Shigella flexneri 2a str. 301
agauuagcccccguuuuguuguc

SEQ ID NO: 3884990 - RNA, 11 nt, Shigella flexneri 2a str. 301
agauuaugccg

SEQ ID NO: 3884991 - RNA, 13 nt, Shigella flexneri 2a str. 301
agauuauugacaa

SEQ ID NO: 3884992 - RNA, 14 nt, Shigella flexneri 2a str. 301
agauucaauuauag

SEQ ID NO: 3884993 - RNA, 22 nt, Shigella flexneri 2a str. 301
agauucagcagcguggugcuga

SEQ ID NO: 3884994 - RNA, 16 nt, Shigella flexneri 2a str. 301
agauucaggcgcagca

SEQ ID NO: 3884995 - RNA, 14 nt, Shigella flexneri 2a str. 301
agauucgauagaga

SEQ ID NO: 3884996 - RNA, 15 nt, Shigella flexneri 2a str. 301
agauucgguaaccau

SEQ ID NO: 3884997 - RNA, 23 nt, Shigella flexneri 2a str. 301
agauucgguaaccauccauucag

SEQ ID NO: 3884998 - RNA, 19 nt, Shigella flexneri 2a str. 301
agauucguauuuaaaaccc

SEQ ID NO: 3884999 - RNA, 14 nt, Shigella flexneri 2a str. 301
agauugaagugaac

SEQ ID NO: 3885000 - RNA, 15 nt, Shigella flexneri 2a str. 301
agauugauccccgcu

SEQ ID NO: 3885001 - RNA, 18 nt, Shigella flexneri 2a str. 301
agauugcaccacaucggu

SEQ ID NO: 3885002 - RNA, 19 nt, Shigella flexneri 2a str. 301
agauugcagacaaagugag

SEQ ID NO: 3885003 - RNA, 22 nt, Shigella flexneri 2a str. 301
agauugccugaugcgcugggca

SEQ ID NO: 3885004 - RNA, 18 nt, Shigella flexneri 2a str. 301
agauugcgaauauguacu

SEQ ID NO: 3885005 - RNA, 23 nt, Shigella flexneri 2a str. 301
agauugguaaugcguaacguuuc

SEQ ID NO: 3885006 - RNA, 22 nt, Shigella flexneri 2a str. 301
agauuguugauuaacaggcugc

SEQ ID NO: 3885007 - RNA, 16 nt, Shigella flexneri 2a str. 301
agauuuaacggcagca

SEQ ID NO: 3885008 - RNA, 18 nt, Shigella flexneri 2a str. 301
agauuuaacggcagcaag

SEQ ID NO: 3885009 - RNA, 20 nt, Shigella flexneri 2a str. 301
agauuuaauaacaacgauau

SEQ ID NO: 3885010 - RNA, 19 nt, Shigella flexneri 2a str. 301
agauuuaugacaaacgcaa

SEQ ID NO: 3885011 - RNA, 18 nt, Shigella flexneri 2a str. 301
agauuuauuuauuauuaa

SEQ ID NO: 3885012 - RNA, 20 nt, Shigella flexneri 2a str. 301
agauuucaaucuggccugag

SEQ ID NO: 3885013 - RNA, 12 nt, Shigella flexneri 2a str. 301
agauuucaccaa

SEQ ID NO: 3885014 - RNA, 13 nt, Shigella flexneri 2a str. 301
agauuuugccagc

SEQ ID NO: 3885015 - RNA, 14 nt, Shigella flexneri 2a str. 301
agauuuuuauccag

SEQ ID NO: 3885016 - RNA, 13 nt, Shigella flexneri 2a str. 301
agcaaaacgcccc

SEQ ID NO: 3885017 - RNA, 21 nt, Shigella flexneri 2a str. 301
agcaaaaucguaagcaggaga

SEQ ID NO: 3885018 - RNA, 19 nt, Shigella flexneri 2a str. 301
agcaaacaauaauuaucau

SEQ ID NO: 3885019 - RNA, 13 nt, Shigella flexneri 2a str. 301
agcaaacaggugc

SEQ ID NO: 3885020 - RNA, 17 nt, Shigella flexneri 2a str. 301
agcaaacccgaccacca

SEQ ID NO: 3885021 - RNA, 20 nt, Shigella flexneri 2a str. 301
agcaaacuaucuguguaaug

SEQ ID NO: 3885022 - RNA, 21 nt, Shigella flexneri 2a str. 301
agcaaagcggucuucugugau

SEQ ID NO: 3885023 - RNA, 22 nt, Shigella flexneri 2a str. 301
agcaaaggugccuuuaauacca

SEQ ID NO: 3885024 - RNA, 18 nt, Shigella flexneri 2a str. 301
agcaaaguaauaaugauc

SEQ ID NO: 3885025 - RNA, 22 nt, Shigella flexneri 2a str. 301
agcaaaguaccaucguccagca

SEQ ID NO: 3885026 - RNA, 22 nt, Shigella flexneri 2a str. 301
agcaaaguggcgcagagccuga

SEQ ID NO: 3885027 - RNA, 17 nt, Shigella flexneri 2a str. 301
agcaaauaaaacaucac

SEQ ID NO: 3885028 - RNA, 20 nt, Shigella flexneri 2a str. 301
agcaaauaaaacaucaccaa

SEQ ID NO: 3885029 - RNA, 20 nt, Shigella flexneri 2a str. 301
agcaaaucgcggcaguggcu

SEQ ID NO: 3885030 - RNA, 21 nt, Shigella flexneri 2a str. 301
agcaaaucgcggcaguggcua

SEQ ID NO: 3885031 - RNA, 17 nt, Shigella flexneri 2a str. 301
agcaaauuaucccccag

SEQ ID NO: 3885032 - RNA, 21 nt, Shigella flexneri 2a str. 301
agcaaauuaucccccagcacu

SEQ ID NO: 3885033 - RNA, 12 nt, Shigella flexneri 2a str. 301
agcaacaacagc

SEQ ID NO: 3885034 - RNA, 15 nt, Shigella flexneri 2a str. 301
agcaacacaaucaga

SEQ ID NO: 3885035 - RNA, 22 nt, Shigella flexneri 2a str. 301
agcaacacgccagcguuauccc

SEQ ID NO: 3885036 - RNA, 18 nt, Shigella flexneri 2a str. 301
agcaacagcgccgagcac

SEQ ID NO: 3885037 - RNA, 13 nt, Shigella flexneri 2a str. 301
agcaacaggccag

SEQ ID NO: 3885038 - RNA, 21 nt, Shigella flexneri 2a str. 301
agcaacaggccaguucgaaau

SEQ ID NO: 3885039 - RNA, 12 nt, Shigella flexneri 2a str. 301
agcaacaucaaa

SEQ ID NO: 3885040 - RNA, 22 nt, Shigella flexneri 2a str. 301
agcaacaucaaaugcgcagcca

SEQ ID NO: 3885041 - RNA, 15 nt, Shigella flexneri 2a str. 301
agcaaccaacgccag

SEQ ID NO: 3885042 - RNA, 17 nt, Shigella flexneri 2a str. 301
agcaaccaacgccagca

SEQ ID NO: 3885043 - RNA, 18 nt, Shigella flexneri 2a str. 301
agcaaccaacgccagcag

SEQ ID NO: 3885044 - RNA, 16 nt, Shigella flexneri 2a str. 301
agcaaccaaugccacc

SEQ ID NO: 3885045 - RNA, 17 nt, Shigella flexneri 2a str. 301
agcaaccgguaaagaag

SEQ ID NO: 3885046 - RNA, 21 nt, Shigella flexneri 2a str. 301
agcaaccucgcccauuuuuca

SEQ ID NO: 3885047 - RNA, 15 nt, Shigella flexneri 2a str. 301
agcaacgaaacgccg

SEQ ID NO: 3885048 - RNA, 17 nt, Shigella flexneri 2a str. 301
agcaacgaaacgccggu

SEQ ID NO: 3885049 - RNA, 15 nt, Shigella flexneri 2a str. 301
agcaacgccuaaacu

SEQ ID NO: 3885050 - RNA, 14 nt, Shigella flexneri 2a str. 301
agcagaccagcaaa

SEQ ID NO: 3885051 - RNA, 16 nt, Shigella flexneri 2a str. 301
agcagaccagcaaaaa

SEQ ID NO: 3885052 - RNA, 22 nt, Shigella flexneri 2a str. 301
agcagaccccagguuuucaacg

SEQ ID NO: 3885053 - RNA, 18 nt, Shigella flexneri 2a str. 301
agcagacgcuccauugcc

SEQ ID NO: 3885054 - RNA, 23 nt, Shigella flexneri 2a str. 301
agcagacgcuccauugcccgccc

SEQ ID NO: 3885055 - RNA, 16 nt, Shigella flexneri 2a str. 301
agcagagaaacgccag

SEQ ID NO: 3885056 - RNA, 13 nt, Shigella flexneri 2a str. 301
agcagagagacaa

SEQ ID NO: 3885057 - RNA, 18 nt, Shigella flexneri 2a str. 301
agcagagauacaggccac

SEQ ID NO: 3885058 - RNA, 15 nt, Shigella flexneri 2a str. 301
agcagagcaugguua

SEQ ID NO: 3885059 - RNA, 18 nt, Shigella flexneri 2a str. 301
agcagauaacccagcagc

SEQ ID NO: 3885060 - RNA, 20 nt, Shigella flexneri 2a str. 301
agcagauaacccagcagccc

SEQ ID NO: 3885061 - RNA, 18 nt, Shigella flexneri 2a str. 301
agcagauacggcgcaucu

SEQ ID NO: 3885062 - RNA, 19 nt, Shigella flexneri 2a str. 301
agcagauaucccgccagca

SEQ ID NO: 3885063 - RNA, 14 nt, Shigella flexneri 2a str. 301
agcagauaugccag

SEQ ID NO: 3885064 - RNA, 19 nt, Shigella flexneri 2a str. 301
agcagcacaaugccgguga

SEQ ID NO: 3885065 - RNA, 17 nt, Shigella flexneri 2a str. 301
agcagcaccaccgcccg

SEQ ID NO: 3885066 - RNA, 18 nt, Shigella flexneri 2a str. 301
agcagcaccaccgcccgu

SEQ ID NO: 3885067 - RNA, 16 nt, Shigella flexneri 2a str. 301
agcagcagucaggcgc

SEQ ID NO: 3885068 - RNA, 15 nt, Shigella flexneri 2a str. 301
agcagcauacccacc

SEQ ID NO: 3885069 - RNA, 16 nt, Shigella flexneri 2a str. 301
agcagccacaccaauc

SEQ ID NO: 3885070 - RNA, 16 nt, Shigella flexneri 2a str. 301
agcagccaucugauga

SEQ ID NO: 3885071 - RNA, 12 nt, Shigella flexneri 2a str. 301
agcagcccugcc

SEQ ID NO: 3885072 - RNA, 15 nt, Shigella flexneri 2a str. 301
agcagcgcaauuaac

SEQ ID NO: 3885073 - RNA, 15 nt, Shigella flexneri 2a str. 301
agcagcgcgcccggu

SEQ ID NO: 3885074 - RNA, 16 nt, Shigella flexneri 2a str. 301
agcagcggcagaucaa

SEQ ID NO: 3885075 - RNA, 16 nt, Shigella flexneri 2a str. 301
agcagcguuaaugaua

SEQ ID NO: 3885076 - RNA, 13 nt, Shigella flexneri 2a str. 301
agcagcuccgcca

SEQ ID NO: 3885077 - RNA, 18 nt, Shigella flexneri 2a str. 301
agcagcugacuuccagcc

SEQ ID NO: 3885078 - RNA, 16 nt, Shigella flexneri 2a str. 301
agcagcugcucccagc

SEQ ID NO: 3885079 - RNA, 18 nt, Shigella flexneri 2a str. 301
agcagcuuucagcagcgg

SEQ ID NO: 3885080 - RNA, 14 nt, Shigella flexneri 2a str. 301
agcaggagcagcag

SEQ ID NO: 3885081 - RNA, 12 nt, Shigella flexneri 2a str. 301
agcaggagucau

SEQ ID NO: 3885082 - RNA, 14 nt, Shigella flexneri 2a str. 301
agcaggauggcugg

SEQ ID NO: 3885083 - RNA, 21 nt, Shigella flexneri 2a str. 301
agcaggauggcuggccgugca

SEQ ID NO: 3885084 - RNA, 14 nt, Shigella flexneri 2a str. 301
agcaggauguuccg

SEQ ID NO: 3885085 - RNA, 12 nt, Shigella flexneri 2a str. 301
agcaggcauccu

SEQ ID NO: 3885086 - RNA, 17 nt, Shigella flexneri 2a str. 301
agcaggcauccugaucg

SEQ ID NO: 3885087 - RNA, 22 nt, Shigella flexneri 2a str. 301
agcaggccggguuuucucccuc

SEQ ID NO: 3885088 - RNA, 13 nt, Shigella flexneri 2a str. 301
agcaggcucagaa

SEQ ID NO: 3885089 - RNA, 15 nt, Shigella flexneri 2a str. 301
agcaggcugcacugg

SEQ ID NO: 3885090 - RNA, 13 nt, Shigella flexneri 2a str. 301
agcaggcuggcua

SEQ ID NO: 3885091 - RNA, 22 nt, Shigella flexneri 2a str. 301
agcaggguuucaucgguggugu

SEQ ID NO: 3885092 - RNA, 22 nt, Shigella flexneri 2a str. 301
agcagguccccgagcacaugca

SEQ ID NO: 3885093 - RNA, 19 nt, Shigella flexneri 2a str. 301
agcaguaaaccacccacca

SEQ ID NO: 3885094 - RNA, 19 nt, Shigella flexneri 2a str. 301
agcaguaaggucaucaauc

SEQ ID NO: 3885095 - RNA, 19 nt, Shigella flexneri 2a str. 301
agcaguaauugcagcagcu

SEQ ID NO: 3885096 - RNA, 13 nt, Shigella flexneri 2a str. 301
agcaguacagccg

SEQ ID NO: 3885097 - RNA, 23 nt, Shigella flexneri 2a str. 301
agcaguacgccgagaauaaaaca

SEQ ID NO: 3885098 - RNA, 21 nt, Shigella flexneri 2a str. 301
agcaguagcgucgccagcagu

SEQ ID NO: 3885099 - RNA, 16 nt, Shigella flexneri 2a str. 301
agcagucaucugauga

SEQ ID NO: 3885100 - RNA, 20 nt, Shigella flexneri 2a str. 301
agcagugaauacccagaauc

SEQ ID NO: 3885101 - RNA, 23 nt, Shigella flexneri 2a str. 301
agcaguuacuccgauuaccggca

SEQ ID NO: 3885102 - RNA, 18 nt, Shigella flexneri 2a str. 301
agcaguucaccgccgagg

SEQ ID NO: 3885103 - RNA, 13 nt, Shigella flexneri 2a str. 301
agcaguucacgca

SEQ ID NO: 3885104 - RNA, 15 nt, Shigella flexneri 2a str. 301
agcaguucacgcagc

SEQ ID NO: 3885105 - RNA, 17 nt, Shigella flexneri 2a str. 301
agcaguucacgcagcuu

SEQ ID NO: 3885106 - RNA, 19 nt, Shigella flexneri 2a str. 301
agcaguucagucagcagug

SEQ ID NO: 3885107 - RNA, 16 nt, Shigella flexneri 2a str. 301
agcaguucaugcacuu

SEQ ID NO: 3885108 - RNA, 21 nt, Shigella flexneri 2a str. 301
agcaguucaugcacuugguuc

SEQ ID NO: 3885109 - RNA, 14 nt, Shigella flexneri 2a str. 301
agcaguuccagcau

SEQ ID NO: 3885110 - RNA, 22 nt, Shigella flexneri 2a str. 301
agcaguucuacuggaauuucau

SEQ ID NO: 3885111 - RNA, 18 nt, Shigella flexneri 2a str. 301
agcaguuuauaaaauucu

SEQ ID NO: 3885112 - RNA, 19 nt, Shigella flexneri 2a str. 301
agcaguuucaccagcagua

SEQ ID NO: 3885113 - RNA, 13 nt, Shigella flexneri 2a str. 301
agcauaaaaauau

SEQ ID NO: 3885114 - RNA, 13 nt, Shigella flexneri 2a str. 301
agcauaauaagcu

SEQ ID NO: 3885115 - RNA, 14 nt, Shigella flexneri 2a str. 301
agcauaaucaccag

SEQ ID NO: 3885116 - RNA, 19 nt, Shigella flexneri 2a str. 301
agcauaaucaccaguaccg

SEQ ID NO: 3885117 - RNA, 18 nt, Shigella flexneri 2a str. 301
agcauaaucaccaucagc

SEQ ID NO: 3885118 - RNA, 18 nt, Shigella flexneri 2a str. 301
agcauaaugugcgcacau

SEQ ID NO: 3885119 - RNA, 15 nt, Shigella flexneri 2a str. 301
agcauaccgccgagg

SEQ ID NO: 3885120 - RNA, 20 nt, Shigella flexneri 2a str. 301
agcauaccgccgaggaacau

SEQ ID NO: 3885121 - RNA, 15 nt, Shigella flexneri 2a str. 301
agcauaccuuccagc

SEQ ID NO: 3885122 - RNA, 18 nt, Shigella flexneri 2a str. 301
agcauacgcugccagcca

SEQ ID NO: 3885123 - RNA, 23 nt, Shigella flexneri 2a str. 301
agcauagccccagcgcagacggc

SEQ ID NO: 3885124 - RNA, 21 nt, Shigella flexneri 2a str. 301
agcauagcucgcuucaucugc

SEQ ID NO: 3885125 - RNA, 22 nt, Shigella flexneri 2a str. 301
agcauauaaugcaacauuuuga

SEQ ID NO: 3885126 - RNA, 21 nt, Shigella flexneri 2a str. 301
agcauaucgacgaaccauuuc

SEQ ID NO: 3885127 - RNA, 22 nt, Shigella flexneri 2a str. 301
agcauauguuuacgcuggcgga

SEQ ID NO: 3885128 - RNA, 14 nt, Shigella flexneri 2a str. 301
agcauauugcaggc

SEQ ID NO: 3885129 - RNA, 17 nt, Shigella flexneri 2a str. 301
agcaucaaacuuuuaaa

SEQ ID NO: 3885130 - RNA, 13 nt, Shigella flexneri 2a str. 301
agcaucaauaacc

SEQ ID NO: 3885131 - RNA, 22 nt, Shigella flexneri 2a str. 301
agcaucacauaaucgaaaacau

SEQ ID NO: 3885132 - RNA, 17 nt, Shigella flexneri 2a str. 301
agcaucagcagugccag

SEQ ID NO: 3885133 - RNA, 18 nt, Shigella flexneri 2a str. 301
agcaucagcagugccagu

SEQ ID NO: 3885134 - RNA, 19 nt, Shigella flexneri 2a str. 301
agcaucagcccaaagcaga

SEQ ID NO: 3885135 - RNA, 13 nt, Shigella flexneri 2a str. 301
agcaucagcgcca

SEQ ID NO: 3885136 - RNA, 22 nt, Shigella flexneri 2a str. 301
agcaucaguucggaaacagugc

SEQ ID NO: 3885137 - RNA, 23 nt, Shigella flexneri 2a str. 301
agcaucauauggaagaaacgcuu

SEQ ID NO: 3885138 - RNA, 21 nt, Shigella flexneri 2a str. 301
agcaucaucauaauggcugcc

SEQ ID NO: 3885139 - RNA, 15 nt, Shigella flexneri 2a str. 301
agcaucaucgcaaug

SEQ ID NO: 3885140 - RNA, 23 nt, Shigella flexneri 2a str. 301
agcaucaucgcaaugauuuugau

SEQ ID NO: 3885141 - RNA, 14 nt, Shigella flexneri 2a str. 301
agcaucaugaauau

SEQ ID NO: 3885142 - RNA, 16 nt, Shigella flexneri 2a str. 301
agcaucaugaauauau

SEQ ID NO: 3885143 - RNA, 21 nt, Shigella flexneri 2a str. 301
agcauccccggcaaccacacc

SEQ ID NO: 3885144 - RNA, 19 nt, Shigella flexneri 2a str. 301
agcaucccggcagccccaa

SEQ ID NO: 3885145 - RNA, 23 nt, Shigella flexneri 2a str. 301
agcaucccggcagccccaaacag

SEQ ID NO: 3885146 - RNA, 23 nt, Shigella flexneri 2a str. 301
agcaucccguuaugguuauccac

SEQ ID NO: 3885147 - RNA, 20 nt, Shigella flexneri 2a str. 301
agcaucgaccaggauuugau

SEQ ID NO: 3885148 - RNA, 14 nt, Shigella flexneri 2a str. 301
agcaucgcaacaug

SEQ ID NO: 3885149 - RNA, 16 nt, Shigella flexneri 2a str. 301
agcaucgcaacaugcu

SEQ ID NO: 3885150 - RNA, 12 nt, Shigella flexneri 2a str. 301
agccaucaccac

SEQ ID NO: 3885151 - RNA, 11 nt, Shigella flexneri 2a str. 301
agccaucaucc

SEQ ID NO: 3885152 - RNA, 15 nt, Shigella flexneri 2a str. 301
agccauccaguuuaa

SEQ ID NO: 3885153 - RNA, 16 nt, Shigella flexneri 2a str. 301
agccauccaguuuaau

SEQ ID NO: 3885154 - RNA, 15 nt, Shigella flexneri 2a str. 301
agccaugcccgugcu

SEQ ID NO: 3885155 - RNA, 19 nt, Shigella flexneri 2a str. 301
agccaugcccgugcugaca

SEQ ID NO: 3885156 - RNA, 19 nt, Shigella flexneri 2a str. 301
agccaugcggcaucuucuc

SEQ ID NO: 3885157 - RNA, 17 nt, Shigella flexneri 2a str. 301
agccauguuuaacuccu

SEQ ID NO: 3885158 - RNA, 15 nt, Shigella flexneri 2a str. 301
agccauuaaacacca

SEQ ID NO: 3885159 - RNA, 18 nt, Shigella flexneri 2a str. 301
agccauucccucuacauu

SEQ ID NO: 3885160 - RNA, 23 nt, Shigella flexneri 2a str. 301
agccauugagauagcaucuucca

SEQ ID NO: 3885161 - RNA, 18 nt, Shigella flexneri 2a str. 301
agcccaaagcagaguugc

SEQ ID NO: 3885162 - RNA, 20 nt, Shigella flexneri 2a str. 301
agcccaaagcagaguugcug

SEQ ID NO: 3885163 - RNA, 20 nt, Shigella flexneri 2a str. 301
agcccaaucaucgcggcaca

SEQ ID NO: 3885164 - RNA, 23 nt, Shigella flexneri 2a str. 301
agcccagacaaaugaacaccaaa

SEQ ID NO: 3885165 - RNA, 15 nt, Shigella flexneri 2a str. 301
agcccagcaucagac

SEQ ID NO: 3885166 - RNA, 22 nt, Shigella flexneri 2a str. 301
agcccaguaccgccagugcagc

SEQ ID NO: 3885167 - RNA, 17 nt, Shigella flexneri 2a str. 301
agcccaguucagcggcu

SEQ ID NO: 3885168 - RNA, 23 nt, Shigella flexneri 2a str. 301
agcccauaccacagcaaaacacc

SEQ ID NO: 3885169 - RNA, 22 nt, Shigella flexneri 2a str. 301
agcccaucaccgcgaggccuaa

SEQ ID NO: 3885170 - RNA, 20 nt, Shigella flexneri 2a str. 301
agcccaucaguacaccaccu

SEQ ID NO: 3885171 - RNA, 21 nt, Shigella flexneri 2a str. 301
agcccaugcacucgaccacgc

SEQ ID NO: 3885172 - RNA, 16 nt, Shigella flexneri 2a str. 301
agccccaccagcaaau

SEQ ID NO: 3885173 - RNA, 12 nt, Shigella flexneri 2a str. 301
agccccagcacu

SEQ ID NO: 3885174 - RNA, 20 nt, Shigella flexneri 2a str. 301
agccccagcgucagcaucau

SEQ ID NO: 3885175 - RNA, 12 nt, Shigella flexneri 2a str. 301
agccccuccaca

SEQ ID NO: 3885176 - RNA, 23 nt, Shigella flexneri 2a str. 301
agcccgaguaacaguauccgggc

SEQ ID NO: 3885177 - RNA, 24 nt, Shigella flexneri 2a str. 301
agcccgaugauaaauccaucgggc

SEQ ID NO: 3885178 - RNA, 17 nt, Shigella flexneri 2a str. 301
agcccgauggcaucacc

SEQ ID NO: 3885179 - RNA, 20 nt, Shigella flexneri 2a str. 301
agcccgauggcaucaccauc

SEQ ID NO: 3885180 - RNA, 13 nt, Shigella flexneri 2a str. 301
agcccgcagcgcc

SEQ ID NO: 3885181 - RNA, 23 nt, Shigella flexneri 2a str. 301
agcccgccaaccaccgccaguag

SEQ ID NO: 3885182 - RNA, 15 nt, Shigella flexneri 2a str. 301
agcccgccaucgccc

SEQ ID NO: 3885183 - RNA, 14 nt, Shigella flexneri 2a str. 301
agcccggucaucag

SEQ ID NO: 3885184 - RNA, 14 nt, Shigella flexneri 2a str. 301
agcccucaaacaac

SEQ ID NO: 3885185 - RNA, 12 nt, Shigella flexneri 2a str. 301
agcccugccgga

SEQ ID NO: 3885186 - RNA, 14 nt, Shigella flexneri 2a str. 301
agcccuggaucugg

SEQ ID NO: 3885187 - RNA, 17 nt, Shigella flexneri 2a str. 301
agcccuggcucugcacu

SEQ ID NO: 3885188 - RNA, 18 nt, Shigella flexneri 2a str. 301
agcccuggcucugcacua

SEQ ID NO: 3885189 - RNA, 17 nt, Shigella flexneri 2a str. 301
agcccuucgccauuccu

SEQ ID NO: 3885190 - RNA, 18 nt, Shigella flexneri 2a str. 301
agcccuugcuucgccagu

SEQ ID NO: 3885191 - RNA, 17 nt, Shigella flexneri 2a str. 301
agccgaaauauggcucu

SEQ ID NO: 3885192 - RNA, 23 nt, Shigella flexneri 2a str. 301
agccgaagccguuagucaucauc

SEQ ID NO: 3885193 - RNA, 20 nt, Shigella flexneri 2a str. 301
agccgaccauugccaguaac

SEQ ID NO: 3885194 - RNA, 21 nt, Shigella flexneri 2a str. 301
agccgaccauugccaguaaca

SEQ ID NO: 3885195 - RNA, 16 nt, Shigella flexneri 2a str. 301
agccgaguagaucaac

SEQ ID NO: 3885196 - RNA, 15 nt, Shigella flexneri 2a str. 301
agccgaucgugcuaa

SEQ ID NO: 3885197 - RNA, 22 nt, Shigella flexneri 2a str. 301
agccgaucgugcuaaacaaguu

SEQ ID NO: 3885198 - RNA, 18 nt, Shigella flexneri 2a str. 301
agccgaugaguuaagaag

SEQ ID NO: 3885199 - RNA, 17 nt, Shigella flexneri 2a str. 301
agccgauuaaucuucca

SEQ ID NO: 3885200 - RNA, 21 nt, Shigella flexneri 2a str. 301
agccgauuaaucuuccagauc

SEQ ID NO: 3885201 - RNA, 16 nt, Shigella flexneri 2a str. 301
agccgcaaacuccgug

SEQ ID NO: 3885202 - RNA, 23 nt, Shigella flexneri 2a str. 301
agccgcagaggggaaguugcguc

SEQ ID NO: 3885203 - RNA, 14 nt, Shigella flexneri 2a str. 301
agccgcagccauca

SEQ ID NO: 3885204 - RNA, 16 nt, Shigella flexneri 2a str. 301
agccgcagccaucagc

SEQ ID NO: 3885205 - RNA, 13 nt, Shigella flexneri 2a str. 301
agccgcccuguuu

SEQ ID NO: 3885206 - RNA, 23 nt, Shigella flexneri 2a str. 301
agccgccgagcaaaccacaggcc

SEQ ID NO: 3885207 - RNA, 17 nt, Shigella flexneri 2a str. 301
agccgccgcuaucggca

SEQ ID NO: 3885208 - RNA, 21 nt, Shigella flexneri 2a str. 301
agccgccgcuaucggcaagga

SEQ ID NO: 3885209 - RNA, 17 nt, Shigella flexneri 2a str. 301
agccgcgcuuucuucuu

SEQ ID NO: 3885210 - RNA, 15 nt, Shigella flexneri 2a str. 301
agccgcgugcgcugg

SEQ ID NO: 3885211 - RNA, 17 nt, Shigella flexneri 2a str. 301
agccgcuaacagcagca

SEQ ID NO: 3885212 - RNA, 13 nt, Shigella flexneri 2a str. 301
agccgcuacggaa

SEQ ID NO: 3885213 - RNA, 14 nt, Shigella flexneri 2a str. 301
agccgcuucugcag

SEQ ID NO: 3885214 - RNA, 17 nt, Shigella flexneri 2a str. 301
agccgcuucugcagcuu

SEQ ID NO: 3885215 - RNA, 21 nt, Shigella flexneri 2a str. 301
agccgcuuggcaagcccagca

SEQ ID NO: 3885216 - RNA, 17 nt, Shigella flexneri 2a str. 301
agccgcuuuuucugcgc

SEQ ID NO: 3885217 - RNA, 14 nt, Shigella flexneri 2a str. 301
agccggaauuuucc

SEQ ID NO: 3885218 - RNA, 17 nt, Shigella flexneri 2a str. 301
agccggacugggcgcgc

SEQ ID NO: 3885219 - RNA, 21 nt, Shigella flexneri 2a str. 301
agccggagaaauaccacccgu

SEQ ID NO: 3885220 - RNA, 15 nt, Shigella flexneri 2a str. 301
agccggagcuggcgc

SEQ ID NO: 3885221 - RNA, 15 nt, Shigella flexneri 2a str. 301
agccggaggugaaaa

SEQ ID NO: 3885222 - RNA, 15 nt, Shigella flexneri 2a str. 301
agccggaguggggga

SEQ ID NO: 3885223 - RNA, 15 nt, Shigella flexneri 2a str. 301
agccggaugaucauc

SEQ ID NO: 3885224 - RNA, 19 nt, Shigella flexneri 2a str. 301
agccggaugaucauccggc

SEQ ID NO: 3885225 - RNA, 14 nt, Shigella flexneri 2a str. 301
agccggaugucugg

SEQ ID NO: 3885226 - RNA, 13 nt, Shigella flexneri 2a str. 301
agccgggaagaau

SEQ ID NO: 3885227 - RNA, 19 nt, Shigella flexneri 2a str. 301
agccgguaacguccaucac

SEQ ID NO: 3885228 - RNA, 17 nt, Shigella flexneri 2a str. 301
agccggugcuugcaccg

SEQ ID NO: 3885229 - RNA, 21 nt, Shigella flexneri 2a str. 301
agccguaggucggauaagacg

SEQ ID NO: 3885230 - RNA, 13 nt, Shigella flexneri 2a str. 301
agccguauucuga

SEQ ID NO: 3885231 - RNA, 15 nt, Shigella flexneri 2a str. 301
agccgucauucugca

SEQ ID NO: 3885232 - RNA, 18 nt, Shigella flexneri 2a str. 301
agccgugaaucacuccau

SEQ ID NO: 3885233 - RNA, 14 nt, Shigella flexneri 2a str. 301
agccgugccacagg

SEQ ID NO: 3885234 - RNA, 13 nt, Shigella flexneri 2a str. 301
agccuaccagacc

SEQ ID NO: 3885235 - RNA, 18 nt, Shigella flexneri 2a str. 301
agccuaccagaccgcaca

SEQ ID NO: 3885236 - RNA, 21 nt, Shigella flexneri 2a str. 301
agccuaucgucauuuugguca

SEQ ID NO: 3885237 - RNA, 15 nt, Shigella flexneri 2a str. 301
agccucaaauuccuu

SEQ ID NO: 3885238 - RNA, 19 nt, Shigella flexneri 2a str. 301
agccucacgguucauuagu

SEQ ID NO: 3885239 - RNA, 19 nt, Shigella flexneri 2a str. 301
agccucccugccuccauga

SEQ ID NO: 3885240 - RNA, 15 nt, Shigella flexneri 2a str. 301
agccugaaaacgaaa

SEQ ID NO: 3885241 - RNA, 21 nt, Shigella flexneri 2a str. 301
agccugaacuaaagccuuuug

SEQ ID NO: 3885242 - RNA, 22 nt, Shigella flexneri 2a str. 301
agccugaacuaaagccuuuugc

SEQ ID NO: 3885243 - RNA, 20 nt, Shigella flexneri 2a str. 301
agccugaagaucaacgucug

SEQ ID NO: 3885244 - RNA, 17 nt, Shigella flexneri 2a str. 301
agccugaauaaacgcca

SEQ ID NO: 3885245 - RNA, 19 nt, Shigella flexneri 2a str. 301
agccugaguuuaacggaca

SEQ ID NO: 3885246 - RNA, 14 nt, Shigella flexneri 2a str. 301
agccugaugaugag

SEQ ID NO: 3885247 - RNA, 22 nt, Shigella flexneri 2a str. 301
agccugcagugaaauuaaacug

SEQ ID NO: 3885248 - RNA, 21 nt, Shigella flexneri 2a str. 301
agccugccagcaugcauaaca

SEQ ID NO: 3885249 - RNA, 19 nt, Shigella flexneri 2a str. 301
agccugccaucuggcaggc

SEQ ID NO: 3885250 - RNA, 20 nt, Shigella flexneri 2a str. 301
agcgccaguuuuuguuucug

SEQ ID NO: 3885251 - RNA, 22 nt, Shigella flexneri 2a str. 301
agcgccauuucuucuccggcau

SEQ ID NO: 3885252 - RNA, 14 nt, Shigella flexneri 2a str. 301
agcgcccgccagca

SEQ ID NO: 3885253 - RNA, 16 nt, Shigella flexneri 2a str. 301
agcgcccgccagcacc

SEQ ID NO: 3885254 - RNA, 21 nt, Shigella flexneri 2a str. 301
agcgcccgccagcaccggagg

SEQ ID NO: 3885255 - RNA, 16 nt, Shigella flexneri 2a str. 301
agcgcccugcaauguc

SEQ ID NO: 3885256 - RNA, 18 nt, Shigella flexneri 2a str. 301
agcgccgacagcagcccu

SEQ ID NO: 3885257 - RNA, 22 nt, Shigella flexneri 2a str. 301
agcgccgaguaaaaaaacauca

SEQ ID NO: 3885258 - RNA, 19 nt, Shigella flexneri 2a str. 301
agcgccgccacugccacca

SEQ ID NO: 3885259 - RNA, 20 nt, Shigella flexneri 2a str. 301
agcgccgccagaaucaccuc

SEQ ID NO: 3885260 - RNA, 15 nt, Shigella flexneri 2a str. 301
agcgccgccucagcc

SEQ ID NO: 3885261 - RNA, 23 nt, Shigella flexneri 2a str. 301
agcgccgucaguuuuucacccgc

SEQ ID NO: 3885262 - RNA, 12 nt, Shigella flexneri 2a str. 301
agcgccuaaauc

SEQ ID NO: 3885263 - RNA, 17 nt, Shigella flexneri 2a str. 301
agcgccuaaauccaccg

SEQ ID NO: 3885264 - RNA, 21 nt, Shigella flexneri 2a str. 301
agcgccucgucguuguucuac

SEQ ID NO: 3885265 - RNA, 18 nt, Shigella flexneri 2a str. 301
agcgccucuuccauaauc

SEQ ID NO: 3885266 - RNA, 21 nt, Shigella flexneri 2a str. 301
agcgccugcgcggcaaugcgc

SEQ ID NO: 3885267 - RNA, 15 nt, Shigella flexneri 2a str. 301
agcgccuuauccugc

SEQ ID NO: 3885268 - RNA, 19 nt, Shigella flexneri 2a str. 301
agcgccuucuacagcuuca

SEQ ID NO: 3885269 - RNA, 16 nt, Shigella flexneri 2a str. 301
agcgcgaggguaaaca

SEQ ID NO: 3885270 - RNA, 19 nt, Shigella flexneri 2a str. 301
agcgcgcaguuugucuuca

SEQ ID NO: 3885271 - RNA, 21 nt, Shigella flexneri 2a str. 301
agcgcgccgccaauaaucagc

SEQ ID NO: 3885272 - RNA, 20 nt, Shigella flexneri 2a str. 301
agcgcgcgccgccaaucacg

SEQ ID NO: 3885273 - RNA, 13 nt, Shigella flexneri 2a str. 301
agcgcgcugacau

SEQ ID NO: 3885274 - RNA, 19 nt, Shigella flexneri 2a str. 301
agcgcggauuuuauucagc

SEQ ID NO: 3885275 - RNA, 21 nt, Shigella flexneri 2a str. 301
agcgcguaaauaccuuccggc

SEQ ID NO: 3885276 - RNA, 22 nt, Shigella flexneri 2a str. 301
agcgcgucacuuaauccggagc

SEQ ID NO: 3885277 - RNA, 15 nt, Shigella flexneri 2a str. 301
agcgcuaguccgggc

SEQ ID NO: 3885278 - RNA, 18 nt, Shigella flexneri 2a str. 301
agcgcugacgugauuuag

SEQ ID NO: 3885279 - RNA, 15 nt, Shigella flexneri 2a str. 301
agcgcugagacgcgc

SEQ ID NO: 3885280 - RNA, 19 nt, Shigella flexneri 2a str. 301
agcgcugcgaaaguaccau

SEQ ID NO: 3885281 - RNA, 20 nt, Shigella flexneri 2a str. 301
agcgcugcggcgcgcaucuu

SEQ ID NO: 3885282 - RNA, 19 nt, Shigella flexneri 2a str. 301
agcgcuggugacaucgcca

SEQ ID NO: 3885283 - RNA, 20 nt, Shigella flexneri 2a str. 301
agcgcuuuugcuacuuuuuu

SEQ ID NO: 3885284 - RNA, 16 nt, Shigella flexneri 2a str. 301
agcgcuuuuggcgcgu

SEQ ID NO: 3885285 - RNA, 12 nt, Shigella flexneri 2a str. 301
agcggaaaucac

SEQ ID NO: 3885286 - RNA, 20 nt, Shigella flexneri 2a str. 301
agcggaaauuaccgcaccac

SEQ ID NO: 3885287 - RNA, 16 nt, Shigella flexneri 2a str. 301
agcggaauauuuuuac

SEQ ID NO: 3885288 - RNA, 14 nt, Shigella flexneri 2a str. 301
agcggacaaugccu

SEQ ID NO: 3885289 - RNA, 18 nt, Shigella flexneri 2a str. 301
agcggagaaacuucugcc

SEQ ID NO: 3885290 - RNA, 22 nt, Shigella flexneri 2a str. 301
agcggauacaggaagcgaauca

SEQ ID NO: 3885291 - RNA, 14 nt, Shigella flexneri 2a str. 301
agcggaugacccag

SEQ ID NO: 3885292 - RNA, 20 nt, Shigella flexneri 2a str. 301
agcggcaaugcguuccagca

SEQ ID NO: 3885293 - RNA, 13 nt, Shigella flexneri 2a str. 301
agcggcaggccgu

SEQ ID NO: 3885294 - RNA, 18 nt, Shigella flexneri 2a str. 301
agcggcauaaaacgaaug

SEQ ID NO: 3885295 - RNA, 22 nt, Shigella flexneri 2a str. 301
agcggccccauuuauuucucac

SEQ ID NO: 3885296 - RNA, 15 nt, Shigella flexneri 2a str. 301
agcggccgucagauc

SEQ ID NO: 3885297 - RNA, 20 nt, Shigella flexneri 2a str. 301
agcggcggcagauugagcgu

SEQ ID NO: 3885298 - RNA, 21 nt, Shigella flexneri 2a str. 301
agcggcgggcuuuaaucaccc

SEQ ID NO: 3885299 - RNA, 23 nt, Shigella flexneri 2a str. 301
agcggcgguaaaaucauccugcu

SEQ ID NO: 3885300 - RNA, 19 nt, Shigella flexneri 2a str. 301
agcggcggucuucucaccg

SEQ ID NO: 3885301 - RNA, 23 nt, Shigella flexneri 2a str. 301
agcggcguuuuguagagcagcac

SEQ ID NO: 3885302 - RNA, 15 nt, Shigella flexneri 2a str. 301
agcggcugaauaucc

SEQ ID NO: 3885303 - RNA, 16 nt, Shigella flexneri 2a str. 301
agcggcuuccaccgcc

SEQ ID NO: 3885304 - RNA, 21 nt, Shigella flexneri 2a str. 301
agcggcuuccaccgccggaua

SEQ ID NO: 3885305 - RNA, 19 nt, Shigella flexneri 2a str. 301
agcgggacgcucguugcag

SEQ ID NO: 3885306 - RNA, 16 nt, Shigella flexneri 2a str. 301
agcgggccggagggca

SEQ ID NO: 3885307 - RNA, 16 nt, Shigella flexneri 2a str. 301
agcgggcgcgcaggcg

SEQ ID NO: 3885308 - RNA, 13 nt, Shigella flexneri 2a str. 301
agcggggaacacc

SEQ ID NO: 3885309 - RNA, 21 nt, Shigella flexneri 2a str. 301
agcggggaacaccucuggcga

SEQ ID NO: 3885310 - RNA, 18 nt, Shigella flexneri 2a str. 301
agcggguuaagcgcgcua

SEQ ID NO: 3885311 - RNA, 19 nt, Shigella flexneri 2a str. 301
agcggguuaagcgcgcuag

SEQ ID NO: 3885312 - RNA, 21 nt, Shigella flexneri 2a str. 301
agcggguuuuuacguuauuug

SEQ ID NO: 3885313 - RNA, 17 nt, Shigella flexneri 2a str. 301
agcgguaaaauggucag

SEQ ID NO: 3885314 - RNA, 20 nt, Shigella flexneri 2a str. 301
agcgguguacccugcucgcu

SEQ ID NO: 3885315 - RNA, 21 nt, Shigella flexneri 2a str. 301
agcgguugaacugaccgugcg

SEQ ID NO: 3885316 - RNA, 13 nt, Shigella flexneri 2a str. 301
agcgguugcaggc

SEQ ID NO: 3885317 - RNA, 21 nt, Shigella flexneri 2a str. 301
agcgguuucgccuccuguucu

SEQ ID NO: 3885318 - RNA, 20 nt, Shigella flexneri 2a str. 301
agcguaaaggcggcagaaca

SEQ ID NO: 3885319 - RNA, 22 nt, Shigella flexneri 2a str. 301
agcguaaaggcggcagaacaga

SEQ ID NO: 3885320 - RNA, 19 nt, Shigella flexneri 2a str. 301
agcguacaauagccacauu

SEQ ID NO: 3885321 - RNA, 23 nt, Shigella flexneri 2a str. 301
agcguaccaugauccugcaauac

SEQ ID NO: 3885322 - RNA, 16 nt, Shigella flexneri 2a str. 301
agcguagcgcaucagg

SEQ ID NO: 3885323 - RNA, 17 nt, Shigella flexneri 2a str. 301
agcguagcgcaucaggc

SEQ ID NO: 3885324 - RNA, 17 nt, Shigella flexneri 2a str. 301
agcguagcgcaucgggc

SEQ ID NO: 3885325 - RNA, 16 nt, Shigella flexneri 2a str. 301
agcguauccagcauac

SEQ ID NO: 3885326 - RNA, 14 nt, Shigella flexneri 2a str. 301
agcguaugcagcca

SEQ ID NO: 3885327 - RNA, 18 nt, Shigella flexneri 2a str. 301
agcguaugcagccaggcc

SEQ ID NO: 3885328 - RNA, 17 nt, Shigella flexneri 2a str. 301
agcguauucgcgcagaa

SEQ ID NO: 3885329 - RNA, 18 nt, Shigella flexneri 2a str. 301
agcgucaaggucaacagu

SEQ ID NO: 3885330 - RNA, 15 nt, Shigella flexneri 2a str. 301
agcgucacccagaca

SEQ ID NO: 3885331 - RNA, 12 nt, Shigella flexneri 2a str. 301
agcgucacuucg

SEQ ID NO: 3885332 - RNA, 17 nt, Shigella flexneri 2a str. 301
agcgucagcaccagaga

SEQ ID NO: 3885333 - RNA, 21 nt, Shigella flexneri 2a str. 301
agcgucagccagaaagaaccg

SEQ ID NO: 3885334 - RNA, 16 nt, Shigella flexneri 2a str. 301
agcgucaguagauuuc

SEQ ID NO: 3885335 - RNA, 23 nt, Shigella flexneri 2a str. 301
agcgucaguuccgcuucgccaau

SEQ ID NO: 3885336 - RNA, 16 nt, Shigella flexneri 2a str. 301
agcgucaucauagacu

SEQ ID NO: 3885337 - RNA, 15 nt, Shigella flexneri 2a str. 301
agcgucccaguaacg

SEQ ID NO: 3885338 - RNA, 15 nt, Shigella flexneri 2a str. 301
agcguccggcugcca

SEQ ID NO: 3885339 - RNA, 19 nt, Shigella flexneri 2a str. 301
agcguccggcugccagcca

SEQ ID NO: 3885340 - RNA, 20 nt, Shigella flexneri 2a str. 301
agcguccggcugccagccag

SEQ ID NO: 3885341 - RNA, 16 nt, Shigella flexneri 2a str. 301
agcgucgcauccgaca

SEQ ID NO: 3885342 - RNA, 13 nt, Shigella flexneri 2a str. 301
agcgucggcguca

SEQ ID NO: 3885343 - RNA, 17 nt, Shigella flexneri 2a str. 301
agcgucgugaaacgcgu

SEQ ID NO: 3885344 - RNA, 20 nt, Shigella flexneri 2a str. 301
agcgucguggcaaaaugcau

SEQ ID NO: 3885345 - RNA, 16 nt, Shigella flexneri 2a str. 301
agcgucugagcaggcg

SEQ ID NO: 3885346 - RNA, 12 nt, Shigella flexneri 2a str. 301
agcgucuugaau

SEQ ID NO: 3885347 - RNA, 16 nt, Shigella flexneri 2a str. 301
agcgugaaacgcguuu

SEQ ID NO: 3885348 - RNA, 15 nt, Shigella flexneri 2a str. 301
agcgugacaccagca

SEQ ID NO: 3885349 - RNA, 21 nt, Shigella flexneri 2a str. 301
agcuggugaacauuuuaaccg

SEQ ID NO: 3885350 - RNA, 18 nt, Shigella flexneri 2a str. 301
agcugguguaacugcgcc

SEQ ID NO: 3885351 - RNA, 15 nt, Shigella flexneri 2a str. 301
agcuguaucccagcc

SEQ ID NO: 3885352 - RNA, 15 nt, Shigella flexneri 2a str. 301
agcugucgaaaagau

SEQ ID NO: 3885353 - RNA, 11 nt, Shigella flexneri 2a str. 301
agcugugccug

SEQ ID NO: 3885354 - RNA, 14 nt, Shigella flexneri 2a str. 301
agcuguucuggcgu

SEQ ID NO: 3885355 - RNA, 23 nt, Shigella flexneri 2a str. 301
agcuguuuauuuauacagugagu

SEQ ID NO: 3885356 - RNA, 18 nt, Shigella flexneri 2a str. 301
agcuuaaucaccagcgca

SEQ ID NO: 3885357 - RNA, 20 nt, Shigella flexneri 2a str. 301
agcuuaccguccucuuccca

SEQ ID NO: 3885358 - RNA, 22 nt, Shigella flexneri 2a str. 301
agcuuaccguccucuucccaga

SEQ ID NO: 3885359 - RNA, 24 nt, Shigella flexneri 2a str. 301
agcuuacgcugauauucgacacca

SEQ ID NO: 3885360 - RNA, 19 nt, Shigella flexneri 2a str. 301
agcuuacguuacccagcac

SEQ ID NO: 3885361 - RNA, 17 nt, Shigella flexneri 2a str. 301
agcuuaguccgcgacgu

SEQ ID NO: 3885362 - RNA, 23 nt, Shigella flexneri 2a str. 301
agcuuauccauaauuuugguugc

SEQ ID NO: 3885363 - RNA, 14 nt, Shigella flexneri 2a str. 301
agcuuaucuuuuuc

SEQ ID NO: 3885364 - RNA, 15 nt, Shigella flexneri 2a str. 301
agcuuauuucuguga

SEQ ID NO: 3885365 - RNA, 19 nt, Shigella flexneri 2a str. 301
agcuuauuuguugagcugg

SEQ ID NO: 3885366 - RNA, 21 nt, Shigella flexneri 2a str. 301
agcuucaaauagugccuggcu

SEQ ID NO: 3885367 - RNA, 22 nt, Shigella flexneri 2a str. 301
agcuucaaaucauuacaguuuc

SEQ ID NO: 3885368 - RNA, 20 nt, Shigella flexneri 2a str. 301
agcuucaaauuagccgcagg

SEQ ID NO: 3885369 - RNA, 21 nt, Shigella flexneri 2a str. 301
agcuucacaaaggcuugcugc

SEQ ID NO: 3885370 - RNA, 15 nt, Shigella flexneri 2a str. 301
agcuucaccgcaucg

SEQ ID NO: 3885371 - RNA, 15 nt, Shigella flexneri 2a str. 301
agcuucaccuuccag

SEQ ID NO: 3885372 - RNA, 19 nt, Shigella flexneri 2a str. 301
agcuucacgcgccagcuua

SEQ ID NO: 3885373 - RNA, 12 nt, Shigella flexneri 2a str. 301
agcuucagauug

SEQ ID NO: 3885374 - RNA, 18 nt, Shigella flexneri 2a str. 301
agcuucaucaucgcagau

SEQ ID NO: 3885375 - RNA, 14 nt, Shigella flexneri 2a str. 301
agcuucccaaagau

SEQ ID NO: 3885376 - RNA, 15 nt, Shigella flexneri 2a str. 301
agcuucgcuucccaa

SEQ ID NO: 3885377 - RNA, 11 nt, Shigella flexneri 2a str. 301
agcuucuuccu

SEQ ID NO: 3885378 - RNA, 16 nt, Shigella flexneri 2a str. 301
agcuugaucaauaacg

SEQ ID NO: 3885379 - RNA, 14 nt, Shigella flexneri 2a str. 301
agcuugcgauccug

SEQ ID NO: 3885380 - RNA, 18 nt, Shigella flexneri 2a str. 301
agcuugcgauccugcaga

SEQ ID NO: 3885381 - RNA, 20 nt, Shigella flexneri 2a str. 301
agcuugcgauccugcagaua

SEQ ID NO: 3885382 - RNA, 18 nt, Shigella flexneri 2a str. 301
agcuugcuuuccagcuuc

SEQ ID NO: 3885383 - RNA, 17 nt, Shigella flexneri 2a str. 301
agcuugugcaccagcug

SEQ ID NO: 3885384 - RNA, 14 nt, Shigella flexneri 2a str. 301
agcuuguuugaagu

SEQ ID NO: 3885385 - RNA, 20 nt, Shigella flexneri 2a str. 301
agcuuguuugaagucaacgc

SEQ ID NO: 3885386 - RNA, 20 nt, Shigella flexneri 2a str. 301
agcuuuauccugcccacucc

SEQ ID NO: 3885387 - RNA, 14 nt, Shigella flexneri 2a str. 301
agcuuucauuucaa

SEQ ID NO: 3885388 - RNA, 16 nt, Shigella flexneri 2a str. 301
agcuuucgaccagcca

SEQ ID NO: 3885389 - RNA, 17 nt, Shigella flexneri 2a str. 301
agcuuugcgccucgcca

SEQ ID NO: 3885390 - RNA, 23 nt, Shigella flexneri 2a str. 301
agcuuuucccagcgcgacagaua

SEQ ID NO: 3885391 - RNA, 16 nt, Shigella flexneri 2a str. 301
agcuuuucucaauaua

SEQ ID NO: 3885392 - RNA, 19 nt, Shigella flexneri 2a str. 301
agcuuuuguaggccugaua

SEQ ID NO: 3885393 - RNA, 22 nt, Shigella flexneri 2a str. 301
aggaaaaaaauuaacgcagaau

SEQ ID NO: 3885394 - RNA, 11 nt, Shigella flexneri 2a str. 301
aggaaaaaaua

SEQ ID NO: 3885395 - RNA, 20 nt, Shigella flexneri 2a str. 301
aggaaaaacgaaugacugau

SEQ ID NO: 3885396 - RNA, 18 nt, Shigella flexneri 2a str. 301
aggaaaaccagaaucugg

SEQ ID NO: 3885397 - RNA, 15 nt, Shigella flexneri 2a str. 301
aggaaaacuacaggc

SEQ ID NO: 3885398 - RNA, 14 nt, Shigella flexneri 2a str. 301
aggaaaauaagcau

SEQ ID NO: 3885399 - RNA, 15 nt, Shigella flexneri 2a str. 301
aggaaaauacagcaa

SEQ ID NO: 3885400 - RNA, 18 nt, Shigella flexneri 2a str. 301
aggaaaauacagcaaugg

SEQ ID NO: 3885401 - RNA, 17 nt, Shigella flexneri 2a str. 301
aggaaacuaaacgccgc

SEQ ID NO: 3885402 - RNA, 14 nt, Shigella flexneri 2a str. 301
aggaaauaaauaau

SEQ ID NO: 3885403 - RNA, 13 nt, Shigella flexneri 2a str. 301
aggaaauaauaua

SEQ ID NO: 3885404 - RNA, 20 nt, Shigella flexneri 2a str. 301
aggaaauacguaggccugau

SEQ ID NO: 3885405 - RNA, 17 nt, Shigella flexneri 2a str. 301
aggaaauguuccggguu

SEQ ID NO: 3885406 - RNA, 18 nt, Shigella flexneri 2a str. 301
aggaaauuaccgcaaagc

SEQ ID NO: 3885407 - RNA, 13 nt, Shigella flexneri 2a str. 301
aggaacaauccaa

SEQ ID NO: 3885408 - RNA, 16 nt, Shigella flexneri 2a str. 301
aggaacagaagaaagc

SEQ ID NO: 3885409 - RNA, 18 nt, Shigella flexneri 2a str. 301
aggaacagaagaaagcaa

SEQ ID NO: 3885410 - RNA, 21 nt, Shigella flexneri 2a str. 301
aggaacagaagaaagcaauga

SEQ ID NO: 3885411 - RNA, 16 nt, Shigella flexneri 2a str. 301
aggaaccacaaccacu

SEQ ID NO: 3885412 - RNA, 12 nt, Shigella flexneri 2a str. 301
aggaagacgcag

SEQ ID NO: 3885413 - RNA, 15 nt, Shigella flexneri 2a str. 301
aggaagcagcuugcu

SEQ ID NO: 3885414 - RNA, 21 nt, Shigella flexneri 2a str. 301
aggaagcgacccgguucaauu

SEQ ID NO: 3885415 - RNA, 15 nt, Shigella flexneri 2a str. 301
aggaagcguugcgcc

SEQ ID NO: 3885416 - RNA, 13 nt, Shigella flexneri 2a str. 301
aggaaggcaagaa

SEQ ID NO: 3885417 - RNA, 16 nt, Shigella flexneri 2a str. 301
aggaaggucauccaaa

SEQ ID NO: 3885418 - RNA, 18 nt, Shigella flexneri 2a str. 301
aggaagugaguaucaauu

SEQ ID NO: 3885419 - RNA, 19 nt, Shigella flexneri 2a str. 301
aggaaguuaagaucagaag

SEQ ID NO: 3885420 - RNA, 21 nt, Shigella flexneri 2a str. 301
aggaaguuaagaucagaagcg

SEQ ID NO: 3885421 - RNA, 17 nt, Shigella flexneri 2a str. 301
aggaauaugguuagaga

SEQ ID NO: 3885422 - RNA, 20 nt, Shigella flexneri 2a str. 301
aggaaucacguaggccugau

SEQ ID NO: 3885423 - RNA, 14 nt, Shigella flexneri 2a str. 301
aggaaucaggcagg

SEQ ID NO: 3885424 - RNA, 12 nt, Shigella flexneri 2a str. 301
aggaauccgggu

SEQ ID NO: 3885425 - RNA, 19 nt, Shigella flexneri 2a str. 301
aggaaucugauuacuuccu

SEQ ID NO: 3885426 - RNA, 16 nt, Shigella flexneri 2a str. 301
aggaauguggcaauga

SEQ ID NO: 3885427 - RNA, 19 nt, Shigella flexneri 2a str. 301
aggaauuuuacagcccugg

SEQ ID NO: 3885428 - RNA, 14 nt, Shigella flexneri 2a str. 301
aggacaaaaauuca

SEQ ID NO: 3885429 - RNA, 13 nt, Shigella flexneri 2a str. 301
aggacacagaaug

SEQ ID NO: 3885430 - RNA, 19 nt, Shigella flexneri 2a str. 301
aggacaucccggcagagaa

SEQ ID NO: 3885431 - RNA, 22 nt, Shigella flexneri 2a str. 301
aggacaucccggcagagaaaau

SEQ ID NO: 3885432 - RNA, 18 nt, Shigella flexneri 2a str. 301
aggaccgguuucaaaacu

SEQ ID NO: 3885433 - RNA, 20 nt, Shigella flexneri 2a str. 301
aggacgaaaaaucaauaaac

SEQ ID NO: 3885434 - RNA, 18 nt, Shigella flexneri 2a str. 301
aggacuuauucauuucgu

SEQ ID NO: 3885435 - RNA, 22 nt, Shigella flexneri 2a str. 301
aggacuucaucacgaugcaaau

SEQ ID NO: 3885436 - RNA, 18 nt, Shigella flexneri 2a str. 301
aggagacacgcugccccu

SEQ ID NO: 3885437 - RNA, 18 nt, Shigella flexneri 2a str. 301
aggagaguaugcgcguca

SEQ ID NO: 3885438 - RNA, 20 nt, Shigella flexneri 2a str. 301
aggagaguaugcgcgucaga

SEQ ID NO: 3885439 - RNA, 14 nt, Shigella flexneri 2a str. 301
aggagauaaaccga

SEQ ID NO: 3885440 - RNA, 23 nt, Shigella flexneri 2a str. 301
aggagaugcccgacuugagcgca

SEQ ID NO: 3885441 - RNA, 17 nt, Shigella flexneri 2a str. 301
aggagcacgccuggaaa

SEQ ID NO: 3885442 - RNA, 20 nt, Shigella flexneri 2a str. 301
aggagcacgccuggaaagug

SEQ ID NO: 3885443 - RNA, 20 nt, Shigella flexneri 2a str. 301
aggagccaacacuuucacua

SEQ ID NO: 3885444 - RNA, 17 nt, Shigella flexneri 2a str. 301
aggagccaucaccaucg

SEQ ID NO: 3885445 - RNA, 23 nt, Shigella flexneri 2a str. 301
aggaggcguaauuuccacgccaa

SEQ ID NO: 3885446 - RNA, 22 nt, Shigella flexneri 2a str. 301
aggaggucgcacugcucuuuuu

SEQ ID NO: 3885447 - RNA, 17 nt, Shigella flexneri 2a str. 301
aggaguuuaauaaauuu

SEQ ID NO: 3885448 - RNA, 20 nt, Shigella flexneri 2a str. 301
aggaguuugaacauaucagc

SEQ ID NO: 3885449 - RNA, 17 nt, Shigella flexneri 2a str. 301
aggcgccauuuucauau

SEQ ID NO: 3885450 - RNA, 14 nt, Shigella flexneri 2a str. 301
aggcgcuaaaagca

SEQ ID NO: 3885451 - RNA, 23 nt, Shigella flexneri 2a str. 301
aggcgcucgcgccgcauccgaca

SEQ ID NO: 3885452 - RNA, 20 nt, Shigella flexneri 2a str. 301
aggcgcugaaagaagcggug

SEQ ID NO: 3885453 - RNA, 13 nt, Shigella flexneri 2a str. 301
aggcgcuggcaga

SEQ ID NO: 3885454 - RNA, 12 nt, Shigella flexneri 2a str. 301
aggcgcuggcgc

SEQ ID NO: 3885455 - RNA, 23 nt, Shigella flexneri 2a str. 301
aggcgcuggcgcauguuggcgcg

SEQ ID NO: 3885456 - RNA, 15 nt, Shigella flexneri 2a str. 301
aggcggcgcaucggu

SEQ ID NO: 3885457 - RNA, 15 nt, Shigella flexneri 2a str. 301
aggcggcucaccugc

SEQ ID NO: 3885458 - RNA, 21 nt, Shigella flexneri 2a str. 301
aggcggcucaccugcacacca

SEQ ID NO: 3885459 - RNA, 19 nt, Shigella flexneri 2a str. 301
aggcggggccaauugcugu

SEQ ID NO: 3885460 - RNA, 22 nt, Shigella flexneri 2a str. 301
aggcggguacguuucgccugca

SEQ ID NO: 3885461 - RNA, 22 nt, Shigella flexneri 2a str. 301
aggcggguuaaaaacauuuuca

SEQ ID NO: 3885462 - RNA, 23 nt, Shigella flexneri 2a str. 301
aggcggguuaaaaacauuuucau

SEQ ID NO: 3885463 - RNA, 22 nt, Shigella flexneri 2a str. 301
aggcgguaaaucggcgaagaga

SEQ ID NO: 3885464 - RNA, 19 nt, Shigella flexneri 2a str. 301
aggcguaauuuccacgcca

SEQ ID NO: 3885465 - RNA, 13 nt, Shigella flexneri 2a str. 301
aggcgugauucau

SEQ ID NO: 3885466 - RNA, 22 nt, Shigella flexneri 2a str. 301
aggcguucacgccacauccggc

SEQ ID NO: 3885467 - RNA, 15 nt, Shigella flexneri 2a str. 301
aggcguucacgccgc

SEQ ID NO: 3885468 - RNA, 23 nt, Shigella flexneri 2a str. 301
aggcguucacgccgcauccgaca

SEQ ID NO: 3885469 - RNA, 23 nt, Shigella flexneri 2a str. 301
aggcguucacgccgcauccggca

SEQ ID NO: 3885470 - RNA, 20 nt, Shigella flexneri 2a str. 301
aggcguucacgccgcaucug

SEQ ID NO: 3885471 - RNA, 17 nt, Shigella flexneri 2a str. 301
aggcguugauuggcgca

SEQ ID NO: 3885472 - RNA, 20 nt, Shigella flexneri 2a str. 301
aggcguuuacgccgcaucag

SEQ ID NO: 3885473 - RNA, 20 nt, Shigella flexneri 2a str. 301
aggcguuuacgccgcauccg

SEQ ID NO: 3885474 - RNA, 13 nt, Shigella flexneri 2a str. 301
aggcguuucaacu

SEQ ID NO: 3885475 - RNA, 22 nt, Shigella flexneri 2a str. 301
aggcguuuucgccgcauccggc

SEQ ID NO: 3885476 - RNA, 23 nt, Shigella flexneri 2a str. 301
aggcguuuugcagauucagccac

SEQ ID NO: 3885477 - RNA, 22 nt, Shigella flexneri 2a str. 301
aggcuaauaccgucgaugccaa

SEQ ID NO: 3885478 - RNA, 23 nt, Shigella flexneri 2a str. 301
aggcuaauaccgucgaugccaau

SEQ ID NO: 3885479 - RNA, 13 nt, Shigella flexneri 2a str. 301
aggcuacucccag

SEQ ID NO: 3885480 - RNA, 19 nt, Shigella flexneri 2a str. 301
aggcuaucgaacaugcggg

SEQ ID NO: 3885481 - RNA, 19 nt, Shigella flexneri 2a str. 301
aggcuauuccacgcaucaa

SEQ ID NO: 3885482 - RNA, 16 nt, Shigella flexneri 2a str. 301
aggcucgccgccgcug

SEQ ID NO: 3885483 - RNA, 19 nt, Shigella flexneri 2a str. 301
aggcugaaaaucuucucuc

SEQ ID NO: 3885484 - RNA, 20 nt, Shigella flexneri 2a str. 301
aggcugaccccaaccgcccu

SEQ ID NO: 3885485 - RNA, 20 nt, Shigella flexneri 2a str. 301
aggcugccagaucaucguuu

SEQ ID NO: 3885486 - RNA, 16 nt, Shigella flexneri 2a str. 301
aggcugcgaguccugu

SEQ ID NO: 3885487 - RNA, 19 nt, Shigella flexneri 2a str. 301
aggcugcgaguccuguugu

SEQ ID NO: 3885488 - RNA, 23 nt, Shigella flexneri 2a str. 301
aggcuggcguguucugaauaaac

SEQ ID NO: 3885489 - RNA, 21 nt, Shigella flexneri 2a str. 301
aggcuggcuuuaucacugagu

SEQ ID NO: 3885490 - RNA, 21 nt, Shigella flexneri 2a str. 301
aggcugugaaccgcacagguu

SEQ ID NO: 3885491 - RNA, 13 nt, Shigella flexneri 2a str. 301
aggcuuagcgcaa

SEQ ID NO: 3885492 - RNA, 15 nt, Shigella flexneri 2a str. 301
aggcuucaaucaaua

SEQ ID NO: 3885493 - RNA, 13 nt, Shigella flexneri 2a str. 301
aggcuucaggugc

SEQ ID NO: 3885494 - RNA, 20 nt, Shigella flexneri 2a str. 301
aggcuuccacuucacgaugc

SEQ ID NO: 3885495 - RNA, 16 nt, Shigella flexneri 2a str. 301
aggcuucgacgcucag

SEQ ID NO: 3885496 - RNA, 14 nt, Shigella flexneri 2a str. 301
aggcuugcugaugc

SEQ ID NO: 3885497 - RNA, 12 nt, Shigella flexneri 2a str. 301
aggcuugcugca

SEQ ID NO: 3885498 - RNA, 13 nt, Shigella flexneri 2a str. 301
aggcuugcugcau

SEQ ID NO: 3885499 - RNA, 21 nt, Shigella flexneri 2a str. 301
aggcuuugccuccccaacaua

SEQ ID NO: 3885500 - RNA, 18 nt, Shigella flexneri 2a str. 301
aggcuuuuaacaccugca

SEQ ID NO: 3885501 - RNA, 20 nt, Shigella flexneri 2a str. 301
aggcuuuuacgcauugcuca

SEQ ID NO: 3885502 - RNA, 18 nt, Shigella flexneri 2a str. 301
aggcuuuuuugguaauga

SEQ ID NO: 3885503 - RNA, 21 nt, Shigella flexneri 2a str. 301
agggaaagagcgauccguuca

SEQ ID NO: 3885504 - RNA, 17 nt, Shigella flexneri 2a str. 301
agggaaaugaggaauua

SEQ ID NO: 3885505 - RNA, 15 nt, Shigella flexneri 2a str. 301
agggaagcgaguuac

SEQ ID NO: 3885506 - RNA, 21 nt, Shigella flexneri 2a str. 301
agggaaggguaguguccauaa

SEQ ID NO: 3885507 - RNA, 17 nt, Shigella flexneri 2a str. 301
agggaaggguguucauc

SEQ ID NO: 3885508 - RNA, 15 nt, Shigella flexneri 2a str. 301
agggaauccagcaau

SEQ ID NO: 3885509 - RNA, 18 nt, Shigella flexneri 2a str. 301
agggaggauuucuccccc

SEQ ID NO: 3885510 - RNA, 23 nt, Shigella flexneri 2a str. 301
agggaguaugcggucaaaagcug

SEQ ID NO: 3885511 - RNA, 22 nt, Shigella flexneri 2a str. 301
agggagucuugcuggaugccag

SEQ ID NO: 3885512 - RNA, 13 nt, Shigella flexneri 2a str. 301
agggauauuucac

SEQ ID NO: 3885513 - RNA, 14 nt, Shigella flexneri 2a str. 301
agggauauuucacc

SEQ ID NO: 3885514 - RNA, 13 nt, Shigella flexneri 2a str. 301
agggaucacgcgg

SEQ ID NO: 3885515 - RNA, 15 nt, Shigella flexneri 2a str. 301
agggauugugcaggc

SEQ ID NO: 3885516 - RNA, 23 nt, Shigella flexneri 2a str. 301
agggcaaacagacuggcaacgac

SEQ ID NO: 3885517 - RNA, 14 nt, Shigella flexneri 2a str. 301
agggcaaacagcac

SEQ ID NO: 3885518 - RNA, 21 nt, Shigella flexneri 2a str. 301
agggcaagcgccuaaauccac

SEQ ID NO: 3885519 - RNA, 14 nt, Shigella flexneri 2a str. 301
agggcaauuaaaaa

SEQ ID NO: 3885520 - RNA, 17 nt, Shigella flexneri 2a str. 301
agggcaucaagaaugcu

SEQ ID NO: 3885521 - RNA, 16 nt, Shigella flexneri 2a str. 301
agggcaucgcaggcca

SEQ ID NO: 3885522 - RNA, 23 nt, Shigella flexneri 2a str. 301
agggcauguugagcauugccgcc

SEQ ID NO: 3885523 - RNA, 14 nt, Shigella flexneri 2a str. 301
agggcggcaggcag

SEQ ID NO: 3885524 - RNA, 22 nt, Shigella flexneri 2a str. 301
agggcggcaggcagcgccacgu

SEQ ID NO: 3885525 - RNA, 17 nt, Shigella flexneri 2a str. 301
agggcuaacgugcaggu

SEQ ID NO: 3885526 - RNA, 22 nt, Shigella flexneri 2a str. 301
agggcuggcaaauucaggagca

SEQ ID NO: 3885527 - RNA, 14 nt, Shigella flexneri 2a str. 301
agggcuggcaauga

SEQ ID NO: 3885528 - RNA, 21 nt, Shigella flexneri 2a str. 301
agggcuguuuaucgugaauuc

SEQ ID NO: 3885529 - RNA, 14 nt, Shigella flexneri 2a str. 301
agggcuuccaccug

SEQ ID NO: 3885530 - RNA, 15 nt, Shigella flexneri 2a str. 301
agggcuuuaccuguc

SEQ ID NO: 3885531 - RNA, 18 nt, Shigella flexneri 2a str. 301
agggcuuuuuuauuucau

SEQ ID NO: 3885532 - RNA, 14 nt, Shigella flexneri 2a str. 301
aggggaacagacca

SEQ ID NO: 3885533 - RNA, 13 nt, Shigella flexneri 2a str. 301
aggggacauuuag

SEQ ID NO: 3885534 - RNA, 19 nt, Shigella flexneri 2a str. 301
aggggcgaaaucggcguaa

SEQ ID NO: 3885535 - RNA, 22 nt, Shigella flexneri 2a str. 301
aggggcggguuuuuuuauaucu

SEQ ID NO: 3885536 - RNA, 15 nt, Shigella flexneri 2a str. 301
aggggcguccagaug

SEQ ID NO: 3885537 - RNA, 15 nt, Shigella flexneri 2a str. 301
agggggauuuucacu

SEQ ID NO: 3885538 - RNA, 15 nt, Shigella flexneri 2a str. 301
aggggugaaaaaaac

SEQ ID NO: 3885539 - RNA, 13 nt, Shigella flexneri 2a str. 301
aggguaaaaggau

SEQ ID NO: 3885540 - RNA, 14 nt, Shigella flexneri 2a str. 301
aggguaagggagga

SEQ ID NO: 3885541 - RNA, 20 nt, Shigella flexneri 2a str. 301
agggucuuuuaaauccugca

SEQ ID NO: 3885542 - RNA, 14 nt, Shigella flexneri 2a str. 301
agggugagggagga

SEQ ID NO: 3885543 - RNA, 14 nt, Shigella flexneri 2a str. 301
agggugaucaccag

SEQ ID NO: 3885544 - RNA, 18 nt, Shigella flexneri 2a str. 301
agggugcagaaucaaucu

SEQ ID NO: 3885545 - RNA, 22 nt, Shigella flexneri 2a str. 301
aggguuauuuguucagcaaaug

SEQ ID NO: 3885546 - RNA, 20 nt, Shigella flexneri 2a str. 301
aggguuucgcgguugguggc

SEQ ID NO: 3885547 - RNA, 17 nt, Shigella flexneri 2a str. 301
aggguuuuauaaucgca

SEQ ID NO: 3885548 - RNA, 17 nt, Shigella flexneri 2a str. 301
aguaacagucaguuauc

SEQ ID NO: 3885549 - RNA, 19 nt, Shigella flexneri 2a str. 301
aguaaccacggcagcaacu

SEQ ID NO: 3885550 - RNA, 19 nt, Shigella flexneri 2a str. 301
aguaaccgcuuuuucaauu

SEQ ID NO: 3885551 - RNA, 22 nt, Shigella flexneri 2a str. 301
aguaaccgcuuuuucaauuucc

SEQ ID NO: 3885552 - RNA, 22 nt, Shigella flexneri 2a str. 301
aguaaccuucgcggcacuggua

SEQ ID NO: 3885553 - RNA, 14 nt, Shigella flexneri 2a str. 301
aguaaccuuucaga

SEQ ID NO: 3885554 - RNA, 15 nt, Shigella flexneri 2a str. 301
aguaaccuuucagau

SEQ ID NO: 3885555 - RNA, 15 nt, Shigella flexneri 2a str. 301
aguaaccuuugaaca

SEQ ID NO: 3885556 - RNA, 17 nt, Shigella flexneri 2a str. 301
aguaacguuugauuaac

SEQ ID NO: 3885557 - RNA, 20 nt, Shigella flexneri 2a str. 301
aguaagaauaaaacgccuga

SEQ ID NO: 3885558 - RNA, 15 nt, Shigella flexneri 2a str. 301
aguaagaauugauaa

SEQ ID NO: 3885559 - RNA, 17 nt, Shigella flexneri 2a str. 301
aguaagaauugauaaaa

SEQ ID NO: 3885560 - RNA, 17 nt, Shigella flexneri 2a str. 301
aguaagcacucugacgg

SEQ ID NO: 3885561 - RNA, 16 nt, Shigella flexneri 2a str. 301
aguaagccagcaccau

SEQ ID NO: 3885562 - RNA, 23 nt, Shigella flexneri 2a str. 301
aguaagcggcguugcucuucucc

SEQ ID NO: 3885563 - RNA, 15 nt, Shigella flexneri 2a str. 301
aguaaggguuuuuuu

SEQ ID NO: 3885564 - RNA, 11 nt, Shigella flexneri 2a str. 301
aguaauaacuu

SEQ ID NO: 3885565 - RNA, 12 nt, Shigella flexneri 2a str. 301
aguaauaaugcc

SEQ ID NO: 3885566 - RNA, 14 nt, Shigella flexneri 2a str. 301
aguaauaaugccca

SEQ ID NO: 3885567 - RNA, 19 nt, Shigella flexneri 2a str. 301
aguaaucacaucaaagucu

SEQ ID NO: 3885568 - RNA, 13 nt, Shigella flexneri 2a str. 301
aguaaucacgaau

SEQ ID NO: 3885569 - RNA, 14 nt, Shigella flexneri 2a str. 301
aguaaucaggcuau

SEQ ID NO: 3885570 - RNA, 19 nt, Shigella flexneri 2a str. 301
aguaaucaggcuaucuucg

SEQ ID NO: 3885571 - RNA, 18 nt, Shigella flexneri 2a str. 301
aguaaucgccagcaaaau

SEQ ID NO: 3885572 - RNA, 18 nt, Shigella flexneri 2a str. 301
aguaaucgggcaacugcu

SEQ ID NO: 3885573 - RNA, 19 nt, Shigella flexneri 2a str. 301
aguaaucgggcaacugcug

SEQ ID NO: 3885574 - RNA, 18 nt, Shigella flexneri 2a str. 301
aguaaugauuuaaaacca

SEQ ID NO: 3885575 - RNA, 21 nt, Shigella flexneri 2a str. 301
aguaaugccggaggcaaguuu

SEQ ID NO: 3885576 - RNA, 15 nt, Shigella flexneri 2a str. 301
aguaaugcgcccaug

SEQ ID NO: 3885577 - RNA, 16 nt, Shigella flexneri 2a str. 301
aguaaugcgcccaugc

SEQ ID NO: 3885578 - RNA, 16 nt, Shigella flexneri 2a str. 301
aguaaugcggcaaggg

SEQ ID NO: 3885579 - RNA, 23 nt, Shigella flexneri 2a str. 301
aguaauuaucuuuacugauaauu

SEQ ID NO: 3885580 - RNA, 17 nt, Shigella flexneri 2a str. 301
aguaauugcuuuuacca

SEQ ID NO: 3885581 - RNA, 22 nt, Shigella flexneri 2a str. 301
aguacaacgccaugcagguuac

SEQ ID NO: 3885582 - RNA, 20 nt, Shigella flexneri 2a str. 301
aguacagccgagaauaauuu

SEQ ID NO: 3885583 - RNA, 17 nt, Shigella flexneri 2a str. 301
aguacagccgccagaca

SEQ ID NO: 3885584 - RNA, 20 nt, Shigella flexneri 2a str. 301
aguacagcgcauaaaagcua

SEQ ID NO: 3885585 - RNA, 16 nt, Shigella flexneri 2a str. 301
aguacaguauucaggu

SEQ ID NO: 3885586 - RNA, 16 nt, Shigella flexneri 2a str. 301
aguacaucuuccacuu

SEQ ID NO: 3885587 - RNA, 17 nt, Shigella flexneri 2a str. 301
aguacaugaagcacugc

SEQ ID NO: 3885588 - RNA, 19 nt, Shigella flexneri 2a str. 301
aguacauuaaaauuggcuu

SEQ ID NO: 3885589 - RNA, 16 nt, Shigella flexneri 2a str. 301
aguacauuguuuucca

SEQ ID NO: 3885590 - RNA, 19 nt, Shigella flexneri 2a str. 301
aguaccacgguacgccaga

SEQ ID NO: 3885591 - RNA, 21 nt, Shigella flexneri 2a str. 301
aguaccacgguacgccagagu

SEQ ID NO: 3885592 - RNA, 13 nt, Shigella flexneri 2a str. 301
aguaccagcagcg

SEQ ID NO: 3885593 - RNA, 18 nt, Shigella flexneri 2a str. 301
aguaccaucguccagcag

SEQ ID NO: 3885594 - RNA, 23 nt, Shigella flexneri 2a str. 301
aguaccaucguccagcagcaaug

SEQ ID NO: 3885595 - RNA, 19 nt, Shigella flexneri 2a str. 301
aguacccaugugauuuaaa

SEQ ID NO: 3885596 - RNA, 19 nt, Shigella flexneri 2a str. 301
aguaccgccaccaccagac

SEQ ID NO: 3885597 - RNA, 21 nt, Shigella flexneri 2a str. 301
aguaccgccagugcagcgaag

SEQ ID NO: 3885598 - RNA, 23 nt, Shigella flexneri 2a str. 301
aguaccgccgccauaaacagcag

SEQ ID NO: 3885599 - RNA, 14 nt, Shigella flexneri 2a str. 301
aguaccgcgucgau

SEQ ID NO: 3885600 - RNA, 21 nt, Shigella flexneri 2a str. 301
aguaccuccuggaucacaauc

SEQ ID NO: 3885601 - RNA, 18 nt, Shigella flexneri 2a str. 301
aguaccucuucgcuggca

SEQ ID NO: 3885602 - RNA, 15 nt, Shigella flexneri 2a str. 301
aguaccugcaaaccg

SEQ ID NO: 3885603 - RNA, 19 nt, Shigella flexneri 2a str. 301
aguacgccaaucugcaaaa

SEQ ID NO: 3885604 - RNA, 21 nt, Shigella flexneri 2a str. 301
aguacgcccacgccagccugc

SEQ ID NO: 3885605 - RNA, 21 nt, Shigella flexneri 2a str. 301
aguacguuucgauuucugacu

SEQ ID NO: 3885606 - RNA, 14 nt, Shigella flexneri 2a str. 301
aguacugaugaaua

SEQ ID NO: 3885607 - RNA, 20 nt, Shigella flexneri 2a str. 301
aguacugaugaauaaauaca

SEQ ID NO: 3885608 - RNA, 14 nt, Shigella flexneri 2a str. 301
aguacuucacaauc

SEQ ID NO: 3885609 - RNA, 14 nt, Shigella flexneri 2a str. 301
aguacuuuggaagu

SEQ ID NO: 3885610 - RNA, 18 nt, Shigella flexneri 2a str. 301
aguacuuuggaaguauaa

SEQ ID NO: 3885611 - RNA, 15 nt, Shigella flexneri 2a str. 301
aguagaaacgaggua

SEQ ID NO: 3885612 - RNA, 22 nt, Shigella flexneri 2a str. 301
aguagaauaaucuguuuuucau

SEQ ID NO: 3885613 - RNA, 13 nt, Shigella flexneri 2a str. 301
aguagagauaaac

SEQ ID NO: 3885614 - RNA, 17 nt, Shigella flexneri 2a str. 301
aguagauucaacauaau

SEQ ID NO: 3885615 - RNA, 10 nt, Shigella flexneri 2a str. 301
aguagcaaag

SEQ ID NO: 3885616 - RNA, 14 nt, Shigella flexneri 2a str. 301
aguagccagacaau

SEQ ID NO: 3885617 - RNA, 14 nt, Shigella flexneri 2a str. 301
aguagccauuugau

SEQ ID NO: 3885618 - RNA, 22 nt, Shigella flexneri 2a str. 301
aguagccucgccgagcaguugc

SEQ ID NO: 3885619 - RNA, 17 nt, Shigella flexneri 2a str. 301
aguagcgcaaucaccac

SEQ ID NO: 3885620 - RNA, 12 nt, Shigella flexneri 2a str. 301
aguagcggguga

SEQ ID NO: 3885621 - RNA, 16 nt, Shigella flexneri 2a str. 301
aguagcgucgccagca

SEQ ID NO: 3885622 - RNA, 19 nt, Shigella flexneri 2a str. 301
aguagcgucgccagcaguu

SEQ ID NO: 3885623 - RNA, 16 nt, Shigella flexneri 2a str. 301
aguagggcugauaaac

SEQ ID NO: 3885624 - RNA, 20 nt, Shigella flexneri 2a str. 301
aguagugguaacgcacacau

SEQ ID NO: 3885625 - RNA, 18 nt, Shigella flexneri 2a str. 301
aguaguguagcacuugca

SEQ ID NO: 3885626 - RNA, 14 nt, Shigella flexneri 2a str. 301
aguaguuccagcau

SEQ ID NO: 3885627 - RNA, 14 nt, Shigella flexneri 2a str. 301
aguauaaguaauga

SEQ ID NO: 3885628 - RNA, 16 nt, Shigella flexneri 2a str. 301
aguauacgccacauca

SEQ ID NO: 3885629 - RNA, 17 nt, Shigella flexneri 2a str. 301
aguauacgccacaucau

SEQ ID NO: 3885630 - RNA, 14 nt, Shigella flexneri 2a str. 301
aguauagcggcaug

SEQ ID NO: 3885631 - RNA, 15 nt, Shigella flexneri 2a str. 301
aguaucaauuauaug

SEQ ID NO: 3885632 - RNA, 11 nt, Shigella flexneri 2a str. 301
aguaucaucau

SEQ ID NO: 3885633 - RNA, 18 nt, Shigella flexneri 2a str. 301
aguauccacacagacaau

SEQ ID NO: 3885634 - RNA, 14 nt, Shigella flexneri 2a str. 301
aguauccacaggua

SEQ ID NO: 3885635 - RNA, 22 nt, Shigella flexneri 2a str. 301
aguauccaugcgcauuaagcca

SEQ ID NO: 3885636 - RNA, 21 nt, Shigella flexneri 2a str. 301
aguaucgcucaauauccugac

SEQ ID NO: 3885637 - RNA, 14 nt, Shigella flexneri 2a str. 301
aguaucggcaaggu

SEQ ID NO: 3885638 - RNA, 16 nt, Shigella flexneri 2a str. 301
aguaucuauucaucaa

SEQ ID NO: 3885639 - RNA, 15 nt, Shigella flexneri 2a str. 301
aguaucugaaucaaa

SEQ ID NO: 3885640 - RNA, 17 nt, Shigella flexneri 2a str. 301
aguaucugaaucaaaau

SEQ ID NO: 3885641 - RNA, 19 nt, Shigella flexneri 2a str. 301
aguaucugaaucaaaauca

SEQ ID NO: 3885642 - RNA, 17 nt, Shigella flexneri 2a str. 301
aguaugacaacuuucau

SEQ ID NO: 3885643 - RNA, 19 nt, Shigella flexneri 2a str. 301
aguaugacuuuaugcugaa

SEQ ID NO: 3885644 - RNA, 21 nt, Shigella flexneri 2a str. 301
aguaugauacguuuauuacca

SEQ ID NO: 3885645 - RNA, 14 nt, Shigella flexneri 2a str. 301
aguaugcaauaaca

SEQ ID NO: 3885646 - RNA, 19 nt, Shigella flexneri 2a str. 301
aguaugcaauaacaauacu

SEQ ID NO: 3885647 - RNA, 20 nt, Shigella flexneri 2a str. 301
aguaugcaauaacaauacuu

SEQ ID NO: 3885648 - RNA, 16 nt, Shigella flexneri 2a str. 301
aguucaagaugucugc

SEQ ID NO: 3885649 - RNA, 19 nt, Shigella flexneri 2a str. 301
aguucacaccagccaccgc

SEQ ID NO: 3885650 - RNA, 18 nt, Shigella flexneri 2a str. 301
aguucacccucauucacc

SEQ ID NO: 3885651 - RNA, 16 nt, Shigella flexneri 2a str. 301
aguucacgcagcuucu

SEQ ID NO: 3885652 - RNA, 20 nt, Shigella flexneri 2a str. 301
aguucacgcagguuagaaua

SEQ ID NO: 3885653 - RNA, 21 nt, Shigella flexneri 2a str. 301
aguucacgcggguugaacggu

SEQ ID NO: 3885654 - RNA, 22 nt, Shigella flexneri 2a str. 301
aguucagaagcugaagcagaaa

SEQ ID NO: 3885655 - RNA, 14 nt, Shigella flexneri 2a str. 301
aguucagcggcuga

SEQ ID NO: 3885656 - RNA, 16 nt, Shigella flexneri 2a str. 301
aguucaggcgcugcau

SEQ ID NO: 3885657 - RNA, 19 nt, Shigella flexneri 2a str. 301
aguucaguaugaucuugcc

SEQ ID NO: 3885658 - RNA, 23 nt, Shigella flexneri 2a str. 301
aguucaguaugaucuugcccgga

SEQ ID NO: 3885659 - RNA, 16 nt, Shigella flexneri 2a str. 301
aguucagucagcagug

SEQ ID NO: 3885660 - RNA, 16 nt, Shigella flexneri 2a str. 301
aguucaucacaccagu

SEQ ID NO: 3885661 - RNA, 19 nt, Shigella flexneri 2a str. 301
aguucaucacaccagucca

SEQ ID NO: 3885662 - RNA, 19 nt, Shigella flexneri 2a str. 301
aguucauccagugcuucaa

SEQ ID NO: 3885663 - RNA, 16 nt, Shigella flexneri 2a str. 301
aguucauccccucuuc

SEQ ID NO: 3885664 - RNA, 17 nt, Shigella flexneri 2a str. 301
aguucauccccucuucc

SEQ ID NO: 3885665 - RNA, 21 nt, Shigella flexneri 2a str. 301
aguucauccccucuuccauuu

SEQ ID NO: 3885666 - RNA, 13 nt, Shigella flexneri 2a str. 301
aguucccccugcc

SEQ ID NO: 3885667 - RNA, 15 nt, Shigella flexneri 2a str. 301
aguucccuacucucg

SEQ ID NO: 3885668 - RNA, 14 nt, Shigella flexneri 2a str. 301
aguuccggcaucga

SEQ ID NO: 3885669 - RNA, 17 nt, Shigella flexneri 2a str. 301
aguuccgggaucaccag

SEQ ID NO: 3885670 - RNA, 14 nt, Shigella flexneri 2a str. 301
aguuccggguuuuc

SEQ ID NO: 3885671 - RNA, 12 nt, Shigella flexneri 2a str. 301
aguuccugcaac

SEQ ID NO: 3885672 - RNA, 13 nt, Shigella flexneri 2a str. 301
aguucgagaaaaa

SEQ ID NO: 3885673 - RNA, 22 nt, Shigella flexneri 2a str. 301
aguucgaucucuucgccugccu

SEQ ID NO: 3885674 - RNA, 13 nt, Shigella flexneri 2a str. 301
aguucgauuuccc

SEQ ID NO: 3885675 - RNA, 19 nt, Shigella flexneri 2a str. 301
aguucgcgcgcugccagaa

SEQ ID NO: 3885676 - RNA, 14 nt, Shigella flexneri 2a str. 301
aguucgcuuuccgu

SEQ ID NO: 3885677 - RNA, 21 nt, Shigella flexneri 2a str. 301
aguucgguugggaucgccagg

SEQ ID NO: 3885678 - RNA, 12 nt, Shigella flexneri 2a str. 301
aguucuacaauc

SEQ ID NO: 3885679 - RNA, 23 nt, Shigella flexneri 2a str. 301
aguucugaacguugcgcuucccg

SEQ ID NO: 3885680 - RNA, 20 nt, Shigella flexneri 2a str. 301
aguucugcagcccgaacggu

SEQ ID NO: 3885681 - RNA, 13 nt, Shigella flexneri 2a str. 301
aguucugcgcauc

SEQ ID NO: 3885682 - RNA, 20 nt, Shigella flexneri 2a str. 301
aguucuucgguggucauuuu

SEQ ID NO: 3885683 - RNA, 13 nt, Shigella flexneri 2a str. 301
aguugaaaaccuc

SEQ ID NO: 3885684 - RNA, 14 nt, Shigella flexneri 2a str. 301
aguugaaaaccucu

SEQ ID NO: 3885685 - RNA, 16 nt, Shigella flexneri 2a str. 301
aguugaaaaccucucu

SEQ ID NO: 3885686 - RNA, 20 nt, Shigella flexneri 2a str. 301
aguugaccagcuccagcaga

SEQ ID NO: 3885687 - RNA, 21 nt, Shigella flexneri 2a str. 301
aguugagcaguccccacauca

SEQ ID NO: 3885688 - RNA, 15 nt, Shigella flexneri 2a str. 301
aguugaucaccagug

SEQ ID NO: 3885689 - RNA, 20 nt, Shigella flexneri 2a str. 301
aguugaucagccaggcgaug

SEQ ID NO: 3885690 - RNA, 19 nt, Shigella flexneri 2a str. 301
aguugaucuauaccaccgc

SEQ ID NO: 3885691 - RNA, 17 nt, Shigella flexneri 2a str. 301
aguugaucucuuuccac

SEQ ID NO: 3885692 - RNA, 18 nt, Shigella flexneri 2a str. 301
aguugauuaauuucauuu

SEQ ID NO: 3885693 - RNA, 19 nt, Shigella flexneri 2a str. 301
aguugauuaauuucauuuu

SEQ ID NO: 3885694 - RNA, 23 nt, Shigella flexneri 2a str. 301
aguugauuaugaucgccacgcgg

SEQ ID NO: 3885695 - RNA, 17 nt, Shigella flexneri 2a str. 301
aguugcacacuuuccau

SEQ ID NO: 3885696 - RNA, 16 nt, Shigella flexneri 2a str. 301
aguugcagacugaaua

SEQ ID NO: 3885697 - RNA, 17 nt, Shigella flexneri 2a str. 301
aguugcauuccagucca

SEQ ID NO: 3885698 - RNA, 22 nt, Shigella flexneri 2a str. 301
aguugccacuaacgucaguaag

SEQ ID NO: 3885699 - RNA, 17 nt, Shigella flexneri 2a str. 301
aguugccguucuucccg

SEQ ID NO: 3885700 - RNA, 14 nt, Shigella flexneri 2a str. 301
aguugcgccaguag

SEQ ID NO: 3885701 - RNA, 14 nt, Shigella flexneri 2a str. 301
aguugcuccacugc

SEQ ID NO: 3885702 - RNA, 14 nt, Shigella flexneri 2a str. 301
aguugcuccagcaa

SEQ ID NO: 3885703 - RNA, 17 nt, Shigella flexneri 2a str. 301
aguugcugacucgaacg

SEQ ID NO: 3885704 - RNA, 16 nt, Shigella flexneri 2a str. 301
aguugguuaaucuuuu

SEQ ID NO: 3885705 - RNA, 17 nt, Shigella flexneri 2a str. 301
aguuguccaugugcugg

SEQ ID NO: 3885706 - RNA, 13 nt, Shigella flexneri 2a str. 301
aguugucugaauc

SEQ ID NO: 3885707 - RNA, 19 nt, Shigella flexneri 2a str. 301
aguuguugagguucggagu

SEQ ID NO: 3885708 - RNA, 18 nt, Shigella flexneri 2a str. 301
aguuguugcauaggaauu

SEQ ID NO: 3885709 - RNA, 18 nt, Shigella flexneri 2a str. 301
aguuuaauugccauuucu

SEQ ID NO: 3885710 - RNA, 14 nt, Shigella flexneri 2a str. 301
aguuuaccagccaa

SEQ ID NO: 3885711 - RNA, 17 nt, Shigella flexneri 2a str. 301
aguuuacgaaccuucac

SEQ ID NO: 3885712 - RNA, 17 nt, Shigella flexneri 2a str. 301
aguuucaccagcaguaa

SEQ ID NO: 3885713 - RNA, 18 nt, Shigella flexneri 2a str. 301
aguuucaccagcaguaaa

SEQ ID NO: 3885714 - RNA, 16 nt, Shigella flexneri 2a str. 301
aguuucagaauauccg

SEQ ID NO: 3885715 - RNA, 16 nt, Shigella flexneri 2a str. 301
aguuucagccccauca

SEQ ID NO: 3885716 - RNA, 17 nt, Shigella flexneri 2a str. 301
aguuucagccccaucaa

SEQ ID NO: 3885717 - RNA, 21 nt, Shigella flexneri 2a str. 301
aguuucauaucugccagauaa

SEQ ID NO: 3885718 - RNA, 12 nt, Shigella flexneri 2a str. 301
aguuucaugaua

SEQ ID NO: 3885719 - RNA, 22 nt, Shigella flexneri 2a str. 301
aguuuccgcgccggcucauacu

SEQ ID NO: 3885720 - RNA, 18 nt, Shigella flexneri 2a str. 301
aguuuccgcuucugcuuu

SEQ ID NO: 3885721 - RNA, 19 nt, Shigella flexneri 2a str. 301
aguuucggacgcggcacgc

SEQ ID NO: 3885722 - RNA, 13 nt, Shigella flexneri 2a str. 301
aguuucugcagcu

SEQ ID NO: 3885723 - RNA, 14 nt, Shigella flexneri 2a str. 301
aguuucuuaccuac

SEQ ID NO: 3885724 - RNA, 21 nt, Shigella flexneri 2a str. 301
aguuugaacauaucagcgcaa

SEQ ID NO: 3885725 - RNA, 15 nt, Shigella flexneri 2a str. 301
aguuugauuaacgca

SEQ ID NO: 3885726 - RNA, 19 nt, Shigella flexneri 2a str. 301
aguuugauuauucacaauu

SEQ ID NO: 3885727 - RNA, 20 nt, Shigella flexneri 2a str. 301
aguuugcaccucugcugcug

SEQ ID NO: 3885728 - RNA, 13 nt, Shigella flexneri 2a str. 301
aguuugccguuga

SEQ ID NO: 3885729 - RNA, 20 nt, Shigella flexneri 2a str. 301
aguuuggcuucguguacaaa

SEQ ID NO: 3885730 - RNA, 18 nt, Shigella flexneri 2a str. 301
aguuuguguguggcgcgc

SEQ ID NO: 3885731 - RNA, 15 nt, Shigella flexneri 2a str. 301
aguuuguucagcugc

SEQ ID NO: 3885732 - RNA, 18 nt, Shigella flexneri 2a str. 301
aguuuguucagcugcgug

SEQ ID NO: 3885733 - RNA, 14 nt, Shigella flexneri 2a str. 301
aguuuguuuagcca

SEQ ID NO: 3885734 - RNA, 23 nt, Shigella flexneri 2a str. 301
aguuuuaguugccguucuucccg

SEQ ID NO: 3885735 - RNA, 21 nt, Shigella flexneri 2a str. 301
aguuuucauauaccgcaucag

SEQ ID NO: 3885736 - RNA, 12 nt, Shigella flexneri 2a str. 301
aguuuucuuugc

SEQ ID NO: 3885737 - RNA, 16 nt, Shigella flexneri 2a str. 301
aguuuuggggagaugu

SEQ ID NO: 3885738 - RNA, 17 nt, Shigella flexneri 2a str. 301
aguuuuuaggcaugaua

SEQ ID NO: 3885739 - RNA, 12 nt, Shigella flexneri 2a str. 301
aguuuuucaaca

SEQ ID NO: 3885740 - RNA, 17 nt, Shigella flexneri 2a str. 301
aguuuuucaucccucuc

SEQ ID NO: 3885741 - RNA, 16 nt, Shigella flexneri 2a str. 301
aguuuuucccgcuucg

SEQ ID NO: 3885742 - RNA, 15 nt, Shigella flexneri 2a str. 301
aguuuuugcccauca

SEQ ID NO: 3885743 - RNA, 17 nt, Shigella flexneri 2a str. 301
aguuuuuucuucccaag

SEQ ID NO: 3885744 - RNA, 13 nt, Shigella flexneri 2a str. 301
auaaaaaagagcg

SEQ ID NO: 3885745 - RNA, 21 nt, Shigella flexneri 2a str. 301
auaaaaauccgccagaaauca

SEQ ID NO: 3885746 - RNA, 22 nt, Shigella flexneri 2a str. 301
auaaaacaacggaacgaaaaaa

SEQ ID NO: 3885747 - RNA, 11 nt, Shigella flexneri 2a str. 301
auaaaacacuc

SEQ ID NO: 3885748 - RNA, 15 nt, Shigella flexneri 2a str. 301
auaacgaucucuuuc

SEQ ID NO: 3885749 - RNA, 20 nt, Shigella flexneri 2a str. 301
auaacgcaucggcuaaacca

SEQ ID NO: 3885750 - RNA, 22 nt, Shigella flexneri 2a str. 301
auaacgccaauucauuccuuga

SEQ ID NO: 3885751 - RNA, 18 nt, Shigella flexneri 2a str. 301
auaacgccggagagaaaa

SEQ ID NO: 3885752 - RNA, 17 nt, Shigella flexneri 2a str. 301
auaacgccuggcagugg

SEQ ID NO: 3885753 - RNA, 18 nt, Shigella flexneri 2a str. 301
auaacgcggcagcaggau

SEQ ID NO: 3885754 - RNA, 13 nt, Shigella flexneri 2a str. 301
auaacgcuuuucu

SEQ ID NO: 3885755 - RNA, 15 nt, Shigella flexneri 2a str. 301
auaacgcuuuucuca

SEQ ID NO: 3885756 - RNA, 15 nt, Shigella flexneri 2a str. 301
auaacggcagaagcu

SEQ ID NO: 3885757 - RNA, 14 nt, Shigella flexneri 2a str. 301
auaacggcucaaac

SEQ ID NO: 3885758 - RNA, 16 nt, Shigella flexneri 2a str. 301
auaacguuauaaccgc

SEQ ID NO: 3885759 - RNA, 16 nt, Shigella flexneri 2a str. 301
auaacguuugacauag

SEQ ID NO: 3885760 - RNA, 22 nt, Shigella flexneri 2a str. 301
auaacuauuguuuugaugaauc

SEQ ID NO: 3885761 - RNA, 14 nt, Shigella flexneri 2a str. 301
auaacucaccauca

SEQ ID NO: 3885762 - RNA, 18 nt, Shigella flexneri 2a str. 301
auaacucaccaucaagua

SEQ ID NO: 3885763 - RNA, 16 nt, Shigella flexneri 2a str. 301
auaacucauauaacgc

SEQ ID NO: 3885764 - RNA, 21 nt, Shigella flexneri 2a str. 301
auaacuccccgagaaauacug

SEQ ID NO: 3885765 - RNA, 22 nt, Shigella flexneri 2a str. 301
auaacuccccgagaaauacugg

SEQ ID NO: 3885766 - RNA, 19 nt, Shigella flexneri 2a str. 301
auaacucgcacguucaguu

SEQ ID NO: 3885767 - RNA, 18 nt, Shigella flexneri 2a str. 301
auaacucuuugaugaaac

SEQ ID NO: 3885768 - RNA, 14 nt, Shigella flexneri 2a str. 301
auaacugcuauuca

SEQ ID NO: 3885769 - RNA, 18 nt, Shigella flexneri 2a str. 301
auaacugcuauucaccag

SEQ ID NO: 3885770 - RNA, 15 nt, Shigella flexneri 2a str. 301
auaacuggucaucaa

SEQ ID NO: 3885771 - RNA, 16 nt, Shigella flexneri 2a str. 301
auaacuggucaucaaa

SEQ ID NO: 3885772 - RNA, 19 nt, Shigella flexneri 2a str. 301
auaacuucacuaaucaauu

SEQ ID NO: 3885773 - RNA, 22 nt, Shigella flexneri 2a str. 301
auaagaacugacuuccacuucc

SEQ ID NO: 3885774 - RNA, 21 nt, Shigella flexneri 2a str. 301
auaagacguaucaggcaaaau

SEQ ID NO: 3885775 - RNA, 19 nt, Shigella flexneri 2a str. 301
auaagagcgggacaacaaa

SEQ ID NO: 3885776 - RNA, 11 nt, Shigella flexneri 2a str. 301
auaagauacug

SEQ ID NO: 3885777 - RNA, 14 nt, Shigella flexneri 2a str. 301
auaagauacuggau

SEQ ID NO: 3885778 - RNA, 17 nt, Shigella flexneri 2a str. 301
auaagaugcgccagcau

SEQ ID NO: 3885779 - RNA, 13 nt, Shigella flexneri 2a str. 301
auaagcaaggcaa

SEQ ID NO: 3885780 - RNA, 22 nt, Shigella flexneri 2a str. 301
auaagcaucccuuuaauuaucc

SEQ ID NO: 3885781 - RNA, 20 nt, Shigella flexneri 2a str. 301
auaagcccagaacaaauaaa

SEQ ID NO: 3885782 - RNA, 15 nt, Shigella flexneri 2a str. 301
auaagcgcaagggua

SEQ ID NO: 3885783 - RNA, 13 nt, Shigella flexneri 2a str. 301
auaagcgcagcgc

SEQ ID NO: 3885784 - RNA, 22 nt, Shigella flexneri 2a str. 301
auaagcggaaagaccacaguaa

SEQ ID NO: 3885785 - RNA, 14 nt, Shigella flexneri 2a str. 301
auaaggcgcaauaa

SEQ ID NO: 3885786 - RNA, 13 nt, Shigella flexneri 2a str. 301
auaaggcuuuaac

SEQ ID NO: 3885787 - RNA, 12 nt, Shigella flexneri 2a str. 301
auaagucucaga

SEQ ID NO: 3885788 - RNA, 14 nt, Shigella flexneri 2a str. 301
auaaguguaaaauu

SEQ ID NO: 3885789 - RNA, 22 nt, Shigella flexneri 2a str. 301
auaaguuaaccccaguaauuca

SEQ ID NO: 3885790 - RNA, 15 nt, Shigella flexneri 2a str. 301
auaaguuacacauca

SEQ ID NO: 3885791 - RNA, 13 nt, Shigella flexneri 2a str. 301
auaaguucaguau

SEQ ID NO: 3885792 - RNA, 21 nt, Shigella flexneri 2a str. 301
auaaguugccacgcuucaauc

SEQ ID NO: 3885793 - RNA, 13 nt, Shigella flexneri 2a str. 301
auaauaaagcuac

SEQ ID NO: 3885794 - RNA, 12 nt, Shigella flexneri 2a str. 301
auaauacacaca

SEQ ID NO: 3885795 - RNA, 15 nt, Shigella flexneri 2a str. 301
auaauacacacauca

SEQ ID NO: 3885796 - RNA, 15 nt, Shigella flexneri 2a str. 301
auaauacacuuaacu

SEQ ID NO: 3885797 - RNA, 20 nt, Shigella flexneri 2a str. 301
auaauacaggcuacucccag

SEQ ID NO: 3885798 - RNA, 13 nt, Shigella flexneri 2a str. 301
auaauaguauuaa

SEQ ID NO: 3885799 - RNA, 21 nt, Shigella flexneri 2a str. 301
auaauauccugccguuuuuua

SEQ ID NO: 3885800 - RNA, 15 nt, Shigella flexneri 2a str. 301
auaauaucuccagcu

SEQ ID NO: 3885801 - RNA, 14 nt, Shigella flexneri 2a str. 301
auaauaucuuuucu

SEQ ID NO: 3885802 - RNA, 15 nt, Shigella flexneri 2a str. 301
auaauaucuuuucuu

SEQ ID NO: 3885803 - RNA, 17 nt, Shigella flexneri 2a str. 301
auaaucaacaaaccaaa

SEQ ID NO: 3885804 - RNA, 16 nt, Shigella flexneri 2a str. 301
auaaucaacaugaugg

SEQ ID NO: 3885805 - RNA, 19 nt, Shigella flexneri 2a str. 301
auaaucaacgcaccgacaa

SEQ ID NO: 3885806 - RNA, 20 nt, Shigella flexneri 2a str. 301
auaaucaaucuuuacacaca

SEQ ID NO: 3885807 - RNA, 15 nt, Shigella flexneri 2a str. 301
auaaucacaaugguc

SEQ ID NO: 3885808 - RNA, 20 nt, Shigella flexneri 2a str. 301
auaaucacaauggucaacau

SEQ ID NO: 3885809 - RNA, 14 nt, Shigella flexneri 2a str. 301
auaaucacauaauc

SEQ ID NO: 3885810 - RNA, 14 nt, Shigella flexneri 2a str. 301
auaaucaccacaca

SEQ ID NO: 3885811 - RNA, 21 nt, Shigella flexneri 2a str. 301
auaaucacgcuuuacaauauc

SEQ ID NO: 3885812 - RNA, 19 nt, Shigella flexneri 2a str. 301
auaaucacucuuccccgcu

SEQ ID NO: 3885813 - RNA, 23 nt, Shigella flexneri 2a str. 301
auaaucagauugugguugcgcag

SEQ ID NO: 3885814 - RNA, 15 nt, Shigella flexneri 2a str. 301
auaauccaucacuuc

SEQ ID NO: 3885815 - RNA, 17 nt, Shigella flexneri 2a str. 301
auaauccaucacuucau

SEQ ID NO: 3885816 - RNA, 18 nt, Shigella flexneri 2a str. 301
auaauccaucacuucauc

SEQ ID NO: 3885817 - RNA, 19 nt, Shigella flexneri 2a str. 301
auaauccaucacuucauca

SEQ ID NO: 3885818 - RNA, 18 nt, Shigella flexneri 2a str. 301
auaauccccaaugaccuu

SEQ ID NO: 3885819 - RNA, 19 nt, Shigella flexneri 2a str. 301
auaaucccgcgcaacaaau

SEQ ID NO: 3885820 - RNA, 21 nt, Shigella flexneri 2a str. 301
auaaucccgcgcaacaaauaa

SEQ ID NO: 3885821 - RNA, 16 nt, Shigella flexneri 2a str. 301
auaaucccggcaccaa

SEQ ID NO: 3885822 - RNA, 17 nt, Shigella flexneri 2a str. 301
auaauccgcuguaauug

SEQ ID NO: 3885823 - RNA, 16 nt, Shigella flexneri 2a str. 301
auaaucgcaauuaccc

SEQ ID NO: 3885824 - RNA, 13 nt, Shigella flexneri 2a str. 301
auaaucgcauuca

SEQ ID NO: 3885825 - RNA, 19 nt, Shigella flexneri 2a str. 301
auaaucgcgaauagcuuca

SEQ ID NO: 3885826 - RNA, 20 nt, Shigella flexneri 2a str. 301
auaaucgcgaauagcuucaa

SEQ ID NO: 3885827 - RNA, 15 nt, Shigella flexneri 2a str. 301
auaaucgggaacgcu

SEQ ID NO: 3885828 - RNA, 18 nt, Shigella flexneri 2a str. 301
auaaucgggaauacagaa

SEQ ID NO: 3885829 - RNA, 16 nt, Shigella flexneri 2a str. 301
auaaucguaaucagca

SEQ ID NO: 3885830 - RNA, 20 nt, Shigella flexneri 2a str. 301
auaaucucgccuuaucagaa

SEQ ID NO: 3885831 - RNA, 20 nt, Shigella flexneri 2a str. 301
auaaucucuacaccauuacc

SEQ ID NO: 3885832 - RNA, 19 nt, Shigella flexneri 2a str. 301
auaaugaacgccaccccac

SEQ ID NO: 3885833 - RNA, 14 nt, Shigella flexneri 2a str. 301
auaaugaaggauga

SEQ ID NO: 3885834 - RNA, 17 nt, Shigella flexneri 2a str. 301
auaaugaaggaugaaac

SEQ ID NO: 3885835 - RNA, 20 nt, Shigella flexneri 2a str. 301
auaaugagcaccgcaccuaa

SEQ ID NO: 3885836 - RNA, 12 nt, Shigella flexneri 2a str. 301
auaaugcaacau

SEQ ID NO: 3885837 - RNA, 19 nt, Shigella flexneri 2a str. 301
auaaugcgacaacagaaau

SEQ ID NO: 3885838 - RNA, 14 nt, Shigella flexneri 2a str. 301
auaaugcucgaacg

SEQ ID NO: 3885839 - RNA, 18 nt, Shigella flexneri 2a str. 301
auaauggcguauuucaca

SEQ ID NO: 3885840 - RNA, 14 nt, Shigella flexneri 2a str. 301
auaauggcugccga

SEQ ID NO: 3885841 - RNA, 13 nt, Shigella flexneri 2a str. 301
auaauggcuguug

SEQ ID NO: 3885842 - RNA, 19 nt, Shigella flexneri 2a str. 301
auaaugugcgcacauugcc

SEQ ID NO: 3885843 - RNA, 22 nt, Shigella flexneri 2a str. 301
auaauguggccccugaaguuca

SEQ ID NO: 3885844 - RNA, 22 nt, Shigella flexneri 2a str. 301
auaauguuauuuaauuacugag

SEQ ID NO: 3885845 - RNA, 20 nt, Shigella flexneri 2a str. 301
auaauuaugccgaucaucau

SEQ ID NO: 3885846 - RNA, 22 nt, Shigella flexneri 2a str. 301
auaauuauuacuaccuuaauca

SEQ ID NO: 3885847 - RNA, 21 nt, Shigella flexneri 2a str. 301
auaauuccauucaccauuuuu

SEQ ID NO: 3885848 - RNA, 17 nt, Shigella flexneri 2a str. 301
auacugagcaaggcaua

SEQ ID NO: 3885849 - RNA, 14 nt, Shigella flexneri 2a str. 301
auacugaucaucau

SEQ ID NO: 3885850 - RNA, 16 nt, Shigella flexneri 2a str. 301
auacugaucaucauua

SEQ ID NO: 3885851 - RNA, 16 nt, Shigella flexneri 2a str. 301
auacugauccgcuucg

SEQ ID NO: 3885852 - RNA, 22 nt, Shigella flexneri 2a str. 301
auacugaucgucaucaaacggc

SEQ ID NO: 3885853 - RNA, 14 nt, Shigella flexneri 2a str. 301
auacugcaucagcg

SEQ ID NO: 3885854 - RNA, 13 nt, Shigella flexneri 2a str. 301
auacugcccaauc

SEQ ID NO: 3885855 - RNA, 19 nt, Shigella flexneri 2a str. 301
auacugcgcguggucagca

SEQ ID NO: 3885856 - RNA, 13 nt, Shigella flexneri 2a str. 301
auacugcucagac

SEQ ID NO: 3885857 - RNA, 22 nt, Shigella flexneri 2a str. 301
auacuggauagauauucuccag

SEQ ID NO: 3885858 - RNA, 18 nt, Shigella flexneri 2a str. 301
auacuggcuaagaagccu

SEQ ID NO: 3885859 - RNA, 19 nt, Shigella flexneri 2a str. 301
auacuguuuaucuucccag

SEQ ID NO: 3885860 - RNA, 20 nt, Shigella flexneri 2a str. 301
auacuguuuaucuucccagc

SEQ ID NO: 3885861 - RNA, 22 nt, Shigella flexneri 2a str. 301
auacuguuuaucuucccagcgc

SEQ ID NO: 3885862 - RNA, 16 nt, Shigella flexneri 2a str. 301
auacuuaaauaaugcu

SEQ ID NO: 3885863 - RNA, 21 nt, Shigella flexneri 2a str. 301
auacuuaaccccagaccaauc

SEQ ID NO: 3885864 - RNA, 18 nt, Shigella flexneri 2a str. 301
auacuuauuaugaaugau

SEQ ID NO: 3885865 - RNA, 13 nt, Shigella flexneri 2a str. 301
auacuuccacgca

SEQ ID NO: 3885866 - RNA, 15 nt, Shigella flexneri 2a str. 301
auacuuccacgcaga

SEQ ID NO: 3885867 - RNA, 19 nt, Shigella flexneri 2a str. 301
auacuuccacuaguauuua

SEQ ID NO: 3885868 - RNA, 13 nt, Shigella flexneri 2a str. 301
auacuuucacaaa

SEQ ID NO: 3885869 - RNA, 15 nt, Shigella flexneri 2a str. 301
auacuuucacaaaaa

SEQ ID NO: 3885870 - RNA, 17 nt, Shigella flexneri 2a str. 301
auacuuucacaaaaaua

SEQ ID NO: 3885871 - RNA, 13 nt, Shigella flexneri 2a str. 301
auacuuuucagga

SEQ ID NO: 3885872 - RNA, 23 nt, Shigella flexneri 2a str. 301
auacuuuuucaagaaucggcuuu

SEQ ID NO: 3885873 - RNA, 17 nt, Shigella flexneri 2a str. 301
auagaaagugacagccc

SEQ ID NO: 3885874 - RNA, 22 nt, Shigella flexneri 2a str. 301
auagaaagugacugcuggguua

SEQ ID NO: 3885875 - RNA, 18 nt, Shigella flexneri 2a str. 301
auagaacaguuacgcaga

SEQ ID NO: 3885876 - RNA, 19 nt, Shigella flexneri 2a str. 301
auagaacaucuuaccucug

SEQ ID NO: 3885877 - RNA, 14 nt, Shigella flexneri 2a str. 301
auagaaccacgcaa

SEQ ID NO: 3885878 - RNA, 20 nt, Shigella flexneri 2a str. 301
auagaaccuaagaaccagaa

SEQ ID NO: 3885879 - RNA, 13 nt, Shigella flexneri 2a str. 301
auagaacggcaga

SEQ ID NO: 3885880 - RNA, 12 nt, Shigella flexneri 2a str. 301
auagaccauugc

SEQ ID NO: 3885881 - RNA, 18 nt, Shigella flexneri 2a str. 301
auagagaaaguaaaccac

SEQ ID NO: 3885882 - RNA, 15 nt, Shigella flexneri 2a str. 301
auagagauuuuuccc

SEQ ID NO: 3885883 - RNA, 20 nt, Shigella flexneri 2a str. 301
auagagcgcggcgcaggcaa

SEQ ID NO: 3885884 - RNA, 13 nt, Shigella flexneri 2a str. 301
auagauccaggaa

SEQ ID NO: 3885885 - RNA, 12 nt, Shigella flexneri 2a str. 301
auagauuauuug

SEQ ID NO: 3885886 - RNA, 16 nt, Shigella flexneri 2a str. 301
auagauuuuuaaugcu

SEQ ID NO: 3885887 - RNA, 13 nt, Shigella flexneri 2a str. 301
auagcaaaguaau

SEQ ID NO: 3885888 - RNA, 15 nt, Shigella flexneri 2a str. 301
auagcaacagcagcc

SEQ ID NO: 3885889 - RNA, 20 nt, Shigella flexneri 2a str. 301
auagcacauaaaauggccgu

SEQ ID NO: 3885890 - RNA, 19 nt, Shigella flexneri 2a str. 301
auagcaccauuaaauccgg

SEQ ID NO: 3885891 - RNA, 17 nt, Shigella flexneri 2a str. 301
auagcacgacguuucuu

SEQ ID NO: 3885892 - RNA, 16 nt, Shigella flexneri 2a str. 301
auagcagaaaacucac

SEQ ID NO: 3885893 - RNA, 18 nt, Shigella flexneri 2a str. 301
auagcauaauauaacagc

SEQ ID NO: 3885894 - RNA, 19 nt, Shigella flexneri 2a str. 301
auagccaccuggcugcguu

SEQ ID NO: 3885895 - RNA, 22 nt, Shigella flexneri 2a str. 301
auagccaccuuauaacccgacu

SEQ ID NO: 3885896 - RNA, 15 nt, Shigella flexneri 2a str. 301
auagccagacguugu

SEQ ID NO: 3885897 - RNA, 15 nt, Shigella flexneri 2a str. 301
auagccagcaacauu

SEQ ID NO: 3885898 - RNA, 19 nt, Shigella flexneri 2a str. 301
auagccagcagagcaaaaa

SEQ ID NO: 3885899 - RNA, 17 nt, Shigella flexneri 2a str. 301
auagccagccucaucca

SEQ ID NO: 3885900 - RNA, 13 nt, Shigella flexneri 2a str. 301
auagccaggcgga

SEQ ID NO: 3885901 - RNA, 19 nt, Shigella flexneri 2a str. 301
auagccccuggugagaguc

SEQ ID NO: 3885902 - RNA, 15 nt, Shigella flexneri 2a str. 301
auagccgauaccuaa

SEQ ID NO: 3885903 - RNA, 16 nt, Shigella flexneri 2a str. 301
auagccgcaaagaugu

SEQ ID NO: 3885904 - RNA, 19 nt, Shigella flexneri 2a str. 301
auagccucaaauuccuuau

SEQ ID NO: 3885905 - RNA, 14 nt, Shigella flexneri 2a str. 301
auagccugccagag

SEQ ID NO: 3885906 - RNA, 15 nt, Shigella flexneri 2a str. 301
auagccuucagugcc

SEQ ID NO: 3885907 - RNA, 19 nt, Shigella flexneri 2a str. 301
auagcgaaguagacagcgu

SEQ ID NO: 3885908 - RNA, 21 nt, Shigella flexneri 2a str. 301
auagcgcacaugcaacuucgc

SEQ ID NO: 3885909 - RNA, 15 nt, Shigella flexneri 2a str. 301
auagcgccugcugcu

SEQ ID NO: 3885910 - RNA, 17 nt, Shigella flexneri 2a str. 301
auagcggcgacuugcuc

SEQ ID NO: 3885911 - RNA, 15 nt, Shigella flexneri 2a str. 301
auagcggcugacggu

SEQ ID NO: 3885912 - RNA, 16 nt, Shigella flexneri 2a str. 301
auagcgggaaauacug

SEQ ID NO: 3885913 - RNA, 21 nt, Shigella flexneri 2a str. 301
auagcgguaagcaugaauauc

SEQ ID NO: 3885914 - RNA, 12 nt, Shigella flexneri 2a str. 301
auagcgucaaga

SEQ ID NO: 3885915 - RNA, 17 nt, Shigella flexneri 2a str. 301
auagcguuaaucaucaa

SEQ ID NO: 3885916 - RNA, 14 nt, Shigella flexneri 2a str. 301
auagcuaaucaucu

SEQ ID NO: 3885917 - RNA, 19 nt, Shigella flexneri 2a str. 301
auagcuaaucaucuguugu

SEQ ID NO: 3885918 - RNA, 12 nt, Shigella flexneri 2a str. 301
auagcuaauccc

SEQ ID NO: 3885919 - RNA, 14 nt, Shigella flexneri 2a str. 301
auagcuggcaacgc

SEQ ID NO: 3885920 - RNA, 17 nt, Shigella flexneri 2a str. 301
auagcuuauucuuauua

SEQ ID NO: 3885921 - RNA, 13 nt, Shigella flexneri 2a str. 301
auagcuucaaaua

SEQ ID NO: 3885922 - RNA, 15 nt, Shigella flexneri 2a str. 301
auaggaauccggguc

SEQ ID NO: 3885923 - RNA, 19 nt, Shigella flexneri 2a str. 301
auaggagucacucgacagc

SEQ ID NO: 3885924 - RNA, 23 nt, Shigella flexneri 2a str. 301
auaggauuucugauuauggcggc

SEQ ID NO: 3885925 - RNA, 20 nt, Shigella flexneri 2a str. 301
auaggcaggcaucaucagau

SEQ ID NO: 3885926 - RNA, 14 nt, Shigella flexneri 2a str. 301
auaggcaucccgca

SEQ ID NO: 3885927 - RNA, 18 nt, Shigella flexneri 2a str. 301
auaggcggcaaacaguuu

SEQ ID NO: 3885928 - RNA, 13 nt, Shigella flexneri 2a str. 301
auagggacacauu

SEQ ID NO: 3885929 - RNA, 15 nt, Shigella flexneri 2a str. 301
auagguaaacaucac

SEQ ID NO: 3885930 - RNA, 19 nt, Shigella flexneri 2a str. 301
auagguaaacaucacauau

SEQ ID NO: 3885931 - RNA, 14 nt, Shigella flexneri 2a str. 301
auaggugucaacca

SEQ ID NO: 3885932 - RNA, 18 nt, Shigella flexneri 2a str. 301
auagguugaaauaaaccg

SEQ ID NO: 3885933 - RNA, 13 nt, Shigella flexneri 2a str. 301
auaguaaccagac

SEQ ID NO: 3885934 - RNA, 21 nt, Shigella flexneri 2a str. 301
auaguagccagccagaaucau

SEQ ID NO: 3885935 - RNA, 20 nt, Shigella flexneri 2a str. 301
auaguagguccugaccaaag

SEQ ID NO: 3885936 - RNA, 16 nt, Shigella flexneri 2a str. 301
auagucaugaugacgc

SEQ ID NO: 3885937 - RNA, 21 nt, Shigella flexneri 2a str. 301
auagucccuucgguagcagcu

SEQ ID NO: 3885938 - RNA, 17 nt, Shigella flexneri 2a str. 301
auaguccugagucagaa

SEQ ID NO: 3885939 - RNA, 22 nt, Shigella flexneri 2a str. 301
auaguccugagucagaaacugu

SEQ ID NO: 3885940 - RNA, 12 nt, Shigella flexneri 2a str. 301
auagucuuuucg

SEQ ID NO: 3885941 - RNA, 16 nt, Shigella flexneri 2a str. 301
auagugccuggcugcg

SEQ ID NO: 3885942 - RNA, 14 nt, Shigella flexneri 2a str. 301
auaguggcucaggc

SEQ ID NO: 3885943 - RNA, 22 nt, Shigella flexneri 2a str. 301
auaguguuuuauguucagauaa

SEQ ID NO: 3885944 - RNA, 14 nt, Shigella flexneri 2a str. 301
auaguucaacagau

SEQ ID NO: 3885945 - RNA, 18 nt, Shigella flexneri 2a str. 301
auaguucaaugauaguuc

SEQ ID NO: 3885946 - RNA, 20 nt, Shigella flexneri 2a str. 301
auaguuccacuauuucaaua

SEQ ID NO: 3885947 - RNA, 22 nt, Shigella flexneri 2a str. 301
auaguucuguugcugaaauucc

SEQ ID NO: 3885948 - RNA, 20 nt, Shigella flexneri 2a str. 301
auaguugcauuccaguccac

SEQ ID NO: 3885949 - RNA, 18 nt, Shigella flexneri 2a str. 301
auauuacaacguauuaua

SEQ ID NO: 3885950 - RNA, 17 nt, Shigella flexneri 2a str. 301
auauuacaucuuaaucu

SEQ ID NO: 3885951 - RNA, 19 nt, Shigella flexneri 2a str. 301
auauuacgagucacaaaca

SEQ ID NO: 3885952 - RNA, 16 nt, Shigella flexneri 2a str. 301
auauuacguuccuuua

SEQ ID NO: 3885953 - RNA, 17 nt, Shigella flexneri 2a str. 301
auauuagucaauuaaaa

SEQ ID NO: 3885954 - RNA, 22 nt, Shigella flexneri 2a str. 301
auauuaucagcaaagcaaauuu

SEQ ID NO: 3885955 - RNA, 17 nt, Shigella flexneri 2a str. 301
auauuauugaaaucacu

SEQ ID NO: 3885956 - RNA, 24 nt, Shigella flexneri 2a str. 301
auauuauuggcaucguauuucaga

SEQ ID NO: 3885957 - RNA, 15 nt, Shigella flexneri 2a str. 301
auauucaacaccgau

SEQ ID NO: 3885958 - RNA, 13 nt, Shigella flexneri 2a str. 301
auauucaauugga

SEQ ID NO: 3885959 - RNA, 16 nt, Shigella flexneri 2a str. 301
auauucaauuugcaau

SEQ ID NO: 3885960 - RNA, 18 nt, Shigella flexneri 2a str. 301
auauucaccauuacgcaa

SEQ ID NO: 3885961 - RNA, 13 nt, Shigella flexneri 2a str. 301
auauucagcagca

SEQ ID NO: 3885962 - RNA, 14 nt, Shigella flexneri 2a str. 301
auauucagcagcag

SEQ ID NO: 3885963 - RNA, 20 nt, Shigella flexneri 2a str. 301
auauucaggcguugaaaaau

SEQ ID NO: 3885964 - RNA, 21 nt, Shigella flexneri 2a str. 301
auauucaggcguugaaaaauc

SEQ ID NO: 3885965 - RNA, 13 nt, Shigella flexneri 2a str. 301
auauuccaucgcu

SEQ ID NO: 3885966 - RNA, 11 nt, Shigella flexneri 2a str. 301
auauuccccag

SEQ ID NO: 3885967 - RNA, 21 nt, Shigella flexneri 2a str. 301
auauuccgcaccugccagcgc

SEQ ID NO: 3885968 - RNA, 23 nt, Shigella flexneri 2a str. 301
auauucgacaccaucuuccucac

SEQ ID NO: 3885969 - RNA, 19 nt, Shigella flexneri 2a str. 301
auauucgauacauucagaa

SEQ ID NO: 3885970 - RNA, 18 nt, Shigella flexneri 2a str. 301
auauucgccgcccugcag

SEQ ID NO: 3885971 - RNA, 13 nt, Shigella flexneri 2a str. 301
auauucgcuuuca

SEQ ID NO: 3885972 - RNA, 11 nt, Shigella flexneri 2a str. 301
auauucguuau

SEQ ID NO: 3885973 - RNA, 14 nt, Shigella flexneri 2a str. 301
auauucuucaguau

SEQ ID NO: 3885974 - RNA, 12 nt, Shigella flexneri 2a str. 301
auauugccaccu

SEQ ID NO: 3885975 - RNA, 21 nt, Shigella flexneri 2a str. 301
auauugccccacaccgcgacg

SEQ ID NO: 3885976 - RNA, 21 nt, Shigella flexneri 2a str. 301
auauugcccgugacucccacu

SEQ ID NO: 3885977 - RNA, 22 nt, Shigella flexneri 2a str. 301
auauugccgauuacguaauuca

SEQ ID NO: 3885978 - RNA, 13 nt, Shigella flexneri 2a str. 301
auauuggucacca

SEQ ID NO: 3885979 - RNA, 23 nt, Shigella flexneri 2a str. 301
auauuguuacgguguucacucau

SEQ ID NO: 3885980 - RNA, 21 nt, Shigella flexneri 2a str. 301
auauuuacaaaucuuuauaau

SEQ ID NO: 3885981 - RNA, 15 nt, Shigella flexneri 2a str. 301
auauuuagccagcaa

SEQ ID NO: 3885982 - RNA, 14 nt, Shigella flexneri 2a str. 301
auauuuauuuccuu

SEQ ID NO: 3885983 - RNA, 11 nt, Shigella flexneri 2a str. 301
auauuucacau

SEQ ID NO: 3885984 - RNA, 15 nt, Shigella flexneri 2a str. 301
auauuucaggccaac

SEQ ID NO: 3885985 - RNA, 23 nt, Shigella flexneri 2a str. 301
auauuuccccuguugcaaacuga

SEQ ID NO: 3885986 - RNA, 16 nt, Shigella flexneri 2a str. 301
auauuuccuuccuugg

SEQ ID NO: 3885987 - RNA, 13 nt, Shigella flexneri 2a str. 301
auauuucuauauc

SEQ ID NO: 3885988 - RNA, 22 nt, Shigella flexneri 2a str. 301
auauuucugcggcauucccagc

SEQ ID NO: 3885989 - RNA, 19 nt, Shigella flexneri 2a str. 301
auauuugaggaguuuaaua

SEQ ID NO: 3885990 - RNA, 18 nt, Shigella flexneri 2a str. 301
auauuugcgauacaggaa

SEQ ID NO: 3885991 - RNA, 15 nt, Shigella flexneri 2a str. 301
auauuuuaaucagcg

SEQ ID NO: 3885992 - RNA, 20 nt, Shigella flexneri 2a str. 301
auauuuugcuuuaaguucag

SEQ ID NO: 3885993 - RNA, 17 nt, Shigella flexneri 2a str. 301
auauuuuguugcauaau

SEQ ID NO: 3885994 - RNA, 15 nt, Shigella flexneri 2a str. 301
auauuuuuaaauaua

SEQ ID NO: 3885995 - RNA, 14 nt, Shigella flexneri 2a str. 301
auauuuuucccuga

SEQ ID NO: 3885996 - RNA, 13 nt, Shigella flexneri 2a str. 301
auauuuuuuuagu

SEQ ID NO: 3885997 - RNA, 20 nt, Shigella flexneri 2a str. 301
aucaaaaaacuggaaaaaua

SEQ ID NO: 3885998 - RNA, 19 nt, Shigella flexneri 2a str. 301
aucaaaaaaggcugacaaa

SEQ ID NO: 3885999 - RNA, 21 nt, Shigella flexneri 2a str. 301
aucaaaaaaggcugacaaauc

SEQ ID NO: 3886000 - RNA, 17 nt, Shigella flexneri 2a str. 301
aucaaaacgcucugagc

SEQ ID NO: 3886001 - RNA, 20 nt, Shigella flexneri 2a str. 301
aucaaaacgcucugagcugc

SEQ ID NO: 3886002 - RNA, 13 nt, Shigella flexneri 2a str. 301
aucaaaacgcugg

SEQ ID NO: 3886003 - RNA, 13 nt, Shigella flexneri 2a str. 301
aucaaaaucauca

SEQ ID NO: 3886004 - RNA, 21 nt, Shigella flexneri 2a str. 301
aucaaacaacggcacuucaau

SEQ ID NO: 3886005 - RNA, 22 nt, Shigella flexneri 2a str. 301
aucaaacagaauauugugcuca

SEQ ID NO: 3886006 - RNA, 15 nt, Shigella flexneri 2a str. 301
aucaaaccacuuaau

SEQ ID NO: 3886007 - RNA, 19 nt, Shigella flexneri 2a str. 301
aucaaacgaagcggcugcg

SEQ ID NO: 3886008 - RNA, 22 nt, Shigella flexneri 2a str. 301
aucaaacgccugaccguugauu

SEQ ID NO: 3886009 - RNA, 16 nt, Shigella flexneri 2a str. 301
aucaaacggugguugu

SEQ ID NO: 3886010 - RNA, 19 nt, Shigella flexneri 2a str. 301
aucaaacuuuuaaauugaa

SEQ ID NO: 3886011 - RNA, 21 nt, Shigella flexneri 2a str. 301
aucaaacuuuuaaauugaaga

SEQ ID NO: 3886012 - RNA, 14 nt, Shigella flexneri 2a str. 301
aucaaagguuuuuc

SEQ ID NO: 3886013 - RNA, 13 nt, Shigella flexneri 2a str. 301
aucaaaguaauuu

SEQ ID NO: 3886014 - RNA, 16 nt, Shigella flexneri 2a str. 301
aucaaaguuuuuauga

SEQ ID NO: 3886015 - RNA, 23 nt, Shigella flexneri 2a str. 301
aucaaaucaacaaccugcauuug

SEQ ID NO: 3886016 - RNA, 11 nt, Shigella flexneri 2a str. 301
aucaaaucucg

SEQ ID NO: 3886017 - RNA, 15 nt, Shigella flexneri 2a str. 301
aucaaaugaaugcca

SEQ ID NO: 3886018 - RNA, 18 nt, Shigella flexneri 2a str. 301
aucaaaugaaugccaaau

SEQ ID NO: 3886019 - RNA, 22 nt, Shigella flexneri 2a str. 301
aucaacaaaccaaaaccgcucg

SEQ ID NO: 3886020 - RNA, 14 nt, Shigella flexneri 2a str. 301
aucaacaaagugca

SEQ ID NO: 3886021 - RNA, 14 nt, Shigella flexneri 2a str. 301
aucaacaagcgaau

SEQ ID NO: 3886022 - RNA, 14 nt, Shigella flexneri 2a str. 301
aucaacacauccag

SEQ ID NO: 3886023 - RNA, 17 nt, Shigella flexneri 2a str. 301
aucaacaccacugccag

SEQ ID NO: 3886024 - RNA, 18 nt, Shigella flexneri 2a str. 301
aucaacaguuuguugcau

SEQ ID NO: 3886025 - RNA, 19 nt, Shigella flexneri 2a str. 301
aucaacaguuuguugcauu

SEQ ID NO: 3886026 - RNA, 24 nt, Shigella flexneri 2a str. 301
aucaacaguuuguugcauuugcag

SEQ ID NO: 3886027 - RNA, 15 nt, Shigella flexneri 2a str. 301
aucaacauauuaaaa

SEQ ID NO: 3886028 - RNA, 16 nt, Shigella flexneri 2a str. 301
aucaacauauuccccu

SEQ ID NO: 3886029 - RNA, 14 nt, Shigella flexneri 2a str. 301
aucaacaugaaaau

SEQ ID NO: 3886030 - RNA, 15 nt, Shigella flexneri 2a str. 301
aucaacaugaaaaua

SEQ ID NO: 3886031 - RNA, 20 nt, Shigella flexneri 2a str. 301
aucaacaugaaaauaaccau

SEQ ID NO: 3886032 - RNA, 12 nt, Shigella flexneri 2a str. 301
aucaacaugaug

SEQ ID NO: 3886033 - RNA, 23 nt, Shigella flexneri 2a str. 301
aucaaccagaucgcucaucugcu

SEQ ID NO: 3886034 - RNA, 15 nt, Shigella flexneri 2a str. 301
aucaacccagcuggu

SEQ ID NO: 3886035 - RNA, 19 nt, Shigella flexneri 2a str. 301
aucaaccgcuacauacuua

SEQ ID NO: 3886036 - RNA, 23 nt, Shigella flexneri 2a str. 301
aucaacgagauaaaauuaacgac

SEQ ID NO: 3886037 - RNA, 22 nt, Shigella flexneri 2a str. 301
aucaacgcaccgacaaauuuca

SEQ ID NO: 3886038 - RNA, 17 nt, Shigella flexneri 2a str. 301
aucaacgccaucgccag

SEQ ID NO: 3886039 - RNA, 14 nt, Shigella flexneri 2a str. 301
aucaacgcuggcau

SEQ ID NO: 3886040 - RNA, 15 nt, Shigella flexneri 2a str. 301
aucaacgcuggcaug

SEQ ID NO: 3886041 - RNA, 19 nt, Shigella flexneri 2a str. 301
aucaacgcuggcaugcucu

SEQ ID NO: 3886042 - RNA, 15 nt, Shigella flexneri 2a str. 301
aucaacggcaacaau

SEQ ID NO: 3886043 - RNA, 20 nt, Shigella flexneri 2a str. 301
aucaacggccugaccaugcu

SEQ ID NO: 3886044 - RNA, 22 nt, Shigella flexneri 2a str. 301
aucaacguaguaucguaaucag

SEQ ID NO: 3886045 - RNA, 22 nt, Shigella flexneri 2a str. 301
aucaacguuauucgcuuccuca

SEQ ID NO: 3886046 - RNA, 14 nt, Shigella flexneri 2a str. 301
aucaacuaaauauc

SEQ ID NO: 3886047 - RNA, 14 nt, Shigella flexneri 2a str. 301
aucaacuccgccag

SEQ ID NO: 3886048 - RNA, 18 nt, Shigella flexneri 2a str. 301
aucaacugcguucugucg

SEQ ID NO: 3886049 - RNA, 17 nt, Shigella flexneri 2a str. 301
aucacgcgaccaucgcg

SEQ ID NO: 3886050 - RNA, 18 nt, Shigella flexneri 2a str. 301
aucacgcuauacaaccac

SEQ ID NO: 3886051 - RNA, 14 nt, Shigella flexneri 2a str. 301
aucacgcugcugau

SEQ ID NO: 3886052 - RNA, 19 nt, Shigella flexneri 2a str. 301
aucacgucggcguuuucug

SEQ ID NO: 3886053 - RNA, 14 nt, Shigella flexneri 2a str. 301
aucacguugauauu

SEQ ID NO: 3886054 - RNA, 17 nt, Shigella flexneri 2a str. 301
aucacuaccuucuuccc

SEQ ID NO: 3886055 - RNA, 15 nt, Shigella flexneri 2a str. 301
aucacuaugaaaaua

SEQ ID NO: 3886056 - RNA, 13 nt, Shigella flexneri 2a str. 301
aucacucacccgc

SEQ ID NO: 3886057 - RNA, 17 nt, Shigella flexneri 2a str. 301
aucacuccauccagcaa

SEQ ID NO: 3886058 - RNA, 22 nt, Shigella flexneri 2a str. 301
aucacucccuuucugccacgcc

SEQ ID NO: 3886059 - RNA, 14 nt, Shigella flexneri 2a str. 301
aucacucggggcuu

SEQ ID NO: 3886060 - RNA, 14 nt, Shigella flexneri 2a str. 301
aucacucugccgua

SEQ ID NO: 3886061 - RNA, 13 nt, Shigella flexneri 2a str. 301
aucacugacugcg

SEQ ID NO: 3886062 - RNA, 18 nt, Shigella flexneri 2a str. 301
aucacugacugcgggcga

SEQ ID NO: 3886063 - RNA, 23 nt, Shigella flexneri 2a str. 301
aucacugccagaauagccgcagc

SEQ ID NO: 3886064 - RNA, 21 nt, Shigella flexneri 2a str. 301
aucacuguuugacaacucauc

SEQ ID NO: 3886065 - RNA, 13 nt, Shigella flexneri 2a str. 301
aucacuuaaccca

SEQ ID NO: 3886066 - RNA, 19 nt, Shigella flexneri 2a str. 301
aucacuuccagcaguucgc

SEQ ID NO: 3886067 - RNA, 18 nt, Shigella flexneri 2a str. 301
aucacuuugcgcucgcug

SEQ ID NO: 3886068 - RNA, 18 nt, Shigella flexneri 2a str. 301
aucagaaacacacuuucc

SEQ ID NO: 3886069 - RNA, 13 nt, Shigella flexneri 2a str. 301
aucagaaccgccc

SEQ ID NO: 3886070 - RNA, 14 nt, Shigella flexneri 2a str. 301
aucagaacguaaac

SEQ ID NO: 3886071 - RNA, 12 nt, Shigella flexneri 2a str. 301
aucagaauccgg

SEQ ID NO: 3886072 - RNA, 17 nt, Shigella flexneri 2a str. 301
aucagaauccggugccu

SEQ ID NO: 3886073 - RNA, 17 nt, Shigella flexneri 2a str. 301
aucagaauugcgagccu

SEQ ID NO: 3886074 - RNA, 13 nt, Shigella flexneri 2a str. 301
aucagaauuuuuc

SEQ ID NO: 3886075 - RNA, 14 nt, Shigella flexneri 2a str. 301
aucagaauuuuucg

SEQ ID NO: 3886076 - RNA, 20 nt, Shigella flexneri 2a str. 301
aucagacaaaugucacugcu

SEQ ID NO: 3886077 - RNA, 21 nt, Shigella flexneri 2a str. 301
aucagacaccgauugccccug

SEQ ID NO: 3886078 - RNA, 21 nt, Shigella flexneri 2a str. 301
aucagaccuacaaaaccugca

SEQ ID NO: 3886079 - RNA, 11 nt, Shigella flexneri 2a str. 301
aucagagauuc

SEQ ID NO: 3886080 - RNA, 23 nt, Shigella flexneri 2a str. 301
aucagagcuggaaguuacucaaa

SEQ ID NO: 3886081 - RNA, 13 nt, Shigella flexneri 2a str. 301
aucagauaaaaua

SEQ ID NO: 3886082 - RNA, 15 nt, Shigella flexneri 2a str. 301
aucagauaaaauaca

SEQ ID NO: 3886083 - RNA, 23 nt, Shigella flexneri 2a str. 301
aucagauaauauuuaucuuccca

SEQ ID NO: 3886084 - RNA, 17 nt, Shigella flexneri 2a str. 301
aucagaucgacgccgau

SEQ ID NO: 3886085 - RNA, 23 nt, Shigella flexneri 2a str. 301
aucagaucguugaacccggcauc

SEQ ID NO: 3886086 - RNA, 17 nt, Shigella flexneri 2a str. 301
aucagauugccacagga

SEQ ID NO: 3886087 - RNA, 16 nt, Shigella flexneri 2a str. 301
aucagcaaacuauccc

SEQ ID NO: 3886088 - RNA, 19 nt, Shigella flexneri 2a str. 301
aucagcaaacuaucccagc

SEQ ID NO: 3886089 - RNA, 20 nt, Shigella flexneri 2a str. 301
aucagcaaacuaucccagcc

SEQ ID NO: 3886090 - RNA, 13 nt, Shigella flexneri 2a str. 301
aucagcaaaucca

SEQ ID NO: 3886091 - RNA, 17 nt, Shigella flexneri 2a str. 301
aucagcaacacgcugcu

SEQ ID NO: 3886092 - RNA, 18 nt, Shigella flexneri 2a str. 301
aucagcaacucuggugga

SEQ ID NO: 3886093 - RNA, 19 nt, Shigella flexneri 2a str. 301
aucagcacauaagucagcc

SEQ ID NO: 3886094 - RNA, 21 nt, Shigella flexneri 2a str. 301
aucagcagaaucgcaaccagc

SEQ ID NO: 3886095 - RNA, 15 nt, Shigella flexneri 2a str. 301
aucagcagcaacaaa

SEQ ID NO: 3886096 - RNA, 16 nt, Shigella flexneri 2a str. 301
aucagcagcggagaaa

SEQ ID NO: 3886097 - RNA, 13 nt, Shigella flexneri 2a str. 301
aucagcaguucag

SEQ ID NO: 3886098 - RNA, 16 nt, Shigella flexneri 2a str. 301
aucagcauaaucacca

SEQ ID NO: 3886099 - RNA, 17 nt, Shigella flexneri 2a str. 301
aucagcaucucauccau

SEQ ID NO: 3886100 - RNA, 19 nt, Shigella flexneri 2a str. 301
aucagcaucucauccauca

SEQ ID NO: 3886101 - RNA, 19 nt, Shigella flexneri 2a str. 301
aucagcaugacaaaaaagc

SEQ ID NO: 3886102 - RNA, 15 nt, Shigella flexneri 2a str. 301
aucagcauucucauc

SEQ ID NO: 3886103 - RNA, 19 nt, Shigella flexneri 2a str. 301
aucagcauucucaucacca

SEQ ID NO: 3886104 - RNA, 13 nt, Shigella flexneri 2a str. 301
aucagcccagccc

SEQ ID NO: 3886105 - RNA, 16 nt, Shigella flexneri 2a str. 301
aucagcccagcccuga

SEQ ID NO: 3886106 - RNA, 14 nt, Shigella flexneri 2a str. 301
aucagcgcaaagag

SEQ ID NO: 3886107 - RNA, 15 nt, Shigella flexneri 2a str. 301
aucagcgcagcaccc

SEQ ID NO: 3886108 - RNA, 19 nt, Shigella flexneri 2a str. 301
aucagcgcagcacccagaa

SEQ ID NO: 3886109 - RNA, 15 nt, Shigella flexneri 2a str. 301
aucagcgccaccaca

SEQ ID NO: 3886110 - RNA, 15 nt, Shigella flexneri 2a str. 301
aucagcgccagcgcg

SEQ ID NO: 3886111 - RNA, 16 nt, Shigella flexneri 2a str. 301
aucagcguaacggguc

SEQ ID NO: 3886112 - RNA, 19 nt, Shigella flexneri 2a str. 301
aucagcgugaccaguugcu

SEQ ID NO: 3886113 - RNA, 20 nt, Shigella flexneri 2a str. 301
aucagcguggcaucgggcac

SEQ ID NO: 3886114 - RNA, 14 nt, Shigella flexneri 2a str. 301
aucagcguuaucag

SEQ ID NO: 3886115 - RNA, 14 nt, Shigella flexneri 2a str. 301
aucagcuccggcag

SEQ ID NO: 3886116 - RNA, 19 nt, Shigella flexneri 2a str. 301
aucagcugugggcuaacac

SEQ ID NO: 3886117 - RNA, 12 nt, Shigella flexneri 2a str. 301
aucagcuucacc

SEQ ID NO: 3886118 - RNA, 23 nt, Shigella flexneri 2a str. 301
aucagcuuuuccauaucaagcau

SEQ ID NO: 3886119 - RNA, 18 nt, Shigella flexneri 2a str. 301
aucaggcaauauuuaaau

SEQ ID NO: 3886120 - RNA, 21 nt, Shigella flexneri 2a str. 301
aucaggcaaugcuuccugcuu

SEQ ID NO: 3886121 - RNA, 20 nt, Shigella flexneri 2a str. 301
aucaggcaauguugcguuug

SEQ ID NO: 3886122 - RNA, 15 nt, Shigella flexneri 2a str. 301
aucaggcaauuuuac

SEQ ID NO: 3886123 - RNA, 22 nt, Shigella flexneri 2a str. 301
aucaggcagauacaaccaaucg

SEQ ID NO: 3886124 - RNA, 18 nt, Shigella flexneri 2a str. 301
aucaggcaggucuuucac

SEQ ID NO: 3886125 - RNA, 16 nt, Shigella flexneri 2a str. 301
aucaggcaucgugcac

SEQ ID NO: 3886126 - RNA, 15 nt, Shigella flexneri 2a str. 301
aucaggcauucuuuu

SEQ ID NO: 3886127 - RNA, 18 nt, Shigella flexneri 2a str. 301
aucaggccaaacagacca

SEQ ID NO: 3886128 - RNA, 14 nt, Shigella flexneri 2a str. 301
aucaggccagccag

SEQ ID NO: 3886129 - RNA, 13 nt, Shigella flexneri 2a str. 301
aucaggccuacaa

SEQ ID NO: 3886130 - RNA, 19 nt, Shigella flexneri 2a str. 301
aucaggccuacauuuucuc

SEQ ID NO: 3886131 - RNA, 14 nt, Shigella flexneri 2a str. 301
aucaggcuaucuuc

SEQ ID NO: 3886132 - RNA, 21 nt, Shigella flexneri 2a str. 301
aucaggcugaaaaucuucucu

SEQ ID NO: 3886133 - RNA, 17 nt, Shigella flexneri 2a str. 301
aucaggcuuauuuggca

SEQ ID NO: 3886134 - RNA, 18 nt, Shigella flexneri 2a str. 301
aucaggcuucuguaccug

SEQ ID NO: 3886135 - RNA, 17 nt, Shigella flexneri 2a str. 301
aucaggguuaaaauacc

SEQ ID NO: 3886136 - RNA, 14 nt, Shigella flexneri 2a str. 301
aucagguaagcaaa

SEQ ID NO: 3886137 - RNA, 20 nt, Shigella flexneri 2a str. 301
aucagguaagcgauaaaaau

SEQ ID NO: 3886138 - RNA, 15 nt, Shigella flexneri 2a str. 301
aucagguauaccgaa

SEQ ID NO: 3886139 - RNA, 22 nt, Shigella flexneri 2a str. 301
aucagguugaugcgaguaauca

SEQ ID NO: 3886140 - RNA, 14 nt, Shigella flexneri 2a str. 301
aucagucucaaacc

SEQ ID NO: 3886141 - RNA, 20 nt, Shigella flexneri 2a str. 301
aucagucugagccugccauu

SEQ ID NO: 3886142 - RNA, 23 nt, Shigella flexneri 2a str. 301
aucaguguacuuaucuuuuacaa

SEQ ID NO: 3886143 - RNA, 16 nt, Shigella flexneri 2a str. 301
aucaguucaccacuuu

SEQ ID NO: 3886144 - RNA, 14 nt, Shigella flexneri 2a str. 301
aucaguuccagcag

SEQ ID NO: 3886145 - RNA, 18 nt, Shigella flexneri 2a str. 301
aucaguuguucagaaugc

SEQ ID NO: 3886146 - RNA, 13 nt, Shigella flexneri 2a str. 301
aucauaaaaauua

SEQ ID NO: 3886147 - RNA, 14 nt, Shigella flexneri 2a str. 301
aucauaacccuuuc

SEQ ID NO: 3886148 - RNA, 21 nt, Shigella flexneri 2a str. 301
aucauaauaaagaugccauug

SEQ ID NO: 3886149 - RNA, 14 nt, Shigella flexneri 2a str. 301
auccagcaacaaca

SEQ ID NO: 3886150 - RNA, 16 nt, Shigella flexneri 2a str. 301
auccagcaccuuuugc

SEQ ID NO: 3886151 - RNA, 23 nt, Shigella flexneri 2a str. 301
auccagcacggugaagaagcgga

SEQ ID NO: 3886152 - RNA, 14 nt, Shigella flexneri 2a str. 301
auccagcagcaaug

SEQ ID NO: 3886153 - RNA, 22 nt, Shigella flexneri 2a str. 301
auccagcagcggaucgaacucc

SEQ ID NO: 3886154 - RNA, 15 nt, Shigella flexneri 2a str. 301
auccagcauaccuuc

SEQ ID NO: 3886155 - RNA, 11 nt, Shigella flexneri 2a str. 301
auccagccaaa

SEQ ID NO: 3886156 - RNA, 14 nt, Shigella flexneri 2a str. 301
auccagccagucuu

SEQ ID NO: 3886157 - RNA, 23 nt, Shigella flexneri 2a str. 301
auccagcccugccaggucaucau

SEQ ID NO: 3886158 - RNA, 18 nt, Shigella flexneri 2a str. 301
auccagccggcaaagugg

SEQ ID NO: 3886159 - RNA, 17 nt, Shigella flexneri 2a str. 301
auccagccuacaaauuu

SEQ ID NO: 3886160 - RNA, 20 nt, Shigella flexneri 2a str. 301
auccagcgacugacgugccu

SEQ ID NO: 3886161 - RNA, 21 nt, Shigella flexneri 2a str. 301
auccagcgcggcgaaggugcc

SEQ ID NO: 3886162 - RNA, 21 nt, Shigella flexneri 2a str. 301
auccagcgcguaaauaccuuc

SEQ ID NO: 3886163 - RNA, 13 nt, Shigella flexneri 2a str. 301
auccagcucaucc

SEQ ID NO: 3886164 - RNA, 18 nt, Shigella flexneri 2a str. 301
auccagcucuucuucacu

SEQ ID NO: 3886165 - RNA, 15 nt, Shigella flexneri 2a str. 301
auccaggaacagaag

SEQ ID NO: 3886166 - RNA, 13 nt, Shigella flexneri 2a str. 301
auccaggaacucc

SEQ ID NO: 3886167 - RNA, 14 nt, Shigella flexneri 2a str. 301
auccaggaacucca

SEQ ID NO: 3886168 - RNA, 17 nt, Shigella flexneri 2a str. 301
auccaggaacuccagau

SEQ ID NO: 3886169 - RNA, 20 nt, Shigella flexneri 2a str. 301
auccaggaacuccagaucca

SEQ ID NO: 3886170 - RNA, 14 nt, Shigella flexneri 2a str. 301
auccaggagcucca

SEQ ID NO: 3886171 - RNA, 16 nt, Shigella flexneri 2a str. 301
auccaggagcuccagg

SEQ ID NO: 3886172 - RNA, 20 nt, Shigella flexneri 2a str. 301
auccaggagcuccagguccu

SEQ ID NO: 3886173 - RNA, 21 nt, Shigella flexneri 2a str. 301
auccaggguuuuauuauucca

SEQ ID NO: 3886174 - RNA, 18 nt, Shigella flexneri 2a str. 301
auccagguuacgcaccag

SEQ ID NO: 3886175 - RNA, 16 nt, Shigella flexneri 2a str. 301
auccagguuucuucca

SEQ ID NO: 3886176 - RNA, 17 nt, Shigella flexneri 2a str. 301
auccaguacgccuucac

SEQ ID NO: 3886177 - RNA, 13 nt, Shigella flexneri 2a str. 301
auccagucccccc

SEQ ID NO: 3886178 - RNA, 16 nt, Shigella flexneri 2a str. 301
auccagugaaacgcuu

SEQ ID NO: 3886179 - RNA, 16 nt, Shigella flexneri 2a str. 301
auccagugauuccagu

SEQ ID NO: 3886180 - RNA, 20 nt, Shigella flexneri 2a str. 301
auccagugcguaucaauagc

SEQ ID NO: 3886181 - RNA, 17 nt, Shigella flexneri 2a str. 301
auccagugcuucaauau

SEQ ID NO: 3886182 - RNA, 17 nt, Shigella flexneri 2a str. 301
auccaguguaaaacagc

SEQ ID NO: 3886183 - RNA, 13 nt, Shigella flexneri 2a str. 301
auccaguuuaauc

SEQ ID NO: 3886184 - RNA, 13 nt, Shigella flexneri 2a str. 301
auccaguuucugc

SEQ ID NO: 3886185 - RNA, 15 nt, Shigella flexneri 2a str. 301
auccauaagauugca

SEQ ID NO: 3886186 - RNA, 22 nt, Shigella flexneri 2a str. 301
auccauacggcagagaucgccg

SEQ ID NO: 3886187 - RNA, 22 nt, Shigella flexneri 2a str. 301
auccauaguguguuccucugcu

SEQ ID NO: 3886188 - RNA, 18 nt, Shigella flexneri 2a str. 301
auccauaucgauuucuac

SEQ ID NO: 3886189 - RNA, 19 nt, Shigella flexneri 2a str. 301
auccauaucgauuucuaca

SEQ ID NO: 3886190 - RNA, 23 nt, Shigella flexneri 2a str. 301
auccauauuuucagcagugggua

SEQ ID NO: 3886191 - RNA, 19 nt, Shigella flexneri 2a str. 301
auccaucagacuuugcgcc

SEQ ID NO: 3886192 - RNA, 16 nt, Shigella flexneri 2a str. 301
auccaucgccagcuca

SEQ ID NO: 3886193 - RNA, 23 nt, Shigella flexneri 2a str. 301
auccaugauauuggcaucgccag

SEQ ID NO: 3886194 - RNA, 19 nt, Shigella flexneri 2a str. 301
auccaugccgaguggcauu

SEQ ID NO: 3886195 - RNA, 20 nt, Shigella flexneri 2a str. 301
auccaugcgcauuaagccau

SEQ ID NO: 3886196 - RNA, 22 nt, Shigella flexneri 2a str. 301
auccauuccggccaucgccuga

SEQ ID NO: 3886197 - RNA, 20 nt, Shigella flexneri 2a str. 301
auccauucggcgauuaacaa

SEQ ID NO: 3886198 - RNA, 15 nt, Shigella flexneri 2a str. 301
aucccaaccauuuca

SEQ ID NO: 3886199 - RNA, 22 nt, Shigella flexneri 2a str. 301
aucccaaccgcgacaguaucau

SEQ ID NO: 3886200 - RNA, 17 nt, Shigella flexneri 2a str. 301
aucccaauacccgcaac

SEQ ID NO: 3886201 - RNA, 22 nt, Shigella flexneri 2a str. 301
aucccacagccgucgagggcaa

SEQ ID NO: 3886202 - RNA, 16 nt, Shigella flexneri 2a str. 301
aucccaccaccagcaa

SEQ ID NO: 3886203 - RNA, 21 nt, Shigella flexneri 2a str. 301
aucccagaagguuucgccgcu

SEQ ID NO: 3886204 - RNA, 19 nt, Shigella flexneri 2a str. 301
aucccagaucgcuuuccca

SEQ ID NO: 3886205 - RNA, 11 nt, Shigella flexneri 2a str. 301
aucccagcagu

SEQ ID NO: 3886206 - RNA, 13 nt, Shigella flexneri 2a str. 301
aucccagcccagc

SEQ ID NO: 3886207 - RNA, 21 nt, Shigella flexneri 2a str. 301
aucccagcugccgccaggcuu

SEQ ID NO: 3886208 - RNA, 16 nt, Shigella flexneri 2a str. 301
aucccagucuucauca

SEQ ID NO: 3886209 - RNA, 18 nt, Shigella flexneri 2a str. 301
aucccagucuucaucauc

SEQ ID NO: 3886210 - RNA, 16 nt, Shigella flexneri 2a str. 301
aucccagugccugcau

SEQ ID NO: 3886211 - RNA, 14 nt, Shigella flexneri 2a str. 301
aucccagugcggca

SEQ ID NO: 3886212 - RNA, 16 nt, Shigella flexneri 2a str. 301
aucccagugcggcauc

SEQ ID NO: 3886213 - RNA, 19 nt, Shigella flexneri 2a str. 301
aucccagugcggcaucgcu

SEQ ID NO: 3886214 - RNA, 19 nt, Shigella flexneri 2a str. 301
aucccaguucgauuuccca

SEQ ID NO: 3886215 - RNA, 16 nt, Shigella flexneri 2a str. 301
aucccaguuuucgcca

SEQ ID NO: 3886216 - RNA, 12 nt, Shigella flexneri 2a str. 301
aucccauccgcg

SEQ ID NO: 3886217 - RNA, 21 nt, Shigella flexneri 2a str. 301
aucccauuacguccagcgauu

SEQ ID NO: 3886218 - RNA, 19 nt, Shigella flexneri 2a str. 301
auccccaccaaaacagcga

SEQ ID NO: 3886219 - RNA, 20 nt, Shigella flexneri 2a str. 301
auccccaccaaaacagcgac

SEQ ID NO: 3886220 - RNA, 12 nt, Shigella flexneri 2a str. 301
aucccccacuuu

SEQ ID NO: 3886221 - RNA, 17 nt, Shigella flexneri 2a str. 301
aucccccacuuuuaaau

SEQ ID NO: 3886222 - RNA, 13 nt, Shigella flexneri 2a str. 301
aucccccagcacu

SEQ ID NO: 3886223 - RNA, 15 nt, Shigella flexneri 2a str. 301
auccccgccagcacg

SEQ ID NO: 3886224 - RNA, 17 nt, Shigella flexneri 2a str. 301
auccccucuucagccgc

SEQ ID NO: 3886225 - RNA, 15 nt, Shigella flexneri 2a str. 301
aucccgccaacagga

SEQ ID NO: 3886226 - RNA, 14 nt, Shigella flexneri 2a str. 301
aucccgccagcacc

SEQ ID NO: 3886227 - RNA, 16 nt, Shigella flexneri 2a str. 301
aucccgccagcaccag

SEQ ID NO: 3886228 - RNA, 15 nt, Shigella flexneri 2a str. 301
aucccgcgauaugcc

SEQ ID NO: 3886229 - RNA, 18 nt, Shigella flexneri 2a str. 301
aucccgcgcguuuuucuu

SEQ ID NO: 3886230 - RNA, 21 nt, Shigella flexneri 2a str. 301
aucccgcuaaguugaaucggc

SEQ ID NO: 3886231 - RNA, 20 nt, Shigella flexneri 2a str. 301
aucccgcucuguaagacauu

SEQ ID NO: 3886232 - RNA, 17 nt, Shigella flexneri 2a str. 301
aucccggauaucaccac

SEQ ID NO: 3886233 - RNA, 20 nt, Shigella flexneri 2a str. 301
aucccggcuccaaugacuau

SEQ ID NO: 3886234 - RNA, 19 nt, Shigella flexneri 2a str. 301
aucccgguuauuaaaacga

SEQ ID NO: 3886235 - RNA, 20 nt, Shigella flexneri 2a str. 301
aucccguuacgauucucugc

SEQ ID NO: 3886236 - RNA, 17 nt, Shigella flexneri 2a str. 301
aucccucuuugucuuuu

SEQ ID NO: 3886237 - RNA, 20 nt, Shigella flexneri 2a str. 301
aucccugcggaaaaaagaaa

SEQ ID NO: 3886238 - RNA, 15 nt, Shigella flexneri 2a str. 301
aucccugcuguccug

SEQ ID NO: 3886239 - RNA, 14 nt, Shigella flexneri 2a str. 301
aucccuuagcuaau

SEQ ID NO: 3886240 - RNA, 10 nt, Shigella flexneri 2a str. 301
aucccuucgu

SEQ ID NO: 3886241 - RNA, 13 nt, Shigella flexneri 2a str. 301
aucccuucuccac

SEQ ID NO: 3886242 - RNA, 19 nt, Shigella flexneri 2a str. 301
aucccuuucgcuucaagua

SEQ ID NO: 3886243 - RNA, 19 nt, Shigella flexneri 2a str. 301
auccgaccuacaaaaccug

SEQ ID NO: 3886244 - RNA, 21 nt, Shigella flexneri 2a str. 301
auccgaccuacaaaaccugca

SEQ ID NO: 3886245 - RNA, 12 nt, Shigella flexneri 2a str. 301
auccgagaaucg

SEQ ID NO: 3886246 - RNA, 19 nt, Shigella flexneri 2a str. 301
auccgcaauuucuggccau

SEQ ID NO: 3886247 - RNA, 16 nt, Shigella flexneri 2a str. 301
auccgcagucccuuuc

SEQ ID NO: 3886248 - RNA, 14 nt, Shigella flexneri 2a str. 301
auccgccacuucuu

SEQ ID NO: 3886249 - RNA, 14 nt, Shigella flexneri 2a str. 301
aucgcaauccuuuc

SEQ ID NO: 3886250 - RNA, 14 nt, Shigella flexneri 2a str. 301
aucgcacagaugcg

SEQ ID NO: 3886251 - RNA, 16 nt, Shigella flexneri 2a str. 301
aucgcacagaugcgac

SEQ ID NO: 3886252 - RNA, 18 nt, Shigella flexneri 2a str. 301
aucgcacuuaaucgcccu

SEQ ID NO: 3886253 - RNA, 14 nt, Shigella flexneri 2a str. 301
aucgcagaaaaaac

SEQ ID NO: 3886254 - RNA, 17 nt, Shigella flexneri 2a str. 301
aucgcaggccaguugcg

SEQ ID NO: 3886255 - RNA, 20 nt, Shigella flexneri 2a str. 301
aucgcaggccaguugcgccg

SEQ ID NO: 3886256 - RNA, 16 nt, Shigella flexneri 2a str. 301
aucgcaguagcgggcg

SEQ ID NO: 3886257 - RNA, 13 nt, Shigella flexneri 2a str. 301
aucgcauaaaaca

SEQ ID NO: 3886258 - RNA, 15 nt, Shigella flexneri 2a str. 301
aucgcaucaggcaau

SEQ ID NO: 3886259 - RNA, 23 nt, Shigella flexneri 2a str. 301
aucgcaucgaugguugcccugcu

SEQ ID NO: 3886260 - RNA, 17 nt, Shigella flexneri 2a str. 301
aucgcauugacgccaaa

SEQ ID NO: 3886261 - RNA, 13 nt, Shigella flexneri 2a str. 301
aucgccaaauuug

SEQ ID NO: 3886262 - RNA, 18 nt, Shigella flexneri 2a str. 301
aucgccaacaaucucuuc

SEQ ID NO: 3886263 - RNA, 18 nt, Shigella flexneri 2a str. 301
aucgccaauaucaaucuu

SEQ ID NO: 3886264 - RNA, 14 nt, Shigella flexneri 2a str. 301
aucgccaccacccu

SEQ ID NO: 3886265 - RNA, 22 nt, Shigella flexneri 2a str. 301
aucgccaccguuauccugauaa

SEQ ID NO: 3886266 - RNA, 21 nt, Shigella flexneri 2a str. 301
aucgccacggcaugaaagcga

SEQ ID NO: 3886267 - RNA, 20 nt, Shigella flexneri 2a str. 301
aucgccagcaaaaucaccau

SEQ ID NO: 3886268 - RNA, 23 nt, Shigella flexneri 2a str. 301
aucgccagcaaaaucaccaucac

SEQ ID NO: 3886269 - RNA, 15 nt, Shigella flexneri 2a str. 301
aucgccagcucaaac

SEQ ID NO: 3886270 - RNA, 14 nt, Shigella flexneri 2a str. 301
aucgccagcucaag

SEQ ID NO: 3886271 - RNA, 13 nt, Shigella flexneri 2a str. 301
aucgccaggaaca

SEQ ID NO: 3886272 - RNA, 20 nt, Shigella flexneri 2a str. 301
aucgccaggaacaacgacaa

SEQ ID NO: 3886273 - RNA, 18 nt, Shigella flexneri 2a str. 301
aucgccaguaguaaccac

SEQ ID NO: 3886274 - RNA, 13 nt, Shigella flexneri 2a str. 301
aucgccagugccg

SEQ ID NO: 3886275 - RNA, 16 nt, Shigella flexneri 2a str. 301
aucgccaucaggcaga

SEQ ID NO: 3886276 - RNA, 14 nt, Shigella flexneri 2a str. 301
aucgccaugaacgc

SEQ ID NO: 3886277 - RNA, 17 nt, Shigella flexneri 2a str. 301
aucgccauugccgguga

SEQ ID NO: 3886278 - RNA, 18 nt, Shigella flexneri 2a str. 301
aucgccauuuaacgcauc

SEQ ID NO: 3886279 - RNA, 21 nt, Shigella flexneri 2a str. 301
aucgcccccgucaccggcaca

SEQ ID NO: 3886280 - RNA, 12 nt, Shigella flexneri 2a str. 301
aucgcccgcuuc

SEQ ID NO: 3886281 - RNA, 18 nt, Shigella flexneri 2a str. 301
aucgcccugauggcgcgc

SEQ ID NO: 3886282 - RNA, 16 nt, Shigella flexneri 2a str. 301
aucgcccugcuccagc

SEQ ID NO: 3886283 - RNA, 18 nt, Shigella flexneri 2a str. 301
aucgcccuggauuucaau

SEQ ID NO: 3886284 - RNA, 23 nt, Shigella flexneri 2a str. 301
aucgccgcguagagaaaaccaau

SEQ ID NO: 3886285 - RNA, 17 nt, Shigella flexneri 2a str. 301
aucgccgcuggaaauga

SEQ ID NO: 3886286 - RNA, 14 nt, Shigella flexneri 2a str. 301
aucgccgcuggcca

SEQ ID NO: 3886287 - RNA, 19 nt, Shigella flexneri 2a str. 301
aucgccucgccgaaacgcu

SEQ ID NO: 3886288 - RNA, 15 nt, Shigella flexneri 2a str. 301
aucgccugguaccag

SEQ ID NO: 3886289 - RNA, 19 nt, Shigella flexneri 2a str. 301
aucgccugguaccagcacc

SEQ ID NO: 3886290 - RNA, 14 nt, Shigella flexneri 2a str. 301
aucgccuggugacc

SEQ ID NO: 3886291 - RNA, 18 nt, Shigella flexneri 2a str. 301
aucgccuuaauaacccac

SEQ ID NO: 3886292 - RNA, 21 nt, Shigella flexneri 2a str. 301
aucgccuucgcaaaaaaccau

SEQ ID NO: 3886293 - RNA, 16 nt, Shigella flexneri 2a str. 301
aucgccuuucagguca

SEQ ID NO: 3886294 - RNA, 12 nt, Shigella flexneri 2a str. 301
aucgcgaccaau

SEQ ID NO: 3886295 - RNA, 15 nt, Shigella flexneri 2a str. 301
aucgcgaccaaucac

SEQ ID NO: 3886296 - RNA, 20 nt, Shigella flexneri 2a str. 301
aucgcgacguucagauuuug

SEQ ID NO: 3886297 - RNA, 24 nt, Shigella flexneri 2a str. 301
aucgcgaugauuuucgcugcgcua

SEQ ID NO: 3886298 - RNA, 14 nt, Shigella flexneri 2a str. 301
aucgcgccagccag

SEQ ID NO: 3886299 - RNA, 18 nt, Shigella flexneri 2a str. 301
aucgcgccaucaaaucug

SEQ ID NO: 3886300 - RNA, 22 nt, Shigella flexneri 2a str. 301
aucgcgcccaaaccacccagca

SEQ ID NO: 3886301 - RNA, 21 nt, Shigella flexneri 2a str. 301
aucgcgcuuaucgccagcgcc

SEQ ID NO: 3886302 - RNA, 20 nt, Shigella flexneri 2a str. 301
aucgcggaucagcuuaucca

SEQ ID NO: 3886303 - RNA, 21 nt, Shigella flexneri 2a str. 301
aucgcggcgauauccagcgcg

SEQ ID NO: 3886304 - RNA, 17 nt, Shigella flexneri 2a str. 301
aucgcggggaguucuga

SEQ ID NO: 3886305 - RNA, 13 nt, Shigella flexneri 2a str. 301
aucgcguaaggcu

SEQ ID NO: 3886306 - RNA, 18 nt, Shigella flexneri 2a str. 301
aucgcguacucaccgcuc

SEQ ID NO: 3886307 - RNA, 15 nt, Shigella flexneri 2a str. 301
aucgcgugcggcauc

SEQ ID NO: 3886308 - RNA, 14 nt, Shigella flexneri 2a str. 301
aucgcguugucaua

SEQ ID NO: 3886309 - RNA, 15 nt, Shigella flexneri 2a str. 301
aucgcguuguuuagc

SEQ ID NO: 3886310 - RNA, 14 nt, Shigella flexneri 2a str. 301
aucgcuaaaauacu

SEQ ID NO: 3886311 - RNA, 14 nt, Shigella flexneri 2a str. 301
aucgcucagcgcau

SEQ ID NO: 3886312 - RNA, 17 nt, Shigella flexneri 2a str. 301
aucgcucagcgcauccu

SEQ ID NO: 3886313 - RNA, 15 nt, Shigella flexneri 2a str. 301
aucgcugaaagaugg

SEQ ID NO: 3886314 - RNA, 15 nt, Shigella flexneri 2a str. 301
aucgcugaacgcacc

SEQ ID NO: 3886315 - RNA, 18 nt, Shigella flexneri 2a str. 301
aucgcugaacgcaccuuc

SEQ ID NO: 3886316 - RNA, 13 nt, Shigella flexneri 2a str. 301
aucgcugauauac

SEQ ID NO: 3886317 - RNA, 23 nt, Shigella flexneri 2a str. 301
aucgcugccgcgcaggaugcaga

SEQ ID NO: 3886318 - RNA, 15 nt, Shigella flexneri 2a str. 301
aucgcugcuaauuua

SEQ ID NO: 3886319 - RNA, 18 nt, Shigella flexneri 2a str. 301
aucgcuggucacgggcuu

SEQ ID NO: 3886320 - RNA, 20 nt, Shigella flexneri 2a str. 301
aucgcuguccgcuucaccac

SEQ ID NO: 3886321 - RNA, 14 nt, Shigella flexneri 2a str. 301
aucgcugugcugcu

SEQ ID NO: 3886322 - RNA, 17 nt, Shigella flexneri 2a str. 301
aucgcuuaacagaacgg

SEQ ID NO: 3886323 - RNA, 22 nt, Shigella flexneri 2a str. 301
aucgcuuacccuaaauccgcca

SEQ ID NO: 3886324 - RNA, 15 nt, Shigella flexneri 2a str. 301
aucgcuucauuuaca

SEQ ID NO: 3886325 - RNA, 22 nt, Shigella flexneri 2a str. 301
aucgcuuucgcuacuucaaaca

SEQ ID NO: 3886326 - RNA, 19 nt, Shigella flexneri 2a str. 301
aucgcuuucgcuuucucuu

SEQ ID NO: 3886327 - RNA, 23 nt, Shigella flexneri 2a str. 301
aucgcuuucggaaagaucgccac

SEQ ID NO: 3886328 - RNA, 18 nt, Shigella flexneri 2a str. 301
aucgcuuucggauuggcg

SEQ ID NO: 3886329 - RNA, 21 nt, Shigella flexneri 2a str. 301
aucgcuuucuucaaccaggcg

SEQ ID NO: 3886330 - RNA, 18 nt, Shigella flexneri 2a str. 301
aucgcuuuuaccagcaua

SEQ ID NO: 3886331 - RNA, 22 nt, Shigella flexneri 2a str. 301
aucggagaacugcaacucaccu

SEQ ID NO: 3886332 - RNA, 15 nt, Shigella flexneri 2a str. 301
aucggauugcuccug

SEQ ID NO: 3886333 - RNA, 16 nt, Shigella flexneri 2a str. 301
aucggcaaaaugggua

SEQ ID NO: 3886334 - RNA, 22 nt, Shigella flexneri 2a str. 301
aucggcaacgguaugaaauuua

SEQ ID NO: 3886335 - RNA, 20 nt, Shigella flexneri 2a str. 301
aucggcaaucacaucaccau

SEQ ID NO: 3886336 - RNA, 18 nt, Shigella flexneri 2a str. 301
aucggcaauuucgcugcc

SEQ ID NO: 3886337 - RNA, 13 nt, Shigella flexneri 2a str. 301
aucggcaccacca

SEQ ID NO: 3886338 - RNA, 23 nt, Shigella flexneri 2a str. 301
aucggcagagugaagguuucugc

SEQ ID NO: 3886339 - RNA, 20 nt, Shigella flexneri 2a str. 301
aucggcagguugcagagcau

SEQ ID NO: 3886340 - RNA, 15 nt, Shigella flexneri 2a str. 301
aucggcaucgcucca

SEQ ID NO: 3886341 - RNA, 18 nt, Shigella flexneri 2a str. 301
aucggcauugcucccugc

SEQ ID NO: 3886342 - RNA, 16 nt, Shigella flexneri 2a str. 301
aucggccagcaccugc

SEQ ID NO: 3886343 - RNA, 22 nt, Shigella flexneri 2a str. 301
aucggccaucucaacuuucuug

SEQ ID NO: 3886344 - RNA, 21 nt, Shigella flexneri 2a str. 301
aucggcgcgccagcgaucuuu

SEQ ID NO: 3886345 - RNA, 15 nt, Shigella flexneri 2a str. 301
aucgggaaauaacau

SEQ ID NO: 3886346 - RNA, 21 nt, Shigella flexneri 2a str. 301
aucgggaacgcuuuugcaucg

SEQ ID NO: 3886347 - RNA, 15 nt, Shigella flexneri 2a str. 301
aucgggaccagcauu

SEQ ID NO: 3886348 - RNA, 18 nt, Shigella flexneri 2a str. 301
aucgggaccagcauucca

SEQ ID NO: 3886349 - RNA, 14 nt, Shigella flexneri 2a str. 301
aucucuaaggcaug

SEQ ID NO: 3886350 - RNA, 15 nt, Shigella flexneri 2a str. 301
aucucuaaggcauga

SEQ ID NO: 3886351 - RNA, 23 nt, Shigella flexneri 2a str. 301
aucucuacagcgcccgccagcac

SEQ ID NO: 3886352 - RNA, 12 nt, Shigella flexneri 2a str. 301
aucucuccuuuc

SEQ ID NO: 3886353 - RNA, 21 nt, Shigella flexneri 2a str. 301
aucucucuugcuaucacccac

SEQ ID NO: 3886354 - RNA, 23 nt, Shigella flexneri 2a str. 301
aucucugacgcgcauacucuccu

SEQ ID NO: 3886355 - RNA, 19 nt, Shigella flexneri 2a str. 301
aucucugcaacgucuuccc

SEQ ID NO: 3886356 - RNA, 20 nt, Shigella flexneri 2a str. 301
aucucugcaacgucuucccg

SEQ ID NO: 3886357 - RNA, 22 nt, Shigella flexneri 2a str. 301
aucucugcgcuauccagcgcau

SEQ ID NO: 3886358 - RNA, 21 nt, Shigella flexneri 2a str. 301
aucucugguuuguuuucagau

SEQ ID NO: 3886359 - RNA, 20 nt, Shigella flexneri 2a str. 301
aucucuguuuugcauggggu

SEQ ID NO: 3886360 - RNA, 21 nt, Shigella flexneri 2a str. 301
aucucuuaucauccaggugaa

SEQ ID NO: 3886361 - RNA, 13 nt, Shigella flexneri 2a str. 301
aucucuucaccau

SEQ ID NO: 3886362 - RNA, 13 nt, Shigella flexneri 2a str. 301
aucucuuccagaa

SEQ ID NO: 3886363 - RNA, 17 nt, Shigella flexneri 2a str. 301
aucucuuccagcgauaa

SEQ ID NO: 3886364 - RNA, 22 nt, Shigella flexneri 2a str. 301
aucucuuccagugccucaagaa

SEQ ID NO: 3886365 - RNA, 13 nt, Shigella flexneri 2a str. 301
aucucuucgccug

SEQ ID NO: 3886366 - RNA, 23 nt, Shigella flexneri 2a str. 301
aucucuucgccugccugcagcug

SEQ ID NO: 3886367 - RNA, 15 nt, Shigella flexneri 2a str. 301
aucucuucggcacug

SEQ ID NO: 3886368 - RNA, 18 nt, Shigella flexneri 2a str. 301
aucucuucguuuucaacg

SEQ ID NO: 3886369 - RNA, 21 nt, Shigella flexneri 2a str. 301
aucucuucuucaagccaggcu

SEQ ID NO: 3886370 - RNA, 13 nt, Shigella flexneri 2a str. 301
aucucuucuuccg

SEQ ID NO: 3886371 - RNA, 14 nt, Shigella flexneri 2a str. 301
aucucuucuucgcu

SEQ ID NO: 3886372 - RNA, 17 nt, Shigella flexneri 2a str. 301
aucucuuuuuccaccgc

SEQ ID NO: 3886373 - RNA, 22 nt, Shigella flexneri 2a str. 301
aucugacaacaccaauuucuga

SEQ ID NO: 3886374 - RNA, 17 nt, Shigella flexneri 2a str. 301
aucugaccgaaugcagu

SEQ ID NO: 3886375 - RNA, 20 nt, Shigella flexneri 2a str. 301
aucugacuggcgagauccgg

SEQ ID NO: 3886376 - RNA, 17 nt, Shigella flexneri 2a str. 301
aucugauaucucaccag

SEQ ID NO: 3886377 - RNA, 19 nt, Shigella flexneri 2a str. 301
aucugauaucucaccagau

SEQ ID NO: 3886378 - RNA, 22 nt, Shigella flexneri 2a str. 301
aucugaugauauuuuucccuga

SEQ ID NO: 3886379 - RNA, 20 nt, Shigella flexneri 2a str. 301
aucugauggaaaaucaucag

SEQ ID NO: 3886380 - RNA, 16 nt, Shigella flexneri 2a str. 301
aucugauuugauaaug

SEQ ID NO: 3886381 - RNA, 17 nt, Shigella flexneri 2a str. 301
aucugauuugucggcag

SEQ ID NO: 3886382 - RNA, 13 nt, Shigella flexneri 2a str. 301
aucugauuuuccu

SEQ ID NO: 3886383 - RNA, 21 nt, Shigella flexneri 2a str. 301
aucugauuuuccuccagcagc

SEQ ID NO: 3886384 - RNA, 18 nt, Shigella flexneri 2a str. 301
aucugccagcaagcgcac

SEQ ID NO: 3886385 - RNA, 12 nt, Shigella flexneri 2a str. 301
aucugcccgcac

SEQ ID NO: 3886386 - RNA, 19 nt, Shigella flexneri 2a str. 301
aucugccuuauugaagcuc

SEQ ID NO: 3886387 - RNA, 21 nt, Shigella flexneri 2a str. 301
aucugcgcccaauauccugag

SEQ ID NO: 3886388 - RNA, 22 nt, Shigella flexneri 2a str. 301
aucugcgccuacggcauucugc

SEQ ID NO: 3886389 - RNA, 15 nt, Shigella flexneri 2a str. 301
aucugcgcuggaaca

SEQ ID NO: 3886390 - RNA, 19 nt, Shigella flexneri 2a str. 301
aucugcgcuggaacaacgc

SEQ ID NO: 3886391 - RNA, 16 nt, Shigella flexneri 2a str. 301
aucugcgguugugccg

SEQ ID NO: 3886392 - RNA, 19 nt, Shigella flexneri 2a str. 301
aucugcguaucgcccugcc

SEQ ID NO: 3886393 - RNA, 19 nt, Shigella flexneri 2a str. 301
aucugcucggcgagcaacg

SEQ ID NO: 3886394 - RNA, 19 nt, Shigella flexneri 2a str. 301
aucugcuguucuacggcuc

SEQ ID NO: 3886395 - RNA, 23 nt, Shigella flexneri 2a str. 301
aucugcuugcgauguucuucacc

SEQ ID NO: 3886396 - RNA, 18 nt, Shigella flexneri 2a str. 301
aucuggaauggaaacagc

SEQ ID NO: 3886397 - RNA, 19 nt, Shigella flexneri 2a str. 301
aucuggcaagccugaaaac

SEQ ID NO: 3886398 - RNA, 16 nt, Shigella flexneri 2a str. 301
aucuggcauuugcacc

SEQ ID NO: 3886399 - RNA, 16 nt, Shigella flexneri 2a str. 301
aucuggcauuugcacu

SEQ ID NO: 3886400 - RNA, 23 nt, Shigella flexneri 2a str. 301
aucuggccgauccggacaugcug

SEQ ID NO: 3886401 - RNA, 15 nt, Shigella flexneri 2a str. 301
aucuggccuacagau

SEQ ID NO: 3886402 - RNA, 20 nt, Shigella flexneri 2a str. 301
aucuggcugugauccauucc

SEQ ID NO: 3886403 - RNA, 23 nt, Shigella flexneri 2a str. 301
aucugguaggacgaaaaaucaau

SEQ ID NO: 3886404 - RNA, 23 nt, Shigella flexneri 2a str. 301
aucuguaacggagguacaaccgc

SEQ ID NO: 3886405 - RNA, 21 nt, Shigella flexneri 2a str. 301
aucuguaggccagauaagacg

SEQ ID NO: 3886406 - RNA, 21 nt, Shigella flexneri 2a str. 301
aucuguauaaccugaauauua

SEQ ID NO: 3886407 - RNA, 15 nt, Shigella flexneri 2a str. 301
aucugucagguaaca

SEQ ID NO: 3886408 - RNA, 22 nt, Shigella flexneri 2a str. 301
aucugucaguggacgauaagca

SEQ ID NO: 3886409 - RNA, 18 nt, Shigella flexneri 2a str. 301
aucugucugauaaaaaac

SEQ ID NO: 3886410 - RNA, 19 nt, Shigella flexneri 2a str. 301
aucugucugauaaaaaacc

SEQ ID NO: 3886411 - RNA, 18 nt, Shigella flexneri 2a str. 301
aucugucuguacggcagu

SEQ ID NO: 3886412 - RNA, 14 nt, Shigella flexneri 2a str. 301
aucuguuaucacuu

SEQ ID NO: 3886413 - RNA, 11 nt, Shigella flexneri 2a str. 301
aucuuacccuu

SEQ ID NO: 3886414 - RNA, 17 nt, Shigella flexneri 2a str. 301
aucuuagguaaugacuc

SEQ ID NO: 3886415 - RNA, 23 nt, Shigella flexneri 2a str. 301
aucuuagugcgccugaucccagu

SEQ ID NO: 3886416 - RNA, 21 nt, Shigella flexneri 2a str. 301
aucuuauagaaagcaaaacgg

SEQ ID NO: 3886417 - RNA, 18 nt, Shigella flexneri 2a str. 301
aucuuaucacgaugcuaa

SEQ ID NO: 3886418 - RNA, 23 nt, Shigella flexneri 2a str. 301
aucuuauucgggauugccagaug

SEQ ID NO: 3886419 - RNA, 15 nt, Shigella flexneri 2a str. 301
aucuucacacacauc

SEQ ID NO: 3886420 - RNA, 16 nt, Shigella flexneri 2a str. 301
aucuucacacacaucg

SEQ ID NO: 3886421 - RNA, 16 nt, Shigella flexneri 2a str. 301
aucuucacaucaucau

SEQ ID NO: 3886422 - RNA, 18 nt, Shigella flexneri 2a str. 301
aucuucacuaaaaucauu

SEQ ID NO: 3886423 - RNA, 18 nt, Shigella flexneri 2a str. 301
aucuucacuguccgucag

SEQ ID NO: 3886424 - RNA, 21 nt, Shigella flexneri 2a str. 301
aucuucaggguaucccgccug

SEQ ID NO: 3886425 - RNA, 20 nt, Shigella flexneri 2a str. 301
aucuucauagauagccagca

SEQ ID NO: 3886426 - RNA, 21 nt, Shigella flexneri 2a str. 301
aucuucaucgauacugcucug

SEQ ID NO: 3886427 - RNA, 19 nt, Shigella flexneri 2a str. 301
aucuucaugcuccagcaga

SEQ ID NO: 3886428 - RNA, 15 nt, Shigella flexneri 2a str. 301
aucuuccagaucacc

SEQ ID NO: 3886429 - RNA, 21 nt, Shigella flexneri 2a str. 301
aucuuccagaucaccgcagaa

SEQ ID NO: 3886430 - RNA, 17 nt, Shigella flexneri 2a str. 301
aucuuccagcaucagca

SEQ ID NO: 3886431 - RNA, 11 nt, Shigella flexneri 2a str. 301
aucuucccagc

SEQ ID NO: 3886432 - RNA, 15 nt, Shigella flexneri 2a str. 301
aucuucccagccaau

SEQ ID NO: 3886433 - RNA, 19 nt, Shigella flexneri 2a str. 301
aucuucccagcccagcgcu

SEQ ID NO: 3886434 - RNA, 14 nt, Shigella flexneri 2a str. 301
aucuucccagcgca

SEQ ID NO: 3886435 - RNA, 15 nt, Shigella flexneri 2a str. 301
aucuuccgucacagg

SEQ ID NO: 3886436 - RNA, 20 nt, Shigella flexneri 2a str. 301
aucuuccgucacaggcacac

SEQ ID NO: 3886437 - RNA, 23 nt, Shigella flexneri 2a str. 301
aucuuccguggaacaaaaucuua

SEQ ID NO: 3886438 - RNA, 15 nt, Shigella flexneri 2a str. 301
aucuuccucacaccc

SEQ ID NO: 3886439 - RNA, 18 nt, Shigella flexneri 2a str. 301
aucuuccucacacccuug

SEQ ID NO: 3886440 - RNA, 22 nt, Shigella flexneri 2a str. 301
aucuucgauaaacucaaucagg

SEQ ID NO: 3886441 - RNA, 20 nt, Shigella flexneri 2a str. 301
aucuucgcgccaauccagaa

SEQ ID NO: 3886442 - RNA, 23 nt, Shigella flexneri 2a str. 301
aucuucgugucuacgcccggcag

SEQ ID NO: 3886443 - RNA, 15 nt, Shigella flexneri 2a str. 301
aucuucguuauccca

SEQ ID NO: 3886444 - RNA, 20 nt, Shigella flexneri 2a str. 301
aucuucguuaucccaggcgu

SEQ ID NO: 3886445 - RNA, 14 nt, Shigella flexneri 2a str. 301
aucuucuccacgcc

SEQ ID NO: 3886446 - RNA, 14 nt, Shigella flexneri 2a str. 301
aucuucucuucccc

SEQ ID NO: 3886447 - RNA, 16 nt, Shigella flexneri 2a str. 301
aucuucuguugcaggg

SEQ ID NO: 3886448 - RNA, 15 nt, Shigella flexneri 2a str. 301
augaguugaaaaccu

SEQ ID NO: 3886449 - RNA, 16 nt, Shigella flexneri 2a str. 301
augaguugaaaaccuc

SEQ ID NO: 3886450 - RNA, 15 nt, Shigella flexneri 2a str. 301
augaguugcuggacg

SEQ ID NO: 3886451 - RNA, 18 nt, Shigella flexneri 2a str. 301
augauaaaauucauucaa

SEQ ID NO: 3886452 - RNA, 15 nt, Shigella flexneri 2a str. 301
augauaaauccaucg

SEQ ID NO: 3886453 - RNA, 16 nt, Shigella flexneri 2a str. 301
augauaccgauuacuc

SEQ ID NO: 3886454 - RNA, 22 nt, Shigella flexneri 2a str. 301
augauacguuuauuaccaacca

SEQ ID NO: 3886455 - RNA, 16 nt, Shigella flexneri 2a str. 301
augauaggucauauca

SEQ ID NO: 3886456 - RNA, 18 nt, Shigella flexneri 2a str. 301
augauaggucauaucaca

SEQ ID NO: 3886457 - RNA, 14 nt, Shigella flexneri 2a str. 301
augauaucccugcu

SEQ ID NO: 3886458 - RNA, 21 nt, Shigella flexneri 2a str. 301
augauaucccugcuguccuga

SEQ ID NO: 3886459 - RNA, 17 nt, Shigella flexneri 2a str. 301
augaucaaaaucauaua

SEQ ID NO: 3886460 - RNA, 15 nt, Shigella flexneri 2a str. 301
augaucaagcgcaca

SEQ ID NO: 3886461 - RNA, 13 nt, Shigella flexneri 2a str. 301
augaucaucaagg

SEQ ID NO: 3886462 - RNA, 23 nt, Shigella flexneri 2a str. 301
augauccugcaauaccgccguua

SEQ ID NO: 3886463 - RNA, 14 nt, Shigella flexneri 2a str. 301
augauccuggauuu

SEQ ID NO: 3886464 - RNA, 21 nt, Shigella flexneri 2a str. 301
augaucgccaucagugccagu

SEQ ID NO: 3886465 - RNA, 12 nt, Shigella flexneri 2a str. 301
augaucgccgga

SEQ ID NO: 3886466 - RNA, 17 nt, Shigella flexneri 2a str. 301
augaucgcgaucgccaa

SEQ ID NO: 3886467 - RNA, 17 nt, Shigella flexneri 2a str. 301
augaucgcgcugauugc

SEQ ID NO: 3886468 - RNA, 21 nt, Shigella flexneri 2a str. 301
augaucgucacgaucgcgcca

SEQ ID NO: 3886469 - RNA, 22 nt, Shigella flexneri 2a str. 301
augaucugcgcccaauauccug

SEQ ID NO: 3886470 - RNA, 17 nt, Shigella flexneri 2a str. 301
augaugaaacugauaau

SEQ ID NO: 3886471 - RNA, 15 nt, Shigella flexneri 2a str. 301
augaugacgggcaag

SEQ ID NO: 3886472 - RNA, 20 nt, Shigella flexneri 2a str. 301
augaugacuugccuccagcg

SEQ ID NO: 3886473 - RNA, 20 nt, Shigella flexneri 2a str. 301
augaugaucuuaugauguaa

SEQ ID NO: 3886474 - RNA, 13 nt, Shigella flexneri 2a str. 301
augaugcaaacau

SEQ ID NO: 3886475 - RNA, 23 nt, Shigella flexneri 2a str. 301
augaugcaccaccugauugcugc

SEQ ID NO: 3886476 - RNA, 19 nt, Shigella flexneri 2a str. 301
augaugcgacuugucauca

SEQ ID NO: 3886477 - RNA, 15 nt, Shigella flexneri 2a str. 301
augaugcgucucauc

SEQ ID NO: 3886478 - RNA, 15 nt, Shigella flexneri 2a str. 301
augaugcugauggcu

SEQ ID NO: 3886479 - RNA, 15 nt, Shigella flexneri 2a str. 301
augauggccuuuuug

SEQ ID NO: 3886480 - RNA, 14 nt, Shigella flexneri 2a str. 301
augauguaaaaaua

SEQ ID NO: 3886481 - RNA, 16 nt, Shigella flexneri 2a str. 301
augauguaaaaauacu

SEQ ID NO: 3886482 - RNA, 21 nt, Shigella flexneri 2a str. 301
augauguuacguuucucugcu

SEQ ID NO: 3886483 - RNA, 15 nt, Shigella flexneri 2a str. 301
augauuacucguauu

SEQ ID NO: 3886484 - RNA, 20 nt, Shigella flexneri 2a str. 301
augauuagucuuuaucugcc

SEQ ID NO: 3886485 - RNA, 13 nt, Shigella flexneri 2a str. 301
augauuagugcca

SEQ ID NO: 3886486 - RNA, 15 nt, Shigella flexneri 2a str. 301
augauuuaaaaaaug

SEQ ID NO: 3886487 - RNA, 17 nt, Shigella flexneri 2a str. 301
augauuucauaacugau

SEQ ID NO: 3886488 - RNA, 23 nt, Shigella flexneri 2a str. 301
augauuuccggcagcauguguaa

SEQ ID NO: 3886489 - RNA, 15 nt, Shigella flexneri 2a str. 301
augauuucugccagc

SEQ ID NO: 3886490 - RNA, 12 nt, Shigella flexneri 2a str. 301
augauuuuccug

SEQ ID NO: 3886491 - RNA, 19 nt, Shigella flexneri 2a str. 301
augauuuugauggaagaaa

SEQ ID NO: 3886492 - RNA, 21 nt, Shigella flexneri 2a str. 301
augauuuuuuugaugccguug

SEQ ID NO: 3886493 - RNA, 18 nt, Shigella flexneri 2a str. 301
augcaagaggguuauuug

SEQ ID NO: 3886494 - RNA, 20 nt, Shigella flexneri 2a str. 301
augcaagaggguuauuuguu

SEQ ID NO: 3886495 - RNA, 22 nt, Shigella flexneri 2a str. 301
augcaagaggguuauuuguuca

SEQ ID NO: 3886496 - RNA, 13 nt, Shigella flexneri 2a str. 301
augcaauaaauau

SEQ ID NO: 3886497 - RNA, 18 nt, Shigella flexneri 2a str. 301
augcaaugauucaggcau

SEQ ID NO: 3886498 - RNA, 19 nt, Shigella flexneri 2a str. 301
augcaauuaccgccaccag

SEQ ID NO: 3886499 - RNA, 19 nt, Shigella flexneri 2a str. 301
augcacaaucguguggcau

SEQ ID NO: 3886500 - RNA, 21 nt, Shigella flexneri 2a str. 301
augcacaccccgcgcagcuga

SEQ ID NO: 3886501 - RNA, 14 nt, Shigella flexneri 2a str. 301
augcacagaaccgg

SEQ ID NO: 3886502 - RNA, 17 nt, Shigella flexneri 2a str. 301
augcaccaacaaauaga

SEQ ID NO: 3886503 - RNA, 15 nt, Shigella flexneri 2a str. 301
augcaccaucucuua

SEQ ID NO: 3886504 - RNA, 21 nt, Shigella flexneri 2a str. 301
augcacgauauaccgugcuga

SEQ ID NO: 3886505 - RNA, 20 nt, Shigella flexneri 2a str. 301
augcacgcaagaacgcauac

SEQ ID NO: 3886506 - RNA, 12 nt, Shigella flexneri 2a str. 301
augcacgcucug

SEQ ID NO: 3886507 - RNA, 17 nt, Shigella flexneri 2a str. 301
augcacgcucuguucug

SEQ ID NO: 3886508 - RNA, 21 nt, Shigella flexneri 2a str. 301
augcacguuccguauaccguc

SEQ ID NO: 3886509 - RNA, 18 nt, Shigella flexneri 2a str. 301
augcacucgaccacgccc

SEQ ID NO: 3886510 - RNA, 18 nt, Shigella flexneri 2a str. 301
augcacucgcauccucuu

SEQ ID NO: 3886511 - RNA, 12 nt, Shigella flexneri 2a str. 301
augcagaaacca

SEQ ID NO: 3886512 - RNA, 13 nt, Shigella flexneri 2a str. 301
augcagccuucau

SEQ ID NO: 3886513 - RNA, 20 nt, Shigella flexneri 2a str. 301
augcagcggaucgccgccgg

SEQ ID NO: 3886514 - RNA, 14 nt, Shigella flexneri 2a str. 301
augcagcggguuaa

SEQ ID NO: 3886515 - RNA, 16 nt, Shigella flexneri 2a str. 301
augcagcuccaccgau

SEQ ID NO: 3886516 - RNA, 18 nt, Shigella flexneri 2a str. 301
augcagcuccaccgauuu

SEQ ID NO: 3886517 - RNA, 14 nt, Shigella flexneri 2a str. 301
augcaggaucgcuc

SEQ ID NO: 3886518 - RNA, 15 nt, Shigella flexneri 2a str. 301
augcaggcagcacug

SEQ ID NO: 3886519 - RNA, 22 nt, Shigella flexneri 2a str. 301
augcaggcaucggugaugcucu

SEQ ID NO: 3886520 - RNA, 14 nt, Shigella flexneri 2a str. 301
augcaggccaccag

SEQ ID NO: 3886521 - RNA, 18 nt, Shigella flexneri 2a str. 301
augcaggcguuuuuggca

SEQ ID NO: 3886522 - RNA, 15 nt, Shigella flexneri 2a str. 301
augcagggcaaacuc

SEQ ID NO: 3886523 - RNA, 14 nt, Shigella flexneri 2a str. 301
augcaguaccagau

SEQ ID NO: 3886524 - RNA, 23 nt, Shigella flexneri 2a str. 301
augcagugcggcuguagagcuac

SEQ ID NO: 3886525 - RNA, 18 nt, Shigella flexneri 2a str. 301
augcaguuuuuaauuuuc

SEQ ID NO: 3886526 - RNA, 13 nt, Shigella flexneri 2a str. 301
augcauaaaaaaa

SEQ ID NO: 3886527 - RNA, 15 nt, Shigella flexneri 2a str. 301
augcauaaaaaaacg

SEQ ID NO: 3886528 - RNA, 16 nt, Shigella flexneri 2a str. 301
augcauauccaggcua

SEQ ID NO: 3886529 - RNA, 23 nt, Shigella flexneri 2a str. 301
augcaucgcauccgacaucaacc

SEQ ID NO: 3886530 - RNA, 14 nt, Shigella flexneri 2a str. 301
augcaucgccgguu

SEQ ID NO: 3886531 - RNA, 14 nt, Shigella flexneri 2a str. 301
augcaucggcauaa

SEQ ID NO: 3886532 - RNA, 23 nt, Shigella flexneri 2a str. 301
augcauuuuuuagugauuaacag

SEQ ID NO: 3886533 - RNA, 13 nt, Shigella flexneri 2a str. 301
augccaaaaggga

SEQ ID NO: 3886534 - RNA, 16 nt, Shigella flexneri 2a str. 301
augccaaauauuucuu

SEQ ID NO: 3886535 - RNA, 20 nt, Shigella flexneri 2a str. 301
augccaauaaauccuuugua

SEQ ID NO: 3886536 - RNA, 14 nt, Shigella flexneri 2a str. 301
augccaaucacaag

SEQ ID NO: 3886537 - RNA, 16 nt, Shigella flexneri 2a str. 301
augccaaucagcagaa

SEQ ID NO: 3886538 - RNA, 19 nt, Shigella flexneri 2a str. 301
augccaaucagcagaaccg

SEQ ID NO: 3886539 - RNA, 18 nt, Shigella flexneri 2a str. 301
augccaauccccagaccu

SEQ ID NO: 3886540 - RNA, 15 nt, Shigella flexneri 2a str. 301
augccaaucuucaca

SEQ ID NO: 3886541 - RNA, 22 nt, Shigella flexneri 2a str. 301
augccaaucuucacaucaucau

SEQ ID NO: 3886542 - RNA, 19 nt, Shigella flexneri 2a str. 301
augccacaaacgccgugca

SEQ ID NO: 3886543 - RNA, 20 nt, Shigella flexneri 2a str. 301
augccacgacguuuuccauc

SEQ ID NO: 3886544 - RNA, 18 nt, Shigella flexneri 2a str. 301
augccacugucaacugcu

SEQ ID NO: 3886545 - RNA, 20 nt, Shigella flexneri 2a str. 301
augccagaauccccacugca

SEQ ID NO: 3886546 - RNA, 21 nt, Shigella flexneri 2a str. 301
augccagaauccccacugcau

SEQ ID NO: 3886547 - RNA, 15 nt, Shigella flexneri 2a str. 301
augccagauaagaca

SEQ ID NO: 3886548 - RNA, 21 nt, Shigella flexneri 2a str. 301
augcgguuaaaccgaaagugu

SEQ ID NO: 3886549 - RNA, 20 nt, Shigella flexneri 2a str. 301
augcguagcugagcaacaaa

SEQ ID NO: 3886550 - RNA, 14 nt, Shigella flexneri 2a str. 301
augcgucucaucag

SEQ ID NO: 3886551 - RNA, 16 nt, Shigella flexneri 2a str. 301
augcgucuuccgugcc

SEQ ID NO: 3886552 - RNA, 19 nt, Shigella flexneri 2a str. 301
augcguucguagccacgau

SEQ ID NO: 3886553 - RNA, 16 nt, Shigella flexneri 2a str. 301
augcguuucagccacg

SEQ ID NO: 3886554 - RNA, 18 nt, Shigella flexneri 2a str. 301
augcguuucagccacgcg

SEQ ID NO: 3886555 - RNA, 21 nt, Shigella flexneri 2a str. 301
augcguuuuccggcacgcagg

SEQ ID NO: 3886556 - RNA, 14 nt, Shigella flexneri 2a str. 301
augcuaaaaacauc

SEQ ID NO: 3886557 - RNA, 19 nt, Shigella flexneri 2a str. 301
augcuaaaaacaucaugau

SEQ ID NO: 3886558 - RNA, 14 nt, Shigella flexneri 2a str. 301
augcuacaacaucg

SEQ ID NO: 3886559 - RNA, 21 nt, Shigella flexneri 2a str. 301
augcuauuggucggaucauuc

SEQ ID NO: 3886560 - RNA, 15 nt, Shigella flexneri 2a str. 301
augcucaacaaaccg

SEQ ID NO: 3886561 - RNA, 18 nt, Shigella flexneri 2a str. 301
augcucaacaauaaacug

SEQ ID NO: 3886562 - RNA, 17 nt, Shigella flexneri 2a str. 301
augcucaacuacuccaa

SEQ ID NO: 3886563 - RNA, 23 nt, Shigella flexneri 2a str. 301
augcucacugcgaaguuuuuccg

SEQ ID NO: 3886564 - RNA, 18 nt, Shigella flexneri 2a str. 301
augcucagaugccugaug

SEQ ID NO: 3886565 - RNA, 14 nt, Shigella flexneri 2a str. 301
augcucaugaucgu

SEQ ID NO: 3886566 - RNA, 12 nt, Shigella flexneri 2a str. 301
augcuccacgcu

SEQ ID NO: 3886567 - RNA, 16 nt, Shigella flexneri 2a str. 301
augcuccagcagaugg

SEQ ID NO: 3886568 - RNA, 15 nt, Shigella flexneri 2a str. 301
augcucucaucacua

SEQ ID NO: 3886569 - RNA, 17 nt, Shigella flexneri 2a str. 301
augcucuuuucugaagu

SEQ ID NO: 3886570 - RNA, 20 nt, Shigella flexneri 2a str. 301
augcugaaaagaguaguaau

SEQ ID NO: 3886571 - RNA, 20 nt, Shigella flexneri 2a str. 301
augcugaaauuacgcggugc

SEQ ID NO: 3886572 - RNA, 14 nt, Shigella flexneri 2a str. 301
augcugaaguaaga

SEQ ID NO: 3886573 - RNA, 19 nt, Shigella flexneri 2a str. 301
augcugacgcaucuucucc

SEQ ID NO: 3886574 - RNA, 19 nt, Shigella flexneri 2a str. 301
augcugcaauugcggcagg

SEQ ID NO: 3886575 - RNA, 22 nt, Shigella flexneri 2a str. 301
augcugcaauugcggcagguca

SEQ ID NO: 3886576 - RNA, 14 nt, Shigella flexneri 2a str. 301
augcugccgucuuc

SEQ ID NO: 3886577 - RNA, 16 nt, Shigella flexneri 2a str. 301
augcugcggaucaauc

SEQ ID NO: 3886578 - RNA, 17 nt, Shigella flexneri 2a str. 301
augcugcggaucaaucg

SEQ ID NO: 3886579 - RNA, 20 nt, Shigella flexneri 2a str. 301
augcugcuuuaucagaucac

SEQ ID NO: 3886580 - RNA, 22 nt, Shigella flexneri 2a str. 301
augcugcuuuaucagaucacgc

SEQ ID NO: 3886581 - RNA, 18 nt, Shigella flexneri 2a str. 301
augcugguaauccgagaa

SEQ ID NO: 3886582 - RNA, 14 nt, Shigella flexneri 2a str. 301
augcugguuccuga

SEQ ID NO: 3886583 - RNA, 16 nt, Shigella flexneri 2a str. 301
augcugguuucggcgu

SEQ ID NO: 3886584 - RNA, 14 nt, Shigella flexneri 2a str. 301
augcuguaaacaac

SEQ ID NO: 3886585 - RNA, 17 nt, Shigella flexneri 2a str. 301
augcuguaaccagcgca

SEQ ID NO: 3886586 - RNA, 15 nt, Shigella flexneri 2a str. 301
augcuguauucuuca

SEQ ID NO: 3886587 - RNA, 21 nt, Shigella flexneri 2a str. 301
augcuguccuaaaaaauuaac

SEQ ID NO: 3886588 - RNA, 17 nt, Shigella flexneri 2a str. 301
augcugucggcugccag

SEQ ID NO: 3886589 - RNA, 20 nt, Shigella flexneri 2a str. 301
augcugucggcugccagcca

SEQ ID NO: 3886590 - RNA, 17 nt, Shigella flexneri 2a str. 301
augcugugaagauggcu

SEQ ID NO: 3886591 - RNA, 23 nt, Shigella flexneri 2a str. 301
augcuguugcuccuuaauaaaau

SEQ ID NO: 3886592 - RNA, 17 nt, Shigella flexneri 2a str. 301
augcuuccgccagcggc

SEQ ID NO: 3886593 - RNA, 22 nt, Shigella flexneri 2a str. 301
augcuuccgccagcggcggcaa

SEQ ID NO: 3886594 - RNA, 19 nt, Shigella flexneri 2a str. 301
augcuugcgauauucuuca

SEQ ID NO: 3886595 - RNA, 22 nt, Shigella flexneri 2a str. 301
augcuugcgauauucuucagua

SEQ ID NO: 3886596 - RNA, 14 nt, Shigella flexneri 2a str. 301
augcuuuaaaugcu

SEQ ID NO: 3886597 - RNA, 22 nt, Shigella flexneri 2a str. 301
augcuuuacgcuuaucccagcc

SEQ ID NO: 3886598 - RNA, 14 nt, Shigella flexneri 2a str. 301
augcuuuuuccugc

SEQ ID NO: 3886599 - RNA, 15 nt, Shigella flexneri 2a str. 301
auggaaaaucaucag

SEQ ID NO: 3886600 - RNA, 21 nt, Shigella flexneri 2a str. 301
auggaaaaucaucaggggcag

SEQ ID NO: 3886601 - RNA, 13 nt, Shigella flexneri 2a str. 301
auggaaacagcac

SEQ ID NO: 3886602 - RNA, 18 nt, Shigella flexneri 2a str. 301
auggaaacagcaccaucc

SEQ ID NO: 3886603 - RNA, 13 nt, Shigella flexneri 2a str. 301
auggaaaucaccc

SEQ ID NO: 3886604 - RNA, 15 nt, Shigella flexneri 2a str. 301
auggaaaucacccag

SEQ ID NO: 3886605 - RNA, 20 nt, Shigella flexneri 2a str. 301
auggaaaucacccagcgaag

SEQ ID NO: 3886606 - RNA, 16 nt, Shigella flexneri 2a str. 301
auggaaccguacagca

SEQ ID NO: 3886607 - RNA, 18 nt, Shigella flexneri 2a str. 301
auggaagacauagcacau

SEQ ID NO: 3886608 - RNA, 17 nt, Shigella flexneri 2a str. 301
auggaaggucacgccag

SEQ ID NO: 3886609 - RNA, 16 nt, Shigella flexneri 2a str. 301
auggacacuauuuccc

SEQ ID NO: 3886610 - RNA, 13 nt, Shigella flexneri 2a str. 301
auggacgcagacc

SEQ ID NO: 3886611 - RNA, 18 nt, Shigella flexneri 2a str. 301
auggagcaaaaguggugu

SEQ ID NO: 3886612 - RNA, 18 nt, Shigella flexneri 2a str. 301
auggagcacauugccuga

SEQ ID NO: 3886613 - RNA, 16 nt, Shigella flexneri 2a str. 301
auggagcuaaacagcg

SEQ ID NO: 3886614 - RNA, 20 nt, Shigella flexneri 2a str. 301
auggaucagaguugaaaaac

SEQ ID NO: 3886615 - RNA, 21 nt, Shigella flexneri 2a str. 301
auggaucagaguugaaaaaca

SEQ ID NO: 3886616 - RNA, 15 nt, Shigella flexneri 2a str. 301
auggauuagcgaccg

SEQ ID NO: 3886617 - RNA, 13 nt, Shigella flexneri 2a str. 301
auggauugcugaa

SEQ ID NO: 3886618 - RNA, 16 nt, Shigella flexneri 2a str. 301
auggauugcugaaaua

SEQ ID NO: 3886619 - RNA, 17 nt, Shigella flexneri 2a str. 301
auggcaaaaacuuccau

SEQ ID NO: 3886620 - RNA, 16 nt, Shigella flexneri 2a str. 301
auggcaaacaaacugc

SEQ ID NO: 3886621 - RNA, 12 nt, Shigella flexneri 2a str. 301
auggcaaacuga

SEQ ID NO: 3886622 - RNA, 15 nt, Shigella flexneri 2a str. 301
auggcaaacugauua

SEQ ID NO: 3886623 - RNA, 14 nt, Shigella flexneri 2a str. 301
auggcaaagugcau

SEQ ID NO: 3886624 - RNA, 12 nt, Shigella flexneri 2a str. 301
auggcacaaaug

SEQ ID NO: 3886625 - RNA, 20 nt, Shigella flexneri 2a str. 301
auggcacguugcugcggcgu

SEQ ID NO: 3886626 - RNA, 13 nt, Shigella flexneri 2a str. 301
auggcagaagcau

SEQ ID NO: 3886627 - RNA, 18 nt, Shigella flexneri 2a str. 301
auggcaggcucagacuga

SEQ ID NO: 3886628 - RNA, 18 nt, Shigella flexneri 2a str. 301
auggcagucuuaaucgcu

SEQ ID NO: 3886629 - RNA, 23 nt, Shigella flexneri 2a str. 301
auggcaguucaccauuggucuuu

SEQ ID NO: 3886630 - RNA, 20 nt, Shigella flexneri 2a str. 301
auggcauaccauccggcaua

SEQ ID NO: 3886631 - RNA, 16 nt, Shigella flexneri 2a str. 301
auggcauacuccggca

SEQ ID NO: 3886632 - RNA, 17 nt, Shigella flexneri 2a str. 301
auggcauauuccgccac

SEQ ID NO: 3886633 - RNA, 15 nt, Shigella flexneri 2a str. 301
auggcaucaccaucg

SEQ ID NO: 3886634 - RNA, 13 nt, Shigella flexneri 2a str. 301
auggcauccuguu

SEQ ID NO: 3886635 - RNA, 23 nt, Shigella flexneri 2a str. 301
auggcauuuuuauuugugguugg

SEQ ID NO: 3886636 - RNA, 12 nt, Shigella flexneri 2a str. 301
auggccagccag

SEQ ID NO: 3886637 - RNA, 15 nt, Shigella flexneri 2a str. 301
auggccagccagcag

SEQ ID NO: 3886638 - RNA, 19 nt, Shigella flexneri 2a str. 301
auggcccgccgcauuggua

SEQ ID NO: 3886639 - RNA, 13 nt, Shigella flexneri 2a str. 301
auggcccuucugg

SEQ ID NO: 3886640 - RNA, 21 nt, Shigella flexneri 2a str. 301
auggccgggguuucagauuau

SEQ ID NO: 3886641 - RNA, 15 nt, Shigella flexneri 2a str. 301
auggccucugccagc

SEQ ID NO: 3886642 - RNA, 14 nt, Shigella flexneri 2a str. 301
auggcgacaaggcg

SEQ ID NO: 3886643 - RNA, 16 nt, Shigella flexneri 2a str. 301
auggcgacuucugcuu

SEQ ID NO: 3886644 - RNA, 19 nt, Shigella flexneri 2a str. 301
auggcgagaagagaggcgu

SEQ ID NO: 3886645 - RNA, 22 nt, Shigella flexneri 2a str. 301
auggcgcaauccggugauguuu

SEQ ID NO: 3886646 - RNA, 17 nt, Shigella flexneri 2a str. 301
auggcgccaguuauuaa

SEQ ID NO: 3886647 - RNA, 15 nt, Shigella flexneri 2a str. 301
auggcgcccaucggc

SEQ ID NO: 3886648 - RNA, 11 nt, Shigella flexneri 2a str. 301
augugccauua

SEQ ID NO: 3886649 - RNA, 20 nt, Shigella flexneri 2a str. 301
augugccgaagcagucaaca

SEQ ID NO: 3886650 - RNA, 18 nt, Shigella flexneri 2a str. 301
augugccggaugcaucac

SEQ ID NO: 3886651 - RNA, 15 nt, Shigella flexneri 2a str. 301
augugccguaaccaa

SEQ ID NO: 3886652 - RNA, 17 nt, Shigella flexneri 2a str. 301
augugcucuaacccuuc

SEQ ID NO: 3886653 - RNA, 19 nt, Shigella flexneri 2a str. 301
augugcucuaacccuucca

SEQ ID NO: 3886654 - RNA, 14 nt, Shigella flexneri 2a str. 301
augugcuucuacca

SEQ ID NO: 3886655 - RNA, 12 nt, Shigella flexneri 2a str. 301
auguggaaacag

SEQ ID NO: 3886656 - RNA, 16 nt, Shigella flexneri 2a str. 301
auguggaaacagugau

SEQ ID NO: 3886657 - RNA, 19 nt, Shigella flexneri 2a str. 301
auguggaucaacggccuga

SEQ ID NO: 3886658 - RNA, 19 nt, Shigella flexneri 2a str. 301
auguggcgugaacgccuua

SEQ ID NO: 3886659 - RNA, 15 nt, Shigella flexneri 2a str. 301
auguggcugggguac

SEQ ID NO: 3886660 - RNA, 19 nt, Shigella flexneri 2a str. 301
augugggcaaucucacucc

SEQ ID NO: 3886661 - RNA, 16 nt, Shigella flexneri 2a str. 301
augugggcugccccag

SEQ ID NO: 3886662 - RNA, 18 nt, Shigella flexneri 2a str. 301
auguguaagaaaggcaga

SEQ ID NO: 3886663 - RNA, 21 nt, Shigella flexneri 2a str. 301
auguguaaguaaugacaaaau

SEQ ID NO: 3886664 - RNA, 14 nt, Shigella flexneri 2a str. 301
auguguaaucaggc

SEQ ID NO: 3886665 - RNA, 21 nt, Shigella flexneri 2a str. 301
auguguuauucagcuggcagu

SEQ ID NO: 3886666 - RNA, 23 nt, Shigella flexneri 2a str. 301
auguguuuacgcguuuuucagaa

SEQ ID NO: 3886667 - RNA, 17 nt, Shigella flexneri 2a str. 301
auguguuuauaagccau

SEQ ID NO: 3886668 - RNA, 14 nt, Shigella flexneri 2a str. 301
auguuaaauacaga

SEQ ID NO: 3886669 - RNA, 14 nt, Shigella flexneri 2a str. 301
auguuaaccgccug

SEQ ID NO: 3886670 - RNA, 15 nt, Shigella flexneri 2a str. 301
auguuaagacuggca

SEQ ID NO: 3886671 - RNA, 17 nt, Shigella flexneri 2a str. 301
auguuacaaccuccucc

SEQ ID NO: 3886672 - RNA, 17 nt, Shigella flexneri 2a str. 301
auguuaccgaucgccag

SEQ ID NO: 3886673 - RNA, 21 nt, Shigella flexneri 2a str. 301
auguuacgugaagucucaauu

SEQ ID NO: 3886674 - RNA, 17 nt, Shigella flexneri 2a str. 301
auguuaggcaagccaca

SEQ ID NO: 3886675 - RNA, 14 nt, Shigella flexneri 2a str. 301
auguuauucaugcc

SEQ ID NO: 3886676 - RNA, 16 nt, Shigella flexneri 2a str. 301
auguuauuuggugaau

SEQ ID NO: 3886677 - RNA, 13 nt, Shigella flexneri 2a str. 301
auguucaaaaaaa

SEQ ID NO: 3886678 - RNA, 11 nt, Shigella flexneri 2a str. 301
auguucacugc

SEQ ID NO: 3886679 - RNA, 21 nt, Shigella flexneri 2a str. 301
auguucacugccguacagaca

SEQ ID NO: 3886680 - RNA, 13 nt, Shigella flexneri 2a str. 301
auguucagauaau

SEQ ID NO: 3886681 - RNA, 19 nt, Shigella flexneri 2a str. 301
auguucagauuguugauua

SEQ ID NO: 3886682 - RNA, 22 nt, Shigella flexneri 2a str. 301
auguucagccgucauccaggaa

SEQ ID NO: 3886683 - RNA, 17 nt, Shigella flexneri 2a str. 301
auguucaggauauuuau

SEQ ID NO: 3886684 - RNA, 20 nt, Shigella flexneri 2a str. 301
auguucaucaagcugugccu

SEQ ID NO: 3886685 - RNA, 20 nt, Shigella flexneri 2a str. 301
auguuccagggccuccugca

SEQ ID NO: 3886686 - RNA, 22 nt, Shigella flexneri 2a str. 301
auguuccagugcgguaacguaa

SEQ ID NO: 3886687 - RNA, 15 nt, Shigella flexneri 2a str. 301
auguuccaucaccag

SEQ ID NO: 3886688 - RNA, 17 nt, Shigella flexneri 2a str. 301
auguuccaucaccagau

SEQ ID NO: 3886689 - RNA, 19 nt, Shigella flexneri 2a str. 301
auguuccggcgacacaucu

SEQ ID NO: 3886690 - RNA, 22 nt, Shigella flexneri 2a str. 301
auguuccggguuugccacauca

SEQ ID NO: 3886691 - RNA, 17 nt, Shigella flexneri 2a str. 301
auguucgacuuaacgcg

SEQ ID NO: 3886692 - RNA, 17 nt, Shigella flexneri 2a str. 301
auguucgccagauuuuu

SEQ ID NO: 3886693 - RNA, 22 nt, Shigella flexneri 2a str. 301
auguucgccagauuuuuaucca

SEQ ID NO: 3886694 - RNA, 20 nt, Shigella flexneri 2a str. 301
auguucggcgucuuguugaa

SEQ ID NO: 3886695 - RNA, 14 nt, Shigella flexneri 2a str. 301
auguucuaucuuuc

SEQ ID NO: 3886696 - RNA, 17 nt, Shigella flexneri 2a str. 301
auguucuaucuuucaga

SEQ ID NO: 3886697 - RNA, 20 nt, Shigella flexneri 2a str. 301
auguucuaugaagaacugga

SEQ ID NO: 3886698 - RNA, 21 nt, Shigella flexneri 2a str. 301
auguucucuggcgaauaugac

SEQ ID NO: 3886699 - RNA, 15 nt, Shigella flexneri 2a str. 301
auguugaacgcggau

SEQ ID NO: 3886700 - RNA, 13 nt, Shigella flexneri 2a str. 301
auguugaaucuuc

SEQ ID NO: 3886701 - RNA, 20 nt, Shigella flexneri 2a str. 301
auguugacgccgucaaaacg

SEQ ID NO: 3886702 - RNA, 16 nt, Shigella flexneri 2a str. 301
auguugagcauugccg

SEQ ID NO: 3886703 - RNA, 13 nt, Shigella flexneri 2a str. 301
auguugagcggca

SEQ ID NO: 3886704 - RNA, 13 nt, Shigella flexneri 2a str. 301
auguugccacacg

SEQ ID NO: 3886705 - RNA, 19 nt, Shigella flexneri 2a str. 301
auguugcgcggucggaaaa

SEQ ID NO: 3886706 - RNA, 13 nt, Shigella flexneri 2a str. 301
auguugcuggaag

SEQ ID NO: 3886707 - RNA, 23 nt, Shigella flexneri 2a str. 301
auguuguacagcgaaacauacag

SEQ ID NO: 3886708 - RNA, 19 nt, Shigella flexneri 2a str. 301
auguugucucagcuucaga

SEQ ID NO: 3886709 - RNA, 20 nt, Shigella flexneri 2a str. 301
auguugucucagcuucagau

SEQ ID NO: 3886710 - RNA, 14 nt, Shigella flexneri 2a str. 301
auguuguuccuuuu

SEQ ID NO: 3886711 - RNA, 16 nt, Shigella flexneri 2a str. 301
auguuguugucuauuu

SEQ ID NO: 3886712 - RNA, 14 nt, Shigella flexneri 2a str. 301
auguuguuuuuaac

SEQ ID NO: 3886713 - RNA, 22 nt, Shigella flexneri 2a str. 301
auguuuaguauuguuaaauauu

SEQ ID NO: 3886714 - RNA, 15 nt, Shigella flexneri 2a str. 301
auguuuaugccuggu

SEQ ID NO: 3886715 - RNA, 16 nt, Shigella flexneri 2a str. 301
auguuuaugccugguu

SEQ ID NO: 3886716 - RNA, 18 nt, Shigella flexneri 2a str. 301
auguuucaacggaccaau

SEQ ID NO: 3886717 - RNA, 19 nt, Shigella flexneri 2a str. 301
auguuuccgcgcagguaaa

SEQ ID NO: 3886718 - RNA, 22 nt, Shigella flexneri 2a str. 301
auguuucuggucugcuggaacu

SEQ ID NO: 3886719 - RNA, 17 nt, Shigella flexneri 2a str. 301
auguuucuucaacacca

SEQ ID NO: 3886720 - RNA, 12 nt, Shigella flexneri 2a str. 301
auguuugcaaua

SEQ ID NO: 3886721 - RNA, 11 nt, Shigella flexneri 2a str. 301
auguuugccau

SEQ ID NO: 3886722 - RNA, 21 nt, Shigella flexneri 2a str. 301
auguuuuaacacacaauuacc

SEQ ID NO: 3886723 - RNA, 20 nt, Shigella flexneri 2a str. 301
auguuuucagaccagacugc

SEQ ID NO: 3886724 - RNA, 13 nt, Shigella flexneri 2a str. 301
auguuuuccagca

SEQ ID NO: 3886725 - RNA, 14 nt, Shigella flexneri 2a str. 301
auguuuuccagcac

SEQ ID NO: 3886726 - RNA, 13 nt, Shigella flexneri 2a str. 301
auguuuuuugaug

SEQ ID NO: 3886727 - RNA, 14 nt, Shigella flexneri 2a str. 301
auuaaaaaaacacc

SEQ ID NO: 3886728 - RNA, 21 nt, Shigella flexneri 2a str. 301
auuaaaaaaacaccacaaaac

SEQ ID NO: 3886729 - RNA, 16 nt, Shigella flexneri 2a str. 301
auuaaaaagccugcca

SEQ ID NO: 3886730 - RNA, 17 nt, Shigella flexneri 2a str. 301
auuaaacacgggguuaa

SEQ ID NO: 3886731 - RNA, 16 nt, Shigella flexneri 2a str. 301
auuaaacagccaacug

SEQ ID NO: 3886732 - RNA, 17 nt, Shigella flexneri 2a str. 301
auuaaaccgcugacccu

SEQ ID NO: 3886733 - RNA, 19 nt, Shigella flexneri 2a str. 301
auuaaacgcaguaagcgcc

SEQ ID NO: 3886734 - RNA, 18 nt, Shigella flexneri 2a str. 301
auuaaacuggauggcucu

SEQ ID NO: 3886735 - RNA, 16 nt, Shigella flexneri 2a str. 301
auuaaaggaaggucau

SEQ ID NO: 3886736 - RNA, 21 nt, Shigella flexneri 2a str. 301
auuaaaggaaggucauccaaa

SEQ ID NO: 3886737 - RNA, 17 nt, Shigella flexneri 2a str. 301
auuaaaggcaccaauau

SEQ ID NO: 3886738 - RNA, 22 nt, Shigella flexneri 2a str. 301
auuaaaguaggccagauaagac

SEQ ID NO: 3886739 - RNA, 13 nt, Shigella flexneri 2a str. 301
auuaaauugauaa

SEQ ID NO: 3886740 - RNA, 12 nt, Shigella flexneri 2a str. 301
auuaaauugucu

SEQ ID NO: 3886741 - RNA, 15 nt, Shigella flexneri 2a str. 301
auuaacaacgggcua

SEQ ID NO: 3886742 - RNA, 22 nt, Shigella flexneri 2a str. 301
auuaacagucagucucaaggga

SEQ ID NO: 3886743 - RNA, 17 nt, Shigella flexneri 2a str. 301
auuaacaguccgccguu

SEQ ID NO: 3886744 - RNA, 21 nt, Shigella flexneri 2a str. 301
auuaaccagccacugcgccau

SEQ ID NO: 3886745 - RNA, 15 nt, Shigella flexneri 2a str. 301
auuaacgaaaucuca

SEQ ID NO: 3886746 - RNA, 22 nt, Shigella flexneri 2a str. 301
auuaacgacgcauacucuuuga

SEQ ID NO: 3886747 - RNA, 14 nt, Shigella flexneri 2a str. 301
auuaacgcugggga

SEQ ID NO: 3886748 - RNA, 15 nt, Shigella flexneri 2a str. 301
auuauauggaaaaau

SEQ ID NO: 3886749 - RNA, 14 nt, Shigella flexneri 2a str. 301
auuaucacucugcc

SEQ ID NO: 3886750 - RNA, 18 nt, Shigella flexneri 2a str. 301
auuaucagacaccgauug

SEQ ID NO: 3886751 - RNA, 15 nt, Shigella flexneri 2a str. 301
auuaucagcaaagca

SEQ ID NO: 3886752 - RNA, 13 nt, Shigella flexneri 2a str. 301
auuaucauuuuac

SEQ ID NO: 3886753 - RNA, 22 nt, Shigella flexneri 2a str. 301
auuauccaucaaagguuuuuca

SEQ ID NO: 3886754 - RNA, 16 nt, Shigella flexneri 2a str. 301
auuauccgucagccac

SEQ ID NO: 3886755 - RNA, 21 nt, Shigella flexneri 2a str. 301
auuaucgaucaugacgggcaa

SEQ ID NO: 3886756 - RNA, 19 nt, Shigella flexneri 2a str. 301
auuaucgcgucuaaauuuu

SEQ ID NO: 3886757 - RNA, 16 nt, Shigella flexneri 2a str. 301
auuaucggcaccauuu

SEQ ID NO: 3886758 - RNA, 23 nt, Shigella flexneri 2a str. 301
auuaucggcucgaucuggugcaa

SEQ ID NO: 3886759 - RNA, 15 nt, Shigella flexneri 2a str. 301
auuaucguagcagca

SEQ ID NO: 3886760 - RNA, 15 nt, Shigella flexneri 2a str. 301
auuaucgucgucacg

SEQ ID NO: 3886761 - RNA, 14 nt, Shigella flexneri 2a str. 301
auuaucucaacaca

SEQ ID NO: 3886762 - RNA, 19 nt, Shigella flexneri 2a str. 301
auuaucuggaauuccuuuc

SEQ ID NO: 3886763 - RNA, 12 nt, Shigella flexneri 2a str. 301
auuaucuuuacu

SEQ ID NO: 3886764 - RNA, 17 nt, Shigella flexneri 2a str. 301
auuaugacuccagcgcc

SEQ ID NO: 3886765 - RNA, 14 nt, Shigella flexneri 2a str. 301
auuaugaucgccac

SEQ ID NO: 3886766 - RNA, 23 nt, Shigella flexneri 2a str. 301
auuaugccgccgacaguuaucaa

SEQ ID NO: 3886767 - RNA, 18 nt, Shigella flexneri 2a str. 301
auuaugcgaccauaugaa

SEQ ID NO: 3886768 - RNA, 21 nt, Shigella flexneri 2a str. 301
auuaugcgcggcauacagcca

SEQ ID NO: 3886769 - RNA, 22 nt, Shigella flexneri 2a str. 301
auuauuaaagagcgccucccuu

SEQ ID NO: 3886770 - RNA, 15 nt, Shigella flexneri 2a str. 301
auuauuaaauuuaau

SEQ ID NO: 3886771 - RNA, 16 nt, Shigella flexneri 2a str. 301
auuauuaauauucagc

SEQ ID NO: 3886772 - RNA, 12 nt, Shigella flexneri 2a str. 301
auuauuauaaua

SEQ ID NO: 3886773 - RNA, 14 nt, Shigella flexneri 2a str. 301
auuauuauuuuugu

SEQ ID NO: 3886774 - RNA, 20 nt, Shigella flexneri 2a str. 301
auuauugagcgcaaauugcu

SEQ ID NO: 3886775 - RNA, 16 nt, Shigella flexneri 2a str. 301
auuauugcgcacauca

SEQ ID NO: 3886776 - RNA, 17 nt, Shigella flexneri 2a str. 301
auuauugcgcacaucaa

SEQ ID NO: 3886777 - RNA, 14 nt, Shigella flexneri 2a str. 301
auuauugucgccgc

SEQ ID NO: 3886778 - RNA, 23 nt, Shigella flexneri 2a str. 301
auuauuucaaugcauuaucagag

SEQ ID NO: 3886779 - RNA, 13 nt, Shigella flexneri 2a str. 301
auuauuucccggc

SEQ ID NO: 3886780 - RNA, 21 nt, Shigella flexneri 2a str. 301
auuauuucccggcugauaaag

SEQ ID NO: 3886781 - RNA, 19 nt, Shigella flexneri 2a str. 301
auuauuucuuuuacauuau

SEQ ID NO: 3886782 - RNA, 12 nt, Shigella flexneri 2a str. 301
auuauuuuaaau

SEQ ID NO: 3886783 - RNA, 14 nt, Shigella flexneri 2a str. 301
auuauuuuuaaaca

SEQ ID NO: 3886784 - RNA, 19 nt, Shigella flexneri 2a str. 301
auuauuuuuaaacaucaaa

SEQ ID NO: 3886785 - RNA, 19 nt, Shigella flexneri 2a str. 301
auuauuuuugugaagaaua

SEQ ID NO: 3886786 - RNA, 22 nt, Shigella flexneri 2a str. 301
auuauuuuugugaagaauaaau

SEQ ID NO: 3886787 - RNA, 15 nt, Shigella flexneri 2a str. 301
auucaaaauccgcca

SEQ ID NO: 3886788 - RNA, 22 nt, Shigella flexneri 2a str. 301
auucaaaguguugcaggaaaag

SEQ ID NO: 3886789 - RNA, 12 nt, Shigella flexneri 2a str. 301
auucaacaguag

SEQ ID NO: 3886790 - RNA, 15 nt, Shigella flexneri 2a str. 301
auucaacgucacugg

SEQ ID NO: 3886791 - RNA, 17 nt, Shigella flexneri 2a str. 301
auucaacgucacugggu

SEQ ID NO: 3886792 - RNA, 15 nt, Shigella flexneri 2a str. 301
auucaagaaacagca

SEQ ID NO: 3886793 - RNA, 17 nt, Shigella flexneri 2a str. 301
auucaagaaacagcagu

SEQ ID NO: 3886794 - RNA, 16 nt, Shigella flexneri 2a str. 301
auucaagacaucaaua

SEQ ID NO: 3886795 - RNA, 15 nt, Shigella flexneri 2a str. 301
auucaaguaucuauu

SEQ ID NO: 3886796 - RNA, 16 nt, Shigella flexneri 2a str. 301
auucaaguaucuauuc

SEQ ID NO: 3886797 - RNA, 21 nt, Shigella flexneri 2a str. 301
auucaauauauugcugaaaua

SEQ ID NO: 3886798 - RNA, 13 nt, Shigella flexneri 2a str. 301
auucaaucucuuc

SEQ ID NO: 3886799 - RNA, 16 nt, Shigella flexneri 2a str. 301
auucaaucucuucaca

SEQ ID NO: 3886800 - RNA, 17 nt, Shigella flexneri 2a str. 301
auucaauuaauaacaca

SEQ ID NO: 3886801 - RNA, 16 nt, Shigella flexneri 2a str. 301
auucaauuauaguauc

SEQ ID NO: 3886802 - RNA, 19 nt, Shigella flexneri 2a str. 301
auucaauuauaguaucguu

SEQ ID NO: 3886803 - RNA, 14 nt, Shigella flexneri 2a str. 301
auucaauuugcaau

SEQ ID NO: 3886804 - RNA, 18 nt, Shigella flexneri 2a str. 301
auucaauuugcaauuuuc

SEQ ID NO: 3886805 - RNA, 16 nt, Shigella flexneri 2a str. 301
auucacaauucaucau

SEQ ID NO: 3886806 - RNA, 19 nt, Shigella flexneri 2a str. 301
auucacacaguucuucuca

SEQ ID NO: 3886807 - RNA, 18 nt, Shigella flexneri 2a str. 301
auucacaguuaaguuaau

SEQ ID NO: 3886808 - RNA, 22 nt, Shigella flexneri 2a str. 301
auucacaucauccggcaccuuu

SEQ ID NO: 3886809 - RNA, 17 nt, Shigella flexneri 2a str. 301
auucacauuuuuaagcc

SEQ ID NO: 3886810 - RNA, 17 nt, Shigella flexneri 2a str. 301
auucaccagaccugaaa

SEQ ID NO: 3886811 - RNA, 18 nt, Shigella flexneri 2a str. 301
auucaccagaccugaaac

SEQ ID NO: 3886812 - RNA, 14 nt, Shigella flexneri 2a str. 301
auucaccagcaaau

SEQ ID NO: 3886813 - RNA, 17 nt, Shigella flexneri 2a str. 301
auucaccagcaaaucca

SEQ ID NO: 3886814 - RNA, 14 nt, Shigella flexneri 2a str. 301
auucaccaguuuac

SEQ ID NO: 3886815 - RNA, 19 nt, Shigella flexneri 2a str. 301
auucaccgcaucaauauua

SEQ ID NO: 3886816 - RNA, 21 nt, Shigella flexneri 2a str. 301
auucaccguaauaguuucuga

SEQ ID NO: 3886817 - RNA, 17 nt, Shigella flexneri 2a str. 301
auucacgaauauuuccc

SEQ ID NO: 3886818 - RNA, 19 nt, Shigella flexneri 2a str. 301
auucacgaauauuucccgg

SEQ ID NO: 3886819 - RNA, 21 nt, Shigella flexneri 2a str. 301
auucacgaaucuauucauuua

SEQ ID NO: 3886820 - RNA, 20 nt, Shigella flexneri 2a str. 301
auucacgagguuuuuucgga

SEQ ID NO: 3886821 - RNA, 20 nt, Shigella flexneri 2a str. 301
auucacgccacugucauauu

SEQ ID NO: 3886822 - RNA, 21 nt, Shigella flexneri 2a str. 301
auucacgccgcauccggcauc

SEQ ID NO: 3886823 - RNA, 14 nt, Shigella flexneri 2a str. 301
auucacugcgccuc

SEQ ID NO: 3886824 - RNA, 17 nt, Shigella flexneri 2a str. 301
auucacuuucugaagga

SEQ ID NO: 3886825 - RNA, 17 nt, Shigella flexneri 2a str. 301
auucagaaaaauacaau

SEQ ID NO: 3886826 - RNA, 13 nt, Shigella flexneri 2a str. 301
auucagaaaguaa

SEQ ID NO: 3886827 - RNA, 16 nt, Shigella flexneri 2a str. 301
auucagaccauuccuc

SEQ ID NO: 3886828 - RNA, 21 nt, Shigella flexneri 2a str. 301
auucagagggcaaauucuuca

SEQ ID NO: 3886829 - RNA, 23 nt, Shigella flexneri 2a str. 301
auucagagggcaaauucuucacg

SEQ ID NO: 3886830 - RNA, 19 nt, Shigella flexneri 2a str. 301
auucagcaaauguggcggu

SEQ ID NO: 3886831 - RNA, 20 nt, Shigella flexneri 2a str. 301
auucagcaauguuucucugg

SEQ ID NO: 3886832 - RNA, 11 nt, Shigella flexneri 2a str. 301
auucagcagca

SEQ ID NO: 3886833 - RNA, 20 nt, Shigella flexneri 2a str. 301
auucagcccgagguuauuuu

SEQ ID NO: 3886834 - RNA, 22 nt, Shigella flexneri 2a str. 301
auucagcgaguuuuucagucca

SEQ ID NO: 3886835 - RNA, 20 nt, Shigella flexneri 2a str. 301
auucagcgucgucagcaguu

SEQ ID NO: 3886836 - RNA, 15 nt, Shigella flexneri 2a str. 301
auucagcgucucacu

SEQ ID NO: 3886837 - RNA, 20 nt, Shigella flexneri 2a str. 301
auucaggagcaggcugcacu

SEQ ID NO: 3886838 - RNA, 18 nt, Shigella flexneri 2a str. 301
auucaggccguagagcac

SEQ ID NO: 3886839 - RNA, 14 nt, Shigella flexneri 2a str. 301
auucaggcgcagca

SEQ ID NO: 3886840 - RNA, 20 nt, Shigella flexneri 2a str. 301
auucaggcguugaaaaauca

SEQ ID NO: 3886841 - RNA, 20 nt, Shigella flexneri 2a str. 301
auucaggucagcggccaguu

SEQ ID NO: 3886842 - RNA, 18 nt, Shigella flexneri 2a str. 301
auucagugacagguugcu

SEQ ID NO: 3886843 - RNA, 18 nt, Shigella flexneri 2a str. 301
auucagugcaaaugccag

SEQ ID NO: 3886844 - RNA, 23 nt, Shigella flexneri 2a str. 301
auucaguucaacggugugagcac

SEQ ID NO: 3886845 - RNA, 18 nt, Shigella flexneri 2a str. 301
auucauaagaagcuuuuc

SEQ ID NO: 3886846 - RNA, 16 nt, Shigella flexneri 2a str. 301
auucauaaugcccagc

SEQ ID NO: 3886847 - RNA, 13 nt, Shigella flexneri 2a str. 301
auucauaauugcg

SEQ ID NO: 3886848 - RNA, 18 nt, Shigella flexneri 2a str. 301
auucuguuuuaucagacc

SEQ ID NO: 3886849 - RNA, 20 nt, Shigella flexneri 2a str. 301
auucuuacguaauuuauaau

SEQ ID NO: 3886850 - RNA, 12 nt, Shigella flexneri 2a str. 301
auucuucaacaa

SEQ ID NO: 3886851 - RNA, 13 nt, Shigella flexneri 2a str. 301
auucuucagcgac

SEQ ID NO: 3886852 - RNA, 20 nt, Shigella flexneri 2a str. 301
auucuucagcgacagggcca

SEQ ID NO: 3886853 - RNA, 16 nt, Shigella flexneri 2a str. 301
auucuuugcuguacau

SEQ ID NO: 3886854 - RNA, 19 nt, Shigella flexneri 2a str. 301
auugaaaaguccaggcugc

SEQ ID NO: 3886855 - RNA, 21 nt, Shigella flexneri 2a str. 301
auugaaaucacuaacgacaua

SEQ ID NO: 3886856 - RNA, 15 nt, Shigella flexneri 2a str. 301
auugaagaauuuuug

SEQ ID NO: 3886857 - RNA, 21 nt, Shigella flexneri 2a str. 301
auugaagauuuugcugugcuu

SEQ ID NO: 3886858 - RNA, 19 nt, Shigella flexneri 2a str. 301
auugaagcaauccauacca

SEQ ID NO: 3886859 - RNA, 15 nt, Shigella flexneri 2a str. 301
auugaaggauaagac

SEQ ID NO: 3886860 - RNA, 18 nt, Shigella flexneri 2a str. 301
auugaaucacgacaaaca

SEQ ID NO: 3886861 - RNA, 16 nt, Shigella flexneri 2a str. 301
auugaaugaacgcaga

SEQ ID NO: 3886862 - RNA, 18 nt, Shigella flexneri 2a str. 301
auugaaugcggcaggcac

SEQ ID NO: 3886863 - RNA, 19 nt, Shigella flexneri 2a str. 301
auugaaugucugucugaca

SEQ ID NO: 3886864 - RNA, 14 nt, Shigella flexneri 2a str. 301
auugaauuuuaugu

SEQ ID NO: 3886865 - RNA, 22 nt, Shigella flexneri 2a str. 301
auugacaaagugcgcuuuguuu

SEQ ID NO: 3886866 - RNA, 20 nt, Shigella flexneri 2a str. 301
auugacaguuuauuuucugc

SEQ ID NO: 3886867 - RNA, 13 nt, Shigella flexneri 2a str. 301
auugaccagaucu

SEQ ID NO: 3886868 - RNA, 19 nt, Shigella flexneri 2a str. 301
auugacgccaaaauaacuu

SEQ ID NO: 3886869 - RNA, 23 nt, Shigella flexneri 2a str. 301
auugacucgccuucaggaauacg

SEQ ID NO: 3886870 - RNA, 15 nt, Shigella flexneri 2a str. 301
auugagaaccacaau

SEQ ID NO: 3886871 - RNA, 20 nt, Shigella flexneri 2a str. 301
auugagaucgcuuaacagaa

SEQ ID NO: 3886872 - RNA, 13 nt, Shigella flexneri 2a str. 301
auugagcaccgcg

SEQ ID NO: 3886873 - RNA, 15 nt, Shigella flexneri 2a str. 301
auugagcauuggcau

SEQ ID NO: 3886874 - RNA, 21 nt, Shigella flexneri 2a str. 301
auugagcauuggcaugcacgu

SEQ ID NO: 3886875 - RNA, 12 nt, Shigella flexneri 2a str. 301
auugagcugccc

SEQ ID NO: 3886876 - RNA, 20 nt, Shigella flexneri 2a str. 301
auugagcuggucugaaucaa

SEQ ID NO: 3886877 - RNA, 17 nt, Shigella flexneri 2a str. 301
auugaguaccagcgcac

SEQ ID NO: 3886878 - RNA, 17 nt, Shigella flexneri 2a str. 301
auugagugagcacugaa

SEQ ID NO: 3886879 - RNA, 22 nt, Shigella flexneri 2a str. 301
auugauaaccguacgcaucacc

SEQ ID NO: 3886880 - RNA, 15 nt, Shigella flexneri 2a str. 301
auugaucaauucuaa

SEQ ID NO: 3886881 - RNA, 20 nt, Shigella flexneri 2a str. 301
auugaucuaccgcuucccuu

SEQ ID NO: 3886882 - RNA, 18 nt, Shigella flexneri 2a str. 301
auugaucucguugaucac

SEQ ID NO: 3886883 - RNA, 14 nt, Shigella flexneri 2a str. 301
auugaugacgccau

SEQ ID NO: 3886884 - RNA, 15 nt, Shigella flexneri 2a str. 301
auugaugcacaccau

SEQ ID NO: 3886885 - RNA, 19 nt, Shigella flexneri 2a str. 301
auugaugcacaccaucgcg

SEQ ID NO: 3886886 - RNA, 19 nt, Shigella flexneri 2a str. 301
auugauguaauuaucgcag

SEQ ID NO: 3886887 - RNA, 15 nt, Shigella flexneri 2a str. 301
auugauucaucaagc

SEQ ID NO: 3886888 - RNA, 21 nt, Shigella flexneri 2a str. 301
auugauucaucucuucuuccg

SEQ ID NO: 3886889 - RNA, 18 nt, Shigella flexneri 2a str. 301
auugauuuaacagcaaaa

SEQ ID NO: 3886890 - RNA, 17 nt, Shigella flexneri 2a str. 301
auugauuuucgaaaaaa

SEQ ID NO: 3886891 - RNA, 16 nt, Shigella flexneri 2a str. 301
auugcaacauguugaa

SEQ ID NO: 3886892 - RNA, 19 nt, Shigella flexneri 2a str. 301
auugcaacauguugaaucu

SEQ ID NO: 3886893 - RNA, 14 nt, Shigella flexneri 2a str. 301
auugcaaccacaca

SEQ ID NO: 3886894 - RNA, 14 nt, Shigella flexneri 2a str. 301
auugcaaucaucuu

SEQ ID NO: 3886895 - RNA, 19 nt, Shigella flexneri 2a str. 301
auugcacauucccugcagu

SEQ ID NO: 3886896 - RNA, 21 nt, Shigella flexneri 2a str. 301
auugcaccacaucgguuugcg

SEQ ID NO: 3886897 - RNA, 20 nt, Shigella flexneri 2a str. 301
auugcaccauccauuuuuca

SEQ ID NO: 3886898 - RNA, 16 nt, Shigella flexneri 2a str. 301
auugcaccgacuggcu

SEQ ID NO: 3886899 - RNA, 19 nt, Shigella flexneri 2a str. 301
auugcacguccgguggcau

SEQ ID NO: 3886900 - RNA, 18 nt, Shigella flexneri 2a str. 301
auugcacuugcuuaaaau

SEQ ID NO: 3886901 - RNA, 16 nt, Shigella flexneri 2a str. 301
auugcagauaccacau

SEQ ID NO: 3886902 - RNA, 15 nt, Shigella flexneri 2a str. 301
auugcaggagcggug

SEQ ID NO: 3886903 - RNA, 22 nt, Shigella flexneri 2a str. 301
auugcaggguuuuguuuaaaua

SEQ ID NO: 3886904 - RNA, 13 nt, Shigella flexneri 2a str. 301
auugcagucauaa

SEQ ID NO: 3886905 - RNA, 19 nt, Shigella flexneri 2a str. 301
auugcauccuuuaccggau

SEQ ID NO: 3886906 - RNA, 17 nt, Shigella flexneri 2a str. 301
auugcaucgaggaaaac

SEQ ID NO: 3886907 - RNA, 19 nt, Shigella flexneri 2a str. 301
auugcaucgaggaaaacca

SEQ ID NO: 3886908 - RNA, 19 nt, Shigella flexneri 2a str. 301
auugccacccugcggcugc

SEQ ID NO: 3886909 - RNA, 13 nt, Shigella flexneri 2a str. 301
auugccagaugcg

SEQ ID NO: 3886910 - RNA, 20 nt, Shigella flexneri 2a str. 301
auugccagaugcgacgcugg

SEQ ID NO: 3886911 - RNA, 12 nt, Shigella flexneri 2a str. 301
auugccagccgu

SEQ ID NO: 3886912 - RNA, 11 nt, Shigella flexneri 2a str. 301
auugccaguaa

SEQ ID NO: 3886913 - RNA, 23 nt, Shigella flexneri 2a str. 301
auugccaguaacagaacgcauaa

SEQ ID NO: 3886914 - RNA, 23 nt, Shigella flexneri 2a str. 301
auugccauauacgccaucgccag

SEQ ID NO: 3886915 - RNA, 17 nt, Shigella flexneri 2a str. 301
auugccccacaccgcga

SEQ ID NO: 3886916 - RNA, 17 nt, Shigella flexneri 2a str. 301
auugccccagaugccag

SEQ ID NO: 3886917 - RNA, 20 nt, Shigella flexneri 2a str. 301
auugcccgaugcgcaaacuu

SEQ ID NO: 3886918 - RNA, 22 nt, Shigella flexneri 2a str. 301
auugcccggucaggauggccgg

SEQ ID NO: 3886919 - RNA, 16 nt, Shigella flexneri 2a str. 301
auugccgaagaccaga

SEQ ID NO: 3886920 - RNA, 16 nt, Shigella flexneri 2a str. 301
auugccgaugaacggc

SEQ ID NO: 3886921 - RNA, 17 nt, Shigella flexneri 2a str. 301
auugccgaugaacggcg

SEQ ID NO: 3886922 - RNA, 15 nt, Shigella flexneri 2a str. 301
auugccgcagcgauu

SEQ ID NO: 3886923 - RNA, 16 nt, Shigella flexneri 2a str. 301
auugccgccagcucac

SEQ ID NO: 3886924 - RNA, 15 nt, Shigella flexneri 2a str. 301
auugccgccucugcc

SEQ ID NO: 3886925 - RNA, 20 nt, Shigella flexneri 2a str. 301
auugccgcgucguccucuuc

SEQ ID NO: 3886926 - RNA, 23 nt, Shigella flexneri 2a str. 301
auugccgcgucguccucuucacc

SEQ ID NO: 3886927 - RNA, 12 nt, Shigella flexneri 2a str. 301
auugccggaaug

SEQ ID NO: 3886928 - RNA, 12 nt, Shigella flexneri 2a str. 301
auugccggaugc

SEQ ID NO: 3886929 - RNA, 19 nt, Shigella flexneri 2a str. 301
auugccggaugcggcguaa

SEQ ID NO: 3886930 - RNA, 18 nt, Shigella flexneri 2a str. 301
auugccgggcgcaucaga

SEQ ID NO: 3886931 - RNA, 22 nt, Shigella flexneri 2a str. 301
auugccgggcgcaucagaucgu

SEQ ID NO: 3886932 - RNA, 18 nt, Shigella flexneri 2a str. 301
auugccgggugcaagagu

SEQ ID NO: 3886933 - RNA, 19 nt, Shigella flexneri 2a str. 301
auugccguuucgcagguuc

SEQ ID NO: 3886934 - RNA, 22 nt, Shigella flexneri 2a str. 301
auugccugaucgcgcaaacagu

SEQ ID NO: 3886935 - RNA, 16 nt, Shigella flexneri 2a str. 301
auugccugauggccug

SEQ ID NO: 3886936 - RNA, 22 nt, Shigella flexneri 2a str. 301
auugccuuccaccagauggcuu

SEQ ID NO: 3886937 - RNA, 14 nt, Shigella flexneri 2a str. 301
auugcgacgagaaa

SEQ ID NO: 3886938 - RNA, 23 nt, Shigella flexneri 2a str. 301
auugcgcaacugaggcaauaaug

SEQ ID NO: 3886939 - RNA, 21 nt, Shigella flexneri 2a str. 301
auugcgcacaagcuaccagcc

SEQ ID NO: 3886940 - RNA, 16 nt, Shigella flexneri 2a str. 301
auugcgcaccagcuug

SEQ ID NO: 3886941 - RNA, 18 nt, Shigella flexneri 2a str. 301
auugcgcagagaugccca

SEQ ID NO: 3886942 - RNA, 19 nt, Shigella flexneri 2a str. 301
auugcgcagagaugcccau

SEQ ID NO: 3886943 - RNA, 22 nt, Shigella flexneri 2a str. 301
auugcgcaggcgcgcguaaauu

SEQ ID NO: 3886944 - RNA, 23 nt, Shigella flexneri 2a str. 301
auugcgccagagcgcggcgugaa

SEQ ID NO: 3886945 - RNA, 14 nt, Shigella flexneri 2a str. 301
auugcgccagcaca

SEQ ID NO: 3886946 - RNA, 14 nt, Shigella flexneri 2a str. 301
auugcgccugcagg

SEQ ID NO: 3886947 - RNA, 18 nt, Shigella flexneri 2a str. 301
auugcgcgacuuuuuccu

SEQ ID NO: 3886948 - RNA, 14 nt, Shigella flexneri 2a str. 301
auuuacuucugcug

SEQ ID NO: 3886949 - RNA, 15 nt, Shigella flexneri 2a str. 301
auuuagcaaauuuuu

SEQ ID NO: 3886950 - RNA, 20 nt, Shigella flexneri 2a str. 301
auuuauaaucuuuaaaaaaa

SEQ ID NO: 3886951 - RNA, 12 nt, Shigella flexneri 2a str. 301
auuuauaucagu

SEQ ID NO: 3886952 - RNA, 15 nt, Shigella flexneri 2a str. 301
auuuaucgacugcca

SEQ ID NO: 3886953 - RNA, 12 nt, Shigella flexneri 2a str. 301
auuuaucuuccc

SEQ ID NO: 3886954 - RNA, 21 nt, Shigella flexneri 2a str. 301
auuuaucuuugauugaagaaa

SEQ ID NO: 3886955 - RNA, 13 nt, Shigella flexneri 2a str. 301
auuuaugacaaac

SEQ ID NO: 3886956 - RNA, 14 nt, Shigella flexneri 2a str. 301
auuuaugauauuuu

SEQ ID NO: 3886957 - RNA, 21 nt, Shigella flexneri 2a str. 301
auuuaugcuguccuaaaaaau

SEQ ID NO: 3886958 - RNA, 18 nt, Shigella flexneri 2a str. 301
auuuauuaccuuuuuacc

SEQ ID NO: 3886959 - RNA, 15 nt, Shigella flexneri 2a str. 301
auuuauucccgccag

SEQ ID NO: 3886960 - RNA, 14 nt, Shigella flexneri 2a str. 301
auuuauugacaauc

SEQ ID NO: 3886961 - RNA, 13 nt, Shigella flexneri 2a str. 301
auuuauuucucac

SEQ ID NO: 3886962 - RNA, 15 nt, Shigella flexneri 2a str. 301
auuuauuugcaaagu

SEQ ID NO: 3886963 - RNA, 12 nt, Shigella flexneri 2a str. 301
auuuauuuucca

SEQ ID NO: 3886964 - RNA, 21 nt, Shigella flexneri 2a str. 301
auuuauuuuccaaaauaaaaa

SEQ ID NO: 3886965 - RNA, 18 nt, Shigella flexneri 2a str. 301
auuucaacagguuuuguu

SEQ ID NO: 3886966 - RNA, 22 nt, Shigella flexneri 2a str. 301
auuucaauaucgccuuuugccc

SEQ ID NO: 3886967 - RNA, 20 nt, Shigella flexneri 2a str. 301
auuucaauaucguuaucacc

SEQ ID NO: 3886968 - RNA, 20 nt, Shigella flexneri 2a str. 301
auuucaauaugauaaaccuc

SEQ ID NO: 3886969 - RNA, 19 nt, Shigella flexneri 2a str. 301
auuucaaugcauuaucaga

SEQ ID NO: 3886970 - RNA, 22 nt, Shigella flexneri 2a str. 301
auuucacaacgguccgguugca

SEQ ID NO: 3886971 - RNA, 15 nt, Shigella flexneri 2a str. 301
auuucacacauauca

SEQ ID NO: 3886972 - RNA, 19 nt, Shigella flexneri 2a str. 301
auuucacaguaaugauuua

SEQ ID NO: 3886973 - RNA, 18 nt, Shigella flexneri 2a str. 301
auuucacaguacgcuuga

SEQ ID NO: 3886974 - RNA, 15 nt, Shigella flexneri 2a str. 301
auuucaccagcgcac

SEQ ID NO: 3886975 - RNA, 13 nt, Shigella flexneri 2a str. 301
auuucaccaucuu

SEQ ID NO: 3886976 - RNA, 13 nt, Shigella flexneri 2a str. 301
auuucacugccuu

SEQ ID NO: 3886977 - RNA, 17 nt, Shigella flexneri 2a str. 301
auuucacuucaaccaca

SEQ ID NO: 3886978 - RNA, 22 nt, Shigella flexneri 2a str. 301
auuucagaacaguuuucagugc

SEQ ID NO: 3886979 - RNA, 16 nt, Shigella flexneri 2a str. 301
auuucagcaagacaau

SEQ ID NO: 3886980 - RNA, 16 nt, Shigella flexneri 2a str. 301
auuucagcguacaaua

SEQ ID NO: 3886981 - RNA, 14 nt, Shigella flexneri 2a str. 301
auuucauauucaaa

SEQ ID NO: 3886982 - RNA, 14 nt, Shigella flexneri 2a str. 301
auuucauccaugcc

SEQ ID NO: 3886983 - RNA, 21 nt, Shigella flexneri 2a str. 301
auuucaucgccagcgaauucc

SEQ ID NO: 3886984 - RNA, 23 nt, Shigella flexneri 2a str. 301
auuucauggcggaaaucagagau

SEQ ID NO: 3886985 - RNA, 22 nt, Shigella flexneri 2a str. 301
auuucauuaagaacuccugaaa

SEQ ID NO: 3886986 - RNA, 14 nt, Shigella flexneri 2a str. 301
auuucauuaauauc

SEQ ID NO: 3886987 - RNA, 21 nt, Shigella flexneri 2a str. 301
auuucauuguccgucugaaaa

SEQ ID NO: 3886988 - RNA, 19 nt, Shigella flexneri 2a str. 301
auuucauuuuuuaauuugg

SEQ ID NO: 3886989 - RNA, 21 nt, Shigella flexneri 2a str. 301
auuuccacccagccgucacga

SEQ ID NO: 3886990 - RNA, 13 nt, Shigella flexneri 2a str. 301
auuuccaccgcua

SEQ ID NO: 3886991 - RNA, 23 nt, Shigella flexneri 2a str. 301
auuuccacgccaagcucauaacg

SEQ ID NO: 3886992 - RNA, 17 nt, Shigella flexneri 2a str. 301
auuuccagggccucucc

SEQ ID NO: 3886993 - RNA, 22 nt, Shigella flexneri 2a str. 301
auuuccagggccucuccuuuac

SEQ ID NO: 3886994 - RNA, 19 nt, Shigella flexneri 2a str. 301
auuuccaguccagcugccg

SEQ ID NO: 3886995 - RNA, 15 nt, Shigella flexneri 2a str. 301
auuuccauaccuaaa

SEQ ID NO: 3886996 - RNA, 17 nt, Shigella flexneri 2a str. 301
auuuccauaccuaaaaa

SEQ ID NO: 3886997 - RNA, 16 nt, Shigella flexneri 2a str. 301
auuuccaucuccagcu

SEQ ID NO: 3886998 - RNA, 21 nt, Shigella flexneri 2a str. 301
auuuccaucuccagcugcucg

SEQ ID NO: 3886999 - RNA, 19 nt, Shigella flexneri 2a str. 301
auuuccauugcucuggcaa

SEQ ID NO: 3887000 - RNA, 20 nt, Shigella flexneri 2a str. 301
auuuccauugcucuggcaaa

SEQ ID NO: 3887001 - RNA, 12 nt, Shigella flexneri 2a str. 301
auuucccacucu

SEQ ID NO: 3887002 - RNA, 19 nt, Shigella flexneri 2a str. 301
auuucccagcaagaaccau

SEQ ID NO: 3887003 - RNA, 22 nt, Shigella flexneri 2a str. 301
auuucccagcaagaaccaugca

SEQ ID NO: 3887004 - RNA, 20 nt, Shigella flexneri 2a str. 301
auuucccgcacguuggcggu

SEQ ID NO: 3887005 - RNA, 13 nt, Shigella flexneri 2a str. 301
auuucccgcucau

SEQ ID NO: 3887006 - RNA, 16 nt, Shigella flexneri 2a str. 301
auuucccggcacauac

SEQ ID NO: 3887007 - RNA, 15 nt, Shigella flexneri 2a str. 301
auuuccgccaaucaa

SEQ ID NO: 3887008 - RNA, 15 nt, Shigella flexneri 2a str. 301
auuuccgccaccuga

SEQ ID NO: 3887009 - RNA, 22 nt, Shigella flexneri 2a str. 301
auuuccgccaccugauccaucg

SEQ ID NO: 3887010 - RNA, 13 nt, Shigella flexneri 2a str. 301
auuuccgcugauu

SEQ ID NO: 3887011 - RNA, 23 nt, Shigella flexneri 2a str. 301
auuuccggauacgguuuuuugaa

SEQ ID NO: 3887012 - RNA, 21 nt, Shigella flexneri 2a str. 301
auuuccggcggcggaaaguau

SEQ ID NO: 3887013 - RNA, 16 nt, Shigella flexneri 2a str. 301
auuuccgguacuggcu

SEQ ID NO: 3887014 - RNA, 20 nt, Shigella flexneri 2a str. 301
auuuccguuaaccuaaagcc

SEQ ID NO: 3887015 - RNA, 13 nt, Shigella flexneri 2a str. 301
auuuccguuugcg

SEQ ID NO: 3887016 - RNA, 22 nt, Shigella flexneri 2a str. 301
auuuccugccagaccuuaucac

SEQ ID NO: 3887017 - RNA, 23 nt, Shigella flexneri 2a str. 301
auuuccugcgugacuaaaacccu

SEQ ID NO: 3887018 - RNA, 15 nt, Shigella flexneri 2a str. 301
auuuccuguaacacu

SEQ ID NO: 3887019 - RNA, 15 nt, Shigella flexneri 2a str. 301
auuuccuucagcagc

SEQ ID NO: 3887020 - RNA, 20 nt, Shigella flexneri 2a str. 301
auuuccuuugguuauucuuu

SEQ ID NO: 3887021 - RNA, 21 nt, Shigella flexneri 2a str. 301
auuuccuuugguuauucuuug

SEQ ID NO: 3887022 - RNA, 20 nt, Shigella flexneri 2a str. 301
auuucgaagaaaccgaugac

SEQ ID NO: 3887023 - RNA, 23 nt, Shigella flexneri 2a str. 301
auuucgagaaugucgauaaaguu

SEQ ID NO: 3887024 - RNA, 20 nt, Shigella flexneri 2a str. 301
auuucgauagacucccagcc

SEQ ID NO: 3887025 - RNA, 14 nt, Shigella flexneri 2a str. 301
auuucgcuaccacc

SEQ ID NO: 3887026 - RNA, 19 nt, Shigella flexneri 2a str. 301
auuucgcuuucaucgauuu

SEQ ID NO: 3887027 - RNA, 21 nt, Shigella flexneri 2a str. 301
auuucggcagcgcgcucgcca

SEQ ID NO: 3887028 - RNA, 21 nt, Shigella flexneri 2a str. 301
auuucgucauccggugugaug

SEQ ID NO: 3887029 - RNA, 20 nt, Shigella flexneri 2a str. 301
auuucguccagcgaaccuuc

SEQ ID NO: 3887030 - RNA, 19 nt, Shigella flexneri 2a str. 301
auuucguuggcucgcucca

SEQ ID NO: 3887031 - RNA, 15 nt, Shigella flexneri 2a str. 301
auuucuaauagccau

SEQ ID NO: 3887032 - RNA, 17 nt, Shigella flexneri 2a str. 301
auuucuacacccagccc

SEQ ID NO: 3887033 - RNA, 12 nt, Shigella flexneri 2a str. 301
auuucucccccc

SEQ ID NO: 3887034 - RNA, 21 nt, Shigella flexneri 2a str. 301
auuucuccccccucugauugg

SEQ ID NO: 3887035 - RNA, 15 nt, Shigella flexneri 2a str. 301
auuucucgugccacc

SEQ ID NO: 3887036 - RNA, 18 nt, Shigella flexneri 2a str. 301
auuucucguuggucauca

SEQ ID NO: 3887037 - RNA, 20 nt, Shigella flexneri 2a str. 301
auuucucguuggucaucacu

SEQ ID NO: 3887038 - RNA, 17 nt, Shigella flexneri 2a str. 301
auuucugccuugaguuu

SEQ ID NO: 3887039 - RNA, 19 nt, Shigella flexneri 2a str. 301
auuucugccuugaguuuuu

SEQ ID NO: 3887040 - RNA, 18 nt, Shigella flexneri 2a str. 301
auuucugcgggggcggca

SEQ ID NO: 3887041 - RNA, 19 nt, Shigella flexneri 2a str. 301
auuucuggcggcuuauaua

SEQ ID NO: 3887042 - RNA, 22 nt, Shigella flexneri 2a str. 301
auuucuggcggcuuauauauua

SEQ ID NO: 3887043 - RNA, 16 nt, Shigella flexneri 2a str. 301
auuucuuauuacagau

SEQ ID NO: 3887044 - RNA, 17 nt, Shigella flexneri 2a str. 301
auuucuucauacuaccu

SEQ ID NO: 3887045 - RNA, 22 nt, Shigella flexneri 2a str. 301
auuucuucaucgguauaaccaa

SEQ ID NO: 3887046 - RNA, 13 nt, Shigella flexneri 2a str. 301
auuucuucugguu

SEQ ID NO: 3887047 - RNA, 14 nt, Shigella flexneri 2a str. 301
auuuuuuuucaacc

SEQ ID NO: 3887048 - RNA, 16 nt, Shigella flexneri 2a str. 301
auuuuuuuucaggaaa

SEQ ID NO: 3887049 - RNA, 12 nt, Shigella flexneri 2a str. 301
caaaaaaaaauc

SEQ ID NO: 3887050 - RNA, 19 nt, Shigella flexneri 2a str. 301
caaaaaaagaauucagacc

SEQ ID NO: 3887051 - RNA, 21 nt, Shigella flexneri 2a str. 301
caaaaaacaaaccccguacag

SEQ ID NO: 3887052 - RNA, 12 nt, Shigella flexneri 2a str. 301
caaaaaagaggg

SEQ ID NO: 3887053 - RNA, 23 nt, Shigella flexneri 2a str. 301
caaaaaagccaaucacaaaaagu

SEQ ID NO: 3887054 - RNA, 19 nt, Shigella flexneri 2a str. 301
caaaaaaggccgcaggcug

SEQ ID NO: 3887055 - RNA, 17 nt, Shigella flexneri 2a str. 301
caaaaaaggcugacaaa

SEQ ID NO: 3887056 - RNA, 20 nt, Shigella flexneri 2a str. 301
caaaaaaggcugacaaauca

SEQ ID NO: 3887057 - RNA, 16 nt, Shigella flexneri 2a str. 301
caaaaaaggugcugaa

SEQ ID NO: 3887058 - RNA, 19 nt, Shigella flexneri 2a str. 301
caaaaaaucaacgacaaaa

SEQ ID NO: 3887059 - RNA, 13 nt, Shigella flexneri 2a str. 301
caaaaacaaagaa

SEQ ID NO: 3887060 - RNA, 19 nt, Shigella flexneri 2a str. 301
caaaaacauugccguaagc

SEQ ID NO: 3887061 - RNA, 15 nt, Shigella flexneri 2a str. 301
caaaaacccugccgu

SEQ ID NO: 3887062 - RNA, 20 nt, Shigella flexneri 2a str. 301
caaaaaccgcugauuccugc

SEQ ID NO: 3887063 - RNA, 12 nt, Shigella flexneri 2a str. 301
caaaaacgccau

SEQ ID NO: 3887064 - RNA, 21 nt, Shigella flexneri 2a str. 301
caaaaacuaauucaccuugcu

SEQ ID NO: 3887065 - RNA, 15 nt, Shigella flexneri 2a str. 301
caaaaagcgggcgac

SEQ ID NO: 3887066 - RNA, 21 nt, Shigella flexneri 2a str. 301
caaaaaguaguuccagcauga

SEQ ID NO: 3887067 - RNA, 17 nt, Shigella flexneri 2a str. 301
caaaaaguccaaaaggu

SEQ ID NO: 3887068 - RNA, 13 nt, Shigella flexneri 2a str. 301
caaaaauaaaugc

SEQ ID NO: 3887069 - RNA, 12 nt, Shigella flexneri 2a str. 301
caaaaaucgaca

SEQ ID NO: 3887070 - RNA, 12 nt, Shigella flexneri 2a str. 301
caaaaaucggca

SEQ ID NO: 3887071 - RNA, 21 nt, Shigella flexneri 2a str. 301
caaaaaucggcaacauuaaau

SEQ ID NO: 3887072 - RNA, 23 nt, Shigella flexneri 2a str. 301
caaaaauugcgcgacuuuuuccu

SEQ ID NO: 3887073 - RNA, 12 nt, Shigella flexneri 2a str. 301
caaaacaacaca

SEQ ID NO: 3887074 - RNA, 15 nt, Shigella flexneri 2a str. 301
caaaacacucuucaa

SEQ ID NO: 3887075 - RNA, 23 nt, Shigella flexneri 2a str. 301
caaaacacucuucaacacacuga

SEQ ID NO: 3887076 - RNA, 14 nt, Shigella flexneri 2a str. 301
caaaacagcgacac

SEQ ID NO: 3887077 - RNA, 19 nt, Shigella flexneri 2a str. 301
caaaacagcgacaccagcc

SEQ ID NO: 3887078 - RNA, 21 nt, Shigella flexneri 2a str. 301
caaaacagcgacaccagccau

SEQ ID NO: 3887079 - RNA, 20 nt, Shigella flexneri 2a str. 301
caaaaccacagugacccgca

SEQ ID NO: 3887080 - RNA, 23 nt, Shigella flexneri 2a str. 301
caaaaccaucaauccacuucgcc

SEQ ID NO: 3887081 - RNA, 20 nt, Shigella flexneri 2a str. 301
caaaaccgagaagcuuaccg

SEQ ID NO: 3887082 - RNA, 22 nt, Shigella flexneri 2a str. 301
caaaaccgauuaauugccgcca

SEQ ID NO: 3887083 - RNA, 18 nt, Shigella flexneri 2a str. 301
caaaaccgguucugccgc

SEQ ID NO: 3887084 - RNA, 20 nt, Shigella flexneri 2a str. 301
caaaaccguucgaacuggau

SEQ ID NO: 3887085 - RNA, 14 nt, Shigella flexneri 2a str. 301
caaaaccucuucca

SEQ ID NO: 3887086 - RNA, 21 nt, Shigella flexneri 2a str. 301
caaaaccucuuccagcagaua

SEQ ID NO: 3887087 - RNA, 17 nt, Shigella flexneri 2a str. 301
caaaacgaauaauugcu

SEQ ID NO: 3887088 - RNA, 16 nt, Shigella flexneri 2a str. 301
caaaacgcaccacuuc

SEQ ID NO: 3887089 - RNA, 18 nt, Shigella flexneri 2a str. 301
caaaacgcgacugcaaaa

SEQ ID NO: 3887090 - RNA, 21 nt, Shigella flexneri 2a str. 301
caaaacgcgcaaccagcaggc

SEQ ID NO: 3887091 - RNA, 13 nt, Shigella flexneri 2a str. 301
caaaacgcucuga

SEQ ID NO: 3887092 - RNA, 15 nt, Shigella flexneri 2a str. 301
caaaacggucacggc

SEQ ID NO: 3887093 - RNA, 18 nt, Shigella flexneri 2a str. 301
caaaacgugcagcugccu

SEQ ID NO: 3887094 - RNA, 19 nt, Shigella flexneri 2a str. 301
caaaacuggugguaagaau

SEQ ID NO: 3887095 - RNA, 14 nt, Shigella flexneri 2a str. 301
caaaagaacacgac

SEQ ID NO: 3887096 - RNA, 18 nt, Shigella flexneri 2a str. 301
caaaagaugagaaaaauc

SEQ ID NO: 3887097 - RNA, 18 nt, Shigella flexneri 2a str. 301
caaaagcaauaauuucaa

SEQ ID NO: 3887098 - RNA, 18 nt, Shigella flexneri 2a str. 301
caaaaggcaauucaauua

SEQ ID NO: 3887099 - RNA, 14 nt, Shigella flexneri 2a str. 301
caaaagggagcuau

SEQ ID NO: 3887100 - RNA, 15 nt, Shigella flexneri 2a str. 301
caaaagguccuucag

SEQ ID NO: 3887101 - RNA, 13 nt, Shigella flexneri 2a str. 301
caaaauaaaaauc

SEQ ID NO: 3887102 - RNA, 23 nt, Shigella flexneri 2a str. 301
caaaauaauaaauuaacugcgcg

SEQ ID NO: 3887103 - RNA, 16 nt, Shigella flexneri 2a str. 301
caaaauaauacacaca

SEQ ID NO: 3887104 - RNA, 14 nt, Shigella flexneri 2a str. 301
caaaauacuguuua

SEQ ID NO: 3887105 - RNA, 23 nt, Shigella flexneri 2a str. 301
caaaauacuguuuaucuucccag

SEQ ID NO: 3887106 - RNA, 19 nt, Shigella flexneri 2a str. 301
caaaauagccaaucauucc

SEQ ID NO: 3887107 - RNA, 17 nt, Shigella flexneri 2a str. 301
caaaauagguaucguaa

SEQ ID NO: 3887108 - RNA, 14 nt, Shigella flexneri 2a str. 301
caaaaucacuggcg

SEQ ID NO: 3887109 - RNA, 21 nt, Shigella flexneri 2a str. 301
caaaaucaggccgaggcacag

SEQ ID NO: 3887110 - RNA, 11 nt, Shigella flexneri 2a str. 301
caaaaucauca

SEQ ID NO: 3887111 - RNA, 20 nt, Shigella flexneri 2a str. 301
caaaaucaucaucuuuauau

SEQ ID NO: 3887112 - RNA, 14 nt, Shigella flexneri 2a str. 301
caaaauccaccagu

SEQ ID NO: 3887113 - RNA, 19 nt, Shigella flexneri 2a str. 301
caaaauccauuuucuauuu

SEQ ID NO: 3887114 - RNA, 19 nt, Shigella flexneri 2a str. 301
caaaaucccacugccaauc

SEQ ID NO: 3887115 - RNA, 12 nt, Shigella flexneri 2a str. 301
caaaaucuauug

SEQ ID NO: 3887116 - RNA, 16 nt, Shigella flexneri 2a str. 301
caaaaucuugcaaaau

SEQ ID NO: 3887117 - RNA, 22 nt, Shigella flexneri 2a str. 301
caaaaugauugcguuaacugcu

SEQ ID NO: 3887118 - RNA, 21 nt, Shigella flexneri 2a str. 301
caaaaugcugcaauugcggca

SEQ ID NO: 3887119 - RNA, 13 nt, Shigella flexneri 2a str. 301
caaaauguuuaug

SEQ ID NO: 3887120 - RNA, 15 nt, Shigella flexneri 2a str. 301
caaaauuagcucgga

SEQ ID NO: 3887121 - RNA, 14 nt, Shigella flexneri 2a str. 301
caaaauuaucacaa

SEQ ID NO: 3887122 - RNA, 12 nt, Shigella flexneri 2a str. 301
caaaauuauucc

SEQ ID NO: 3887123 - RNA, 19 nt, Shigella flexneri 2a str. 301
caaaauugcuguuacgcca

SEQ ID NO: 3887124 - RNA, 22 nt, Shigella flexneri 2a str. 301
caaaauuuaacaccaucauauu

SEQ ID NO: 3887125 - RNA, 21 nt, Shigella flexneri 2a str. 301
caaaauuuagcaaauuuuuaa

SEQ ID NO: 3887126 - RNA, 15 nt, Shigella flexneri 2a str. 301
caaacaaaagggcga

SEQ ID NO: 3887127 - RNA, 15 nt, Shigella flexneri 2a str. 301
caaacaacgccucgu

SEQ ID NO: 3887128 - RNA, 14 nt, Shigella flexneri 2a str. 301
caaacaauuuucau

SEQ ID NO: 3887129 - RNA, 23 nt, Shigella flexneri 2a str. 301
caaacaauuuucauugaaaaagu

SEQ ID NO: 3887130 - RNA, 17 nt, Shigella flexneri 2a str. 301
caaacacaaaacugccu

SEQ ID NO: 3887131 - RNA, 16 nt, Shigella flexneri 2a str. 301
caaacacaauauucau

SEQ ID NO: 3887132 - RNA, 19 nt, Shigella flexneri 2a str. 301
caaacacaggcaaaacacu

SEQ ID NO: 3887133 - RNA, 15 nt, Shigella flexneri 2a str. 301
caaacacaucaauga

SEQ ID NO: 3887134 - RNA, 12 nt, Shigella flexneri 2a str. 301
caaacaccagcg

SEQ ID NO: 3887135 - RNA, 18 nt, Shigella flexneri 2a str. 301
caaacaccgaaccagaga

SEQ ID NO: 3887136 - RNA, 21 nt, Shigella flexneri 2a str. 301
caaacacgccgacgggucagc

SEQ ID NO: 3887137 - RNA, 22 nt, Shigella flexneri 2a str. 301
caaacacugaaccgaaauggcu

SEQ ID NO: 3887138 - RNA, 16 nt, Shigella flexneri 2a str. 301
caaacagaauauugug

SEQ ID NO: 3887139 - RNA, 12 nt, Shigella flexneri 2a str. 301
caaacagaccau

SEQ ID NO: 3887140 - RNA, 17 nt, Shigella flexneri 2a str. 301
caaacagacuggcaacg

SEQ ID NO: 3887141 - RNA, 13 nt, Shigella flexneri 2a str. 301
caaacagcagaac

SEQ ID NO: 3887142 - RNA, 16 nt, Shigella flexneri 2a str. 301
caaacagcagaacgac

SEQ ID NO: 3887143 - RNA, 21 nt, Shigella flexneri 2a str. 301
caaacagcgcgccagccacca

SEQ ID NO: 3887144 - RNA, 17 nt, Shigella flexneri 2a str. 301
caaacagggugcagcga

SEQ ID NO: 3887145 - RNA, 17 nt, Shigella flexneri 2a str. 301
caaacagucgcccgacc

SEQ ID NO: 3887146 - RNA, 23 nt, Shigella flexneri 2a str. 301
caaacaguguuuugacauuggca

SEQ ID NO: 3887147 - RNA, 21 nt, Shigella flexneri 2a str. 301
caaauagugccuggcugcgug

SEQ ID NO: 3887148 - RNA, 20 nt, Shigella flexneri 2a str. 301
caaauauacauaaagucuuu

SEQ ID NO: 3887149 - RNA, 15 nt, Shigella flexneri 2a str. 301
caaauauuaauaaua

SEQ ID NO: 3887150 - RNA, 17 nt, Shigella flexneri 2a str. 301
caaaucaaugguguuau

SEQ ID NO: 3887151 - RNA, 20 nt, Shigella flexneri 2a str. 301
caaaucacuauuaaagaaag

SEQ ID NO: 3887152 - RNA, 19 nt, Shigella flexneri 2a str. 301
caaaucaguggcuggaaca

SEQ ID NO: 3887153 - RNA, 14 nt, Shigella flexneri 2a str. 301
caaaucauaaaaau

SEQ ID NO: 3887154 - RNA, 14 nt, Shigella flexneri 2a str. 301
caaaucaucaguac

SEQ ID NO: 3887155 - RNA, 20 nt, Shigella flexneri 2a str. 301
caaaucauccagaccgcuca

SEQ ID NO: 3887156 - RNA, 12 nt, Shigella flexneri 2a str. 301
caaauccagcgc

SEQ ID NO: 3887157 - RNA, 14 nt, Shigella flexneri 2a str. 301
caaauccagcgcca

SEQ ID NO: 3887158 - RNA, 17 nt, Shigella flexneri 2a str. 301
caaauccagcgccacau

SEQ ID NO: 3887159 - RNA, 18 nt, Shigella flexneri 2a str. 301
caaauccaucagaccuuc

SEQ ID NO: 3887160 - RNA, 14 nt, Shigella flexneri 2a str. 301
caaauccgcacuca

SEQ ID NO: 3887161 - RNA, 15 nt, Shigella flexneri 2a str. 301
caaauccgcuguaau

SEQ ID NO: 3887162 - RNA, 18 nt, Shigella flexneri 2a str. 301
caaauccggccagcgccg

SEQ ID NO: 3887163 - RNA, 16 nt, Shigella flexneri 2a str. 301
caaauccuuccagcuc

SEQ ID NO: 3887164 - RNA, 14 nt, Shigella flexneri 2a str. 301
caaaucgaaaucaa

SEQ ID NO: 3887165 - RNA, 15 nt, Shigella flexneri 2a str. 301
caaaucgcggcagug

SEQ ID NO: 3887166 - RNA, 13 nt, Shigella flexneri 2a str. 301
caaaucgcugaau

SEQ ID NO: 3887167 - RNA, 15 nt, Shigella flexneri 2a str. 301
caaaucggaacaaca

SEQ ID NO: 3887168 - RNA, 16 nt, Shigella flexneri 2a str. 301
caaaucguauccggca

SEQ ID NO: 3887169 - RNA, 18 nt, Shigella flexneri 2a str. 301
caaaucgucgguguccac

SEQ ID NO: 3887170 - RNA, 23 nt, Shigella flexneri 2a str. 301
caaaucgucgguguccacuuccg

SEQ ID NO: 3887171 - RNA, 17 nt, Shigella flexneri 2a str. 301
caaaucuucgucgugaa

SEQ ID NO: 3887172 - RNA, 14 nt, Shigella flexneri 2a str. 301
caaaugaacaccaa

SEQ ID NO: 3887173 - RNA, 15 nt, Shigella flexneri 2a str. 301
caaaugaacaccaaa

SEQ ID NO: 3887174 - RNA, 14 nt, Shigella flexneri 2a str. 301
caaaugaaugccaa

SEQ ID NO: 3887175 - RNA, 17 nt, Shigella flexneri 2a str. 301
caaaugcagcauugccu

SEQ ID NO: 3887176 - RNA, 15 nt, Shigella flexneri 2a str. 301
caaaugcaucaguga

SEQ ID NO: 3887177 - RNA, 21 nt, Shigella flexneri 2a str. 301
caaaugcaucagugacaaauu

SEQ ID NO: 3887178 - RNA, 17 nt, Shigella flexneri 2a str. 301
caaaugccagauaagac

SEQ ID NO: 3887179 - RNA, 18 nt, Shigella flexneri 2a str. 301
caaaugccagauaagaca

SEQ ID NO: 3887180 - RNA, 13 nt, Shigella flexneri 2a str. 301
caaaugcgcagcc

SEQ ID NO: 3887181 - RNA, 14 nt, Shigella flexneri 2a str. 301
caaaugcgccgcca

SEQ ID NO: 3887182 - RNA, 15 nt, Shigella flexneri 2a str. 301
caaaugcgccgccaa

SEQ ID NO: 3887183 - RNA, 21 nt, Shigella flexneri 2a str. 301
caaaugcgcuuuauucagacg

SEQ ID NO: 3887184 - RNA, 11 nt, Shigella flexneri 2a str. 301
caaauggcgcu

SEQ ID NO: 3887185 - RNA, 22 nt, Shigella flexneri 2a str. 301
caaauguaaaaccaacaguauc

SEQ ID NO: 3887186 - RNA, 15 nt, Shigella flexneri 2a str. 301
caaaugucaccagcc

SEQ ID NO: 3887187 - RNA, 17 nt, Shigella flexneri 2a str. 301
caaaugucaccagccga

SEQ ID NO: 3887188 - RNA, 23 nt, Shigella flexneri 2a str. 301
caaauguggcgguuaccuuggca

SEQ ID NO: 3887189 - RNA, 22 nt, Shigella flexneri 2a str. 301
caaauguugcaucgccugcgcg

SEQ ID NO: 3887190 - RNA, 15 nt, Shigella flexneri 2a str. 301
caaauuauccacggc

SEQ ID NO: 3887191 - RNA, 14 nt, Shigella flexneri 2a str. 301
caaauuauccccca

SEQ ID NO: 3887192 - RNA, 16 nt, Shigella flexneri 2a str. 301
caaauucaauauauug

SEQ ID NO: 3887193 - RNA, 19 nt, Shigella flexneri 2a str. 301
caaauucauugcguaacau

SEQ ID NO: 3887194 - RNA, 19 nt, Shigella flexneri 2a str. 301
caaauucuuuaucgauaaa

SEQ ID NO: 3887195 - RNA, 16 nt, Shigella flexneri 2a str. 301
caaauugacuacacca

SEQ ID NO: 3887196 - RNA, 22 nt, Shigella flexneri 2a str. 301
caaauugcaccauccauuuuuc

SEQ ID NO: 3887197 - RNA, 16 nt, Shigella flexneri 2a str. 301
caaauugcugguauuu

SEQ ID NO: 3887198 - RNA, 16 nt, Shigella flexneri 2a str. 301
caaauuuaaacgacaa

SEQ ID NO: 3887199 - RNA, 21 nt, Shigella flexneri 2a str. 301
caaauuuggcaucgaggaucu

SEQ ID NO: 3887200 - RNA, 17 nt, Shigella flexneri 2a str. 301
caaauuuugaacagaac

SEQ ID NO: 3887201 - RNA, 19 nt, Shigella flexneri 2a str. 301
caacaaaaaacggaaagca

SEQ ID NO: 3887202 - RNA, 19 nt, Shigella flexneri 2a str. 301
caacaaaaaucucgacuuc

SEQ ID NO: 3887203 - RNA, 15 nt, Shigella flexneri 2a str. 301
caacaaacgauuuau

SEQ ID NO: 3887204 - RNA, 13 nt, Shigella flexneri 2a str. 301
caacaaaguugca

SEQ ID NO: 3887205 - RNA, 14 nt, Shigella flexneri 2a str. 301
caacaacacauuca

SEQ ID NO: 3887206 - RNA, 12 nt, Shigella flexneri 2a str. 301
caacaacaccca

SEQ ID NO: 3887207 - RNA, 14 nt, Shigella flexneri 2a str. 301
caacaacacccaug

SEQ ID NO: 3887208 - RNA, 18 nt, Shigella flexneri 2a str. 301
caacaacagucucugccg

SEQ ID NO: 3887209 - RNA, 23 nt, Shigella flexneri 2a str. 301
caacaacaucacaccugcucagc

SEQ ID NO: 3887210 - RNA, 17 nt, Shigella flexneri 2a str. 301
caacaaccagaagguga

SEQ ID NO: 3887211 - RNA, 16 nt, Shigella flexneri 2a str. 301
caacaacugaaaaaaa

SEQ ID NO: 3887212 - RNA, 10 nt, Shigella flexneri 2a str. 301
caacaacugg

SEQ ID NO: 3887213 - RNA, 14 nt, Shigella flexneri 2a str. 301
caacaacuggugcg

SEQ ID NO: 3887214 - RNA, 17 nt, Shigella flexneri 2a str. 301
caacaaggguaugcugu

SEQ ID NO: 3887215 - RNA, 13 nt, Shigella flexneri 2a str. 301
caacaauaaaauu

SEQ ID NO: 3887216 - RNA, 15 nt, Shigella flexneri 2a str. 301
caacaauaaaauuga

SEQ ID NO: 3887217 - RNA, 14 nt, Shigella flexneri 2a str. 301
caacaauacaaaug

SEQ ID NO: 3887218 - RNA, 22 nt, Shigella flexneri 2a str. 301
caacaaucucuuccagaauauc

SEQ ID NO: 3887219 - RNA, 20 nt, Shigella flexneri 2a str. 301
caacaaucugcaaaucgauc

SEQ ID NO: 3887220 - RNA, 20 nt, Shigella flexneri 2a str. 301
caacaaugccacgccacagc

SEQ ID NO: 3887221 - RNA, 14 nt, Shigella flexneri 2a str. 301
caacaaugcucucu

SEQ ID NO: 3887222 - RNA, 21 nt, Shigella flexneri 2a str. 301
caacaauucccgcagcuccag

SEQ ID NO: 3887223 - RNA, 22 nt, Shigella flexneri 2a str. 301
caacaauucccgcagcuccagc

SEQ ID NO: 3887224 - RNA, 16 nt, Shigella flexneri 2a str. 301
caacaauucguuguuu

SEQ ID NO: 3887225 - RNA, 22 nt, Shigella flexneri 2a str. 301
caacaauugaagaauaucuucu

SEQ ID NO: 3887226 - RNA, 14 nt, Shigella flexneri 2a str. 301
caacaauugucgcc

SEQ ID NO: 3887227 - RNA, 13 nt, Shigella flexneri 2a str. 301
caacacauaaccg

SEQ ID NO: 3887228 - RNA, 14 nt, Shigella flexneri 2a str. 301
caacacauaaccgu

SEQ ID NO: 3887229 - RNA, 19 nt, Shigella flexneri 2a str. 301
caacacauucaauaacaca

SEQ ID NO: 3887230 - RNA, 20 nt, Shigella flexneri 2a str. 301
caacaccuguugcgcgucgc

SEQ ID NO: 3887231 - RNA, 14 nt, Shigella flexneri 2a str. 301
caacacgccuggcu

SEQ ID NO: 3887232 - RNA, 20 nt, Shigella flexneri 2a str. 301
caacacucaguccgccuuca

SEQ ID NO: 3887233 - RNA, 15 nt, Shigella flexneri 2a str. 301
caacacucucugaag

SEQ ID NO: 3887234 - RNA, 17 nt, Shigella flexneri 2a str. 301
caacacuuucacuacaa

SEQ ID NO: 3887235 - RNA, 14 nt, Shigella flexneri 2a str. 301
caacagaaacgcca

SEQ ID NO: 3887236 - RNA, 16 nt, Shigella flexneri 2a str. 301
caacagaaacgccauc

SEQ ID NO: 3887237 - RNA, 17 nt, Shigella flexneri 2a str. 301
caacagcaccagcaggu

SEQ ID NO: 3887238 - RNA, 18 nt, Shigella flexneri 2a str. 301
caacagcgccgagcaccg

SEQ ID NO: 3887239 - RNA, 14 nt, Shigella flexneri 2a str. 301
caacagcgguuuug

SEQ ID NO: 3887240 - RNA, 22 nt, Shigella flexneri 2a str. 301
caacagcgugaacugggccugc

SEQ ID NO: 3887241 - RNA, 19 nt, Shigella flexneri 2a str. 301
caacagcguuucuucgaca

SEQ ID NO: 3887242 - RNA, 23 nt, Shigella flexneri 2a str. 301
caacaggcccaacuguugaucca

SEQ ID NO: 3887243 - RNA, 15 nt, Shigella flexneri 2a str. 301
caacaguaauaaugc

SEQ ID NO: 3887244 - RNA, 19 nt, Shigella flexneri 2a str. 301
caacaguaauaaugcccau

SEQ ID NO: 3887245 - RNA, 23 nt, Shigella flexneri 2a str. 301
caacaguacgguaaagccgugcu

SEQ ID NO: 3887246 - RNA, 17 nt, Shigella flexneri 2a str. 301
caacagucgccacgcgc

SEQ ID NO: 3887247 - RNA, 16 nt, Shigella flexneri 2a str. 301
caacgccccuucugcc

SEQ ID NO: 3887248 - RNA, 19 nt, Shigella flexneri 2a str. 301
caacgcccuuaccgccagu

SEQ ID NO: 3887249 - RNA, 19 nt, Shigella flexneri 2a str. 301
caacgccgcauagcgacag

SEQ ID NO: 3887250 - RNA, 15 nt, Shigella flexneri 2a str. 301
caacgccgcgcgcca

SEQ ID NO: 3887251 - RNA, 13 nt, Shigella flexneri 2a str. 301
caacgcgccgcca

SEQ ID NO: 3887252 - RNA, 14 nt, Shigella flexneri 2a str. 301
caacgcgccgccaa

SEQ ID NO: 3887253 - RNA, 18 nt, Shigella flexneri 2a str. 301
caacgcgcgugaaguggc

SEQ ID NO: 3887254 - RNA, 19 nt, Shigella flexneri 2a str. 301
caacgcguggaucaagcaa

SEQ ID NO: 3887255 - RNA, 21 nt, Shigella flexneri 2a str. 301
caacgcguggaucaagcaaca

SEQ ID NO: 3887256 - RNA, 17 nt, Shigella flexneri 2a str. 301
caacgcugaauggcgau

SEQ ID NO: 3887257 - RNA, 13 nt, Shigella flexneri 2a str. 301
caacgcugccagc

SEQ ID NO: 3887258 - RNA, 13 nt, Shigella flexneri 2a str. 301
caacgcuggcaug

SEQ ID NO: 3887259 - RNA, 20 nt, Shigella flexneri 2a str. 301
caacgcuucauugcugaagu

SEQ ID NO: 3887260 - RNA, 14 nt, Shigella flexneri 2a str. 301
caacgcuuucccug

SEQ ID NO: 3887261 - RNA, 22 nt, Shigella flexneri 2a str. 301
caacgcuuucccugaagcaguu

SEQ ID NO: 3887262 - RNA, 23 nt, Shigella flexneri 2a str. 301
caacgcuuucccugaagcaguuu

SEQ ID NO: 3887263 - RNA, 23 nt, Shigella flexneri 2a str. 301
caacggaggauuuuucgcgaccg

SEQ ID NO: 3887264 - RNA, 15 nt, Shigella flexneri 2a str. 301
caacggauauuguuu

SEQ ID NO: 3887265 - RNA, 16 nt, Shigella flexneri 2a str. 301
caacggaugugacgga

SEQ ID NO: 3887266 - RNA, 15 nt, Shigella flexneri 2a str. 301
caacggcaaacacgc

SEQ ID NO: 3887267 - RNA, 19 nt, Shigella flexneri 2a str. 301
caacggccaaauauccgcg

SEQ ID NO: 3887268 - RNA, 18 nt, Shigella flexneri 2a str. 301
caacggcggcuuguacgc

SEQ ID NO: 3887269 - RNA, 22 nt, Shigella flexneri 2a str. 301
caacggcugcuucggucagcac

SEQ ID NO: 3887270 - RNA, 16 nt, Shigella flexneri 2a str. 301
caacgggcaccgccgc

SEQ ID NO: 3887271 - RNA, 18 nt, Shigella flexneri 2a str. 301
caacggugcggcucucuu

SEQ ID NO: 3887272 - RNA, 18 nt, Shigella flexneri 2a str. 301
caacgguugauggcaguc

SEQ ID NO: 3887273 - RNA, 14 nt, Shigella flexneri 2a str. 301
caacguaacaaaac

SEQ ID NO: 3887274 - RNA, 17 nt, Shigella flexneri 2a str. 301
caacguacucugccacu

SEQ ID NO: 3887275 - RNA, 13 nt, Shigella flexneri 2a str. 301
caacguagccugc

SEQ ID NO: 3887276 - RNA, 17 nt, Shigella flexneri 2a str. 301
caacguaggcacauucg

SEQ ID NO: 3887277 - RNA, 13 nt, Shigella flexneri 2a str. 301
caacgucaaacgc

SEQ ID NO: 3887278 - RNA, 16 nt, Shigella flexneri 2a str. 301
caacguccugagcauu

SEQ ID NO: 3887279 - RNA, 22 nt, Shigella flexneri 2a str. 301
caacgucuucccgagacauucc

SEQ ID NO: 3887280 - RNA, 21 nt, Shigella flexneri 2a str. 301
caacgugaccaguaccaccgc

SEQ ID NO: 3887281 - RNA, 15 nt, Shigella flexneri 2a str. 301
caacgugcucgucga

SEQ ID NO: 3887282 - RNA, 13 nt, Shigella flexneri 2a str. 301
caacgugcuucgc

SEQ ID NO: 3887283 - RNA, 17 nt, Shigella flexneri 2a str. 301
caacguggaacaaauag

SEQ ID NO: 3887284 - RNA, 17 nt, Shigella flexneri 2a str. 301
caacgugguuugcggca

SEQ ID NO: 3887285 - RNA, 17 nt, Shigella flexneri 2a str. 301
caacgugguuuucgccg

SEQ ID NO: 3887286 - RNA, 23 nt, Shigella flexneri 2a str. 301
caacguuaucgccgacaaacaau

SEQ ID NO: 3887287 - RNA, 15 nt, Shigella flexneri 2a str. 301
caacuacguuuuuau

SEQ ID NO: 3887288 - RNA, 19 nt, Shigella flexneri 2a str. 301
caacuacuccaacccggca

SEQ ID NO: 3887289 - RNA, 16 nt, Shigella flexneri 2a str. 301
caacucacgccccaga

SEQ ID NO: 3887290 - RNA, 13 nt, Shigella flexneri 2a str. 301
caacucaucgccg

SEQ ID NO: 3887291 - RNA, 18 nt, Shigella flexneri 2a str. 301
caacucauuuacagaaac

SEQ ID NO: 3887292 - RNA, 14 nt, Shigella flexneri 2a str. 301
caacuccaccagca

SEQ ID NO: 3887293 - RNA, 18 nt, Shigella flexneri 2a str. 301
caacuccacuucaccgcg

SEQ ID NO: 3887294 - RNA, 16 nt, Shigella flexneri 2a str. 301
caacuccagaauaccg

SEQ ID NO: 3887295 - RNA, 15 nt, Shigella flexneri 2a str. 301
caacuccaucaagcu

SEQ ID NO: 3887296 - RNA, 19 nt, Shigella flexneri 2a str. 301
caacuccccgcauuuacuc

SEQ ID NO: 3887297 - RNA, 19 nt, Shigella flexneri 2a str. 301
caacuccgccagcaacuga

SEQ ID NO: 3887298 - RNA, 12 nt, Shigella flexneri 2a str. 301
caacugacugac

SEQ ID NO: 3887299 - RNA, 21 nt, Shigella flexneri 2a str. 301
caacugacugacuucaacagg

SEQ ID NO: 3887300 - RNA, 15 nt, Shigella flexneri 2a str. 301
caacugacuggcucu

SEQ ID NO: 3887301 - RNA, 14 nt, Shigella flexneri 2a str. 301
caacugcauuuuca

SEQ ID NO: 3887302 - RNA, 11 nt, Shigella flexneri 2a str. 301
caacugccagu

SEQ ID NO: 3887303 - RNA, 15 nt, Shigella flexneri 2a str. 301
caacugccugaugcg

SEQ ID NO: 3887304 - RNA, 17 nt, Shigella flexneri 2a str. 301
caacugcgacguggauc

SEQ ID NO: 3887305 - RNA, 10 nt, Shigella flexneri 2a str. 301
caacugcgcu

SEQ ID NO: 3887306 - RNA, 23 nt, Shigella flexneri 2a str. 301
caacugcugacgcagauccugau

SEQ ID NO: 3887307 - RNA, 23 nt, Shigella flexneri 2a str. 301
caacugcugcgguugaacgccaa

SEQ ID NO: 3887308 - RNA, 18 nt, Shigella flexneri 2a str. 301
caacugcuuuuugcucuc

SEQ ID NO: 3887309 - RNA, 16 nt, Shigella flexneri 2a str. 301
caacuggagcaggaac

SEQ ID NO: 3887310 - RNA, 21 nt, Shigella flexneri 2a str. 301
caacuggagcaggaacuuggc

SEQ ID NO: 3887311 - RNA, 20 nt, Shigella flexneri 2a str. 301
caacuggcaaccagaagaga

SEQ ID NO: 3887312 - RNA, 22 nt, Shigella flexneri 2a str. 301
caacuguacgccgacgcccugc

SEQ ID NO: 3887313 - RNA, 16 nt, Shigella flexneri 2a str. 301
caacugugccgccgcc

SEQ ID NO: 3887314 - RNA, 17 nt, Shigella flexneri 2a str. 301
caacuguugauccagga

SEQ ID NO: 3887315 - RNA, 17 nt, Shigella flexneri 2a str. 301
caacuuaagucuccauu

SEQ ID NO: 3887316 - RNA, 15 nt, Shigella flexneri 2a str. 301
caacuucagcaacaa

SEQ ID NO: 3887317 - RNA, 17 nt, Shigella flexneri 2a str. 301
caacuucagcaacaaaa

SEQ ID NO: 3887318 - RNA, 20 nt, Shigella flexneri 2a str. 301
caacuucagcaacaaaaugg

SEQ ID NO: 3887319 - RNA, 23 nt, Shigella flexneri 2a str. 301
caacuucagcaacaaaauggcaa

SEQ ID NO: 3887320 - RNA, 16 nt, Shigella flexneri 2a str. 301
caacuucagcagcagc

SEQ ID NO: 3887321 - RNA, 23 nt, Shigella flexneri 2a str. 301
caacuucgaguacauccacugca

SEQ ID NO: 3887322 - RNA, 21 nt, Shigella flexneri 2a str. 301
caacuucuaauuuuuccagca

SEQ ID NO: 3887323 - RNA, 19 nt, Shigella flexneri 2a str. 301
caacuucucuuucggcagu

SEQ ID NO: 3887324 - RNA, 23 nt, Shigella flexneri 2a str. 301
caacuucucuuucggcagugcca

SEQ ID NO: 3887325 - RNA, 12 nt, Shigella flexneri 2a str. 301
caacuucugcug

SEQ ID NO: 3887326 - RNA, 15 nt, Shigella flexneri 2a str. 301
caacuuuagcgaugu

SEQ ID NO: 3887327 - RNA, 15 nt, Shigella flexneri 2a str. 301
caacuuuaucuucga

SEQ ID NO: 3887328 - RNA, 14 nt, Shigella flexneri 2a str. 301
caacuuucacgcgc

SEQ ID NO: 3887329 - RNA, 15 nt, Shigella flexneri 2a str. 301
caacuuucaucagca

SEQ ID NO: 3887330 - RNA, 16 nt, Shigella flexneri 2a str. 301
caacuuucuuggcacc

SEQ ID NO: 3887331 - RNA, 17 nt, Shigella flexneri 2a str. 301
caacuuuguucugaauc

SEQ ID NO: 3887332 - RNA, 17 nt, Shigella flexneri 2a str. 301
caagaaaauuauucgcc

SEQ ID NO: 3887333 - RNA, 23 nt, Shigella flexneri 2a str. 301
caagaaagagaagguaaagaagg

SEQ ID NO: 3887334 - RNA, 12 nt, Shigella flexneri 2a str. 301
caagaaagagcg

SEQ ID NO: 3887335 - RNA, 12 nt, Shigella flexneri 2a str. 301
caagaaaugaca

SEQ ID NO: 3887336 - RNA, 15 nt, Shigella flexneri 2a str. 301
caagaacagccuuaa

SEQ ID NO: 3887337 - RNA, 19 nt, Shigella flexneri 2a str. 301
caagaaccaaagaaaucag

SEQ ID NO: 3887338 - RNA, 21 nt, Shigella flexneri 2a str. 301
caagaacgcauaccccaucag

SEQ ID NO: 3887339 - RNA, 22 nt, Shigella flexneri 2a str. 301
caagaacgugcuacgguugacu

SEQ ID NO: 3887340 - RNA, 17 nt, Shigella flexneri 2a str. 301
caagaauacuguccaua

SEQ ID NO: 3887341 - RNA, 22 nt, Shigella flexneri 2a str. 301
caagaauagccgcaaagauguu

SEQ ID NO: 3887342 - RNA, 13 nt, Shigella flexneri 2a str. 301
caagaaucaugcc

SEQ ID NO: 3887343 - RNA, 16 nt, Shigella flexneri 2a str. 301
caagaaucaugccaaa

SEQ ID NO: 3887344 - RNA, 20 nt, Shigella flexneri 2a str. 301
caagaaucaugccaaaaaua

SEQ ID NO: 3887345 - RNA, 17 nt, Shigella flexneri 2a str. 301
caagaaugaccgccugc

SEQ ID NO: 3887346 - RNA, 19 nt, Shigella flexneri 2a str. 301
caagaaugccugccagcuu

SEQ ID NO: 3887347 - RNA, 16 nt, Shigella flexneri 2a str. 301
caauaauuaaucuggu

SEQ ID NO: 3887348 - RNA, 15 nt, Shigella flexneri 2a str. 301
caauaauuuacagcc

SEQ ID NO: 3887349 - RNA, 16 nt, Shigella flexneri 2a str. 301
caauaauuuacagccu

SEQ ID NO: 3887350 - RNA, 18 nt, Shigella flexneri 2a str. 301
caauaauuuacagccugc

SEQ ID NO: 3887351 - RNA, 17 nt, Shigella flexneri 2a str. 301
caauaauuucaacaggu

SEQ ID NO: 3887352 - RNA, 12 nt, Shigella flexneri 2a str. 301
caauacagccag

SEQ ID NO: 3887353 - RNA, 17 nt, Shigella flexneri 2a str. 301
caauacagccagccagc

SEQ ID NO: 3887354 - RNA, 22 nt, Shigella flexneri 2a str. 301
caauacagccagccagcaccag

SEQ ID NO: 3887355 - RNA, 16 nt, Shigella flexneri 2a str. 301
caauacagguuucaau

SEQ ID NO: 3887356 - RNA, 17 nt, Shigella flexneri 2a str. 301
caauacaucaauuuucc

SEQ ID NO: 3887357 - RNA, 22 nt, Shigella flexneri 2a str. 301
caauaccauggcucaccagcag

SEQ ID NO: 3887358 - RNA, 17 nt, Shigella flexneri 2a str. 301
caauaccauuaucauug

SEQ ID NO: 3887359 - RNA, 16 nt, Shigella flexneri 2a str. 301
caauacccgcaacaau

SEQ ID NO: 3887360 - RNA, 13 nt, Shigella flexneri 2a str. 301
caauacccugacc

SEQ ID NO: 3887361 - RNA, 21 nt, Shigella flexneri 2a str. 301
caauaccgcccaccaccagcg

SEQ ID NO: 3887362 - RNA, 17 nt, Shigella flexneri 2a str. 301
caauaccgccugacggu

SEQ ID NO: 3887363 - RNA, 12 nt, Shigella flexneri 2a str. 301
caauaccgucug

SEQ ID NO: 3887364 - RNA, 14 nt, Shigella flexneri 2a str. 301
caauaccugucaug

SEQ ID NO: 3887365 - RNA, 22 nt, Shigella flexneri 2a str. 301
caauaccugucauggcaguuca

SEQ ID NO: 3887366 - RNA, 16 nt, Shigella flexneri 2a str. 301
caauaccuucugcgcc

SEQ ID NO: 3887367 - RNA, 17 nt, Shigella flexneri 2a str. 301
caauaccuucugcgccc

SEQ ID NO: 3887368 - RNA, 22 nt, Shigella flexneri 2a str. 301
caauaccuucugcgcccgcccg

SEQ ID NO: 3887369 - RNA, 20 nt, Shigella flexneri 2a str. 301
caauacgauccugagcagcc

SEQ ID NO: 3887370 - RNA, 14 nt, Shigella flexneri 2a str. 301
caauacgauuaacg

SEQ ID NO: 3887371 - RNA, 16 nt, Shigella flexneri 2a str. 301
caauacgcauaugcau

SEQ ID NO: 3887372 - RNA, 17 nt, Shigella flexneri 2a str. 301
caauacgcgaggcgcua

SEQ ID NO: 3887373 - RNA, 11 nt, Shigella flexneri 2a str. 301
caauacuggca

SEQ ID NO: 3887374 - RNA, 20 nt, Shigella flexneri 2a str. 301
caauacuggcagcagucgca

SEQ ID NO: 3887375 - RNA, 16 nt, Shigella flexneri 2a str. 301
caauacuuaaccccag

SEQ ID NO: 3887376 - RNA, 19 nt, Shigella flexneri 2a str. 301
caauacuuucacaaaaaua

SEQ ID NO: 3887377 - RNA, 21 nt, Shigella flexneri 2a str. 301
caauacuuucacaaaaauaau

SEQ ID NO: 3887378 - RNA, 13 nt, Shigella flexneri 2a str. 301
caauagcaacuga

SEQ ID NO: 3887379 - RNA, 14 nt, Shigella flexneri 2a str. 301
caauagcaacugau

SEQ ID NO: 3887380 - RNA, 17 nt, Shigella flexneri 2a str. 301
caauagcgccugcugcu

SEQ ID NO: 3887381 - RNA, 18 nt, Shigella flexneri 2a str. 301
caauagcgccugcugcug

SEQ ID NO: 3887382 - RNA, 14 nt, Shigella flexneri 2a str. 301
caauagcguuaauu

SEQ ID NO: 3887383 - RNA, 15 nt, Shigella flexneri 2a str. 301
caauaguaaccagac

SEQ ID NO: 3887384 - RNA, 16 nt, Shigella flexneri 2a str. 301
caauauauugcaauca

SEQ ID NO: 3887385 - RNA, 13 nt, Shigella flexneri 2a str. 301
caauaucaaauaa

SEQ ID NO: 3887386 - RNA, 14 nt, Shigella flexneri 2a str. 301
caauauccauuugu

SEQ ID NO: 3887387 - RNA, 13 nt, Shigella flexneri 2a str. 301
caauauccugacc

SEQ ID NO: 3887388 - RNA, 20 nt, Shigella flexneri 2a str. 301
caauauccugcgcuuccugc

SEQ ID NO: 3887389 - RNA, 18 nt, Shigella flexneri 2a str. 301
caauaucggcaccagcgc

SEQ ID NO: 3887390 - RNA, 23 nt, Shigella flexneri 2a str. 301
caauaucggcaccagcgcagaag

SEQ ID NO: 3887391 - RNA, 16 nt, Shigella flexneri 2a str. 301
caauaucuuccuggcg

SEQ ID NO: 3887392 - RNA, 15 nt, Shigella flexneri 2a str. 301
caauaugauaaaccu

SEQ ID NO: 3887393 - RNA, 13 nt, Shigella flexneri 2a str. 301
caauaugcauaaa

SEQ ID NO: 3887394 - RNA, 19 nt, Shigella flexneri 2a str. 301
caauaugucguuauauaaa

SEQ ID NO: 3887395 - RNA, 16 nt, Shigella flexneri 2a str. 301
caauauuaaucccugc

SEQ ID NO: 3887396 - RNA, 19 nt, Shigella flexneri 2a str. 301
caauauucauuaaaacuga

SEQ ID NO: 3887397 - RNA, 12 nt, Shigella flexneri 2a str. 301
caauauuuaaau

SEQ ID NO: 3887398 - RNA, 22 nt, Shigella flexneri 2a str. 301
caaucaaaaaaggcugacaaau

SEQ ID NO: 3887399 - RNA, 11 nt, Shigella flexneri 2a str. 301
caaucaaauac

SEQ ID NO: 3887400 - RNA, 16 nt, Shigella flexneri 2a str. 301
caaucaaauagccugc

SEQ ID NO: 3887401 - RNA, 12 nt, Shigella flexneri 2a str. 301
caaucaaaugac

SEQ ID NO: 3887402 - RNA, 19 nt, Shigella flexneri 2a str. 301
caaucaaauuauccacggc

SEQ ID NO: 3887403 - RNA, 13 nt, Shigella flexneri 2a str. 301
caaucacaaaaag

SEQ ID NO: 3887404 - RNA, 15 nt, Shigella flexneri 2a str. 301
caaucacaaaaagua

SEQ ID NO: 3887405 - RNA, 17 nt, Shigella flexneri 2a str. 301
caaucacaaaaccgucg

SEQ ID NO: 3887406 - RNA, 13 nt, Shigella flexneri 2a str. 301
caaucacaaauag

SEQ ID NO: 3887407 - RNA, 15 nt, Shigella flexneri 2a str. 301
caaucacaauagaaa

SEQ ID NO: 3887408 - RNA, 16 nt, Shigella flexneri 2a str. 301
caaucacaucaccaua

SEQ ID NO: 3887409 - RNA, 21 nt, Shigella flexneri 2a str. 301
caaucaccacacgaauuccaa

SEQ ID NO: 3887410 - RNA, 15 nt, Shigella flexneri 2a str. 301
caaucaccaugccgu

SEQ ID NO: 3887411 - RNA, 21 nt, Shigella flexneri 2a str. 301
caaucaccaugccgugaugcg

SEQ ID NO: 3887412 - RNA, 17 nt, Shigella flexneri 2a str. 301
caaucaccgccagcaag

SEQ ID NO: 3887413 - RNA, 18 nt, Shigella flexneri 2a str. 301
caaucaccgccagcaagg

SEQ ID NO: 3887414 - RNA, 16 nt, Shigella flexneri 2a str. 301
caaucaccgccagcgg

SEQ ID NO: 3887415 - RNA, 16 nt, Shigella flexneri 2a str. 301
caaucacgauagccag

SEQ ID NO: 3887416 - RNA, 12 nt, Shigella flexneri 2a str. 301
caaucacgcccg

SEQ ID NO: 3887417 - RNA, 15 nt, Shigella flexneri 2a str. 301
caaucacucaccugc

SEQ ID NO: 3887418 - RNA, 14 nt, Shigella flexneri 2a str. 301
caaucacugccaga

SEQ ID NO: 3887419 - RNA, 12 nt, Shigella flexneri 2a str. 301
caaucacuuugu

SEQ ID NO: 3887420 - RNA, 22 nt, Shigella flexneri 2a str. 301
caaucacuuugucgaucuccgc

SEQ ID NO: 3887421 - RNA, 13 nt, Shigella flexneri 2a str. 301
caaucagagccau

SEQ ID NO: 3887422 - RNA, 12 nt, Shigella flexneri 2a str. 301
caaucagauaaa

SEQ ID NO: 3887423 - RNA, 21 nt, Shigella flexneri 2a str. 301
caaucagauaaaauacacuuu

SEQ ID NO: 3887424 - RNA, 14 nt, Shigella flexneri 2a str. 301
caaucagcaauaaa

SEQ ID NO: 3887425 - RNA, 15 nt, Shigella flexneri 2a str. 301
caaucagcacacaua

SEQ ID NO: 3887426 - RNA, 12 nt, Shigella flexneri 2a str. 301
caaucagccaga

SEQ ID NO: 3887427 - RNA, 19 nt, Shigella flexneri 2a str. 301
caaucagcgcagcacccag

SEQ ID NO: 3887428 - RNA, 14 nt, Shigella flexneri 2a str. 301
caaucaggcuaucg

SEQ ID NO: 3887429 - RNA, 22 nt, Shigella flexneri 2a str. 301
caaucagguaagcgauaaaaau

SEQ ID NO: 3887430 - RNA, 21 nt, Shigella flexneri 2a str. 301
caaucaucgcggcacacagca

SEQ ID NO: 3887431 - RNA, 23 nt, Shigella flexneri 2a str. 301
caaucaugauugaaugucugucu

SEQ ID NO: 3887432 - RNA, 14 nt, Shigella flexneri 2a str. 301
caaucauucccauu

SEQ ID NO: 3887433 - RNA, 15 nt, Shigella flexneri 2a str. 301
caauccacgguuuau

SEQ ID NO: 3887434 - RNA, 13 nt, Shigella flexneri 2a str. 301
caauccagcccug

SEQ ID NO: 3887435 - RNA, 23 nt, Shigella flexneri 2a str. 301
caauccaguacaugaagcacugc

SEQ ID NO: 3887436 - RNA, 13 nt, Shigella flexneri 2a str. 301
caauccaguccac

SEQ ID NO: 3887437 - RNA, 18 nt, Shigella flexneri 2a str. 301
caauccauaccagcacau

SEQ ID NO: 3887438 - RNA, 18 nt, Shigella flexneri 2a str. 301
caaucccaaaauaauaaa

SEQ ID NO: 3887439 - RNA, 18 nt, Shigella flexneri 2a str. 301
caauccccagaccugcug

SEQ ID NO: 3887440 - RNA, 14 nt, Shigella flexneri 2a str. 301
caaucccccacuuu

SEQ ID NO: 3887441 - RNA, 19 nt, Shigella flexneri 2a str. 301
caaucccggaagccaccac

SEQ ID NO: 3887442 - RNA, 20 nt, Shigella flexneri 2a str. 301
caaucccuuaguaacgccag

SEQ ID NO: 3887443 - RNA, 19 nt, Shigella flexneri 2a str. 301
caaucccuuucucuucaaa

SEQ ID NO: 3887444 - RNA, 20 nt, Shigella flexneri 2a str. 301
caauccgccaaaacaucuuc

SEQ ID NO: 3887445 - RNA, 13 nt, Shigella flexneri 2a str. 301
caaucgaccaggc

SEQ ID NO: 3887446 - RNA, 14 nt, Shigella flexneri 2a str. 301
caaucgaccaggcc

SEQ ID NO: 3887447 - RNA, 18 nt, Shigella flexneri 2a str. 301
caaucgagauacgacuga

SEQ ID NO: 3887448 - RNA, 13 nt, Shigella flexneri 2a str. 301
caaucgagcccag

SEQ ID NO: 3887449 - RNA, 14 nt, Shigella flexneri 2a str. 301
caaucgccuccagc

SEQ ID NO: 3887450 - RNA, 18 nt, Shigella flexneri 2a str. 301
caaucgccuccagcgcug

SEQ ID NO: 3887451 - RNA, 19 nt, Shigella flexneri 2a str. 301
caaucgccuccagcgcugg

SEQ ID NO: 3887452 - RNA, 21 nt, Shigella flexneri 2a str. 301
caaucgcgccagaacacgcuc

SEQ ID NO: 3887453 - RNA, 15 nt, Shigella flexneri 2a str. 301
caaucgcgccagccg

SEQ ID NO: 3887454 - RNA, 22 nt, Shigella flexneri 2a str. 301
caaucgcggcgauauccagcgc

SEQ ID NO: 3887455 - RNA, 14 nt, Shigella flexneri 2a str. 301
caaucgcugcggca

SEQ ID NO: 3887456 - RNA, 19 nt, Shigella flexneri 2a str. 301
caaucgcugcggcaauaau

SEQ ID NO: 3887457 - RNA, 19 nt, Shigella flexneri 2a str. 301
caaucggcaauucaguacg

SEQ ID NO: 3887458 - RNA, 15 nt, Shigella flexneri 2a str. 301
caaucggcugcaccu

SEQ ID NO: 3887459 - RNA, 16 nt, Shigella flexneri 2a str. 301
caaucgggaaaaucug

SEQ ID NO: 3887460 - RNA, 16 nt, Shigella flexneri 2a str. 301
caaucgguaacgcuug

SEQ ID NO: 3887461 - RNA, 20 nt, Shigella flexneri 2a str. 301
caaucgguucgccugcacca

SEQ ID NO: 3887462 - RNA, 20 nt, Shigella flexneri 2a str. 301
caaucguaugaucauccgcc

SEQ ID NO: 3887463 - RNA, 22 nt, Shigella flexneri 2a str. 301
caaucgucagcucgcugccauc

SEQ ID NO: 3887464 - RNA, 18 nt, Shigella flexneri 2a str. 301
caaucuacaaaagauuau

SEQ ID NO: 3887465 - RNA, 13 nt, Shigella flexneri 2a str. 301
caaucucaccaau

SEQ ID NO: 3887466 - RNA, 12 nt, Shigella flexneri 2a str. 301
caaucucacucc

SEQ ID NO: 3887467 - RNA, 13 nt, Shigella flexneri 2a str. 301
caaucucacuccg

SEQ ID NO: 3887468 - RNA, 20 nt, Shigella flexneri 2a str. 301
caaucucguggucaauauua

SEQ ID NO: 3887469 - RNA, 21 nt, Shigella flexneri 2a str. 301
caaucucugguuuguuuucag

SEQ ID NO: 3887470 - RNA, 23 nt, Shigella flexneri 2a str. 301
caaucucugguuuguuuucagau

SEQ ID NO: 3887471 - RNA, 14 nt, Shigella flexneri 2a str. 301
caaucucuucacag

SEQ ID NO: 3887472 - RNA, 15 nt, Shigella flexneri 2a str. 301
caaucucuuuuucca

SEQ ID NO: 3887473 - RNA, 18 nt, Shigella flexneri 2a str. 301
caaucucuuuuuccaccg

SEQ ID NO: 3887474 - RNA, 15 nt, Shigella flexneri 2a str. 301
caaucugaagccgca

SEQ ID NO: 3887475 - RNA, 18 nt, Shigella flexneri 2a str. 301
caaucugauagugaucca

SEQ ID NO: 3887476 - RNA, 14 nt, Shigella flexneri 2a str. 301
caaucugauugaca

SEQ ID NO: 3887477 - RNA, 17 nt, Shigella flexneri 2a str. 301
caaucugcgcuucucgc

SEQ ID NO: 3887478 - RNA, 16 nt, Shigella flexneri 2a str. 301
caaucugcuccauuag

SEQ ID NO: 3887479 - RNA, 17 nt, Shigella flexneri 2a str. 301
caaucugcuggcaaacg

SEQ ID NO: 3887480 - RNA, 14 nt, Shigella flexneri 2a str. 301
caaucuuaggggac

SEQ ID NO: 3887481 - RNA, 15 nt, Shigella flexneri 2a str. 301
caaucuucucuuccc

SEQ ID NO: 3887482 - RNA, 23 nt, Shigella flexneri 2a str. 301
caaucuuguucucagcacauuga

SEQ ID NO: 3887483 - RNA, 19 nt, Shigella flexneri 2a str. 301
caaugaaacgcaaauacug

SEQ ID NO: 3887484 - RNA, 19 nt, Shigella flexneri 2a str. 301
caaugaaagccccaccagc

SEQ ID NO: 3887485 - RNA, 20 nt, Shigella flexneri 2a str. 301
caaugaaagccccaccagca

SEQ ID NO: 3887486 - RNA, 18 nt, Shigella flexneri 2a str. 301
caaugaaauccauugauu

SEQ ID NO: 3887487 - RNA, 19 nt, Shigella flexneri 2a str. 301
caaugaaauugguacagca

SEQ ID NO: 3887488 - RNA, 15 nt, Shigella flexneri 2a str. 301
caaugaagcccgcug

SEQ ID NO: 3887489 - RNA, 18 nt, Shigella flexneri 2a str. 301
caaugaauauuccacagc

SEQ ID NO: 3887490 - RNA, 21 nt, Shigella flexneri 2a str. 301
caaugaaugcuucgcucucuu

SEQ ID NO: 3887491 - RNA, 20 nt, Shigella flexneri 2a str. 301
caaugaccgcgccauccaua

SEQ ID NO: 3887492 - RNA, 13 nt, Shigella flexneri 2a str. 301
caaugacgggcuu

SEQ ID NO: 3887493 - RNA, 18 nt, Shigella flexneri 2a str. 301
caaugaguggugaaaaaa

SEQ ID NO: 3887494 - RNA, 19 nt, Shigella flexneri 2a str. 301
caaugaguggugaaaaaaa

SEQ ID NO: 3887495 - RNA, 22 nt, Shigella flexneri 2a str. 301
caaugaguggugaaaaaaaggc

SEQ ID NO: 3887496 - RNA, 21 nt, Shigella flexneri 2a str. 301
caaugaguucgcgcgcugcca

SEQ ID NO: 3887497 - RNA, 19 nt, Shigella flexneri 2a str. 301
caaugauuuugauggaaga

SEQ ID NO: 3887498 - RNA, 17 nt, Shigella flexneri 2a str. 301
caaugcaguuccauaug

SEQ ID NO: 3887499 - RNA, 17 nt, Shigella flexneri 2a str. 301
caaugcaucgcgaccaa

SEQ ID NO: 3887500 - RNA, 17 nt, Shigella flexneri 2a str. 301
caaugcauuaucagaga

SEQ ID NO: 3887501 - RNA, 13 nt, Shigella flexneri 2a str. 301
caaugccacaaac

SEQ ID NO: 3887502 - RNA, 15 nt, Shigella flexneri 2a str. 301
caaugccacaaacgc

SEQ ID NO: 3887503 - RNA, 18 nt, Shigella flexneri 2a str. 301
caaugccaccaauaauga

SEQ ID NO: 3887504 - RNA, 20 nt, Shigella flexneri 2a str. 301
caaugcccagaaaccaguuu

SEQ ID NO: 3887505 - RNA, 23 nt, Shigella flexneri 2a str. 301
caaugccugaugcgcuucgcuua

SEQ ID NO: 3887506 - RNA, 18 nt, Shigella flexneri 2a str. 301
caaugcgcguaauuugcg

SEQ ID NO: 3887507 - RNA, 22 nt, Shigella flexneri 2a str. 301
caaugcgcugaguguaacgcuu

SEQ ID NO: 3887508 - RNA, 23 nt, Shigella flexneri 2a str. 301
caaugcgcugaguguaacgcuug

SEQ ID NO: 3887509 - RNA, 22 nt, Shigella flexneri 2a str. 301
caaugcgcuguuuagcgcggca

SEQ ID NO: 3887510 - RNA, 19 nt, Shigella flexneri 2a str. 301
caaugcuuuuugcauuucc

SEQ ID NO: 3887511 - RNA, 19 nt, Shigella flexneri 2a str. 301
caauggagcacauugccug

SEQ ID NO: 3887512 - RNA, 15 nt, Shigella flexneri 2a str. 301
caauggcauuuaucu

SEQ ID NO: 3887513 - RNA, 14 nt, Shigella flexneri 2a str. 301
caauggcccgccgc

SEQ ID NO: 3887514 - RNA, 17 nt, Shigella flexneri 2a str. 301
caauggccugcgcgacc

SEQ ID NO: 3887515 - RNA, 22 nt, Shigella flexneri 2a str. 301
caauggcugcaaagcauuuuuu

SEQ ID NO: 3887516 - RNA, 14 nt, Shigella flexneri 2a str. 301
caauggcuggccug

SEQ ID NO: 3887517 - RNA, 23 nt, Shigella flexneri 2a str. 301
caauggucagcgccaggcuuucc

SEQ ID NO: 3887518 - RNA, 17 nt, Shigella flexneri 2a str. 301
caauggucccuugcugg

SEQ ID NO: 3887519 - RNA, 13 nt, Shigella flexneri 2a str. 301
caauggugaacug

SEQ ID NO: 3887520 - RNA, 19 nt, Shigella flexneri 2a str. 301
caaugguggcaaucugaau

SEQ ID NO: 3887521 - RNA, 14 nt, Shigella flexneri 2a str. 301
caauguagcgcugc

SEQ ID NO: 3887522 - RNA, 16 nt, Shigella flexneri 2a str. 301
caauguaggccugaua

SEQ ID NO: 3887523 - RNA, 17 nt, Shigella flexneri 2a str. 301
caaugucagggccaucg

SEQ ID NO: 3887524 - RNA, 21 nt, Shigella flexneri 2a str. 301
caaugucaucagcauucucau

SEQ ID NO: 3887525 - RNA, 19 nt, Shigella flexneri 2a str. 301
caaugucauggcagucuua

SEQ ID NO: 3887526 - RNA, 15 nt, Shigella flexneri 2a str. 301
caaugucgaaagccc

SEQ ID NO: 3887527 - RNA, 14 nt, Shigella flexneri 2a str. 301
caauguuaccgauc

SEQ ID NO: 3887528 - RNA, 15 nt, Shigella flexneri 2a str. 301
caauguuauccggcu

SEQ ID NO: 3887529 - RNA, 18 nt, Shigella flexneri 2a str. 301
caauguucguccauuuca

SEQ ID NO: 3887530 - RNA, 22 nt, Shigella flexneri 2a str. 301
caauguucguccauuucagcgc

SEQ ID NO: 3887531 - RNA, 20 nt, Shigella flexneri 2a str. 301
caauguugcguuugucauca

SEQ ID NO: 3887532 - RNA, 14 nt, Shigella flexneri 2a str. 301
caauguuucucugg

SEQ ID NO: 3887533 - RNA, 13 nt, Shigella flexneri 2a str. 301
caauuaaaaaauu

SEQ ID NO: 3887534 - RNA, 17 nt, Shigella flexneri 2a str. 301
caauuaaaaaauuagca

SEQ ID NO: 3887535 - RNA, 13 nt, Shigella flexneri 2a str. 301
caauuaacaacac

SEQ ID NO: 3887536 - RNA, 15 nt, Shigella flexneri 2a str. 301
caauuaacgguaaua

SEQ ID NO: 3887537 - RNA, 17 nt, Shigella flexneri 2a str. 301
caauuaacgguaauaau

SEQ ID NO: 3887538 - RNA, 14 nt, Shigella flexneri 2a str. 301
caauuaacugugcc

SEQ ID NO: 3887539 - RNA, 17 nt, Shigella flexneri 2a str. 301
caauuaauaacacauau

SEQ ID NO: 3887540 - RNA, 19 nt, Shigella flexneri 2a str. 301
caauuaaugcaccaacaaa

SEQ ID NO: 3887541 - RNA, 17 nt, Shigella flexneri 2a str. 301
caauuaauucuccgcuc

SEQ ID NO: 3887542 - RNA, 18 nt, Shigella flexneri 2a str. 301
caauuaauugccagccgu

SEQ ID NO: 3887543 - RNA, 14 nt, Shigella flexneri 2a str. 301
caauuaauugugaa

SEQ ID NO: 3887544 - RNA, 15 nt, Shigella flexneri 2a str. 301
caauuacacaucagg

SEQ ID NO: 3887545 - RNA, 17 nt, Shigella flexneri 2a str. 301
caauuaccacaaguaaa

SEQ ID NO: 3887546 - RNA, 22 nt, Shigella flexneri 2a str. 301
caauuacccaguagacagcaaa

SEQ ID NO: 3887547 - RNA, 17 nt, Shigella flexneri 2a str. 301
caauuaccugucgccag

SEQ ID NO: 3887548 - RNA, 17 nt, Shigella flexneri 2a str. 301
cacaaugcuguaaccag

SEQ ID NO: 3887549 - RNA, 18 nt, Shigella flexneri 2a str. 301
cacaauggagcuaaacag

SEQ ID NO: 3887550 - RNA, 22 nt, Shigella flexneri 2a str. 301
cacaauggcacaaauggcaaug

SEQ ID NO: 3887551 - RNA, 20 nt, Shigella flexneri 2a str. 301
cacaauggcggugaucccaa

SEQ ID NO: 3887552 - RNA, 15 nt, Shigella flexneri 2a str. 301
cacaauggucaacau

SEQ ID NO: 3887553 - RNA, 23 nt, Shigella flexneri 2a str. 301
cacaauuaccuuccacaauggca

SEQ ID NO: 3887554 - RNA, 20 nt, Shigella flexneri 2a str. 301
cacaauuuuguaggccggau

SEQ ID NO: 3887555 - RNA, 19 nt, Shigella flexneri 2a str. 301
cacacaauuaccuuccaca

SEQ ID NO: 3887556 - RNA, 12 nt, Shigella flexneri 2a str. 301
cacacacaucga

SEQ ID NO: 3887557 - RNA, 14 nt, Shigella flexneri 2a str. 301
cacacacguugagc

SEQ ID NO: 3887558 - RNA, 14 nt, Shigella flexneri 2a str. 301
cacacagacaauaa

SEQ ID NO: 3887559 - RNA, 16 nt, Shigella flexneri 2a str. 301
cacacauuucucggua

SEQ ID NO: 3887560 - RNA, 14 nt, Shigella flexneri 2a str. 301
cacaccaguaaagc

SEQ ID NO: 3887561 - RNA, 14 nt, Shigella flexneri 2a str. 301
cacaccagucagcg

SEQ ID NO: 3887562 - RNA, 18 nt, Shigella flexneri 2a str. 301
cacaccaguccagcgccu

SEQ ID NO: 3887563 - RNA, 22 nt, Shigella flexneri 2a str. 301
cacaccauugauaauccaucac

SEQ ID NO: 3887564 - RNA, 18 nt, Shigella flexneri 2a str. 301
cacacccagaugucuuua

SEQ ID NO: 3887565 - RNA, 23 nt, Shigella flexneri 2a str. 301
cacacccauguuuaauucacgca

SEQ ID NO: 3887566 - RNA, 13 nt, Shigella flexneri 2a str. 301
cacacccccgcug

SEQ ID NO: 3887567 - RNA, 15 nt, Shigella flexneri 2a str. 301
cacaccccgcgcagc

SEQ ID NO: 3887568 - RNA, 13 nt, Shigella flexneri 2a str. 301
cacaccugcucag

SEQ ID NO: 3887569 - RNA, 22 nt, Shigella flexneri 2a str. 301
cacacgagaguuaguguuaacc

SEQ ID NO: 3887570 - RNA, 14 nt, Shigella flexneri 2a str. 301
cacacgcgcugagg

SEQ ID NO: 3887571 - RNA, 14 nt, Shigella flexneri 2a str. 301
cacacgcucuucca

SEQ ID NO: 3887572 - RNA, 18 nt, Shigella flexneri 2a str. 301
cacacugaugacaggcua

SEQ ID NO: 3887573 - RNA, 17 nt, Shigella flexneri 2a str. 301
cacacugcuuaacugcg

SEQ ID NO: 3887574 - RNA, 15 nt, Shigella flexneri 2a str. 301
cacacugguucccaa

SEQ ID NO: 3887575 - RNA, 22 nt, Shigella flexneri 2a str. 301
cacacugguucccaacaacagc

SEQ ID NO: 3887576 - RNA, 18 nt, Shigella flexneri 2a str. 301
cacacuguaagccaccga

SEQ ID NO: 3887577 - RNA, 23 nt, Shigella flexneri 2a str. 301
cacacuguucauuaaagccgccc

SEQ ID NO: 3887578 - RNA, 20 nt, Shigella flexneri 2a str. 301
cacacuucaauauuaaugcu

SEQ ID NO: 3887579 - RNA, 16 nt, Shigella flexneri 2a str. 301
cacacuucuucagcca

SEQ ID NO: 3887580 - RNA, 16 nt, Shigella flexneri 2a str. 301
cacacuuuccaguucc

SEQ ID NO: 3887581 - RNA, 14 nt, Shigella flexneri 2a str. 301
cacagaaacgccau

SEQ ID NO: 3887582 - RNA, 12 nt, Shigella flexneri 2a str. 301
cacagacaaaca

SEQ ID NO: 3887583 - RNA, 14 nt, Shigella flexneri 2a str. 301
cacagacaaacagc

SEQ ID NO: 3887584 - RNA, 15 nt, Shigella flexneri 2a str. 301
cacagacauccugcg

SEQ ID NO: 3887585 - RNA, 19 nt, Shigella flexneri 2a str. 301
cacagaccggacugacucc

SEQ ID NO: 3887586 - RNA, 13 nt, Shigella flexneri 2a str. 301
cacagacgaaggu

SEQ ID NO: 3887587 - RNA, 17 nt, Shigella flexneri 2a str. 301
cacagagcugauuuccg

SEQ ID NO: 3887588 - RNA, 16 nt, Shigella flexneri 2a str. 301
cacagaggcagcaucu

SEQ ID NO: 3887589 - RNA, 16 nt, Shigella flexneri 2a str. 301
cacagaggucuuuucu

SEQ ID NO: 3887590 - RNA, 18 nt, Shigella flexneri 2a str. 301
cacagaggucuuuucucg

SEQ ID NO: 3887591 - RNA, 14 nt, Shigella flexneri 2a str. 301
cacagaguauuucc

SEQ ID NO: 3887592 - RNA, 22 nt, Shigella flexneri 2a str. 301
cacagauaauaauguguucaac

SEQ ID NO: 3887593 - RNA, 20 nt, Shigella flexneri 2a str. 301
cacagauuuccaagcgcggc

SEQ ID NO: 3887594 - RNA, 18 nt, Shigella flexneri 2a str. 301
cacagcaaaacacccgca

SEQ ID NO: 3887595 - RNA, 17 nt, Shigella flexneri 2a str. 301
cacagcacgcuuuucag

SEQ ID NO: 3887596 - RNA, 15 nt, Shigella flexneri 2a str. 301
cacagcagccuucgc

SEQ ID NO: 3887597 - RNA, 13 nt, Shigella flexneri 2a str. 301
cacagccaacaca

SEQ ID NO: 3887598 - RNA, 15 nt, Shigella flexneri 2a str. 301
cacagccgagcgcca

SEQ ID NO: 3887599 - RNA, 11 nt, Shigella flexneri 2a str. 301
cacagccgcag

SEQ ID NO: 3887600 - RNA, 14 nt, Shigella flexneri 2a str. 301
cacagcgacguaaa

SEQ ID NO: 3887601 - RNA, 16 nt, Shigella flexneri 2a str. 301
cacagcgccagacacu

SEQ ID NO: 3887602 - RNA, 23 nt, Shigella flexneri 2a str. 301
cacagcggugcgaauugccacca

SEQ ID NO: 3887603 - RNA, 16 nt, Shigella flexneri 2a str. 301
cacagcgugcauagca

SEQ ID NO: 3887604 - RNA, 12 nt, Shigella flexneri 2a str. 301
cacagcucugcu

SEQ ID NO: 3887605 - RNA, 13 nt, Shigella flexneri 2a str. 301
cacagcucugcug

SEQ ID NO: 3887606 - RNA, 15 nt, Shigella flexneri 2a str. 301
cacaggccaucacau

SEQ ID NO: 3887607 - RNA, 15 nt, Shigella flexneri 2a str. 301
cacaggccauuuccc

SEQ ID NO: 3887608 - RNA, 12 nt, Shigella flexneri 2a str. 301
cacaggccgcca

SEQ ID NO: 3887609 - RNA, 20 nt, Shigella flexneri 2a str. 301
cacaggccggagccagccgu

SEQ ID NO: 3887610 - RNA, 23 nt, Shigella flexneri 2a str. 301
cacaggccugauaagacgcgcag

SEQ ID NO: 3887611 - RNA, 11 nt, Shigella flexneri 2a str. 301
cacaggcgcga

SEQ ID NO: 3887612 - RNA, 20 nt, Shigella flexneri 2a str. 301
cacagggcucuuaagcaccg

SEQ ID NO: 3887613 - RNA, 13 nt, Shigella flexneri 2a str. 301
cacagggugauca

SEQ ID NO: 3887614 - RNA, 20 nt, Shigella flexneri 2a str. 301
cacaggguggcccaaauggc

SEQ ID NO: 3887615 - RNA, 20 nt, Shigella flexneri 2a str. 301
cacaggguguauucaugccc

SEQ ID NO: 3887616 - RNA, 14 nt, Shigella flexneri 2a str. 301
cacaguaaugauuu

SEQ ID NO: 3887617 - RNA, 21 nt, Shigella flexneri 2a str. 301
cacaguaaugauuuaaaacca

SEQ ID NO: 3887618 - RNA, 22 nt, Shigella flexneri 2a str. 301
cacagugacccgcagccagcac

SEQ ID NO: 3887619 - RNA, 16 nt, Shigella flexneri 2a str. 301
cacagugcugauuuug

SEQ ID NO: 3887620 - RNA, 20 nt, Shigella flexneri 2a str. 301
cacaguggcgagcuuccugu

SEQ ID NO: 3887621 - RNA, 21 nt, Shigella flexneri 2a str. 301
cacaguuaaguuaauucugag

SEQ ID NO: 3887622 - RNA, 18 nt, Shigella flexneri 2a str. 301
cacaguuucagccccauc

SEQ ID NO: 3887623 - RNA, 21 nt, Shigella flexneri 2a str. 301
cacaguuucagccccaucaac

SEQ ID NO: 3887624 - RNA, 21 nt, Shigella flexneri 2a str. 301
cacaguuucauaucugccaga

SEQ ID NO: 3887625 - RNA, 16 nt, Shigella flexneri 2a str. 301
cacaguuuuacugcag

SEQ ID NO: 3887626 - RNA, 17 nt, Shigella flexneri 2a str. 301
cacaguuuuacugcagc

SEQ ID NO: 3887627 - RNA, 18 nt, Shigella flexneri 2a str. 301
cacaguuuuacugcagcc

SEQ ID NO: 3887628 - RNA, 22 nt, Shigella flexneri 2a str. 301
cacaguuuuacugcagccagcg

SEQ ID NO: 3887629 - RNA, 20 nt, Shigella flexneri 2a str. 301
cacauaaaguagccaauccc

SEQ ID NO: 3887630 - RNA, 21 nt, Shigella flexneri 2a str. 301
cacauaaccguacaaucguuu

SEQ ID NO: 3887631 - RNA, 17 nt, Shigella flexneri 2a str. 301
cacauaagaucaucggc

SEQ ID NO: 3887632 - RNA, 20 nt, Shigella flexneri 2a str. 301
cacauacgacgcuucaguuc

SEQ ID NO: 3887633 - RNA, 22 nt, Shigella flexneri 2a str. 301
cacauacgacgcuucaguucag

SEQ ID NO: 3887634 - RNA, 13 nt, Shigella flexneri 2a str. 301
cacauauauuaau

SEQ ID NO: 3887635 - RNA, 15 nt, Shigella flexneri 2a str. 301
cacauaugaucggaa

SEQ ID NO: 3887636 - RNA, 17 nt, Shigella flexneri 2a str. 301
cacauauucacgggcgc

SEQ ID NO: 3887637 - RNA, 23 nt, Shigella flexneri 2a str. 301
cacauauucgccgcccugcagca

SEQ ID NO: 3887638 - RNA, 15 nt, Shigella flexneri 2a str. 301
cacaucaaaucccca

SEQ ID NO: 3887639 - RNA, 18 nt, Shigella flexneri 2a str. 301
cacaucaacucugcaaug

SEQ ID NO: 3887640 - RNA, 20 nt, Shigella flexneri 2a str. 301
cacaucaauggaugcaauca

SEQ ID NO: 3887641 - RNA, 13 nt, Shigella flexneri 2a str. 301
cacaucaauuugc

SEQ ID NO: 3887642 - RNA, 13 nt, Shigella flexneri 2a str. 301
cacaucaccauaa

SEQ ID NO: 3887643 - RNA, 15 nt, Shigella flexneri 2a str. 301
cacaucaccauagcc

SEQ ID NO: 3887644 - RNA, 16 nt, Shigella flexneri 2a str. 301
cacaucaccuccagcg

SEQ ID NO: 3887645 - RNA, 13 nt, Shigella flexneri 2a str. 301
cacaucacuccau

SEQ ID NO: 3887646 - RNA, 19 nt, Shigella flexneri 2a str. 301
cacaucacuccauccagca

SEQ ID NO: 3887647 - RNA, 14 nt, Shigella flexneri 2a str. 301
cacaucaucaucgc

SEQ ID NO: 3887648 - RNA, 21 nt, Shigella flexneri 2a str. 301
caccagcaauaaugccagucc

SEQ ID NO: 3887649 - RNA, 22 nt, Shigella flexneri 2a str. 301
caccagcacaucaucaaagcca

SEQ ID NO: 3887650 - RNA, 12 nt, Shigella flexneri 2a str. 301
caccagcaccgc

SEQ ID NO: 3887651 - RNA, 13 nt, Shigella flexneri 2a str. 301
caccagcaccgcg

SEQ ID NO: 3887652 - RNA, 22 nt, Shigella flexneri 2a str. 301
caccagcacuucacugacauug

SEQ ID NO: 3887653 - RNA, 22 nt, Shigella flexneri 2a str. 301
caccagcaguaaaccacccacc

SEQ ID NO: 3887654 - RNA, 19 nt, Shigella flexneri 2a str. 301
caccagcaucaacaacaau

SEQ ID NO: 3887655 - RNA, 11 nt, Shigella flexneri 2a str. 301
caccagcaucg

SEQ ID NO: 3887656 - RNA, 16 nt, Shigella flexneri 2a str. 301
caccagccaccgcguu

SEQ ID NO: 3887657 - RNA, 20 nt, Shigella flexneri 2a str. 301
caccagccagaauuaccccg

SEQ ID NO: 3887658 - RNA, 19 nt, Shigella flexneri 2a str. 301
caccagccaucuguuccgg

SEQ ID NO: 3887659 - RNA, 23 nt, Shigella flexneri 2a str. 301
caccagccauuaaccagccacug

SEQ ID NO: 3887660 - RNA, 19 nt, Shigella flexneri 2a str. 301
caccagccccagaauucac

SEQ ID NO: 3887661 - RNA, 16 nt, Shigella flexneri 2a str. 301
caccagccgaucauug

SEQ ID NO: 3887662 - RNA, 20 nt, Shigella flexneri 2a str. 301
caccagcgaaaucaccgcca

SEQ ID NO: 3887663 - RNA, 22 nt, Shigella flexneri 2a str. 301
caccagcgaaaucaccgccacc

SEQ ID NO: 3887664 - RNA, 13 nt, Shigella flexneri 2a str. 301
caccagcgcacgc

SEQ ID NO: 3887665 - RNA, 16 nt, Shigella flexneri 2a str. 301
caccagcgccgcgcca

SEQ ID NO: 3887666 - RNA, 14 nt, Shigella flexneri 2a str. 301
caccagcgcgagga

SEQ ID NO: 3887667 - RNA, 13 nt, Shigella flexneri 2a str. 301
caccagcggaaug

SEQ ID NO: 3887668 - RNA, 22 nt, Shigella flexneri 2a str. 301
caccagcggaaugcagucacgc

SEQ ID NO: 3887669 - RNA, 14 nt, Shigella flexneri 2a str. 301
caccagcggcacgc

SEQ ID NO: 3887670 - RNA, 21 nt, Shigella flexneri 2a str. 301
caccagcgucagaaacaguug

SEQ ID NO: 3887671 - RNA, 20 nt, Shigella flexneri 2a str. 301
caccaggcaguuuauccagc

SEQ ID NO: 3887672 - RNA, 22 nt, Shigella flexneri 2a str. 301
caccaggcucuuuaaacaguuu

SEQ ID NO: 3887673 - RNA, 13 nt, Shigella flexneri 2a str. 301
caccaggcuugcu

SEQ ID NO: 3887674 - RNA, 14 nt, Shigella flexneri 2a str. 301
caccagggaaauaa

SEQ ID NO: 3887675 - RNA, 16 nt, Shigella flexneri 2a str. 301
caccagggaaauaauc

SEQ ID NO: 3887676 - RNA, 21 nt, Shigella flexneri 2a str. 301
caccaguaaauugucgccgga

SEQ ID NO: 3887677 - RNA, 16 nt, Shigella flexneri 2a str. 301
caccaguaacaggauc

SEQ ID NO: 3887678 - RNA, 17 nt, Shigella flexneri 2a str. 301
caccaguaacgauaacg

SEQ ID NO: 3887679 - RNA, 20 nt, Shigella flexneri 2a str. 301
caccaguaaggcaucuucuu

SEQ ID NO: 3887680 - RNA, 22 nt, Shigella flexneri 2a str. 301
caccaguaaggcaucuucuuca

SEQ ID NO: 3887681 - RNA, 15 nt, Shigella flexneri 2a str. 301
caccaguaccgccac

SEQ ID NO: 3887682 - RNA, 22 nt, Shigella flexneri 2a str. 301
caccagucagcgaacaccagca

SEQ ID NO: 3887683 - RNA, 14 nt, Shigella flexneri 2a str. 301
caccaguccagcgc

SEQ ID NO: 3887684 - RNA, 14 nt, Shigella flexneri 2a str. 301
caccaguccaucgg

SEQ ID NO: 3887685 - RNA, 15 nt, Shigella flexneri 2a str. 301
caccaguccaucggc

SEQ ID NO: 3887686 - RNA, 17 nt, Shigella flexneri 2a str. 301
caccagugcaggcacca

SEQ ID NO: 3887687 - RNA, 23 nt, Shigella flexneri 2a str. 301
caccagugcaggcaccagccccu

SEQ ID NO: 3887688 - RNA, 22 nt, Shigella flexneri 2a str. 301
caccagugccauuaacaggcca

SEQ ID NO: 3887689 - RNA, 17 nt, Shigella flexneri 2a str. 301
caccagugcggauacca

SEQ ID NO: 3887690 - RNA, 20 nt, Shigella flexneri 2a str. 301
caccaguucacccucauuca

SEQ ID NO: 3887691 - RNA, 13 nt, Shigella flexneri 2a str. 301
caccaguucacgc

SEQ ID NO: 3887692 - RNA, 15 nt, Shigella flexneri 2a str. 301
caccaguucgcgcag

SEQ ID NO: 3887693 - RNA, 22 nt, Shigella flexneri 2a str. 301
caccaguugguaaugacuccaa

SEQ ID NO: 3887694 - RNA, 21 nt, Shigella flexneri 2a str. 301
caccaguuuucggauuuaccg

SEQ ID NO: 3887695 - RNA, 21 nt, Shigella flexneri 2a str. 301
caccauaaaucagaucgacgc

SEQ ID NO: 3887696 - RNA, 12 nt, Shigella flexneri 2a str. 301
caccauacugcu

SEQ ID NO: 3887697 - RNA, 16 nt, Shigella flexneri 2a str. 301
caccauacuucgguaa

SEQ ID NO: 3887698 - RNA, 16 nt, Shigella flexneri 2a str. 301
caccauauucagcagc

SEQ ID NO: 3887699 - RNA, 14 nt, Shigella flexneri 2a str. 301
caccaucagcagca

SEQ ID NO: 3887700 - RNA, 15 nt, Shigella flexneri 2a str. 301
caccaucagcagcaa

SEQ ID NO: 3887701 - RNA, 17 nt, Shigella flexneri 2a str. 301
caccaucgcaaacagua

SEQ ID NO: 3887702 - RNA, 21 nt, Shigella flexneri 2a str. 301
caccaucgggaucgaguucau

SEQ ID NO: 3887703 - RNA, 21 nt, Shigella flexneri 2a str. 301
caccaucgggccucuuuuuau

SEQ ID NO: 3887704 - RNA, 17 nt, Shigella flexneri 2a str. 301
caccaucucuuacuuga

SEQ ID NO: 3887705 - RNA, 14 nt, Shigella flexneri 2a str. 301
caccaucuuccuca

SEQ ID NO: 3887706 - RNA, 19 nt, Shigella flexneri 2a str. 301
caccaucuuugugacgugu

SEQ ID NO: 3887707 - RNA, 16 nt, Shigella flexneri 2a str. 301
caccaugccacagaau

SEQ ID NO: 3887708 - RNA, 15 nt, Shigella flexneri 2a str. 301
caccaugccgauggc

SEQ ID NO: 3887709 - RNA, 18 nt, Shigella flexneri 2a str. 301
caccaugccgauggcaaa

SEQ ID NO: 3887710 - RNA, 20 nt, Shigella flexneri 2a str. 301
caccauguaggaguugcggc

SEQ ID NO: 3887711 - RNA, 17 nt, Shigella flexneri 2a str. 301
caccauguucacugccg

SEQ ID NO: 3887712 - RNA, 13 nt, Shigella flexneri 2a str. 301
caccauucugcgc

SEQ ID NO: 3887713 - RNA, 15 nt, Shigella flexneri 2a str. 301
caccauucugcgcug

SEQ ID NO: 3887714 - RNA, 14 nt, Shigella flexneri 2a str. 301
caccauugcugccg

SEQ ID NO: 3887715 - RNA, 17 nt, Shigella flexneri 2a str. 301
caccauugcugccgcca

SEQ ID NO: 3887716 - RNA, 16 nt, Shigella flexneri 2a str. 301
caccauuggcauuggu

SEQ ID NO: 3887717 - RNA, 21 nt, Shigella flexneri 2a str. 301
caccauuuccggagacagcuu

SEQ ID NO: 3887718 - RNA, 14 nt, Shigella flexneri 2a str. 301
cacccaacaugccg

SEQ ID NO: 3887719 - RNA, 22 nt, Shigella flexneri 2a str. 301
cacccacggcguuaacuguaca

SEQ ID NO: 3887720 - RNA, 17 nt, Shigella flexneri 2a str. 301
cacccagaacgccgaau

SEQ ID NO: 3887721 - RNA, 15 nt, Shigella flexneri 2a str. 301
cacccagcagcgccg

SEQ ID NO: 3887722 - RNA, 17 nt, Shigella flexneri 2a str. 301
cacccagcaucugcaug

SEQ ID NO: 3887723 - RNA, 11 nt, Shigella flexneri 2a str. 301
cacccagcccc

SEQ ID NO: 3887724 - RNA, 21 nt, Shigella flexneri 2a str. 301
cacccagucccguacccagca

SEQ ID NO: 3887725 - RNA, 21 nt, Shigella flexneri 2a str. 301
cacccauaaaaaaacccgccg

SEQ ID NO: 3887726 - RNA, 18 nt, Shigella flexneri 2a str. 301
cacccauagauaccuucu

SEQ ID NO: 3887727 - RNA, 14 nt, Shigella flexneri 2a str. 301
cacccaucacuacc

SEQ ID NO: 3887728 - RNA, 15 nt, Shigella flexneri 2a str. 301
cacccaucgccagau

SEQ ID NO: 3887729 - RNA, 15 nt, Shigella flexneri 2a str. 301
cacccaugaagaaua

SEQ ID NO: 3887730 - RNA, 19 nt, Shigella flexneri 2a str. 301
cacccauuuauccagcggc

SEQ ID NO: 3887731 - RNA, 19 nt, Shigella flexneri 2a str. 301
cacccauuuuaaugugucu

SEQ ID NO: 3887732 - RNA, 11 nt, Shigella flexneri 2a str. 301
cacccccaccc

SEQ ID NO: 3887733 - RNA, 20 nt, Shigella flexneri 2a str. 301
caccccgcgcagcugagaaa

SEQ ID NO: 3887734 - RNA, 16 nt, Shigella flexneri 2a str. 301
caccccggcccucucc

SEQ ID NO: 3887735 - RNA, 19 nt, Shigella flexneri 2a str. 301
cacccgaaggaggcgugcu

SEQ ID NO: 3887736 - RNA, 21 nt, Shigella flexneri 2a str. 301
cacccgcaagacgaaccggca

SEQ ID NO: 3887737 - RNA, 14 nt, Shigella flexneri 2a str. 301
cacccgcagcacgg

SEQ ID NO: 3887738 - RNA, 14 nt, Shigella flexneri 2a str. 301
cacccgcagugauu

SEQ ID NO: 3887739 - RNA, 24 nt, Shigella flexneri 2a str. 301
cacccgcauaugcggugcggagua

SEQ ID NO: 3887740 - RNA, 22 nt, Shigella flexneri 2a str. 301
cacccgccuguugcgucgccgc

SEQ ID NO: 3887741 - RNA, 16 nt, Shigella flexneri 2a str. 301
cacccgcuucagugac

SEQ ID NO: 3887742 - RNA, 15 nt, Shigella flexneri 2a str. 301
cacccgguaccuuug

SEQ ID NO: 3887743 - RNA, 19 nt, Shigella flexneri 2a str. 301
cacccgguaucaaacccuu

SEQ ID NO: 3887744 - RNA, 21 nt, Shigella flexneri 2a str. 301
cacccgguaucaaacccuucc

SEQ ID NO: 3887745 - RNA, 20 nt, Shigella flexneri 2a str. 301
cacccguaacauggcgguaa

SEQ ID NO: 3887746 - RNA, 19 nt, Shigella flexneri 2a str. 301
cacccgugagaacugcugc

SEQ ID NO: 3887747 - RNA, 22 nt, Shigella flexneri 2a str. 301
cacccucaaaauuucuccuuca

SEQ ID NO: 3887748 - RNA, 14 nt, Shigella flexneri 2a str. 301
caccugagcuggca

SEQ ID NO: 3887749 - RNA, 18 nt, Shigella flexneri 2a str. 301
caccugauacgcgccaau

SEQ ID NO: 3887750 - RNA, 19 nt, Shigella flexneri 2a str. 301
caccugauccagcucuucu

SEQ ID NO: 3887751 - RNA, 20 nt, Shigella flexneri 2a str. 301
caccugauccagcucuucuu

SEQ ID NO: 3887752 - RNA, 23 nt, Shigella flexneri 2a str. 301
caccugauccagcucuucuucac

SEQ ID NO: 3887753 - RNA, 23 nt, Shigella flexneri 2a str. 301
caccugauugaccgccagcgcca

SEQ ID NO: 3887754 - RNA, 14 nt, Shigella flexneri 2a str. 301
caccugcacaugca

SEQ ID NO: 3887755 - RNA, 13 nt, Shigella flexneri 2a str. 301
caccugccaggga

SEQ ID NO: 3887756 - RNA, 22 nt, Shigella flexneri 2a str. 301
caccugcucgucauccgccagu

SEQ ID NO: 3887757 - RNA, 23 nt, Shigella flexneri 2a str. 301
caccugcuuccugaacucgccag

SEQ ID NO: 3887758 - RNA, 21 nt, Shigella flexneri 2a str. 301
caccuggcgcauuaacggcaa

SEQ ID NO: 3887759 - RNA, 11 nt, Shigella flexneri 2a str. 301
caccuggcgcu

SEQ ID NO: 3887760 - RNA, 13 nt, Shigella flexneri 2a str. 301
caccuggcgcugu

SEQ ID NO: 3887761 - RNA, 21 nt, Shigella flexneri 2a str. 301
caccuggcugcguuuucgaga

SEQ ID NO: 3887762 - RNA, 21 nt, Shigella flexneri 2a str. 301
caccugggcaauggugaacug

SEQ ID NO: 3887763 - RNA, 17 nt, Shigella flexneri 2a str. 301
caccuggggcuugccag

SEQ ID NO: 3887764 - RNA, 18 nt, Shigella flexneri 2a str. 301
caccugggucugcagaua

SEQ ID NO: 3887765 - RNA, 16 nt, Shigella flexneri 2a str. 301
caccuguaccagcccg

SEQ ID NO: 3887766 - RNA, 23 nt, Shigella flexneri 2a str. 301
caccuguaguguguugcaauaca

SEQ ID NO: 3887767 - RNA, 17 nt, Shigella flexneri 2a str. 301
caccuguuccaugacgu

SEQ ID NO: 3887768 - RNA, 22 nt, Shigella flexneri 2a str. 301
caccuguugccauuucugcugc

SEQ ID NO: 3887769 - RNA, 19 nt, Shigella flexneri 2a str. 301
caccuguugcgcgucgccc

SEQ ID NO: 3887770 - RNA, 18 nt, Shigella flexneri 2a str. 301
caccuuacggcacuccuc

SEQ ID NO: 3887771 - RNA, 22 nt, Shigella flexneri 2a str. 301
caccuuacggcacuccucuuca

SEQ ID NO: 3887772 - RNA, 23 nt, Shigella flexneri 2a str. 301
caccuuauaacccgacuucgucg

SEQ ID NO: 3887773 - RNA, 20 nt, Shigella flexneri 2a str. 301
caccuucaaguaauucauuc

SEQ ID NO: 3887774 - RNA, 15 nt, Shigella flexneri 2a str. 301
caccuucauccagca

SEQ ID NO: 3887775 - RNA, 18 nt, Shigella flexneri 2a str. 301
caccuucauccagcauca

SEQ ID NO: 3887776 - RNA, 18 nt, Shigella flexneri 2a str. 301
caccuucucgcugauucu

SEQ ID NO: 3887777 - RNA, 14 nt, Shigella flexneri 2a str. 301
caccuucuggcgac

SEQ ID NO: 3887778 - RNA, 16 nt, Shigella flexneri 2a str. 301
caccuucuguaacugg

SEQ ID NO: 3887779 - RNA, 20 nt, Shigella flexneri 2a str. 301
caccuucuuuacugcccgcu

SEQ ID NO: 3887780 - RNA, 12 nt, Shigella flexneri 2a str. 301
caccuuuaaccu

SEQ ID NO: 3887781 - RNA, 20 nt, Shigella flexneri 2a str. 301
caccuuuaaugcaucagcca

SEQ ID NO: 3887782 - RNA, 13 nt, Shigella flexneri 2a str. 301
caccuuuuuucug

SEQ ID NO: 3887783 - RNA, 16 nt, Shigella flexneri 2a str. 301
caccuuuuuuuaugcu

SEQ ID NO: 3887784 - RNA, 22 nt, Shigella flexneri 2a str. 301
caccuuuuuuuaugcuuccuuc

SEQ ID NO: 3887785 - RNA, 18 nt, Shigella flexneri 2a str. 301
cacgaaaccacugcaaca

SEQ ID NO: 3887786 - RNA, 14 nt, Shigella flexneri 2a str. 301
cacgaaacugcugg

SEQ ID NO: 3887787 - RNA, 16 nt, Shigella flexneri 2a str. 301
cacgaaccagagacag

SEQ ID NO: 3887788 - RNA, 19 nt, Shigella flexneri 2a str. 301
cacgaaccguaaaagccug

SEQ ID NO: 3887789 - RNA, 14 nt, Shigella flexneri 2a str. 301
cacgaagcaauggc

SEQ ID NO: 3887790 - RNA, 13 nt, Shigella flexneri 2a str. 301
cacgaagcauugc

SEQ ID NO: 3887791 - RNA, 18 nt, Shigella flexneri 2a str. 301
cacgaagcucucugcuau

SEQ ID NO: 3887792 - RNA, 13 nt, Shigella flexneri 2a str. 301
cacgaauauuucc

SEQ ID NO: 3887793 - RNA, 15 nt, Shigella flexneri 2a str. 301
cacgaauucaacgcg

SEQ ID NO: 3887794 - RNA, 16 nt, Shigella flexneri 2a str. 301
cacgaauuccaagcag

SEQ ID NO: 3887795 - RNA, 23 nt, Shigella flexneri 2a str. 301
cacgaauugauuuucgaaaaaaa

SEQ ID NO: 3887796 - RNA, 18 nt, Shigella flexneri 2a str. 301
cacgacaaaugcgccgcc

SEQ ID NO: 3887797 - RNA, 19 nt, Shigella flexneri 2a str. 301
cacgacaaaugcgccgcca

SEQ ID NO: 3887798 - RNA, 14 nt, Shigella flexneri 2a str. 301
cacgacauacaccg

SEQ ID NO: 3887799 - RNA, 13 nt, Shigella flexneri 2a str. 301
cacgaccgcagca

SEQ ID NO: 3887800 - RNA, 17 nt, Shigella flexneri 2a str. 301
cacgaccggguuuucaa

SEQ ID NO: 3887801 - RNA, 16 nt, Shigella flexneri 2a str. 301
cacgaccuacgcgccc

SEQ ID NO: 3887802 - RNA, 20 nt, Shigella flexneri 2a str. 301
cacgaccuguaccuucagcg

SEQ ID NO: 3887803 - RNA, 18 nt, Shigella flexneri 2a str. 301
cacgaguagguagaauau

SEQ ID NO: 3887804 - RNA, 14 nt, Shigella flexneri 2a str. 301
cacgaguguuacgc

SEQ ID NO: 3887805 - RNA, 22 nt, Shigella flexneri 2a str. 301
cacgauauaccgugcugacuca

SEQ ID NO: 3887806 - RNA, 12 nt, Shigella flexneri 2a str. 301
cacgaucacagc

SEQ ID NO: 3887807 - RNA, 19 nt, Shigella flexneri 2a str. 301
cacgaucgaugugauaaau

SEQ ID NO: 3887808 - RNA, 13 nt, Shigella flexneri 2a str. 301
cacgaucgcgcca

SEQ ID NO: 3887809 - RNA, 20 nt, Shigella flexneri 2a str. 301
cacgaucucgccagugacca

SEQ ID NO: 3887810 - RNA, 16 nt, Shigella flexneri 2a str. 301
cacgaugcuaaaaaca

SEQ ID NO: 3887811 - RNA, 21 nt, Shigella flexneri 2a str. 301
cacgcaaaaucccacugccaa

SEQ ID NO: 3887812 - RNA, 17 nt, Shigella flexneri 2a str. 301
cacgcaaacuucgguua

SEQ ID NO: 3887813 - RNA, 20 nt, Shigella flexneri 2a str. 301
cacgcaauaccuggcgcagc

SEQ ID NO: 3887814 - RNA, 20 nt, Shigella flexneri 2a str. 301
cacgcaauuuauacugcgau

SEQ ID NO: 3887815 - RNA, 15 nt, Shigella flexneri 2a str. 301
cacgcacagcccgcc

SEQ ID NO: 3887816 - RNA, 20 nt, Shigella flexneri 2a str. 301
cacgcagaagcgcagaucga

SEQ ID NO: 3887817 - RNA, 15 nt, Shigella flexneri 2a str. 301
cacgcagacacugcu

SEQ ID NO: 3887818 - RNA, 17 nt, Shigella flexneri 2a str. 301
cacgcagcagccaagca

SEQ ID NO: 3887819 - RNA, 23 nt, Shigella flexneri 2a str. 301
cacgcauccucuauauuucaccg

SEQ ID NO: 3887820 - RNA, 13 nt, Shigella flexneri 2a str. 301
cacgcauuaauaa

SEQ ID NO: 3887821 - RNA, 14 nt, Shigella flexneri 2a str. 301
cacgcauucagcaa

SEQ ID NO: 3887822 - RNA, 12 nt, Shigella flexneri 2a str. 301
cacgccaacaaa

SEQ ID NO: 3887823 - RNA, 11 nt, Shigella flexneri 2a str. 301
cacgccaagcu

SEQ ID NO: 3887824 - RNA, 21 nt, Shigella flexneri 2a str. 301
cacgccaauguguuuauaagc

SEQ ID NO: 3887825 - RNA, 14 nt, Shigella flexneri 2a str. 301
cacgccacauccgg

SEQ ID NO: 3887826 - RNA, 12 nt, Shigella flexneri 2a str. 301
cacgccaccagc

SEQ ID NO: 3887827 - RNA, 17 nt, Shigella flexneri 2a str. 301
cacgccaccagcaacag

SEQ ID NO: 3887828 - RNA, 18 nt, Shigella flexneri 2a str. 301
cacgccagcagcgcaauc

SEQ ID NO: 3887829 - RNA, 21 nt, Shigella flexneri 2a str. 301
cacgccaggcaccgcacuggc

SEQ ID NO: 3887830 - RNA, 14 nt, Shigella flexneri 2a str. 301
cacgcccuccugau

SEQ ID NO: 3887831 - RNA, 19 nt, Shigella flexneri 2a str. 301
cacgccgacaaagaugcag

SEQ ID NO: 3887832 - RNA, 18 nt, Shigella flexneri 2a str. 301
cacgccgaggccaaacuc

SEQ ID NO: 3887833 - RNA, 23 nt, Shigella flexneri 2a str. 301
cacgccgaggccaaacucaccau

SEQ ID NO: 3887834 - RNA, 14 nt, Shigella flexneri 2a str. 301
cacgccgcauccgg

SEQ ID NO: 3887835 - RNA, 21 nt, Shigella flexneri 2a str. 301
cacgccgcauccggcagccgu

SEQ ID NO: 3887836 - RNA, 14 nt, Shigella flexneri 2a str. 301
cacgccgcauuacc

SEQ ID NO: 3887837 - RNA, 13 nt, Shigella flexneri 2a str. 301
cacgccgccgagc

SEQ ID NO: 3887838 - RNA, 20 nt, Shigella flexneri 2a str. 301
cacgccgcugucuaccagca

SEQ ID NO: 3887839 - RNA, 18 nt, Shigella flexneri 2a str. 301
cacgccgguucccagacc

SEQ ID NO: 3887840 - RNA, 12 nt, Shigella flexneri 2a str. 301
cacgccuccugg

SEQ ID NO: 3887841 - RNA, 13 nt, Shigella flexneri 2a str. 301
cacgccuccuggc

SEQ ID NO: 3887842 - RNA, 19 nt, Shigella flexneri 2a str. 301
cacgccuccuggcucagcg

SEQ ID NO: 3887843 - RNA, 22 nt, Shigella flexneri 2a str. 301
cacgccugaaacggaugccaau

SEQ ID NO: 3887844 - RNA, 13 nt, Shigella flexneri 2a str. 301
cacgccugccgcc

SEQ ID NO: 3887845 - RNA, 16 nt, Shigella flexneri 2a str. 301
cacgccuggcucaagc

SEQ ID NO: 3887846 - RNA, 12 nt, Shigella flexneri 2a str. 301
cacgccuucuuc

SEQ ID NO: 3887847 - RNA, 23 nt, Shigella flexneri 2a str. 301
cacgccuugcggaaauuccagcg

SEQ ID NO: 3887848 - RNA, 14 nt, Shigella flexneri 2a str. 301
cacuauuggcggau

SEQ ID NO: 3887849 - RNA, 20 nt, Shigella flexneri 2a str. 301
cacuauuucaauaugauaaa

SEQ ID NO: 3887850 - RNA, 18 nt, Shigella flexneri 2a str. 301
cacucaacaaccagaagg

SEQ ID NO: 3887851 - RNA, 11 nt, Shigella flexneri 2a str. 301
cacucaccgca

SEQ ID NO: 3887852 - RNA, 15 nt, Shigella flexneri 2a str. 301
cacucaccgccguua

SEQ ID NO: 3887853 - RNA, 16 nt, Shigella flexneri 2a str. 301
cacucaggccaaauga

SEQ ID NO: 3887854 - RNA, 17 nt, Shigella flexneri 2a str. 301
cacucaggccaaaugac

SEQ ID NO: 3887855 - RNA, 16 nt, Shigella flexneri 2a str. 301
cacucauacucaccgu

SEQ ID NO: 3887856 - RNA, 22 nt, Shigella flexneri 2a str. 301
cacucauacucaccguucaaag

SEQ ID NO: 3887857 - RNA, 17 nt, Shigella flexneri 2a str. 301
cacucaucgcaucgccu

SEQ ID NO: 3887858 - RNA, 21 nt, Shigella flexneri 2a str. 301
cacucaucuuauugaucaucc

SEQ ID NO: 3887859 - RNA, 22 nt, Shigella flexneri 2a str. 301
cacucaugauccuggauuuccu

SEQ ID NO: 3887860 - RNA, 22 nt, Shigella flexneri 2a str. 301
cacucauuaagacuguaaauaa

SEQ ID NO: 3887861 - RNA, 16 nt, Shigella flexneri 2a str. 301
cacuccagccagagcc

SEQ ID NO: 3887862 - RNA, 21 nt, Shigella flexneri 2a str. 301
cacuccauccagcaacaacag

SEQ ID NO: 3887863 - RNA, 22 nt, Shigella flexneri 2a str. 301
cacuccauccagcaacaacagc

SEQ ID NO: 3887864 - RNA, 23 nt, Shigella flexneri 2a str. 301
cacucccauacggcgucugaauc

SEQ ID NO: 3887865 - RNA, 17 nt, Shigella flexneri 2a str. 301
cacuccccgcaacagug

SEQ ID NO: 3887866 - RNA, 23 nt, Shigella flexneri 2a str. 301
cacucccggauaaaucuccauuu

SEQ ID NO: 3887867 - RNA, 16 nt, Shigella flexneri 2a str. 301
cacucccugccccauc

SEQ ID NO: 3887868 - RNA, 20 nt, Shigella flexneri 2a str. 301
cacucccuuucugccacgcc

SEQ ID NO: 3887869 - RNA, 14 nt, Shigella flexneri 2a str. 301
cacucgacagcacc

SEQ ID NO: 3887870 - RNA, 16 nt, Shigella flexneri 2a str. 301
cacucgcagaagcagu

SEQ ID NO: 3887871 - RNA, 13 nt, Shigella flexneri 2a str. 301
cacucgcauccuc

SEQ ID NO: 3887872 - RNA, 15 nt, Shigella flexneri 2a str. 301
cacucgcauccucuu

SEQ ID NO: 3887873 - RNA, 17 nt, Shigella flexneri 2a str. 301
cacucgcccugaccugc

SEQ ID NO: 3887874 - RNA, 15 nt, Shigella flexneri 2a str. 301
cacucgcugacugau

SEQ ID NO: 3887875 - RNA, 19 nt, Shigella flexneri 2a str. 301
cacucggggcuuuucucua

SEQ ID NO: 3887876 - RNA, 15 nt, Shigella flexneri 2a str. 301
cacucggugucguua

SEQ ID NO: 3887877 - RNA, 22 nt, Shigella flexneri 2a str. 301
cacucgugcgucgcauccggca

SEQ ID NO: 3887878 - RNA, 14 nt, Shigella flexneri 2a str. 301
cacucucaccacgc

SEQ ID NO: 3887879 - RNA, 15 nt, Shigella flexneri 2a str. 301
cacucucgccccuuc

SEQ ID NO: 3887880 - RNA, 21 nt, Shigella flexneri 2a str. 301
cacucucgggaaggcccuucc

SEQ ID NO: 3887881 - RNA, 16 nt, Shigella flexneri 2a str. 301
cacucugaccugccgc

SEQ ID NO: 3887882 - RNA, 12 nt, Shigella flexneri 2a str. 301
cacucugacgga

SEQ ID NO: 3887883 - RNA, 22 nt, Shigella flexneri 2a str. 301
cacucugccguaccaucgccag

SEQ ID NO: 3887884 - RNA, 19 nt, Shigella flexneri 2a str. 301
cacucugcugccacauucc

SEQ ID NO: 3887885 - RNA, 12 nt, Shigella flexneri 2a str. 301
cacucuucaaca

SEQ ID NO: 3887886 - RNA, 18 nt, Shigella flexneri 2a str. 301
cacucuugagcuccacau

SEQ ID NO: 3887887 - RNA, 16 nt, Shigella flexneri 2a str. 301
cacucuuuauugagau

SEQ ID NO: 3887888 - RNA, 17 nt, Shigella flexneri 2a str. 301
cacugaaaaucaccuca

SEQ ID NO: 3887889 - RNA, 18 nt, Shigella flexneri 2a str. 301
cacugacacggaacaacg

SEQ ID NO: 3887890 - RNA, 21 nt, Shigella flexneri 2a str. 301
cacugacgcccguuaaccgcu

SEQ ID NO: 3887891 - RNA, 18 nt, Shigella flexneri 2a str. 301
cacugacgcgucuuaucu

SEQ ID NO: 3887892 - RNA, 16 nt, Shigella flexneri 2a str. 301
cacugacgggaaacuc

SEQ ID NO: 3887893 - RNA, 18 nt, Shigella flexneri 2a str. 301
cacugacugccggaugca

SEQ ID NO: 3887894 - RNA, 14 nt, Shigella flexneri 2a str. 301
cacugacuucucug

SEQ ID NO: 3887895 - RNA, 15 nt, Shigella flexneri 2a str. 301
cacugagucagccca

SEQ ID NO: 3887896 - RNA, 17 nt, Shigella flexneri 2a str. 301
cacugauaagcugagca

SEQ ID NO: 3887897 - RNA, 21 nt, Shigella flexneri 2a str. 301
cacugauauggugguaacuac

SEQ ID NO: 3887898 - RNA, 16 nt, Shigella flexneri 2a str. 301
cacugaugacaggcua

SEQ ID NO: 3887899 - RNA, 19 nt, Shigella flexneri 2a str. 301
cacugauggaauuucauca

SEQ ID NO: 3887900 - RNA, 15 nt, Shigella flexneri 2a str. 301
cacugcaacagcugu

SEQ ID NO: 3887901 - RNA, 21 nt, Shigella flexneri 2a str. 301
cacugcaaugaccaucauucg

SEQ ID NO: 3887902 - RNA, 13 nt, Shigella flexneri 2a str. 301
cacugcaggcuga

SEQ ID NO: 3887903 - RNA, 16 nt, Shigella flexneri 2a str. 301
cacugcaucauggcau

SEQ ID NO: 3887904 - RNA, 20 nt, Shigella flexneri 2a str. 301
cacugccagaauagccgcag

SEQ ID NO: 3887905 - RNA, 13 nt, Shigella flexneri 2a str. 301
cacugccagauuc

SEQ ID NO: 3887906 - RNA, 19 nt, Shigella flexneri 2a str. 301
cacugcccacgcgcacgcu

SEQ ID NO: 3887907 - RNA, 16 nt, Shigella flexneri 2a str. 301
cacugcccgagaacag

SEQ ID NO: 3887908 - RNA, 17 nt, Shigella flexneri 2a str. 301
cacugccguacagacag

SEQ ID NO: 3887909 - RNA, 16 nt, Shigella flexneri 2a str. 301
cacugccguacaggca

SEQ ID NO: 3887910 - RNA, 17 nt, Shigella flexneri 2a str. 301
cacugccguacaggcag

SEQ ID NO: 3887911 - RNA, 14 nt, Shigella flexneri 2a str. 301
cacugccugcugau

SEQ ID NO: 3887912 - RNA, 20 nt, Shigella flexneri 2a str. 301
cacugccuuucagcgcaugu

SEQ ID NO: 3887913 - RNA, 20 nt, Shigella flexneri 2a str. 301
cacugcgaccgaucaccaca

SEQ ID NO: 3887914 - RNA, 15 nt, Shigella flexneri 2a str. 301
cacugcgagaaaaag

SEQ ID NO: 3887915 - RNA, 18 nt, Shigella flexneri 2a str. 301
cacugcgcauaauccacu

SEQ ID NO: 3887916 - RNA, 16 nt, Shigella flexneri 2a str. 301
cacugcgcccgccagc

SEQ ID NO: 3887917 - RNA, 17 nt, Shigella flexneri 2a str. 301
cacugcgcccgccagca

SEQ ID NO: 3887918 - RNA, 18 nt, Shigella flexneri 2a str. 301
cacugcgcccgccagcau

SEQ ID NO: 3887919 - RNA, 14 nt, Shigella flexneri 2a str. 301
cacugcgcucuucu

SEQ ID NO: 3887920 - RNA, 15 nt, Shigella flexneri 2a str. 301
cacugcggcauuucc

SEQ ID NO: 3887921 - RNA, 17 nt, Shigella flexneri 2a str. 301
cacugcucaaucaucac

SEQ ID NO: 3887922 - RNA, 14 nt, Shigella flexneri 2a str. 301
cacugcucaccgaa

SEQ ID NO: 3887923 - RNA, 17 nt, Shigella flexneri 2a str. 301
cacugcucgcagaaaua

SEQ ID NO: 3887924 - RNA, 18 nt, Shigella flexneri 2a str. 301
cacugcugauaauccagu

SEQ ID NO: 3887925 - RNA, 14 nt, Shigella flexneri 2a str. 301
cacuggcaaaauca

SEQ ID NO: 3887926 - RNA, 14 nt, Shigella flexneri 2a str. 301
cacuggcaaugacg

SEQ ID NO: 3887927 - RNA, 19 nt, Shigella flexneri 2a str. 301
cacuggcagccaggcgcga

SEQ ID NO: 3887928 - RNA, 18 nt, Shigella flexneri 2a str. 301
cacuggcgauauugccgc

SEQ ID NO: 3887929 - RNA, 19 nt, Shigella flexneri 2a str. 301
cacuggcgcgaauagcuuc

SEQ ID NO: 3887930 - RNA, 14 nt, Shigella flexneri 2a str. 301
cacuggcggcagca

SEQ ID NO: 3887931 - RNA, 16 nt, Shigella flexneri 2a str. 301
cacuggcggcagcagg

SEQ ID NO: 3887932 - RNA, 20 nt, Shigella flexneri 2a str. 301
cacugggcgaagguggcgga

SEQ ID NO: 3887933 - RNA, 15 nt, Shigella flexneri 2a str. 301
cacuggguucaaaaa

SEQ ID NO: 3887934 - RNA, 17 nt, Shigella flexneri 2a str. 301
cacuggucugacgcuga

SEQ ID NO: 3887935 - RNA, 15 nt, Shigella flexneri 2a str. 301
cacugguucaaagua

SEQ ID NO: 3887936 - RNA, 19 nt, Shigella flexneri 2a str. 301
cacugguucccaacaacag

SEQ ID NO: 3887937 - RNA, 16 nt, Shigella flexneri 2a str. 301
cacuguaagccaccga

SEQ ID NO: 3887938 - RNA, 14 nt, Shigella flexneri 2a str. 301
cacuguaugaaaca

SEQ ID NO: 3887939 - RNA, 18 nt, Shigella flexneri 2a str. 301
cacuguaugaaacaacgu

SEQ ID NO: 3887940 - RNA, 18 nt, Shigella flexneri 2a str. 301
cacugucgagaucgcggc

SEQ ID NO: 3887941 - RNA, 15 nt, Shigella flexneri 2a str. 301
cacugucuaacaaca

SEQ ID NO: 3887942 - RNA, 20 nt, Shigella flexneri 2a str. 301
cacugugggauugcuucagu

SEQ ID NO: 3887943 - RNA, 20 nt, Shigella flexneri 2a str. 301
cacuguuaccgcugcuggcg

SEQ ID NO: 3887944 - RNA, 19 nt, Shigella flexneri 2a str. 301
cacuguucacuuuugcugc

SEQ ID NO: 3887945 - RNA, 14 nt, Shigella flexneri 2a str. 301
cacuguucauuaaa

SEQ ID NO: 3887946 - RNA, 20 nt, Shigella flexneri 2a str. 301
cacuguucauuaaagccgcc

SEQ ID NO: 3887947 - RNA, 19 nt, Shigella flexneri 2a str. 301
cacuguuggcgaaaauccu

SEQ ID NO: 3887948 - RNA, 23 nt, Shigella flexneri 2a str. 301
cagaagagagauaauucagcagg

SEQ ID NO: 3887949 - RNA, 18 nt, Shigella flexneri 2a str. 301
cagaagaugcguucaccu

SEQ ID NO: 3887950 - RNA, 18 nt, Shigella flexneri 2a str. 301
cagaagcaaucaucccag

SEQ ID NO: 3887951 - RNA, 24 nt, Shigella flexneri 2a str. 301
cagaagcacugccagaaucaaggu

SEQ ID NO: 3887952 - RNA, 14 nt, Shigella flexneri 2a str. 301
cagaagcaguaagu

SEQ ID NO: 3887953 - RNA, 15 nt, Shigella flexneri 2a str. 301
cagaagcaugaacau

SEQ ID NO: 3887954 - RNA, 23 nt, Shigella flexneri 2a str. 301
cagaagcaugaacauugcugcug

SEQ ID NO: 3887955 - RNA, 15 nt, Shigella flexneri 2a str. 301
cagaagcgcagaucg

SEQ ID NO: 3887956 - RNA, 21 nt, Shigella flexneri 2a str. 301
cagaagcgcagaucgaacacg

SEQ ID NO: 3887957 - RNA, 20 nt, Shigella flexneri 2a str. 301
cagaagcguucggcaacugg

SEQ ID NO: 3887958 - RNA, 13 nt, Shigella flexneri 2a str. 301
cagaagcugcagg

SEQ ID NO: 3887959 - RNA, 18 nt, Shigella flexneri 2a str. 301
cagaagcugcaggaccau

SEQ ID NO: 3887960 - RNA, 20 nt, Shigella flexneri 2a str. 301
cagaagcugcaggaccauac

SEQ ID NO: 3887961 - RNA, 19 nt, Shigella flexneri 2a str. 301
cagaaggagcuaauaauga

SEQ ID NO: 3887962 - RNA, 18 nt, Shigella flexneri 2a str. 301
cagaaggauaauuaaucu

SEQ ID NO: 3887963 - RNA, 22 nt, Shigella flexneri 2a str. 301
cagaaggauaauuaaucuuucu

SEQ ID NO: 3887964 - RNA, 13 nt, Shigella flexneri 2a str. 301
cagaaggccagga

SEQ ID NO: 3887965 - RNA, 20 nt, Shigella flexneri 2a str. 301
cagaaggccgcaguaaagcg

SEQ ID NO: 3887966 - RNA, 17 nt, Shigella flexneri 2a str. 301
cagaaggugacccguuu

SEQ ID NO: 3887967 - RNA, 18 nt, Shigella flexneri 2a str. 301
cagaaguaucguuaauuc

SEQ ID NO: 3887968 - RNA, 15 nt, Shigella flexneri 2a str. 301
cagaaguugcaccca

SEQ ID NO: 3887969 - RNA, 16 nt, Shigella flexneri 2a str. 301
cagaaguugcucaagc

SEQ ID NO: 3887970 - RNA, 19 nt, Shigella flexneri 2a str. 301
cagaaguugcucaagcuga

SEQ ID NO: 3887971 - RNA, 20 nt, Shigella flexneri 2a str. 301
cagaaguugcucaagcugaa

SEQ ID NO: 3887972 - RNA, 15 nt, Shigella flexneri 2a str. 301
cagaauaacggcuga

SEQ ID NO: 3887973 - RNA, 18 nt, Shigella flexneri 2a str. 301
cagaauaccuugcugcuc

SEQ ID NO: 3887974 - RNA, 14 nt, Shigella flexneri 2a str. 301
cagaauauccggca

SEQ ID NO: 3887975 - RNA, 23 nt, Shigella flexneri 2a str. 301
cagaauaucguucaagagacugc

SEQ ID NO: 3887976 - RNA, 21 nt, Shigella flexneri 2a str. 301
cagaauauugccgaagaccag

SEQ ID NO: 3887977 - RNA, 22 nt, Shigella flexneri 2a str. 301
cagaauauuugauugcagauuc

SEQ ID NO: 3887978 - RNA, 20 nt, Shigella flexneri 2a str. 301
cagaaucaccucuuuuucca

SEQ ID NO: 3887979 - RNA, 22 nt, Shigella flexneri 2a str. 301
cagaaucagguugaugcgagua

SEQ ID NO: 3887980 - RNA, 17 nt, Shigella flexneri 2a str. 301
cagaauccaggaaagcc

SEQ ID NO: 3887981 - RNA, 18 nt, Shigella flexneri 2a str. 301
cagaauccccacugcaug

SEQ ID NO: 3887982 - RNA, 12 nt, Shigella flexneri 2a str. 301
cagaaucgccag

SEQ ID NO: 3887983 - RNA, 14 nt, Shigella flexneri 2a str. 301
cagaaucgccagca

SEQ ID NO: 3887984 - RNA, 20 nt, Shigella flexneri 2a str. 301
cagaaucgccagcaucggca

SEQ ID NO: 3887985 - RNA, 23 nt, Shigella flexneri 2a str. 301
cagaaucuaagaucccugccauu

SEQ ID NO: 3887986 - RNA, 19 nt, Shigella flexneri 2a str. 301
cagaaucuucuucucagcc

SEQ ID NO: 3887987 - RNA, 14 nt, Shigella flexneri 2a str. 301
cagaaugccccauu

SEQ ID NO: 3887988 - RNA, 19 nt, Shigella flexneri 2a str. 301
cagaaugcgggcgaaaaca

SEQ ID NO: 3887989 - RNA, 19 nt, Shigella flexneri 2a str. 301
cagaauggcgcacucaaaa

SEQ ID NO: 3887990 - RNA, 21 nt, Shigella flexneri 2a str. 301
cagaauggcgcacucaaaacu

SEQ ID NO: 3887991 - RNA, 15 nt, Shigella flexneri 2a str. 301
cagaauuaacgcuga

SEQ ID NO: 3887992 - RNA, 14 nt, Shigella flexneri 2a str. 301
cagaauuugaggaa

SEQ ID NO: 3887993 - RNA, 15 nt, Shigella flexneri 2a str. 301
cagaauuugaggaag

SEQ ID NO: 3887994 - RNA, 17 nt, Shigella flexneri 2a str. 301
cagaauuugaggaagcu

SEQ ID NO: 3887995 - RNA, 14 nt, Shigella flexneri 2a str. 301
cagacaaaacauac

SEQ ID NO: 3887996 - RNA, 20 nt, Shigella flexneri 2a str. 301
cagacaaaauccugccagcg

SEQ ID NO: 3887997 - RNA, 19 nt, Shigella flexneri 2a str. 301
cagacaaaugaacaccaaa

SEQ ID NO: 3887998 - RNA, 19 nt, Shigella flexneri 2a str. 301
cagacaaaugucacugcuu

SEQ ID NO: 3887999 - RNA, 12 nt, Shigella flexneri 2a str. 301
cagacaacauga

SEQ ID NO: 3888000 - RNA, 13 nt, Shigella flexneri 2a str. 301
cagacaacuuccc

SEQ ID NO: 3888001 - RNA, 15 nt, Shigella flexneri 2a str. 301
cagacaauaucggca

SEQ ID NO: 3888002 - RNA, 22 nt, Shigella flexneri 2a str. 301
cagacaauaucggcaccagcgc

SEQ ID NO: 3888003 - RNA, 17 nt, Shigella flexneri 2a str. 301
cagacaaucgccaguga

SEQ ID NO: 3888004 - RNA, 22 nt, Shigella flexneri 2a str. 301
cagacaauggccugcgcgaccu

SEQ ID NO: 3888005 - RNA, 23 nt, Shigella flexneri 2a str. 301
cagacaccagaaugguguuaacc

SEQ ID NO: 3888006 - RNA, 19 nt, Shigella flexneri 2a str. 301
cagacaccgauugccccug

SEQ ID NO: 3888007 - RNA, 17 nt, Shigella flexneri 2a str. 301
cagacacggcguauaca

SEQ ID NO: 3888008 - RNA, 18 nt, Shigella flexneri 2a str. 301
cagacacggcguauacaa

SEQ ID NO: 3888009 - RNA, 21 nt, Shigella flexneri 2a str. 301
cagacacggcguauacaagaa

SEQ ID NO: 3888010 - RNA, 22 nt, Shigella flexneri 2a str. 301
cagacacggcguauacaagaac

SEQ ID NO: 3888011 - RNA, 13 nt, Shigella flexneri 2a str. 301
cagacacuuuccc

SEQ ID NO: 3888012 - RNA, 15 nt, Shigella flexneri 2a str. 301
cagacagcacauuuc

SEQ ID NO: 3888013 - RNA, 21 nt, Shigella flexneri 2a str. 301
cagacaggcgaaacccgcugc

SEQ ID NO: 3888014 - RNA, 23 nt, Shigella flexneri 2a str. 301
cagacaggcgaaacccgcugcca

SEQ ID NO: 3888015 - RNA, 16 nt, Shigella flexneri 2a str. 301
cagacaguaauacggu

SEQ ID NO: 3888016 - RNA, 20 nt, Shigella flexneri 2a str. 301
cagacauaaagccugcuuca

SEQ ID NO: 3888017 - RNA, 12 nt, Shigella flexneri 2a str. 301
cagacaucaagu

SEQ ID NO: 3888018 - RNA, 15 nt, Shigella flexneri 2a str. 301
cagacaucaccagua

SEQ ID NO: 3888019 - RNA, 23 nt, Shigella flexneri 2a str. 301
cagacauuauaaauucuggccac

SEQ ID NO: 3888020 - RNA, 21 nt, Shigella flexneri 2a str. 301
cagaccaauccagccggcaaa

SEQ ID NO: 3888021 - RNA, 18 nt, Shigella flexneri 2a str. 301
cagaccaaucccgccaua

SEQ ID NO: 3888022 - RNA, 20 nt, Shigella flexneri 2a str. 301
cagaccaaucccgccauaac

SEQ ID NO: 3888023 - RNA, 13 nt, Shigella flexneri 2a str. 301
cagaccaauggcu

SEQ ID NO: 3888024 - RNA, 12 nt, Shigella flexneri 2a str. 301
cagaccagcaaa

SEQ ID NO: 3888025 - RNA, 13 nt, Shigella flexneri 2a str. 301
cagaccagcaccg

SEQ ID NO: 3888026 - RNA, 14 nt, Shigella flexneri 2a str. 301
cagaccagcaccgg

SEQ ID NO: 3888027 - RNA, 17 nt, Shigella flexneri 2a str. 301
cagaccagcuaccacgc

SEQ ID NO: 3888028 - RNA, 20 nt, Shigella flexneri 2a str. 301
cagaccaggcgggcgaagcu

SEQ ID NO: 3888029 - RNA, 16 nt, Shigella flexneri 2a str. 301
cagaccauuccucuuc

SEQ ID NO: 3888030 - RNA, 23 nt, Shigella flexneri 2a str. 301
cagaccauuugaucgcuggcagc

SEQ ID NO: 3888031 - RNA, 19 nt, Shigella flexneri 2a str. 301
cagacccacggauagauuu

SEQ ID NO: 3888032 - RNA, 17 nt, Shigella flexneri 2a str. 301
cagacccagacgcucag

SEQ ID NO: 3888033 - RNA, 21 nt, Shigella flexneri 2a str. 301
cagacccagguagacaccaag

SEQ ID NO: 3888034 - RNA, 23 nt, Shigella flexneri 2a str. 301
cagacccugcucuuucagcaccg

SEQ ID NO: 3888035 - RNA, 18 nt, Shigella flexneri 2a str. 301
cagacccuucaucgcucc

SEQ ID NO: 3888036 - RNA, 12 nt, Shigella flexneri 2a str. 301
cagaccgauaca

SEQ ID NO: 3888037 - RNA, 15 nt, Shigella flexneri 2a str. 301
cagaccgccaaccac

SEQ ID NO: 3888038 - RNA, 19 nt, Shigella flexneri 2a str. 301
cagaccgcugacggcagcg

SEQ ID NO: 3888039 - RNA, 20 nt, Shigella flexneri 2a str. 301
cagaccugaauuugcuccag

SEQ ID NO: 3888040 - RNA, 14 nt, Shigella flexneri 2a str. 301
cagaccugcgucac

SEQ ID NO: 3888041 - RNA, 16 nt, Shigella flexneri 2a str. 301
cagaccugcgucacca

SEQ ID NO: 3888042 - RNA, 22 nt, Shigella flexneri 2a str. 301
cagaccugcgucaccacaucca

SEQ ID NO: 3888043 - RNA, 17 nt, Shigella flexneri 2a str. 301
cagaccugcguucagca

SEQ ID NO: 3888044 - RNA, 23 nt, Shigella flexneri 2a str. 301
cagaccuucauagguaaacauca

SEQ ID NO: 3888045 - RNA, 23 nt, Shigella flexneri 2a str. 301
cagaccuuucgaacccaacccua

SEQ ID NO: 3888046 - RNA, 12 nt, Shigella flexneri 2a str. 301
cagacgaaaucg

SEQ ID NO: 3888047 - RNA, 13 nt, Shigella flexneri 2a str. 301
cagaucagaccaa

SEQ ID NO: 3888048 - RNA, 13 nt, Shigella flexneri 2a str. 301
cagaucagccacu

SEQ ID NO: 3888049 - RNA, 13 nt, Shigella flexneri 2a str. 301
cagaucagggaag

SEQ ID NO: 3888050 - RNA, 13 nt, Shigella flexneri 2a str. 301
cagaucauccugc

SEQ ID NO: 3888051 - RNA, 21 nt, Shigella flexneri 2a str. 301
cagauccaaaccgacugccug

SEQ ID NO: 3888052 - RNA, 14 nt, Shigella flexneri 2a str. 301
cagauccagcaccu

SEQ ID NO: 3888053 - RNA, 23 nt, Shigella flexneri 2a str. 301
cagaucccguugaaggguauugc

SEQ ID NO: 3888054 - RNA, 22 nt, Shigella flexneri 2a str. 301
cagauccgccaguuuguagcca

SEQ ID NO: 3888055 - RNA, 13 nt, Shigella flexneri 2a str. 301
cagauccgccauu

SEQ ID NO: 3888056 - RNA, 20 nt, Shigella flexneri 2a str. 301
cagauccgccauuucuccuc

SEQ ID NO: 3888057 - RNA, 15 nt, Shigella flexneri 2a str. 301
cagauccugaaauuc

SEQ ID NO: 3888058 - RNA, 21 nt, Shigella flexneri 2a str. 301
cagaucgaucauauuuccuuc

SEQ ID NO: 3888059 - RNA, 14 nt, Shigella flexneri 2a str. 301
cagaucgccaauau

SEQ ID NO: 3888060 - RNA, 17 nt, Shigella flexneri 2a str. 301
cagaucgccaauaucaa

SEQ ID NO: 3888061 - RNA, 15 nt, Shigella flexneri 2a str. 301
cagaucgcggcccac

SEQ ID NO: 3888062 - RNA, 16 nt, Shigella flexneri 2a str. 301
cagaucgcucaucugc

SEQ ID NO: 3888063 - RNA, 21 nt, Shigella flexneri 2a str. 301
cagaucggacuucaugcgcag

SEQ ID NO: 3888064 - RNA, 14 nt, Shigella flexneri 2a str. 301
cagaucggcagggc

SEQ ID NO: 3888065 - RNA, 17 nt, Shigella flexneri 2a str. 301
cagaucggccaucagua

SEQ ID NO: 3888066 - RNA, 17 nt, Shigella flexneri 2a str. 301
cagaucgugcaucuccu

SEQ ID NO: 3888067 - RNA, 16 nt, Shigella flexneri 2a str. 301
cagaucguuuuccugc

SEQ ID NO: 3888068 - RNA, 13 nt, Shigella flexneri 2a str. 301
cagaucucaccac

SEQ ID NO: 3888069 - RNA, 18 nt, Shigella flexneri 2a str. 301
cagaucugccuguccgga

SEQ ID NO: 3888070 - RNA, 20 nt, Shigella flexneri 2a str. 301
cagaucuggcgauuauuuuc

SEQ ID NO: 3888071 - RNA, 17 nt, Shigella flexneri 2a str. 301
cagaugaaaacgccgga

SEQ ID NO: 3888072 - RNA, 14 nt, Shigella flexneri 2a str. 301
cagaugaaaacgcu

SEQ ID NO: 3888073 - RNA, 20 nt, Shigella flexneri 2a str. 301
cagaugaacgagucaacgcu

SEQ ID NO: 3888074 - RNA, 18 nt, Shigella flexneri 2a str. 301
cagaugaagauuuaaaca

SEQ ID NO: 3888075 - RNA, 17 nt, Shigella flexneri 2a str. 301
cagaugauuaguauugc

SEQ ID NO: 3888076 - RNA, 21 nt, Shigella flexneri 2a str. 301
cagaugauuagucuuuaucug

SEQ ID NO: 3888077 - RNA, 22 nt, Shigella flexneri 2a str. 301
cagaugcaggauuucuucacca

SEQ ID NO: 3888078 - RNA, 23 nt, Shigella flexneri 2a str. 301
cagaugcaggauuucuucaccag

SEQ ID NO: 3888079 - RNA, 14 nt, Shigella flexneri 2a str. 301
cagaugcaucaccg

SEQ ID NO: 3888080 - RNA, 22 nt, Shigella flexneri 2a str. 301
cagaugccaaucaguucaccac

SEQ ID NO: 3888081 - RNA, 19 nt, Shigella flexneri 2a str. 301
cagaugccagaauccccac

SEQ ID NO: 3888082 - RNA, 15 nt, Shigella flexneri 2a str. 301
cagaugccaggaaca

SEQ ID NO: 3888083 - RNA, 15 nt, Shigella flexneri 2a str. 301
cagaugccuugccaa

SEQ ID NO: 3888084 - RNA, 17 nt, Shigella flexneri 2a str. 301
cagaugcgacggcacca

SEQ ID NO: 3888085 - RNA, 23 nt, Shigella flexneri 2a str. 301
cagaugcgacggcaccacauucu

SEQ ID NO: 3888086 - RNA, 19 nt, Shigella flexneri 2a str. 301
cagaugcucuuuucugaag

SEQ ID NO: 3888087 - RNA, 13 nt, Shigella flexneri 2a str. 301
cagaugcuuuaau

SEQ ID NO: 3888088 - RNA, 20 nt, Shigella flexneri 2a str. 301
cagauggccaauaacccgcu

SEQ ID NO: 3888089 - RNA, 17 nt, Shigella flexneri 2a str. 301
cagauggcggcuggcgc

SEQ ID NO: 3888090 - RNA, 20 nt, Shigella flexneri 2a str. 301
cagauggcuauaaucacuca

SEQ ID NO: 3888091 - RNA, 23 nt, Shigella flexneri 2a str. 301
cagauggggauagcgcugcugca

SEQ ID NO: 3888092 - RNA, 17 nt, Shigella flexneri 2a str. 301
cagauguagcucaccuu

SEQ ID NO: 3888093 - RNA, 20 nt, Shigella flexneri 2a str. 301
cagaugugcaccuuuuccac

SEQ ID NO: 3888094 - RNA, 17 nt, Shigella flexneri 2a str. 301
cagaugugcuucugcca

SEQ ID NO: 3888095 - RNA, 18 nt, Shigella flexneri 2a str. 301
cagaugugcuucugccac

SEQ ID NO: 3888096 - RNA, 19 nt, Shigella flexneri 2a str. 301
cagauguugucucagauuc

SEQ ID NO: 3888097 - RNA, 23 nt, Shigella flexneri 2a str. 301
cagauuaugccgcuucaguugcg

SEQ ID NO: 3888098 - RNA, 21 nt, Shigella flexneri 2a str. 301
cagauuaugucgcucaaugcg

SEQ ID NO: 3888099 - RNA, 23 nt, Shigella flexneri 2a str. 301
cagauuauugacaaagugcgcuu

SEQ ID NO: 3888100 - RNA, 21 nt, Shigella flexneri 2a str. 301
cagauucagauuaugucgcuc

SEQ ID NO: 3888101 - RNA, 14 nt, Shigella flexneri 2a str. 301
cagauucagcagcg

SEQ ID NO: 3888102 - RNA, 16 nt, Shigella flexneri 2a str. 301
cagauucagccacauu

SEQ ID NO: 3888103 - RNA, 23 nt, Shigella flexneri 2a str. 301
cagauucucauauaucccuucca

SEQ ID NO: 3888104 - RNA, 18 nt, Shigella flexneri 2a str. 301
cagauugagcauuggcau

SEQ ID NO: 3888105 - RNA, 18 nt, Shigella flexneri 2a str. 301
cagauugcagacaaagug

SEQ ID NO: 3888106 - RNA, 16 nt, Shigella flexneri 2a str. 301
cagauuguggugccga

SEQ ID NO: 3888107 - RNA, 13 nt, Shigella flexneri 2a str. 301
cagauuguugauu

SEQ ID NO: 3888108 - RNA, 21 nt, Shigella flexneri 2a str. 301
cagauuguugauuaacaggcu

SEQ ID NO: 3888109 - RNA, 22 nt, Shigella flexneri 2a str. 301
cagauuguugauuaacaggcug

SEQ ID NO: 3888110 - RNA, 23 nt, Shigella flexneri 2a str. 301
cagauuuauuuacuucugcugca

SEQ ID NO: 3888111 - RNA, 18 nt, Shigella flexneri 2a str. 301
cagauuugccaguaccga

SEQ ID NO: 3888112 - RNA, 21 nt, Shigella flexneri 2a str. 301
cagauuuuaagguugauacga

SEQ ID NO: 3888113 - RNA, 16 nt, Shigella flexneri 2a str. 301
cagauuuugccagcau

SEQ ID NO: 3888114 - RNA, 22 nt, Shigella flexneri 2a str. 301
cagcaaaaauuugcgcgaugcc

SEQ ID NO: 3888115 - RNA, 15 nt, Shigella flexneri 2a str. 301
cagcaaaacacccgc

SEQ ID NO: 3888116 - RNA, 16 nt, Shigella flexneri 2a str. 301
cagcaaaaucaccauc

SEQ ID NO: 3888117 - RNA, 17 nt, Shigella flexneri 2a str. 301
cagcaaaaucaccauca

SEQ ID NO: 3888118 - RNA, 15 nt, Shigella flexneri 2a str. 301
cagcaaaaugcauaa

SEQ ID NO: 3888119 - RNA, 14 nt, Shigella flexneri 2a str. 301
cagcaaacaggugc

SEQ ID NO: 3888120 - RNA, 14 nt, Shigella flexneri 2a str. 301
cagcaaacgcaguu

SEQ ID NO: 3888121 - RNA, 16 nt, Shigella flexneri 2a str. 301
cagcaaacuaucccag

SEQ ID NO: 3888122 - RNA, 20 nt, Shigella flexneri 2a str. 301
cagcaaagcgugcaaauaua

SEQ ID NO: 3888123 - RNA, 17 nt, Shigella flexneri 2a str. 301
cagcaaauccagcgguu

SEQ ID NO: 3888124 - RNA, 18 nt, Shigella flexneri 2a str. 301
cagcaacaaaauggcaaa

SEQ ID NO: 3888125 - RNA, 20 nt, Shigella flexneri 2a str. 301
cagcaacaaaauggcaaagc

SEQ ID NO: 3888126 - RNA, 22 nt, Shigella flexneri 2a str. 301
cagcaacaaauaaccgccugau

SEQ ID NO: 3888127 - RNA, 14 nt, Shigella flexneri 2a str. 301
cagcaacagcgccg

SEQ ID NO: 3888128 - RNA, 11 nt, Shigella flexneri 2a str. 301
cagcaacauag

SEQ ID NO: 3888129 - RNA, 22 nt, Shigella flexneri 2a str. 301
cagcaacaucaaaugcgcagcc

SEQ ID NO: 3888130 - RNA, 13 nt, Shigella flexneri 2a str. 301
cagcaacaugccg

SEQ ID NO: 3888131 - RNA, 20 nt, Shigella flexneri 2a str. 301
cagcaaccaaugccaccagg

SEQ ID NO: 3888132 - RNA, 16 nt, Shigella flexneri 2a str. 301
cagcaacgaaacgccg

SEQ ID NO: 3888133 - RNA, 15 nt, Shigella flexneri 2a str. 301
cagcaacgcuucaac

SEQ ID NO: 3888134 - RNA, 23 nt, Shigella flexneri 2a str. 301
cagcaacgcuucaaccaacgcac

SEQ ID NO: 3888135 - RNA, 22 nt, Shigella flexneri 2a str. 301
cagcaacgcuucguagaagcca

SEQ ID NO: 3888136 - RNA, 14 nt, Shigella flexneri 2a str. 301
cagcaacggccaaa

SEQ ID NO: 3888137 - RNA, 21 nt, Shigella flexneri 2a str. 301
cagcaacgggcugaagaagua

SEQ ID NO: 3888138 - RNA, 15 nt, Shigella flexneri 2a str. 301
cagcaacucaaucgc

SEQ ID NO: 3888139 - RNA, 17 nt, Shigella flexneri 2a str. 301
cagcaacucugguggac

SEQ ID NO: 3888140 - RNA, 18 nt, Shigella flexneri 2a str. 301
cagcaacucuuuuuccug

SEQ ID NO: 3888141 - RNA, 24 nt, Shigella flexneri 2a str. 301
cagcaacucuuuuuccugcugcau

SEQ ID NO: 3888142 - RNA, 17 nt, Shigella flexneri 2a str. 301
cagcaacugacugacuu

SEQ ID NO: 3888143 - RNA, 20 nt, Shigella flexneri 2a str. 301
cagcaacuguaguuguuaau

SEQ ID NO: 3888144 - RNA, 12 nt, Shigella flexneri 2a str. 301
cagcaagaacca

SEQ ID NO: 3888145 - RNA, 17 nt, Shigella flexneri 2a str. 301
cagcaagaccgcgacca

SEQ ID NO: 3888146 - RNA, 15 nt, Shigella flexneri 2a str. 301
cagcauaaucaccag

SEQ ID NO: 3888147 - RNA, 17 nt, Shigella flexneri 2a str. 301
cagcauaaucaccagua

SEQ ID NO: 3888148 - RNA, 18 nt, Shigella flexneri 2a str. 301
cagcauaaucaccaguac

SEQ ID NO: 3888149 - RNA, 17 nt, Shigella flexneri 2a str. 301
cagcauaaucaccauca

SEQ ID NO: 3888150 - RNA, 19 nt, Shigella flexneri 2a str. 301
cagcauaaucaccaucagc

SEQ ID NO: 3888151 - RNA, 17 nt, Shigella flexneri 2a str. 301
cagcauaccgccgagga

SEQ ID NO: 3888152 - RNA, 15 nt, Shigella flexneri 2a str. 301
cagcauaccuucaca

SEQ ID NO: 3888153 - RNA, 21 nt, Shigella flexneri 2a str. 301
cagcauacugauaucauuaaa

SEQ ID NO: 3888154 - RNA, 18 nt, Shigella flexneri 2a str. 301
cagcauauaaugcaacau

SEQ ID NO: 3888155 - RNA, 19 nt, Shigella flexneri 2a str. 301
cagcauauaggaggccucg

SEQ ID NO: 3888156 - RNA, 13 nt, Shigella flexneri 2a str. 301
cagcaucagcagu

SEQ ID NO: 3888157 - RNA, 14 nt, Shigella flexneri 2a str. 301
cagcaucaucgcaa

SEQ ID NO: 3888158 - RNA, 16 nt, Shigella flexneri 2a str. 301
cagcaucaucgcaaug

SEQ ID NO: 3888159 - RNA, 16 nt, Shigella flexneri 2a str. 301
cagcaucccggcagcc

SEQ ID NO: 3888160 - RNA, 12 nt, Shigella flexneri 2a str. 301
cagcauccggca

SEQ ID NO: 3888161 - RNA, 15 nt, Shigella flexneri 2a str. 301
cagcaucgaccagga

SEQ ID NO: 3888162 - RNA, 15 nt, Shigella flexneri 2a str. 301
cagcaucgcauccgg

SEQ ID NO: 3888163 - RNA, 16 nt, Shigella flexneri 2a str. 301
cagcaucggcagcgcc

SEQ ID NO: 3888164 - RNA, 20 nt, Shigella flexneri 2a str. 301
cagcaucggcggcguaucga

SEQ ID NO: 3888165 - RNA, 24 nt, Shigella flexneri 2a str. 301
cagcaucggcggcguaucgacaau

SEQ ID NO: 3888166 - RNA, 22 nt, Shigella flexneri 2a str. 301
cagcaucggugaggaucaccag

SEQ ID NO: 3888167 - RNA, 17 nt, Shigella flexneri 2a str. 301
cagcaucgucaucauuc

SEQ ID NO: 3888168 - RNA, 11 nt, Shigella flexneri 2a str. 301
cagcaucuccu

SEQ ID NO: 3888169 - RNA, 20 nt, Shigella flexneri 2a str. 301
cagcaucuccugcaacaggu

SEQ ID NO: 3888170 - RNA, 21 nt, Shigella flexneri 2a str. 301
cagcaucucgcgcucuucuuc

SEQ ID NO: 3888171 - RNA, 13 nt, Shigella flexneri 2a str. 301
cagcaucuggaug

SEQ ID NO: 3888172 - RNA, 15 nt, Shigella flexneri 2a str. 301
cagcaucuggaugaa

SEQ ID NO: 3888173 - RNA, 19 nt, Shigella flexneri 2a str. 301
cagcaucuggaugaaaaaa

SEQ ID NO: 3888174 - RNA, 17 nt, Shigella flexneri 2a str. 301
cagcaugacguccugua

SEQ ID NO: 3888175 - RNA, 15 nt, Shigella flexneri 2a str. 301
cagcaugcacccuca

SEQ ID NO: 3888176 - RNA, 19 nt, Shigella flexneri 2a str. 301
cagcaugcacccucaacaa

SEQ ID NO: 3888177 - RNA, 19 nt, Shigella flexneri 2a str. 301
cagcaugcacccucaauaa

SEQ ID NO: 3888178 - RNA, 14 nt, Shigella flexneri 2a str. 301
cagcaugcucacca

SEQ ID NO: 3888179 - RNA, 22 nt, Shigella flexneri 2a str. 301
cagcauggaaauguuccggcga

SEQ ID NO: 3888180 - RNA, 12 nt, Shigella flexneri 2a str. 301
cagcauggcaau

SEQ ID NO: 3888181 - RNA, 13 nt, Shigella flexneri 2a str. 301
cagcauggcaaua

SEQ ID NO: 3888182 - RNA, 17 nt, Shigella flexneri 2a str. 301
cagcauguagaugccgg

SEQ ID NO: 3888183 - RNA, 20 nt, Shigella flexneri 2a str. 301
cagcaugugguuaccaucaa

SEQ ID NO: 3888184 - RNA, 14 nt, Shigella flexneri 2a str. 301
cagcauguuuauau

SEQ ID NO: 3888185 - RNA, 15 nt, Shigella flexneri 2a str. 301
cagcauuccagauac

SEQ ID NO: 3888186 - RNA, 20 nt, Shigella flexneri 2a str. 301
cagcauuccagauacgaccg

SEQ ID NO: 3888187 - RNA, 19 nt, Shigella flexneri 2a str. 301
cagcauucccgccagcggc

SEQ ID NO: 3888188 - RNA, 17 nt, Shigella flexneri 2a str. 301
cagcauucucaucacca

SEQ ID NO: 3888189 - RNA, 21 nt, Shigella flexneri 2a str. 301
cagcauugcucaccgccagca

SEQ ID NO: 3888190 - RNA, 22 nt, Shigella flexneri 2a str. 301
cagcauugcucaccgccagcau

SEQ ID NO: 3888191 - RNA, 23 nt, Shigella flexneri 2a str. 301
cagcauugcucaccgccagcauc

SEQ ID NO: 3888192 - RNA, 12 nt, Shigella flexneri 2a str. 301
cagcauuucuuc

SEQ ID NO: 3888193 - RNA, 15 nt, Shigella flexneri 2a str. 301
cagccaaccacauga

SEQ ID NO: 3888194 - RNA, 19 nt, Shigella flexneri 2a str. 301
cagccaacuggagaacgcg

SEQ ID NO: 3888195 - RNA, 17 nt, Shigella flexneri 2a str. 301
cagccaaugcaggcauc

SEQ ID NO: 3888196 - RNA, 16 nt, Shigella flexneri 2a str. 301
cagccacaccaaucaa

SEQ ID NO: 3888197 - RNA, 14 nt, Shigella flexneri 2a str. 301
cagccaccgccagc

SEQ ID NO: 3888198 - RNA, 22 nt, Shigella flexneri 2a str. 301
cagccaccgcguuccacgggga

SEQ ID NO: 3888199 - RNA, 16 nt, Shigella flexneri 2a str. 301
cagccacggcuccagc

SEQ ID NO: 3888200 - RNA, 17 nt, Shigella flexneri 2a str. 301
cagccacggcuccagca

SEQ ID NO: 3888201 - RNA, 13 nt, Shigella flexneri 2a str. 301
cagccacuccuua

SEQ ID NO: 3888202 - RNA, 17 nt, Shigella flexneri 2a str. 301
cagccacucggacaccu

SEQ ID NO: 3888203 - RNA, 22 nt, Shigella flexneri 2a str. 301
cagccacuuccugcucgguaaa

SEQ ID NO: 3888204 - RNA, 15 nt, Shigella flexneri 2a str. 301
cagccacuucuucca

SEQ ID NO: 3888205 - RNA, 17 nt, Shigella flexneri 2a str. 301
cagccacuucuuccagc

SEQ ID NO: 3888206 - RNA, 17 nt, Shigella flexneri 2a str. 301
cagccagaaagaaccgu

SEQ ID NO: 3888207 - RNA, 16 nt, Shigella flexneri 2a str. 301
cagccagaaugucccc

SEQ ID NO: 3888208 - RNA, 16 nt, Shigella flexneri 2a str. 301
cagccagaauuacccc

SEQ ID NO: 3888209 - RNA, 16 nt, Shigella flexneri 2a str. 301
cagccagagccaccaa

SEQ ID NO: 3888210 - RNA, 14 nt, Shigella flexneri 2a str. 301
cagccagaugccuu

SEQ ID NO: 3888211 - RNA, 15 nt, Shigella flexneri 2a str. 301
cagccagcacugccg

SEQ ID NO: 3888212 - RNA, 14 nt, Shigella flexneri 2a str. 301
cagccagcagcgaa

SEQ ID NO: 3888213 - RNA, 20 nt, Shigella flexneri 2a str. 301
cagccagccgaacagcgcca

SEQ ID NO: 3888214 - RNA, 19 nt, Shigella flexneri 2a str. 301
cagccagccgcuaacuucc

SEQ ID NO: 3888215 - RNA, 14 nt, Shigella flexneri 2a str. 301
cagccagcgcgccu

SEQ ID NO: 3888216 - RNA, 19 nt, Shigella flexneri 2a str. 301
cagccagcgucacccagac

SEQ ID NO: 3888217 - RNA, 14 nt, Shigella flexneri 2a str. 301
cagccaggccgcca

SEQ ID NO: 3888218 - RNA, 16 nt, Shigella flexneri 2a str. 301
cagccaggcgcgaaug

SEQ ID NO: 3888219 - RNA, 15 nt, Shigella flexneri 2a str. 301
cagccaggguuauau

SEQ ID NO: 3888220 - RNA, 14 nt, Shigella flexneri 2a str. 301
cagccagguuuugu

SEQ ID NO: 3888221 - RNA, 21 nt, Shigella flexneri 2a str. 301
cagccaguauugccaugcacg

SEQ ID NO: 3888222 - RNA, 21 nt, Shigella flexneri 2a str. 301
cagccaguuuuucagcgccag

SEQ ID NO: 3888223 - RNA, 20 nt, Shigella flexneri 2a str. 301
cagccauaaagaaaucaccu

SEQ ID NO: 3888224 - RNA, 23 nt, Shigella flexneri 2a str. 301
cagccauaaagaaaucaccugcc

SEQ ID NO: 3888225 - RNA, 22 nt, Shigella flexneri 2a str. 301
cagccauaaccccaccagcaug

SEQ ID NO: 3888226 - RNA, 16 nt, Shigella flexneri 2a str. 301
cagccauaaucacucu

SEQ ID NO: 3888227 - RNA, 21 nt, Shigella flexneri 2a str. 301
cagccauaaucacucuucccc

SEQ ID NO: 3888228 - RNA, 19 nt, Shigella flexneri 2a str. 301
cagccauaccgggaucagg

SEQ ID NO: 3888229 - RNA, 12 nt, Shigella flexneri 2a str. 301
cagccaucaucc

SEQ ID NO: 3888230 - RNA, 14 nt, Shigella flexneri 2a str. 301
cagccaucauccau

SEQ ID NO: 3888231 - RNA, 15 nt, Shigella flexneri 2a str. 301
cagccaucauccauu

SEQ ID NO: 3888232 - RNA, 11 nt, Shigella flexneri 2a str. 301
cagccaucuga

SEQ ID NO: 3888233 - RNA, 15 nt, Shigella flexneri 2a str. 301
cagccaucuuucgca

SEQ ID NO: 3888234 - RNA, 16 nt, Shigella flexneri 2a str. 301
cagccaucuuucgcag

SEQ ID NO: 3888235 - RNA, 17 nt, Shigella flexneri 2a str. 301
cagccaugcggcaucuu

SEQ ID NO: 3888236 - RNA, 17 nt, Shigella flexneri 2a str. 301
cagccauuaaccagcca

SEQ ID NO: 3888237 - RNA, 21 nt, Shigella flexneri 2a str. 301
cagccauuaaccagccacugc

SEQ ID NO: 3888238 - RNA, 14 nt, Shigella flexneri 2a str. 301
cagccauucaaucu

SEQ ID NO: 3888239 - RNA, 23 nt, Shigella flexneri 2a str. 301
cagccauugugaccuuugacuca

SEQ ID NO: 3888240 - RNA, 13 nt, Shigella flexneri 2a str. 301
cagccauuuugca

SEQ ID NO: 3888241 - RNA, 22 nt, Shigella flexneri 2a str. 301
cagccauuuugcacauuccaga

SEQ ID NO: 3888242 - RNA, 12 nt, Shigella flexneri 2a str. 301
cagcccaaagca

SEQ ID NO: 3888243 - RNA, 20 nt, Shigella flexneri 2a str. 301
cagcccaaagcagaguugcu

SEQ ID NO: 3888244 - RNA, 13 nt, Shigella flexneri 2a str. 301
cagcccaaccacg

SEQ ID NO: 3888245 - RNA, 13 nt, Shigella flexneri 2a str. 301
cagcccaauaccu

SEQ ID NO: 3888246 - RNA, 15 nt, Shigella flexneri 2a str. 301
cagcgaugaugagcg

SEQ ID NO: 3888247 - RNA, 22 nt, Shigella flexneri 2a str. 301
cagcgaugcuuugcgcuuuucu

SEQ ID NO: 3888248 - RNA, 20 nt, Shigella flexneri 2a str. 301
cagcgauuacuguacagauc

SEQ ID NO: 3888249 - RNA, 16 nt, Shigella flexneri 2a str. 301
cagcgauuuaucggca

SEQ ID NO: 3888250 - RNA, 19 nt, Shigella flexneri 2a str. 301
cagcgauuuugccagccgc

SEQ ID NO: 3888251 - RNA, 23 nt, Shigella flexneri 2a str. 301
cagcgauuuuggguuccacuucu

SEQ ID NO: 3888252 - RNA, 14 nt, Shigella flexneri 2a str. 301
cagcgcaaaacgca

SEQ ID NO: 3888253 - RNA, 19 nt, Shigella flexneri 2a str. 301
cagcgcaauuaacgcccca

SEQ ID NO: 3888254 - RNA, 17 nt, Shigella flexneri 2a str. 301
cagcgcaauucgcgucg

SEQ ID NO: 3888255 - RNA, 19 nt, Shigella flexneri 2a str. 301
cagcgcaauuggcacgccg

SEQ ID NO: 3888256 - RNA, 23 nt, Shigella flexneri 2a str. 301
cagcgcacaguuauaaaaugaua

SEQ ID NO: 3888257 - RNA, 14 nt, Shigella flexneri 2a str. 301
cagcgcaccagaaa

SEQ ID NO: 3888258 - RNA, 19 nt, Shigella flexneri 2a str. 301
cagcgcacgggcgguuaau

SEQ ID NO: 3888259 - RNA, 20 nt, Shigella flexneri 2a str. 301
cagcgcagaagagcuggggc

SEQ ID NO: 3888260 - RNA, 13 nt, Shigella flexneri 2a str. 301
cagcgcagcaccc

SEQ ID NO: 3888261 - RNA, 15 nt, Shigella flexneri 2a str. 301
cagcgcagcucuggc

SEQ ID NO: 3888262 - RNA, 13 nt, Shigella flexneri 2a str. 301
cagcgcaggaaag

SEQ ID NO: 3888263 - RNA, 19 nt, Shigella flexneri 2a str. 301
cagcgcauagcuaaucccc

SEQ ID NO: 3888264 - RNA, 18 nt, Shigella flexneri 2a str. 301
cagcgcauccauuacauc

SEQ ID NO: 3888265 - RNA, 15 nt, Shigella flexneri 2a str. 301
cagcgcaucugccgg

SEQ ID NO: 3888266 - RNA, 21 nt, Shigella flexneri 2a str. 301
cagcgcauggcggcagcgugc

SEQ ID NO: 3888267 - RNA, 15 nt, Shigella flexneri 2a str. 301
cagcgcauucguaau

SEQ ID NO: 3888268 - RNA, 14 nt, Shigella flexneri 2a str. 301
cagcgccaacgcac

SEQ ID NO: 3888269 - RNA, 20 nt, Shigella flexneri 2a str. 301
cagcgccaacgcaccugaaa

SEQ ID NO: 3888270 - RNA, 22 nt, Shigella flexneri 2a str. 301
cagcgccaacggugaaaaacca

SEQ ID NO: 3888271 - RNA, 17 nt, Shigella flexneri 2a str. 301
cagcgccacauccggcu

SEQ ID NO: 3888272 - RNA, 12 nt, Shigella flexneri 2a str. 301
cagcgccaccac

SEQ ID NO: 3888273 - RNA, 18 nt, Shigella flexneri 2a str. 301
cagcgccaccaccagcac

SEQ ID NO: 3888274 - RNA, 15 nt, Shigella flexneri 2a str. 301
cagcgccagaaggga

SEQ ID NO: 3888275 - RNA, 15 nt, Shigella flexneri 2a str. 301
cagcgccagacacug

SEQ ID NO: 3888276 - RNA, 19 nt, Shigella flexneri 2a str. 301
cagcgccagacacuggaaa

SEQ ID NO: 3888277 - RNA, 15 nt, Shigella flexneri 2a str. 301
cagcgccagauagcc

SEQ ID NO: 3888278 - RNA, 14 nt, Shigella flexneri 2a str. 301
cagcgccaguugcu

SEQ ID NO: 3888279 - RNA, 13 nt, Shigella flexneri 2a str. 301
cagcgccaucccu

SEQ ID NO: 3888280 - RNA, 21 nt, Shigella flexneri 2a str. 301
cagcgccauuguguuaucccg

SEQ ID NO: 3888281 - RNA, 22 nt, Shigella flexneri 2a str. 301
cagcgcccgacaagauccugau

SEQ ID NO: 3888282 - RNA, 19 nt, Shigella flexneri 2a str. 301
cagcgcccgccagcaccgg

SEQ ID NO: 3888283 - RNA, 21 nt, Shigella flexneri 2a str. 301
cagcgccgccagaaucaccuc

SEQ ID NO: 3888284 - RNA, 14 nt, Shigella flexneri 2a str. 301
cagcgccgcgccua

SEQ ID NO: 3888285 - RNA, 19 nt, Shigella flexneri 2a str. 301
cagcgccugauacagccaa

SEQ ID NO: 3888286 - RNA, 14 nt, Shigella flexneri 2a str. 301
cagcgccugaugga

SEQ ID NO: 3888287 - RNA, 16 nt, Shigella flexneri 2a str. 301
cagcgccugcgcggca

SEQ ID NO: 3888288 - RNA, 13 nt, Shigella flexneri 2a str. 301
cagcgccugcugc

SEQ ID NO: 3888289 - RNA, 15 nt, Shigella flexneri 2a str. 301
cagcgccugcugcac

SEQ ID NO: 3888290 - RNA, 12 nt, Shigella flexneri 2a str. 301
cagcgccuggcu

SEQ ID NO: 3888291 - RNA, 13 nt, Shigella flexneri 2a str. 301
cagcgccuucaga

SEQ ID NO: 3888292 - RNA, 12 nt, Shigella flexneri 2a str. 301
cagcgcgauacg

SEQ ID NO: 3888293 - RNA, 20 nt, Shigella flexneri 2a str. 301
cagcgcgccgccaauaauca

SEQ ID NO: 3888294 - RNA, 19 nt, Shigella flexneri 2a str. 301
cagcgcgccugaaugccac

SEQ ID NO: 3888295 - RNA, 16 nt, Shigella flexneri 2a str. 301
cagcgcgcuaucggca

SEQ ID NO: 3888296 - RNA, 20 nt, Shigella flexneri 2a str. 301
cagcgcggaagggaugaaau

SEQ ID NO: 3888297 - RNA, 16 nt, Shigella flexneri 2a str. 301
cagcgcgggcuggcgu

SEQ ID NO: 3888298 - RNA, 18 nt, Shigella flexneri 2a str. 301
cagcgcggugacgcacag

SEQ ID NO: 3888299 - RNA, 19 nt, Shigella flexneri 2a str. 301
cagcgcggugauaaccguu

SEQ ID NO: 3888300 - RNA, 16 nt, Shigella flexneri 2a str. 301
cagcgcgucgucaauc

SEQ ID NO: 3888301 - RNA, 17 nt, Shigella flexneri 2a str. 301
cagcgcuaaccgccuga

SEQ ID NO: 3888302 - RNA, 15 nt, Shigella flexneri 2a str. 301
cagcgcuaccgccga

SEQ ID NO: 3888303 - RNA, 20 nt, Shigella flexneri 2a str. 301
cagcgcugcgaaaguaccau

SEQ ID NO: 3888304 - RNA, 14 nt, Shigella flexneri 2a str. 301
cagcgcugcgcgcu

SEQ ID NO: 3888305 - RNA, 21 nt, Shigella flexneri 2a str. 301
cagcgcugcgcgcuucgcccu

SEQ ID NO: 3888306 - RNA, 21 nt, Shigella flexneri 2a str. 301
cagcgcugcggcgcgcaucuu

SEQ ID NO: 3888307 - RNA, 20 nt, Shigella flexneri 2a str. 301
cagcgcuucacuaugacgaa

SEQ ID NO: 3888308 - RNA, 13 nt, Shigella flexneri 2a str. 301
cagcgcuucgcuc

SEQ ID NO: 3888309 - RNA, 23 nt, Shigella flexneri 2a str. 301
cagcggaaauuaccgcaccacca

SEQ ID NO: 3888310 - RNA, 15 nt, Shigella flexneri 2a str. 301
cagcggaauaucaga

SEQ ID NO: 3888311 - RNA, 19 nt, Shigella flexneri 2a str. 301
cagcggacaaugccuaccg

SEQ ID NO: 3888312 - RNA, 14 nt, Shigella flexneri 2a str. 301
cagcggacagccau

SEQ ID NO: 3888313 - RNA, 14 nt, Shigella flexneri 2a str. 301
cagcggaugaccca

SEQ ID NO: 3888314 - RNA, 19 nt, Shigella flexneri 2a str. 301
cagcggcaaacgacgcaga

SEQ ID NO: 3888315 - RNA, 18 nt, Shigella flexneri 2a str. 301
cagcggcaaccagcccau

SEQ ID NO: 3888316 - RNA, 16 nt, Shigella flexneri 2a str. 301
cagcggcagcucgcgu

SEQ ID NO: 3888317 - RNA, 21 nt, Shigella flexneri 2a str. 301
cagcggcauuacgcgccccuu

SEQ ID NO: 3888318 - RNA, 22 nt, Shigella flexneri 2a str. 301
cagcggcauuacgcgccccuuc

SEQ ID NO: 3888319 - RNA, 15 nt, Shigella flexneri 2a str. 301
cagcggccaaccauc

SEQ ID NO: 3888320 - RNA, 15 nt, Shigella flexneri 2a str. 301
cagcggcuccuggcg

SEQ ID NO: 3888321 - RNA, 12 nt, Shigella flexneri 2a str. 301
cagcggcugcca

SEQ ID NO: 3888322 - RNA, 16 nt, Shigella flexneri 2a str. 301
cagcggcugcugaugu

SEQ ID NO: 3888323 - RNA, 22 nt, Shigella flexneri 2a str. 301
cagcgggaucggcguacuggca

SEQ ID NO: 3888324 - RNA, 21 nt, Shigella flexneri 2a str. 301
cagcgggcgaaucaacuccag

SEQ ID NO: 3888325 - RNA, 21 nt, Shigella flexneri 2a str. 301
cagcgggguucuccugagaau

SEQ ID NO: 3888326 - RNA, 12 nt, Shigella flexneri 2a str. 301
cagcggguuaau

SEQ ID NO: 3888327 - RNA, 14 nt, Shigella flexneri 2a str. 301
cagcggucacaugu

SEQ ID NO: 3888328 - RNA, 18 nt, Shigella flexneri 2a str. 301
cagcggugccgcgauacc

SEQ ID NO: 3888329 - RNA, 16 nt, Shigella flexneri 2a str. 301
cagcgguguacccugc

SEQ ID NO: 3888330 - RNA, 18 nt, Shigella flexneri 2a str. 301
cagcgguucacuccacug

SEQ ID NO: 3888331 - RNA, 19 nt, Shigella flexneri 2a str. 301
cagcgguugggcaucggca

SEQ ID NO: 3888332 - RNA, 17 nt, Shigella flexneri 2a str. 301
cagcgguuugcgcaucc

SEQ ID NO: 3888333 - RNA, 15 nt, Shigella flexneri 2a str. 301
cagcgguuuugccag

SEQ ID NO: 3888334 - RNA, 17 nt, Shigella flexneri 2a str. 301
cagcgguuuugccagcg

SEQ ID NO: 3888335 - RNA, 19 nt, Shigella flexneri 2a str. 301
cagcgguuuugcuauccag

SEQ ID NO: 3888336 - RNA, 18 nt, Shigella flexneri 2a str. 301
cagcguaaaggcggcaga

SEQ ID NO: 3888337 - RNA, 23 nt, Shigella flexneri 2a str. 301
cagcguaaaggcggcagaacaga

SEQ ID NO: 3888338 - RNA, 19 nt, Shigella flexneri 2a str. 301
cagcguaccaugauccugc

SEQ ID NO: 3888339 - RNA, 20 nt, Shigella flexneri 2a str. 301
cagcguaccaugauccugca

SEQ ID NO: 3888340 - RNA, 17 nt, Shigella flexneri 2a str. 301
cagcguacccugaucaa

SEQ ID NO: 3888341 - RNA, 19 nt, Shigella flexneri 2a str. 301
cagcguacguuggcaaagu

SEQ ID NO: 3888342 - RNA, 17 nt, Shigella flexneri 2a str. 301
cagcguauucgcgcaga

SEQ ID NO: 3888343 - RNA, 18 nt, Shigella flexneri 2a str. 301
cagcgucacccagacaaa

SEQ ID NO: 3888344 - RNA, 14 nt, Shigella flexneri 2a str. 301
cagcgucagaaaca

SEQ ID NO: 3888345 - RNA, 14 nt, Shigella flexneri 2a str. 301
cagcgucagcacca

SEQ ID NO: 3888346 - RNA, 22 nt, Shigella flexneri 2a str. 301
cagcuugucuacgccuuguuuc

SEQ ID NO: 3888347 - RNA, 15 nt, Shigella flexneri 2a str. 301
cagcuuucagcagcg

SEQ ID NO: 3888348 - RNA, 19 nt, Shigella flexneri 2a str. 301
cagcuuucagcagcggcuc

SEQ ID NO: 3888349 - RNA, 14 nt, Shigella flexneri 2a str. 301
cagcuuucccuuca

SEQ ID NO: 3888350 - RNA, 14 nt, Shigella flexneri 2a str. 301
cagcuuuggugaaa

SEQ ID NO: 3888351 - RNA, 17 nt, Shigella flexneri 2a str. 301
cagcuuuuagaucacuc

SEQ ID NO: 3888352 - RNA, 23 nt, Shigella flexneri 2a str. 301
cagcuuuucgauaacccggcggc

SEQ ID NO: 3888353 - RNA, 22 nt, Shigella flexneri 2a str. 301
cagcuuuuuagcgaucucgguc

SEQ ID NO: 3888354 - RNA, 21 nt, Shigella flexneri 2a str. 301
caggaaaaucagcaucaaccc

SEQ ID NO: 3888355 - RNA, 17 nt, Shigella flexneri 2a str. 301
caggaaaucgucgaggg

SEQ ID NO: 3888356 - RNA, 21 nt, Shigella flexneri 2a str. 301
caggaaauuauggaucaccau

SEQ ID NO: 3888357 - RNA, 22 nt, Shigella flexneri 2a str. 301
caggaaauuauggaucaccauc

SEQ ID NO: 3888358 - RNA, 19 nt, Shigella flexneri 2a str. 301
caggaacagccacugguga

SEQ ID NO: 3888359 - RNA, 15 nt, Shigella flexneri 2a str. 301
caggaaccgcauacg

SEQ ID NO: 3888360 - RNA, 19 nt, Shigella flexneri 2a str. 301
caggaaccugugacagcag

SEQ ID NO: 3888361 - RNA, 18 nt, Shigella flexneri 2a str. 301
caggaacgcgccaagaua

SEQ ID NO: 3888362 - RNA, 14 nt, Shigella flexneri 2a str. 301
caggaacugcucau

SEQ ID NO: 3888363 - RNA, 16 nt, Shigella flexneri 2a str. 301
caggaagaccugcagc

SEQ ID NO: 3888364 - RNA, 15 nt, Shigella flexneri 2a str. 301
caggaaguccgagga

SEQ ID NO: 3888365 - RNA, 21 nt, Shigella flexneri 2a str. 301
caggaauaaaucuaaaagaug

SEQ ID NO: 3888366 - RNA, 19 nt, Shigella flexneri 2a str. 301
caggaauaaucagcaacga

SEQ ID NO: 3888367 - RNA, 15 nt, Shigella flexneri 2a str. 301
caggaauacgcccgu

SEQ ID NO: 3888368 - RNA, 21 nt, Shigella flexneri 2a str. 301
caggaauagcggcaagcccag

SEQ ID NO: 3888369 - RNA, 12 nt, Shigella flexneri 2a str. 301
caggaauauacc

SEQ ID NO: 3888370 - RNA, 20 nt, Shigella flexneri 2a str. 301
caggaaucacguaggccuga

SEQ ID NO: 3888371 - RNA, 15 nt, Shigella flexneri 2a str. 301
caggaauggcgaagg

SEQ ID NO: 3888372 - RNA, 17 nt, Shigella flexneri 2a str. 301
caggaauucagaaaaau

SEQ ID NO: 3888373 - RNA, 17 nt, Shigella flexneri 2a str. 301
caggacagucagaccgu

SEQ ID NO: 3888374 - RNA, 20 nt, Shigella flexneri 2a str. 301
caggaccauacugacggauc

SEQ ID NO: 3888375 - RNA, 15 nt, Shigella flexneri 2a str. 301
caggaccauucacac

SEQ ID NO: 3888376 - RNA, 18 nt, Shigella flexneri 2a str. 301
caggaccguucgcuaccu

SEQ ID NO: 3888377 - RNA, 19 nt, Shigella flexneri 2a str. 301
caggaccuugacgaauacu

SEQ ID NO: 3888378 - RNA, 17 nt, Shigella flexneri 2a str. 301
caggacgaguacggauu

SEQ ID NO: 3888379 - RNA, 14 nt, Shigella flexneri 2a str. 301
caggacgauaaacc

SEQ ID NO: 3888380 - RNA, 21 nt, Shigella flexneri 2a str. 301
caggacgcccgguaucaacga

SEQ ID NO: 3888381 - RNA, 12 nt, Shigella flexneri 2a str. 301
caggacuauuuu

SEQ ID NO: 3888382 - RNA, 15 nt, Shigella flexneri 2a str. 301
caggacuuugaaagc

SEQ ID NO: 3888383 - RNA, 16 nt, Shigella flexneri 2a str. 301
caggagaagcaucagc

SEQ ID NO: 3888384 - RNA, 22 nt, Shigella flexneri 2a str. 301
caggagacgcgcaaaucagauu

SEQ ID NO: 3888385 - RNA, 14 nt, Shigella flexneri 2a str. 301
caggagauuaacgg

SEQ ID NO: 3888386 - RNA, 12 nt, Shigella flexneri 2a str. 301
caggagcacgcu

SEQ ID NO: 3888387 - RNA, 15 nt, Shigella flexneri 2a str. 301
caggagcagcagguu

SEQ ID NO: 3888388 - RNA, 12 nt, Shigella flexneri 2a str. 301
caggagcaggcu

SEQ ID NO: 3888389 - RNA, 22 nt, Shigella flexneri 2a str. 301
caggagcgauuaugaaacaaga

SEQ ID NO: 3888390 - RNA, 19 nt, Shigella flexneri 2a str. 301
caggaggcguaauuuccac

SEQ ID NO: 3888391 - RNA, 17 nt, Shigella flexneri 2a str. 301
caggauaaacuccugca

SEQ ID NO: 3888392 - RNA, 12 nt, Shigella flexneri 2a str. 301
caggauacgcau

SEQ ID NO: 3888393 - RNA, 22 nt, Shigella flexneri 2a str. 301
caggauaucguggcacguacca

SEQ ID NO: 3888394 - RNA, 17 nt, Shigella flexneri 2a str. 301
caggauauuuauauuuu

SEQ ID NO: 3888395 - RNA, 13 nt, Shigella flexneri 2a str. 301
caggaucagcucc

SEQ ID NO: 3888396 - RNA, 17 nt, Shigella flexneri 2a str. 301
caggaucgcagccgagu

SEQ ID NO: 3888397 - RNA, 17 nt, Shigella flexneri 2a str. 301
caggaucggugcugcca

SEQ ID NO: 3888398 - RNA, 17 nt, Shigella flexneri 2a str. 301
caggaucuccagcuccc

SEQ ID NO: 3888399 - RNA, 15 nt, Shigella flexneri 2a str. 301
caggaucugacuggc

SEQ ID NO: 3888400 - RNA, 16 nt, Shigella flexneri 2a str. 301
caggaucugcgcggca

SEQ ID NO: 3888401 - RNA, 23 nt, Shigella flexneri 2a str. 301
caggaucuggcuugccagcaggg

SEQ ID NO: 3888402 - RNA, 17 nt, Shigella flexneri 2a str. 301
caggaucugguguuaaa

SEQ ID NO: 3888403 - RNA, 18 nt, Shigella flexneri 2a str. 301
caggaugauuccggcaaa

SEQ ID NO: 3888404 - RNA, 18 nt, Shigella flexneri 2a str. 301
caggaugcagaaaccaaa

SEQ ID NO: 3888405 - RNA, 16 nt, Shigella flexneri 2a str. 301
caggaugcggcuaauu

SEQ ID NO: 3888406 - RNA, 23 nt, Shigella flexneri 2a str. 301
caggauggcguucgcaacaccgu

SEQ ID NO: 3888407 - RNA, 21 nt, Shigella flexneri 2a str. 301
caggauggcuggccgugcaga

SEQ ID NO: 3888408 - RNA, 12 nt, Shigella flexneri 2a str. 301
caggaugggcaa

SEQ ID NO: 3888409 - RNA, 16 nt, Shigella flexneri 2a str. 301
caggaugggcaacgcg

SEQ ID NO: 3888410 - RNA, 16 nt, Shigella flexneri 2a str. 301
caggaugggcauauuu

SEQ ID NO: 3888411 - RNA, 12 nt, Shigella flexneri 2a str. 301
caggauuauguu

SEQ ID NO: 3888412 - RNA, 20 nt, Shigella flexneri 2a str. 301
caggauuauguugcgccugc

SEQ ID NO: 3888413 - RNA, 14 nt, Shigella flexneri 2a str. 301
caggcaaaccagua

SEQ ID NO: 3888414 - RNA, 15 nt, Shigella flexneri 2a str. 301
caggcaaaccaguac

SEQ ID NO: 3888415 - RNA, 22 nt, Shigella flexneri 2a str. 301
caggcaaacuucacgcauuuac

SEQ ID NO: 3888416 - RNA, 14 nt, Shigella flexneri 2a str. 301
caggcaaaucccau

SEQ ID NO: 3888417 - RNA, 16 nt, Shigella flexneri 2a str. 301
caggcaacagggaaau

SEQ ID NO: 3888418 - RNA, 14 nt, Shigella flexneri 2a str. 301
caggcaaccgcuga

SEQ ID NO: 3888419 - RNA, 21 nt, Shigella flexneri 2a str. 301
caggcaacuacguuuuuauug

SEQ ID NO: 3888420 - RNA, 14 nt, Shigella flexneri 2a str. 301
caggcaagcauaug

SEQ ID NO: 3888421 - RNA, 16 nt, Shigella flexneri 2a str. 301
caggcaagcauaugac

SEQ ID NO: 3888422 - RNA, 22 nt, Shigella flexneri 2a str. 301
caggcaagccgcuaacagcagc

SEQ ID NO: 3888423 - RNA, 17 nt, Shigella flexneri 2a str. 301
caggcaaucagcaaucg

SEQ ID NO: 3888424 - RNA, 21 nt, Shigella flexneri 2a str. 301
caggcaaucgagcccagaugc

SEQ ID NO: 3888425 - RNA, 19 nt, Shigella flexneri 2a str. 301
caggcaauguugcguuugu

SEQ ID NO: 3888426 - RNA, 17 nt, Shigella flexneri 2a str. 301
caggcacaccgccgccg

SEQ ID NO: 3888427 - RNA, 17 nt, Shigella flexneri 2a str. 301
caggcaccagccccugg

SEQ ID NO: 3888428 - RNA, 21 nt, Shigella flexneri 2a str. 301
caggcagauacaaccaaucgc

SEQ ID NO: 3888429 - RNA, 16 nt, Shigella flexneri 2a str. 301
caggcagcacugcuua

SEQ ID NO: 3888430 - RNA, 15 nt, Shigella flexneri 2a str. 301
caggcagcugccaga

SEQ ID NO: 3888431 - RNA, 20 nt, Shigella flexneri 2a str. 301
caggcagcuuagaaauucac

SEQ ID NO: 3888432 - RNA, 23 nt, Shigella flexneri 2a str. 301
caggcagggccaccagcguggca

SEQ ID NO: 3888433 - RNA, 21 nt, Shigella flexneri 2a str. 301
caggcagggcuaucuggagau

SEQ ID NO: 3888434 - RNA, 15 nt, Shigella flexneri 2a str. 301
caggcaggucuuuca

SEQ ID NO: 3888435 - RNA, 18 nt, Shigella flexneri 2a str. 301
caggcaggucuuucaccu

SEQ ID NO: 3888436 - RNA, 20 nt, Shigella flexneri 2a str. 301
caggcagucugcgcccuggg

SEQ ID NO: 3888437 - RNA, 18 nt, Shigella flexneri 2a str. 301
caggcaguuuauccagcc

SEQ ID NO: 3888438 - RNA, 14 nt, Shigella flexneri 2a str. 301
caggcaucacuuua

SEQ ID NO: 3888439 - RNA, 19 nt, Shigella flexneri 2a str. 301
caggcaucagcaacacgcu

SEQ ID NO: 3888440 - RNA, 16 nt, Shigella flexneri 2a str. 301
caggcaucggugcugg

SEQ ID NO: 3888441 - RNA, 22 nt, Shigella flexneri 2a str. 301
caggcauuaaauccugaaacca

SEQ ID NO: 3888442 - RNA, 18 nt, Shigella flexneri 2a str. 301
caggcauuugcuccagac

SEQ ID NO: 3888443 - RNA, 16 nt, Shigella flexneri 2a str. 301
caggcauuuuuaucac

SEQ ID NO: 3888444 - RNA, 15 nt, Shigella flexneri 2a str. 301
caggccaaaaaacag

SEQ ID NO: 3888445 - RNA, 23 nt, Shigella flexneri 2a str. 301
caggccaaaagcuaacagagccg

SEQ ID NO: 3888446 - RNA, 22 nt, Shigella flexneri 2a str. 301
caggguaauuuguaacugucgg

SEQ ID NO: 3888447 - RNA, 23 nt, Shigella flexneri 2a str. 301
caggguaauuuguaacugucggg

SEQ ID NO: 3888448 - RNA, 18 nt, Shigella flexneri 2a str. 301
caggguaccgauagauuu

SEQ ID NO: 3888449 - RNA, 14 nt, Shigella flexneri 2a str. 301
caggguaucccgcc

SEQ ID NO: 3888450 - RNA, 15 nt, Shigella flexneri 2a str. 301
caggguaucccgccu

SEQ ID NO: 3888451 - RNA, 18 nt, Shigella flexneri 2a str. 301
caggguaucccgccugag

SEQ ID NO: 3888452 - RNA, 21 nt, Shigella flexneri 2a str. 301
caggguauggaucccucuuuc

SEQ ID NO: 3888453 - RNA, 17 nt, Shigella flexneri 2a str. 301
cagggugaucaccagua

SEQ ID NO: 3888454 - RNA, 18 nt, Shigella flexneri 2a str. 301
cagggugaucaccaguaa

SEQ ID NO: 3888455 - RNA, 17 nt, Shigella flexneri 2a str. 301
caggguggugacaccau

SEQ ID NO: 3888456 - RNA, 17 nt, Shigella flexneri 2a str. 301
caggguguauucaugcc

SEQ ID NO: 3888457 - RNA, 20 nt, Shigella flexneri 2a str. 301
caggguuauauaaaaccgca

SEQ ID NO: 3888458 - RNA, 15 nt, Shigella flexneri 2a str. 301
caggguugcagaccc

SEQ ID NO: 3888459 - RNA, 17 nt, Shigella flexneri 2a str. 301
caggguugcagacccgc

SEQ ID NO: 3888460 - RNA, 13 nt, Shigella flexneri 2a str. 301
cagguaaacaccu

SEQ ID NO: 3888461 - RNA, 22 nt, Shigella flexneri 2a str. 301
cagguaaagaccauaaauaugg

SEQ ID NO: 3888462 - RNA, 15 nt, Shigella flexneri 2a str. 301
cagguaacagggaac

SEQ ID NO: 3888463 - RNA, 22 nt, Shigella flexneri 2a str. 301
cagguaagagugaauucacaau

SEQ ID NO: 3888464 - RNA, 18 nt, Shigella flexneri 2a str. 301
cagguaagaguuucaaca

SEQ ID NO: 3888465 - RNA, 21 nt, Shigella flexneri 2a str. 301
cagguaagaguuucaacauca

SEQ ID NO: 3888466 - RNA, 14 nt, Shigella flexneri 2a str. 301
cagguaaggcgcga

SEQ ID NO: 3888467 - RNA, 14 nt, Shigella flexneri 2a str. 301
cagguaaucggcau

SEQ ID NO: 3888468 - RNA, 14 nt, Shigella flexneri 2a str. 301
cagguaaucugcca

SEQ ID NO: 3888469 - RNA, 20 nt, Shigella flexneri 2a str. 301
cagguaauuugaucaaauac

SEQ ID NO: 3888470 - RNA, 19 nt, Shigella flexneri 2a str. 301
cagguaccgagauaacguu

SEQ ID NO: 3888471 - RNA, 18 nt, Shigella flexneri 2a str. 301
cagguagcgcauaagcca

SEQ ID NO: 3888472 - RNA, 21 nt, Shigella flexneri 2a str. 301
cagguaguguuggaucugauc

SEQ ID NO: 3888473 - RNA, 20 nt, Shigella flexneri 2a str. 301
cagguauaccgaaaucgcca

SEQ ID NO: 3888474 - RNA, 21 nt, Shigella flexneri 2a str. 301
cagguauaccgaaaucgccau

SEQ ID NO: 3888475 - RNA, 19 nt, Shigella flexneri 2a str. 301
cagguauaccggaccaaua

SEQ ID NO: 3888476 - RNA, 19 nt, Shigella flexneri 2a str. 301
cagguauucggugugcagc

SEQ ID NO: 3888477 - RNA, 22 nt, Shigella flexneri 2a str. 301
caggucagauuucaaucuggcc

SEQ ID NO: 3888478 - RNA, 18 nt, Shigella flexneri 2a str. 301
caggucagcaggagcagc

SEQ ID NO: 3888479 - RNA, 16 nt, Shigella flexneri 2a str. 301
caggucagcgccuggc

SEQ ID NO: 3888480 - RNA, 14 nt, Shigella flexneri 2a str. 301
caggucaucauugc

SEQ ID NO: 3888481 - RNA, 15 nt, Shigella flexneri 2a str. 301
caggucggcucagcc

SEQ ID NO: 3888482 - RNA, 16 nt, Shigella flexneri 2a str. 301
caggucguccugcaaa

SEQ ID NO: 3888483 - RNA, 21 nt, Shigella flexneri 2a str. 301
caggugauacguccaccccag

SEQ ID NO: 3888484 - RNA, 18 nt, Shigella flexneri 2a str. 301
cagguggcaaugcccggu

SEQ ID NO: 3888485 - RNA, 19 nt, Shigella flexneri 2a str. 301
cagguggcguuugccaccu

SEQ ID NO: 3888486 - RNA, 14 nt, Shigella flexneri 2a str. 301
cagguguccagcca

SEQ ID NO: 3888487 - RNA, 22 nt, Shigella flexneri 2a str. 301
caggugucuaacccgcgacugg

SEQ ID NO: 3888488 - RNA, 23 nt, Shigella flexneri 2a str. 301
cagguuaacucccccuuucugag

SEQ ID NO: 3888489 - RNA, 21 nt, Shigella flexneri 2a str. 301
cagguuaaugacccaccccag

SEQ ID NO: 3888490 - RNA, 22 nt, Shigella flexneri 2a str. 301
cagguuauuaaauaaccagcgc

SEQ ID NO: 3888491 - RNA, 19 nt, Shigella flexneri 2a str. 301
cagguuccgcauaccccuu

SEQ ID NO: 3888492 - RNA, 21 nt, Shigella flexneri 2a str. 301
cagguuccgcauaccccuuca

SEQ ID NO: 3888493 - RNA, 14 nt, Shigella flexneri 2a str. 301
cagguucguaagcg

SEQ ID NO: 3888494 - RNA, 21 nt, Shigella flexneri 2a str. 301
cagguugaucccaccgggcaa

SEQ ID NO: 3888495 - RNA, 18 nt, Shigella flexneri 2a str. 301
cagguugcccagcgcgcc

SEQ ID NO: 3888496 - RNA, 19 nt, Shigella flexneri 2a str. 301
cagguugcucauaaaauga

SEQ ID NO: 3888497 - RNA, 23 nt, Shigella flexneri 2a str. 301
cagguuuaaacagagauuacuuu

SEQ ID NO: 3888498 - RNA, 14 nt, Shigella flexneri 2a str. 301
cagguuuaccagca

SEQ ID NO: 3888499 - RNA, 16 nt, Shigella flexneri 2a str. 301
cagguuuaccagcagc

SEQ ID NO: 3888500 - RNA, 21 nt, Shigella flexneri 2a str. 301
cagguuuugacgugucugaua

SEQ ID NO: 3888501 - RNA, 18 nt, Shigella flexneri 2a str. 301
cagguuuuguucuggugc

SEQ ID NO: 3888502 - RNA, 16 nt, Shigella flexneri 2a str. 301
cagguuuuucagcugc

SEQ ID NO: 3888503 - RNA, 19 nt, Shigella flexneri 2a str. 301
caguaaaccacccaccagc

SEQ ID NO: 3888504 - RNA, 21 nt, Shigella flexneri 2a str. 301
caguaaaccacccaccagcgc

SEQ ID NO: 3888505 - RNA, 17 nt, Shigella flexneri 2a str. 301
caguaaaccgucagcac

SEQ ID NO: 3888506 - RNA, 13 nt, Shigella flexneri 2a str. 301
caguaaacgcuuu

SEQ ID NO: 3888507 - RNA, 13 nt, Shigella flexneri 2a str. 301
caguaaagcagcg

SEQ ID NO: 3888508 - RNA, 14 nt, Shigella flexneri 2a str. 301
caguaaauccauaa

SEQ ID NO: 3888509 - RNA, 24 nt, Shigella flexneri 2a str. 301
caguaacaauauuugcagaggugc

SEQ ID NO: 3888510 - RNA, 17 nt, Shigella flexneri 2a str. 301
caguaaccacgcagcgu

SEQ ID NO: 3888511 - RNA, 13 nt, Shigella flexneri 2a str. 301
caguaaccgcuuu

SEQ ID NO: 3888512 - RNA, 17 nt, Shigella flexneri 2a str. 301
caguaaccggaaauaaa

SEQ ID NO: 3888513 - RNA, 19 nt, Shigella flexneri 2a str. 301
caguaaccuuucagauguu

SEQ ID NO: 3888514 - RNA, 14 nt, Shigella flexneri 2a str. 301
caguaacguugcau

SEQ ID NO: 3888515 - RNA, 19 nt, Shigella flexneri 2a str. 301
caguaagacaccccacagc

SEQ ID NO: 3888516 - RNA, 19 nt, Shigella flexneri 2a str. 301
caguaagcaguccagcgcc

SEQ ID NO: 3888517 - RNA, 20 nt, Shigella flexneri 2a str. 301
caguaaggucaucaaucauu

SEQ ID NO: 3888518 - RNA, 14 nt, Shigella flexneri 2a str. 301
caguaauaccagac

SEQ ID NO: 3888519 - RNA, 17 nt, Shigella flexneri 2a str. 301
caguaauaccagaccuu

SEQ ID NO: 3888520 - RNA, 14 nt, Shigella flexneri 2a str. 301
caguaauccuuucu

SEQ ID NO: 3888521 - RNA, 16 nt, Shigella flexneri 2a str. 301
caguaaugauuuaaaa

SEQ ID NO: 3888522 - RNA, 19 nt, Shigella flexneri 2a str. 301
caguaauugacgcauccga

SEQ ID NO: 3888523 - RNA, 15 nt, Shigella flexneri 2a str. 301
caguacagccgccag

SEQ ID NO: 3888524 - RNA, 16 nt, Shigella flexneri 2a str. 301
caguacaguaccgaac

SEQ ID NO: 3888525 - RNA, 19 nt, Shigella flexneri 2a str. 301
caguacauuguuuuccaga

SEQ ID NO: 3888526 - RNA, 22 nt, Shigella flexneri 2a str. 301
caguacauuguuuuccagacug

SEQ ID NO: 3888527 - RNA, 23 nt, Shigella flexneri 2a str. 301
caguaccagauaaucaccugccu

SEQ ID NO: 3888528 - RNA, 13 nt, Shigella flexneri 2a str. 301
caguaccagcagc

SEQ ID NO: 3888529 - RNA, 14 nt, Shigella flexneri 2a str. 301
caguaccagcagcg

SEQ ID NO: 3888530 - RNA, 15 nt, Shigella flexneri 2a str. 301
caguaccagcaguac

SEQ ID NO: 3888531 - RNA, 22 nt, Shigella flexneri 2a str. 301
caguaccgauugcccauacagg

SEQ ID NO: 3888532 - RNA, 22 nt, Shigella flexneri 2a str. 301
caguaccgccgccauaaacagc

SEQ ID NO: 3888533 - RNA, 16 nt, Shigella flexneri 2a str. 301
caguaccuccuucaca

SEQ ID NO: 3888534 - RNA, 22 nt, Shigella flexneri 2a str. 301
caguacgcccacgccagccugc

SEQ ID NO: 3888535 - RNA, 17 nt, Shigella flexneri 2a str. 301
caguacgcgcccgccgc

SEQ ID NO: 3888536 - RNA, 19 nt, Shigella flexneri 2a str. 301
caguacgcgcccgccgcug

SEQ ID NO: 3888537 - RNA, 12 nt, Shigella flexneri 2a str. 301
caguacggcagc

SEQ ID NO: 3888538 - RNA, 23 nt, Shigella flexneri 2a str. 301
caguacggcagcaaucgaccagg

SEQ ID NO: 3888539 - RNA, 23 nt, Shigella flexneri 2a str. 301
caguacggcuucgaucaggaacu

SEQ ID NO: 3888540 - RNA, 21 nt, Shigella flexneri 2a str. 301
caguacggucgugcgguuuca

SEQ ID NO: 3888541 - RNA, 16 nt, Shigella flexneri 2a str. 301
caguacuggccuccac

SEQ ID NO: 3888542 - RNA, 19 nt, Shigella flexneri 2a str. 301
caguacuggccuccacggu

SEQ ID NO: 3888543 - RNA, 15 nt, Shigella flexneri 2a str. 301
caguagacagcaaag

SEQ ID NO: 3888544 - RNA, 23 nt, Shigella flexneri 2a str. 301
caguagacagcaaagugccccca

SEQ ID NO: 3888545 - RNA, 20 nt, Shigella flexneri 2a str. 301
cagugcgucgcugcucuuca

SEQ ID NO: 3888546 - RNA, 16 nt, Shigella flexneri 2a str. 301
cagugcgugcgcugcu

SEQ ID NO: 3888547 - RNA, 12 nt, Shigella flexneri 2a str. 301
cagugcugaagg

SEQ ID NO: 3888548 - RNA, 15 nt, Shigella flexneri 2a str. 301
cagugcuucgcggac

SEQ ID NO: 3888549 - RNA, 12 nt, Shigella flexneri 2a str. 301
cagugcuuuauc

SEQ ID NO: 3888550 - RNA, 17 nt, Shigella flexneri 2a str. 301
caguggacgauaagcac

SEQ ID NO: 3888551 - RNA, 19 nt, Shigella flexneri 2a str. 301
caguggacgauaagcaccg

SEQ ID NO: 3888552 - RNA, 21 nt, Shigella flexneri 2a str. 301
caguggauaauacacuaacag

SEQ ID NO: 3888553 - RNA, 21 nt, Shigella flexneri 2a str. 301
caguggaugcgccauaccaug

SEQ ID NO: 3888554 - RNA, 18 nt, Shigella flexneri 2a str. 301
caguggcgagcuuccugu

SEQ ID NO: 3888555 - RNA, 21 nt, Shigella flexneri 2a str. 301
caguggcuaagcaggcuggcu

SEQ ID NO: 3888556 - RNA, 14 nt, Shigella flexneri 2a str. 301
caguggcuccagcg

SEQ ID NO: 3888557 - RNA, 15 nt, Shigella flexneri 2a str. 301
caguggcuccagcgc

SEQ ID NO: 3888558 - RNA, 16 nt, Shigella flexneri 2a str. 301
caguggcucuuguucg

SEQ ID NO: 3888559 - RNA, 12 nt, Shigella flexneri 2a str. 301
caguggcugcgu

SEQ ID NO: 3888560 - RNA, 13 nt, Shigella flexneri 2a str. 301
cagugggcgcugc

SEQ ID NO: 3888561 - RNA, 20 nt, Shigella flexneri 2a str. 301
cagugggcgcugcuguacuu

SEQ ID NO: 3888562 - RNA, 18 nt, Shigella flexneri 2a str. 301
caguggugcggcugaugg

SEQ ID NO: 3888563 - RNA, 20 nt, Shigella flexneri 2a str. 301
cagugguuucgccagcaccg

SEQ ID NO: 3888564 - RNA, 14 nt, Shigella flexneri 2a str. 301
caguguaaaacagc

SEQ ID NO: 3888565 - RNA, 15 nt, Shigella flexneri 2a str. 301
caguguaaaacagca

SEQ ID NO: 3888566 - RNA, 20 nt, Shigella flexneri 2a str. 301
caguguacuuaucuuuuaca

SEQ ID NO: 3888567 - RNA, 15 nt, Shigella flexneri 2a str. 301
caguguaucggcggc

SEQ ID NO: 3888568 - RNA, 20 nt, Shigella flexneri 2a str. 301
cagugugcuacggucugccg

SEQ ID NO: 3888569 - RNA, 22 nt, Shigella flexneri 2a str. 301
caguguuaaacgcagcuccggg

SEQ ID NO: 3888570 - RNA, 19 nt, Shigella flexneri 2a str. 301
caguuaacgcggauccccu

SEQ ID NO: 3888571 - RNA, 13 nt, Shigella flexneri 2a str. 301
caguuaagcaacu

SEQ ID NO: 3888572 - RNA, 15 nt, Shigella flexneri 2a str. 301
caguuaaguuaauuc

SEQ ID NO: 3888573 - RNA, 17 nt, Shigella flexneri 2a str. 301
caguuacugccaccauc

SEQ ID NO: 3888574 - RNA, 17 nt, Shigella flexneri 2a str. 301
caguuacugcugacgcu

SEQ ID NO: 3888575 - RNA, 17 nt, Shigella flexneri 2a str. 301
caguuauagcgcagacg

SEQ ID NO: 3888576 - RNA, 22 nt, Shigella flexneri 2a str. 301
caguucaaaguuaccggaagcg

SEQ ID NO: 3888577 - RNA, 21 nt, Shigella flexneri 2a str. 301
caguucaaauucauugucggg

SEQ ID NO: 3888578 - RNA, 16 nt, Shigella flexneri 2a str. 301
caguucaacgcggcgc

SEQ ID NO: 3888579 - RNA, 23 nt, Shigella flexneri 2a str. 301
caguucaagugcuacccacuucc

SEQ ID NO: 3888580 - RNA, 18 nt, Shigella flexneri 2a str. 301
caguucaccgccgaggcg

SEQ ID NO: 3888581 - RNA, 13 nt, Shigella flexneri 2a str. 301
caguucagaaagc

SEQ ID NO: 3888582 - RNA, 21 nt, Shigella flexneri 2a str. 301
caguucagcagcacuacaccc

SEQ ID NO: 3888583 - RNA, 19 nt, Shigella flexneri 2a str. 301
caguucagucagcaguguc

SEQ ID NO: 3888584 - RNA, 21 nt, Shigella flexneri 2a str. 301
caguucaucaacgcccauaaa

SEQ ID NO: 3888585 - RNA, 17 nt, Shigella flexneri 2a str. 301
caguucauuugaacugg

SEQ ID NO: 3888586 - RNA, 13 nt, Shigella flexneri 2a str. 301
caguuccagcagc

SEQ ID NO: 3888587 - RNA, 15 nt, Shigella flexneri 2a str. 301
caguucccccugcca

SEQ ID NO: 3888588 - RNA, 15 nt, Shigella flexneri 2a str. 301
caguuccgccagcuu

SEQ ID NO: 3888589 - RNA, 21 nt, Shigella flexneri 2a str. 301
caguuccuuaacuucaucagc

SEQ ID NO: 3888590 - RNA, 18 nt, Shigella flexneri 2a str. 301
caguucgaaauccagacg

SEQ ID NO: 3888591 - RNA, 23 nt, Shigella flexneri 2a str. 301
caguucgaucucuucgccugccu

SEQ ID NO: 3888592 - RNA, 16 nt, Shigella flexneri 2a str. 301
caguucgauuucccag

SEQ ID NO: 3888593 - RNA, 17 nt, Shigella flexneri 2a str. 301
caguucgauuucccagc

SEQ ID NO: 3888594 - RNA, 16 nt, Shigella flexneri 2a str. 301
caguucgccguacuga

SEQ ID NO: 3888595 - RNA, 22 nt, Shigella flexneri 2a str. 301
caguucgcgauccugauacaga

SEQ ID NO: 3888596 - RNA, 13 nt, Shigella flexneri 2a str. 301
caguucgcggaua

SEQ ID NO: 3888597 - RNA, 13 nt, Shigella flexneri 2a str. 301
caguucgcggcgu

SEQ ID NO: 3888598 - RNA, 17 nt, Shigella flexneri 2a str. 301
caguucggaaacagugc

SEQ ID NO: 3888599 - RNA, 16 nt, Shigella flexneri 2a str. 301
caguucggcaucaucg

SEQ ID NO: 3888600 - RNA, 16 nt, Shigella flexneri 2a str. 301
caguucgguugggauc

SEQ ID NO: 3888601 - RNA, 15 nt, Shigella flexneri 2a str. 301
caguucguucgggca

SEQ ID NO: 3888602 - RNA, 22 nt, Shigella flexneri 2a str. 301
caguucguuuuacgcacuucuu

SEQ ID NO: 3888603 - RNA, 18 nt, Shigella flexneri 2a str. 301
caguucuaccaucaaugg

SEQ ID NO: 3888604 - RNA, 20 nt, Shigella flexneri 2a str. 301
caguucuaccaucaauggcu

SEQ ID NO: 3888605 - RNA, 18 nt, Shigella flexneri 2a str. 301
caguucuacuggaauuuc

SEQ ID NO: 3888606 - RNA, 13 nt, Shigella flexneri 2a str. 301
caguucugcagcg

SEQ ID NO: 3888607 - RNA, 16 nt, Shigella flexneri 2a str. 301
caguucuggcaccgga

SEQ ID NO: 3888608 - RNA, 22 nt, Shigella flexneri 2a str. 301
caguucuggcaccggacgcuug

SEQ ID NO: 3888609 - RNA, 15 nt, Shigella flexneri 2a str. 301
caguucuucaaaaau

SEQ ID NO: 3888610 - RNA, 16 nt, Shigella flexneri 2a str. 301
caguucuuccaguucc

SEQ ID NO: 3888611 - RNA, 17 nt, Shigella flexneri 2a str. 301
caguucuuccaguuccg

SEQ ID NO: 3888612 - RNA, 13 nt, Shigella flexneri 2a str. 301
caguucuucucaa

SEQ ID NO: 3888613 - RNA, 19 nt, Shigella flexneri 2a str. 301
caguugauacaggaacagc

SEQ ID NO: 3888614 - RNA, 12 nt, Shigella flexneri 2a str. 301
caguugaucacc

SEQ ID NO: 3888615 - RNA, 16 nt, Shigella flexneri 2a str. 301
caguugaucagccagg

SEQ ID NO: 3888616 - RNA, 14 nt, Shigella flexneri 2a str. 301
caguugauccagcu

SEQ ID NO: 3888617 - RNA, 20 nt, Shigella flexneri 2a str. 301
caguugauuaugaucgccac

SEQ ID NO: 3888618 - RNA, 16 nt, Shigella flexneri 2a str. 301
caguugauucgcgcgu

SEQ ID NO: 3888619 - RNA, 14 nt, Shigella flexneri 2a str. 301
caguugcacgccac

SEQ ID NO: 3888620 - RNA, 14 nt, Shigella flexneri 2a str. 301
caguugcauaauuu

SEQ ID NO: 3888621 - RNA, 18 nt, Shigella flexneri 2a str. 301
caguugcauaauuucuuc

SEQ ID NO: 3888622 - RNA, 16 nt, Shigella flexneri 2a str. 301
caguugcgcgcgcacc

SEQ ID NO: 3888623 - RNA, 21 nt, Shigella flexneri 2a str. 301
caguugcggcuuauucauuac

SEQ ID NO: 3888624 - RNA, 18 nt, Shigella flexneri 2a str. 301
caguugcucaaucaucuc

SEQ ID NO: 3888625 - RNA, 14 nt, Shigella flexneri 2a str. 301
caguugcugcguga

SEQ ID NO: 3888626 - RNA, 12 nt, Shigella flexneri 2a str. 301
caguugcuucau

SEQ ID NO: 3888627 - RNA, 14 nt, Shigella flexneri 2a str. 301
caguugcuuuacuc

SEQ ID NO: 3888628 - RNA, 16 nt, Shigella flexneri 2a str. 301
caguuggaugcugcau

SEQ ID NO: 3888629 - RNA, 20 nt, Shigella flexneri 2a str. 301
caguuggaugcugcauauga

SEQ ID NO: 3888630 - RNA, 21 nt, Shigella flexneri 2a str. 301
caguuggcagaauuugaggaa

SEQ ID NO: 3888631 - RNA, 15 nt, Shigella flexneri 2a str. 301
caguuggcugacaaa

SEQ ID NO: 3888632 - RNA, 13 nt, Shigella flexneri 2a str. 301
caguuggcugugg

SEQ ID NO: 3888633 - RNA, 20 nt, Shigella flexneri 2a str. 301
caguugguagguccagccgc

SEQ ID NO: 3888634 - RNA, 19 nt, Shigella flexneri 2a str. 301
caguugucagcccuuuuuc

SEQ ID NO: 3888635 - RNA, 20 nt, Shigella flexneri 2a str. 301
caguugucagcccuuuuuca

SEQ ID NO: 3888636 - RNA, 12 nt, Shigella flexneri 2a str. 301
caguugucggua

SEQ ID NO: 3888637 - RNA, 14 nt, Shigella flexneri 2a str. 301
caguuguugcugcc

SEQ ID NO: 3888638 - RNA, 17 nt, Shigella flexneri 2a str. 301
caguuuaaccgggagau

SEQ ID NO: 3888639 - RNA, 13 nt, Shigella flexneri 2a str. 301
caguuuauacagc

SEQ ID NO: 3888640 - RNA, 15 nt, Shigella flexneri 2a str. 301
caguuuauccagcca

SEQ ID NO: 3888641 - RNA, 14 nt, Shigella flexneri 2a str. 301
caguuucacagggu

SEQ ID NO: 3888642 - RNA, 16 nt, Shigella flexneri 2a str. 301
caguuucaccagcagu

SEQ ID NO: 3888643 - RNA, 17 nt, Shigella flexneri 2a str. 301
caguuucagccccauca

SEQ ID NO: 3888644 - RNA, 13 nt, Shigella flexneri 2a str. 301
caguuucauagug

SEQ ID NO: 3888645 - RNA, 22 nt, Shigella flexneri 2a str. 301
caguuucaugauauguuuuaaa

SEQ ID NO: 3888646 - RNA, 17 nt, Shigella flexneri 2a str. 301
cauacuuaaauaaugcu

SEQ ID NO: 3888647 - RNA, 14 nt, Shigella flexneri 2a str. 301
cauacuuauuauga

SEQ ID NO: 3888648 - RNA, 18 nt, Shigella flexneri 2a str. 301
cauacuuauuaugaauga

SEQ ID NO: 3888649 - RNA, 13 nt, Shigella flexneri 2a str. 301
cauacuuccacgc

SEQ ID NO: 3888650 - RNA, 16 nt, Shigella flexneri 2a str. 301
cauacuuccacgcaga

SEQ ID NO: 3888651 - RNA, 21 nt, Shigella flexneri 2a str. 301
cauagaaacucauaugcagca

SEQ ID NO: 3888652 - RNA, 15 nt, Shigella flexneri 2a str. 301
cauagaccauugcau

SEQ ID NO: 3888653 - RNA, 17 nt, Shigella flexneri 2a str. 301
cauagacuggaaacuca

SEQ ID NO: 3888654 - RNA, 12 nt, Shigella flexneri 2a str. 301
cauagacuuccc

SEQ ID NO: 3888655 - RNA, 22 nt, Shigella flexneri 2a str. 301
cauagagacuuuuccagccgac

SEQ ID NO: 3888656 - RNA, 17 nt, Shigella flexneri 2a str. 301
cauagauaccuucuuga

SEQ ID NO: 3888657 - RNA, 19 nt, Shigella flexneri 2a str. 301
cauagcagcacaccacauc

SEQ ID NO: 3888658 - RNA, 12 nt, Shigella flexneri 2a str. 301
cauagcauccca

SEQ ID NO: 3888659 - RNA, 20 nt, Shigella flexneri 2a str. 301
cauagcuaauccccuccagc

SEQ ID NO: 3888660 - RNA, 15 nt, Shigella flexneri 2a str. 301
cauaggcauuaaaca

SEQ ID NO: 3888661 - RNA, 22 nt, Shigella flexneri 2a str. 301
cauagggugugacgacaccauc

SEQ ID NO: 3888662 - RNA, 19 nt, Shigella flexneri 2a str. 301
cauaggugucaaccagcca

SEQ ID NO: 3888663 - RNA, 19 nt, Shigella flexneri 2a str. 301
cauagguugaaauaaaccg

SEQ ID NO: 3888664 - RNA, 13 nt, Shigella flexneri 2a str. 301
cauaguaagcaga

SEQ ID NO: 3888665 - RNA, 16 nt, Shigella flexneri 2a str. 301
cauaguagccagccag

SEQ ID NO: 3888666 - RNA, 15 nt, Shigella flexneri 2a str. 301
cauaguagguccuga

SEQ ID NO: 3888667 - RNA, 14 nt, Shigella flexneri 2a str. 301
cauaguauuuaucc

SEQ ID NO: 3888668 - RNA, 22 nt, Shigella flexneri 2a str. 301
cauaguauuuauccauaauuug

SEQ ID NO: 3888669 - RNA, 20 nt, Shigella flexneri 2a str. 301
cauagucacuaccuguuuaa

SEQ ID NO: 3888670 - RNA, 14 nt, Shigella flexneri 2a str. 301
cauagucauccucu

SEQ ID NO: 3888671 - RNA, 20 nt, Shigella flexneri 2a str. 301
cauagucuuugcgaggcgcg

SEQ ID NO: 3888672 - RNA, 14 nt, Shigella flexneri 2a str. 301
cauauaaauuucau

SEQ ID NO: 3888673 - RNA, 19 nt, Shigella flexneri 2a str. 301
cauauaaccggcaacagaa

SEQ ID NO: 3888674 - RNA, 16 nt, Shigella flexneri 2a str. 301
cauauaaugcaacauu

SEQ ID NO: 3888675 - RNA, 18 nt, Shigella flexneri 2a str. 301
cauauaccgcaucagcau

SEQ ID NO: 3888676 - RNA, 22 nt, Shigella flexneri 2a str. 301
cauauacgccaucgccagcagc

SEQ ID NO: 3888677 - RNA, 18 nt, Shigella flexneri 2a str. 301
cauauagaucuuuagugc

SEQ ID NO: 3888678 - RNA, 20 nt, Shigella flexneri 2a str. 301
cauauagccgccuuguugua

SEQ ID NO: 3888679 - RNA, 23 nt, Shigella flexneri 2a str. 301
cauauagccgccuuguuguaaug

SEQ ID NO: 3888680 - RNA, 18 nt, Shigella flexneri 2a str. 301
cauauaguggguaacaau

SEQ ID NO: 3888681 - RNA, 22 nt, Shigella flexneri 2a str. 301
cauauauuacaacguauuauau

SEQ ID NO: 3888682 - RNA, 18 nt, Shigella flexneri 2a str. 301
cauaucauuuugcugcca

SEQ ID NO: 3888683 - RNA, 20 nt, Shigella flexneri 2a str. 301
cauauccccgggcggccucu

SEQ ID NO: 3888684 - RNA, 13 nt, Shigella flexneri 2a str. 301
cauauccgcaaug

SEQ ID NO: 3888685 - RNA, 16 nt, Shigella flexneri 2a str. 301
cauaucgaaccagcgg

SEQ ID NO: 3888686 - RNA, 17 nt, Shigella flexneri 2a str. 301
cauaucucccaguaagc

SEQ ID NO: 3888687 - RNA, 14 nt, Shigella flexneri 2a str. 301
cauaugcgccagcu

SEQ ID NO: 3888688 - RNA, 17 nt, Shigella flexneri 2a str. 301
cauauggaagaaacgcu

SEQ ID NO: 3888689 - RNA, 17 nt, Shigella flexneri 2a str. 301
cauauguguuugugccg

SEQ ID NO: 3888690 - RNA, 19 nt, Shigella flexneri 2a str. 301
cauauguuuacgcuggcgg

SEQ ID NO: 3888691 - RNA, 19 nt, Shigella flexneri 2a str. 301
cauauuccgcaccugccag

SEQ ID NO: 3888692 - RNA, 15 nt, Shigella flexneri 2a str. 301
cauauucgccaccgc

SEQ ID NO: 3888693 - RNA, 18 nt, Shigella flexneri 2a str. 301
cauauucgccgcccugca

SEQ ID NO: 3888694 - RNA, 22 nt, Shigella flexneri 2a str. 301
cauauucgccgcccugcagcau

SEQ ID NO: 3888695 - RNA, 18 nt, Shigella flexneri 2a str. 301
cauauucugaucgugcuc

SEQ ID NO: 3888696 - RNA, 16 nt, Shigella flexneri 2a str. 301
cauauugccgugcccc

SEQ ID NO: 3888697 - RNA, 12 nt, Shigella flexneri 2a str. 301
cauauuguuuca

SEQ ID NO: 3888698 - RNA, 14 nt, Shigella flexneri 2a str. 301
cauauuucuccauu

SEQ ID NO: 3888699 - RNA, 16 nt, Shigella flexneri 2a str. 301
cauauuugugagcuac

SEQ ID NO: 3888700 - RNA, 22 nt, Shigella flexneri 2a str. 301
cauauuuucauuauugcgcaca

SEQ ID NO: 3888701 - RNA, 15 nt, Shigella flexneri 2a str. 301
caucaaacgaagccu

SEQ ID NO: 3888702 - RNA, 19 nt, Shigella flexneri 2a str. 301
caucaaaggcuucaacgac

SEQ ID NO: 3888703 - RNA, 15 nt, Shigella flexneri 2a str. 301
caucaaaguuuuuau

SEQ ID NO: 3888704 - RNA, 21 nt, Shigella flexneri 2a str. 301
caucaaaguuuuuaugaguuu

SEQ ID NO: 3888705 - RNA, 20 nt, Shigella flexneri 2a str. 301
caucaaauggcauccuugcu

SEQ ID NO: 3888706 - RNA, 22 nt, Shigella flexneri 2a str. 301
caucaaauuacccugcacguug

SEQ ID NO: 3888707 - RNA, 23 nt, Shigella flexneri 2a str. 301
caucaacaacaauuucacuugcu

SEQ ID NO: 3888708 - RNA, 14 nt, Shigella flexneri 2a str. 301
caucaaccaacacc

SEQ ID NO: 3888709 - RNA, 19 nt, Shigella flexneri 2a str. 301
caucaacuggcaaccagaa

SEQ ID NO: 3888710 - RNA, 19 nt, Shigella flexneri 2a str. 301
caucaagauaaaccccuuu

SEQ ID NO: 3888711 - RNA, 19 nt, Shigella flexneri 2a str. 301
caucaagauuagcgacgaa

SEQ ID NO: 3888712 - RNA, 15 nt, Shigella flexneri 2a str. 301
caucaagcuguucuu

SEQ ID NO: 3888713 - RNA, 18 nt, Shigella flexneri 2a str. 301
caucaagcuguucuuccc

SEQ ID NO: 3888714 - RNA, 20 nt, Shigella flexneri 2a str. 301
caucaaguaaccuuuaucgc

SEQ ID NO: 3888715 - RNA, 15 nt, Shigella flexneri 2a str. 301
caucaaguagcaggu

SEQ ID NO: 3888716 - RNA, 22 nt, Shigella flexneri 2a str. 301
caucaaguagcgcuuguaggaa

SEQ ID NO: 3888717 - RNA, 17 nt, Shigella flexneri 2a str. 301
caucaagucauugauuc

SEQ ID NO: 3888718 - RNA, 21 nt, Shigella flexneri 2a str. 301
caucaaguugauuuuucguuu

SEQ ID NO: 3888719 - RNA, 15 nt, Shigella flexneri 2a str. 301
caucaauaaacaaug

SEQ ID NO: 3888720 - RNA, 21 nt, Shigella flexneri 2a str. 301
caucaauaccauuaucauuga

SEQ ID NO: 3888721 - RNA, 23 nt, Shigella flexneri 2a str. 301
caucaauaccauuaucauugaga

SEQ ID NO: 3888722 - RNA, 21 nt, Shigella flexneri 2a str. 301
caucaauaccugguccuucau

SEQ ID NO: 3888723 - RNA, 20 nt, Shigella flexneri 2a str. 301
caucaauagcuaacgaaaga

SEQ ID NO: 3888724 - RNA, 13 nt, Shigella flexneri 2a str. 301
caucaauauuaag

SEQ ID NO: 3888725 - RNA, 15 nt, Shigella flexneri 2a str. 301
caucaauccaaacau

SEQ ID NO: 3888726 - RNA, 21 nt, Shigella flexneri 2a str. 301
caucaaucccuucgacuuuca

SEQ ID NO: 3888727 - RNA, 14 nt, Shigella flexneri 2a str. 301
caucaaugaccuga

SEQ ID NO: 3888728 - RNA, 16 nt, Shigella flexneri 2a str. 301
caucaaugaccuuuuu

SEQ ID NO: 3888729 - RNA, 16 nt, Shigella flexneri 2a str. 301
caucaaugccagcaua

SEQ ID NO: 3888730 - RNA, 15 nt, Shigella flexneri 2a str. 301
caucaauggaugaac

SEQ ID NO: 3888731 - RNA, 22 nt, Shigella flexneri 2a str. 301
caucaauggaugaacgagcugc

SEQ ID NO: 3888732 - RNA, 22 nt, Shigella flexneri 2a str. 301
caucaauggcugcaaagcauuu

SEQ ID NO: 3888733 - RNA, 13 nt, Shigella flexneri 2a str. 301
caucaauuugccc

SEQ ID NO: 3888734 - RNA, 23 nt, Shigella flexneri 2a str. 301
caucacaaucauccuaccgccag

SEQ ID NO: 3888735 - RNA, 23 nt, Shigella flexneri 2a str. 301
caucacaauuccggugcgccaga

SEQ ID NO: 3888736 - RNA, 21 nt, Shigella flexneri 2a str. 301
caucacaccaguccagcgccu

SEQ ID NO: 3888737 - RNA, 23 nt, Shigella flexneri 2a str. 301
caucacaccgcgaucuuccacgc

SEQ ID NO: 3888738 - RNA, 22 nt, Shigella flexneri 2a str. 301
caucacauauucgccgcccugc

SEQ ID NO: 3888739 - RNA, 13 nt, Shigella flexneri 2a str. 301
caucaccaacacc

SEQ ID NO: 3888740 - RNA, 22 nt, Shigella flexneri 2a str. 301
caucaccaauacgcauaugcau

SEQ ID NO: 3888741 - RNA, 13 nt, Shigella flexneri 2a str. 301
caucaccacgcug

SEQ ID NO: 3888742 - RNA, 20 nt, Shigella flexneri 2a str. 301
caucaccacgcugagagaag

SEQ ID NO: 3888743 - RNA, 14 nt, Shigella flexneri 2a str. 301
caucaccacugacg

SEQ ID NO: 3888744 - RNA, 17 nt, Shigella flexneri 2a str. 301
caucaccaguaccgcca

SEQ ID NO: 3888745 - RNA, 22 nt, Shigella flexneri 2a str. 301
cauccaacaauagugccgcacu

SEQ ID NO: 3888746 - RNA, 12 nt, Shigella flexneri 2a str. 301
cauccaccagug

SEQ ID NO: 3888747 - RNA, 17 nt, Shigella flexneri 2a str. 301
cauccagacugcucagc

SEQ ID NO: 3888748 - RNA, 20 nt, Shigella flexneri 2a str. 301
cauccagacugcucagcucc

SEQ ID NO: 3888749 - RNA, 19 nt, Shigella flexneri 2a str. 301
cauccagagaucgcguagc

SEQ ID NO: 3888750 - RNA, 15 nt, Shigella flexneri 2a str. 301
cauccagcacuugca

SEQ ID NO: 3888751 - RNA, 22 nt, Shigella flexneri 2a str. 301
cauccagcacuugcaggaacag

SEQ ID NO: 3888752 - RNA, 20 nt, Shigella flexneri 2a str. 301
cauccagcagacgcuccauu

SEQ ID NO: 3888753 - RNA, 21 nt, Shigella flexneri 2a str. 301
cauccagcagagauacaggcc

SEQ ID NO: 3888754 - RNA, 14 nt, Shigella flexneri 2a str. 301
cauccagcagcccu

SEQ ID NO: 3888755 - RNA, 15 nt, Shigella flexneri 2a str. 301
cauccagcagugacu

SEQ ID NO: 3888756 - RNA, 13 nt, Shigella flexneri 2a str. 301
cauccagcucgug

SEQ ID NO: 3888757 - RNA, 20 nt, Shigella flexneri 2a str. 301
cauccagcuuuuagaucacu

SEQ ID NO: 3888758 - RNA, 22 nt, Shigella flexneri 2a str. 301
cauccagcuuuuuaaucgccau

SEQ ID NO: 3888759 - RNA, 18 nt, Shigella flexneri 2a str. 301
cauccaggaacuccagau

SEQ ID NO: 3888760 - RNA, 20 nt, Shigella flexneri 2a str. 301
cauccaggugaaaaauaaaa

SEQ ID NO: 3888761 - RNA, 19 nt, Shigella flexneri 2a str. 301
cauccaguacgccuucacg

SEQ ID NO: 3888762 - RNA, 12 nt, Shigella flexneri 2a str. 301
cauccaucaaau

SEQ ID NO: 3888763 - RNA, 14 nt, Shigella flexneri 2a str. 301
cauccaucugcuuu

SEQ ID NO: 3888764 - RNA, 22 nt, Shigella flexneri 2a str. 301
cauccauucggcgauuaacaag

SEQ ID NO: 3888765 - RNA, 17 nt, Shigella flexneri 2a str. 301
cauccauugcauaaaca

SEQ ID NO: 3888766 - RNA, 14 nt, Shigella flexneri 2a str. 301
cauccauuuuucac

SEQ ID NO: 3888767 - RNA, 22 nt, Shigella flexneri 2a str. 301
caucccaggccaaauccuucca

SEQ ID NO: 3888768 - RNA, 23 nt, Shigella flexneri 2a str. 301
caucccagugcaauaccauggcu

SEQ ID NO: 3888769 - RNA, 17 nt, Shigella flexneri 2a str. 301
cauccccggcaaccaca

SEQ ID NO: 3888770 - RNA, 21 nt, Shigella flexneri 2a str. 301
cauccccggcaaccacaccca

SEQ ID NO: 3888771 - RNA, 14 nt, Shigella flexneri 2a str. 301
cauccccucuucca

SEQ ID NO: 3888772 - RNA, 23 nt, Shigella flexneri 2a str. 301
caucccgguaucaaagcgccaga

SEQ ID NO: 3888773 - RNA, 22 nt, Shigella flexneri 2a str. 301
caucccugaaauguuugcaaua

SEQ ID NO: 3888774 - RNA, 21 nt, Shigella flexneri 2a str. 301
caucccuguaaaacgcgcccu

SEQ ID NO: 3888775 - RNA, 21 nt, Shigella flexneri 2a str. 301
cauccgacaaggcaucagauc

SEQ ID NO: 3888776 - RNA, 22 nt, Shigella flexneri 2a str. 301
cauccgaucgcgcaucagcagu

SEQ ID NO: 3888777 - RNA, 15 nt, Shigella flexneri 2a str. 301
cauccgcacaauccc

SEQ ID NO: 3888778 - RNA, 14 nt, Shigella flexneri 2a str. 301
cauccgccauccac

SEQ ID NO: 3888779 - RNA, 21 nt, Shigella flexneri 2a str. 301
cauccgcccacaccagucagc

SEQ ID NO: 3888780 - RNA, 20 nt, Shigella flexneri 2a str. 301
cauccgccccggcuucaaag

SEQ ID NO: 3888781 - RNA, 17 nt, Shigella flexneri 2a str. 301
cauccgcgguaucgccg

SEQ ID NO: 3888782 - RNA, 12 nt, Shigella flexneri 2a str. 301
cauccgcucacu

SEQ ID NO: 3888783 - RNA, 22 nt, Shigella flexneri 2a str. 301
cauccgcucccuggcccaucgc

SEQ ID NO: 3888784 - RNA, 19 nt, Shigella flexneri 2a str. 301
cauccgcuggcccaucaga

SEQ ID NO: 3888785 - RNA, 18 nt, Shigella flexneri 2a str. 301
cauccggauacagcccca

SEQ ID NO: 3888786 - RNA, 21 nt, Shigella flexneri 2a str. 301
cauccggcaacaucaaauuac

SEQ ID NO: 3888787 - RNA, 19 nt, Shigella flexneri 2a str. 301
cauccggcaaguuguauug

SEQ ID NO: 3888788 - RNA, 21 nt, Shigella flexneri 2a str. 301
cauccggcaaucggugcaaau

SEQ ID NO: 3888789 - RNA, 22 nt, Shigella flexneri 2a str. 301
cauccggcaaucggugcaaaug

SEQ ID NO: 3888790 - RNA, 19 nt, Shigella flexneri 2a str. 301
cauccggcaauucucucug

SEQ ID NO: 3888791 - RNA, 15 nt, Shigella flexneri 2a str. 301
cauccggcagcaaau

SEQ ID NO: 3888792 - RNA, 22 nt, Shigella flexneri 2a str. 301
cauccggcagccgugcccaacu

SEQ ID NO: 3888793 - RNA, 20 nt, Shigella flexneri 2a str. 301
cauccggcaguaauaccaga

SEQ ID NO: 3888794 - RNA, 15 nt, Shigella flexneri 2a str. 301
cauccggcauaaaca

SEQ ID NO: 3888795 - RNA, 16 nt, Shigella flexneri 2a str. 301
cauccggcauauuaac

SEQ ID NO: 3888796 - RNA, 19 nt, Shigella flexneri 2a str. 301
cauccggcaugaacaaagc

SEQ ID NO: 3888797 - RNA, 22 nt, Shigella flexneri 2a str. 301
cauccggcaugaacaaagcgca

SEQ ID NO: 3888798 - RNA, 18 nt, Shigella flexneri 2a str. 301
cauccggcaugauaccga

SEQ ID NO: 3888799 - RNA, 14 nt, Shigella flexneri 2a str. 301
cauccggcauucag

SEQ ID NO: 3888800 - RNA, 22 nt, Shigella flexneri 2a str. 301
cauccggcauucagugcaaaug

SEQ ID NO: 3888801 - RNA, 22 nt, Shigella flexneri 2a str. 301
cauccggcuccgguuaacgccg

SEQ ID NO: 3888802 - RNA, 23 nt, Shigella flexneri 2a str. 301
cauccggcuuuuuuacaucauca

SEQ ID NO: 3888803 - RNA, 16 nt, Shigella flexneri 2a str. 301
cauccgggcgaacugg

SEQ ID NO: 3888804 - RNA, 14 nt, Shigella flexneri 2a str. 301
cauccgucauccau

SEQ ID NO: 3888805 - RNA, 18 nt, Shigella flexneri 2a str. 301
cauccgucauccauacca

SEQ ID NO: 3888806 - RNA, 20 nt, Shigella flexneri 2a str. 301
cauccguggcgacagaggug

SEQ ID NO: 3888807 - RNA, 22 nt, Shigella flexneri 2a str. 301
cauccguuucucuguucagccu

SEQ ID NO: 3888808 - RNA, 16 nt, Shigella flexneri 2a str. 301
cauccguuuuguggug

SEQ ID NO: 3888809 - RNA, 21 nt, Shigella flexneri 2a str. 301
cauccuaaaggcaaaaugcca

SEQ ID NO: 3888810 - RNA, 14 nt, Shigella flexneri 2a str. 301
cauccucuuuacgc

SEQ ID NO: 3888811 - RNA, 16 nt, Shigella flexneri 2a str. 301
cauccugacccagcaa

SEQ ID NO: 3888812 - RNA, 16 nt, Shigella flexneri 2a str. 301
cauccugauaggauuu

SEQ ID NO: 3888813 - RNA, 12 nt, Shigella flexneri 2a str. 301
cauccugccaug

SEQ ID NO: 3888814 - RNA, 14 nt, Shigella flexneri 2a str. 301
cauccugcggcagc

SEQ ID NO: 3888815 - RNA, 21 nt, Shigella flexneri 2a str. 301
cauccugcggcagcuccagca

SEQ ID NO: 3888816 - RNA, 19 nt, Shigella flexneri 2a str. 301
cauccugcguuaaucgccg

SEQ ID NO: 3888817 - RNA, 12 nt, Shigella flexneri 2a str. 301
cauccugcugca

SEQ ID NO: 3888818 - RNA, 19 nt, Shigella flexneri 2a str. 301
cauccuguacgacaaaaga

SEQ ID NO: 3888819 - RNA, 16 nt, Shigella flexneri 2a str. 301
cauccuguuccacugg

SEQ ID NO: 3888820 - RNA, 16 nt, Shigella flexneri 2a str. 301
cauccuucauuauccu

SEQ ID NO: 3888821 - RNA, 16 nt, Shigella flexneri 2a str. 301
cauccuuugcuggcaa

SEQ ID NO: 3888822 - RNA, 16 nt, Shigella flexneri 2a str. 301
caucgaaaacgccacc

SEQ ID NO: 3888823 - RNA, 17 nt, Shigella flexneri 2a str. 301
caucgaaaacgccaccg

SEQ ID NO: 3888824 - RNA, 15 nt, Shigella flexneri 2a str. 301
caucgaaccaucggc

SEQ ID NO: 3888825 - RNA, 20 nt, Shigella flexneri 2a str. 301
caucgaagagacaaaaaagg

SEQ ID NO: 3888826 - RNA, 14 nt, Shigella flexneri 2a str. 301
caucgacagcaaau

SEQ ID NO: 3888827 - RNA, 18 nt, Shigella flexneri 2a str. 301
caucgacguccaaucagc

SEQ ID NO: 3888828 - RNA, 15 nt, Shigella flexneri 2a str. 301
caucgauaccaucgc

SEQ ID NO: 3888829 - RNA, 19 nt, Shigella flexneri 2a str. 301
caucgauaccaucgcuuca

SEQ ID NO: 3888830 - RNA, 17 nt, Shigella flexneri 2a str. 301
caucgauauuaucuuca

SEQ ID NO: 3888831 - RNA, 17 nt, Shigella flexneri 2a str. 301
caucgaugagaugacgc

SEQ ID NO: 3888832 - RNA, 22 nt, Shigella flexneri 2a str. 301
caucgaugguugcccugcuggu

SEQ ID NO: 3888833 - RNA, 21 nt, Shigella flexneri 2a str. 301
caucgcaaaccagacgcgcgu

SEQ ID NO: 3888834 - RNA, 23 nt, Shigella flexneri 2a str. 301
caucgcaacgccuaaauccgcca

SEQ ID NO: 3888835 - RNA, 13 nt, Shigella flexneri 2a str. 301
caucgcagcaaac

SEQ ID NO: 3888836 - RNA, 19 nt, Shigella flexneri 2a str. 301
caucgcauaaaccacagac

SEQ ID NO: 3888837 - RNA, 15 nt, Shigella flexneri 2a str. 301
caucgcaucaaaguu

SEQ ID NO: 3888838 - RNA, 21 nt, Shigella flexneri 2a str. 301
caucgcauccgacaucaaccg

SEQ ID NO: 3888839 - RNA, 15 nt, Shigella flexneri 2a str. 301
caucgcaucuucgcc

SEQ ID NO: 3888840 - RNA, 14 nt, Shigella flexneri 2a str. 301
caucgccaaacagg

SEQ ID NO: 3888841 - RNA, 14 nt, Shigella flexneri 2a str. 301
caucgccacaccag

SEQ ID NO: 3888842 - RNA, 16 nt, Shigella flexneri 2a str. 301
caucgccacaccagua

SEQ ID NO: 3888843 - RNA, 17 nt, Shigella flexneri 2a str. 301
caucgccacggcaugaa

SEQ ID NO: 3888844 - RNA, 18 nt, Shigella flexneri 2a str. 301
caucuuccagcaucagca

SEQ ID NO: 3888845 - RNA, 17 nt, Shigella flexneri 2a str. 301
caucuucccagguuuca

SEQ ID NO: 3888846 - RNA, 12 nt, Shigella flexneri 2a str. 301
caucuucuucac

SEQ ID NO: 3888847 - RNA, 19 nt, Shigella flexneri 2a str. 301
caucuucuugcagcuuaau

SEQ ID NO: 3888848 - RNA, 14 nt, Shigella flexneri 2a str. 301
caucuugauaccaa

SEQ ID NO: 3888849 - RNA, 17 nt, Shigella flexneri 2a str. 301
caucuuguaggccugau

SEQ ID NO: 3888850 - RNA, 11 nt, Shigella flexneri 2a str. 301
caucuuuaacg

SEQ ID NO: 3888851 - RNA, 14 nt, Shigella flexneri 2a str. 301
caucuuuauauauu

SEQ ID NO: 3888852 - RNA, 21 nt, Shigella flexneri 2a str. 301
caucuuuccaaaccucagagu

SEQ ID NO: 3888853 - RNA, 15 nt, Shigella flexneri 2a str. 301
caucuuugaaaucac

SEQ ID NO: 3888854 - RNA, 22 nt, Shigella flexneri 2a str. 301
caugaaaaaacuggcuacccug

SEQ ID NO: 3888855 - RNA, 17 nt, Shigella flexneri 2a str. 301
caugaaagcgaugcuga

SEQ ID NO: 3888856 - RNA, 19 nt, Shigella flexneri 2a str. 301
caugaaagcgaugcugaug

SEQ ID NO: 3888857 - RNA, 17 nt, Shigella flexneri 2a str. 301
caugaaauaaaaauaag

SEQ ID NO: 3888858 - RNA, 12 nt, Shigella flexneri 2a str. 301
caugaaaugaaa

SEQ ID NO: 3888859 - RNA, 14 nt, Shigella flexneri 2a str. 301
caugaaaugaaaau

SEQ ID NO: 3888860 - RNA, 16 nt, Shigella flexneri 2a str. 301
caugaaaugaaaauca

SEQ ID NO: 3888861 - RNA, 14 nt, Shigella flexneri 2a str. 301
caugaacacacccg

SEQ ID NO: 3888862 - RNA, 21 nt, Shigella flexneri 2a str. 301
caugaacgcccgcaagccaac

SEQ ID NO: 3888863 - RNA, 15 nt, Shigella flexneri 2a str. 301
caugaauauauaauu

SEQ ID NO: 3888864 - RNA, 15 nt, Shigella flexneri 2a str. 301
caugaauucgacuuu

SEQ ID NO: 3888865 - RNA, 16 nt, Shigella flexneri 2a str. 301
caugacaaaaaagcca

SEQ ID NO: 3888866 - RNA, 13 nt, Shigella flexneri 2a str. 301
caugacagcgccc

SEQ ID NO: 3888867 - RNA, 22 nt, Shigella flexneri 2a str. 301
caugacagcgcccgacaagauc

SEQ ID NO: 3888868 - RNA, 23 nt, Shigella flexneri 2a str. 301
caugaccacucauuacggucaaa

SEQ ID NO: 3888869 - RNA, 18 nt, Shigella flexneri 2a str. 301
caugaccgcuccgccauc

SEQ ID NO: 3888870 - RNA, 22 nt, Shigella flexneri 2a str. 301
caugaccuuucaguuugccgcu

SEQ ID NO: 3888871 - RNA, 11 nt, Shigella flexneri 2a str. 301
caugacgauca

SEQ ID NO: 3888872 - RNA, 19 nt, Shigella flexneri 2a str. 301
caugacgcacuuucgcuuu

SEQ ID NO: 3888873 - RNA, 19 nt, Shigella flexneri 2a str. 301
caugacgcgcaucacgaca

SEQ ID NO: 3888874 - RNA, 16 nt, Shigella flexneri 2a str. 301
caugacguccuguacu

SEQ ID NO: 3888875 - RNA, 17 nt, Shigella flexneri 2a str. 301
caugacugcggcguggg

SEQ ID NO: 3888876 - RNA, 15 nt, Shigella flexneri 2a str. 301
caugacuuugaucug

SEQ ID NO: 3888877 - RNA, 16 nt, Shigella flexneri 2a str. 301
caugagccgccgccac

SEQ ID NO: 3888878 - RNA, 16 nt, Shigella flexneri 2a str. 301
caugaguaaaauaaca

SEQ ID NO: 3888879 - RNA, 18 nt, Shigella flexneri 2a str. 301
caugauaccgauuacuca

SEQ ID NO: 3888880 - RNA, 22 nt, Shigella flexneri 2a str. 301
caugauaccgauuacucagcaa

SEQ ID NO: 3888881 - RNA, 14 nt, Shigella flexneri 2a str. 301
caugauagcccgga

SEQ ID NO: 3888882 - RNA, 13 nt, Shigella flexneri 2a str. 301
caugauaugccug

SEQ ID NO: 3888883 - RNA, 20 nt, Shigella flexneri 2a str. 301
caugauauuggcaucgccag

SEQ ID NO: 3888884 - RNA, 14 nt, Shigella flexneri 2a str. 301
caugauccuggauu

SEQ ID NO: 3888885 - RNA, 20 nt, Shigella flexneri 2a str. 301
caugaugaccgggcgcggcu

SEQ ID NO: 3888886 - RNA, 20 nt, Shigella flexneri 2a str. 301
caugaugauaucacugguga

SEQ ID NO: 3888887 - RNA, 20 nt, Shigella flexneri 2a str. 301
caugaugccggguuuacuuc

SEQ ID NO: 3888888 - RNA, 18 nt, Shigella flexneri 2a str. 301
caugauguaagaugaaau

SEQ ID NO: 3888889 - RNA, 20 nt, Shigella flexneri 2a str. 301
caugauguggugcaaggaaa

SEQ ID NO: 3888890 - RNA, 14 nt, Shigella flexneri 2a str. 301
caugauuucauaac

SEQ ID NO: 3888891 - RNA, 21 nt, Shigella flexneri 2a str. 301
caugauuuuguaggccggaua

SEQ ID NO: 3888892 - RNA, 15 nt, Shigella flexneri 2a str. 301
caugcaaaccaucac

SEQ ID NO: 3888893 - RNA, 15 nt, Shigella flexneri 2a str. 301
caugcaacgucauca

SEQ ID NO: 3888894 - RNA, 12 nt, Shigella flexneri 2a str. 301
caugcacccuca

SEQ ID NO: 3888895 - RNA, 13 nt, Shigella flexneri 2a str. 301
caugcacccucaa

SEQ ID NO: 3888896 - RNA, 22 nt, Shigella flexneri 2a str. 301
caugcagaucguuuuccugcau

SEQ ID NO: 3888897 - RNA, 17 nt, Shigella flexneri 2a str. 301
caugcagcauggucagg

SEQ ID NO: 3888898 - RNA, 14 nt, Shigella flexneri 2a str. 301
caugcagcuccacc

SEQ ID NO: 3888899 - RNA, 22 nt, Shigella flexneri 2a str. 301
caugcagggcaaacucugagag

SEQ ID NO: 3888900 - RNA, 23 nt, Shigella flexneri 2a str. 301
caugcagggcaaacucugagaga

SEQ ID NO: 3888901 - RNA, 18 nt, Shigella flexneri 2a str. 301
caugcauaacagauaaau

SEQ ID NO: 3888902 - RNA, 15 nt, Shigella flexneri 2a str. 301
caugcauaaugcagc

SEQ ID NO: 3888903 - RNA, 16 nt, Shigella flexneri 2a str. 301
caugcaucgguuuugc

SEQ ID NO: 3888904 - RNA, 16 nt, Shigella flexneri 2a str. 301
caugcaugauuacugg

SEQ ID NO: 3888905 - RNA, 16 nt, Shigella flexneri 2a str. 301
caugccaaaagggagc

SEQ ID NO: 3888906 - RNA, 17 nt, Shigella flexneri 2a str. 301
caugccaaucagcagaa

SEQ ID NO: 3888907 - RNA, 21 nt, Shigella flexneri 2a str. 301
caugccacacacgauccugca

SEQ ID NO: 3888908 - RNA, 18 nt, Shigella flexneri 2a str. 301
caugccagugaugggcag

SEQ ID NO: 3888909 - RNA, 17 nt, Shigella flexneri 2a str. 301
caugccauauuguuuca

SEQ ID NO: 3888910 - RNA, 12 nt, Shigella flexneri 2a str. 301
caugccauuucc

SEQ ID NO: 3888911 - RNA, 17 nt, Shigella flexneri 2a str. 301
caugccgaauccgggaa

SEQ ID NO: 3888912 - RNA, 17 nt, Shigella flexneri 2a str. 301
caugccggaugcggcgu

SEQ ID NO: 3888913 - RNA, 23 nt, Shigella flexneri 2a str. 301
caugccgggcaaaagucaccagu

SEQ ID NO: 3888914 - RNA, 14 nt, Shigella flexneri 2a str. 301
caugccggucgcgc

SEQ ID NO: 3888915 - RNA, 19 nt, Shigella flexneri 2a str. 301
caugccggucgcgcgggaa

SEQ ID NO: 3888916 - RNA, 12 nt, Shigella flexneri 2a str. 301
caugccggugau

SEQ ID NO: 3888917 - RNA, 16 nt, Shigella flexneri 2a str. 301
caugccgucaaaaaac

SEQ ID NO: 3888918 - RNA, 16 nt, Shigella flexneri 2a str. 301
caugccgugaugcgca

SEQ ID NO: 3888919 - RNA, 15 nt, Shigella flexneri 2a str. 301
caugccuaagcgaac

SEQ ID NO: 3888920 - RNA, 14 nt, Shigella flexneri 2a str. 301
caugccuaccaaac

SEQ ID NO: 3888921 - RNA, 17 nt, Shigella flexneri 2a str. 301
caugccugcauaaagga

SEQ ID NO: 3888922 - RNA, 23 nt, Shigella flexneri 2a str. 301
caugcgaucccacgccgaaugcc

SEQ ID NO: 3888923 - RNA, 21 nt, Shigella flexneri 2a str. 301
caugcgauggagugagaaugc

SEQ ID NO: 3888924 - RNA, 17 nt, Shigella flexneri 2a str. 301
caugcggguauucaucc

SEQ ID NO: 3888925 - RNA, 21 nt, Shigella flexneri 2a str. 301
caugcgguucacgcgccagag

SEQ ID NO: 3888926 - RNA, 16 nt, Shigella flexneri 2a str. 301
caugcguuuguaggcg

SEQ ID NO: 3888927 - RNA, 13 nt, Shigella flexneri 2a str. 301
caugcuauuccuu

SEQ ID NO: 3888928 - RNA, 14 nt, Shigella flexneri 2a str. 301
caugcucacagagu

SEQ ID NO: 3888929 - RNA, 15 nt, Shigella flexneri 2a str. 301
caugcucaccacgua

SEQ ID NO: 3888930 - RNA, 17 nt, Shigella flexneri 2a str. 301
caugcucagaugccuga

SEQ ID NO: 3888931 - RNA, 12 nt, Shigella flexneri 2a str. 301
caugcuccagca

SEQ ID NO: 3888932 - RNA, 16 nt, Shigella flexneri 2a str. 301
caugcuggaaccacag

SEQ ID NO: 3888933 - RNA, 19 nt, Shigella flexneri 2a str. 301
caugcuggaaccacagcgc

SEQ ID NO: 3888934 - RNA, 15 nt, Shigella flexneri 2a str. 301
caugcuggauggcgc

SEQ ID NO: 3888935 - RNA, 22 nt, Shigella flexneri 2a str. 301
caugcugucggcugccagccau

SEQ ID NO: 3888936 - RNA, 13 nt, Shigella flexneri 2a str. 301
caugcuuagcaca

SEQ ID NO: 3888937 - RNA, 18 nt, Shigella flexneri 2a str. 301
cauggaagcagaucugga

SEQ ID NO: 3888938 - RNA, 17 nt, Shigella flexneri 2a str. 301
cauggacgaaaucuacg

SEQ ID NO: 3888939 - RNA, 16 nt, Shigella flexneri 2a str. 301
cauggagaacgccugu

SEQ ID NO: 3888940 - RNA, 16 nt, Shigella flexneri 2a str. 301
cauggcaacuaacuga

SEQ ID NO: 3888941 - RNA, 14 nt, Shigella flexneri 2a str. 301
cauggcaagaauaa

SEQ ID NO: 3888942 - RNA, 14 nt, Shigella flexneri 2a str. 301
cauggcagaagcau

SEQ ID NO: 3888943 - RNA, 21 nt, Shigella flexneri 2a str. 301
cauggcauuggccguugccau

SEQ ID NO: 3888944 - RNA, 13 nt, Shigella flexneri 2a str. 301
cauggcauuuucu

SEQ ID NO: 3888945 - RNA, 16 nt, Shigella flexneri 2a str. 301
cauucacacuccaguc

SEQ ID NO: 3888946 - RNA, 14 nt, Shigella flexneri 2a str. 301
cauucaccaguuga

SEQ ID NO: 3888947 - RNA, 20 nt, Shigella flexneri 2a str. 301
cauucacgcugucggcacug

SEQ ID NO: 3888948 - RNA, 21 nt, Shigella flexneri 2a str. 301
cauucacgcugucggcacuga

SEQ ID NO: 3888949 - RNA, 23 nt, Shigella flexneri 2a str. 301
cauucagacacgccgccagacca

SEQ ID NO: 3888950 - RNA, 21 nt, Shigella flexneri 2a str. 301
cauucaggccgccgucaucac

SEQ ID NO: 3888951 - RNA, 18 nt, Shigella flexneri 2a str. 301
cauucagugcaaaugcca

SEQ ID NO: 3888952 - RNA, 21 nt, Shigella flexneri 2a str. 301
cauucauacccugaaucaauc

SEQ ID NO: 3888953 - RNA, 16 nt, Shigella flexneri 2a str. 301
cauucaucgccuucuu

SEQ ID NO: 3888954 - RNA, 19 nt, Shigella flexneri 2a str. 301
cauucaugcgaauacaccc

SEQ ID NO: 3888955 - RNA, 21 nt, Shigella flexneri 2a str. 301
cauucaugcgaauacacccug

SEQ ID NO: 3888956 - RNA, 23 nt, Shigella flexneri 2a str. 301
cauucaugcgaauacacccugaa

SEQ ID NO: 3888957 - RNA, 18 nt, Shigella flexneri 2a str. 301
cauuccaccgaaacuuuu

SEQ ID NO: 3888958 - RNA, 13 nt, Shigella flexneri 2a str. 301
cauuccaguccac

SEQ ID NO: 3888959 - RNA, 21 nt, Shigella flexneri 2a str. 301
cauucccagcgcguucuggua

SEQ ID NO: 3888960 - RNA, 18 nt, Shigella flexneri 2a str. 301
cauucccccuuugaccag

SEQ ID NO: 3888961 - RNA, 22 nt, Shigella flexneri 2a str. 301
cauucccggucaguagaauaau

SEQ ID NO: 3888962 - RNA, 18 nt, Shigella flexneri 2a str. 301
cauucccuacgcgauaaa

SEQ ID NO: 3888963 - RNA, 19 nt, Shigella flexneri 2a str. 301
cauuccggaguuuaugagg

SEQ ID NO: 3888964 - RNA, 18 nt, Shigella flexneri 2a str. 301
cauuccggcgcaguauga

SEQ ID NO: 3888965 - RNA, 20 nt, Shigella flexneri 2a str. 301
cauuccgggaaacgaaccau

SEQ ID NO: 3888966 - RNA, 23 nt, Shigella flexneri 2a str. 301
cauuccgggaaacgaaccauaaa

SEQ ID NO: 3888967 - RNA, 18 nt, Shigella flexneri 2a str. 301
cauucgagaagcccauac

SEQ ID NO: 3888968 - RNA, 16 nt, Shigella flexneri 2a str. 301
cauucgcaguugcagu

SEQ ID NO: 3888969 - RNA, 20 nt, Shigella flexneri 2a str. 301
cauucgccgcuuaccauaac

SEQ ID NO: 3888970 - RNA, 19 nt, Shigella flexneri 2a str. 301
cauucgccgguuccagcuu

SEQ ID NO: 3888971 - RNA, 20 nt, Shigella flexneri 2a str. 301
cauucggauugcuauuuaac

SEQ ID NO: 3888972 - RNA, 19 nt, Shigella flexneri 2a str. 301
cauucgguugccagcgcca

SEQ ID NO: 3888973 - RNA, 17 nt, Shigella flexneri 2a str. 301
cauucgguuuucaaucg

SEQ ID NO: 3888974 - RNA, 17 nt, Shigella flexneri 2a str. 301
cauucgucuccuggccg

SEQ ID NO: 3888975 - RNA, 17 nt, Shigella flexneri 2a str. 301
cauucguucuucagacu

SEQ ID NO: 3888976 - RNA, 16 nt, Shigella flexneri 2a str. 301
cauucucacuccagcc

SEQ ID NO: 3888977 - RNA, 18 nt, Shigella flexneri 2a str. 301
cauucucacuccagccag

SEQ ID NO: 3888978 - RNA, 12 nt, Shigella flexneri 2a str. 301
cauucuccgagg

SEQ ID NO: 3888979 - RNA, 12 nt, Shigella flexneri 2a str. 301
cauucugacugg

SEQ ID NO: 3888980 - RNA, 15 nt, Shigella flexneri 2a str. 301
cauucugcgcugacu

SEQ ID NO: 3888981 - RNA, 22 nt, Shigella flexneri 2a str. 301
cauucuuaccgggucgcacugg

SEQ ID NO: 3888982 - RNA, 17 nt, Shigella flexneri 2a str. 301
cauucuuccuccagcgg

SEQ ID NO: 3888983 - RNA, 23 nt, Shigella flexneri 2a str. 301
cauucuugccaucaaucacuuug

SEQ ID NO: 3888984 - RNA, 20 nt, Shigella flexneri 2a str. 301
cauugaacuuguagcuuuca

SEQ ID NO: 3888985 - RNA, 15 nt, Shigella flexneri 2a str. 301
cauugaagaauuuuu

SEQ ID NO: 3888986 - RNA, 11 nt, Shigella flexneri 2a str. 301
cauugaaugcg

SEQ ID NO: 3888987 - RNA, 23 nt, Shigella flexneri 2a str. 301
cauugaauuuuauguuucgcauc

SEQ ID NO: 3888988 - RNA, 14 nt, Shigella flexneri 2a str. 301
cauugaccagauca

SEQ ID NO: 3888989 - RNA, 20 nt, Shigella flexneri 2a str. 301
cauugagcuggucugaauca

SEQ ID NO: 3888990 - RNA, 15 nt, Shigella flexneri 2a str. 301
cauugagguugaucu

SEQ ID NO: 3888991 - RNA, 21 nt, Shigella flexneri 2a str. 301
cauugagucccaucuuuuuaa

SEQ ID NO: 3888992 - RNA, 14 nt, Shigella flexneri 2a str. 301
cauugaguuuacgc

SEQ ID NO: 3888993 - RNA, 23 nt, Shigella flexneri 2a str. 301
cauugaguuugaugaccagauca

SEQ ID NO: 3888994 - RNA, 23 nt, Shigella flexneri 2a str. 301
cauugauaauccaucacuucauc

SEQ ID NO: 3888995 - RNA, 20 nt, Shigella flexneri 2a str. 301
cauugaugcguuagaugaug

SEQ ID NO: 3888996 - RNA, 15 nt, Shigella flexneri 2a str. 301
cauugcaagauuuuu

SEQ ID NO: 3888997 - RNA, 23 nt, Shigella flexneri 2a str. 301
cauugcagucauaaccaguccau

SEQ ID NO: 3888998 - RNA, 22 nt, Shigella flexneri 2a str. 301
cauugcauaaacaccugcggcg

SEQ ID NO: 3888999 - RNA, 19 nt, Shigella flexneri 2a str. 301
cauugcaucgaggaaaacc

SEQ ID NO: 3889000 - RNA, 20 nt, Shigella flexneri 2a str. 301
cauugcaucgaggaaaacca

SEQ ID NO: 3889001 - RNA, 20 nt, Shigella flexneri 2a str. 301
cauugccagagugaaaaugc

SEQ ID NO: 3889002 - RNA, 15 nt, Shigella flexneri 2a str. 301
cauugccaggcagga

SEQ ID NO: 3889003 - RNA, 21 nt, Shigella flexneri 2a str. 301
cauugcccaauacagcgcgga

SEQ ID NO: 3889004 - RNA, 20 nt, Shigella flexneri 2a str. 301
cauugcccgcccgacaaagc

SEQ ID NO: 3889005 - RNA, 21 nt, Shigella flexneri 2a str. 301
cauugccgggcgcaucagauc

SEQ ID NO: 3889006 - RNA, 23 nt, Shigella flexneri 2a str. 301
cauugccugaucgcgcaaacagu

SEQ ID NO: 3889007 - RNA, 11 nt, Shigella flexneri 2a str. 301
cauugccuggc

SEQ ID NO: 3889008 - RNA, 17 nt, Shigella flexneri 2a str. 301
cauugcgacgagaaaau

SEQ ID NO: 3889009 - RNA, 15 nt, Shigella flexneri 2a str. 301
cauugcgccugcagg

SEQ ID NO: 3889010 - RNA, 17 nt, Shigella flexneri 2a str. 301
cauugcggcaacaaugc

SEQ ID NO: 3889011 - RNA, 21 nt, Shigella flexneri 2a str. 301
cauugcgguucguugauaaua

SEQ ID NO: 3889012 - RNA, 20 nt, Shigella flexneri 2a str. 301
cauugcgugauaucaccguu

SEQ ID NO: 3889013 - RNA, 13 nt, Shigella flexneri 2a str. 301
cauugcuauuucc

SEQ ID NO: 3889014 - RNA, 15 nt, Shigella flexneri 2a str. 301
cauugcucacuuccu

SEQ ID NO: 3889015 - RNA, 20 nt, Shigella flexneri 2a str. 301
cauugcucacuuccuuuuuu

SEQ ID NO: 3889016 - RNA, 17 nt, Shigella flexneri 2a str. 301
cauugcucuggcaaacu

SEQ ID NO: 3889017 - RNA, 14 nt, Shigella flexneri 2a str. 301
cauugcugccagaa

SEQ ID NO: 3889018 - RNA, 13 nt, Shigella flexneri 2a str. 301
cauugcuguauca

SEQ ID NO: 3889019 - RNA, 19 nt, Shigella flexneri 2a str. 301
cauugcuguaucacuauga

SEQ ID NO: 3889020 - RNA, 23 nt, Shigella flexneri 2a str. 301
cauugcuuugguggucaccauga

SEQ ID NO: 3889021 - RNA, 17 nt, Shigella flexneri 2a str. 301
cauuggagacugaugac

SEQ ID NO: 3889022 - RNA, 18 nt, Shigella flexneri 2a str. 301
cauuggagaguugaaagc

SEQ ID NO: 3889023 - RNA, 16 nt, Shigella flexneri 2a str. 301
cauuggcagccagcau

SEQ ID NO: 3889024 - RNA, 21 nt, Shigella flexneri 2a str. 301
cauuggcauaaauaauaagag

SEQ ID NO: 3889025 - RNA, 17 nt, Shigella flexneri 2a str. 301
cauuggcucaucaaaca

SEQ ID NO: 3889026 - RNA, 20 nt, Shigella flexneri 2a str. 301
cauuggguucaucugauagc

SEQ ID NO: 3889027 - RNA, 21 nt, Shigella flexneri 2a str. 301
cauugguugcuggaaagagaa

SEQ ID NO: 3889028 - RNA, 23 nt, Shigella flexneri 2a str. 301
cauugucgggccgcacgcuguau

SEQ ID NO: 3889029 - RNA, 23 nt, Shigella flexneri 2a str. 301
cauugugaccuuugacucagcgu

SEQ ID NO: 3889030 - RNA, 17 nt, Shigella flexneri 2a str. 301
cauugugugaaaucagc

SEQ ID NO: 3889031 - RNA, 19 nt, Shigella flexneri 2a str. 301
cauuguuguuggauccccu

SEQ ID NO: 3889032 - RNA, 13 nt, Shigella flexneri 2a str. 301
cauuguuugcaaa

SEQ ID NO: 3889033 - RNA, 15 nt, Shigella flexneri 2a str. 301
cauuuaaaaagaaaa

SEQ ID NO: 3889034 - RNA, 15 nt, Shigella flexneri 2a str. 301
cauuuaaaucaauaa

SEQ ID NO: 3889035 - RNA, 20 nt, Shigella flexneri 2a str. 301
cauuuaccgcaacucauuua

SEQ ID NO: 3889036 - RNA, 23 nt, Shigella flexneri 2a str. 301
cauuuaccgcaacucauuuacag

SEQ ID NO: 3889037 - RNA, 20 nt, Shigella flexneri 2a str. 301
cauuuagcgccggguuuuuu

SEQ ID NO: 3889038 - RNA, 22 nt, Shigella flexneri 2a str. 301
cauuuagcgccggguuuuuuau

SEQ ID NO: 3889039 - RNA, 17 nt, Shigella flexneri 2a str. 301
cauuuaugccauguuca

SEQ ID NO: 3889040 - RNA, 12 nt, Shigella flexneri 2a str. 301
cauuuaugcugu

SEQ ID NO: 3889041 - RNA, 22 nt, Shigella flexneri 2a str. 301
cauuuaugcuguccuaaaaaau

SEQ ID NO: 3889042 - RNA, 21 nt, Shigella flexneri 2a str. 301
cauuuauggugcuaguuaucu

SEQ ID NO: 3889043 - RNA, 23 nt, Shigella flexneri 2a str. 301
cauuuauguucagccgucaucca

SEQ ID NO: 3889044 - RNA, 14 nt, Shigella flexneri 2a str. 301
ccaacuccagcggc

SEQ ID NO: 3889045 - RNA, 18 nt, Shigella flexneri 2a str. 301
ccaacugauuuucaucuu

SEQ ID NO: 3889046 - RNA, 21 nt, Shigella flexneri 2a str. 301
ccaacuguugauccaggagcu

SEQ ID NO: 3889047 - RNA, 22 nt, Shigella flexneri 2a str. 301
ccaacuucagcaacaaaauggc

SEQ ID NO: 3889048 - RNA, 13 nt, Shigella flexneri 2a str. 301
ccaacuucaugac

SEQ ID NO: 3889049 - RNA, 15 nt, Shigella flexneri 2a str. 301
ccaacuugcccaggu

SEQ ID NO: 3889050 - RNA, 19 nt, Shigella flexneri 2a str. 301
ccaacuugcccaggugugu

SEQ ID NO: 3889051 - RNA, 14 nt, Shigella flexneri 2a str. 301
ccaagauagaacca

SEQ ID NO: 3889052 - RNA, 16 nt, Shigella flexneri 2a str. 301
ccaagauagaaccacg

SEQ ID NO: 3889053 - RNA, 20 nt, Shigella flexneri 2a str. 301
ccaagauuaaaggcaccaau

SEQ ID NO: 3889054 - RNA, 19 nt, Shigella flexneri 2a str. 301
ccaagcagcgcgcagaaca

SEQ ID NO: 3889055 - RNA, 23 nt, Shigella flexneri 2a str. 301
ccaagcguagcugguucucgcuu

SEQ ID NO: 3889056 - RNA, 22 nt, Shigella flexneri 2a str. 301
ccaaggcgaggggaccgccccu

SEQ ID NO: 3889057 - RNA, 14 nt, Shigella flexneri 2a str. 301
ccaaguaauagaac

SEQ ID NO: 3889058 - RNA, 19 nt, Shigella flexneri 2a str. 301
ccaaguucgaacgccgcca

SEQ ID NO: 3889059 - RNA, 18 nt, Shigella flexneri 2a str. 301
ccaaguugugauugagau

SEQ ID NO: 3889060 - RNA, 14 nt, Shigella flexneri 2a str. 301
ccaauaaacgccag

SEQ ID NO: 3889061 - RNA, 18 nt, Shigella flexneri 2a str. 301
ccaauaauccccaauacg

SEQ ID NO: 3889062 - RNA, 19 nt, Shigella flexneri 2a str. 301
ccaauaauccccaauacga

SEQ ID NO: 3889063 - RNA, 16 nt, Shigella flexneri 2a str. 301
ccaauaccgcccacca

SEQ ID NO: 3889064 - RNA, 22 nt, Shigella flexneri 2a str. 301
ccaauaccgcccaccaccagcg

SEQ ID NO: 3889065 - RNA, 18 nt, Shigella flexneri 2a str. 301
ccaauagaaagugacagc

SEQ ID NO: 3889066 - RNA, 23 nt, Shigella flexneri 2a str. 301
ccaauagaaagugacagcccggc

SEQ ID NO: 3889067 - RNA, 14 nt, Shigella flexneri 2a str. 301
ccaauagccgcgcc

SEQ ID NO: 3889068 - RNA, 22 nt, Shigella flexneri 2a str. 301
ccaauaguuccacuauuucaau

SEQ ID NO: 3889069 - RNA, 19 nt, Shigella flexneri 2a str. 301
ccaauauagacaaaguaac

SEQ ID NO: 3889070 - RNA, 11 nt, Shigella flexneri 2a str. 301
ccaauauccug

SEQ ID NO: 3889071 - RNA, 14 nt, Shigella flexneri 2a str. 301
ccaauauucagaaa

SEQ ID NO: 3889072 - RNA, 16 nt, Shigella flexneri 2a str. 301
ccaauauugcaccuga

SEQ ID NO: 3889073 - RNA, 23 nt, Shigella flexneri 2a str. 301
ccaaucaaauacccuugcagaua

SEQ ID NO: 3889074 - RNA, 20 nt, Shigella flexneri 2a str. 301
ccaaucacaagaccgcuucc

SEQ ID NO: 3889075 - RNA, 22 nt, Shigella flexneri 2a str. 301
ccaaucacacaaccaugcagga

SEQ ID NO: 3889076 - RNA, 23 nt, Shigella flexneri 2a str. 301
ccaaucagacucauauaaaaacc

SEQ ID NO: 3889077 - RNA, 16 nt, Shigella flexneri 2a str. 301
ccaaucagcaauaaac

SEQ ID NO: 3889078 - RNA, 17 nt, Shigella flexneri 2a str. 301
ccaaucagcaauaaacg

SEQ ID NO: 3889079 - RNA, 14 nt, Shigella flexneri 2a str. 301
ccaaucagcacaca

SEQ ID NO: 3889080 - RNA, 17 nt, Shigella flexneri 2a str. 301
ccaaucagcacacauaa

SEQ ID NO: 3889081 - RNA, 16 nt, Shigella flexneri 2a str. 301
ccaaucagguaagcaa

SEQ ID NO: 3889082 - RNA, 16 nt, Shigella flexneri 2a str. 301
ccaaucaucgcggcac

SEQ ID NO: 3889083 - RNA, 20 nt, Shigella flexneri 2a str. 301
ccaaucauucccauuuauuu

SEQ ID NO: 3889084 - RNA, 17 nt, Shigella flexneri 2a str. 301
ccaauccagcccugcca

SEQ ID NO: 3889085 - RNA, 14 nt, Shigella flexneri 2a str. 301
ccaaucccgccaua

SEQ ID NO: 3889086 - RNA, 18 nt, Shigella flexneri 2a str. 301
ccaaucccggaagccacc

SEQ ID NO: 3889087 - RNA, 19 nt, Shigella flexneri 2a str. 301
ccaaucucaccaaucgaaa

SEQ ID NO: 3889088 - RNA, 13 nt, Shigella flexneri 2a str. 301
ccaaucugcaaaa

SEQ ID NO: 3889089 - RNA, 18 nt, Shigella flexneri 2a str. 301
ccaaucuucacaucauca

SEQ ID NO: 3889090 - RNA, 17 nt, Shigella flexneri 2a str. 301
ccaaucuucucuuccgg

SEQ ID NO: 3889091 - RNA, 19 nt, Shigella flexneri 2a str. 301
ccaaugaaagccccaccag

SEQ ID NO: 3889092 - RNA, 19 nt, Shigella flexneri 2a str. 301
ccaaugacagccagcaagu

SEQ ID NO: 3889093 - RNA, 21 nt, Shigella flexneri 2a str. 301
ccaaugaccacuccggcauga

SEQ ID NO: 3889094 - RNA, 22 nt, Shigella flexneri 2a str. 301
ccaaugauugggucauuuccca

SEQ ID NO: 3889095 - RNA, 17 nt, Shigella flexneri 2a str. 301
ccaaugccguucucugg

SEQ ID NO: 3889096 - RNA, 14 nt, Shigella flexneri 2a str. 301
ccaaugccugaugc

SEQ ID NO: 3889097 - RNA, 19 nt, Shigella flexneri 2a str. 301
ccaauggcaauaaagacau

SEQ ID NO: 3889098 - RNA, 18 nt, Shigella flexneri 2a str. 301
ccaauggcuuuugccgcc

SEQ ID NO: 3889099 - RNA, 23 nt, Shigella flexneri 2a str. 301
ccaauguagccgcacgcuggcgu

SEQ ID NO: 3889100 - RNA, 22 nt, Shigella flexneri 2a str. 301
ccaaugucgaaagccccagccc

SEQ ID NO: 3889101 - RNA, 14 nt, Shigella flexneri 2a str. 301
ccaauuccgcagcg

SEQ ID NO: 3889102 - RNA, 16 nt, Shigella flexneri 2a str. 301
ccaauuccgcagcgcg

SEQ ID NO: 3889103 - RNA, 23 nt, Shigella flexneri 2a str. 301
ccaauucguaaguacauuaaaau

SEQ ID NO: 3889104 - RNA, 10 nt, Shigella flexneri 2a str. 301
ccaauugccu

SEQ ID NO: 3889105 - RNA, 23 nt, Shigella flexneri 2a str. 301
ccaauuucugugcagccaaaaau

SEQ ID NO: 3889106 - RNA, 15 nt, Shigella flexneri 2a str. 301
ccacaaaaaccgcug

SEQ ID NO: 3889107 - RNA, 23 nt, Shigella flexneri 2a str. 301
ccacaaaacggauguuucuucaa

SEQ ID NO: 3889108 - RNA, 22 nt, Shigella flexneri 2a str. 301
ccacaaaagcggugauaaaccc

SEQ ID NO: 3889109 - RNA, 18 nt, Shigella flexneri 2a str. 301
ccacaaaccuuaaauggc

SEQ ID NO: 3889110 - RNA, 13 nt, Shigella flexneri 2a str. 301
ccacaaacucuuu

SEQ ID NO: 3889111 - RNA, 16 nt, Shigella flexneri 2a str. 301
ccacaaacucuuuucc

SEQ ID NO: 3889112 - RNA, 23 nt, Shigella flexneri 2a str. 301
ccacaaagcagacaacccacaca

SEQ ID NO: 3889113 - RNA, 18 nt, Shigella flexneri 2a str. 301
ccacaaagggagagggau

SEQ ID NO: 3889114 - RNA, 11 nt, Shigella flexneri 2a str. 301
ccacaacagug

SEQ ID NO: 3889115 - RNA, 13 nt, Shigella flexneri 2a str. 301
ccacaacuucaac

SEQ ID NO: 3889116 - RNA, 20 nt, Shigella flexneri 2a str. 301
ccacaauaacugccggaacu

SEQ ID NO: 3889117 - RNA, 17 nt, Shigella flexneri 2a str. 301
ccacaaucagccagaac

SEQ ID NO: 3889118 - RNA, 12 nt, Shigella flexneri 2a str. 301
ccacaaucucac

SEQ ID NO: 3889119 - RNA, 21 nt, Shigella flexneri 2a str. 301
ccacaauggcauauuccgcca

SEQ ID NO: 3889120 - RNA, 15 nt, Shigella flexneri 2a str. 301
ccacaauugaccagu

SEQ ID NO: 3889121 - RNA, 23 nt, Shigella flexneri 2a str. 301
ccacaauugaccaguaauauccc

SEQ ID NO: 3889122 - RNA, 17 nt, Shigella flexneri 2a str. 301
ccacacacgauccugca

SEQ ID NO: 3889123 - RNA, 17 nt, Shigella flexneri 2a str. 301
ccacaccaagccggaau

SEQ ID NO: 3889124 - RNA, 16 nt, Shigella flexneri 2a str. 301
ccacaccaaucaacaa

SEQ ID NO: 3889125 - RNA, 16 nt, Shigella flexneri 2a str. 301
ccacaccaccaugcua

SEQ ID NO: 3889126 - RNA, 21 nt, Shigella flexneri 2a str. 301
ccacaccaccgcaaucgccag

SEQ ID NO: 3889127 - RNA, 19 nt, Shigella flexneri 2a str. 301
ccacaccaccguuuucccg

SEQ ID NO: 3889128 - RNA, 15 nt, Shigella flexneri 2a str. 301
ccacaccagcuuucg

SEQ ID NO: 3889129 - RNA, 15 nt, Shigella flexneri 2a str. 301
ccacacccacaucaa

SEQ ID NO: 3889130 - RNA, 16 nt, Shigella flexneri 2a str. 301
ccacaccggaccagac

SEQ ID NO: 3889131 - RNA, 17 nt, Shigella flexneri 2a str. 301
ccacaccguugccgcgu

SEQ ID NO: 3889132 - RNA, 16 nt, Shigella flexneri 2a str. 301
ccacacgcccaacuaa

SEQ ID NO: 3889133 - RNA, 22 nt, Shigella flexneri 2a str. 301
ccacagacaaaauccugccagc

SEQ ID NO: 3889134 - RNA, 19 nt, Shigella flexneri 2a str. 301
ccacagacaaacagcucga

SEQ ID NO: 3889135 - RNA, 17 nt, Shigella flexneri 2a str. 301
ccacagacaaucgccag

SEQ ID NO: 3889136 - RNA, 14 nt, Shigella flexneri 2a str. 301
ccacagcaaaacac

SEQ ID NO: 3889137 - RNA, 22 nt, Shigella flexneri 2a str. 301
ccacagccccgaaaaagagcca

SEQ ID NO: 3889138 - RNA, 20 nt, Shigella flexneri 2a str. 301
ccacagccgagcgccaccau

SEQ ID NO: 3889139 - RNA, 13 nt, Shigella flexneri 2a str. 301
ccacagcucugcu

SEQ ID NO: 3889140 - RNA, 15 nt, Shigella flexneri 2a str. 301
ccacagcucugcugu

SEQ ID NO: 3889141 - RNA, 17 nt, Shigella flexneri 2a str. 301
ccacaggaccacguucc

SEQ ID NO: 3889142 - RNA, 16 nt, Shigella flexneri 2a str. 301
ccacaggccggagcca

SEQ ID NO: 3889143 - RNA, 19 nt, Shigella flexneri 2a str. 301
ccacgccgcugucuaccag

SEQ ID NO: 3889144 - RNA, 12 nt, Shigella flexneri 2a str. 301
ccacgccugccg

SEQ ID NO: 3889145 - RNA, 16 nt, Shigella flexneri 2a str. 301
ccacgcgauacuuuuu

SEQ ID NO: 3889146 - RNA, 20 nt, Shigella flexneri 2a str. 301
ccacgcgggagagccccugc

SEQ ID NO: 3889147 - RNA, 12 nt, Shigella flexneri 2a str. 301
ccacgcucagca

SEQ ID NO: 3889148 - RNA, 19 nt, Shigella flexneri 2a str. 301
ccacgcugagagaagcacg

SEQ ID NO: 3889149 - RNA, 17 nt, Shigella flexneri 2a str. 301
ccacgcugcaucgccaa

SEQ ID NO: 3889150 - RNA, 22 nt, Shigella flexneri 2a str. 301
ccacgcugcaucgccaaucugc

SEQ ID NO: 3889151 - RNA, 15 nt, Shigella flexneri 2a str. 301
ccacgcugccgcgca

SEQ ID NO: 3889152 - RNA, 17 nt, Shigella flexneri 2a str. 301
ccacgcuguagccgccg

SEQ ID NO: 3889153 - RNA, 17 nt, Shigella flexneri 2a str. 301
ccacggaagcaguucgc

SEQ ID NO: 3889154 - RNA, 17 nt, Shigella flexneri 2a str. 301
ccacggcgcagcuucac

SEQ ID NO: 3889155 - RNA, 18 nt, Shigella flexneri 2a str. 301
ccacggcggugucgccag

SEQ ID NO: 3889156 - RNA, 14 nt, Shigella flexneri 2a str. 301
ccacgggcaauaag

SEQ ID NO: 3889157 - RNA, 13 nt, Shigella flexneri 2a str. 301
ccacgggcaauau

SEQ ID NO: 3889158 - RNA, 21 nt, Shigella flexneri 2a str. 301
ccacgguacgccagaguggau

SEQ ID NO: 3889159 - RNA, 15 nt, Shigella flexneri 2a str. 301
ccacgguauuaggca

SEQ ID NO: 3889160 - RNA, 22 nt, Shigella flexneri 2a str. 301
ccacggugcagcugcgggagga

SEQ ID NO: 3889161 - RNA, 19 nt, Shigella flexneri 2a str. 301
ccacgguugguuuuaucca

SEQ ID NO: 3889162 - RNA, 14 nt, Shigella flexneri 2a str. 301
ccacgucacucuuu

SEQ ID NO: 3889163 - RNA, 23 nt, Shigella flexneri 2a str. 301
ccacgucguuccccauuaccuga

SEQ ID NO: 3889164 - RNA, 13 nt, Shigella flexneri 2a str. 301
ccacgucugaagu

SEQ ID NO: 3889165 - RNA, 19 nt, Shigella flexneri 2a str. 301
ccacguuaguguggccagu

SEQ ID NO: 3889166 - RNA, 14 nt, Shigella flexneri 2a str. 301
ccacguuccccaga

SEQ ID NO: 3889167 - RNA, 16 nt, Shigella flexneri 2a str. 301
ccacguuccccagaug

SEQ ID NO: 3889168 - RNA, 18 nt, Shigella flexneri 2a str. 301
ccacguucugaucuuucu

SEQ ID NO: 3889169 - RNA, 12 nt, Shigella flexneri 2a str. 301
ccacuaacuguu

SEQ ID NO: 3889170 - RNA, 21 nt, Shigella flexneri 2a str. 301
ccacuacaucaagucauugau

SEQ ID NO: 3889171 - RNA, 23 nt, Shigella flexneri 2a str. 301
ccacuacgugaucgucuucaacc

SEQ ID NO: 3889172 - RNA, 15 nt, Shigella flexneri 2a str. 301
ccacuacucugaccc

SEQ ID NO: 3889173 - RNA, 19 nt, Shigella flexneri 2a str. 301
ccacuaucgccaucaggca

SEQ ID NO: 3889174 - RNA, 18 nt, Shigella flexneri 2a str. 301
ccacuauuauggcgcagg

SEQ ID NO: 3889175 - RNA, 14 nt, Shigella flexneri 2a str. 301
ccacucaccgccgu

SEQ ID NO: 3889176 - RNA, 21 nt, Shigella flexneri 2a str. 301
ccacucaccgccguuaccuuc

SEQ ID NO: 3889177 - RNA, 11 nt, Shigella flexneri 2a str. 301
ccacuccagcu

SEQ ID NO: 3889178 - RNA, 22 nt, Shigella flexneri 2a str. 301
ccacuccgguaauaucgcgcag

SEQ ID NO: 3889179 - RNA, 21 nt, Shigella flexneri 2a str. 301
ccacucgccagaccgcagaag

SEQ ID NO: 3889180 - RNA, 17 nt, Shigella flexneri 2a str. 301
ccacucugaccugacaa

SEQ ID NO: 3889181 - RNA, 15 nt, Shigella flexneri 2a str. 301
ccacucuuucagcac

SEQ ID NO: 3889182 - RNA, 22 nt, Shigella flexneri 2a str. 301
ccacugacgggaaacucugcug

SEQ ID NO: 3889183 - RNA, 13 nt, Shigella flexneri 2a str. 301
ccacugacuucuc

SEQ ID NO: 3889184 - RNA, 14 nt, Shigella flexneri 2a str. 301
ccacugacuucucu

SEQ ID NO: 3889185 - RNA, 16 nt, Shigella flexneri 2a str. 301
ccacugacuucucugg

SEQ ID NO: 3889186 - RNA, 20 nt, Shigella flexneri 2a str. 301
ccacugacuucucugggaga

SEQ ID NO: 3889187 - RNA, 19 nt, Shigella flexneri 2a str. 301
ccacugcauggcggcgucu

SEQ ID NO: 3889188 - RNA, 15 nt, Shigella flexneri 2a str. 301
ccacugccaaucacc

SEQ ID NO: 3889189 - RNA, 18 nt, Shigella flexneri 2a str. 301
ccacugcgccagcgucau

SEQ ID NO: 3889190 - RNA, 20 nt, Shigella flexneri 2a str. 301
ccacuggcugcuuucuuuga

SEQ ID NO: 3889191 - RNA, 18 nt, Shigella flexneri 2a str. 301
ccacuggucugacgcuga

SEQ ID NO: 3889192 - RNA, 22 nt, Shigella flexneri 2a str. 301
ccacuggugagcgguguugccg

SEQ ID NO: 3889193 - RNA, 15 nt, Shigella flexneri 2a str. 301
ccacugucaaaucca

SEQ ID NO: 3889194 - RNA, 21 nt, Shigella flexneri 2a str. 301
ccacuuaauaagaagaaaccg

SEQ ID NO: 3889195 - RNA, 13 nt, Shigella flexneri 2a str. 301
ccacuucaugccc

SEQ ID NO: 3889196 - RNA, 14 nt, Shigella flexneri 2a str. 301
ccacuuccaccagc

SEQ ID NO: 3889197 - RNA, 22 nt, Shigella flexneri 2a str. 301
ccacuucccaguguucuggcga

SEQ ID NO: 3889198 - RNA, 15 nt, Shigella flexneri 2a str. 301
ccacuuccgcgucaa

SEQ ID NO: 3889199 - RNA, 23 nt, Shigella flexneri 2a str. 301
ccacuuccgcgucaaucugcccg

SEQ ID NO: 3889200 - RNA, 20 nt, Shigella flexneri 2a str. 301
ccacuuccggcaacaaugcc

SEQ ID NO: 3889201 - RNA, 13 nt, Shigella flexneri 2a str. 301
ccacuucugccag

SEQ ID NO: 3889202 - RNA, 13 nt, Shigella flexneri 2a str. 301
ccacuugcagcuc

SEQ ID NO: 3889203 - RNA, 15 nt, Shigella flexneri 2a str. 301
ccacuugcagcucau

SEQ ID NO: 3889204 - RNA, 15 nt, Shigella flexneri 2a str. 301
ccacuuuacgggcaa

SEQ ID NO: 3889205 - RNA, 16 nt, Shigella flexneri 2a str. 301
ccacuuucacgccgcc

SEQ ID NO: 3889206 - RNA, 17 nt, Shigella flexneri 2a str. 301
ccacuuucacgccgcca

SEQ ID NO: 3889207 - RNA, 16 nt, Shigella flexneri 2a str. 301
ccacuuugcgcuccug

SEQ ID NO: 3889208 - RNA, 18 nt, Shigella flexneri 2a str. 301
ccacuuuuaaaucgccaa

SEQ ID NO: 3889209 - RNA, 22 nt, Shigella flexneri 2a str. 301
ccacuuuugcuccauaugaacg

SEQ ID NO: 3889210 - RNA, 23 nt, Shigella flexneri 2a str. 301
ccagaaaaaacguugucgccgcu

SEQ ID NO: 3889211 - RNA, 21 nt, Shigella flexneri 2a str. 301
ccagaaaagagacgcugaaaa

SEQ ID NO: 3889212 - RNA, 15 nt, Shigella flexneri 2a str. 301
ccagaaacaauaagu

SEQ ID NO: 3889213 - RNA, 20 nt, Shigella flexneri 2a str. 301
ccagaaacagugaccugaac

SEQ ID NO: 3889214 - RNA, 17 nt, Shigella flexneri 2a str. 301
ccagaaacgccaccauu

SEQ ID NO: 3889215 - RNA, 19 nt, Shigella flexneri 2a str. 301
ccagaaacucugcggcauc

SEQ ID NO: 3889216 - RNA, 20 nt, Shigella flexneri 2a str. 301
ccagaaagcguauccaucac

SEQ ID NO: 3889217 - RNA, 18 nt, Shigella flexneri 2a str. 301
ccagaaaguacggccacu

SEQ ID NO: 3889218 - RNA, 15 nt, Shigella flexneri 2a str. 301
ccagaaagugaguuu

SEQ ID NO: 3889219 - RNA, 15 nt, Shigella flexneri 2a str. 301
ccagaaaguuuuuca

SEQ ID NO: 3889220 - RNA, 11 nt, Shigella flexneri 2a str. 301
ccagaaaucag

SEQ ID NO: 3889221 - RNA, 20 nt, Shigella flexneri 2a str. 301
ccagaaaucggccuuccaua

SEQ ID NO: 3889222 - RNA, 16 nt, Shigella flexneri 2a str. 301
ccagaaaugcagcugu

SEQ ID NO: 3889223 - RNA, 20 nt, Shigella flexneri 2a str. 301
ccagaaauggcccaaaaggc

SEQ ID NO: 3889224 - RNA, 18 nt, Shigella flexneri 2a str. 301
ccagaacaaacuacauag

SEQ ID NO: 3889225 - RNA, 15 nt, Shigella flexneri 2a str. 301
ccagaacaaauaaau

SEQ ID NO: 3889226 - RNA, 18 nt, Shigella flexneri 2a str. 301
ccagaacacgcucccagc

SEQ ID NO: 3889227 - RNA, 20 nt, Shigella flexneri 2a str. 301
ccagaacacgcucccagcag

SEQ ID NO: 3889228 - RNA, 21 nt, Shigella flexneri 2a str. 301
ccagaacacgcucccagcaga

SEQ ID NO: 3889229 - RNA, 19 nt, Shigella flexneri 2a str. 301
ccagaacacuguuaccgcu

SEQ ID NO: 3889230 - RNA, 13 nt, Shigella flexneri 2a str. 301
ccagaaccgcgua

SEQ ID NO: 3889231 - RNA, 13 nt, Shigella flexneri 2a str. 301
ccagaacugaucc

SEQ ID NO: 3889232 - RNA, 14 nt, Shigella flexneri 2a str. 301
ccagaagaauauca

SEQ ID NO: 3889233 - RNA, 19 nt, Shigella flexneri 2a str. 301
ccagaagcacugccagaau

SEQ ID NO: 3889234 - RNA, 13 nt, Shigella flexneri 2a str. 301
ccagaagggcgag

SEQ ID NO: 3889235 - RNA, 12 nt, Shigella flexneri 2a str. 301
ccagaauaccuu

SEQ ID NO: 3889236 - RNA, 23 nt, Shigella flexneri 2a str. 301
ccagaauauugccgaagaccaga

SEQ ID NO: 3889237 - RNA, 21 nt, Shigella flexneri 2a str. 301
ccagaauccaggaaagccaug

SEQ ID NO: 3889238 - RNA, 17 nt, Shigella flexneri 2a str. 301
ccagaaucuggcgcagg

SEQ ID NO: 3889239 - RNA, 17 nt, Shigella flexneri 2a str. 301
ccagaaugucggaugca

SEQ ID NO: 3889240 - RNA, 21 nt, Shigella flexneri 2a str. 301
ccagaaugucggaugcagaac

SEQ ID NO: 3889241 - RNA, 20 nt, Shigella flexneri 2a str. 301
ccagaauucacgcacuuccg

SEQ ID NO: 3889242 - RNA, 13 nt, Shigella flexneri 2a str. 301
ccagacaaaccac

SEQ ID NO: 3889243 - RNA, 17 nt, Shigella flexneri 2a str. 301
ccagcaauccccagaca

SEQ ID NO: 3889244 - RNA, 19 nt, Shigella flexneri 2a str. 301
ccagcaauccccagacaaa

SEQ ID NO: 3889245 - RNA, 14 nt, Shigella flexneri 2a str. 301
ccagcaauccugca

SEQ ID NO: 3889246 - RNA, 23 nt, Shigella flexneri 2a str. 301
ccagcaauuuacgcuuuucuucc

SEQ ID NO: 3889247 - RNA, 20 nt, Shigella flexneri 2a str. 301
ccagcacaucaucaaagcca

SEQ ID NO: 3889248 - RNA, 17 nt, Shigella flexneri 2a str. 301
ccagcaccacuuccggc

SEQ ID NO: 3889249 - RNA, 12 nt, Shigella flexneri 2a str. 301
ccagcaccagcu

SEQ ID NO: 3889250 - RNA, 13 nt, Shigella flexneri 2a str. 301
ccagcaccaguac

SEQ ID NO: 3889251 - RNA, 18 nt, Shigella flexneri 2a str. 301
ccagcacccaguaagcug

SEQ ID NO: 3889252 - RNA, 16 nt, Shigella flexneri 2a str. 301
ccagcaccgcagagau

SEQ ID NO: 3889253 - RNA, 18 nt, Shigella flexneri 2a str. 301
ccagcacgaucagugccg

SEQ ID NO: 3889254 - RNA, 20 nt, Shigella flexneri 2a str. 301
ccagcacgaucagugccgca

SEQ ID NO: 3889255 - RNA, 23 nt, Shigella flexneri 2a str. 301
ccagcacggugaagaagcggaaa

SEQ ID NO: 3889256 - RNA, 15 nt, Shigella flexneri 2a str. 301
ccagcacguugaacu

SEQ ID NO: 3889257 - RNA, 13 nt, Shigella flexneri 2a str. 301
ccagcacugccgc

SEQ ID NO: 3889258 - RNA, 14 nt, Shigella flexneri 2a str. 301
ccagcacugccgca

SEQ ID NO: 3889259 - RNA, 15 nt, Shigella flexneri 2a str. 301
ccagcacuucgcugg

SEQ ID NO: 3889260 - RNA, 17 nt, Shigella flexneri 2a str. 301
ccagcagaauccgguga

SEQ ID NO: 3889261 - RNA, 14 nt, Shigella flexneri 2a str. 301
ccagcagaccagca

SEQ ID NO: 3889262 - RNA, 17 nt, Shigella flexneri 2a str. 301
ccagcagaccuucugcc

SEQ ID NO: 3889263 - RNA, 18 nt, Shigella flexneri 2a str. 301
ccagcagauauugcccca

SEQ ID NO: 3889264 - RNA, 14 nt, Shigella flexneri 2a str. 301
ccagcagcagcggu

SEQ ID NO: 3889265 - RNA, 20 nt, Shigella flexneri 2a str. 301
ccagcagcgaaucagcccag

SEQ ID NO: 3889266 - RNA, 22 nt, Shigella flexneri 2a str. 301
ccagcagcgaaucagcccagcc

SEQ ID NO: 3889267 - RNA, 20 nt, Shigella flexneri 2a str. 301
ccagcagcugcguggcgcuu

SEQ ID NO: 3889268 - RNA, 13 nt, Shigella flexneri 2a str. 301
ccagcagcugcuc

SEQ ID NO: 3889269 - RNA, 14 nt, Shigella flexneri 2a str. 301
ccagcagcugcucc

SEQ ID NO: 3889270 - RNA, 21 nt, Shigella flexneri 2a str. 301
ccagcagcugcucccagcgca

SEQ ID NO: 3889271 - RNA, 18 nt, Shigella flexneri 2a str. 301
ccagcagggcaaacagca

SEQ ID NO: 3889272 - RNA, 21 nt, Shigella flexneri 2a str. 301
ccagcagggcaaacagcacgg

SEQ ID NO: 3889273 - RNA, 16 nt, Shigella flexneri 2a str. 301
ccagcagguuuaacca

SEQ ID NO: 3889274 - RNA, 16 nt, Shigella flexneri 2a str. 301
ccagcaguaaaccacc

SEQ ID NO: 3889275 - RNA, 23 nt, Shigella flexneri 2a str. 301
ccagcaguaaaccacccaccagc

SEQ ID NO: 3889276 - RNA, 16 nt, Shigella flexneri 2a str. 301
ccagcaguucuacugg

SEQ ID NO: 3889277 - RNA, 20 nt, Shigella flexneri 2a str. 301
ccagcauaaccuugcaauag

SEQ ID NO: 3889278 - RNA, 15 nt, Shigella flexneri 2a str. 301
ccagcauaccuucca

SEQ ID NO: 3889279 - RNA, 19 nt, Shigella flexneri 2a str. 301
ccagcauacgcugccagcc

SEQ ID NO: 3889280 - RNA, 20 nt, Shigella flexneri 2a str. 301
ccagcauacgcugccagcca

SEQ ID NO: 3889281 - RNA, 23 nt, Shigella flexneri 2a str. 301
ccagcauaguacgggcaauuuca

SEQ ID NO: 3889282 - RNA, 18 nt, Shigella flexneri 2a str. 301
ccagcauauguuuacgcu

SEQ ID NO: 3889283 - RNA, 13 nt, Shigella flexneri 2a str. 301
ccagcaucgacca

SEQ ID NO: 3889284 - RNA, 17 nt, Shigella flexneri 2a str. 301
ccagcaucgaccaggau

SEQ ID NO: 3889285 - RNA, 16 nt, Shigella flexneri 2a str. 301
ccagcaucgcaacaug

SEQ ID NO: 3889286 - RNA, 18 nt, Shigella flexneri 2a str. 301
ccagcaucgcauccggca

SEQ ID NO: 3889287 - RNA, 12 nt, Shigella flexneri 2a str. 301
ccagcaucuccu

SEQ ID NO: 3889288 - RNA, 19 nt, Shigella flexneri 2a str. 301
ccagcaucuccugcaacag

SEQ ID NO: 3889289 - RNA, 17 nt, Shigella flexneri 2a str. 301
ccagcaugaucagcgca

SEQ ID NO: 3889290 - RNA, 21 nt, Shigella flexneri 2a str. 301
ccagcaugaucagcgcauaga

SEQ ID NO: 3889291 - RNA, 23 nt, Shigella flexneri 2a str. 301
ccagcaugaucagcgcauagaga

SEQ ID NO: 3889292 - RNA, 20 nt, Shigella flexneri 2a str. 301
ccagcauggcaauaaccgcu

SEQ ID NO: 3889293 - RNA, 17 nt, Shigella flexneri 2a str. 301
ccagcaugguaccgugu

SEQ ID NO: 3889294 - RNA, 23 nt, Shigella flexneri 2a str. 301
ccagcaugugguuaccaucaacc

SEQ ID NO: 3889295 - RNA, 15 nt, Shigella flexneri 2a str. 301
ccagcauucgcgcac

SEQ ID NO: 3889296 - RNA, 11 nt, Shigella flexneri 2a str. 301
ccagcauuucu

SEQ ID NO: 3889297 - RNA, 22 nt, Shigella flexneri 2a str. 301
ccagccaacuugcccaggugug

SEQ ID NO: 3889298 - RNA, 12 nt, Shigella flexneri 2a str. 301
ccagccaccaug

SEQ ID NO: 3889299 - RNA, 16 nt, Shigella flexneri 2a str. 301
ccagccacugcgccau

SEQ ID NO: 3889300 - RNA, 15 nt, Shigella flexneri 2a str. 301
ccagccagacgccag

SEQ ID NO: 3889301 - RNA, 22 nt, Shigella flexneri 2a str. 301
ccagccagacgccagccacagg

SEQ ID NO: 3889302 - RNA, 12 nt, Shigella flexneri 2a str. 301
ccagccagagcc

SEQ ID NO: 3889303 - RNA, 14 nt, Shigella flexneri 2a str. 301
ccagccagcaccag

SEQ ID NO: 3889304 - RNA, 16 nt, Shigella flexneri 2a str. 301
ccagccagccaagcau

SEQ ID NO: 3889305 - RNA, 13 nt, Shigella flexneri 2a str. 301
ccagccaggaauc

SEQ ID NO: 3889306 - RNA, 18 nt, Shigella flexneri 2a str. 301
ccagccaggguuauauaa

SEQ ID NO: 3889307 - RNA, 21 nt, Shigella flexneri 2a str. 301
ccagccaggguuauauaaaac

SEQ ID NO: 3889308 - RNA, 14 nt, Shigella flexneri 2a str. 301
ccagccagguguug

SEQ ID NO: 3889309 - RNA, 14 nt, Shigella flexneri 2a str. 301
ccagccauccguca

SEQ ID NO: 3889310 - RNA, 21 nt, Shigella flexneri 2a str. 301
ccagccauuaaccagccacug

SEQ ID NO: 3889311 - RNA, 13 nt, Shigella flexneri 2a str. 301
ccagcccacaugc

SEQ ID NO: 3889312 - RNA, 16 nt, Shigella flexneri 2a str. 301
ccagccccagaauuca

SEQ ID NO: 3889313 - RNA, 20 nt, Shigella flexneri 2a str. 301
ccagccccagaauucacgca

SEQ ID NO: 3889314 - RNA, 21 nt, Shigella flexneri 2a str. 301
ccagcccgacgauaccgccgc

SEQ ID NO: 3889315 - RNA, 17 nt, Shigella flexneri 2a str. 301
ccagcccgaucggcugg

SEQ ID NO: 3889316 - RNA, 13 nt, Shigella flexneri 2a str. 301
ccagcccuuuuga

SEQ ID NO: 3889317 - RNA, 19 nt, Shigella flexneri 2a str. 301
ccagcccuuuugacgcgug

SEQ ID NO: 3889318 - RNA, 14 nt, Shigella flexneri 2a str. 301
ccagccgaacagcg

SEQ ID NO: 3889319 - RNA, 18 nt, Shigella flexneri 2a str. 301
ccagccgaccauugccag

SEQ ID NO: 3889320 - RNA, 19 nt, Shigella flexneri 2a str. 301
ccagccgccgcuaucggca

SEQ ID NO: 3889321 - RNA, 16 nt, Shigella flexneri 2a str. 301
ccagccgcgucugaau

SEQ ID NO: 3889322 - RNA, 19 nt, Shigella flexneri 2a str. 301
ccagccgcuaacuuccugc

SEQ ID NO: 3889323 - RNA, 22 nt, Shigella flexneri 2a str. 301
ccagccgcuaacuuccugcugg

SEQ ID NO: 3889324 - RNA, 15 nt, Shigella flexneri 2a str. 301
ccagccgugaauggu

SEQ ID NO: 3889325 - RNA, 16 nt, Shigella flexneri 2a str. 301
ccagccugcaaacgcu

SEQ ID NO: 3889326 - RNA, 20 nt, Shigella flexneri 2a str. 301
ccagccuguuccagacgcug

SEQ ID NO: 3889327 - RNA, 20 nt, Shigella flexneri 2a str. 301
ccagccuucuucauccagcg

SEQ ID NO: 3889328 - RNA, 21 nt, Shigella flexneri 2a str. 301
ccagccuucuucauccagcgc

SEQ ID NO: 3889329 - RNA, 24 nt, Shigella flexneri 2a str. 301
ccagccuugccagauguugucuca

SEQ ID NO: 3889330 - RNA, 20 nt, Shigella flexneri 2a str. 301
ccagcgaaccguugaggaug

SEQ ID NO: 3889331 - RNA, 22 nt, Shigella flexneri 2a str. 301
ccagcgaaccuuccaucgcauc

SEQ ID NO: 3889332 - RNA, 23 nt, Shigella flexneri 2a str. 301
ccagcgaaggaucaccccgaugg

SEQ ID NO: 3889333 - RNA, 13 nt, Shigella flexneri 2a str. 301
ccagcgacuccag

SEQ ID NO: 3889334 - RNA, 17 nt, Shigella flexneri 2a str. 301
ccagcgauaccggugca

SEQ ID NO: 3889335 - RNA, 22 nt, Shigella flexneri 2a str. 301
ccagcgaugacuguacagaucc

SEQ ID NO: 3889336 - RNA, 19 nt, Shigella flexneri 2a str. 301
ccagcgaugcccagugacc

SEQ ID NO: 3889337 - RNA, 17 nt, Shigella flexneri 2a str. 301
ccagcgauuuaucggca

SEQ ID NO: 3889338 - RNA, 19 nt, Shigella flexneri 2a str. 301
ccagcgcaauuggcacgcc

SEQ ID NO: 3889339 - RNA, 20 nt, Shigella flexneri 2a str. 301
ccagcgcagaagagcugggg

SEQ ID NO: 3889340 - RNA, 15 nt, Shigella flexneri 2a str. 301
ccagcgcagacacca

SEQ ID NO: 3889341 - RNA, 17 nt, Shigella flexneri 2a str. 301
ccagcgcagacaccaga

SEQ ID NO: 3889342 - RNA, 18 nt, Shigella flexneri 2a str. 301
ccagcgcaucaggcaauc

SEQ ID NO: 3889343 - RNA, 14 nt, Shigella flexneri 2a str. 301
ccagguggugcagg

SEQ ID NO: 3889344 - RNA, 16 nt, Shigella flexneri 2a str. 301
ccagguggugcaggcu

SEQ ID NO: 3889345 - RNA, 19 nt, Shigella flexneri 2a str. 301
ccagguucgauauccgcca

SEQ ID NO: 3889346 - RNA, 14 nt, Shigella flexneri 2a str. 301
ccagguuucuucca

SEQ ID NO: 3889347 - RNA, 22 nt, Shigella flexneri 2a str. 301
ccagguuuucuuucaccucuuc

SEQ ID NO: 3889348 - RNA, 18 nt, Shigella flexneri 2a str. 301
ccaguaaagcagcgaagc

SEQ ID NO: 3889349 - RNA, 23 nt, Shigella flexneri 2a str. 301
ccaguaacagaacgcauaacagc

SEQ ID NO: 3889350 - RNA, 19 nt, Shigella flexneri 2a str. 301
ccaguaaccuuucagaugu

SEQ ID NO: 3889351 - RNA, 23 nt, Shigella flexneri 2a str. 301
ccaguaagacaccccacagcucu

SEQ ID NO: 3889352 - RNA, 19 nt, Shigella flexneri 2a str. 301
ccaguaagcaguccagcgc

SEQ ID NO: 3889353 - RNA, 13 nt, Shigella flexneri 2a str. 301
ccaguaaggcugc

SEQ ID NO: 3889354 - RNA, 14 nt, Shigella flexneri 2a str. 301
ccaguaauccggcu

SEQ ID NO: 3889355 - RNA, 21 nt, Shigella flexneri 2a str. 301
ccaguaaucuggccaaugccu

SEQ ID NO: 3889356 - RNA, 14 nt, Shigella flexneri 2a str. 301
ccaguaaugcgccc

SEQ ID NO: 3889357 - RNA, 21 nt, Shigella flexneri 2a str. 301
ccaguaauucagccgcgcgcu

SEQ ID NO: 3889358 - RNA, 14 nt, Shigella flexneri 2a str. 301
ccaguacaugaagc

SEQ ID NO: 3889359 - RNA, 17 nt, Shigella flexneri 2a str. 301
ccaguacauugagaaua

SEQ ID NO: 3889360 - RNA, 18 nt, Shigella flexneri 2a str. 301
ccaguaccacccccagac

SEQ ID NO: 3889361 - RNA, 20 nt, Shigella flexneri 2a str. 301
ccaguaccacccccagacga

SEQ ID NO: 3889362 - RNA, 17 nt, Shigella flexneri 2a str. 301
ccaguaccagcagcgcc

SEQ ID NO: 3889363 - RNA, 17 nt, Shigella flexneri 2a str. 301
ccaguaccgccaccacc

SEQ ID NO: 3889364 - RNA, 24 nt, Shigella flexneri 2a str. 301
ccaguaccgccaccaccagacgca

SEQ ID NO: 3889365 - RNA, 18 nt, Shigella flexneri 2a str. 301
ccaguaccgccagugcag

SEQ ID NO: 3889366 - RNA, 19 nt, Shigella flexneri 2a str. 301
ccaguaccgccagugcagc

SEQ ID NO: 3889367 - RNA, 15 nt, Shigella flexneri 2a str. 301
ccaguaccgccgcca

SEQ ID NO: 3889368 - RNA, 16 nt, Shigella flexneri 2a str. 301
ccaguacgccuucacg

SEQ ID NO: 3889369 - RNA, 19 nt, Shigella flexneri 2a str. 301
ccaguacgcgcaaccccgc

SEQ ID NO: 3889370 - RNA, 13 nt, Shigella flexneri 2a str. 301
ccaguaguaacca

SEQ ID NO: 3889371 - RNA, 21 nt, Shigella flexneri 2a str. 301
ccaguaucuuauagaaagcaa

SEQ ID NO: 3889372 - RNA, 18 nt, Shigella flexneri 2a str. 301
ccaguaugaggcaaaccu

SEQ ID NO: 3889373 - RNA, 22 nt, Shigella flexneri 2a str. 301
ccaguauguaacuggguuuguc

SEQ ID NO: 3889374 - RNA, 15 nt, Shigella flexneri 2a str. 301
ccagucaaucaucca

SEQ ID NO: 3889375 - RNA, 12 nt, Shigella flexneri 2a str. 301
ccagucagguac

SEQ ID NO: 3889376 - RNA, 14 nt, Shigella flexneri 2a str. 301
ccagucauccggcu

SEQ ID NO: 3889377 - RNA, 21 nt, Shigella flexneri 2a str. 301
ccagucauccggcucguaauc

SEQ ID NO: 3889378 - RNA, 21 nt, Shigella flexneri 2a str. 301
ccagucauugagcuucucgau

SEQ ID NO: 3889379 - RNA, 12 nt, Shigella flexneri 2a str. 301
ccaguccaccca

SEQ ID NO: 3889380 - RNA, 15 nt, Shigella flexneri 2a str. 301
ccaguccagcugccg

SEQ ID NO: 3889381 - RNA, 14 nt, Shigella flexneri 2a str. 301
ccaguccaucggca

SEQ ID NO: 3889382 - RNA, 21 nt, Shigella flexneri 2a str. 301
ccagucccguacccagcaaga

SEQ ID NO: 3889383 - RNA, 20 nt, Shigella flexneri 2a str. 301
ccaguccgcgcuugccgccg

SEQ ID NO: 3889384 - RNA, 12 nt, Shigella flexneri 2a str. 301
ccaguccuccgg

SEQ ID NO: 3889385 - RNA, 16 nt, Shigella flexneri 2a str. 301
ccaguccugugacuca

SEQ ID NO: 3889386 - RNA, 13 nt, Shigella flexneri 2a str. 301
ccagucgccgacg

SEQ ID NO: 3889387 - RNA, 15 nt, Shigella flexneri 2a str. 301
ccagucgcugcugac

SEQ ID NO: 3889388 - RNA, 15 nt, Shigella flexneri 2a str. 301
ccagucgucauccca

SEQ ID NO: 3889389 - RNA, 16 nt, Shigella flexneri 2a str. 301
ccagucgucaucccag

SEQ ID NO: 3889390 - RNA, 15 nt, Shigella flexneri 2a str. 301
ccagucguucaacca

SEQ ID NO: 3889391 - RNA, 19 nt, Shigella flexneri 2a str. 301
ccagucugaccauaacccg

SEQ ID NO: 3889392 - RNA, 12 nt, Shigella flexneri 2a str. 301
ccagucugcugg

SEQ ID NO: 3889393 - RNA, 19 nt, Shigella flexneri 2a str. 301
ccagucuuccugcggcaga

SEQ ID NO: 3889394 - RNA, 17 nt, Shigella flexneri 2a str. 301
ccagugaauacugcgcg

SEQ ID NO: 3889395 - RNA, 23 nt, Shigella flexneri 2a str. 301
ccagugaaucgggaccagcauuc

SEQ ID NO: 3889396 - RNA, 13 nt, Shigella flexneri 2a str. 301
ccagugauuaacg

SEQ ID NO: 3889397 - RNA, 14 nt, Shigella flexneri 2a str. 301
ccagugauucagga

SEQ ID NO: 3889398 - RNA, 18 nt, Shigella flexneri 2a str. 301
ccagugauuuuugcugaa

SEQ ID NO: 3889399 - RNA, 15 nt, Shigella flexneri 2a str. 301
ccagugccaaagcca

SEQ ID NO: 3889400 - RNA, 15 nt, Shigella flexneri 2a str. 301
ccagugccagcacca

SEQ ID NO: 3889401 - RNA, 21 nt, Shigella flexneri 2a str. 301
ccagugcccgaccacuucaug

SEQ ID NO: 3889402 - RNA, 17 nt, Shigella flexneri 2a str. 301
ccagugccgcccaccac

SEQ ID NO: 3889403 - RNA, 19 nt, Shigella flexneri 2a str. 301
ccagugccgcccaccacuc

SEQ ID NO: 3889404 - RNA, 12 nt, Shigella flexneri 2a str. 301
ccagugccgccu

SEQ ID NO: 3889405 - RNA, 18 nt, Shigella flexneri 2a str. 301
ccagugccggaugauuca

SEQ ID NO: 3889406 - RNA, 19 nt, Shigella flexneri 2a str. 301
ccagugccggaugauucac

SEQ ID NO: 3889407 - RNA, 21 nt, Shigella flexneri 2a str. 301
ccagugccggaugauucacau

SEQ ID NO: 3889408 - RNA, 21 nt, Shigella flexneri 2a str. 301
ccagugcgccccagguaauuu

SEQ ID NO: 3889409 - RNA, 15 nt, Shigella flexneri 2a str. 301
ccagugcgguaacgu

SEQ ID NO: 3889410 - RNA, 17 nt, Shigella flexneri 2a str. 301
ccagugcguacccagcg

SEQ ID NO: 3889411 - RNA, 12 nt, Shigella flexneri 2a str. 301
ccagugcuccac

SEQ ID NO: 3889412 - RNA, 21 nt, Shigella flexneri 2a str. 301
ccagugcucccucggugccgc

SEQ ID NO: 3889413 - RNA, 12 nt, Shigella flexneri 2a str. 301
ccagugcuucaa

SEQ ID NO: 3889414 - RNA, 19 nt, Shigella flexneri 2a str. 301
ccaguggaugcgccauacc

SEQ ID NO: 3889415 - RNA, 15 nt, Shigella flexneri 2a str. 301
ccaguggcagcaauu

SEQ ID NO: 3889416 - RNA, 17 nt, Shigella flexneri 2a str. 301
ccaguguaaaacagcac

SEQ ID NO: 3889417 - RNA, 23 nt, Shigella flexneri 2a str. 301
ccaguguucuggcgacagcgaaa

SEQ ID NO: 3889418 - RNA, 18 nt, Shigella flexneri 2a str. 301
ccaguuaaccugcuccuc

SEQ ID NO: 3889419 - RNA, 23 nt, Shigella flexneri 2a str. 301
ccaguuacccagcggauaaagca

SEQ ID NO: 3889420 - RNA, 18 nt, Shigella flexneri 2a str. 301
ccaguuacugccaccauc

SEQ ID NO: 3889421 - RNA, 21 nt, Shigella flexneri 2a str. 301
ccaguucaacgcccgcuuuca

SEQ ID NO: 3889422 - RNA, 22 nt, Shigella flexneri 2a str. 301
ccaguucaacgcccgcuuucac

SEQ ID NO: 3889423 - RNA, 20 nt, Shigella flexneri 2a str. 301
ccaguucaacgcggcgcugc

SEQ ID NO: 3889424 - RNA, 12 nt, Shigella flexneri 2a str. 301
ccaguucacacc

SEQ ID NO: 3889425 - RNA, 17 nt, Shigella flexneri 2a str. 301
ccaguucacaccagcca

SEQ ID NO: 3889426 - RNA, 22 nt, Shigella flexneri 2a str. 301
ccaguucacgcgauuucucauc

SEQ ID NO: 3889427 - RNA, 16 nt, Shigella flexneri 2a str. 301
ccaguucccccugcca

SEQ ID NO: 3889428 - RNA, 12 nt, Shigella flexneri 2a str. 301
ccaguucgauuu

SEQ ID NO: 3889429 - RNA, 20 nt, Shigella flexneri 2a str. 301
ccaguucgauuucccagcga

SEQ ID NO: 3889430 - RNA, 16 nt, Shigella flexneri 2a str. 301
ccaguucuacaaucug

SEQ ID NO: 3889431 - RNA, 18 nt, Shigella flexneri 2a str. 301
ccaguucuacaaucugcc

SEQ ID NO: 3889432 - RNA, 13 nt, Shigella flexneri 2a str. 301
ccaguucuucuuc

SEQ ID NO: 3889433 - RNA, 16 nt, Shigella flexneri 2a str. 301
ccaguugauucgcgcg

SEQ ID NO: 3889434 - RNA, 17 nt, Shigella flexneri 2a str. 301
ccaguugcauaauuucu

SEQ ID NO: 3889435 - RNA, 12 nt, Shigella flexneri 2a str. 301
ccaguugcgccg

SEQ ID NO: 3889436 - RNA, 14 nt, Shigella flexneri 2a str. 301
ccaguugcgccguc

SEQ ID NO: 3889437 - RNA, 18 nt, Shigella flexneri 2a str. 301
ccaguugcuuauccagca

SEQ ID NO: 3889438 - RNA, 13 nt, Shigella flexneri 2a str. 301
ccaguuguugcug

SEQ ID NO: 3889439 - RNA, 19 nt, Shigella flexneri 2a str. 301
ccaguuguugcugaauuug

SEQ ID NO: 3889440 - RNA, 13 nt, Shigella flexneri 2a str. 301
ccaguuucacagg

SEQ ID NO: 3889441 - RNA, 22 nt, Shigella flexneri 2a str. 301
ccaguuucaugauauguuuuaa

SEQ ID NO: 3889442 - RNA, 19 nt, Shigella flexneri 2a str. 301
ccaguuucggacgcggcac

SEQ ID NO: 3889443 - RNA, 21 nt, Shigella flexneri 2a str. 301
ccaucgacgaaauggugugca

SEQ ID NO: 3889444 - RNA, 14 nt, Shigella flexneri 2a str. 301
ccaucgauaaucac

SEQ ID NO: 3889445 - RNA, 21 nt, Shigella flexneri 2a str. 301
ccaucgauuuugcaauaaugg

SEQ ID NO: 3889446 - RNA, 23 nt, Shigella flexneri 2a str. 301
ccaucgcaaacaguacaucuucc

SEQ ID NO: 3889447 - RNA, 19 nt, Shigella flexneri 2a str. 301
ccaucgcaccaaacgggca

SEQ ID NO: 3889448 - RNA, 13 nt, Shigella flexneri 2a str. 301
ccaucgccagcag

SEQ ID NO: 3889449 - RNA, 14 nt, Shigella flexneri 2a str. 301
ccaucgccagcagc

SEQ ID NO: 3889450 - RNA, 20 nt, Shigella flexneri 2a str. 301
ccaucgccagcagccauucc

SEQ ID NO: 3889451 - RNA, 19 nt, Shigella flexneri 2a str. 301
ccaucgcgguuaaucggca

SEQ ID NO: 3889452 - RNA, 20 nt, Shigella flexneri 2a str. 301
ccaucgcuuuuaccagcaua

SEQ ID NO: 3889453 - RNA, 15 nt, Shigella flexneri 2a str. 301
ccaucggcagcgcca

SEQ ID NO: 3889454 - RNA, 20 nt, Shigella flexneri 2a str. 301
ccaucggcauuaaucugcuc

SEQ ID NO: 3889455 - RNA, 19 nt, Shigella flexneri 2a str. 301
ccaucgggcuagacugaug

SEQ ID NO: 3889456 - RNA, 18 nt, Shigella flexneri 2a str. 301
ccaucguacaggcacaug

SEQ ID NO: 3889457 - RNA, 16 nt, Shigella flexneri 2a str. 301
ccaucgucacaccuuc

SEQ ID NO: 3889458 - RNA, 16 nt, Shigella flexneri 2a str. 301
ccaucguccagcagca

SEQ ID NO: 3889459 - RNA, 18 nt, Shigella flexneri 2a str. 301
ccaucguccgugaagaaa

SEQ ID NO: 3889460 - RNA, 18 nt, Shigella flexneri 2a str. 301
ccaucgucggguaguuaa

SEQ ID NO: 3889461 - RNA, 20 nt, Shigella flexneri 2a str. 301
ccaucguugaaagauaauca

SEQ ID NO: 3889462 - RNA, 20 nt, Shigella flexneri 2a str. 301
ccaucucaaaacguccggca

SEQ ID NO: 3889463 - RNA, 18 nt, Shigella flexneri 2a str. 301
ccaucuccgcauguuucg

SEQ ID NO: 3889464 - RNA, 21 nt, Shigella flexneri 2a str. 301
ccaucucugcaacgucuuccc

SEQ ID NO: 3889465 - RNA, 23 nt, Shigella flexneri 2a str. 301
ccaucugaugauauuuuucccug

SEQ ID NO: 3889466 - RNA, 15 nt, Shigella flexneri 2a str. 301
ccaucuggcugacgg

SEQ ID NO: 3889467 - RNA, 14 nt, Shigella flexneri 2a str. 301
ccaucuucaccgcc

SEQ ID NO: 3889468 - RNA, 13 nt, Shigella flexneri 2a str. 301
ccaucuuccagca

SEQ ID NO: 3889469 - RNA, 15 nt, Shigella flexneri 2a str. 301
ccaucuuccagcauc

SEQ ID NO: 3889470 - RNA, 13 nt, Shigella flexneri 2a str. 301
ccaucuucuucac

SEQ ID NO: 3889471 - RNA, 21 nt, Shigella flexneri 2a str. 301
ccaucuucuugcagcuuaauc

SEQ ID NO: 3889472 - RNA, 12 nt, Shigella flexneri 2a str. 301
ccaugaccgccg

SEQ ID NO: 3889473 - RNA, 13 nt, Shigella flexneri 2a str. 301
ccaugaccgccgc

SEQ ID NO: 3889474 - RNA, 20 nt, Shigella flexneri 2a str. 301
ccaugaccgccgcagcaacc

SEQ ID NO: 3889475 - RNA, 23 nt, Shigella flexneri 2a str. 301
ccaugaccugcaaauucaauaaa

SEQ ID NO: 3889476 - RNA, 23 nt, Shigella flexneri 2a str. 301
ccaugacuuucuggcacgaccug

SEQ ID NO: 3889477 - RNA, 17 nt, Shigella flexneri 2a str. 301
ccaugagaagcugaaau

SEQ ID NO: 3889478 - RNA, 20 nt, Shigella flexneri 2a str. 301
ccaugauaauuccgccgccc

SEQ ID NO: 3889479 - RNA, 16 nt, Shigella flexneri 2a str. 301
ccaugauaguguccau

SEQ ID NO: 3889480 - RNA, 21 nt, Shigella flexneri 2a str. 301
ccaugauauuggcaucgccag

SEQ ID NO: 3889481 - RNA, 16 nt, Shigella flexneri 2a str. 301
ccaugauccugcaaua

SEQ ID NO: 3889482 - RNA, 11 nt, Shigella flexneri 2a str. 301
ccaugauuucg

SEQ ID NO: 3889483 - RNA, 23 nt, Shigella flexneri 2a str. 301
ccaugauuucguagacugcagcg

SEQ ID NO: 3889484 - RNA, 17 nt, Shigella flexneri 2a str. 301
ccaugcaauuaccgcca

SEQ ID NO: 3889485 - RNA, 21 nt, Shigella flexneri 2a str. 301
ccaugcaauuaccgccaccag

SEQ ID NO: 3889486 - RNA, 17 nt, Shigella flexneri 2a str. 301
ccaugcaccaacccuaa

SEQ ID NO: 3889487 - RNA, 21 nt, Shigella flexneri 2a str. 301
ccaugcacgauauaccgugcu

SEQ ID NO: 3889488 - RNA, 18 nt, Shigella flexneri 2a str. 301
ccaugcauaaugcagcca

SEQ ID NO: 3889489 - RNA, 13 nt, Shigella flexneri 2a str. 301
ccaugccaucugc

SEQ ID NO: 3889490 - RNA, 23 nt, Shigella flexneri 2a str. 301
ccaugccgcccagaagcacugcc

SEQ ID NO: 3889491 - RNA, 20 nt, Shigella flexneri 2a str. 301
ccaugccggaugcgccagca

SEQ ID NO: 3889492 - RNA, 21 nt, Shigella flexneri 2a str. 301
ccaugccggaugcgccagcau

SEQ ID NO: 3889493 - RNA, 22 nt, Shigella flexneri 2a str. 301
ccaugcggauuuugcccugcug

SEQ ID NO: 3889494 - RNA, 17 nt, Shigella flexneri 2a str. 301
ccaugcggcgaggaauc

SEQ ID NO: 3889495 - RNA, 21 nt, Shigella flexneri 2a str. 301
ccaugcguugucgccauccag

SEQ ID NO: 3889496 - RNA, 19 nt, Shigella flexneri 2a str. 301
ccaugcguuuuaccgccuc

SEQ ID NO: 3889497 - RNA, 18 nt, Shigella flexneri 2a str. 301
ccaugcuaauagcugcgc

SEQ ID NO: 3889498 - RNA, 16 nt, Shigella flexneri 2a str. 301
ccaugcugagcuucuu

SEQ ID NO: 3889499 - RNA, 19 nt, Shigella flexneri 2a str. 301
ccaugcugucggcugccag

SEQ ID NO: 3889500 - RNA, 19 nt, Shigella flexneri 2a str. 301
ccauggacauacgcaccuu

SEQ ID NO: 3889501 - RNA, 18 nt, Shigella flexneri 2a str. 301
ccauggcucaccagcagc

SEQ ID NO: 3889502 - RNA, 20 nt, Shigella flexneri 2a str. 301
ccauggcucaccagcagcgg

SEQ ID NO: 3889503 - RNA, 21 nt, Shigella flexneri 2a str. 301
ccaugucgaaaccgacagccc

SEQ ID NO: 3889504 - RNA, 20 nt, Shigella flexneri 2a str. 301
ccaugucgguacagagcaau

SEQ ID NO: 3889505 - RNA, 13 nt, Shigella flexneri 2a str. 301
ccaugugcuggac

SEQ ID NO: 3889506 - RNA, 20 nt, Shigella flexneri 2a str. 301
ccauguuauuaguguguaua

SEQ ID NO: 3889507 - RNA, 19 nt, Shigella flexneri 2a str. 301
ccauguuuaccaucugcgc

SEQ ID NO: 3889508 - RNA, 13 nt, Shigella flexneri 2a str. 301
ccauuaaaagaau

SEQ ID NO: 3889509 - RNA, 12 nt, Shigella flexneri 2a str. 301
ccauuaaacacc

SEQ ID NO: 3889510 - RNA, 23 nt, Shigella flexneri 2a str. 301
ccauuaaacgcaguaagcgccag

SEQ ID NO: 3889511 - RNA, 15 nt, Shigella flexneri 2a str. 301
ccauuaacauuaacu

SEQ ID NO: 3889512 - RNA, 16 nt, Shigella flexneri 2a str. 301
ccauuaaccagccacu

SEQ ID NO: 3889513 - RNA, 14 nt, Shigella flexneri 2a str. 301
ccauuaccgccacu

SEQ ID NO: 3889514 - RNA, 20 nt, Shigella flexneri 2a str. 301
ccauuagcaaauuauccccc

SEQ ID NO: 3889515 - RNA, 21 nt, Shigella flexneri 2a str. 301
ccauuagcaaauuauccccca

SEQ ID NO: 3889516 - RNA, 12 nt, Shigella flexneri 2a str. 301
ccauuauuucca

SEQ ID NO: 3889517 - RNA, 13 nt, Shigella flexneri 2a str. 301
ccauucaaucuuc

SEQ ID NO: 3889518 - RNA, 22 nt, Shigella flexneri 2a str. 301
ccauucacacuccagucccagu

SEQ ID NO: 3889519 - RNA, 17 nt, Shigella flexneri 2a str. 301
ccauucaccauuuuuua

SEQ ID NO: 3889520 - RNA, 11 nt, Shigella flexneri 2a str. 301
ccauucaggcu

SEQ ID NO: 3889521 - RNA, 19 nt, Shigella flexneri 2a str. 301
ccauuccggccaucgccug

SEQ ID NO: 3889522 - RNA, 19 nt, Shigella flexneri 2a str. 301
ccauugaagaauuuuugcg

SEQ ID NO: 3889523 - RNA, 23 nt, Shigella flexneri 2a str. 301
ccauugacagaauauacggaaug

SEQ ID NO: 3889524 - RNA, 21 nt, Shigella flexneri 2a str. 301
ccauugacgcaucgcccgguu

SEQ ID NO: 3889525 - RNA, 16 nt, Shigella flexneri 2a str. 301
ccauugacguuccuuu

SEQ ID NO: 3889526 - RNA, 18 nt, Shigella flexneri 2a str. 301
ccauugacguuccuuucu

SEQ ID NO: 3889527 - RNA, 22 nt, Shigella flexneri 2a str. 301
ccauugagaaagcccuggcgca

SEQ ID NO: 3889528 - RNA, 23 nt, Shigella flexneri 2a str. 301
ccauugagcuggucugaaucaac

SEQ ID NO: 3889529 - RNA, 23 nt, Shigella flexneri 2a str. 301
ccauugcaucgaggaaaaccaga

SEQ ID NO: 3889530 - RNA, 23 nt, Shigella flexneri 2a str. 301
ccauugcccgaugcgcaaacuua

SEQ ID NO: 3889531 - RNA, 18 nt, Shigella flexneri 2a str. 301
ccauugccgccucugccg

SEQ ID NO: 3889532 - RNA, 12 nt, Shigella flexneri 2a str. 301
ccauugcucugg

SEQ ID NO: 3889533 - RNA, 21 nt, Shigella flexneri 2a str. 301
ccauugcucuggcaaacucgc

SEQ ID NO: 3889534 - RNA, 19 nt, Shigella flexneri 2a str. 301
ccauuggcggcguccugga

SEQ ID NO: 3889535 - RNA, 15 nt, Shigella flexneri 2a str. 301
ccauugggcuguuau

SEQ ID NO: 3889536 - RNA, 22 nt, Shigella flexneri 2a str. 301
ccauugggcuguuaucccagca

SEQ ID NO: 3889537 - RNA, 16 nt, Shigella flexneri 2a str. 301
ccauuguaggccugau

SEQ ID NO: 3889538 - RNA, 14 nt, Shigella flexneri 2a str. 301
ccauuguuagcaac

SEQ ID NO: 3889539 - RNA, 18 nt, Shigella flexneri 2a str. 301
ccauuguuagcaacgaca

SEQ ID NO: 3889540 - RNA, 22 nt, Shigella flexneri 2a str. 301
ccauuuauccagcggcagccau

SEQ ID NO: 3889541 - RNA, 14 nt, Shigella flexneri 2a str. 301
ccauuuccagcgcu

SEQ ID NO: 3889542 - RNA, 15 nt, Shigella flexneri 2a str. 301
cccagugcagugccu

SEQ ID NO: 3889543 - RNA, 16 nt, Shigella flexneri 2a str. 301
cccagugccagcacca

SEQ ID NO: 3889544 - RNA, 19 nt, Shigella flexneri 2a str. 301
cccagugccguuauucagg

SEQ ID NO: 3889545 - RNA, 20 nt, Shigella flexneri 2a str. 301
cccagugguuucgccagcac

SEQ ID NO: 3889546 - RNA, 22 nt, Shigella flexneri 2a str. 301
cccagugguuucgccagcaccg

SEQ ID NO: 3889547 - RNA, 23 nt, Shigella flexneri 2a str. 301
cccaguuauuaaaacgauagugg

SEQ ID NO: 3889548 - RNA, 14 nt, Shigella flexneri 2a str. 301
cccaguucagcggc

SEQ ID NO: 3889549 - RNA, 23 nt, Shigella flexneri 2a str. 301
cccaguugugggugcccacaaac

SEQ ID NO: 3889550 - RNA, 11 nt, Shigella flexneri 2a str. 301
cccaguuucau

SEQ ID NO: 3889551 - RNA, 21 nt, Shigella flexneri 2a str. 301
cccaguuucaugauauguuuu

SEQ ID NO: 3889552 - RNA, 23 nt, Shigella flexneri 2a str. 301
cccaguuucggcaucagcagaau

SEQ ID NO: 3889553 - RNA, 16 nt, Shigella flexneri 2a str. 301
cccauaaauuccggcu

SEQ ID NO: 3889554 - RNA, 23 nt, Shigella flexneri 2a str. 301
cccauaacggagcuaccggauuu

SEQ ID NO: 3889555 - RNA, 19 nt, Shigella flexneri 2a str. 301
cccauacuugcaagaucgc

SEQ ID NO: 3889556 - RNA, 22 nt, Shigella flexneri 2a str. 301
cccauagauaccuucuugacau

SEQ ID NO: 3889557 - RNA, 20 nt, Shigella flexneri 2a str. 301
cccauauguucccgcgccuc

SEQ ID NO: 3889558 - RNA, 23 nt, Shigella flexneri 2a str. 301
cccauauuuaaucaguucuacca

SEQ ID NO: 3889559 - RNA, 14 nt, Shigella flexneri 2a str. 301
cccaucaacgccau

SEQ ID NO: 3889560 - RNA, 17 nt, Shigella flexneri 2a str. 301
cccaucacaauggcaca

SEQ ID NO: 3889561 - RNA, 23 nt, Shigella flexneri 2a str. 301
cccaucacaauggcacaaauggc

SEQ ID NO: 3889562 - RNA, 16 nt, Shigella flexneri 2a str. 301
cccaucaccgcgaggc

SEQ ID NO: 3889563 - RNA, 11 nt, Shigella flexneri 2a str. 301
cccaucacuau

SEQ ID NO: 3889564 - RNA, 13 nt, Shigella flexneri 2a str. 301
cccaucaguagca

SEQ ID NO: 3889565 - RNA, 23 nt, Shigella flexneri 2a str. 301
cccaucaucuggcugugauccau

SEQ ID NO: 3889566 - RNA, 11 nt, Shigella flexneri 2a str. 301
cccauccacgc

SEQ ID NO: 3889567 - RNA, 23 nt, Shigella flexneri 2a str. 301
cccauccggcgaauuaccagcca

SEQ ID NO: 3889568 - RNA, 17 nt, Shigella flexneri 2a str. 301
cccaucgcguuugcgcu

SEQ ID NO: 3889569 - RNA, 18 nt, Shigella flexneri 2a str. 301
cccaugaaauaaaaauaa

SEQ ID NO: 3889570 - RNA, 14 nt, Shigella flexneri 2a str. 301
cccaugacuuugau

SEQ ID NO: 3889571 - RNA, 21 nt, Shigella flexneri 2a str. 301
cccaugcacucgaccacgccc

SEQ ID NO: 3889572 - RNA, 22 nt, Shigella flexneri 2a str. 301
cccaugccggaugcgccagcau

SEQ ID NO: 3889573 - RNA, 15 nt, Shigella flexneri 2a str. 301
cccauggcguagccg

SEQ ID NO: 3889574 - RNA, 17 nt, Shigella flexneri 2a str. 301
cccauuagacuauuuuu

SEQ ID NO: 3889575 - RNA, 15 nt, Shigella flexneri 2a str. 301
cccauuccucaugga

SEQ ID NO: 3889576 - RNA, 15 nt, Shigella flexneri 2a str. 301
cccauuucuccagca

SEQ ID NO: 3889577 - RNA, 14 nt, Shigella flexneri 2a str. 301
cccauuuuauuuuc

SEQ ID NO: 3889578 - RNA, 19 nt, Shigella flexneri 2a str. 301
ccccaaaacguaaccaugu

SEQ ID NO: 3889579 - RNA, 21 nt, Shigella flexneri 2a str. 301
ccccaaaacguaaccaugugu

SEQ ID NO: 3889580 - RNA, 21 nt, Shigella flexneri 2a str. 301
ccccaaggcgaggggaccgcc

SEQ ID NO: 3889581 - RNA, 15 nt, Shigella flexneri 2a str. 301
ccccaauccacgcgg

SEQ ID NO: 3889582 - RNA, 11 nt, Shigella flexneri 2a str. 301
ccccaaugacc

SEQ ID NO: 3889583 - RNA, 15 nt, Shigella flexneri 2a str. 301
ccccaauguagccgc

SEQ ID NO: 3889584 - RNA, 13 nt, Shigella flexneri 2a str. 301
ccccaauguucgu

SEQ ID NO: 3889585 - RNA, 17 nt, Shigella flexneri 2a str. 301
ccccacaaacccgccag

SEQ ID NO: 3889586 - RNA, 20 nt, Shigella flexneri 2a str. 301
ccccacaaucagccagaaca

SEQ ID NO: 3889587 - RNA, 19 nt, Shigella flexneri 2a str. 301
ccccacagacccagguaga

SEQ ID NO: 3889588 - RNA, 12 nt, Shigella flexneri 2a str. 301
ccccacagcucu

SEQ ID NO: 3889589 - RNA, 21 nt, Shigella flexneri 2a str. 301
ccccacagcucugcugucacc

SEQ ID NO: 3889590 - RNA, 18 nt, Shigella flexneri 2a str. 301
ccccacagggugagcaga

SEQ ID NO: 3889591 - RNA, 14 nt, Shigella flexneri 2a str. 301
ccccacugcauggc

SEQ ID NO: 3889592 - RNA, 22 nt, Shigella flexneri 2a str. 301
ccccagaauucacgcacuuccg

SEQ ID NO: 3889593 - RNA, 22 nt, Shigella flexneri 2a str. 301
ccccagaucccauaaccaacaa

SEQ ID NO: 3889594 - RNA, 16 nt, Shigella flexneri 2a str. 301
ccccagauugccgaua

SEQ ID NO: 3889595 - RNA, 12 nt, Shigella flexneri 2a str. 301
ccccagcuuuug

SEQ ID NO: 3889596 - RNA, 20 nt, Shigella flexneri 2a str. 301
ccccagggaacauuucuuau

SEQ ID NO: 3889597 - RNA, 19 nt, Shigella flexneri 2a str. 301
ccccaggguuucuccguca

SEQ ID NO: 3889598 - RNA, 19 nt, Shigella flexneri 2a str. 301
ccccaggguuuugcccagc

SEQ ID NO: 3889599 - RNA, 14 nt, Shigella flexneri 2a str. 301
ccccagguuccccc

SEQ ID NO: 3889600 - RNA, 22 nt, Shigella flexneri 2a str. 301
ccccaguaaauggugauaucac

SEQ ID NO: 3889601 - RNA, 17 nt, Shigella flexneri 2a str. 301
ccccagucuuccugcgg

SEQ ID NO: 3889602 - RNA, 17 nt, Shigella flexneri 2a str. 301
ccccagugguuucgcca

SEQ ID NO: 3889603 - RNA, 21 nt, Shigella flexneri 2a str. 301
ccccagugguuucgccagcac

SEQ ID NO: 3889604 - RNA, 18 nt, Shigella flexneri 2a str. 301
ccccaucugcuuuuaacc

SEQ ID NO: 3889605 - RNA, 12 nt, Shigella flexneri 2a str. 301
cccccacagcuc

SEQ ID NO: 3889606 - RNA, 19 nt, Shigella flexneri 2a str. 301
cccccacuaagcaccaaau

SEQ ID NO: 3889607 - RNA, 20 nt, Shigella flexneri 2a str. 301
cccccagacgacggcugcca

SEQ ID NO: 3889608 - RNA, 15 nt, Shigella flexneri 2a str. 301
cccccagcagcgccg

SEQ ID NO: 3889609 - RNA, 14 nt, Shigella flexneri 2a str. 301
cccccaguaaauga

SEQ ID NO: 3889610 - RNA, 18 nt, Shigella flexneri 2a str. 301
cccccgcucuuccaggca

SEQ ID NO: 3889611 - RNA, 23 nt, Shigella flexneri 2a str. 301
cccccgucaccggcacaaagcug

SEQ ID NO: 3889612 - RNA, 20 nt, Shigella flexneri 2a str. 301
cccccguuuuguugucaggu

SEQ ID NO: 3889613 - RNA, 17 nt, Shigella flexneri 2a str. 301
cccccugaagcaguuuc

SEQ ID NO: 3889614 - RNA, 13 nt, Shigella flexneri 2a str. 301
cccccuuccugcu

SEQ ID NO: 3889615 - RNA, 21 nt, Shigella flexneri 2a str. 301
cccccuuugaccagccaguca

SEQ ID NO: 3889616 - RNA, 21 nt, Shigella flexneri 2a str. 301
ccccgagaaaaauagcauuaa

SEQ ID NO: 3889617 - RNA, 12 nt, Shigella flexneri 2a str. 301
ccccgccagcag

SEQ ID NO: 3889618 - RNA, 22 nt, Shigella flexneri 2a str. 301
ccccgcgcaacgcuuucccuga

SEQ ID NO: 3889619 - RNA, 22 nt, Shigella flexneri 2a str. 301
ccccgcgcucacaccacagcag

SEQ ID NO: 3889620 - RNA, 16 nt, Shigella flexneri 2a str. 301
ccccggcaaaaccauc

SEQ ID NO: 3889621 - RNA, 18 nt, Shigella flexneri 2a str. 301
ccccggcagugcuuucau

SEQ ID NO: 3889622 - RNA, 22 nt, Shigella flexneri 2a str. 301
ccccggcggccggaugacagac

SEQ ID NO: 3889623 - RNA, 18 nt, Shigella flexneri 2a str. 301
ccccgggcggccucuuca

SEQ ID NO: 3889624 - RNA, 14 nt, Shigella flexneri 2a str. 301
ccccggguuuccug

SEQ ID NO: 3889625 - RNA, 18 nt, Shigella flexneri 2a str. 301
ccccggucagcagcacca

SEQ ID NO: 3889626 - RNA, 22 nt, Shigella flexneri 2a str. 301
ccccgguuuuucuggcaccugu

SEQ ID NO: 3889627 - RNA, 12 nt, Shigella flexneri 2a str. 301
ccccgucaccac

SEQ ID NO: 3889628 - RNA, 17 nt, Shigella flexneri 2a str. 301
ccccgucagcaaaauac

SEQ ID NO: 3889629 - RNA, 15 nt, Shigella flexneri 2a str. 301
ccccuccacauucag

SEQ ID NO: 3889630 - RNA, 12 nt, Shigella flexneri 2a str. 301
ccccuccagcga

SEQ ID NO: 3889631 - RNA, 14 nt, Shigella flexneri 2a str. 301
ccccucgcaccaaa

SEQ ID NO: 3889632 - RNA, 19 nt, Shigella flexneri 2a str. 301
ccccugacgcuuaucuucu

SEQ ID NO: 3889633 - RNA, 21 nt, Shigella flexneri 2a str. 301
ccccugagcguuacccgcagc

SEQ ID NO: 3889634 - RNA, 20 nt, Shigella flexneri 2a str. 301
ccccugauaauggcguauuu

SEQ ID NO: 3889635 - RNA, 11 nt, Shigella flexneri 2a str. 301
ccccugcgguu

SEQ ID NO: 3889636 - RNA, 12 nt, Shigella flexneri 2a str. 301
ccccuguugcaa

SEQ ID NO: 3889637 - RNA, 13 nt, Shigella flexneri 2a str. 301
ccccuuccugcug

SEQ ID NO: 3889638 - RNA, 23 nt, Shigella flexneri 2a str. 301
ccccuucugccgcaauucgcccu

SEQ ID NO: 3889639 - RNA, 12 nt, Shigella flexneri 2a str. 301
ccccuuuaaaua

SEQ ID NO: 3889640 - RNA, 21 nt, Shigella flexneri 2a str. 301
ccccuuucuuauuuuucugca

SEQ ID NO: 3889641 - RNA, 23 nt, Shigella flexneri 2a str. 301
cccgaacgcgcacaggcgcuggg

SEQ ID NO: 3889642 - RNA, 17 nt, Shigella flexneri 2a str. 301
cccgugagucuccuuua

SEQ ID NO: 3889643 - RNA, 14 nt, Shigella flexneri 2a str. 301
cccgugaugcaacu

SEQ ID NO: 3889644 - RNA, 21 nt, Shigella flexneri 2a str. 301
cccgugcuguuaauaucuuuc

SEQ ID NO: 3889645 - RNA, 23 nt, Shigella flexneri 2a str. 301
cccguggcgagcgauaacccagc

SEQ ID NO: 3889646 - RNA, 16 nt, Shigella flexneri 2a str. 301
cccgugggcaggccug

SEQ ID NO: 3889647 - RNA, 16 nt, Shigella flexneri 2a str. 301
cccguuaaccacuuca

SEQ ID NO: 3889648 - RNA, 23 nt, Shigella flexneri 2a str. 301
cccguuccaccgcguuuuccagu

SEQ ID NO: 3889649 - RNA, 16 nt, Shigella flexneri 2a str. 301
cccguuuuccgggcaa

SEQ ID NO: 3889650 - RNA, 13 nt, Shigella flexneri 2a str. 301
cccguuuucucca

SEQ ID NO: 3889651 - RNA, 19 nt, Shigella flexneri 2a str. 301
cccguuuucuccagcgccg

SEQ ID NO: 3889652 - RNA, 21 nt, Shigella flexneri 2a str. 301
cccguuuucuccagcgccgcc

SEQ ID NO: 3889653 - RNA, 14 nt, Shigella flexneri 2a str. 301
cccuaacaucaucc

SEQ ID NO: 3889654 - RNA, 18 nt, Shigella flexneri 2a str. 301
cccuaacccucuccccaa

SEQ ID NO: 3889655 - RNA, 15 nt, Shigella flexneri 2a str. 301
cccuaggcauagaaa

SEQ ID NO: 3889656 - RNA, 11 nt, Shigella flexneri 2a str. 301
cccucaaacaa

SEQ ID NO: 3889657 - RNA, 15 nt, Shigella flexneri 2a str. 301
cccucaauaauaauc

SEQ ID NO: 3889658 - RNA, 15 nt, Shigella flexneri 2a str. 301
cccucauaauuuccc

SEQ ID NO: 3889659 - RNA, 23 nt, Shigella flexneri 2a str. 301
cccucgaccaaaugaaacagggg

SEQ ID NO: 3889660 - RNA, 13 nt, Shigella flexneri 2a str. 301
cccucgcaccaaa

SEQ ID NO: 3889661 - RNA, 16 nt, Shigella flexneri 2a str. 301
cccucgccgcuucccu

SEQ ID NO: 3889662 - RNA, 16 nt, Shigella flexneri 2a str. 301
cccucugauuggcugu

SEQ ID NO: 3889663 - RNA, 21 nt, Shigella flexneri 2a str. 301
cccucugcggcucucagccgc

SEQ ID NO: 3889664 - RNA, 14 nt, Shigella flexneri 2a str. 301
cccucuucagccgc

SEQ ID NO: 3889665 - RNA, 20 nt, Shigella flexneri 2a str. 301
cccugaaucaaucagagcca

SEQ ID NO: 3889666 - RNA, 23 nt, Shigella flexneri 2a str. 301
cccugaaucaaucagagccaucc

SEQ ID NO: 3889667 - RNA, 15 nt, Shigella flexneri 2a str. 301
cccugacgaccaccc

SEQ ID NO: 3889668 - RNA, 17 nt, Shigella flexneri 2a str. 301
cccugagacaguuauua

SEQ ID NO: 3889669 - RNA, 17 nt, Shigella flexneri 2a str. 301
cccugauaaaucaccug

SEQ ID NO: 3889670 - RNA, 16 nt, Shigella flexneri 2a str. 301
cccugaucggccauga

SEQ ID NO: 3889671 - RNA, 21 nt, Shigella flexneri 2a str. 301
cccugauuaacgacacucucu

SEQ ID NO: 3889672 - RNA, 14 nt, Shigella flexneri 2a str. 301
cccugcaaacgggg

SEQ ID NO: 3889673 - RNA, 16 nt, Shigella flexneri 2a str. 301
cccugcaauccagggg

SEQ ID NO: 3889674 - RNA, 14 nt, Shigella flexneri 2a str. 301
cccugcaauuauua

SEQ ID NO: 3889675 - RNA, 19 nt, Shigella flexneri 2a str. 301
cccugcaccggugcaucca

SEQ ID NO: 3889676 - RNA, 19 nt, Shigella flexneri 2a str. 301
cccugcacuuaacaggauc

SEQ ID NO: 3889677 - RNA, 20 nt, Shigella flexneri 2a str. 301
cccugcacuuaacaggaucu

SEQ ID NO: 3889678 - RNA, 22 nt, Shigella flexneri 2a str. 301
cccugcacuuaacaggaucugg

SEQ ID NO: 3889679 - RNA, 23 nt, Shigella flexneri 2a str. 301
cccugcauauaaucgauccccaa

SEQ ID NO: 3889680 - RNA, 14 nt, Shigella flexneri 2a str. 301
cccugccaguccug

SEQ ID NO: 3889681 - RNA, 18 nt, Shigella flexneri 2a str. 301
cccugcccguugccagga

SEQ ID NO: 3889682 - RNA, 14 nt, Shigella flexneri 2a str. 301
cccugccuccauga

SEQ ID NO: 3889683 - RNA, 23 nt, Shigella flexneri 2a str. 301
cccugcgauggugaagucauuga

SEQ ID NO: 3889684 - RNA, 13 nt, Shigella flexneri 2a str. 301
cccugcggaaaaa

SEQ ID NO: 3889685 - RNA, 19 nt, Shigella flexneri 2a str. 301
cccugcggcgaugaccgcc

SEQ ID NO: 3889686 - RNA, 14 nt, Shigella flexneri 2a str. 301
cccugcggcugacc

SEQ ID NO: 3889687 - RNA, 18 nt, Shigella flexneri 2a str. 301
cccugcggcugaccacca

SEQ ID NO: 3889688 - RNA, 19 nt, Shigella flexneri 2a str. 301
cccugcggcugaccaccac

SEQ ID NO: 3889689 - RNA, 17 nt, Shigella flexneri 2a str. 301
cccugcgguuucaacga

SEQ ID NO: 3889690 - RNA, 22 nt, Shigella flexneri 2a str. 301
cccugcuguuuuuucaggcccu

SEQ ID NO: 3889691 - RNA, 15 nt, Shigella flexneri 2a str. 301
cccugcuuugcaagc

SEQ ID NO: 3889692 - RNA, 15 nt, Shigella flexneri 2a str. 301
cccuggaugcaguca

SEQ ID NO: 3889693 - RNA, 19 nt, Shigella flexneri 2a str. 301
cccuggcaacccgggcucc

SEQ ID NO: 3889694 - RNA, 18 nt, Shigella flexneri 2a str. 301
cccuggcaauagcgcacg

SEQ ID NO: 3889695 - RNA, 16 nt, Shigella flexneri 2a str. 301
cccuggcucugcacua

SEQ ID NO: 3889696 - RNA, 14 nt, Shigella flexneri 2a str. 301
cccugggcaccgac

SEQ ID NO: 3889697 - RNA, 23 nt, Shigella flexneri 2a str. 301
cccuggggagugaccuuaccacc

SEQ ID NO: 3889698 - RNA, 17 nt, Shigella flexneri 2a str. 301
cccuggucaguuucagc

SEQ ID NO: 3889699 - RNA, 15 nt, Shigella flexneri 2a str. 301
cccuguaauugccug

SEQ ID NO: 3889700 - RNA, 16 nt, Shigella flexneri 2a str. 301
cccuguaauugccuga

SEQ ID NO: 3889701 - RNA, 18 nt, Shigella flexneri 2a str. 301
cccugugcgcccuguucu

SEQ ID NO: 3889702 - RNA, 19 nt, Shigella flexneri 2a str. 301
cccugugcgcccuguucug

SEQ ID NO: 3889703 - RNA, 21 nt, Shigella flexneri 2a str. 301
cccuguggaacgugcugcauu

SEQ ID NO: 3889704 - RNA, 22 nt, Shigella flexneri 2a str. 301
cccuguuugguugccagccaca

SEQ ID NO: 3889705 - RNA, 23 nt, Shigella flexneri 2a str. 301
cccuguuugguugccagccacac

SEQ ID NO: 3889706 - RNA, 15 nt, Shigella flexneri 2a str. 301
cccuuacccuuacuc

SEQ ID NO: 3889707 - RNA, 12 nt, Shigella flexneri 2a str. 301
cccuuaguaacg

SEQ ID NO: 3889708 - RNA, 16 nt, Shigella flexneri 2a str. 301
cccuuauugcuaauga

SEQ ID NO: 3889709 - RNA, 14 nt, Shigella flexneri 2a str. 301
cccuucaucacgca

SEQ ID NO: 3889710 - RNA, 20 nt, Shigella flexneri 2a str. 301
cccuucaucacgcagcguca

SEQ ID NO: 3889711 - RNA, 20 nt, Shigella flexneri 2a str. 301
cccuuccagauucaguuuca

SEQ ID NO: 3889712 - RNA, 12 nt, Shigella flexneri 2a str. 301
cccuuccagcuu

SEQ ID NO: 3889713 - RNA, 23 nt, Shigella flexneri 2a str. 301
cccuucccgggucgcgacugcca

SEQ ID NO: 3889714 - RNA, 23 nt, Shigella flexneri 2a str. 301
cccuuccuugcuaagcccucuca

SEQ ID NO: 3889715 - RNA, 18 nt, Shigella flexneri 2a str. 301
cccuucgguagcagcuuu

SEQ ID NO: 3889716 - RNA, 14 nt, Shigella flexneri 2a str. 301
cccuucucaauccc

SEQ ID NO: 3889717 - RNA, 24 nt, Shigella flexneri 2a str. 301
cccuucucaaucccuuucucuuca

SEQ ID NO: 3889718 - RNA, 16 nt, Shigella flexneri 2a str. 301
cccuucucgcucuugu

SEQ ID NO: 3889719 - RNA, 10 nt, Shigella flexneri 2a str. 301
cccuucuucc

SEQ ID NO: 3889720 - RNA, 19 nt, Shigella flexneri 2a str. 301
cccuucuucuacugcgcgc

SEQ ID NO: 3889721 - RNA, 19 nt, Shigella flexneri 2a str. 301
cccuucuuuugucgugccc

SEQ ID NO: 3889722 - RNA, 13 nt, Shigella flexneri 2a str. 301
cccuugcaggcga

SEQ ID NO: 3889723 - RNA, 15 nt, Shigella flexneri 2a str. 301
cccuugccgaugcgg

SEQ ID NO: 3889724 - RNA, 15 nt, Shigella flexneri 2a str. 301
cccuugucgcagcau

SEQ ID NO: 3889725 - RNA, 19 nt, Shigella flexneri 2a str. 301
cccuuuaauuauccccuca

SEQ ID NO: 3889726 - RNA, 13 nt, Shigella flexneri 2a str. 301
cccuuuauuuucu

SEQ ID NO: 3889727 - RNA, 15 nt, Shigella flexneri 2a str. 301
cccuuuccugacuca

SEQ ID NO: 3889728 - RNA, 12 nt, Shigella flexneri 2a str. 301
cccuuuccuucu

SEQ ID NO: 3889729 - RNA, 17 nt, Shigella flexneri 2a str. 301
cccuuucucuucaaacc

SEQ ID NO: 3889730 - RNA, 15 nt, Shigella flexneri 2a str. 301
cccuuuuuucaggug

SEQ ID NO: 3889731 - RNA, 17 nt, Shigella flexneri 2a str. 301
ccgaaaaaagucauuac

SEQ ID NO: 3889732 - RNA, 14 nt, Shigella flexneri 2a str. 301
ccgaaaaagagcca

SEQ ID NO: 3889733 - RNA, 20 nt, Shigella flexneri 2a str. 301
ccgaaaucgccaaccagacg

SEQ ID NO: 3889734 - RNA, 14 nt, Shigella flexneri 2a str. 301
ccgaacagaucacg

SEQ ID NO: 3889735 - RNA, 19 nt, Shigella flexneri 2a str. 301
ccgaacagcgccagacaaa

SEQ ID NO: 3889736 - RNA, 23 nt, Shigella flexneri 2a str. 301
ccgaacagcgccagacaaaccac

SEQ ID NO: 3889737 - RNA, 16 nt, Shigella flexneri 2a str. 301
ccgaaccagugcucca

SEQ ID NO: 3889738 - RNA, 19 nt, Shigella flexneri 2a str. 301
ccgaaccagugcuccaccu

SEQ ID NO: 3889739 - RNA, 14 nt, Shigella flexneri 2a str. 301
ccgaaccgggcgcg

SEQ ID NO: 3889740 - RNA, 19 nt, Shigella flexneri 2a str. 301
ccgaagaguaaccaaacgu

SEQ ID NO: 3889741 - RNA, 13 nt, Shigella flexneri 2a str. 301
ccgaagcagcuac

SEQ ID NO: 3889742 - RNA, 21 nt, Shigella flexneri 2a str. 301
ccgcgaucgccugcagggcuu

SEQ ID NO: 3889743 - RNA, 15 nt, Shigella flexneri 2a str. 301
ccgcgaucuuccacg

SEQ ID NO: 3889744 - RNA, 13 nt, Shigella flexneri 2a str. 301
ccgcgcaaaccac

SEQ ID NO: 3889745 - RNA, 21 nt, Shigella flexneri 2a str. 301
ccgcgcaaucgcccagcgcgu

SEQ ID NO: 3889746 - RNA, 16 nt, Shigella flexneri 2a str. 301
ccgcgcaauggcuggc

SEQ ID NO: 3889747 - RNA, 16 nt, Shigella flexneri 2a str. 301
ccgcgcaggaugcaga

SEQ ID NO: 3889748 - RNA, 21 nt, Shigella flexneri 2a str. 301
ccgcgcagggacacucgcuga

SEQ ID NO: 3889749 - RNA, 21 nt, Shigella flexneri 2a str. 301
ccgcgcaguaccacuucaucc

SEQ ID NO: 3889750 - RNA, 12 nt, Shigella flexneri 2a str. 301
ccgcgcaguucg

SEQ ID NO: 3889751 - RNA, 16 nt, Shigella flexneri 2a str. 301
ccgcgccacgcggagc

SEQ ID NO: 3889752 - RNA, 12 nt, Shigella flexneri 2a str. 301
ccgcgccagcgg

SEQ ID NO: 3889753 - RNA, 13 nt, Shigella flexneri 2a str. 301
ccgcgccauaguu

SEQ ID NO: 3889754 - RNA, 20 nt, Shigella flexneri 2a str. 301
ccgcgcccgugcaucuccug

SEQ ID NO: 3889755 - RNA, 22 nt, Shigella flexneri 2a str. 301
ccgcgccgugcaacugcggcgc

SEQ ID NO: 3889756 - RNA, 23 nt, Shigella flexneri 2a str. 301
ccgcgccugaccauuaucaaaca

SEQ ID NO: 3889757 - RNA, 20 nt, Shigella flexneri 2a str. 301
ccgcgccuucgugcggcugc

SEQ ID NO: 3889758 - RNA, 16 nt, Shigella flexneri 2a str. 301
ccgcgcgccaccauuc

SEQ ID NO: 3889759 - RNA, 20 nt, Shigella flexneri 2a str. 301
ccgcgcggguaauugcucca

SEQ ID NO: 3889760 - RNA, 23 nt, Shigella flexneri 2a str. 301
ccgcgcggguggugcguaccagg

SEQ ID NO: 3889761 - RNA, 23 nt, Shigella flexneri 2a str. 301
ccgcgcguuuuucuucagccccu

SEQ ID NO: 3889762 - RNA, 19 nt, Shigella flexneri 2a str. 301
ccgcgcuaucagcauuguu

SEQ ID NO: 3889763 - RNA, 22 nt, Shigella flexneri 2a str. 301
ccgcgcugcuguagcaguucca

SEQ ID NO: 3889764 - RNA, 16 nt, Shigella flexneri 2a str. 301
ccgcgcuuucuucuuc

SEQ ID NO: 3889765 - RNA, 17 nt, Shigella flexneri 2a str. 301
ccgcggcucaggcgcac

SEQ ID NO: 3889766 - RNA, 23 nt, Shigella flexneri 2a str. 301
ccgcguaaacgugcggcugugcg

SEQ ID NO: 3889767 - RNA, 14 nt, Shigella flexneri 2a str. 301
ccgcguaaucaaca

SEQ ID NO: 3889768 - RNA, 16 nt, Shigella flexneri 2a str. 301
ccgcguaccgcagcaa

SEQ ID NO: 3889769 - RNA, 14 nt, Shigella flexneri 2a str. 301
ccgcgugacgcugg

SEQ ID NO: 3889770 - RNA, 16 nt, Shigella flexneri 2a str. 301
ccgcgugcgcggcagc

SEQ ID NO: 3889771 - RNA, 14 nt, Shigella flexneri 2a str. 301
ccgcguggcgcaag

SEQ ID NO: 3889772 - RNA, 15 nt, Shigella flexneri 2a str. 301
ccgcguguuuccggg

SEQ ID NO: 3889773 - RNA, 14 nt, Shigella flexneri 2a str. 301
ccgcguugcagcau

SEQ ID NO: 3889774 - RNA, 19 nt, Shigella flexneri 2a str. 301
ccgcguuuguugcgcuaag

SEQ ID NO: 3889775 - RNA, 20 nt, Shigella flexneri 2a str. 301
ccgcuaacugguggcaggaa

SEQ ID NO: 3889776 - RNA, 15 nt, Shigella flexneri 2a str. 301
ccgcuaccgcccuga

SEQ ID NO: 3889777 - RNA, 15 nt, Shigella flexneri 2a str. 301
ccgcuaucaguucag

SEQ ID NO: 3889778 - RNA, 23 nt, Shigella flexneri 2a str. 301
ccgcuauuauaucgcucucuuua

SEQ ID NO: 3889779 - RNA, 17 nt, Shigella flexneri 2a str. 301
ccgcucaaacaccgucg

SEQ ID NO: 3889780 - RNA, 22 nt, Shigella flexneri 2a str. 301
ccgcucaccugauacgcgccaa

SEQ ID NO: 3889781 - RNA, 19 nt, Shigella flexneri 2a str. 301
ccgcucacgcagcggcggc

SEQ ID NO: 3889782 - RNA, 18 nt, Shigella flexneri 2a str. 301
ccgcucgaaguuuuccuc

SEQ ID NO: 3889783 - RNA, 22 nt, Shigella flexneri 2a str. 301
ccgcucggcggcuggcuggaug

SEQ ID NO: 3889784 - RNA, 14 nt, Shigella flexneri 2a str. 301
ccgcucucauccau

SEQ ID NO: 3889785 - RNA, 20 nt, Shigella flexneri 2a str. 301
ccgcucuuucaccgccgaga

SEQ ID NO: 3889786 - RNA, 23 nt, Shigella flexneri 2a str. 301
ccgcugaacugauugccacccug

SEQ ID NO: 3889787 - RNA, 18 nt, Shigella flexneri 2a str. 301
ccgcugacggcucgcccg

SEQ ID NO: 3889788 - RNA, 18 nt, Shigella flexneri 2a str. 301
ccgcugaugcaacgucaa

SEQ ID NO: 3889789 - RNA, 11 nt, Shigella flexneri 2a str. 301
ccgcugccgcu

SEQ ID NO: 3889790 - RNA, 15 nt, Shigella flexneri 2a str. 301
ccgcugcugacuuug

SEQ ID NO: 3889791 - RNA, 21 nt, Shigella flexneri 2a str. 301
ccgcugcuuaauuacugccuu

SEQ ID NO: 3889792 - RNA, 21 nt, Shigella flexneri 2a str. 301
ccgcugcuucucuucagccaa

SEQ ID NO: 3889793 - RNA, 13 nt, Shigella flexneri 2a str. 301
ccgcuggacccgg

SEQ ID NO: 3889794 - RNA, 21 nt, Shigella flexneri 2a str. 301
ccgcuggccauuucugccagu

SEQ ID NO: 3889795 - RNA, 22 nt, Shigella flexneri 2a str. 301
ccgcuggcccaucagaauaucg

SEQ ID NO: 3889796 - RNA, 22 nt, Shigella flexneri 2a str. 301
ccgcuggcgcgguucccucauc

SEQ ID NO: 3889797 - RNA, 23 nt, Shigella flexneri 2a str. 301
ccgcuggcgcgguucccucaucu

SEQ ID NO: 3889798 - RNA, 16 nt, Shigella flexneri 2a str. 301
ccgcuggcgucugggc

SEQ ID NO: 3889799 - RNA, 20 nt, Shigella flexneri 2a str. 301
ccgcuguaaagaggcguuga

SEQ ID NO: 3889800 - RNA, 21 nt, Shigella flexneri 2a str. 301
ccgcuguccagucgcaaaccu

SEQ ID NO: 3889801 - RNA, 21 nt, Shigella flexneri 2a str. 301
ccgcugucgcagcgugcucuc

SEQ ID NO: 3889802 - RNA, 17 nt, Shigella flexneri 2a str. 301
ccgcugucuaccagcac

SEQ ID NO: 3889803 - RNA, 19 nt, Shigella flexneri 2a str. 301
ccgcuucaaucuucgauuu

SEQ ID NO: 3889804 - RNA, 15 nt, Shigella flexneri 2a str. 301
ccgcuucaccaccgc

SEQ ID NO: 3889805 - RNA, 17 nt, Shigella flexneri 2a str. 301
ccgcuucaguugcgccu

SEQ ID NO: 3889806 - RNA, 17 nt, Shigella flexneri 2a str. 301
ccgcuucauaaccguug

SEQ ID NO: 3889807 - RNA, 16 nt, Shigella flexneri 2a str. 301
ccgcuucaucgugcuc

SEQ ID NO: 3889808 - RNA, 16 nt, Shigella flexneri 2a str. 301
ccgcuucauugaccuu

SEQ ID NO: 3889809 - RNA, 13 nt, Shigella flexneri 2a str. 301
ccgcuuccagaaa

SEQ ID NO: 3889810 - RNA, 10 nt, Shigella flexneri 2a str. 301
ccgcuucccu

SEQ ID NO: 3889811 - RNA, 17 nt, Shigella flexneri 2a str. 301
ccgcuuccggucugcga

SEQ ID NO: 3889812 - RNA, 14 nt, Shigella flexneri 2a str. 301
ccgcuucugcagcu

SEQ ID NO: 3889813 - RNA, 13 nt, Shigella flexneri 2a str. 301
ccgcuucugcuuu

SEQ ID NO: 3889814 - RNA, 12 nt, Shigella flexneri 2a str. 301
ccgcuuuccagg

SEQ ID NO: 3889815 - RNA, 18 nt, Shigella flexneri 2a str. 301
ccgcuuuccaggcugugu

SEQ ID NO: 3889816 - RNA, 22 nt, Shigella flexneri 2a str. 301
ccgcuuuguguaaguuuaaccu

SEQ ID NO: 3889817 - RNA, 14 nt, Shigella flexneri 2a str. 301
ccgcuuuuccagca

SEQ ID NO: 3889818 - RNA, 15 nt, Shigella flexneri 2a str. 301
ccgcuuuuccagcau

SEQ ID NO: 3889819 - RNA, 18 nt, Shigella flexneri 2a str. 301
ccggaaacccugcgucag

SEQ ID NO: 3889820 - RNA, 18 nt, Shigella flexneri 2a str. 301
ccggaacaggcagggcca

SEQ ID NO: 3889821 - RNA, 16 nt, Shigella flexneri 2a str. 301
ccggaacaucaccaag

SEQ ID NO: 3889822 - RNA, 21 nt, Shigella flexneri 2a str. 301
ccggaaccggauuuucaccau

SEQ ID NO: 3889823 - RNA, 18 nt, Shigella flexneri 2a str. 301
ccggaacugccugcucgu

SEQ ID NO: 3889824 - RNA, 22 nt, Shigella flexneri 2a str. 301
ccggaaggaagacgcagcaugc

SEQ ID NO: 3889825 - RNA, 18 nt, Shigella flexneri 2a str. 301
ccggaaguaccaauggca

SEQ ID NO: 3889826 - RNA, 22 nt, Shigella flexneri 2a str. 301
ccggaauaacucccuauaaugc

SEQ ID NO: 3889827 - RNA, 15 nt, Shigella flexneri 2a str. 301
ccggaauagcuuuac

SEQ ID NO: 3889828 - RNA, 21 nt, Shigella flexneri 2a str. 301
ccggaauuucuuucagcaguu

SEQ ID NO: 3889829 - RNA, 22 nt, Shigella flexneri 2a str. 301
ccggacacugcuuacaggcugg

SEQ ID NO: 3889830 - RNA, 13 nt, Shigella flexneri 2a str. 301
ccggaccgucauc

SEQ ID NO: 3889831 - RNA, 19 nt, Shigella flexneri 2a str. 301
ccggaccugucggggccag

SEQ ID NO: 3889832 - RNA, 20 nt, Shigella flexneri 2a str. 301
ccggacgacggcaucgccau

SEQ ID NO: 3889833 - RNA, 22 nt, Shigella flexneri 2a str. 301
ccggacgcguugagugcgacau

SEQ ID NO: 3889834 - RNA, 19 nt, Shigella flexneri 2a str. 301
ccggacguaaugauguaaa

SEQ ID NO: 3889835 - RNA, 21 nt, Shigella flexneri 2a str. 301
ccggacuguaaacgaugaugc

SEQ ID NO: 3889836 - RNA, 17 nt, Shigella flexneri 2a str. 301
ccggagacaaacagggu

SEQ ID NO: 3889837 - RNA, 17 nt, Shigella flexneri 2a str. 301
ccggagacguauuaaau

SEQ ID NO: 3889838 - RNA, 23 nt, Shigella flexneri 2a str. 301
ccggagaguauuaucugcaauua

SEQ ID NO: 3889839 - RNA, 14 nt, Shigella flexneri 2a str. 301
ccggagccagccgu

SEQ ID NO: 3889840 - RNA, 14 nt, Shigella flexneri 2a str. 301
ccggagcgccacca

SEQ ID NO: 3889841 - RNA, 18 nt, Shigella flexneri 2a str. 301
ccggggcgcgugcuccag

SEQ ID NO: 3889842 - RNA, 15 nt, Shigella flexneri 2a str. 301
ccgggucauccagga

SEQ ID NO: 3889843 - RNA, 16 nt, Shigella flexneri 2a str. 301
ccgggugaacugccac

SEQ ID NO: 3889844 - RNA, 13 nt, Shigella flexneri 2a str. 301
ccgggugcagaca

SEQ ID NO: 3889845 - RNA, 18 nt, Shigella flexneri 2a str. 301
ccggguuuaacccuguac

SEQ ID NO: 3889846 - RNA, 21 nt, Shigella flexneri 2a str. 301
ccggguuugccacaucacugu

SEQ ID NO: 3889847 - RNA, 16 nt, Shigella flexneri 2a str. 301
ccggguuuuuuauuaa

SEQ ID NO: 3889848 - RNA, 15 nt, Shigella flexneri 2a str. 301
ccgguaaagcaauga

SEQ ID NO: 3889849 - RNA, 20 nt, Shigella flexneri 2a str. 301
ccgguaaagcaaugaagaac

SEQ ID NO: 3889850 - RNA, 12 nt, Shigella flexneri 2a str. 301
ccgguaaauaau

SEQ ID NO: 3889851 - RNA, 18 nt, Shigella flexneri 2a str. 301
ccgguaaaucaccagcgu

SEQ ID NO: 3889852 - RNA, 14 nt, Shigella flexneri 2a str. 301
ccgguaagcauuua

SEQ ID NO: 3889853 - RNA, 22 nt, Shigella flexneri 2a str. 301
ccgguaaugcugaaauuacgcg

SEQ ID NO: 3889854 - RNA, 17 nt, Shigella flexneri 2a str. 301
ccgguacaaacaucauc

SEQ ID NO: 3889855 - RNA, 16 nt, Shigella flexneri 2a str. 301
ccgguaccuuugaacu

SEQ ID NO: 3889856 - RNA, 17 nt, Shigella flexneri 2a str. 301
ccgguacggaugcgaau

SEQ ID NO: 3889857 - RNA, 14 nt, Shigella flexneri 2a str. 301
ccgguaguuucagc

SEQ ID NO: 3889858 - RNA, 20 nt, Shigella flexneri 2a str. 301
ccgguaucaaacccuuccau

SEQ ID NO: 3889859 - RNA, 13 nt, Shigella flexneri 2a str. 301
ccgguauccagcg

SEQ ID NO: 3889860 - RNA, 15 nt, Shigella flexneri 2a str. 301
ccggucaaaugaccg

SEQ ID NO: 3889861 - RNA, 13 nt, Shigella flexneri 2a str. 301
ccggucagcagca

SEQ ID NO: 3889862 - RNA, 18 nt, Shigella flexneri 2a str. 301
ccggucagcagcaccacc

SEQ ID NO: 3889863 - RNA, 20 nt, Shigella flexneri 2a str. 301
ccggucagcagcaccaccgc

SEQ ID NO: 3889864 - RNA, 19 nt, Shigella flexneri 2a str. 301
ccggucgcaggcaguacug

SEQ ID NO: 3889865 - RNA, 17 nt, Shigella flexneri 2a str. 301
ccggucgcuucuagugc

SEQ ID NO: 3889866 - RNA, 14 nt, Shigella flexneri 2a str. 301
ccggucguuaccag

SEQ ID NO: 3889867 - RNA, 19 nt, Shigella flexneri 2a str. 301
ccggucuaccgauccggca

SEQ ID NO: 3889868 - RNA, 22 nt, Shigella flexneri 2a str. 301
ccggucuaccgauccggcacca

SEQ ID NO: 3889869 - RNA, 16 nt, Shigella flexneri 2a str. 301
ccggugaccaucagca

SEQ ID NO: 3889870 - RNA, 14 nt, Shigella flexneri 2a str. 301
ccggugagcugcau

SEQ ID NO: 3889871 - RNA, 15 nt, Shigella flexneri 2a str. 301
ccggugaucauuaaa

SEQ ID NO: 3889872 - RNA, 11 nt, Shigella flexneri 2a str. 301
ccggugcauuc

SEQ ID NO: 3889873 - RNA, 18 nt, Shigella flexneri 2a str. 301
ccggugccgguuucacgu

SEQ ID NO: 3889874 - RNA, 16 nt, Shigella flexneri 2a str. 301
ccggugccuuaccgcu

SEQ ID NO: 3889875 - RNA, 16 nt, Shigella flexneri 2a str. 301
ccggugcgccagaccu

SEQ ID NO: 3889876 - RNA, 14 nt, Shigella flexneri 2a str. 301
ccgguggaagggcu

SEQ ID NO: 3889877 - RNA, 13 nt, Shigella flexneri 2a str. 301
ccgguggcauccg

SEQ ID NO: 3889878 - RNA, 22 nt, Shigella flexneri 2a str. 301
ccggugguuaacgaaucaaucg

SEQ ID NO: 3889879 - RNA, 22 nt, Shigella flexneri 2a str. 301
ccgguuaaguaaaauccgaacu

SEQ ID NO: 3889880 - RNA, 19 nt, Shigella flexneri 2a str. 301
ccgguuaauugcgccagca

SEQ ID NO: 3889881 - RNA, 18 nt, Shigella flexneri 2a str. 301
ccgguuaugccgcgaucg

SEQ ID NO: 3889882 - RNA, 12 nt, Shigella flexneri 2a str. 301
ccgguucaucac

SEQ ID NO: 3889883 - RNA, 13 nt, Shigella flexneri 2a str. 301
ccgguuccacauc

SEQ ID NO: 3889884 - RNA, 15 nt, Shigella flexneri 2a str. 301
ccgguuccugcaucg

SEQ ID NO: 3889885 - RNA, 16 nt, Shigella flexneri 2a str. 301
ccgguucggccauauc

SEQ ID NO: 3889886 - RNA, 22 nt, Shigella flexneri 2a str. 301
ccgguucguugaucacuuucac

SEQ ID NO: 3889887 - RNA, 13 nt, Shigella flexneri 2a str. 301
ccgguugaccggc

SEQ ID NO: 3889888 - RNA, 23 nt, Shigella flexneri 2a str. 301
ccgguugucaggaagccccagcu

SEQ ID NO: 3889889 - RNA, 15 nt, Shigella flexneri 2a str. 301
ccgguuucaaaacug

SEQ ID NO: 3889890 - RNA, 17 nt, Shigella flexneri 2a str. 301
ccgguuucaauccaggu

SEQ ID NO: 3889891 - RNA, 22 nt, Shigella flexneri 2a str. 301
ccgguuucgugaaacucagcau

SEQ ID NO: 3889892 - RNA, 20 nt, Shigella flexneri 2a str. 301
ccgguuugcgccgugcgaau

SEQ ID NO: 3889893 - RNA, 17 nt, Shigella flexneri 2a str. 301
ccgguuuggcauaacca

SEQ ID NO: 3889894 - RNA, 21 nt, Shigella flexneri 2a str. 301
ccgguuuuacagaaucuggcc

SEQ ID NO: 3889895 - RNA, 16 nt, Shigella flexneri 2a str. 301
ccgguuuugguuuucu

SEQ ID NO: 3889896 - RNA, 12 nt, Shigella flexneri 2a str. 301
ccgguuuuucaa

SEQ ID NO: 3889897 - RNA, 12 nt, Shigella flexneri 2a str. 301
ccguaaaaaaug

SEQ ID NO: 3889898 - RNA, 21 nt, Shigella flexneri 2a str. 301
ccguaaccaccagcacugauu

SEQ ID NO: 3889899 - RNA, 13 nt, Shigella flexneri 2a str. 301
ccguaagcaacgc

SEQ ID NO: 3889900 - RNA, 17 nt, Shigella flexneri 2a str. 301
ccguaagcaacgccaaa

SEQ ID NO: 3889901 - RNA, 16 nt, Shigella flexneri 2a str. 301
ccguaagcgccccgag

SEQ ID NO: 3889902 - RNA, 17 nt, Shigella flexneri 2a str. 301
ccguaagcgucguucgc

SEQ ID NO: 3889903 - RNA, 18 nt, Shigella flexneri 2a str. 301
ccguaaugaucgcgaucg

SEQ ID NO: 3889904 - RNA, 16 nt, Shigella flexneri 2a str. 301
ccguaauuuuuacucc

SEQ ID NO: 3889905 - RNA, 19 nt, Shigella flexneri 2a str. 301
ccguacaggcagcuuagaa

SEQ ID NO: 3889906 - RNA, 15 nt, Shigella flexneri 2a str. 301
ccguaccaucgccag

SEQ ID NO: 3889907 - RNA, 21 nt, Shigella flexneri 2a str. 301
ccguaccgguaaaccuggugu

SEQ ID NO: 3889908 - RNA, 18 nt, Shigella flexneri 2a str. 301
ccguacgcaucaccagac

SEQ ID NO: 3889909 - RNA, 21 nt, Shigella flexneri 2a str. 301
ccguacugacggcguucuuua

SEQ ID NO: 3889910 - RNA, 15 nt, Shigella flexneri 2a str. 301
ccguagcguucuuug

SEQ ID NO: 3889911 - RNA, 19 nt, Shigella flexneri 2a str. 301
ccguaguccauacccagca

SEQ ID NO: 3889912 - RNA, 12 nt, Shigella flexneri 2a str. 301
ccguagugaaaa

SEQ ID NO: 3889913 - RNA, 13 nt, Shigella flexneri 2a str. 301
ccguaguggccac

SEQ ID NO: 3889914 - RNA, 16 nt, Shigella flexneri 2a str. 301
ccguauaauaucuuuu

SEQ ID NO: 3889915 - RNA, 18 nt, Shigella flexneri 2a str. 301
ccguauaauaucuuuucu

SEQ ID NO: 3889916 - RNA, 19 nt, Shigella flexneri 2a str. 301
ccguaugaugugcgcuaac

SEQ ID NO: 3889917 - RNA, 14 nt, Shigella flexneri 2a str. 301
ccguauguucucug

SEQ ID NO: 3889918 - RNA, 19 nt, Shigella flexneri 2a str. 301
ccguauuacugagauggcu

SEQ ID NO: 3889919 - RNA, 20 nt, Shigella flexneri 2a str. 301
ccguauuuuuugcucauaaa

SEQ ID NO: 3889920 - RNA, 15 nt, Shigella flexneri 2a str. 301
ccgucaaagcgccag

SEQ ID NO: 3889921 - RNA, 21 nt, Shigella flexneri 2a str. 301
ccgucacaggcacaccgccgc

SEQ ID NO: 3889922 - RNA, 12 nt, Shigella flexneri 2a str. 301
ccgucaccggca

SEQ ID NO: 3889923 - RNA, 14 nt, Shigella flexneri 2a str. 301
ccgucacuucuucg

SEQ ID NO: 3889924 - RNA, 20 nt, Shigella flexneri 2a str. 301
ccgucacuucuucgcgaucg

SEQ ID NO: 3889925 - RNA, 15 nt, Shigella flexneri 2a str. 301
ccgucagauccgcca

SEQ ID NO: 3889926 - RNA, 16 nt, Shigella flexneri 2a str. 301
ccgucagauccgccag

SEQ ID NO: 3889927 - RNA, 14 nt, Shigella flexneri 2a str. 301
ccgucagcaaaaua

SEQ ID NO: 3889928 - RNA, 21 nt, Shigella flexneri 2a str. 301
ccgucagcaaaauacugaaca

SEQ ID NO: 3889929 - RNA, 11 nt, Shigella flexneri 2a str. 301
ccgucagccgc

SEQ ID NO: 3889930 - RNA, 15 nt, Shigella flexneri 2a str. 301
ccgucagccgcccgc

SEQ ID NO: 3889931 - RNA, 14 nt, Shigella flexneri 2a str. 301
ccgucagccugacg

SEQ ID NO: 3889932 - RNA, 20 nt, Shigella flexneri 2a str. 301
ccgucagccugacggaucug

SEQ ID NO: 3889933 - RNA, 12 nt, Shigella flexneri 2a str. 301
ccgucagcgagu

SEQ ID NO: 3889934 - RNA, 19 nt, Shigella flexneri 2a str. 301
ccgucagcgaucagcauuu

SEQ ID NO: 3889935 - RNA, 13 nt, Shigella flexneri 2a str. 301
ccgucagcggcaa

SEQ ID NO: 3889936 - RNA, 19 nt, Shigella flexneri 2a str. 301
ccgucaguuugccguacca

SEQ ID NO: 3889937 - RNA, 22 nt, Shigella flexneri 2a str. 301
ccgucaguuugccguaccacgc

SEQ ID NO: 3889938 - RNA, 23 nt, Shigella flexneri 2a str. 301
ccgucaucgacaaaaacccugcc

SEQ ID NO: 3889939 - RNA, 13 nt, Shigella flexneri 2a str. 301
ccgucaucgguau

SEQ ID NO: 3889940 - RNA, 15 nt, Shigella flexneri 2a str. 301
ccgucaugccgguaa

SEQ ID NO: 3889941 - RNA, 20 nt, Shigella flexneri 2a str. 301
ccguccaggcggucaccgaa

SEQ ID NO: 3889942 - RNA, 16 nt, Shigella flexneri 2a str. 301
ccucaacauacaaaua

SEQ ID NO: 3889943 - RNA, 19 nt, Shigella flexneri 2a str. 301
ccucaacgccuaaugccag

SEQ ID NO: 3889944 - RNA, 13 nt, Shigella flexneri 2a str. 301
ccucaagaaucac

SEQ ID NO: 3889945 - RNA, 19 nt, Shigella flexneri 2a str. 301
ccucaagcucgccaccauu

SEQ ID NO: 3889946 - RNA, 18 nt, Shigella flexneri 2a str. 301
ccucaauaauaauccgcu

SEQ ID NO: 3889947 - RNA, 21 nt, Shigella flexneri 2a str. 301
ccucaauaauaauccgcugca

SEQ ID NO: 3889948 - RNA, 20 nt, Shigella flexneri 2a str. 301
ccucaauuagcggcucaugu

SEQ ID NO: 3889949 - RNA, 17 nt, Shigella flexneri 2a str. 301
ccucacagcuaaucauc

SEQ ID NO: 3889950 - RNA, 15 nt, Shigella flexneri 2a str. 301
ccucacccuaacccu

SEQ ID NO: 3889951 - RNA, 17 nt, Shigella flexneri 2a str. 301
ccucaccuuccacgcgg

SEQ ID NO: 3889952 - RNA, 20 nt, Shigella flexneri 2a str. 301
ccucacggcuuagcaaggcu

SEQ ID NO: 3889953 - RNA, 10 nt, Shigella flexneri 2a str. 301
ccucagagcu

SEQ ID NO: 3889954 - RNA, 19 nt, Shigella flexneri 2a str. 301
ccucagaguuaaccugaaa

SEQ ID NO: 3889955 - RNA, 16 nt, Shigella flexneri 2a str. 301
ccucagcagacugaua

SEQ ID NO: 3889956 - RNA, 16 nt, Shigella flexneri 2a str. 301
ccucagcgaacaggac

SEQ ID NO: 3889957 - RNA, 22 nt, Shigella flexneri 2a str. 301
ccucagcgaacaggaccuugac

SEQ ID NO: 3889958 - RNA, 20 nt, Shigella flexneri 2a str. 301
ccucaguacccgcguucugg

SEQ ID NO: 3889959 - RNA, 14 nt, Shigella flexneri 2a str. 301
ccucaguugucuga

SEQ ID NO: 3889960 - RNA, 14 nt, Shigella flexneri 2a str. 301
ccucaucaccacag

SEQ ID NO: 3889961 - RNA, 22 nt, Shigella flexneri 2a str. 301
ccucaucgauauuaucuucauc

SEQ ID NO: 3889962 - RNA, 17 nt, Shigella flexneri 2a str. 301
ccucauuccuccccgaa

SEQ ID NO: 3889963 - RNA, 14 nt, Shigella flexneri 2a str. 301
ccucauuucccugu

SEQ ID NO: 3889964 - RNA, 15 nt, Shigella flexneri 2a str. 301
ccuccaaaaaacaaa

SEQ ID NO: 3889965 - RNA, 14 nt, Shigella flexneri 2a str. 301
ccuccaagccugau

SEQ ID NO: 3889966 - RNA, 12 nt, Shigella flexneri 2a str. 301
ccuccagcagca

SEQ ID NO: 3889967 - RNA, 21 nt, Shigella flexneri 2a str. 301
ccuccagcgagcuggcgcuga

SEQ ID NO: 3889968 - RNA, 22 nt, Shigella flexneri 2a str. 301
ccuccagcgagcuggcgcugau

SEQ ID NO: 3889969 - RNA, 22 nt, Shigella flexneri 2a str. 301
ccuccagcuccucgaguccuuc

SEQ ID NO: 3889970 - RNA, 14 nt, Shigella flexneri 2a str. 301
ccuccauguccagc

SEQ ID NO: 3889971 - RNA, 17 nt, Shigella flexneri 2a str. 301
ccuccauugaauuuuau

SEQ ID NO: 3889972 - RNA, 17 nt, Shigella flexneri 2a str. 301
ccucccgguaggugagg

SEQ ID NO: 3889973 - RNA, 18 nt, Shigella flexneri 2a str. 301
ccucccguuucccugucu

SEQ ID NO: 3889974 - RNA, 16 nt, Shigella flexneri 2a str. 301
ccucccucgaagccgu

SEQ ID NO: 3889975 - RNA, 15 nt, Shigella flexneri 2a str. 301
ccuccggcguuucag

SEQ ID NO: 3889976 - RNA, 18 nt, Shigella flexneri 2a str. 301
ccuccgggaccuuucuga

SEQ ID NO: 3889977 - RNA, 19 nt, Shigella flexneri 2a str. 301
ccuccgggaccuuucugau

SEQ ID NO: 3889978 - RNA, 19 nt, Shigella flexneri 2a str. 301
ccuccggggaagcgcaugg

SEQ ID NO: 3889979 - RNA, 12 nt, Shigella flexneri 2a str. 301
ccuccugcagcg

SEQ ID NO: 3889980 - RNA, 17 nt, Shigella flexneri 2a str. 301
ccuccuguaccuucacg

SEQ ID NO: 3889981 - RNA, 15 nt, Shigella flexneri 2a str. 301
ccuccugucuucccu

SEQ ID NO: 3889982 - RNA, 16 nt, Shigella flexneri 2a str. 301
ccucgaccaaaugaaa

SEQ ID NO: 3889983 - RNA, 19 nt, Shigella flexneri 2a str. 301
ccucgaccccgaacucauc

SEQ ID NO: 3889984 - RNA, 15 nt, Shigella flexneri 2a str. 301
ccucgaucagagugg

SEQ ID NO: 3889985 - RNA, 14 nt, Shigella flexneri 2a str. 301
ccucgcauuuuugu

SEQ ID NO: 3889986 - RNA, 18 nt, Shigella flexneri 2a str. 301
ccucgcccauuuuucaug

SEQ ID NO: 3889987 - RNA, 17 nt, Shigella flexneri 2a str. 301
ccucgccccuccgggga

SEQ ID NO: 3889988 - RNA, 14 nt, Shigella flexneri 2a str. 301
ccucgcccgcagaa

SEQ ID NO: 3889989 - RNA, 15 nt, Shigella flexneri 2a str. 301
ccucgccgcuucccu

SEQ ID NO: 3889990 - RNA, 15 nt, Shigella flexneri 2a str. 301
ccucgccguuaauga

SEQ ID NO: 3889991 - RNA, 19 nt, Shigella flexneri 2a str. 301
ccucgcguccgcguccgcu

SEQ ID NO: 3889992 - RNA, 13 nt, Shigella flexneri 2a str. 301
ccucgcuacgcca

SEQ ID NO: 3889993 - RNA, 14 nt, Shigella flexneri 2a str. 301
ccucgcuacgccag

SEQ ID NO: 3889994 - RNA, 23 nt, Shigella flexneri 2a str. 301
ccucggagaacggauucagugag

SEQ ID NO: 3889995 - RNA, 22 nt, Shigella flexneri 2a str. 301
ccucggcauggaucgccgcggu

SEQ ID NO: 3889996 - RNA, 16 nt, Shigella flexneri 2a str. 301
ccucgucccaaaagcu

SEQ ID NO: 3889997 - RNA, 18 nt, Shigella flexneri 2a str. 301
ccucgucccaaaagcucg

SEQ ID NO: 3889998 - RNA, 20 nt, Shigella flexneri 2a str. 301
ccucgucggcgguuuucauc

SEQ ID NO: 3889999 - RNA, 14 nt, Shigella flexneri 2a str. 301
ccucuaacagauca

SEQ ID NO: 3890000 - RNA, 15 nt, Shigella flexneri 2a str. 301
ccucucaugagcaga

SEQ ID NO: 3890001 - RNA, 23 nt, Shigella flexneri 2a str. 301
ccucucaugagcagaccaauaac

SEQ ID NO: 3890002 - RNA, 15 nt, Shigella flexneri 2a str. 301
ccucuccccagcgga

SEQ ID NO: 3890003 - RNA, 22 nt, Shigella flexneri 2a str. 301
ccucucccgaaugaccgccccu

SEQ ID NO: 3890004 - RNA, 13 nt, Shigella flexneri 2a str. 301
ccucugccagcug

SEQ ID NO: 3890005 - RNA, 15 nt, Shigella flexneri 2a str. 301
ccucugcgcccagca

SEQ ID NO: 3890006 - RNA, 17 nt, Shigella flexneri 2a str. 301
ccucugcgcccagcaac

SEQ ID NO: 3890007 - RNA, 18 nt, Shigella flexneri 2a str. 301
ccucuuaaugcaggcagc

SEQ ID NO: 3890008 - RNA, 16 nt, Shigella flexneri 2a str. 301
ccucuuacgccgccac

SEQ ID NO: 3890009 - RNA, 17 nt, Shigella flexneri 2a str. 301
ccucuuacgccgccaca

SEQ ID NO: 3890010 - RNA, 22 nt, Shigella flexneri 2a str. 301
ccucuuacgcgaauaguuuccg

SEQ ID NO: 3890011 - RNA, 20 nt, Shigella flexneri 2a str. 301
ccucuucagccgcaaaccug

SEQ ID NO: 3890012 - RNA, 14 nt, Shigella flexneri 2a str. 301
ccucuucagcgucc

SEQ ID NO: 3890013 - RNA, 21 nt, Shigella flexneri 2a str. 301
ccucuucagcguccauccaca

SEQ ID NO: 3890014 - RNA, 13 nt, Shigella flexneri 2a str. 301
ccucuucauuaaa

SEQ ID NO: 3890015 - RNA, 16 nt, Shigella flexneri 2a str. 301
ccucuuccauuucauc

SEQ ID NO: 3890016 - RNA, 19 nt, Shigella flexneri 2a str. 301
ccucuuccauuucaucgcc

SEQ ID NO: 3890017 - RNA, 21 nt, Shigella flexneri 2a str. 301
ccucuuccauuucaucgccag

SEQ ID NO: 3890018 - RNA, 15 nt, Shigella flexneri 2a str. 301
ccucuucccagaccc

SEQ ID NO: 3890019 - RNA, 17 nt, Shigella flexneri 2a str. 301
ccucuucccagacccag

SEQ ID NO: 3890020 - RNA, 16 nt, Shigella flexneri 2a str. 301
ccucuucggcagucac

SEQ ID NO: 3890021 - RNA, 16 nt, Shigella flexneri 2a str. 301
ccucuucuuuuagcuc

SEQ ID NO: 3890022 - RNA, 15 nt, Shigella flexneri 2a str. 301
ccucuuucauccgau

SEQ ID NO: 3890023 - RNA, 15 nt, Shigella flexneri 2a str. 301
ccucuuucucauaaa

SEQ ID NO: 3890024 - RNA, 21 nt, Shigella flexneri 2a str. 301
ccucuuuuuauuuacucuccu

SEQ ID NO: 3890025 - RNA, 16 nt, Shigella flexneri 2a str. 301
ccucuuuuuucagugc

SEQ ID NO: 3890026 - RNA, 17 nt, Shigella flexneri 2a str. 301
ccugaaaaaacaaauau

SEQ ID NO: 3890027 - RNA, 13 nt, Shigella flexneri 2a str. 301
ccugaaaacgaaa

SEQ ID NO: 3890028 - RNA, 21 nt, Shigella flexneri 2a str. 301
ccugaaacgcggcguaaccgc

SEQ ID NO: 3890029 - RNA, 23 nt, Shigella flexneri 2a str. 301
ccugaaacgcggcguaaccgccc

SEQ ID NO: 3890030 - RNA, 21 nt, Shigella flexneri 2a str. 301
ccugaacucgccgcacaggcg

SEQ ID NO: 3890031 - RNA, 13 nt, Shigella flexneri 2a str. 301
ccugaagaucaac

SEQ ID NO: 3890032 - RNA, 15 nt, Shigella flexneri 2a str. 301
ccugaagaugcugca

SEQ ID NO: 3890033 - RNA, 20 nt, Shigella flexneri 2a str. 301
ccugaagcaguuucaccagc

SEQ ID NO: 3890034 - RNA, 22 nt, Shigella flexneri 2a str. 301
ccugaagcaguuucaccagcag

SEQ ID NO: 3890035 - RNA, 16 nt, Shigella flexneri 2a str. 301
ccugaagcguccgcuu

SEQ ID NO: 3890036 - RNA, 13 nt, Shigella flexneri 2a str. 301
ccugaauaaacgc

SEQ ID NO: 3890037 - RNA, 16 nt, Shigella flexneri 2a str. 301
ccugaauaaacgccau

SEQ ID NO: 3890038 - RNA, 12 nt, Shigella flexneri 2a str. 301
ccugaauaacac

SEQ ID NO: 3890039 - RNA, 23 nt, Shigella flexneri 2a str. 301
ccugaauaaugucccccgggcgg

SEQ ID NO: 3890040 - RNA, 13 nt, Shigella flexneri 2a str. 301
ccugaaucaauca

SEQ ID NO: 3890041 - RNA, 19 nt, Shigella flexneri 2a str. 301
ccugaaucaaucagagcca

SEQ ID NO: 3890042 - RNA, 23 nt, Shigella flexneri 2a str. 301
ccugcucaaacuucgucacagcg

SEQ ID NO: 3890043 - RNA, 13 nt, Shigella flexneri 2a str. 301
ccugcucagcccg

SEQ ID NO: 3890044 - RNA, 13 nt, Shigella flexneri 2a str. 301
ccugcucaucagc

SEQ ID NO: 3890045 - RNA, 23 nt, Shigella flexneri 2a str. 301
ccugcuccagcaacucaaucgcc

SEQ ID NO: 3890046 - RNA, 18 nt, Shigella flexneri 2a str. 301
ccugcucgucauccgcca

SEQ ID NO: 3890047 - RNA, 15 nt, Shigella flexneri 2a str. 301
ccugcucgucggcaa

SEQ ID NO: 3890048 - RNA, 22 nt, Shigella flexneri 2a str. 301
ccugcucgucggcaaagcgggc

SEQ ID NO: 3890049 - RNA, 19 nt, Shigella flexneri 2a str. 301
ccugcucuuucagcaccgc

SEQ ID NO: 3890050 - RNA, 22 nt, Shigella flexneri 2a str. 301
ccugcugauggcgggaugugua

SEQ ID NO: 3890051 - RNA, 17 nt, Shigella flexneri 2a str. 301
ccugcugauuaucggca

SEQ ID NO: 3890052 - RNA, 20 nt, Shigella flexneri 2a str. 301
ccugcugcacgcccugauaa

SEQ ID NO: 3890053 - RNA, 18 nt, Shigella flexneri 2a str. 301
ccugcugcacgucauacu

SEQ ID NO: 3890054 - RNA, 20 nt, Shigella flexneri 2a str. 301
ccugcugcuguugcgucucg

SEQ ID NO: 3890055 - RNA, 17 nt, Shigella flexneri 2a str. 301
ccugcuggacgcgccaa

SEQ ID NO: 3890056 - RNA, 13 nt, Shigella flexneri 2a str. 301
ccugcuggguaaa

SEQ ID NO: 3890057 - RNA, 21 nt, Shigella flexneri 2a str. 301
ccugcugucggcgguaagcca

SEQ ID NO: 3890058 - RNA, 14 nt, Shigella flexneri 2a str. 301
ccugcugugccgua

SEQ ID NO: 3890059 - RNA, 22 nt, Shigella flexneri 2a str. 301
ccugcuuccuuaaucccuggau

SEQ ID NO: 3890060 - RNA, 15 nt, Shigella flexneri 2a str. 301
ccugcuuuaaaagcu

SEQ ID NO: 3890061 - RNA, 22 nt, Shigella flexneri 2a str. 301
ccuggaaaaagugccccagcuu

SEQ ID NO: 3890062 - RNA, 15 nt, Shigella flexneri 2a str. 301
ccuggaaccaggcgc

SEQ ID NO: 3890063 - RNA, 17 nt, Shigella flexneri 2a str. 301
ccuggaaccaggcgcga

SEQ ID NO: 3890064 - RNA, 22 nt, Shigella flexneri 2a str. 301
ccuggacagcucguuaaucaga

SEQ ID NO: 3890065 - RNA, 14 nt, Shigella flexneri 2a str. 301
ccuggacuuuaaac

SEQ ID NO: 3890066 - RNA, 20 nt, Shigella flexneri 2a str. 301
ccuggauugagucagaaauc

SEQ ID NO: 3890067 - RNA, 22 nt, Shigella flexneri 2a str. 301
ccuggauugcaggggagcugca

SEQ ID NO: 3890068 - RNA, 16 nt, Shigella flexneri 2a str. 301
ccuggcccaucgccag

SEQ ID NO: 3890069 - RNA, 16 nt, Shigella flexneri 2a str. 301
ccuggccgugaagaag

SEQ ID NO: 3890070 - RNA, 17 nt, Shigella flexneri 2a str. 301
ccuggcgaacauccagc

SEQ ID NO: 3890071 - RNA, 21 nt, Shigella flexneri 2a str. 301
ccuggcgagcauuaauacacc

SEQ ID NO: 3890072 - RNA, 20 nt, Shigella flexneri 2a str. 301
ccuggcgcaguggauagacg

SEQ ID NO: 3890073 - RNA, 20 nt, Shigella flexneri 2a str. 301
ccuggcgggaauaaaagcca

SEQ ID NO: 3890074 - RNA, 23 nt, Shigella flexneri 2a str. 301
ccuggcgggaauaaaagccagga

SEQ ID NO: 3890075 - RNA, 15 nt, Shigella flexneri 2a str. 301
ccuggcggggauuau

SEQ ID NO: 3890076 - RNA, 18 nt, Shigella flexneri 2a str. 301
ccuggcgguuaauaauga

SEQ ID NO: 3890077 - RNA, 16 nt, Shigella flexneri 2a str. 301
ccuggcuaccauccgc

SEQ ID NO: 3890078 - RNA, 19 nt, Shigella flexneri 2a str. 301
ccuggcucaagcaccaucc

SEQ ID NO: 3890079 - RNA, 23 nt, Shigella flexneri 2a str. 301
ccuggcugauugauauccagauc

SEQ ID NO: 3890080 - RNA, 13 nt, Shigella flexneri 2a str. 301
ccuggcugcccau

SEQ ID NO: 3890081 - RNA, 12 nt, Shigella flexneri 2a str. 301
ccuggcugguga

SEQ ID NO: 3890082 - RNA, 13 nt, Shigella flexneri 2a str. 301
ccugggcaauggu

SEQ ID NO: 3890083 - RNA, 23 nt, Shigella flexneri 2a str. 301
ccugggcaccgacguucagcgca

SEQ ID NO: 3890084 - RNA, 15 nt, Shigella flexneri 2a str. 301
ccugggcgauuuccu

SEQ ID NO: 3890085 - RNA, 18 nt, Shigella flexneri 2a str. 301
ccugggcuucauccagca

SEQ ID NO: 3890086 - RNA, 20 nt, Shigella flexneri 2a str. 301
ccugguaucuuuacagcgcu

SEQ ID NO: 3890087 - RNA, 13 nt, Shigella flexneri 2a str. 301
ccuggucgcugau

SEQ ID NO: 3890088 - RNA, 23 nt, Shigella flexneri 2a str. 301
ccugguguucggcauucugcugg

SEQ ID NO: 3890089 - RNA, 18 nt, Shigella flexneri 2a str. 301
ccugguuauuucacuuca

SEQ ID NO: 3890090 - RNA, 19 nt, Shigella flexneri 2a str. 301
ccugguuauuucacuucaa

SEQ ID NO: 3890091 - RNA, 20 nt, Shigella flexneri 2a str. 301
ccugguugcuggauaagaug

SEQ ID NO: 3890092 - RNA, 22 nt, Shigella flexneri 2a str. 301
ccuguaaaacgcgcccucagcc

SEQ ID NO: 3890093 - RNA, 16 nt, Shigella flexneri 2a str. 301
ccuguaccacaaccug

SEQ ID NO: 3890094 - RNA, 21 nt, Shigella flexneri 2a str. 301
ccuguaccuucagcggcagcu

SEQ ID NO: 3890095 - RNA, 13 nt, Shigella flexneri 2a str. 301
ccuguacggcagu

SEQ ID NO: 3890096 - RNA, 22 nt, Shigella flexneri 2a str. 301
ccuguauacgcauaucaacgcc

SEQ ID NO: 3890097 - RNA, 21 nt, Shigella flexneri 2a str. 301
ccuguaucaggcuguguuuaa

SEQ ID NO: 3890098 - RNA, 22 nt, Shigella flexneri 2a str. 301
ccuguaucccagaucgcuuucc

SEQ ID NO: 3890099 - RNA, 18 nt, Shigella flexneri 2a str. 301
ccugucgcuuugacugcu

SEQ ID NO: 3890100 - RNA, 15 nt, Shigella flexneri 2a str. 301
ccugucucucagcac

SEQ ID NO: 3890101 - RNA, 22 nt, Shigella flexneri 2a str. 301
ccugucucucagcacaccauaa

SEQ ID NO: 3890102 - RNA, 15 nt, Shigella flexneri 2a str. 301
ccugucuucccugcu

SEQ ID NO: 3890103 - RNA, 15 nt, Shigella flexneri 2a str. 301
ccugugacaacacuu

SEQ ID NO: 3890104 - RNA, 15 nt, Shigella flexneri 2a str. 301
ccugugacagcagcg

SEQ ID NO: 3890105 - RNA, 22 nt, Shigella flexneri 2a str. 301
ccugugccagcucgugcagaac

SEQ ID NO: 3890106 - RNA, 18 nt, Shigella flexneri 2a str. 301
ccugugccugagccggag

SEQ ID NO: 3890107 - RNA, 13 nt, Shigella flexneri 2a str. 301
ccugugcgcccug

SEQ ID NO: 3890108 - RNA, 18 nt, Shigella flexneri 2a str. 301
ccugugcgcccuguucug

SEQ ID NO: 3890109 - RNA, 22 nt, Shigella flexneri 2a str. 301
ccuguggaacgugcugcauuug

SEQ ID NO: 3890110 - RNA, 18 nt, Shigella flexneri 2a str. 301
ccuguggacgcagcucau

SEQ ID NO: 3890111 - RNA, 18 nt, Shigella flexneri 2a str. 301
ccugugggccgauggcua

SEQ ID NO: 3890112 - RNA, 22 nt, Shigella flexneri 2a str. 301
ccuguuaagaagggcuggccaa

SEQ ID NO: 3890113 - RNA, 13 nt, Shigella flexneri 2a str. 301
ccuguuaugccuc

SEQ ID NO: 3890114 - RNA, 23 nt, Shigella flexneri 2a str. 301
ccuguucaucgacagaacggaua

SEQ ID NO: 3890115 - RNA, 14 nt, Shigella flexneri 2a str. 301
ccuguucgccgccg

SEQ ID NO: 3890116 - RNA, 16 nt, Shigella flexneri 2a str. 301
ccuguucugcgcgcca

SEQ ID NO: 3890117 - RNA, 17 nt, Shigella flexneri 2a str. 301
ccuguugaaaaaccaga

SEQ ID NO: 3890118 - RNA, 16 nt, Shigella flexneri 2a str. 301
ccuguugccauuucug

SEQ ID NO: 3890119 - RNA, 13 nt, Shigella flexneri 2a str. 301
ccuguugcccuuu

SEQ ID NO: 3890120 - RNA, 18 nt, Shigella flexneri 2a str. 301
ccuguugcgucgccgccu

SEQ ID NO: 3890121 - RNA, 16 nt, Shigella flexneri 2a str. 301
ccuguugucuuuccag

SEQ ID NO: 3890122 - RNA, 19 nt, Shigella flexneri 2a str. 301
ccuguugucuuuccagacu

SEQ ID NO: 3890123 - RNA, 17 nt, Shigella flexneri 2a str. 301
ccuguuuagccgcuucu

SEQ ID NO: 3890124 - RNA, 13 nt, Shigella flexneri 2a str. 301
ccuguuuucgauu

SEQ ID NO: 3890125 - RNA, 22 nt, Shigella flexneri 2a str. 301
ccuuaaagcauuuucauccauu

SEQ ID NO: 3890126 - RNA, 16 nt, Shigella flexneri 2a str. 301
ccuuaacgcaaaaucu

SEQ ID NO: 3890127 - RNA, 15 nt, Shigella flexneri 2a str. 301
ccuuaacucuuccug

SEQ ID NO: 3890128 - RNA, 16 nt, Shigella flexneri 2a str. 301
ccuuaacucuuccuga

SEQ ID NO: 3890129 - RNA, 18 nt, Shigella flexneri 2a str. 301
ccuuaaguaugcaauaac

SEQ ID NO: 3890130 - RNA, 22 nt, Shigella flexneri 2a str. 301
ccuuaaguaugcaauaacaaua

SEQ ID NO: 3890131 - RNA, 13 nt, Shigella flexneri 2a str. 301
ccuuaauaaccca

SEQ ID NO: 3890132 - RNA, 18 nt, Shigella flexneri 2a str. 301
ccuuaccccugacgcuua

SEQ ID NO: 3890133 - RNA, 23 nt, Shigella flexneri 2a str. 301
ccuuacccgcgacgcgcuuuuac

SEQ ID NO: 3890134 - RNA, 20 nt, Shigella flexneri 2a str. 301
ccuuacccuuacucacuaaa

SEQ ID NO: 3890135 - RNA, 17 nt, Shigella flexneri 2a str. 301
ccuuacucauaaauacu

SEQ ID NO: 3890136 - RNA, 12 nt, Shigella flexneri 2a str. 301
ccuuacugcccc

SEQ ID NO: 3890137 - RNA, 19 nt, Shigella flexneri 2a str. 301
ccuuacuuacacaucaaga

SEQ ID NO: 3890138 - RNA, 16 nt, Shigella flexneri 2a str. 301
ccuuagcaacaggcca

SEQ ID NO: 3890139 - RNA, 17 nt, Shigella flexneri 2a str. 301
ccuuagccacaaagcag

SEQ ID NO: 3890140 - RNA, 14 nt, Shigella flexneri 2a str. 301
ccuuauccagcaga

SEQ ID NO: 3890141 - RNA, 21 nt, Shigella flexneri 2a str. 301
ccuuucuguuccauaaucgcc

SEQ ID NO: 3890142 - RNA, 18 nt, Shigella flexneri 2a str. 301
ccuuugaaaauaacaucg

SEQ ID NO: 3890143 - RNA, 22 nt, Shigella flexneri 2a str. 301
ccuuugaacaaccagaaagaug

SEQ ID NO: 3890144 - RNA, 13 nt, Shigella flexneri 2a str. 301
ccuuugccaaaau

SEQ ID NO: 3890145 - RNA, 14 nt, Shigella flexneri 2a str. 301
ccuuugccaaaaug

SEQ ID NO: 3890146 - RNA, 16 nt, Shigella flexneri 2a str. 301
ccuuuguaugccuggc

SEQ ID NO: 3890147 - RNA, 16 nt, Shigella flexneri 2a str. 301
ccuuuucaccaugggc

SEQ ID NO: 3890148 - RNA, 23 nt, Shigella flexneri 2a str. 301
ccuuuucaguuggcugacaaagu

SEQ ID NO: 3890149 - RNA, 18 nt, Shigella flexneri 2a str. 301
ccuuuuccauugccgcag

SEQ ID NO: 3890150 - RNA, 22 nt, Shigella flexneri 2a str. 301
ccuuuucgccaccggcaaucug

SEQ ID NO: 3890151 - RNA, 15 nt, Shigella flexneri 2a str. 301
ccuuuugcccggcaa

SEQ ID NO: 3890152 - RNA, 12 nt, Shigella flexneri 2a str. 301
ccuuuugcgcuc

SEQ ID NO: 3890153 - RNA, 15 nt, Shigella flexneri 2a str. 301
ccuuuuggcaaaggu

SEQ ID NO: 3890154 - RNA, 20 nt, Shigella flexneri 2a str. 301
ccuuuuguuuguucuucucg

SEQ ID NO: 3890155 - RNA, 21 nt, Shigella flexneri 2a str. 301
ccuuuuguuuguucuucucga

SEQ ID NO: 3890156 - RNA, 15 nt, Shigella flexneri 2a str. 301
ccuuuuuacccaugg

SEQ ID NO: 3890157 - RNA, 13 nt, Shigella flexneri 2a str. 301
ccuuuuucaagcu

SEQ ID NO: 3890158 - RNA, 13 nt, Shigella flexneri 2a str. 301
ccuuuuucccaaa

SEQ ID NO: 3890159 - RNA, 12 nt, Shigella flexneri 2a str. 301
ccuuuuucuuca

SEQ ID NO: 3890160 - RNA, 15 nt, Shigella flexneri 2a str. 301
ccuuuuuuaaacauu

SEQ ID NO: 3890161 - RNA, 14 nt, Shigella flexneri 2a str. 301
ccuuuuuucagcgg

SEQ ID NO: 3890162 - RNA, 21 nt, Shigella flexneri 2a str. 301
ccuuuuuuugucuguuugcuc

SEQ ID NO: 3890163 - RNA, 13 nt, Shigella flexneri 2a str. 301
cgaaaaaaaagaa

SEQ ID NO: 3890164 - RNA, 13 nt, Shigella flexneri 2a str. 301
cgaaaaaagggca

SEQ ID NO: 3890165 - RNA, 20 nt, Shigella flexneri 2a str. 301
cgaaaaaagucauuaccagc

SEQ ID NO: 3890166 - RNA, 14 nt, Shigella flexneri 2a str. 301
cgaaaaaugaauac

SEQ ID NO: 3890167 - RNA, 16 nt, Shigella flexneri 2a str. 301
cgaaaacaacuggcaa

SEQ ID NO: 3890168 - RNA, 21 nt, Shigella flexneri 2a str. 301
cgaaaacgccaccgcgccggg

SEQ ID NO: 3890169 - RNA, 16 nt, Shigella flexneri 2a str. 301
cgaaaagcuucuuccu

SEQ ID NO: 3890170 - RNA, 17 nt, Shigella flexneri 2a str. 301
cgaaacagggcuggaag

SEQ ID NO: 3890171 - RNA, 17 nt, Shigella flexneri 2a str. 301
cgaaacccgcugccauc

SEQ ID NO: 3890172 - RNA, 15 nt, Shigella flexneri 2a str. 301
cgaaaccgcgcagcg

SEQ ID NO: 3890173 - RNA, 16 nt, Shigella flexneri 2a str. 301
cgaaacgccugcaauu

SEQ ID NO: 3890174 - RNA, 21 nt, Shigella flexneri 2a str. 301
cgaaacgggcugauuucaccc

SEQ ID NO: 3890175 - RNA, 12 nt, Shigella flexneri 2a str. 301
cgaaacguucca

SEQ ID NO: 3890176 - RNA, 16 nt, Shigella flexneri 2a str. 301
cgaaagagcuggcgaa

SEQ ID NO: 3890177 - RNA, 21 nt, Shigella flexneri 2a str. 301
cgaaagaggcgcagaugaagc

SEQ ID NO: 3890178 - RNA, 17 nt, Shigella flexneri 2a str. 301
cgaaagcgucagcuuuc

SEQ ID NO: 3890179 - RNA, 19 nt, Shigella flexneri 2a str. 301
cgaaaguaacaccauccau

SEQ ID NO: 3890180 - RNA, 12 nt, Shigella flexneri 2a str. 301
cgaaaguaccau

SEQ ID NO: 3890181 - RNA, 14 nt, Shigella flexneri 2a str. 301
cgaaauaacugaau

SEQ ID NO: 3890182 - RNA, 18 nt, Shigella flexneri 2a str. 301
cgaaauaaucaaaugaau

SEQ ID NO: 3890183 - RNA, 22 nt, Shigella flexneri 2a str. 301
cgaaauacagguccccgcuucg

SEQ ID NO: 3890184 - RNA, 19 nt, Shigella flexneri 2a str. 301
cgaaaucaccgccaccagc

SEQ ID NO: 3890185 - RNA, 20 nt, Shigella flexneri 2a str. 301
cgaaaucaccgccaccagcg

SEQ ID NO: 3890186 - RNA, 19 nt, Shigella flexneri 2a str. 301
cgaaauccauguugcugga

SEQ ID NO: 3890187 - RNA, 21 nt, Shigella flexneri 2a str. 301
cgaaaucccuucguucucugc

SEQ ID NO: 3890188 - RNA, 12 nt, Shigella flexneri 2a str. 301
cgaaaucgccau

SEQ ID NO: 3890189 - RNA, 13 nt, Shigella flexneri 2a str. 301
cgaaaucgccauu

SEQ ID NO: 3890190 - RNA, 15 nt, Shigella flexneri 2a str. 301
cgaaaucgccuuugg

SEQ ID NO: 3890191 - RNA, 19 nt, Shigella flexneri 2a str. 301
cgaaaugacaguaucguga

SEQ ID NO: 3890192 - RNA, 14 nt, Shigella flexneri 2a str. 301
cgaaauuauggugu

SEQ ID NO: 3890193 - RNA, 22 nt, Shigella flexneri 2a str. 301
cgaaauuuugcaacguccugca

SEQ ID NO: 3890194 - RNA, 12 nt, Shigella flexneri 2a str. 301
cgaacaaaacca

SEQ ID NO: 3890195 - RNA, 21 nt, Shigella flexneri 2a str. 301
cgaacaccagcaguaaaccac

SEQ ID NO: 3890196 - RNA, 14 nt, Shigella flexneri 2a str. 301
cgaacagaccaaac

SEQ ID NO: 3890197 - RNA, 14 nt, Shigella flexneri 2a str. 301
cgaacagcagcagg

SEQ ID NO: 3890198 - RNA, 15 nt, Shigella flexneri 2a str. 301
cgaacagcagcaggu

SEQ ID NO: 3890199 - RNA, 14 nt, Shigella flexneri 2a str. 301
cgaacaggauugcc

SEQ ID NO: 3890200 - RNA, 15 nt, Shigella flexneri 2a str. 301
cgaacaggccgacug

SEQ ID NO: 3890201 - RNA, 20 nt, Shigella flexneri 2a str. 301
cgaacaggccgacuggcaug

SEQ ID NO: 3890202 - RNA, 19 nt, Shigella flexneri 2a str. 301
cgaacagguugcccagcgc

SEQ ID NO: 3890203 - RNA, 21 nt, Shigella flexneri 2a str. 301
cgaacagguugcccagcgcgc

SEQ ID NO: 3890204 - RNA, 22 nt, Shigella flexneri 2a str. 301
cgaacagguugcccagcgcgcc

SEQ ID NO: 3890205 - RNA, 17 nt, Shigella flexneri 2a str. 301
cgaacagguugguaucg

SEQ ID NO: 3890206 - RNA, 22 nt, Shigella flexneri 2a str. 301
cgaacaguucaacgccgcuauc

SEQ ID NO: 3890207 - RNA, 24 nt, Shigella flexneri 2a str. 301
cgaacauauucgauacauucagaa

SEQ ID NO: 3890208 - RNA, 18 nt, Shigella flexneri 2a str. 301
cgaaccaccaaacugcgc

SEQ ID NO: 3890209 - RNA, 12 nt, Shigella flexneri 2a str. 301
cgaaccagcgga

SEQ ID NO: 3890210 - RNA, 22 nt, Shigella flexneri 2a str. 301
cgaaccaucaccucuucagcgu

SEQ ID NO: 3890211 - RNA, 12 nt, Shigella flexneri 2a str. 301
cgaaccggaaca

SEQ ID NO: 3890212 - RNA, 15 nt, Shigella flexneri 2a str. 301
cgaaccggaacauca

SEQ ID NO: 3890213 - RNA, 22 nt, Shigella flexneri 2a str. 301
cgaaccggaccagcaacaaaua

SEQ ID NO: 3890214 - RNA, 23 nt, Shigella flexneri 2a str. 301
cgaaccggacgaucccaaccauu

SEQ ID NO: 3890215 - RNA, 16 nt, Shigella flexneri 2a str. 301
cgaaccguaggccgga

SEQ ID NO: 3890216 - RNA, 16 nt, Shigella flexneri 2a str. 301
cgaaccucggaaugcc

SEQ ID NO: 3890217 - RNA, 18 nt, Shigella flexneri 2a str. 301
cgaaccuucgaagucgau

SEQ ID NO: 3890218 - RNA, 21 nt, Shigella flexneri 2a str. 301
cgaacgcagugauaacucaaa

SEQ ID NO: 3890219 - RNA, 15 nt, Shigella flexneri 2a str. 301
cgaacgccucugcaa

SEQ ID NO: 3890220 - RNA, 18 nt, Shigella flexneri 2a str. 301
cgaacgccuucgccaucu

SEQ ID NO: 3890221 - RNA, 16 nt, Shigella flexneri 2a str. 301
cgaacgcuaugacgcc

SEQ ID NO: 3890222 - RNA, 10 nt, Shigella flexneri 2a str. 301
cgaacgcugc

SEQ ID NO: 3890223 - RNA, 22 nt, Shigella flexneri 2a str. 301
cgaacggcgcgguuuccaccuu

SEQ ID NO: 3890224 - RNA, 16 nt, Shigella flexneri 2a str. 301
cgaacggcuguugaug

SEQ ID NO: 3890225 - RNA, 22 nt, Shigella flexneri 2a str. 301
cgaacgggauaaacgaaaugcg

SEQ ID NO: 3890226 - RNA, 16 nt, Shigella flexneri 2a str. 301
cgaacguccagccagg

SEQ ID NO: 3890227 - RNA, 16 nt, Shigella flexneri 2a str. 301
cgaacuaaccgcgcuc

SEQ ID NO: 3890228 - RNA, 15 nt, Shigella flexneri 2a str. 301
cgaacuauuaaaauu

SEQ ID NO: 3890229 - RNA, 18 nt, Shigella flexneri 2a str. 301
cgaacucauacaccagcg

SEQ ID NO: 3890230 - RNA, 19 nt, Shigella flexneri 2a str. 301
cgaacuccgccccggcaau

SEQ ID NO: 3890231 - RNA, 15 nt, Shigella flexneri 2a str. 301
cgaacucuuccggca

SEQ ID NO: 3890232 - RNA, 21 nt, Shigella flexneri 2a str. 301
cgaacuggaugaaaaaauccc

SEQ ID NO: 3890233 - RNA, 15 nt, Shigella flexneri 2a str. 301
cgaacuguaaugaau

SEQ ID NO: 3890234 - RNA, 13 nt, Shigella flexneri 2a str. 301
cgaagaaagcaau

SEQ ID NO: 3890235 - RNA, 22 nt, Shigella flexneri 2a str. 301
cgaagacaucgcagggaucauc

SEQ ID NO: 3890236 - RNA, 13 nt, Shigella flexneri 2a str. 301
cgaagacgugcgc

SEQ ID NO: 3890237 - RNA, 16 nt, Shigella flexneri 2a str. 301
cgaagagacaaaaaag

SEQ ID NO: 3890238 - RNA, 16 nt, Shigella flexneri 2a str. 301
cgaagagagcgccaga

SEQ ID NO: 3890239 - RNA, 18 nt, Shigella flexneri 2a str. 301
cgaagagagcgccagaag

SEQ ID NO: 3890240 - RNA, 22 nt, Shigella flexneri 2a str. 301
cgaagauggcauacaacgccau

SEQ ID NO: 3890241 - RNA, 15 nt, Shigella flexneri 2a str. 301
cgacccgcgacuggu

SEQ ID NO: 3890242 - RNA, 17 nt, Shigella flexneri 2a str. 301
cgaccgaacagaucacg

SEQ ID NO: 3890243 - RNA, 19 nt, Shigella flexneri 2a str. 301
cgaccgccucgcgccagcg

SEQ ID NO: 3890244 - RNA, 21 nt, Shigella flexneri 2a str. 301
cgaccgcguuuugucgcgcca

SEQ ID NO: 3890245 - RNA, 19 nt, Shigella flexneri 2a str. 301
cgaccggcguaacggccac

SEQ ID NO: 3890246 - RNA, 17 nt, Shigella flexneri 2a str. 301
cgaccggguuagucugg

SEQ ID NO: 3890247 - RNA, 15 nt, Shigella flexneri 2a str. 301
cgaccguuccauuca

SEQ ID NO: 3890248 - RNA, 19 nt, Shigella flexneri 2a str. 301
cgaccuaaacguuuaaaaa

SEQ ID NO: 3890249 - RNA, 21 nt, Shigella flexneri 2a str. 301
cgaccuguaccuucagcggca

SEQ ID NO: 3890250 - RNA, 14 nt, Shigella flexneri 2a str. 301
cgaccuugcaauaa

SEQ ID NO: 3890251 - RNA, 15 nt, Shigella flexneri 2a str. 301
cgacgaacagcucag

SEQ ID NO: 3890252 - RNA, 12 nt, Shigella flexneri 2a str. 301
cgacgaagaaac

SEQ ID NO: 3890253 - RNA, 14 nt, Shigella flexneri 2a str. 301
cgacgacaggcaag

SEQ ID NO: 3890254 - RNA, 13 nt, Shigella flexneri 2a str. 301
cgacgaccaccga

SEQ ID NO: 3890255 - RNA, 20 nt, Shigella flexneri 2a str. 301
cgacgacugccgcucaccug

SEQ ID NO: 3890256 - RNA, 21 nt, Shigella flexneri 2a str. 301
cgacgagcgcuggugacaucg

SEQ ID NO: 3890257 - RNA, 15 nt, Shigella flexneri 2a str. 301
cgacgaugaucaagc

SEQ ID NO: 3890258 - RNA, 12 nt, Shigella flexneri 2a str. 301
cgacgauugcuu

SEQ ID NO: 3890259 - RNA, 20 nt, Shigella flexneri 2a str. 301
cgacgcaaacgacgagcgcu

SEQ ID NO: 3890260 - RNA, 23 nt, Shigella flexneri 2a str. 301
cgacgcgcuuuuacugcauucac

SEQ ID NO: 3890261 - RNA, 14 nt, Shigella flexneri 2a str. 301
cgacgcuuaacgcg

SEQ ID NO: 3890262 - RNA, 14 nt, Shigella flexneri 2a str. 301
cgacggccagucau

SEQ ID NO: 3890263 - RNA, 19 nt, Shigella flexneri 2a str. 301
cgacggcgaaucaaccgcg

SEQ ID NO: 3890264 - RNA, 17 nt, Shigella flexneri 2a str. 301
cgacgggauucgaaccu

SEQ ID NO: 3890265 - RNA, 11 nt, Shigella flexneri 2a str. 301
cgacgggcgac

SEQ ID NO: 3890266 - RNA, 13 nt, Shigella flexneri 2a str. 301
cgacguaaaaaac

SEQ ID NO: 3890267 - RNA, 13 nt, Shigella flexneri 2a str. 301
cgacguaauuuag

SEQ ID NO: 3890268 - RNA, 14 nt, Shigella flexneri 2a str. 301
cgacguaccagcgu

SEQ ID NO: 3890269 - RNA, 17 nt, Shigella flexneri 2a str. 301
cgacgucaguuuccagc

SEQ ID NO: 3890270 - RNA, 18 nt, Shigella flexneri 2a str. 301
cgacgucaguuuccagca

SEQ ID NO: 3890271 - RNA, 16 nt, Shigella flexneri 2a str. 301
cgacgugaccuuucag

SEQ ID NO: 3890272 - RNA, 11 nt, Shigella flexneri 2a str. 301
cgacgugcugg

SEQ ID NO: 3890273 - RNA, 18 nt, Shigella flexneri 2a str. 301
cgacguucugccaaacgc

SEQ ID NO: 3890274 - RNA, 19 nt, Shigella flexneri 2a str. 301
cgacguuugcgcccagcca

SEQ ID NO: 3890275 - RNA, 20 nt, Shigella flexneri 2a str. 301
cgacguuugcgcccagccag

SEQ ID NO: 3890276 - RNA, 16 nt, Shigella flexneri 2a str. 301
cgacguuuuacagcaa

SEQ ID NO: 3890277 - RNA, 17 nt, Shigella flexneri 2a str. 301
cgacuaacuuuacucuu

SEQ ID NO: 3890278 - RNA, 20 nt, Shigella flexneri 2a str. 301
cgacuacaggacaucuugaa

SEQ ID NO: 3890279 - RNA, 18 nt, Shigella flexneri 2a str. 301
cgacuacgggcaccagua

SEQ ID NO: 3890280 - RNA, 19 nt, Shigella flexneri 2a str. 301
cgacuacgggcaccaguaa

SEQ ID NO: 3890281 - RNA, 15 nt, Shigella flexneri 2a str. 301
cgacucaaaucacgc

SEQ ID NO: 3890282 - RNA, 16 nt, Shigella flexneri 2a str. 301
cgacucaaaucacgca

SEQ ID NO: 3890283 - RNA, 17 nt, Shigella flexneri 2a str. 301
cgacucaaccccagcca

SEQ ID NO: 3890284 - RNA, 19 nt, Shigella flexneri 2a str. 301
cgacucgcaauuauaauac

SEQ ID NO: 3890285 - RNA, 13 nt, Shigella flexneri 2a str. 301
cgacucgccauua

SEQ ID NO: 3890286 - RNA, 23 nt, Shigella flexneri 2a str. 301
cgacugauugaacuguggcgcga

SEQ ID NO: 3890287 - RNA, 20 nt, Shigella flexneri 2a str. 301
cgacugcaaaccaugacgca

SEQ ID NO: 3890288 - RNA, 15 nt, Shigella flexneri 2a str. 301
cgacugcccgcgagc

SEQ ID NO: 3890289 - RNA, 14 nt, Shigella flexneri 2a str. 301
cgacugccgcucac

SEQ ID NO: 3890290 - RNA, 15 nt, Shigella flexneri 2a str. 301
cgacugccgcucacc

SEQ ID NO: 3890291 - RNA, 16 nt, Shigella flexneri 2a str. 301
cgacugccgcucaccu

SEQ ID NO: 3890292 - RNA, 16 nt, Shigella flexneri 2a str. 301
cgacugcgccaauacc

SEQ ID NO: 3890293 - RNA, 18 nt, Shigella flexneri 2a str. 301
cgacuggcccggcgaugg

SEQ ID NO: 3890294 - RNA, 20 nt, Shigella flexneri 2a str. 301
cgacugucaacucuggcaug

SEQ ID NO: 3890295 - RNA, 18 nt, Shigella flexneri 2a str. 301
cgacuuauucuucaacaa

SEQ ID NO: 3890296 - RNA, 23 nt, Shigella flexneri 2a str. 301
cgacuucagauaaaucacgcuuc

SEQ ID NO: 3890297 - RNA, 15 nt, Shigella flexneri 2a str. 301
cgacuucaucgccaa

SEQ ID NO: 3890298 - RNA, 18 nt, Shigella flexneri 2a str. 301
cgacuucgauguccgcuc

SEQ ID NO: 3890299 - RNA, 10 nt, Shigella flexneri 2a str. 301
cgacuucugu

SEQ ID NO: 3890300 - RNA, 21 nt, Shigella flexneri 2a str. 301
cgacuucuucauucauccgcc

SEQ ID NO: 3890301 - RNA, 16 nt, Shigella flexneri 2a str. 301
cgacuucuucccacca

SEQ ID NO: 3890302 - RNA, 14 nt, Shigella flexneri 2a str. 301
cgacuuugccuggc

SEQ ID NO: 3890303 - RNA, 16 nt, Shigella flexneri 2a str. 301
cgacuuuggugccgug

SEQ ID NO: 3890304 - RNA, 13 nt, Shigella flexneri 2a str. 301
cgacuuuuuccug

SEQ ID NO: 3890305 - RNA, 13 nt, Shigella flexneri 2a str. 301
cgagaaacgcuuu

SEQ ID NO: 3890306 - RNA, 21 nt, Shigella flexneri 2a str. 301
cgagaaacuucacaucaccau

SEQ ID NO: 3890307 - RNA, 20 nt, Shigella flexneri 2a str. 301
cgagaacgacauggcccagc

SEQ ID NO: 3890308 - RNA, 19 nt, Shigella flexneri 2a str. 301
cgagaacucggaagcagcg

SEQ ID NO: 3890309 - RNA, 14 nt, Shigella flexneri 2a str. 301
cgagaagagaggcg

SEQ ID NO: 3890310 - RNA, 19 nt, Shigella flexneri 2a str. 301
cgagaagcagcaacacaau

SEQ ID NO: 3890311 - RNA, 16 nt, Shigella flexneri 2a str. 301
cgagaauaaaacaggc

SEQ ID NO: 3890312 - RNA, 23 nt, Shigella flexneri 2a str. 301
cgagaauaaaacaggcagcugcc

SEQ ID NO: 3890313 - RNA, 16 nt, Shigella flexneri 2a str. 301
cgagaauauuuccagu

SEQ ID NO: 3890314 - RNA, 22 nt, Shigella flexneri 2a str. 301
cgagacgguuaaaaacagccag

SEQ ID NO: 3890315 - RNA, 23 nt, Shigella flexneri 2a str. 301
cgagacgguuaaaaacagccagc

SEQ ID NO: 3890316 - RNA, 14 nt, Shigella flexneri 2a str. 301
cgagacugcgcgcc

SEQ ID NO: 3890317 - RNA, 23 nt, Shigella flexneri 2a str. 301
cgagagaauggggucagcaggug

SEQ ID NO: 3890318 - RNA, 21 nt, Shigella flexneri 2a str. 301
cgagagcaaugcgcaucaaag

SEQ ID NO: 3890319 - RNA, 14 nt, Shigella flexneri 2a str. 301
cgagaguaacacau

SEQ ID NO: 3890320 - RNA, 19 nt, Shigella flexneri 2a str. 301
cgagauaaccccgcuugcu

SEQ ID NO: 3890321 - RNA, 23 nt, Shigella flexneri 2a str. 301
cgagauaaugguuuccagcaucg

SEQ ID NO: 3890322 - RNA, 13 nt, Shigella flexneri 2a str. 301
cgagauaauguuc

SEQ ID NO: 3890323 - RNA, 17 nt, Shigella flexneri 2a str. 301
cgagauaccuaacauuu

SEQ ID NO: 3890324 - RNA, 22 nt, Shigella flexneri 2a str. 301
cgagauccggaucccaccagac

SEQ ID NO: 3890325 - RNA, 15 nt, Shigella flexneri 2a str. 301
cgagaucggccagca

SEQ ID NO: 3890326 - RNA, 16 nt, Shigella flexneri 2a str. 301
cgagaucggccagcac

SEQ ID NO: 3890327 - RNA, 23 nt, Shigella flexneri 2a str. 301
cgagaucuuuaucaaucaccgcu

SEQ ID NO: 3890328 - RNA, 17 nt, Shigella flexneri 2a str. 301
cgagauuagacggcgca

SEQ ID NO: 3890329 - RNA, 16 nt, Shigella flexneri 2a str. 301
cgagcacgacuuucuc

SEQ ID NO: 3890330 - RNA, 12 nt, Shigella flexneri 2a str. 301
cgagcagccacu

SEQ ID NO: 3890331 - RNA, 24 nt, Shigella flexneri 2a str. 301
cgagcaggucagucaguggcagca

SEQ ID NO: 3890332 - RNA, 14 nt, Shigella flexneri 2a str. 301
cgagcaguacagcc

SEQ ID NO: 3890333 - RNA, 22 nt, Shigella flexneri 2a str. 301
cgagcaguacagccgccagaca

SEQ ID NO: 3890334 - RNA, 16 nt, Shigella flexneri 2a str. 301
cgagcauugccagcau

SEQ ID NO: 3890335 - RNA, 20 nt, Shigella flexneri 2a str. 301
cgagccagcgcauccuggcu

SEQ ID NO: 3890336 - RNA, 18 nt, Shigella flexneri 2a str. 301
cgagccauaaacugagcc

SEQ ID NO: 3890337 - RNA, 18 nt, Shigella flexneri 2a str. 301
cgagcccagaugccggau

SEQ ID NO: 3890338 - RNA, 22 nt, Shigella flexneri 2a str. 301
cgagccguuccuaacaugccac

SEQ ID NO: 3890339 - RNA, 17 nt, Shigella flexneri 2a str. 301
cgagcgacucgaaggcc

SEQ ID NO: 3890340 - RNA, 17 nt, Shigella flexneri 2a str. 301
cgagcgauacaucauca

SEQ ID NO: 3890341 - RNA, 22 nt, Shigella flexneri 2a str. 301
cgaucgcuuucgcuuucucuuc

SEQ ID NO: 3890342 - RNA, 17 nt, Shigella flexneri 2a str. 301
cgaucggcagcugucau

SEQ ID NO: 3890343 - RNA, 13 nt, Shigella flexneri 2a str. 301
cgaucgucugggc

SEQ ID NO: 3890344 - RNA, 23 nt, Shigella flexneri 2a str. 301
cgaucgugauacaacugccgcgc

SEQ ID NO: 3890345 - RNA, 21 nt, Shigella flexneri 2a str. 301
cgaucuaggaucgggcauuuu

SEQ ID NO: 3890346 - RNA, 19 nt, Shigella flexneri 2a str. 301
cgaucucuucgccugccug

SEQ ID NO: 3890347 - RNA, 19 nt, Shigella flexneri 2a str. 301
cgaucugcgcgucauuuuc

SEQ ID NO: 3890348 - RNA, 17 nt, Shigella flexneri 2a str. 301
cgaucuuccacgccugc

SEQ ID NO: 3890349 - RNA, 23 nt, Shigella flexneri 2a str. 301
cgaucuugcgaccgcucuuuuuu

SEQ ID NO: 3890350 - RNA, 14 nt, Shigella flexneri 2a str. 301
cgaugaaacguguu

SEQ ID NO: 3890351 - RNA, 21 nt, Shigella flexneri 2a str. 301
cgaugaauagcauguuccagu

SEQ ID NO: 3890352 - RNA, 19 nt, Shigella flexneri 2a str. 301
cgaugaccuugucaugcag

SEQ ID NO: 3890353 - RNA, 22 nt, Shigella flexneri 2a str. 301
cgaugaccuugucaugcagcuc

SEQ ID NO: 3890354 - RNA, 17 nt, Shigella flexneri 2a str. 301
cgaugacuguacagauc

SEQ ID NO: 3890355 - RNA, 17 nt, Shigella flexneri 2a str. 301
cgaugaucgucacgauc

SEQ ID NO: 3890356 - RNA, 18 nt, Shigella flexneri 2a str. 301
cgaugaucgucacgaucg

SEQ ID NO: 3890357 - RNA, 21 nt, Shigella flexneri 2a str. 301
cgaugcagcguuugcuguucc

SEQ ID NO: 3890358 - RNA, 21 nt, Shigella flexneri 2a str. 301
cgaugcagguuggcgacguca

SEQ ID NO: 3890359 - RNA, 14 nt, Shigella flexneri 2a str. 301
cgaugccaguaauc

SEQ ID NO: 3890360 - RNA, 21 nt, Shigella flexneri 2a str. 301
cgaugccagucgcacgccugg

SEQ ID NO: 3890361 - RNA, 23 nt, Shigella flexneri 2a str. 301
cgaugcgaucauuaacaccacgc

SEQ ID NO: 3890362 - RNA, 21 nt, Shigella flexneri 2a str. 301
cgaugcgggauucccccaggc

SEQ ID NO: 3890363 - RNA, 13 nt, Shigella flexneri 2a str. 301
cgaugcuaaaaac

SEQ ID NO: 3890364 - RNA, 21 nt, Shigella flexneri 2a str. 301
cgaugcuaaaaacaucaugau

SEQ ID NO: 3890365 - RNA, 22 nt, Shigella flexneri 2a str. 301
cgaugcugauguacccgcugca

SEQ ID NO: 3890366 - RNA, 20 nt, Shigella flexneri 2a str. 301
cgaugcugauuuuggucaug

SEQ ID NO: 3890367 - RNA, 19 nt, Shigella flexneri 2a str. 301
cgaugcuuugaccucccgc

SEQ ID NO: 3890368 - RNA, 19 nt, Shigella flexneri 2a str. 301
cgauggaaccguacagcau

SEQ ID NO: 3890369 - RNA, 14 nt, Shigella flexneri 2a str. 301
cgauggcaucacca

SEQ ID NO: 3890370 - RNA, 13 nt, Shigella flexneri 2a str. 301
cgauggccaacca

SEQ ID NO: 3890371 - RNA, 14 nt, Shigella flexneri 2a str. 301
cgauggcccgcuug

SEQ ID NO: 3890372 - RNA, 19 nt, Shigella flexneri 2a str. 301
cgauggcccgcuugccaga

SEQ ID NO: 3890373 - RNA, 12 nt, Shigella flexneri 2a str. 301
cgauggcugggg

SEQ ID NO: 3890374 - RNA, 13 nt, Shigella flexneri 2a str. 301
cgauggcuggggu

SEQ ID NO: 3890375 - RNA, 18 nt, Shigella flexneri 2a str. 301
cgauggucagcuucaccu

SEQ ID NO: 3890376 - RNA, 18 nt, Shigella flexneri 2a str. 301
cgauggucuggcgacggc

SEQ ID NO: 3890377 - RNA, 12 nt, Shigella flexneri 2a str. 301
cgauggucuguu

SEQ ID NO: 3890378 - RNA, 17 nt, Shigella flexneri 2a str. 301
cgauggugaugagcuga

SEQ ID NO: 3890379 - RNA, 13 nt, Shigella flexneri 2a str. 301
cgauggugcacga

SEQ ID NO: 3890380 - RNA, 16 nt, Shigella flexneri 2a str. 301
cgauggugguggggga

SEQ ID NO: 3890381 - RNA, 19 nt, Shigella flexneri 2a str. 301
cgaugguugcccugcuggu

SEQ ID NO: 3890382 - RNA, 23 nt, Shigella flexneri 2a str. 301
cgaugguugucacugcaucuucc

SEQ ID NO: 3890383 - RNA, 19 nt, Shigella flexneri 2a str. 301
cgauguacuucaacauaac

SEQ ID NO: 3890384 - RNA, 16 nt, Shigella flexneri 2a str. 301
cgauguaggccugaua

SEQ ID NO: 3890385 - RNA, 23 nt, Shigella flexneri 2a str. 301
cgauguccagacgcgcagcuuca

SEQ ID NO: 3890386 - RNA, 18 nt, Shigella flexneri 2a str. 301
cgaugucgcccacuuuca

SEQ ID NO: 3890387 - RNA, 19 nt, Shigella flexneri 2a str. 301
cgaugugaacccugauuuc

SEQ ID NO: 3890388 - RNA, 18 nt, Shigella flexneri 2a str. 301
cgauguucccccagccag

SEQ ID NO: 3890389 - RNA, 14 nt, Shigella flexneri 2a str. 301
cgauguuugcugcg

SEQ ID NO: 3890390 - RNA, 16 nt, Shigella flexneri 2a str. 301
cgauguuuucugccuc

SEQ ID NO: 3890391 - RNA, 17 nt, Shigella flexneri 2a str. 301
cgauuaaaaacccugca

SEQ ID NO: 3890392 - RNA, 19 nt, Shigella flexneri 2a str. 301
cgauuaaauucaccaguuu

SEQ ID NO: 3890393 - RNA, 15 nt, Shigella flexneri 2a str. 301
cgauuagcagcauga

SEQ ID NO: 3890394 - RNA, 18 nt, Shigella flexneri 2a str. 301
cgauuauagcuaacucua

SEQ ID NO: 3890395 - RNA, 13 nt, Shigella flexneri 2a str. 301
cgauuaucgccau

SEQ ID NO: 3890396 - RNA, 14 nt, Shigella flexneri 2a str. 301
cgauuauuuauucc

SEQ ID NO: 3890397 - RNA, 19 nt, Shigella flexneri 2a str. 301
cgauucaaaagaugagaaa

SEQ ID NO: 3890398 - RNA, 13 nt, Shigella flexneri 2a str. 301
cgauucaacagua

SEQ ID NO: 3890399 - RNA, 17 nt, Shigella flexneri 2a str. 301
cgauucacauaacggcc

SEQ ID NO: 3890400 - RNA, 17 nt, Shigella flexneri 2a str. 301
cgauucacauuuaaaca

SEQ ID NO: 3890401 - RNA, 20 nt, Shigella flexneri 2a str. 301
cgauucccagucauccggcu

SEQ ID NO: 3890402 - RNA, 17 nt, Shigella flexneri 2a str. 301
cgauucgcccugcauau

SEQ ID NO: 3890403 - RNA, 21 nt, Shigella flexneri 2a str. 301
cgauucgguucaauacccacu

SEQ ID NO: 3890404 - RNA, 22 nt, Shigella flexneri 2a str. 301
cgauucguuuggggguaaccca

SEQ ID NO: 3890405 - RNA, 23 nt, Shigella flexneri 2a str. 301
cgauugauuuaucagguauugau

SEQ ID NO: 3890406 - RNA, 14 nt, Shigella flexneri 2a str. 301
cgauugccggaugc

SEQ ID NO: 3890407 - RNA, 15 nt, Shigella flexneri 2a str. 301
cgauugcucaacgcc

SEQ ID NO: 3890408 - RNA, 18 nt, Shigella flexneri 2a str. 301
cgauuguaaucacauucg

SEQ ID NO: 3890409 - RNA, 19 nt, Shigella flexneri 2a str. 301
cgauuguauacgcuggcgg

SEQ ID NO: 3890410 - RNA, 19 nt, Shigella flexneri 2a str. 301
cgauugucguguuaagccg

SEQ ID NO: 3890411 - RNA, 20 nt, Shigella flexneri 2a str. 301
cgauugugcuggugauugcc

SEQ ID NO: 3890412 - RNA, 14 nt, Shigella flexneri 2a str. 301
cgauuuaucgauuu

SEQ ID NO: 3890413 - RNA, 19 nt, Shigella flexneri 2a str. 301
cgauuuaugauauuuuuuu

SEQ ID NO: 3890414 - RNA, 21 nt, Shigella flexneri 2a str. 301
cgauuucaaccacucacgaua

SEQ ID NO: 3890415 - RNA, 11 nt, Shigella flexneri 2a str. 301
cgauuucacaa

SEQ ID NO: 3890416 - RNA, 16 nt, Shigella flexneri 2a str. 301
cgauuucaucgcccag

SEQ ID NO: 3890417 - RNA, 16 nt, Shigella flexneri 2a str. 301
cgauuuccaucuccag

SEQ ID NO: 3890418 - RNA, 15 nt, Shigella flexneri 2a str. 301
cgauuucucagcaga

SEQ ID NO: 3890419 - RNA, 15 nt, Shigella flexneri 2a str. 301
cgauuucuuuauccg

SEQ ID NO: 3890420 - RNA, 13 nt, Shigella flexneri 2a str. 301
cgauuuugaaguc

SEQ ID NO: 3890421 - RNA, 18 nt, Shigella flexneri 2a str. 301
cgauuuugccagccgcag

SEQ ID NO: 3890422 - RNA, 13 nt, Shigella flexneri 2a str. 301
cgauuuuguaaaa

SEQ ID NO: 3890423 - RNA, 16 nt, Shigella flexneri 2a str. 301
cgauuuuguaaaagaa

SEQ ID NO: 3890424 - RNA, 13 nt, Shigella flexneri 2a str. 301
cgauuuuuuccag

SEQ ID NO: 3890425 - RNA, 14 nt, Shigella flexneri 2a str. 301
cgauuuuuuccagc

SEQ ID NO: 3890426 - RNA, 16 nt, Shigella flexneri 2a str. 301
cgauuuuuuccagcgc

SEQ ID NO: 3890427 - RNA, 12 nt, Shigella flexneri 2a str. 301
cgcaaaacccag

SEQ ID NO: 3890428 - RNA, 17 nt, Shigella flexneri 2a str. 301
cgcaaaaccucuuccag

SEQ ID NO: 3890429 - RNA, 18 nt, Shigella flexneri 2a str. 301
cgcaaaaccucuuccagc

SEQ ID NO: 3890430 - RNA, 18 nt, Shigella flexneri 2a str. 301
cgcaaaacguggccucca

SEQ ID NO: 3890431 - RNA, 21 nt, Shigella flexneri 2a str. 301
cgcaaaacugccugaugcgcu

SEQ ID NO: 3890432 - RNA, 18 nt, Shigella flexneri 2a str. 301
cgcaaaauaccagcaauu

SEQ ID NO: 3890433 - RNA, 18 nt, Shigella flexneri 2a str. 301
cgcaaaaucucacacuca

SEQ ID NO: 3890434 - RNA, 16 nt, Shigella flexneri 2a str. 301
cgcaaaauucacgcca

SEQ ID NO: 3890435 - RNA, 14 nt, Shigella flexneri 2a str. 301
cgcaaacaggcgca

SEQ ID NO: 3890436 - RNA, 20 nt, Shigella flexneri 2a str. 301
cgcaaacaguacaucuucca

SEQ ID NO: 3890437 - RNA, 20 nt, Shigella flexneri 2a str. 301
cgcaaacagugaccaucuuc

SEQ ID NO: 3890438 - RNA, 19 nt, Shigella flexneri 2a str. 301
cgcaaaccuggcaacaauc

SEQ ID NO: 3890439 - RNA, 16 nt, Shigella flexneri 2a str. 301
cgcaaacgcccgucca

SEQ ID NO: 3890440 - RNA, 20 nt, Shigella flexneri 2a str. 301
cgcaaacguggggugaauaa

SEQ ID NO: 3890441 - RNA, 17 nt, Shigella flexneri 2a str. 301
cgcagccaucagcgaga

SEQ ID NO: 3890442 - RNA, 13 nt, Shigella flexneri 2a str. 301
cgcagcgcaagcu

SEQ ID NO: 3890443 - RNA, 18 nt, Shigella flexneri 2a str. 301
cgcagcgguuucacagga

SEQ ID NO: 3890444 - RNA, 20 nt, Shigella flexneri 2a str. 301
cgcagcgucagcaccagaga

SEQ ID NO: 3890445 - RNA, 17 nt, Shigella flexneri 2a str. 301
cgcagcucacuucgauc

SEQ ID NO: 3890446 - RNA, 17 nt, Shigella flexneri 2a str. 301
cgcagcucaucaacacg

SEQ ID NO: 3890447 - RNA, 22 nt, Shigella flexneri 2a str. 301
cgcagcuccgggcucaugcugu

SEQ ID NO: 3890448 - RNA, 15 nt, Shigella flexneri 2a str. 301
cgcagcucuggcaua

SEQ ID NO: 3890449 - RNA, 12 nt, Shigella flexneri 2a str. 301
cgcagcugaccu

SEQ ID NO: 3890450 - RNA, 13 nt, Shigella flexneri 2a str. 301
cgcagcugagaaa

SEQ ID NO: 3890451 - RNA, 21 nt, Shigella flexneri 2a str. 301
cgcagcugagaaaaagcgaag

SEQ ID NO: 3890452 - RNA, 19 nt, Shigella flexneri 2a str. 301
cgcagcugcgcguuaucua

SEQ ID NO: 3890453 - RNA, 22 nt, Shigella flexneri 2a str. 301
cgcagcugguguaacugcgcca

SEQ ID NO: 3890454 - RNA, 12 nt, Shigella flexneri 2a str. 301
cgcagcuucucg

SEQ ID NO: 3890455 - RNA, 22 nt, Shigella flexneri 2a str. 301
cgcagcuuugugcuucaguucc

SEQ ID NO: 3890456 - RNA, 15 nt, Shigella flexneri 2a str. 301
cgcaggacgggcaau

SEQ ID NO: 3890457 - RNA, 20 nt, Shigella flexneri 2a str. 301
cgcaggagcgccgaauggau

SEQ ID NO: 3890458 - RNA, 15 nt, Shigella flexneri 2a str. 301
cgcaggauaucgugg

SEQ ID NO: 3890459 - RNA, 23 nt, Shigella flexneri 2a str. 301
cgcaggaucgacugcaaaccaug

SEQ ID NO: 3890460 - RNA, 14 nt, Shigella flexneri 2a str. 301
cgcaggccaacagu

SEQ ID NO: 3890461 - RNA, 14 nt, Shigella flexneri 2a str. 301
cgcaggccaauagc

SEQ ID NO: 3890462 - RNA, 13 nt, Shigella flexneri 2a str. 301
cgcaggccacgaa

SEQ ID NO: 3890463 - RNA, 15 nt, Shigella flexneri 2a str. 301
cgcaggcgacauauc

SEQ ID NO: 3890464 - RNA, 12 nt, Shigella flexneri 2a str. 301
cgcaggcgcgcu

SEQ ID NO: 3890465 - RNA, 14 nt, Shigella flexneri 2a str. 301
cgcaggcgcgcugu

SEQ ID NO: 3890466 - RNA, 14 nt, Shigella flexneri 2a str. 301
cgcaggcgcugaaa

SEQ ID NO: 3890467 - RNA, 15 nt, Shigella flexneri 2a str. 301
cgcaggcgguggaag

SEQ ID NO: 3890468 - RNA, 17 nt, Shigella flexneri 2a str. 301
cgcaggcuguuaccccu

SEQ ID NO: 3890469 - RNA, 23 nt, Shigella flexneri 2a str. 301
cgcaggcuguuaccccugcggcc

SEQ ID NO: 3890470 - RNA, 22 nt, Shigella flexneri 2a str. 301
cgcagggacacucgcugacuga

SEQ ID NO: 3890471 - RNA, 23 nt, Shigella flexneri 2a str. 301
cgcagggaucauccacccgcagc

SEQ ID NO: 3890472 - RNA, 19 nt, Shigella flexneri 2a str. 301
cgcaggucauccggcacgc

SEQ ID NO: 3890473 - RNA, 21 nt, Shigella flexneri 2a str. 301
cgcaggugacgcgggcagcag

SEQ ID NO: 3890474 - RNA, 13 nt, Shigella flexneri 2a str. 301
cgcagguuccgca

SEQ ID NO: 3890475 - RNA, 12 nt, Shigella flexneri 2a str. 301
cgcagguuuugc

SEQ ID NO: 3890476 - RNA, 14 nt, Shigella flexneri 2a str. 301
cgcaguaaagcgca

SEQ ID NO: 3890477 - RNA, 16 nt, Shigella flexneri 2a str. 301
cgcaguaaauccgcca

SEQ ID NO: 3890478 - RNA, 18 nt, Shigella flexneri 2a str. 301
cgcaguaagcgacgggcg

SEQ ID NO: 3890479 - RNA, 20 nt, Shigella flexneri 2a str. 301
cgcaguaagcgccagggcau

SEQ ID NO: 3890480 - RNA, 23 nt, Shigella flexneri 2a str. 301
cgcaguaaucggcgaaaccgcgc

SEQ ID NO: 3890481 - RNA, 22 nt, Shigella flexneri 2a str. 301
cgcaguaccacuucauccggau

SEQ ID NO: 3890482 - RNA, 16 nt, Shigella flexneri 2a str. 301
cgcaguagccaugcau

SEQ ID NO: 3890483 - RNA, 23 nt, Shigella flexneri 2a str. 301
cgcaguaugcgauacccccagua

SEQ ID NO: 3890484 - RNA, 14 nt, Shigella flexneri 2a str. 301
cgcagucacaccag

SEQ ID NO: 3890485 - RNA, 15 nt, Shigella flexneri 2a str. 301
cgcagucacaccagc

SEQ ID NO: 3890486 - RNA, 21 nt, Shigella flexneri 2a str. 301
cgcagucccuuucccaccggc

SEQ ID NO: 3890487 - RNA, 13 nt, Shigella flexneri 2a str. 301
cgcagucuuccca

SEQ ID NO: 3890488 - RNA, 14 nt, Shigella flexneri 2a str. 301
cgcagucuucccag

SEQ ID NO: 3890489 - RNA, 19 nt, Shigella flexneri 2a str. 301
cgcagugagaagccaccgc

SEQ ID NO: 3890490 - RNA, 16 nt, Shigella flexneri 2a str. 301
cgcagugauugccgca

SEQ ID NO: 3890491 - RNA, 20 nt, Shigella flexneri 2a str. 301
cgcaguguaguucuggccuu

SEQ ID NO: 3890492 - RNA, 18 nt, Shigella flexneri 2a str. 301
cgcaguuacagcaggugu

SEQ ID NO: 3890493 - RNA, 15 nt, Shigella flexneri 2a str. 301
cgcaguuccgccagc

SEQ ID NO: 3890494 - RNA, 21 nt, Shigella flexneri 2a str. 301
cgcaguuccgccagcuugccg

SEQ ID NO: 3890495 - RNA, 19 nt, Shigella flexneri 2a str. 301
cgcaguuuaucgaccgcuu

SEQ ID NO: 3890496 - RNA, 12 nt, Shigella flexneri 2a str. 301
cgcauaaaacaa

SEQ ID NO: 3890497 - RNA, 18 nt, Shigella flexneri 2a str. 301
cgcauaaaacaacgccac

SEQ ID NO: 3890498 - RNA, 17 nt, Shigella flexneri 2a str. 301
cgcauaacagagcgaag

SEQ ID NO: 3890499 - RNA, 13 nt, Shigella flexneri 2a str. 301
cgcauaacagccc

SEQ ID NO: 3890500 - RNA, 18 nt, Shigella flexneri 2a str. 301
cgcauaacucaccaucaa

SEQ ID NO: 3890501 - RNA, 23 nt, Shigella flexneri 2a str. 301
cgcauaacugccggaugcggcgu

SEQ ID NO: 3890502 - RNA, 16 nt, Shigella flexneri 2a str. 301
cgcauaaugccugaug

SEQ ID NO: 3890503 - RNA, 22 nt, Shigella flexneri 2a str. 301
cgcauaccauccaggagauauu

SEQ ID NO: 3890504 - RNA, 17 nt, Shigella flexneri 2a str. 301
cgcauaccccaucagcg

SEQ ID NO: 3890505 - RNA, 22 nt, Shigella flexneri 2a str. 301
cgcauacggguaaaggcguugg

SEQ ID NO: 3890506 - RNA, 23 nt, Shigella flexneri 2a str. 301
cgcauagcuaauccccuccagcg

SEQ ID NO: 3890507 - RNA, 14 nt, Shigella flexneri 2a str. 301
cgcaucaauauuaa

SEQ ID NO: 3890508 - RNA, 15 nt, Shigella flexneri 2a str. 301
cgcaucagcuccggu

SEQ ID NO: 3890509 - RNA, 21 nt, Shigella flexneri 2a str. 301
cgcaucaggcaaugggcaaac

SEQ ID NO: 3890510 - RNA, 22 nt, Shigella flexneri 2a str. 301
cgcaucaggcauugugcacgau

SEQ ID NO: 3890511 - RNA, 21 nt, Shigella flexneri 2a str. 301
cgcaucaggcauugugcucca

SEQ ID NO: 3890512 - RNA, 19 nt, Shigella flexneri 2a str. 301
cgcaucagggcgcuggcga

SEQ ID NO: 3890513 - RNA, 13 nt, Shigella flexneri 2a str. 301
cgcauccaccaga

SEQ ID NO: 3890514 - RNA, 11 nt, Shigella flexneri 2a str. 301
cgcauccagaa

SEQ ID NO: 3890515 - RNA, 23 nt, Shigella flexneri 2a str. 301
cgcauccagccaacguuucugga

SEQ ID NO: 3890516 - RNA, 17 nt, Shigella flexneri 2a str. 301
cgcaucccauuucucca

SEQ ID NO: 3890517 - RNA, 15 nt, Shigella flexneri 2a str. 301
cgcauccgacacugg

SEQ ID NO: 3890518 - RNA, 15 nt, Shigella flexneri 2a str. 301
cgcauccgacauuug

SEQ ID NO: 3890519 - RNA, 11 nt, Shigella flexneri 2a str. 301
cgcauccgcug

SEQ ID NO: 3890520 - RNA, 13 nt, Shigella flexneri 2a str. 301
cgcauccggcaag

SEQ ID NO: 3890521 - RNA, 13 nt, Shigella flexneri 2a str. 301
cgcauccggcaau

SEQ ID NO: 3890522 - RNA, 16 nt, Shigella flexneri 2a str. 301
cgcauccggcaauaag

SEQ ID NO: 3890523 - RNA, 22 nt, Shigella flexneri 2a str. 301
cgcauccggcaauaagcaacgc

SEQ ID NO: 3890524 - RNA, 23 nt, Shigella flexneri 2a str. 301
cgcauccggcaauucucucugau

SEQ ID NO: 3890525 - RNA, 14 nt, Shigella flexneri 2a str. 301
cgcauccggcaguu

SEQ ID NO: 3890526 - RNA, 19 nt, Shigella flexneri 2a str. 301
cgcauccggcauaaacaaa

SEQ ID NO: 3890527 - RNA, 14 nt, Shigella flexneri 2a str. 301
cgcauccggcauca

SEQ ID NO: 3890528 - RNA, 15 nt, Shigella flexneri 2a str. 301
cgcauccggcaugaa

SEQ ID NO: 3890529 - RNA, 19 nt, Shigella flexneri 2a str. 301
cgcauccggcaugaacaaa

SEQ ID NO: 3890530 - RNA, 13 nt, Shigella flexneri 2a str. 301
cgcauccggcauu

SEQ ID NO: 3890531 - RNA, 21 nt, Shigella flexneri 2a str. 301
cgcaucgacauauucaccauu

SEQ ID NO: 3890532 - RNA, 13 nt, Shigella flexneri 2a str. 301
cgcaucgcagcau

SEQ ID NO: 3890533 - RNA, 15 nt, Shigella flexneri 2a str. 301
cgcaucgcugcgcuu

SEQ ID NO: 3890534 - RNA, 15 nt, Shigella flexneri 2a str. 301
cgcaucggcgucgug

SEQ ID NO: 3890535 - RNA, 17 nt, Shigella flexneri 2a str. 301
cgcaucggcgucgugga

SEQ ID NO: 3890536 - RNA, 12 nt, Shigella flexneri 2a str. 301
cgcaucggucag

SEQ ID NO: 3890537 - RNA, 18 nt, Shigella flexneri 2a str. 301
cgcaucuacgcgggucag

SEQ ID NO: 3890538 - RNA, 17 nt, Shigella flexneri 2a str. 301
cgcaucugaccagaugc

SEQ ID NO: 3890539 - RNA, 23 nt, Shigella flexneri 2a str. 301
cgcaucuguuucgaucagcaauu

SEQ ID NO: 3890540 - RNA, 12 nt, Shigella flexneri 2a str. 301
cgcaucuucucc

SEQ ID NO: 3890541 - RNA, 23 nt, Shigella flexneri 2a str. 301
cgccaggaaccugugacagcagc

SEQ ID NO: 3890542 - RNA, 20 nt, Shigella flexneri 2a str. 301
cgccaggaauuugguccuga

SEQ ID NO: 3890543 - RNA, 19 nt, Shigella flexneri 2a str. 301
cgccaggccagccugguua

SEQ ID NO: 3890544 - RNA, 18 nt, Shigella flexneri 2a str. 301
cgccaggcguuugaaaaa

SEQ ID NO: 3890545 - RNA, 22 nt, Shigella flexneri 2a str. 301
cgccaggcuuuccgucagcggc

SEQ ID NO: 3890546 - RNA, 22 nt, Shigella flexneri 2a str. 301
cgccagguguuuaaccaacaca

SEQ ID NO: 3890547 - RNA, 15 nt, Shigella flexneri 2a str. 301
cgccagguucaucaa

SEQ ID NO: 3890548 - RNA, 16 nt, Shigella flexneri 2a str. 301
cgccagguuguucacg

SEQ ID NO: 3890549 - RNA, 19 nt, Shigella flexneri 2a str. 301
cgccagguuucaauauccg

SEQ ID NO: 3890550 - RNA, 23 nt, Shigella flexneri 2a str. 301
cgccagguuuuagaucccacggc

SEQ ID NO: 3890551 - RNA, 23 nt, Shigella flexneri 2a str. 301
cgccaguaaucuggccaaugccu

SEQ ID NO: 3890552 - RNA, 16 nt, Shigella flexneri 2a str. 301
cgccaguaccagcagc

SEQ ID NO: 3890553 - RNA, 15 nt, Shigella flexneri 2a str. 301
cgccaguacgcgccc

SEQ ID NO: 3890554 - RNA, 11 nt, Shigella flexneri 2a str. 301
cgccagugacc

SEQ ID NO: 3890555 - RNA, 14 nt, Shigella flexneri 2a str. 301
cgccagugccgccc

SEQ ID NO: 3890556 - RNA, 19 nt, Shigella flexneri 2a str. 301
cgccagugcgccccaggua

SEQ ID NO: 3890557 - RNA, 21 nt, Shigella flexneri 2a str. 301
cgccagugugcgucgguuuuu

SEQ ID NO: 3890558 - RNA, 16 nt, Shigella flexneri 2a str. 301
cgccaguguuucgaca

SEQ ID NO: 3890559 - RNA, 18 nt, Shigella flexneri 2a str. 301
cgccaguuacugccacca

SEQ ID NO: 3890560 - RNA, 15 nt, Shigella flexneri 2a str. 301
cgccaguucgauauc

SEQ ID NO: 3890561 - RNA, 13 nt, Shigella flexneri 2a str. 301
cgccaguugcggc

SEQ ID NO: 3890562 - RNA, 19 nt, Shigella flexneri 2a str. 301
cgccaguuuacugucugcu

SEQ ID NO: 3890563 - RNA, 14 nt, Shigella flexneri 2a str. 301
cgccaguuuugcca

SEQ ID NO: 3890564 - RNA, 19 nt, Shigella flexneri 2a str. 301
cgccauaacggcuguccau

SEQ ID NO: 3890565 - RNA, 18 nt, Shigella flexneri 2a str. 301
cgccauaccaugcaccaa

SEQ ID NO: 3890566 - RNA, 20 nt, Shigella flexneri 2a str. 301
cgccauaccaugcaccaacc

SEQ ID NO: 3890567 - RNA, 12 nt, Shigella flexneri 2a str. 301
cgccauauuucu

SEQ ID NO: 3890568 - RNA, 18 nt, Shigella flexneri 2a str. 301
cgccaucaauaaccagcg

SEQ ID NO: 3890569 - RNA, 20 nt, Shigella flexneri 2a str. 301
cgccaucagugccaguacgc

SEQ ID NO: 3890570 - RNA, 14 nt, Shigella flexneri 2a str. 301
cgccauccaccagc

SEQ ID NO: 3890571 - RNA, 14 nt, Shigella flexneri 2a str. 301
cgccauccggcagc

SEQ ID NO: 3890572 - RNA, 16 nt, Shigella flexneri 2a str. 301
cgccauccgguuauca

SEQ ID NO: 3890573 - RNA, 22 nt, Shigella flexneri 2a str. 301
cgccauccgguuaucagaagau

SEQ ID NO: 3890574 - RNA, 23 nt, Shigella flexneri 2a str. 301
cgccauccugauagcuuacggcg

SEQ ID NO: 3890575 - RNA, 12 nt, Shigella flexneri 2a str. 301
cgccaucgccag

SEQ ID NO: 3890576 - RNA, 14 nt, Shigella flexneri 2a str. 301
cgccaucgccagca

SEQ ID NO: 3890577 - RNA, 14 nt, Shigella flexneri 2a str. 301
cgccaucucuucca

SEQ ID NO: 3890578 - RNA, 15 nt, Shigella flexneri 2a str. 301
cgccaucucuuccag

SEQ ID NO: 3890579 - RNA, 14 nt, Shigella flexneri 2a str. 301
cgccaucuggcuga

SEQ ID NO: 3890580 - RNA, 17 nt, Shigella flexneri 2a str. 301
cgccaugaacgcgaagg

SEQ ID NO: 3890581 - RNA, 23 nt, Shigella flexneri 2a str. 301
cgccaugaacgcgaaggccagaa

SEQ ID NO: 3890582 - RNA, 14 nt, Shigella flexneri 2a str. 301
cgccaugaagaugg

SEQ ID NO: 3890583 - RNA, 18 nt, Shigella flexneri 2a str. 301
cgccaugagcggacugaa

SEQ ID NO: 3890584 - RNA, 18 nt, Shigella flexneri 2a str. 301
cgccauggcuucucgcca

SEQ ID NO: 3890585 - RNA, 20 nt, Shigella flexneri 2a str. 301
cgccaugugcgacgggccaa

SEQ ID NO: 3890586 - RNA, 14 nt, Shigella flexneri 2a str. 301
cgccauuaacauua

SEQ ID NO: 3890587 - RNA, 19 nt, Shigella flexneri 2a str. 301
cgccauucauacccugaau

SEQ ID NO: 3890588 - RNA, 19 nt, Shigella flexneri 2a str. 301
cgccauugacguuccuuuc

SEQ ID NO: 3890589 - RNA, 17 nt, Shigella flexneri 2a str. 301
cgccauugccauaagcg

SEQ ID NO: 3890590 - RNA, 17 nt, Shigella flexneri 2a str. 301
cgccauuucgucgucgg

SEQ ID NO: 3890591 - RNA, 20 nt, Shigella flexneri 2a str. 301
cgccauuucuucuccggcau

SEQ ID NO: 3890592 - RNA, 21 nt, Shigella flexneri 2a str. 301
cgccauuucuucuccggcauc

SEQ ID NO: 3890593 - RNA, 17 nt, Shigella flexneri 2a str. 301
cgccauuuuaaucaucu

SEQ ID NO: 3890594 - RNA, 17 nt, Shigella flexneri 2a str. 301
cgccauuuucugccgca

SEQ ID NO: 3890595 - RNA, 16 nt, Shigella flexneri 2a str. 301
cgccauuuugcgcggc

SEQ ID NO: 3890596 - RNA, 18 nt, Shigella flexneri 2a str. 301
cgccauuuugcgcggcau

SEQ ID NO: 3890597 - RNA, 18 nt, Shigella flexneri 2a str. 301
cgccauuuuuuugucugc

SEQ ID NO: 3890598 - RNA, 15 nt, Shigella flexneri 2a str. 301
cgcccaaaccaccca

SEQ ID NO: 3890599 - RNA, 23 nt, Shigella flexneri 2a str. 301
cgcccaacuaaaugcugcagcca

SEQ ID NO: 3890600 - RNA, 22 nt, Shigella flexneri 2a str. 301
cgcccaaucgaugggauauaac

SEQ ID NO: 3890601 - RNA, 14 nt, Shigella flexneri 2a str. 301
cgcccaccaccagc

SEQ ID NO: 3890602 - RNA, 15 nt, Shigella flexneri 2a str. 301
cgcccaccaccagcg

SEQ ID NO: 3890603 - RNA, 16 nt, Shigella flexneri 2a str. 301
cgcccacguuucacug

SEQ ID NO: 3890604 - RNA, 17 nt, Shigella flexneri 2a str. 301
cgcccagaccugcguuc

SEQ ID NO: 3890605 - RNA, 22 nt, Shigella flexneri 2a str. 301
cgcccagcgucagcauaaaaau

SEQ ID NO: 3890606 - RNA, 17 nt, Shigella flexneri 2a str. 301
cgcccagcguugcacau

SEQ ID NO: 3890607 - RNA, 18 nt, Shigella flexneri 2a str. 301
cgcccagcguugcacaug

SEQ ID NO: 3890608 - RNA, 13 nt, Shigella flexneri 2a str. 301
cgcccagcuucau

SEQ ID NO: 3890609 - RNA, 18 nt, Shigella flexneri 2a str. 301
cgcccaguggaugcgcca

SEQ ID NO: 3890610 - RNA, 21 nt, Shigella flexneri 2a str. 301
cgcccaguugaucaccagugc

SEQ ID NO: 3890611 - RNA, 15 nt, Shigella flexneri 2a str. 301
cgcccaucgcauaac

SEQ ID NO: 3890612 - RNA, 19 nt, Shigella flexneri 2a str. 301
cgcccaucgcgcccgccgc

SEQ ID NO: 3890613 - RNA, 14 nt, Shigella flexneri 2a str. 301
cgcccauuccagua

SEQ ID NO: 3890614 - RNA, 20 nt, Shigella flexneri 2a str. 301
cgcccauugagcuggucuga

SEQ ID NO: 3890615 - RNA, 17 nt, Shigella flexneri 2a str. 301
cgcccauuuuucaugau

SEQ ID NO: 3890616 - RNA, 20 nt, Shigella flexneri 2a str. 301
cgccccacaaacccgccaga

SEQ ID NO: 3890617 - RNA, 15 nt, Shigella flexneri 2a str. 301
cgccccacaccacca

SEQ ID NO: 3890618 - RNA, 19 nt, Shigella flexneri 2a str. 301
cgccccacagacccaggua

SEQ ID NO: 3890619 - RNA, 14 nt, Shigella flexneri 2a str. 301
cgccccggaagcau

SEQ ID NO: 3890620 - RNA, 15 nt, Shigella flexneri 2a str. 301
cgccccggcacuuaa

SEQ ID NO: 3890621 - RNA, 14 nt, Shigella flexneri 2a str. 301
cgccccggccuugc

SEQ ID NO: 3890622 - RNA, 17 nt, Shigella flexneri 2a str. 301
cgccccggccuugccug

SEQ ID NO: 3890623 - RNA, 18 nt, Shigella flexneri 2a str. 301
cgccccggcucgcgaccu

SEQ ID NO: 3890624 - RNA, 14 nt, Shigella flexneri 2a str. 301
cgccccggcuucaa

SEQ ID NO: 3890625 - RNA, 22 nt, Shigella flexneri 2a str. 301
cgccccgguuaauugcgccagc

SEQ ID NO: 3890626 - RNA, 16 nt, Shigella flexneri 2a str. 301
cgccccgguuucucuu

SEQ ID NO: 3890627 - RNA, 22 nt, Shigella flexneri 2a str. 301
cgccccugcacuuaacaggauc

SEQ ID NO: 3890628 - RNA, 22 nt, Shigella flexneri 2a str. 301
cgccccugcgcuaaacaggauc

SEQ ID NO: 3890629 - RNA, 14 nt, Shigella flexneri 2a str. 301
cgccccuuccaggc

SEQ ID NO: 3890630 - RNA, 17 nt, Shigella flexneri 2a str. 301
cgccccuucugccgcaa

SEQ ID NO: 3890631 - RNA, 20 nt, Shigella flexneri 2a str. 301
cgcccgaccaucgccagcuc

SEQ ID NO: 3890632 - RNA, 16 nt, Shigella flexneri 2a str. 301
cgcccgacgaggcgcu

SEQ ID NO: 3890633 - RNA, 16 nt, Shigella flexneri 2a str. 301
cgcccgcuaugagcag

SEQ ID NO: 3890634 - RNA, 18 nt, Shigella flexneri 2a str. 301
cgcccgcuguaagccaag

SEQ ID NO: 3890635 - RNA, 22 nt, Shigella flexneri 2a str. 301
cgcccggauauccacccgcagc

SEQ ID NO: 3890636 - RNA, 18 nt, Shigella flexneri 2a str. 301
cgcccgguuuucgcgcgc

SEQ ID NO: 3890637 - RNA, 19 nt, Shigella flexneri 2a str. 301
cgcccgguuuucgcgcgca

SEQ ID NO: 3890638 - RNA, 22 nt, Shigella flexneri 2a str. 301
cgcccgucacguucugcgccgu

SEQ ID NO: 3890639 - RNA, 19 nt, Shigella flexneri 2a str. 301
cgcccguugcgccaaccag

SEQ ID NO: 3890640 - RNA, 15 nt, Shigella flexneri 2a str. 301
cgcccguuuucucca

SEQ ID NO: 3890641 - RNA, 14 nt, Shigella flexneri 2a str. 301
cgccuggugaccgc

SEQ ID NO: 3890642 - RNA, 11 nt, Shigella flexneri 2a str. 301
cgccuguuaau

SEQ ID NO: 3890643 - RNA, 13 nt, Shigella flexneri 2a str. 301
cgccuguuaauca

SEQ ID NO: 3890644 - RNA, 13 nt, Shigella flexneri 2a str. 301
cgccuguugcguc

SEQ ID NO: 3890645 - RNA, 22 nt, Shigella flexneri 2a str. 301
cgccuguuuaccgcucaccgga

SEQ ID NO: 3890646 - RNA, 14 nt, Shigella flexneri 2a str. 301
cgccuuacgcugcg

SEQ ID NO: 3890647 - RNA, 14 nt, Shigella flexneri 2a str. 301
cgccuuauccgccc

SEQ ID NO: 3890648 - RNA, 16 nt, Shigella flexneri 2a str. 301
cgccuuauccgcccua

SEQ ID NO: 3890649 - RNA, 20 nt, Shigella flexneri 2a str. 301
cgccuuauccgcccuacgcg

SEQ ID NO: 3890650 - RNA, 14 nt, Shigella flexneri 2a str. 301
cgccuuauccggcc

SEQ ID NO: 3890651 - RNA, 15 nt, Shigella flexneri 2a str. 301
cgccuuauccggccu

SEQ ID NO: 3890652 - RNA, 19 nt, Shigella flexneri 2a str. 301
cgccuuauccggccuaccg

SEQ ID NO: 3890653 - RNA, 20 nt, Shigella flexneri 2a str. 301
cgccuuauccggccuaccgu

SEQ ID NO: 3890654 - RNA, 16 nt, Shigella flexneri 2a str. 301
cgccuucacgguuauu

SEQ ID NO: 3890655 - RNA, 18 nt, Shigella flexneri 2a str. 301
cgccuucagguuuuucag

SEQ ID NO: 3890656 - RNA, 15 nt, Shigella flexneri 2a str. 301
cgccuucauucaggc

SEQ ID NO: 3890657 - RNA, 22 nt, Shigella flexneri 2a str. 301
cgccuucauucaggccaaagcc

SEQ ID NO: 3890658 - RNA, 15 nt, Shigella flexneri 2a str. 301
cgccuugcgcgcagu

SEQ ID NO: 3890659 - RNA, 19 nt, Shigella flexneri 2a str. 301
cgccuugcggaaauuccag

SEQ ID NO: 3890660 - RNA, 20 nt, Shigella flexneri 2a str. 301
cgccuuuaauauuaacgcca

SEQ ID NO: 3890661 - RNA, 22 nt, Shigella flexneri 2a str. 301
cgccuuuucaguuggcugacaa

SEQ ID NO: 3890662 - RNA, 13 nt, Shigella flexneri 2a str. 301
cgccuuuuccagc

SEQ ID NO: 3890663 - RNA, 15 nt, Shigella flexneri 2a str. 301
cgcgaaaaccgguaa

SEQ ID NO: 3890664 - RNA, 17 nt, Shigella flexneri 2a str. 301
cgcgaaaaugccccagc

SEQ ID NO: 3890665 - RNA, 19 nt, Shigella flexneri 2a str. 301
cgcgaaaguuaccgcgcca

SEQ ID NO: 3890666 - RNA, 21 nt, Shigella flexneri 2a str. 301
cgcgaaccgccuggcgcugcu

SEQ ID NO: 3890667 - RNA, 13 nt, Shigella flexneri 2a str. 301
cgcgaaccuguga

SEQ ID NO: 3890668 - RNA, 19 nt, Shigella flexneri 2a str. 301
cgcgaacggggcugccagc

SEQ ID NO: 3890669 - RNA, 18 nt, Shigella flexneri 2a str. 301
cgcgaacgugacacgcag

SEQ ID NO: 3890670 - RNA, 17 nt, Shigella flexneri 2a str. 301
cgcgaacuaaacaacgc

SEQ ID NO: 3890671 - RNA, 20 nt, Shigella flexneri 2a str. 301
cgcgaacuaaacaacgccgc

SEQ ID NO: 3890672 - RNA, 21 nt, Shigella flexneri 2a str. 301
cgcgaacuaaacaacgccgcc

SEQ ID NO: 3890673 - RNA, 18 nt, Shigella flexneri 2a str. 301
cgcgaacugucgguuugu

SEQ ID NO: 3890674 - RNA, 12 nt, Shigella flexneri 2a str. 301
cgcgaagcuggu

SEQ ID NO: 3890675 - RNA, 19 nt, Shigella flexneri 2a str. 301
cgcgaagcuggucagcauc

SEQ ID NO: 3890676 - RNA, 14 nt, Shigella flexneri 2a str. 301
cgcgaaguuccgau

SEQ ID NO: 3890677 - RNA, 18 nt, Shigella flexneri 2a str. 301
cgcgaaucuccacgccuu

SEQ ID NO: 3890678 - RNA, 19 nt, Shigella flexneri 2a str. 301
cgcgacaguaucaucauua

SEQ ID NO: 3890679 - RNA, 16 nt, Shigella flexneri 2a str. 301
cgcgacauaaaacccg

SEQ ID NO: 3890680 - RNA, 12 nt, Shigella flexneri 2a str. 301
cgcgaccaccac

SEQ ID NO: 3890681 - RNA, 14 nt, Shigella flexneri 2a str. 301
cgcgaccaccacca

SEQ ID NO: 3890682 - RNA, 18 nt, Shigella flexneri 2a str. 301
cgcgaccggcgucgcauc

SEQ ID NO: 3890683 - RNA, 12 nt, Shigella flexneri 2a str. 301
cgcgacuaucga

SEQ ID NO: 3890684 - RNA, 16 nt, Shigella flexneri 2a str. 301
cgcgacucccugacug

SEQ ID NO: 3890685 - RNA, 23 nt, Shigella flexneri 2a str. 301
cgcgacuuuaaucaccugccagg

SEQ ID NO: 3890686 - RNA, 16 nt, Shigella flexneri 2a str. 301
cgcgacuuuuuccugc

SEQ ID NO: 3890687 - RNA, 10 nt, Shigella flexneri 2a str. 301
cgcgagcugg

SEQ ID NO: 3890688 - RNA, 13 nt, Shigella flexneri 2a str. 301
cgcgaggcgcaua

SEQ ID NO: 3890689 - RNA, 15 nt, Shigella flexneri 2a str. 301
cgcgagguuuuccuu

SEQ ID NO: 3890690 - RNA, 22 nt, Shigella flexneri 2a str. 301
cgcgauaaaagacgccgacauc

SEQ ID NO: 3890691 - RNA, 17 nt, Shigella flexneri 2a str. 301
cgcgauaaaaucccaua

SEQ ID NO: 3890692 - RNA, 15 nt, Shigella flexneri 2a str. 301
cgcgauacaccagau

SEQ ID NO: 3890693 - RNA, 19 nt, Shigella flexneri 2a str. 301
cgcgauacuuuuucaagaa

SEQ ID NO: 3890694 - RNA, 22 nt, Shigella flexneri 2a str. 301
cgcgauaucgcgguacuucuca

SEQ ID NO: 3890695 - RNA, 14 nt, Shigella flexneri 2a str. 301
cgcgauauugcugc

SEQ ID NO: 3890696 - RNA, 13 nt, Shigella flexneri 2a str. 301
cgcgaucgcgcca

SEQ ID NO: 3890697 - RNA, 19 nt, Shigella flexneri 2a str. 301
cgcgaucgcugagcuccug

SEQ ID NO: 3890698 - RNA, 13 nt, Shigella flexneri 2a str. 301
cgcgaucuuccac

SEQ ID NO: 3890699 - RNA, 14 nt, Shigella flexneri 2a str. 301
cgcgaugaccaaaa

SEQ ID NO: 3890700 - RNA, 16 nt, Shigella flexneri 2a str. 301
cgcgauuaucauuuua

SEQ ID NO: 3890701 - RNA, 16 nt, Shigella flexneri 2a str. 301
cgcgauuaugccgccg

SEQ ID NO: 3890702 - RNA, 23 nt, Shigella flexneri 2a str. 301
cgcgauucgcccugcauauuggu

SEQ ID NO: 3890703 - RNA, 17 nt, Shigella flexneri 2a str. 301
cgcgcaaucagcaccgc

SEQ ID NO: 3890704 - RNA, 21 nt, Shigella flexneri 2a str. 301
cgcgcaaucagcaccgcgcgu

SEQ ID NO: 3890705 - RNA, 14 nt, Shigella flexneri 2a str. 301
cgcgcaauugcacg

SEQ ID NO: 3890706 - RNA, 20 nt, Shigella flexneri 2a str. 301
cgcgcaccggaacaacccag

SEQ ID NO: 3890707 - RNA, 22 nt, Shigella flexneri 2a str. 301
cgcgcacguacaucccgcgaac

SEQ ID NO: 3890708 - RNA, 16 nt, Shigella flexneri 2a str. 301
cgcgcacgucagccuc

SEQ ID NO: 3890709 - RNA, 18 nt, Shigella flexneri 2a str. 301
cgcgcacgucagccucgc

SEQ ID NO: 3890710 - RNA, 21 nt, Shigella flexneri 2a str. 301
cgcgcacuaugugccagcuuc

SEQ ID NO: 3890711 - RNA, 12 nt, Shigella flexneri 2a str. 301
cgcgcagcuuca

SEQ ID NO: 3890712 - RNA, 13 nt, Shigella flexneri 2a str. 301
cgcgcagcuucac

SEQ ID NO: 3890713 - RNA, 21 nt, Shigella flexneri 2a str. 301
cgcgcaggaucgacugcaaac

SEQ ID NO: 3890714 - RNA, 14 nt, Shigella flexneri 2a str. 301
cgcgcaggcgcuga

SEQ ID NO: 3890715 - RNA, 20 nt, Shigella flexneri 2a str. 301
cgcgcaguuaaacgccuugc

SEQ ID NO: 3890716 - RNA, 16 nt, Shigella flexneri 2a str. 301
cgcgcaucagcaguuc

SEQ ID NO: 3890717 - RNA, 13 nt, Shigella flexneri 2a str. 301
cgcgcauccggca

SEQ ID NO: 3890718 - RNA, 18 nt, Shigella flexneri 2a str. 301
cgcgccaaucagcgcagc

SEQ ID NO: 3890719 - RNA, 21 nt, Shigella flexneri 2a str. 301
cgcgccaaucagcgcagcacc

SEQ ID NO: 3890720 - RNA, 22 nt, Shigella flexneri 2a str. 301
cgcgccaaucagcgcagcaccc

SEQ ID NO: 3890721 - RNA, 14 nt, Shigella flexneri 2a str. 301
cgcgccaauccaga

SEQ ID NO: 3890722 - RNA, 11 nt, Shigella flexneri 2a str. 301
cgcgccagccg

SEQ ID NO: 3890723 - RNA, 13 nt, Shigella flexneri 2a str. 301
cgcgccagcuuag

SEQ ID NO: 3890724 - RNA, 19 nt, Shigella flexneri 2a str. 301
cgcgccaucugccgauacg

SEQ ID NO: 3890725 - RNA, 18 nt, Shigella flexneri 2a str. 301
cgcgccccacggauugcc

SEQ ID NO: 3890726 - RNA, 21 nt, Shigella flexneri 2a str. 301
cgcgccccacggauugccgcu

SEQ ID NO: 3890727 - RNA, 13 nt, Shigella flexneri 2a str. 301
cgcgcccuccugc

SEQ ID NO: 3890728 - RNA, 17 nt, Shigella flexneri 2a str. 301
cgcgccgcagccggaaa

SEQ ID NO: 3890729 - RNA, 14 nt, Shigella flexneri 2a str. 301
cgcgccgccaaccc

SEQ ID NO: 3890730 - RNA, 15 nt, Shigella flexneri 2a str. 301
cgcgccgccaacccc

SEQ ID NO: 3890731 - RNA, 13 nt, Shigella flexneri 2a str. 301
cgcgccgccgccc

SEQ ID NO: 3890732 - RNA, 16 nt, Shigella flexneri 2a str. 301
cgcgccgccucccuuc

SEQ ID NO: 3890733 - RNA, 14 nt, Shigella flexneri 2a str. 301
cgcgccugcggcca

SEQ ID NO: 3890734 - RNA, 18 nt, Shigella flexneri 2a str. 301
cgcgccuuguuaccugau

SEQ ID NO: 3890735 - RNA, 20 nt, Shigella flexneri 2a str. 301
cgcgcgaauauggcggcggc

SEQ ID NO: 3890736 - RNA, 13 nt, Shigella flexneri 2a str. 301
cgcgcgcagcacg

SEQ ID NO: 3890737 - RNA, 13 nt, Shigella flexneri 2a str. 301
cgcgcgccaccau

SEQ ID NO: 3890738 - RNA, 19 nt, Shigella flexneri 2a str. 301
cgcgcgcuuuuaccgcguc

SEQ ID NO: 3890739 - RNA, 16 nt, Shigella flexneri 2a str. 301
cgcgcgguaucaccac

SEQ ID NO: 3890740 - RNA, 18 nt, Shigella flexneri 2a str. 301
cgcgcgguaucaccaccc

SEQ ID NO: 3890741 - RNA, 15 nt, Shigella flexneri 2a str. 301
cgcgcguucgcagag

SEQ ID NO: 3890742 - RNA, 13 nt, Shigella flexneri 2a str. 301
cgcuauccagcgc

SEQ ID NO: 3890743 - RNA, 16 nt, Shigella flexneri 2a str. 301
cgcuauccagcgcaua

SEQ ID NO: 3890744 - RNA, 21 nt, Shigella flexneri 2a str. 301
cgcuaucguccacgucaucaa

SEQ ID NO: 3890745 - RNA, 17 nt, Shigella flexneri 2a str. 301
cgcucaaaaauccagau

SEQ ID NO: 3890746 - RNA, 23 nt, Shigella flexneri 2a str. 301
cgcucaagaaagguugaggcuga

SEQ ID NO: 3890747 - RNA, 17 nt, Shigella flexneri 2a str. 301
cgcucaauaaucaaucu

SEQ ID NO: 3890748 - RNA, 19 nt, Shigella flexneri 2a str. 301
cgcucaauauccugaccuu

SEQ ID NO: 3890749 - RNA, 18 nt, Shigella flexneri 2a str. 301
cgcucaaucguaugauca

SEQ ID NO: 3890750 - RNA, 13 nt, Shigella flexneri 2a str. 301
cgcucaaugcgcu

SEQ ID NO: 3890751 - RNA, 15 nt, Shigella flexneri 2a str. 301
cgcucaccggaugcg

SEQ ID NO: 3890752 - RNA, 14 nt, Shigella flexneri 2a str. 301
cgcucagcuccucu

SEQ ID NO: 3890753 - RNA, 15 nt, Shigella flexneri 2a str. 301
cgcucagucggcgcu

SEQ ID NO: 3890754 - RNA, 18 nt, Shigella flexneri 2a str. 301
cgcucauaauacaggcua

SEQ ID NO: 3890755 - RNA, 17 nt, Shigella flexneri 2a str. 301
cgcucauacuuccacgc

SEQ ID NO: 3890756 - RNA, 17 nt, Shigella flexneri 2a str. 301
cgcucaucagcuccggu

SEQ ID NO: 3890757 - RNA, 18 nt, Shigella flexneri 2a str. 301
cgcucaucaggccuacaa

SEQ ID NO: 3890758 - RNA, 20 nt, Shigella flexneri 2a str. 301
cgcuccaggaguuccggguc

SEQ ID NO: 3890759 - RNA, 13 nt, Shigella flexneri 2a str. 301
cgcuccagugccu

SEQ ID NO: 3890760 - RNA, 18 nt, Shigella flexneri 2a str. 301
cgcucccgcaggagcgcc

SEQ ID NO: 3890761 - RNA, 21 nt, Shigella flexneri 2a str. 301
cgcucccuggcccaucgccag

SEQ ID NO: 3890762 - RNA, 21 nt, Shigella flexneri 2a str. 301
cgcuccggcggcacagccagc

SEQ ID NO: 3890763 - RNA, 13 nt, Shigella flexneri 2a str. 301
cgcuccgucagca

SEQ ID NO: 3890764 - RNA, 17 nt, Shigella flexneri 2a str. 301
cgcucgaacagcugguu

SEQ ID NO: 3890765 - RNA, 17 nt, Shigella flexneri 2a str. 301
cgcucgaagcgggcgcg

SEQ ID NO: 3890766 - RNA, 13 nt, Shigella flexneri 2a str. 301
cgcucgcccagcu

SEQ ID NO: 3890767 - RNA, 16 nt, Shigella flexneri 2a str. 301
cgcucgcgccgcaucc

SEQ ID NO: 3890768 - RNA, 21 nt, Shigella flexneri 2a str. 301
cgcucggcaaagcgcugaaga

SEQ ID NO: 3890769 - RNA, 21 nt, Shigella flexneri 2a str. 301
cgcucggcaacaccucagcca

SEQ ID NO: 3890770 - RNA, 19 nt, Shigella flexneri 2a str. 301
cgcucggcgcaaucgccag

SEQ ID NO: 3890771 - RNA, 22 nt, Shigella flexneri 2a str. 301
cgcucguagguuucugccagcg

SEQ ID NO: 3890772 - RNA, 22 nt, Shigella flexneri 2a str. 301
cgcucguuaaaacgcgcggcgu

SEQ ID NO: 3890773 - RNA, 20 nt, Shigella flexneri 2a str. 301
cgcucucccaguaaccacgc

SEQ ID NO: 3890774 - RNA, 19 nt, Shigella flexneri 2a str. 301
cgcucucgcagcucaucaa

SEQ ID NO: 3890775 - RNA, 16 nt, Shigella flexneri 2a str. 301
cgcucucuaucacgaa

SEQ ID NO: 3890776 - RNA, 11 nt, Shigella flexneri 2a str. 301
cgcucugagcu

SEQ ID NO: 3890777 - RNA, 16 nt, Shigella flexneri 2a str. 301
cgcucugcccaugcug

SEQ ID NO: 3890778 - RNA, 12 nt, Shigella flexneri 2a str. 301
cgcucuggcagg

SEQ ID NO: 3890779 - RNA, 22 nt, Shigella flexneri 2a str. 301
cgcucuguagggagagggccgg

SEQ ID NO: 3890780 - RNA, 23 nt, Shigella flexneri 2a str. 301
cgcucuucaucgcuaaaauacug

SEQ ID NO: 3890781 - RNA, 22 nt, Shigella flexneri 2a str. 301
cgcucuuguucuuccggcacac

SEQ ID NO: 3890782 - RNA, 15 nt, Shigella flexneri 2a str. 301
cgcucuuuaaaggcc

SEQ ID NO: 3890783 - RNA, 23 nt, Shigella flexneri 2a str. 301
cgcugaaagaagcggugaaaaaa

SEQ ID NO: 3890784 - RNA, 14 nt, Shigella flexneri 2a str. 301
cgcugaaagcugaa

SEQ ID NO: 3890785 - RNA, 24 nt, Shigella flexneri 2a str. 301
cgcugaagaaaauggccagccagc

SEQ ID NO: 3890786 - RNA, 16 nt, Shigella flexneri 2a str. 301
cgcugaauaaucccca

SEQ ID NO: 3890787 - RNA, 18 nt, Shigella flexneri 2a str. 301
cgcugaauaauggugaau

SEQ ID NO: 3890788 - RNA, 13 nt, Shigella flexneri 2a str. 301
cgcugaauacgca

SEQ ID NO: 3890789 - RNA, 23 nt, Shigella flexneri 2a str. 301
cgcugaauacggaagcgaaacug

SEQ ID NO: 3890790 - RNA, 15 nt, Shigella flexneri 2a str. 301
cgcugaauggcgauu

SEQ ID NO: 3890791 - RNA, 23 nt, Shigella flexneri 2a str. 301
cgcugaauggcgauuucacaaga

SEQ ID NO: 3890792 - RNA, 15 nt, Shigella flexneri 2a str. 301
cgcugacagcgcguc

SEQ ID NO: 3890793 - RNA, 20 nt, Shigella flexneri 2a str. 301
cgcugacaguacccagauuc

SEQ ID NO: 3890794 - RNA, 19 nt, Shigella flexneri 2a str. 301
cgcugaccuucuucagcaa

SEQ ID NO: 3890795 - RNA, 24 nt, Shigella flexneri 2a str. 301
cgcugacgauuguagaaaaucuca

SEQ ID NO: 3890796 - RNA, 17 nt, Shigella flexneri 2a str. 301
cgcugacgccaugccau

SEQ ID NO: 3890797 - RNA, 20 nt, Shigella flexneri 2a str. 301
cgcugacgcgucuuaucugg

SEQ ID NO: 3890798 - RNA, 13 nt, Shigella flexneri 2a str. 301
cgcugagacgcgc

SEQ ID NO: 3890799 - RNA, 19 nt, Shigella flexneri 2a str. 301
cgcugagacgcgcuugcau

SEQ ID NO: 3890800 - RNA, 14 nt, Shigella flexneri 2a str. 301
cgcugagagaagca

SEQ ID NO: 3890801 - RNA, 15 nt, Shigella flexneri 2a str. 301
cgcugagagaagcac

SEQ ID NO: 3890802 - RNA, 16 nt, Shigella flexneri 2a str. 301
cgcugagguccggcca

SEQ ID NO: 3890803 - RNA, 20 nt, Shigella flexneri 2a str. 301
cgcugauauucgacaccauc

SEQ ID NO: 3890804 - RNA, 21 nt, Shigella flexneri 2a str. 301
cgcugauauucgacaccaucu

SEQ ID NO: 3890805 - RNA, 13 nt, Shigella flexneri 2a str. 301
cgcugaugccagg

SEQ ID NO: 3890806 - RNA, 20 nt, Shigella flexneri 2a str. 301
cgcugaugucagcacuucca

SEQ ID NO: 3890807 - RNA, 20 nt, Shigella flexneri 2a str. 301
cgcugauuucaccaucuuca

SEQ ID NO: 3890808 - RNA, 16 nt, Shigella flexneri 2a str. 301
cgcugauuugcuucaa

SEQ ID NO: 3890809 - RNA, 14 nt, Shigella flexneri 2a str. 301
cgcugauuuuucug

SEQ ID NO: 3890810 - RNA, 21 nt, Shigella flexneri 2a str. 301
cgcugauuuuuuuucaaccua

SEQ ID NO: 3890811 - RNA, 19 nt, Shigella flexneri 2a str. 301
cgcugcaacguccugagca

SEQ ID NO: 3890812 - RNA, 22 nt, Shigella flexneri 2a str. 301
cgcugcaaguuuugucaguucg

SEQ ID NO: 3890813 - RNA, 20 nt, Shigella flexneri 2a str. 301
cgcugcacaauugccagccc

SEQ ID NO: 3890814 - RNA, 22 nt, Shigella flexneri 2a str. 301
cgcugcacuuucucgacaucca

SEQ ID NO: 3890815 - RNA, 13 nt, Shigella flexneri 2a str. 301
cgcugcagcucug

SEQ ID NO: 3890816 - RNA, 14 nt, Shigella flexneri 2a str. 301
cgcugcaucgccaa

SEQ ID NO: 3890817 - RNA, 19 nt, Shigella flexneri 2a str. 301
cgcugcauggcaacuuuaa

SEQ ID NO: 3890818 - RNA, 23 nt, Shigella flexneri 2a str. 301
cgcugcauugacaagcucaccuc

SEQ ID NO: 3890819 - RNA, 20 nt, Shigella flexneri 2a str. 301
cgcugcauugcccaauacag

SEQ ID NO: 3890820 - RNA, 15 nt, Shigella flexneri 2a str. 301
cgcugccagccgccg

SEQ ID NO: 3890821 - RNA, 20 nt, Shigella flexneri 2a str. 301
cgcugcccaugcgcucgacg

SEQ ID NO: 3890822 - RNA, 11 nt, Shigella flexneri 2a str. 301
cgcugccguug

SEQ ID NO: 3890823 - RNA, 19 nt, Shigella flexneri 2a str. 301
cgcugccguugccgcucuu

SEQ ID NO: 3890824 - RNA, 16 nt, Shigella flexneri 2a str. 301
cgcugccguugcuuga

SEQ ID NO: 3890825 - RNA, 20 nt, Shigella flexneri 2a str. 301
cgcugccucucuucgcugcu

SEQ ID NO: 3890826 - RNA, 23 nt, Shigella flexneri 2a str. 301
cgcugccuucggcgucuccaccu

SEQ ID NO: 3890827 - RNA, 17 nt, Shigella flexneri 2a str. 301
cgcugcgguuuacgcca

SEQ ID NO: 3890828 - RNA, 13 nt, Shigella flexneri 2a str. 301
cgcugcguagcca

SEQ ID NO: 3890829 - RNA, 22 nt, Shigella flexneri 2a str. 301
cgcugcuaauuuaucggcguua

SEQ ID NO: 3890830 - RNA, 14 nt, Shigella flexneri 2a str. 301
cgcugcucuucagu

SEQ ID NO: 3890831 - RNA, 15 nt, Shigella flexneri 2a str. 301
cgcugcugcacauac

SEQ ID NO: 3890832 - RNA, 18 nt, Shigella flexneri 2a str. 301
cgcugcuguacuuuuucc

SEQ ID NO: 3890833 - RNA, 19 nt, Shigella flexneri 2a str. 301
cgcugcuguagcaguucca

SEQ ID NO: 3890834 - RNA, 23 nt, Shigella flexneri 2a str. 301
cgcugcuuuccugcugcgccugu

SEQ ID NO: 3890835 - RNA, 16 nt, Shigella flexneri 2a str. 301
cgcuggaacgcuucug

SEQ ID NO: 3890836 - RNA, 19 nt, Shigella flexneri 2a str. 301
cgcuggacguugcguugca

SEQ ID NO: 3890837 - RNA, 15 nt, Shigella flexneri 2a str. 301
cgcuggcaacacaga

SEQ ID NO: 3890838 - RNA, 14 nt, Shigella flexneri 2a str. 301
cgcuggcaccgcag

SEQ ID NO: 3890839 - RNA, 22 nt, Shigella flexneri 2a str. 301
cgcuggcagcguauucgcgcag

SEQ ID NO: 3890840 - RNA, 17 nt, Shigella flexneri 2a str. 301
cgcuggcuuugcccugg

SEQ ID NO: 3890841 - RNA, 16 nt, Shigella flexneri 2a str. 301
cggaauaccacuuuca

SEQ ID NO: 3890842 - RNA, 20 nt, Shigella flexneri 2a str. 301
cggaauagcguacggcaugc

SEQ ID NO: 3890843 - RNA, 15 nt, Shigella flexneri 2a str. 301
cggaauaucagaggc

SEQ ID NO: 3890844 - RNA, 15 nt, Shigella flexneri 2a str. 301
cggaauaucgcuggc

SEQ ID NO: 3890845 - RNA, 15 nt, Shigella flexneri 2a str. 301
cggaauggugcuggu

SEQ ID NO: 3890846 - RNA, 15 nt, Shigella flexneri 2a str. 301
cggaaugucaucauc

SEQ ID NO: 3890847 - RNA, 16 nt, Shigella flexneri 2a str. 301
cggaauucccgcuucu

SEQ ID NO: 3890848 - RNA, 22 nt, Shigella flexneri 2a str. 301
cggaauugccgguacagccgga

SEQ ID NO: 3890849 - RNA, 19 nt, Shigella flexneri 2a str. 301
cggacaaacggcuggaaca

SEQ ID NO: 3890850 - RNA, 15 nt, Shigella flexneri 2a str. 301
cggacaaccagcuuc

SEQ ID NO: 3890851 - RNA, 15 nt, Shigella flexneri 2a str. 301
cggacagaucugccu

SEQ ID NO: 3890852 - RNA, 17 nt, Shigella flexneri 2a str. 301
cggacagaucugccugu

SEQ ID NO: 3890853 - RNA, 23 nt, Shigella flexneri 2a str. 301
cggacagucacguagcggcggca

SEQ ID NO: 3890854 - RNA, 14 nt, Shigella flexneri 2a str. 301
cggacaguccccuc

SEQ ID NO: 3890855 - RNA, 17 nt, Shigella flexneri 2a str. 301
cggacauguuuuccagc

SEQ ID NO: 3890856 - RNA, 18 nt, Shigella flexneri 2a str. 301
cggacauguuuuccagca

SEQ ID NO: 3890857 - RNA, 21 nt, Shigella flexneri 2a str. 301
cggacauguuuuccagcacau

SEQ ID NO: 3890858 - RNA, 23 nt, Shigella flexneri 2a str. 301
cggacauugaguuuacgcagcag

SEQ ID NO: 3890859 - RNA, 21 nt, Shigella flexneri 2a str. 301
cggaccagccgcuaccagcgc

SEQ ID NO: 3890860 - RNA, 14 nt, Shigella flexneri 2a str. 301
cggacccacacccc

SEQ ID NO: 3890861 - RNA, 14 nt, Shigella flexneri 2a str. 301
cggaccccacgcuc

SEQ ID NO: 3890862 - RNA, 19 nt, Shigella flexneri 2a str. 301
cggaccccacgcucucgca

SEQ ID NO: 3890863 - RNA, 15 nt, Shigella flexneri 2a str. 301
cggaccgucaucuuc

SEQ ID NO: 3890864 - RNA, 15 nt, Shigella flexneri 2a str. 301
cggaccgucuuuuuu

SEQ ID NO: 3890865 - RNA, 15 nt, Shigella flexneri 2a str. 301
cggacgacggcaucg

SEQ ID NO: 3890866 - RNA, 16 nt, Shigella flexneri 2a str. 301
cggacgaucccaacca

SEQ ID NO: 3890867 - RNA, 21 nt, Shigella flexneri 2a str. 301
cggacgcaccgcguauugcuc

SEQ ID NO: 3890868 - RNA, 17 nt, Shigella flexneri 2a str. 301
cggacgcccgccgacca

SEQ ID NO: 3890869 - RNA, 15 nt, Shigella flexneri 2a str. 301
cggacggacuuccag

SEQ ID NO: 3890870 - RNA, 18 nt, Shigella flexneri 2a str. 301
cggacggacuuccagcgg

SEQ ID NO: 3890871 - RNA, 23 nt, Shigella flexneri 2a str. 301
cggacguuugccaugcauaucca

SEQ ID NO: 3890872 - RNA, 15 nt, Shigella flexneri 2a str. 301
cggacuauccgccuc

SEQ ID NO: 3890873 - RNA, 16 nt, Shigella flexneri 2a str. 301
cggacuccgcaccgcc

SEQ ID NO: 3890874 - RNA, 20 nt, Shigella flexneri 2a str. 301
cggacugaaaguacuucaca

SEQ ID NO: 3890875 - RNA, 15 nt, Shigella flexneri 2a str. 301
cggacugaacgcggc

SEQ ID NO: 3890876 - RNA, 19 nt, Shigella flexneri 2a str. 301
cggacuuccagcggacgau

SEQ ID NO: 3890877 - RNA, 13 nt, Shigella flexneri 2a str. 301
cggagaagcguag

SEQ ID NO: 3890878 - RNA, 23 nt, Shigella flexneri 2a str. 301
cggagacaaacagggugcagcga

SEQ ID NO: 3890879 - RNA, 22 nt, Shigella flexneri 2a str. 301
cggagacgguuauauuuacaaa

SEQ ID NO: 3890880 - RNA, 22 nt, Shigella flexneri 2a str. 301
cggagagaaaaaccuccggcgu

SEQ ID NO: 3890881 - RNA, 15 nt, Shigella flexneri 2a str. 301
cggagagaaaagcaa

SEQ ID NO: 3890882 - RNA, 21 nt, Shigella flexneri 2a str. 301
cggagagaaaagcaaaagaug

SEQ ID NO: 3890883 - RNA, 20 nt, Shigella flexneri 2a str. 301
cggagaguaaugccagucag

SEQ ID NO: 3890884 - RNA, 20 nt, Shigella flexneri 2a str. 301
cggagaucgagcgcgagcag

SEQ ID NO: 3890885 - RNA, 13 nt, Shigella flexneri 2a str. 301
cggagcaaugauc

SEQ ID NO: 3890886 - RNA, 17 nt, Shigella flexneri 2a str. 301
cggagcaaugaucucaa

SEQ ID NO: 3890887 - RNA, 21 nt, Shigella flexneri 2a str. 301
cggagcagcagucaggcgcgc

SEQ ID NO: 3890888 - RNA, 21 nt, Shigella flexneri 2a str. 301
cggagccaaacaugcaaacca

SEQ ID NO: 3890889 - RNA, 22 nt, Shigella flexneri 2a str. 301
cggagccauugcccgaugcgca

SEQ ID NO: 3890890 - RNA, 21 nt, Shigella flexneri 2a str. 301
cggagcucccaggcuccgcca

SEQ ID NO: 3890891 - RNA, 13 nt, Shigella flexneri 2a str. 301
cggagcugccagg

SEQ ID NO: 3890892 - RNA, 18 nt, Shigella flexneri 2a str. 301
cggagcuucacccgcagc

SEQ ID NO: 3890893 - RNA, 15 nt, Shigella flexneri 2a str. 301
cggaggaaagcaccu

SEQ ID NO: 3890894 - RNA, 19 nt, Shigella flexneri 2a str. 301
cggaggcgcugguaaucac

SEQ ID NO: 3890895 - RNA, 19 nt, Shigella flexneri 2a str. 301
cggagggauguggcccagc

SEQ ID NO: 3890896 - RNA, 22 nt, Shigella flexneri 2a str. 301
cggaggggcggcucuccugcca

SEQ ID NO: 3890897 - RNA, 23 nt, Shigella flexneri 2a str. 301
cggaguagucucucgccucaugg

SEQ ID NO: 3890898 - RNA, 15 nt, Shigella flexneri 2a str. 301
cggagugaaaauucu

SEQ ID NO: 3890899 - RNA, 22 nt, Shigella flexneri 2a str. 301
cggagugaaaauucuccggcgu

SEQ ID NO: 3890900 - RNA, 23 nt, Shigella flexneri 2a str. 301
cggaguugaccagcuccagcaga

SEQ ID NO: 3890901 - RNA, 16 nt, Shigella flexneri 2a str. 301
cggaguugcagauuug

SEQ ID NO: 3890902 - RNA, 14 nt, Shigella flexneri 2a str. 301
cggaguuuaugagg

SEQ ID NO: 3890903 - RNA, 16 nt, Shigella flexneri 2a str. 301
cggaguuuaugaggca

SEQ ID NO: 3890904 - RNA, 18 nt, Shigella flexneri 2a str. 301
cggauaaacuuggcuaua

SEQ ID NO: 3890905 - RNA, 17 nt, Shigella flexneri 2a str. 301
cggauaaagcagagcag

SEQ ID NO: 3890906 - RNA, 14 nt, Shigella flexneri 2a str. 301
cggauaagacgcga

SEQ ID NO: 3890907 - RNA, 18 nt, Shigella flexneri 2a str. 301
cggauaagacgcgccagc

SEQ ID NO: 3890908 - RNA, 19 nt, Shigella flexneri 2a str. 301
cggauaagaugcgccagca

SEQ ID NO: 3890909 - RNA, 14 nt, Shigella flexneri 2a str. 301
cggauaaggcauuu

SEQ ID NO: 3890910 - RNA, 16 nt, Shigella flexneri 2a str. 301
cggauaauaauauccu

SEQ ID NO: 3890911 - RNA, 18 nt, Shigella flexneri 2a str. 301
cggauaaucgcuggugcc

SEQ ID NO: 3890912 - RNA, 16 nt, Shigella flexneri 2a str. 301
cggauaauucccaggc

SEQ ID NO: 3890913 - RNA, 16 nt, Shigella flexneri 2a str. 301
cggauaauuucacugc

SEQ ID NO: 3890914 - RNA, 22 nt, Shigella flexneri 2a str. 301
cggauacgguuuuuugaacaga

SEQ ID NO: 3890915 - RNA, 21 nt, Shigella flexneri 2a str. 301
cggauagauuuuuaaugcuuu

SEQ ID NO: 3890916 - RNA, 18 nt, Shigella flexneri 2a str. 301
cggauagcagaaaacuca

SEQ ID NO: 3890917 - RNA, 17 nt, Shigella flexneri 2a str. 301
cggauagcguucggcaa

SEQ ID NO: 3890918 - RNA, 14 nt, Shigella flexneri 2a str. 301
cggauauaaaaaac

SEQ ID NO: 3890919 - RNA, 13 nt, Shigella flexneri 2a str. 301
cggauaucaccac

SEQ ID NO: 3890920 - RNA, 16 nt, Shigella flexneri 2a str. 301
cggauaucgagaauca

SEQ ID NO: 3890921 - RNA, 18 nt, Shigella flexneri 2a str. 301
cggauaucuuucgccaug

SEQ ID NO: 3890922 - RNA, 19 nt, Shigella flexneri 2a str. 301
cggauccccugcgcggcga

SEQ ID NO: 3890923 - RNA, 16 nt, Shigella flexneri 2a str. 301
cggauccugagcaaac

SEQ ID NO: 3890924 - RNA, 19 nt, Shigella flexneri 2a str. 301
cggaucgaacuccgccccg

SEQ ID NO: 3890925 - RNA, 14 nt, Shigella flexneri 2a str. 301
cggaucgccgccgg

SEQ ID NO: 3890926 - RNA, 15 nt, Shigella flexneri 2a str. 301
cggaucggaggcagc

SEQ ID NO: 3890927 - RNA, 17 nt, Shigella flexneri 2a str. 301
cggaucgguggcgcggu

SEQ ID NO: 3890928 - RNA, 22 nt, Shigella flexneri 2a str. 301
cggaugaggcguuaacagcgca

SEQ ID NO: 3890929 - RNA, 16 nt, Shigella flexneri 2a str. 301
cggaugaucauccggc

SEQ ID NO: 3890930 - RNA, 19 nt, Shigella flexneri 2a str. 301
cggaugaugcuccccaggg

SEQ ID NO: 3890931 - RNA, 12 nt, Shigella flexneri 2a str. 301
cggaugcagcgg

SEQ ID NO: 3890932 - RNA, 20 nt, Shigella flexneri 2a str. 301
cggaugccaaucacaagacc

SEQ ID NO: 3890933 - RNA, 20 nt, Shigella flexneri 2a str. 301
cggaugcgaguuuucgcauc

SEQ ID NO: 3890934 - RNA, 17 nt, Shigella flexneri 2a str. 301
cggaugcgaugcuggcg

SEQ ID NO: 3890935 - RNA, 15 nt, Shigella flexneri 2a str. 301
cggaugcgccagcau

SEQ ID NO: 3890936 - RNA, 22 nt, Shigella flexneri 2a str. 301
cggaugcggcguaaacgccuua

SEQ ID NO: 3890937 - RNA, 17 nt, Shigella flexneri 2a str. 301
cggaugcggugcaagca

SEQ ID NO: 3890938 - RNA, 17 nt, Shigella flexneri 2a str. 301
cggauggcaaacugauu

SEQ ID NO: 3890939 - RNA, 14 nt, Shigella flexneri 2a str. 301
cggauggcagaguu

SEQ ID NO: 3890940 - RNA, 17 nt, Shigella flexneri 2a str. 301
cggauguagcaacggag

SEQ ID NO: 3890941 - RNA, 19 nt, Shigella flexneri 2a str. 301
cggcagucggcgcauaaug

SEQ ID NO: 3890942 - RNA, 14 nt, Shigella flexneri 2a str. 301
cggcagucugcuga

SEQ ID NO: 3890943 - RNA, 16 nt, Shigella flexneri 2a str. 301
cggcagugacugcccc

SEQ ID NO: 3890944 - RNA, 23 nt, Shigella flexneri 2a str. 301
cggcagugacugccccaguuccu

SEQ ID NO: 3890945 - RNA, 11 nt, Shigella flexneri 2a str. 301
cggcagugcca

SEQ ID NO: 3890946 - RNA, 22 nt, Shigella flexneri 2a str. 301
cggcaguucgguugggaucgcc

SEQ ID NO: 3890947 - RNA, 19 nt, Shigella flexneri 2a str. 301
cggcaguuggcgcacaaug

SEQ ID NO: 3890948 - RNA, 16 nt, Shigella flexneri 2a str. 301
cggcaguuugagauug

SEQ ID NO: 3890949 - RNA, 16 nt, Shigella flexneri 2a str. 301
cggcauaaacaaagug

SEQ ID NO: 3890950 - RNA, 13 nt, Shigella flexneri 2a str. 301
cggcauaaacgcu

SEQ ID NO: 3890951 - RNA, 11 nt, Shigella flexneri 2a str. 301
cggcauaauca

SEQ ID NO: 3890952 - RNA, 21 nt, Shigella flexneri 2a str. 301
cggcauaccacggucauugac

SEQ ID NO: 3890953 - RNA, 23 nt, Shigella flexneri 2a str. 301
cggcauacguugcaggaaccgca

SEQ ID NO: 3890954 - RNA, 23 nt, Shigella flexneri 2a str. 301
cggcauagccaccuggcugcguu

SEQ ID NO: 3890955 - RNA, 17 nt, Shigella flexneri 2a str. 301
cggcauauccaccaccc

SEQ ID NO: 3890956 - RNA, 21 nt, Shigella flexneri 2a str. 301
cggcauauccaccacccagcg

SEQ ID NO: 3890957 - RNA, 18 nt, Shigella flexneri 2a str. 301
cggcaucagaaacacacu

SEQ ID NO: 3890958 - RNA, 15 nt, Shigella flexneri 2a str. 301
cggcaucagcagaau

SEQ ID NO: 3890959 - RNA, 22 nt, Shigella flexneri 2a str. 301
cggcaucagcagaaucgcaacc

SEQ ID NO: 3890960 - RNA, 17 nt, Shigella flexneri 2a str. 301
cggcaucgcaaaccaga

SEQ ID NO: 3890961 - RNA, 17 nt, Shigella flexneri 2a str. 301
cggcaucgccgcuaucg

SEQ ID NO: 3890962 - RNA, 13 nt, Shigella flexneri 2a str. 301
cggcaucgcucca

SEQ ID NO: 3890963 - RNA, 21 nt, Shigella flexneri 2a str. 301
cggcaucgcuccacgccauau

SEQ ID NO: 3890964 - RNA, 18 nt, Shigella flexneri 2a str. 301
cggcaucuucuccacgcc

SEQ ID NO: 3890965 - RNA, 18 nt, Shigella flexneri 2a str. 301
cggcaucuuguucauagu

SEQ ID NO: 3890966 - RNA, 14 nt, Shigella flexneri 2a str. 301
cggcaugaaagcga

SEQ ID NO: 3890967 - RNA, 21 nt, Shigella flexneri 2a str. 301
cggcaugaacaaagcgcaccu

SEQ ID NO: 3890968 - RNA, 16 nt, Shigella flexneri 2a str. 301
cggcaugacgccgggc

SEQ ID NO: 3890969 - RNA, 14 nt, Shigella flexneri 2a str. 301
cggcaugauaccga

SEQ ID NO: 3890970 - RNA, 15 nt, Shigella flexneri 2a str. 301
cggcauucagugcaa

SEQ ID NO: 3890971 - RNA, 14 nt, Shigella flexneri 2a str. 301
cggcauucugcugg

SEQ ID NO: 3890972 - RNA, 22 nt, Shigella flexneri 2a str. 301
cggcauucugcuggccuggcug

SEQ ID NO: 3890973 - RNA, 15 nt, Shigella flexneri 2a str. 301
cggcauuuugcugau

SEQ ID NO: 3890974 - RNA, 18 nt, Shigella flexneri 2a str. 301
cggcauuuugcugaugca

SEQ ID NO: 3890975 - RNA, 22 nt, Shigella flexneri 2a str. 301
cggcauuuuucggcgucagaac

SEQ ID NO: 3890976 - RNA, 18 nt, Shigella flexneri 2a str. 301
cggcauuuuuuucaccaa

SEQ ID NO: 3890977 - RNA, 23 nt, Shigella flexneri 2a str. 301
cggcauuuuuuucaccaacgcaa

SEQ ID NO: 3890978 - RNA, 16 nt, Shigella flexneri 2a str. 301
cggccaaaauguggau

SEQ ID NO: 3890979 - RNA, 15 nt, Shigella flexneri 2a str. 301
cggccaaauauccgc

SEQ ID NO: 3890980 - RNA, 21 nt, Shigella flexneri 2a str. 301
cggccaaccauccgucaucca

SEQ ID NO: 3890981 - RNA, 14 nt, Shigella flexneri 2a str. 301
cggccacagccagc

SEQ ID NO: 3890982 - RNA, 15 nt, Shigella flexneri 2a str. 301
cggccacgcauaacg

SEQ ID NO: 3890983 - RNA, 12 nt, Shigella flexneri 2a str. 301
cggccagcaccu

SEQ ID NO: 3890984 - RNA, 12 nt, Shigella flexneri 2a str. 301
cggccagcagcu

SEQ ID NO: 3890985 - RNA, 16 nt, Shigella flexneri 2a str. 301
cggccagcaucgcaac

SEQ ID NO: 3890986 - RNA, 19 nt, Shigella flexneri 2a str. 301
cggccagccauccgucauc

SEQ ID NO: 3890987 - RNA, 14 nt, Shigella flexneri 2a str. 301
cggccagcgggcgu

SEQ ID NO: 3890988 - RNA, 22 nt, Shigella flexneri 2a str. 301
cggccagcgggcgucaaaauca

SEQ ID NO: 3890989 - RNA, 15 nt, Shigella flexneri 2a str. 301
cggccagguuaacca

SEQ ID NO: 3890990 - RNA, 12 nt, Shigella flexneri 2a str. 301
cggccaguaacc

SEQ ID NO: 3890991 - RNA, 18 nt, Shigella flexneri 2a str. 301
cggccaguaaccuuucag

SEQ ID NO: 3890992 - RNA, 14 nt, Shigella flexneri 2a str. 301
cggccauauccagc

SEQ ID NO: 3890993 - RNA, 18 nt, Shigella flexneri 2a str. 301
cggcccaccuggcugagc

SEQ ID NO: 3890994 - RNA, 18 nt, Shigella flexneri 2a str. 301
cggccccaucgaaccauc

SEQ ID NO: 3890995 - RNA, 20 nt, Shigella flexneri 2a str. 301
cggccccgucucccgaugcc

SEQ ID NO: 3890996 - RNA, 22 nt, Shigella flexneri 2a str. 301
cggcccgcucggcggcuggcug

SEQ ID NO: 3890997 - RNA, 18 nt, Shigella flexneri 2a str. 301
cggcccggcccaacgcau

SEQ ID NO: 3890998 - RNA, 15 nt, Shigella flexneri 2a str. 301
cggcccggcgacgac

SEQ ID NO: 3890999 - RNA, 14 nt, Shigella flexneri 2a str. 301
cggcccggcuuucu

SEQ ID NO: 3891000 - RNA, 20 nt, Shigella flexneri 2a str. 301
cggcccguuccgcgacuauc

SEQ ID NO: 3891001 - RNA, 17 nt, Shigella flexneri 2a str. 301
cggccggaugacagacu

SEQ ID NO: 3891002 - RNA, 22 nt, Shigella flexneri 2a str. 301
cggccuacaaaagcaauaauuu

SEQ ID NO: 3891003 - RNA, 20 nt, Shigella flexneri 2a str. 301
cggccuacacaugcgucccc

SEQ ID NO: 3891004 - RNA, 15 nt, Shigella flexneri 2a str. 301
cggccuaccaugacc

SEQ ID NO: 3891005 - RNA, 20 nt, Shigella flexneri 2a str. 301
cggccugcgcgaugaugcca

SEQ ID NO: 3891006 - RNA, 20 nt, Shigella flexneri 2a str. 301
cggccuugcggguaguccgc

SEQ ID NO: 3891007 - RNA, 13 nt, Shigella flexneri 2a str. 301
cggccuuuuccuu

SEQ ID NO: 3891008 - RNA, 14 nt, Shigella flexneri 2a str. 301
cggcgaaaacgcca

SEQ ID NO: 3891009 - RNA, 20 nt, Shigella flexneri 2a str. 301
cggcgaaacgguaauuauug

SEQ ID NO: 3891010 - RNA, 12 nt, Shigella flexneri 2a str. 301
cggcgaaagagc

SEQ ID NO: 3891011 - RNA, 18 nt, Shigella flexneri 2a str. 301
cggcgaagauacccgcga

SEQ ID NO: 3891012 - RNA, 22 nt, Shigella flexneri 2a str. 301
cggcgaccguucgccaggucag

SEQ ID NO: 3891013 - RNA, 19 nt, Shigella flexneri 2a str. 301
cggcgacgacgguuuccac

SEQ ID NO: 3891014 - RNA, 18 nt, Shigella flexneri 2a str. 301
cggcgacuggauaaugaa

SEQ ID NO: 3891015 - RNA, 18 nt, Shigella flexneri 2a str. 301
cggcgagcaacgcagcgg

SEQ ID NO: 3891016 - RNA, 13 nt, Shigella flexneri 2a str. 301
cggcgagccagcg

SEQ ID NO: 3891017 - RNA, 18 nt, Shigella flexneri 2a str. 301
cggcgagggcuauuucuu

SEQ ID NO: 3891018 - RNA, 20 nt, Shigella flexneri 2a str. 301
cggcgaguauucuugcugau

SEQ ID NO: 3891019 - RNA, 14 nt, Shigella flexneri 2a str. 301
cggcgaguguucgg

SEQ ID NO: 3891020 - RNA, 13 nt, Shigella flexneri 2a str. 301
cggcgauaccagu

SEQ ID NO: 3891021 - RNA, 14 nt, Shigella flexneri 2a str. 301
cggcgaucgugagc

SEQ ID NO: 3891022 - RNA, 18 nt, Shigella flexneri 2a str. 301
cggcgaucuuuuaauaau

SEQ ID NO: 3891023 - RNA, 22 nt, Shigella flexneri 2a str. 301
cggcgcaauucccggaccguca

SEQ ID NO: 3891024 - RNA, 14 nt, Shigella flexneri 2a str. 301
cggcgcgccaggcg

SEQ ID NO: 3891025 - RNA, 13 nt, Shigella flexneri 2a str. 301
cggcgcggcagcu

SEQ ID NO: 3891026 - RNA, 23 nt, Shigella flexneri 2a str. 301
cggcgcguugaugccgugcagca

SEQ ID NO: 3891027 - RNA, 16 nt, Shigella flexneri 2a str. 301
cggcgcuaauggcacg

SEQ ID NO: 3891028 - RNA, 18 nt, Shigella flexneri 2a str. 301
cggcgcuaauucaacgcc

SEQ ID NO: 3891029 - RNA, 14 nt, Shigella flexneri 2a str. 301
cggcgcuacggcgu

SEQ ID NO: 3891030 - RNA, 11 nt, Shigella flexneri 2a str. 301
cggcgcuucca

SEQ ID NO: 3891031 - RNA, 13 nt, Shigella flexneri 2a str. 301
cggcgcuuucagc

SEQ ID NO: 3891032 - RNA, 17 nt, Shigella flexneri 2a str. 301
cggcggaaagggccgca

SEQ ID NO: 3891033 - RNA, 22 nt, Shigella flexneri 2a str. 301
cggcggaauagcguacggcaug

SEQ ID NO: 3891034 - RNA, 13 nt, Shigella flexneri 2a str. 301
cggcggcacagcg

SEQ ID NO: 3891035 - RNA, 21 nt, Shigella flexneri 2a str. 301
cggcggcaguugcccgguuuc

SEQ ID NO: 3891036 - RNA, 14 nt, Shigella flexneri 2a str. 301
cggcgggcgauauc

SEQ ID NO: 3891037 - RNA, 16 nt, Shigella flexneri 2a str. 301
cggcgguaaaaucauc

SEQ ID NO: 3891038 - RNA, 15 nt, Shigella flexneri 2a str. 301
cggcgguaucgucgg

SEQ ID NO: 3891039 - RNA, 16 nt, Shigella flexneri 2a str. 301
cggcggugaccagcag

SEQ ID NO: 3891040 - RNA, 23 nt, Shigella flexneri 2a str. 301
cggcggugaccagcagcauuuca

SEQ ID NO: 3891041 - RNA, 13 nt, Shigella flexneri 2a str. 301
cgggauauggcga

SEQ ID NO: 3891042 - RNA, 20 nt, Shigella flexneri 2a str. 301
cgggaucagguauaccgaaa

SEQ ID NO: 3891043 - RNA, 14 nt, Shigella flexneri 2a str. 301
cgggaucgaguuca

SEQ ID NO: 3891044 - RNA, 13 nt, Shigella flexneri 2a str. 301
cgggaucugaugg

SEQ ID NO: 3891045 - RNA, 22 nt, Shigella flexneri 2a str. 301
cgggaucugauucugauccugc

SEQ ID NO: 3891046 - RNA, 22 nt, Shigella flexneri 2a str. 301
cgggauucccccaggccgugau

SEQ ID NO: 3891047 - RNA, 18 nt, Shigella flexneri 2a str. 301
cgggauucgaaccuguga

SEQ ID NO: 3891048 - RNA, 17 nt, Shigella flexneri 2a str. 301
cgggauugccagaugcg

SEQ ID NO: 3891049 - RNA, 18 nt, Shigella flexneri 2a str. 301
cgggcaaagcgacgcgca

SEQ ID NO: 3891050 - RNA, 18 nt, Shigella flexneri 2a str. 301
cgggcaaauccacugaau

SEQ ID NO: 3891051 - RNA, 16 nt, Shigella flexneri 2a str. 301
cgggcaacguuccagc

SEQ ID NO: 3891052 - RNA, 13 nt, Shigella flexneri 2a str. 301
cgggcaacugcug

SEQ ID NO: 3891053 - RNA, 13 nt, Shigella flexneri 2a str. 301
cgggcaacuucaa

SEQ ID NO: 3891054 - RNA, 16 nt, Shigella flexneri 2a str. 301
cgggcaagcaccaggg

SEQ ID NO: 3891055 - RNA, 14 nt, Shigella flexneri 2a str. 301
cgggcaaucggcug

SEQ ID NO: 3891056 - RNA, 15 nt, Shigella flexneri 2a str. 301
cgggcaccgccgccg

SEQ ID NO: 3891057 - RNA, 16 nt, Shigella flexneri 2a str. 301
cgggcagaggcaauau

SEQ ID NO: 3891058 - RNA, 20 nt, Shigella flexneri 2a str. 301
cgggcaggcuucaacacagg

SEQ ID NO: 3891059 - RNA, 14 nt, Shigella flexneri 2a str. 301
cgggcauauuuccg

SEQ ID NO: 3891060 - RNA, 15 nt, Shigella flexneri 2a str. 301
cgggcaucagcagca

SEQ ID NO: 3891061 - RNA, 14 nt, Shigella flexneri 2a str. 301
cgggcaugauagcc

SEQ ID NO: 3891062 - RNA, 19 nt, Shigella flexneri 2a str. 301
cgggcaugauagcccggau

SEQ ID NO: 3891063 - RNA, 17 nt, Shigella flexneri 2a str. 301
cgggccaguuucauagu

SEQ ID NO: 3891064 - RNA, 18 nt, Shigella flexneri 2a str. 301
cgggccaguuucauagug

SEQ ID NO: 3891065 - RNA, 20 nt, Shigella flexneri 2a str. 301
cgggccauaaaaggaagagg

SEQ ID NO: 3891066 - RNA, 18 nt, Shigella flexneri 2a str. 301
cgggccaucagagcugga

SEQ ID NO: 3891067 - RNA, 15 nt, Shigella flexneri 2a str. 301
cgggccgcaaaccag

SEQ ID NO: 3891068 - RNA, 17 nt, Shigella flexneri 2a str. 301
cgggccguaacugugcc

SEQ ID NO: 3891069 - RNA, 21 nt, Shigella flexneri 2a str. 301
cgggccuccccggauucaucc

SEQ ID NO: 3891070 - RNA, 16 nt, Shigella flexneri 2a str. 301
cgggcgaaagcagaaa

SEQ ID NO: 3891071 - RNA, 17 nt, Shigella flexneri 2a str. 301
cgggcgaaguucgccau

SEQ ID NO: 3891072 - RNA, 18 nt, Shigella flexneri 2a str. 301
cgggcgaauuuacccggu

SEQ ID NO: 3891073 - RNA, 14 nt, Shigella flexneri 2a str. 301
cgggcgaccaauca

SEQ ID NO: 3891074 - RNA, 16 nt, Shigella flexneri 2a str. 301
cgggcgauccggcaaa

SEQ ID NO: 3891075 - RNA, 15 nt, Shigella flexneri 2a str. 301
cgggcggccucuuca

SEQ ID NO: 3891076 - RNA, 23 nt, Shigella flexneri 2a str. 301
cgggcggccucuucaaacggcau

SEQ ID NO: 3891077 - RNA, 14 nt, Shigella flexneri 2a str. 301
cgggcguccugcuu

SEQ ID NO: 3891078 - RNA, 15 nt, Shigella flexneri 2a str. 301
cgggcgugcugccgu

SEQ ID NO: 3891079 - RNA, 22 nt, Shigella flexneri 2a str. 301
cgggcuaacuucuuuuucgaca

SEQ ID NO: 3891080 - RNA, 14 nt, Shigella flexneri 2a str. 301
cgggcuaaucguca

SEQ ID NO: 3891081 - RNA, 15 nt, Shigella flexneri 2a str. 301
cgggcuaaucgucau

SEQ ID NO: 3891082 - RNA, 13 nt, Shigella flexneri 2a str. 301
cgggcucaugcug

SEQ ID NO: 3891083 - RNA, 19 nt, Shigella flexneri 2a str. 301
cgggcuggcguacccauca

SEQ ID NO: 3891084 - RNA, 15 nt, Shigella flexneri 2a str. 301
cgggcuuaccacggg

SEQ ID NO: 3891085 - RNA, 18 nt, Shigella flexneri 2a str. 301
cggggaacaucaggcauu

SEQ ID NO: 3891086 - RNA, 14 nt, Shigella flexneri 2a str. 301
cggggacaggcggg

SEQ ID NO: 3891087 - RNA, 16 nt, Shigella flexneri 2a str. 301
cggggacgcugucggc

SEQ ID NO: 3891088 - RNA, 19 nt, Shigella flexneri 2a str. 301
cggggagauauuccccaga

SEQ ID NO: 3891089 - RNA, 17 nt, Shigella flexneri 2a str. 301
cggggaucacuggcaga

SEQ ID NO: 3891090 - RNA, 20 nt, Shigella flexneri 2a str. 301
cggggauuacuccccgcaca

SEQ ID NO: 3891091 - RNA, 17 nt, Shigella flexneri 2a str. 301
cggggcuauaccagaua

SEQ ID NO: 3891092 - RNA, 22 nt, Shigella flexneri 2a str. 301
cgggggcggcaaucgcugcuaa

SEQ ID NO: 3891093 - RNA, 15 nt, Shigella flexneri 2a str. 301
cggggguaaaaccgg

SEQ ID NO: 3891094 - RNA, 23 nt, Shigella flexneri 2a str. 301
cgggguaaauccacguuccugga

SEQ ID NO: 3891095 - RNA, 14 nt, Shigella flexneri 2a str. 301
cggggucgugcaga

SEQ ID NO: 3891096 - RNA, 23 nt, Shigella flexneri 2a str. 301
cgggguuugcguuugcagcauug

SEQ ID NO: 3891097 - RNA, 20 nt, Shigella flexneri 2a str. 301
cggguaaauaauauccccag

SEQ ID NO: 3891098 - RNA, 20 nt, Shigella flexneri 2a str. 301
cggguaacggaccgcauuca

SEQ ID NO: 3891099 - RNA, 21 nt, Shigella flexneri 2a str. 301
cggguaacuaauaauugcccc

SEQ ID NO: 3891100 - RNA, 19 nt, Shigella flexneri 2a str. 301
cggguaagaauauccggcu

SEQ ID NO: 3891101 - RNA, 20 nt, Shigella flexneri 2a str. 301
cggguaagaauauccggcuc

SEQ ID NO: 3891102 - RNA, 14 nt, Shigella flexneri 2a str. 301
cggguaccagaauc

SEQ ID NO: 3891103 - RNA, 13 nt, Shigella flexneri 2a str. 301
cggguauucaucc

SEQ ID NO: 3891104 - RNA, 17 nt, Shigella flexneri 2a str. 301
cgggucaccugccaggg

SEQ ID NO: 3891105 - RNA, 16 nt, Shigella flexneri 2a str. 301
cgggucauaaucagau

SEQ ID NO: 3891106 - RNA, 20 nt, Shigella flexneri 2a str. 301
cgggugaagagauccaccag

SEQ ID NO: 3891107 - RNA, 14 nt, Shigella flexneri 2a str. 301
cgggugcauuuuca

SEQ ID NO: 3891108 - RNA, 20 nt, Shigella flexneri 2a str. 301
cggguggcucucgccagcac

SEQ ID NO: 3891109 - RNA, 17 nt, Shigella flexneri 2a str. 301
cggguuaaccagcacca

SEQ ID NO: 3891110 - RNA, 20 nt, Shigella flexneri 2a str. 301
cggguuagguggcaccugac

SEQ ID NO: 3891111 - RNA, 16 nt, Shigella flexneri 2a str. 301
cggguuggagcgcguc

SEQ ID NO: 3891112 - RNA, 19 nt, Shigella flexneri 2a str. 301
cggguuuaagcccggcauu

SEQ ID NO: 3891113 - RNA, 22 nt, Shigella flexneri 2a str. 301
cggguuucccaugccauuucca

SEQ ID NO: 3891114 - RNA, 13 nt, Shigella flexneri 2a str. 301
cggguuuccugga

SEQ ID NO: 3891115 - RNA, 17 nt, Shigella flexneri 2a str. 301
cggguuuggccgggaag

SEQ ID NO: 3891116 - RNA, 14 nt, Shigella flexneri 2a str. 301
cggguuuucaauga

SEQ ID NO: 3891117 - RNA, 21 nt, Shigella flexneri 2a str. 301
cggguuuuucgcgcgggcaga

SEQ ID NO: 3891118 - RNA, 13 nt, Shigella flexneri 2a str. 301
cgguaaaaucauc

SEQ ID NO: 3891119 - RNA, 14 nt, Shigella flexneri 2a str. 301
cgguaaaaucaucc

SEQ ID NO: 3891120 - RNA, 16 nt, Shigella flexneri 2a str. 301
cgguaaaaucauccug

SEQ ID NO: 3891121 - RNA, 16 nt, Shigella flexneri 2a str. 301
cgguaaagcccucacc

SEQ ID NO: 3891122 - RNA, 22 nt, Shigella flexneri 2a str. 301
cgguaaagccgugcugcugcca

SEQ ID NO: 3891123 - RNA, 13 nt, Shigella flexneri 2a str. 301
cgguaacccuuca

SEQ ID NO: 3891124 - RNA, 15 nt, Shigella flexneri 2a str. 301
cgguaacuuaucugu

SEQ ID NO: 3891125 - RNA, 16 nt, Shigella flexneri 2a str. 301
cgguaagaacaagcaa

SEQ ID NO: 3891126 - RNA, 23 nt, Shigella flexneri 2a str. 301
cgguaagaguaaagcccgccauc

SEQ ID NO: 3891127 - RNA, 15 nt, Shigella flexneri 2a str. 301
cgguaagcugaugac

SEQ ID NO: 3891128 - RNA, 16 nt, Shigella flexneri 2a str. 301
cgguaauccgggugaa

SEQ ID NO: 3891129 - RNA, 13 nt, Shigella flexneri 2a str. 301
cgguaauggcaaa

SEQ ID NO: 3891130 - RNA, 14 nt, Shigella flexneri 2a str. 301
cgguaauuucacaa

SEQ ID NO: 3891131 - RNA, 23 nt, Shigella flexneri 2a str. 301
cgguacaaacaucauccagugcc

SEQ ID NO: 3891132 - RNA, 17 nt, Shigella flexneri 2a str. 301
cgguacagagcaauaaa

SEQ ID NO: 3891133 - RNA, 22 nt, Shigella flexneri 2a str. 301
cgguacaucaauaccauuauca

SEQ ID NO: 3891134 - RNA, 24 nt, Shigella flexneri 2a str. 301
cgguaccaguacgcccacgccagc

SEQ ID NO: 3891135 - RNA, 22 nt, Shigella flexneri 2a str. 301
cgguacgcuuucacccggcgcu

SEQ ID NO: 3891136 - RNA, 12 nt, Shigella flexneri 2a str. 301
cgguacuucacc

SEQ ID NO: 3891137 - RNA, 23 nt, Shigella flexneri 2a str. 301
cgguagauuauuucgcugcggau

SEQ ID NO: 3891138 - RNA, 15 nt, Shigella flexneri 2a str. 301
cgguagcagcuuuca

SEQ ID NO: 3891139 - RNA, 20 nt, Shigella flexneri 2a str. 301
cgguagcagcuuucagcagc

SEQ ID NO: 3891140 - RNA, 22 nt, Shigella flexneri 2a str. 301
cgguagcagcuuucagcagcgg

SEQ ID NO: 3891141 - RNA, 15 nt, Shigella flexneri 2a str. 301
cgguugcugaacagc

SEQ ID NO: 3891142 - RNA, 22 nt, Shigella flexneri 2a str. 301
cgguugcugaacagcuuuuucc

SEQ ID NO: 3891143 - RNA, 22 nt, Shigella flexneri 2a str. 301
cgguuguucaaccaccggcacc

SEQ ID NO: 3891144 - RNA, 18 nt, Shigella flexneri 2a str. 301
cgguuuaaaccugauuuu

SEQ ID NO: 3891145 - RNA, 21 nt, Shigella flexneri 2a str. 301
cgguuuauccauccccagagc

SEQ ID NO: 3891146 - RNA, 14 nt, Shigella flexneri 2a str. 301
cgguuuauccccaa

SEQ ID NO: 3891147 - RNA, 18 nt, Shigella flexneri 2a str. 301
cgguuucaauuucccgcu

SEQ ID NO: 3891148 - RNA, 18 nt, Shigella flexneri 2a str. 301
cgguuucaguggggcagg

SEQ ID NO: 3891149 - RNA, 14 nt, Shigella flexneri 2a str. 301
cgguuucucuucug

SEQ ID NO: 3891150 - RNA, 16 nt, Shigella flexneri 2a str. 301
cgguuucucuucugcu

SEQ ID NO: 3891151 - RNA, 13 nt, Shigella flexneri 2a str. 301
cgguuugccauuu

SEQ ID NO: 3891152 - RNA, 16 nt, Shigella flexneri 2a str. 301
cgguuugccauuuucu

SEQ ID NO: 3891153 - RNA, 14 nt, Shigella flexneri 2a str. 301
cgguuugcggcagg

SEQ ID NO: 3891154 - RNA, 14 nt, Shigella flexneri 2a str. 301
cgguuuucacgccu

SEQ ID NO: 3891155 - RNA, 14 nt, Shigella flexneri 2a str. 301
cgguuuucaucauc

SEQ ID NO: 3891156 - RNA, 23 nt, Shigella flexneri 2a str. 301
cgguuuugcaggaaaaacugccc

SEQ ID NO: 3891157 - RNA, 15 nt, Shigella flexneri 2a str. 301
cgguuuuuugcuccg

SEQ ID NO: 3891158 - RNA, 11 nt, Shigella flexneri 2a str. 301
cguaaaaaaug

SEQ ID NO: 3891159 - RNA, 17 nt, Shigella flexneri 2a str. 301
cguaaaaacccgcuucg

SEQ ID NO: 3891160 - RNA, 18 nt, Shigella flexneri 2a str. 301
cguaaaaacccgcuucgg

SEQ ID NO: 3891161 - RNA, 13 nt, Shigella flexneri 2a str. 301
cguaaaacucagg

SEQ ID NO: 3891162 - RNA, 16 nt, Shigella flexneri 2a str. 301
cguaaaagccuggacc

SEQ ID NO: 3891163 - RNA, 20 nt, Shigella flexneri 2a str. 301
cguaaaagccuggaccauau

SEQ ID NO: 3891164 - RNA, 17 nt, Shigella flexneri 2a str. 301
cguaaaccacugacaca

SEQ ID NO: 3891165 - RNA, 21 nt, Shigella flexneri 2a str. 301
cguaaacgccuuauccggccu

SEQ ID NO: 3891166 - RNA, 13 nt, Shigella flexneri 2a str. 301
cguaaacgugcgg

SEQ ID NO: 3891167 - RNA, 17 nt, Shigella flexneri 2a str. 301
cguaaagaaccucuuca

SEQ ID NO: 3891168 - RNA, 13 nt, Shigella flexneri 2a str. 301
cguaaaguuaccu

SEQ ID NO: 3891169 - RNA, 18 nt, Shigella flexneri 2a str. 301
cguaaauaccuuccggcg

SEQ ID NO: 3891170 - RNA, 13 nt, Shigella flexneri 2a str. 301
cguaaaucaaacc

SEQ ID NO: 3891171 - RNA, 18 nt, Shigella flexneri 2a str. 301
cguaaaucgucaguagcg

SEQ ID NO: 3891172 - RNA, 11 nt, Shigella flexneri 2a str. 301
cguaaaugccu

SEQ ID NO: 3891173 - RNA, 18 nt, Shigella flexneri 2a str. 301
cguaaauucaauauauug

SEQ ID NO: 3891174 - RNA, 13 nt, Shigella flexneri 2a str. 301
cguaacaaaacuc

SEQ ID NO: 3891175 - RNA, 16 nt, Shigella flexneri 2a str. 301
cguaacauaguuuccc

SEQ ID NO: 3891176 - RNA, 14 nt, Shigella flexneri 2a str. 301
cguaacauauuccc

SEQ ID NO: 3891177 - RNA, 17 nt, Shigella flexneri 2a str. 301
cguaaccagacggcgua

SEQ ID NO: 3891178 - RNA, 14 nt, Shigella flexneri 2a str. 301
cguaaccgagcaga

SEQ ID NO: 3891179 - RNA, 14 nt, Shigella flexneri 2a str. 301
cguaacgaccacca

SEQ ID NO: 3891180 - RNA, 15 nt, Shigella flexneri 2a str. 301
cguaacgaccaccac

SEQ ID NO: 3891181 - RNA, 17 nt, Shigella flexneri 2a str. 301
cguaacgaccaccaccg

SEQ ID NO: 3891182 - RNA, 20 nt, Shigella flexneri 2a str. 301
cguaacgaccaccaccgcag

SEQ ID NO: 3891183 - RNA, 15 nt, Shigella flexneri 2a str. 301
cguaacgacugacuu

SEQ ID NO: 3891184 - RNA, 22 nt, Shigella flexneri 2a str. 301
cguaacgccacgauagagagca

SEQ ID NO: 3891185 - RNA, 23 nt, Shigella flexneri 2a str. 301
cguaacgccacgauagagagcag

SEQ ID NO: 3891186 - RNA, 20 nt, Shigella flexneri 2a str. 301
cguaacguuucuuucaucag

SEQ ID NO: 3891187 - RNA, 16 nt, Shigella flexneri 2a str. 301
cguaacucauccaacu

SEQ ID NO: 3891188 - RNA, 18 nt, Shigella flexneri 2a str. 301
cguaagaugacauugaca

SEQ ID NO: 3891189 - RNA, 21 nt, Shigella flexneri 2a str. 301
cguaagcaaaaguagcaaagu

SEQ ID NO: 3891190 - RNA, 17 nt, Shigella flexneri 2a str. 301
cguaagcaacgccaaau

SEQ ID NO: 3891191 - RNA, 21 nt, Shigella flexneri 2a str. 301
cguaaguuaacugcacaccgc

SEQ ID NO: 3891192 - RNA, 18 nt, Shigella flexneri 2a str. 301
cguaaguuagaggcacau

SEQ ID NO: 3891193 - RNA, 16 nt, Shigella flexneri 2a str. 301
cguaauaaaaucuauu

SEQ ID NO: 3891194 - RNA, 22 nt, Shigella flexneri 2a str. 301
cguaaucaacauauuccccugg

SEQ ID NO: 3891195 - RNA, 16 nt, Shigella flexneri 2a str. 301
cguaauccguaaagcc

SEQ ID NO: 3891196 - RNA, 17 nt, Shigella flexneri 2a str. 301
cguaaucgcccgcuucc

SEQ ID NO: 3891197 - RNA, 18 nt, Shigella flexneri 2a str. 301
cguaaucuuuucauauua

SEQ ID NO: 3891198 - RNA, 23 nt, Shigella flexneri 2a str. 301
cguaaugaauguuuuccugcuuc

SEQ ID NO: 3891199 - RNA, 18 nt, Shigella flexneri 2a str. 301
cguaaugauguaaaaaua

SEQ ID NO: 3891200 - RNA, 19 nt, Shigella flexneri 2a str. 301
cguaaugauguaaaaauac

SEQ ID NO: 3891201 - RNA, 22 nt, Shigella flexneri 2a str. 301
cguaaugccugggcgauuuccu

SEQ ID NO: 3891202 - RNA, 20 nt, Shigella flexneri 2a str. 301
cguaaugcuucuaccgucug

SEQ ID NO: 3891203 - RNA, 23 nt, Shigella flexneri 2a str. 301
cguaauggaugcccgcgggcgaa

SEQ ID NO: 3891204 - RNA, 15 nt, Shigella flexneri 2a str. 301
cguaaugucggugaa

SEQ ID NO: 3891205 - RNA, 23 nt, Shigella flexneri 2a str. 301
cguaauuaguggcuaaccgucug

SEQ ID NO: 3891206 - RNA, 16 nt, Shigella flexneri 2a str. 301
cguaauuggccugaca

SEQ ID NO: 3891207 - RNA, 14 nt, Shigella flexneri 2a str. 301
cguacaaauuuauc

SEQ ID NO: 3891208 - RNA, 16 nt, Shigella flexneri 2a str. 301
cguacaaccaaaucug

SEQ ID NO: 3891209 - RNA, 20 nt, Shigella flexneri 2a str. 301
cguacaccaacaucacgcaa

SEQ ID NO: 3891210 - RNA, 13 nt, Shigella flexneri 2a str. 301
cguacaggcacau

SEQ ID NO: 3891211 - RNA, 14 nt, Shigella flexneri 2a str. 301
cguacaggcagcuu

SEQ ID NO: 3891212 - RNA, 22 nt, Shigella flexneri 2a str. 301
cguacagggugagggcaauaau

SEQ ID NO: 3891213 - RNA, 15 nt, Shigella flexneri 2a str. 301
cguacaugcagggca

SEQ ID NO: 3891214 - RNA, 22 nt, Shigella flexneri 2a str. 301
cguacaugcagggcaaacucug

SEQ ID NO: 3891215 - RNA, 20 nt, Shigella flexneri 2a str. 301
cguacauugccgacauggca

SEQ ID NO: 3891216 - RNA, 21 nt, Shigella flexneri 2a str. 301
cguacauugccgacauggcaa

SEQ ID NO: 3891217 - RNA, 22 nt, Shigella flexneri 2a str. 301
cguacauugccgacauggcaau

SEQ ID NO: 3891218 - RNA, 18 nt, Shigella flexneri 2a str. 301
cguaccaaaacaccagcc

SEQ ID NO: 3891219 - RNA, 22 nt, Shigella flexneri 2a str. 301
cguaccaaccgcaauugcugua

SEQ ID NO: 3891220 - RNA, 23 nt, Shigella flexneri 2a str. 301
cguaccaaucagacucauauaaa

SEQ ID NO: 3891221 - RNA, 19 nt, Shigella flexneri 2a str. 301
cguaccacgcacagcccgc

SEQ ID NO: 3891222 - RNA, 16 nt, Shigella flexneri 2a str. 301
cguaccagccuugcca

SEQ ID NO: 3891223 - RNA, 14 nt, Shigella flexneri 2a str. 301
cguaccaucgccag

SEQ ID NO: 3891224 - RNA, 17 nt, Shigella flexneri 2a str. 301
cguaccaugauccugca

SEQ ID NO: 3891225 - RNA, 17 nt, Shigella flexneri 2a str. 301
cguaccauuaucaccaa

SEQ ID NO: 3891226 - RNA, 20 nt, Shigella flexneri 2a str. 301
cguaccauuaucaccaaacu

SEQ ID NO: 3891227 - RNA, 22 nt, Shigella flexneri 2a str. 301
cguaccggcaacgacugcgagc

SEQ ID NO: 3891228 - RNA, 21 nt, Shigella flexneri 2a str. 301
cguacgggcaaagcgacgcgc

SEQ ID NO: 3891229 - RNA, 19 nt, Shigella flexneri 2a str. 301
cguacgggucgggcugugu

SEQ ID NO: 3891230 - RNA, 21 nt, Shigella flexneri 2a str. 301
cguacgggucgggcuguguuu

SEQ ID NO: 3891231 - RNA, 16 nt, Shigella flexneri 2a str. 301
cguacguuaacagccu

SEQ ID NO: 3891232 - RNA, 21 nt, Shigella flexneri 2a str. 301
cguacucaccagacaucccag

SEQ ID NO: 3891233 - RNA, 21 nt, Shigella flexneri 2a str. 301
cguacuggcaaucgccagcgg

SEQ ID NO: 3891234 - RNA, 22 nt, Shigella flexneri 2a str. 301
cguacuggcaaucgccagcggc

SEQ ID NO: 3891235 - RNA, 16 nt, Shigella flexneri 2a str. 301
cguacuguuauccgcc

SEQ ID NO: 3891236 - RNA, 22 nt, Shigella flexneri 2a str. 301
cguagaaaaugcccauggcaag

SEQ ID NO: 3891237 - RNA, 19 nt, Shigella flexneri 2a str. 301
cguagaagccauuaaacac

SEQ ID NO: 3891238 - RNA, 15 nt, Shigella flexneri 2a str. 301
cguagaccgggcgaa

SEQ ID NO: 3891239 - RNA, 15 nt, Shigella flexneri 2a str. 301
cguagacugcagcgg

SEQ ID NO: 3891240 - RNA, 19 nt, Shigella flexneri 2a str. 301
cguccacagccaacacauu

SEQ ID NO: 3891241 - RNA, 22 nt, Shigella flexneri 2a str. 301
cguccacggugcgacacugcgu

SEQ ID NO: 3891242 - RNA, 19 nt, Shigella flexneri 2a str. 301
cguccagaugcgagauguc

SEQ ID NO: 3891243 - RNA, 20 nt, Shigella flexneri 2a str. 301
cguccagaugcgagaugucc

SEQ ID NO: 3891244 - RNA, 20 nt, Shigella flexneri 2a str. 301
cguccagcccuccgcgcugu

SEQ ID NO: 3891245 - RNA, 16 nt, Shigella flexneri 2a str. 301
cguccagcgaaccuuc

SEQ ID NO: 3891246 - RNA, 22 nt, Shigella flexneri 2a str. 301
cguccaguuugccuucacaggc

SEQ ID NO: 3891247 - RNA, 18 nt, Shigella flexneri 2a str. 301
cguccauuucagcgcaga

SEQ ID NO: 3891248 - RNA, 19 nt, Shigella flexneri 2a str. 301
cguccauuucagcgcagac

SEQ ID NO: 3891249 - RNA, 17 nt, Shigella flexneri 2a str. 301
cguccauuuugagggaa

SEQ ID NO: 3891250 - RNA, 17 nt, Shigella flexneri 2a str. 301
cgucccacgaccgcagc

SEQ ID NO: 3891251 - RNA, 18 nt, Shigella flexneri 2a str. 301
cgucccagccuugccaga

SEQ ID NO: 3891252 - RNA, 15 nt, Shigella flexneri 2a str. 301
cgucccaggcaaauc

SEQ ID NO: 3891253 - RNA, 20 nt, Shigella flexneri 2a str. 301
cgucccaucggcaaucauuc

SEQ ID NO: 3891254 - RNA, 15 nt, Shigella flexneri 2a str. 301
cguccccaucaggaa

SEQ ID NO: 3891255 - RNA, 21 nt, Shigella flexneri 2a str. 301
cgucccggugaagcgcccugc

SEQ ID NO: 3891256 - RNA, 19 nt, Shigella flexneri 2a str. 301
cguccgauuaaaaacccug

SEQ ID NO: 3891257 - RNA, 20 nt, Shigella flexneri 2a str. 301
cguccggcaucgcaaaccag

SEQ ID NO: 3891258 - RNA, 17 nt, Shigella flexneri 2a str. 301
cguccggcugccagcca

SEQ ID NO: 3891259 - RNA, 15 nt, Shigella flexneri 2a str. 301
cguccgguggcaucc

SEQ ID NO: 3891260 - RNA, 15 nt, Shigella flexneri 2a str. 301
cgucgaaauuauuca

SEQ ID NO: 3891261 - RNA, 16 nt, Shigella flexneri 2a str. 301
cgucgagggcaaccug

SEQ ID NO: 3891262 - RNA, 22 nt, Shigella flexneri 2a str. 301
cgucgauaaucguuggcagacg

SEQ ID NO: 3891263 - RNA, 19 nt, Shigella flexneri 2a str. 301
cgucgauaucgaugacgcg

SEQ ID NO: 3891264 - RNA, 22 nt, Shigella flexneri 2a str. 301
cgucgauuguuauaccagucca

SEQ ID NO: 3891265 - RNA, 15 nt, Shigella flexneri 2a str. 301
cgucgcaucaggcau

SEQ ID NO: 3891266 - RNA, 16 nt, Shigella flexneri 2a str. 301
cgucgcaucaggcaug

SEQ ID NO: 3891267 - RNA, 16 nt, Shigella flexneri 2a str. 301
cgucgcaucaggcauu

SEQ ID NO: 3891268 - RNA, 15 nt, Shigella flexneri 2a str. 301
cgucgcauccggcaa

SEQ ID NO: 3891269 - RNA, 13 nt, Shigella flexneri 2a str. 301
cgucgccuucaac

SEQ ID NO: 3891270 - RNA, 17 nt, Shigella flexneri 2a str. 301
cgucgcgcacgcccauc

SEQ ID NO: 3891271 - RNA, 16 nt, Shigella flexneri 2a str. 301
cgucgcgcccuccugc

SEQ ID NO: 3891272 - RNA, 23 nt, Shigella flexneri 2a str. 301
cgucgcgguugcugucggcggcg

SEQ ID NO: 3891273 - RNA, 12 nt, Shigella flexneri 2a str. 301
cgucgcuuuaua

SEQ ID NO: 3891274 - RNA, 20 nt, Shigella flexneri 2a str. 301
cgucggcaucgggcagcauc

SEQ ID NO: 3891275 - RNA, 19 nt, Shigella flexneri 2a str. 301
cgucggcgucaucgacauc

SEQ ID NO: 3891276 - RNA, 17 nt, Shigella flexneri 2a str. 301
cgucggcuuucagcgcg

SEQ ID NO: 3891277 - RNA, 22 nt, Shigella flexneri 2a str. 301
cgucggcuuucagcgcgacgcu

SEQ ID NO: 3891278 - RNA, 17 nt, Shigella flexneri 2a str. 301
cgucgguguccacuucc

SEQ ID NO: 3891279 - RNA, 23 nt, Shigella flexneri 2a str. 301
cgucgguucagggcaucaucauu

SEQ ID NO: 3891280 - RNA, 20 nt, Shigella flexneri 2a str. 301
cgucgguuccguucauaugg

SEQ ID NO: 3891281 - RNA, 21 nt, Shigella flexneri 2a str. 301
cgucgguucguaggccagaua

SEQ ID NO: 3891282 - RNA, 20 nt, Shigella flexneri 2a str. 301
cgucgucagcaguucacgca

SEQ ID NO: 3891283 - RNA, 21 nt, Shigella flexneri 2a str. 301
cgucgugaagcagagcagacg

SEQ ID NO: 3891284 - RNA, 20 nt, Shigella flexneri 2a str. 301
cgucguuacugucgcgcagc

SEQ ID NO: 3891285 - RNA, 17 nt, Shigella flexneri 2a str. 301
cgucuacaggcgcgacc

SEQ ID NO: 3891286 - RNA, 22 nt, Shigella flexneri 2a str. 301
cgucucaaucaccaccagcgga

SEQ ID NO: 3891287 - RNA, 14 nt, Shigella flexneri 2a str. 301
cgucucccgaugcc

SEQ ID NO: 3891288 - RNA, 16 nt, Shigella flexneri 2a str. 301
cgucuccugccgagcg

SEQ ID NO: 3891289 - RNA, 13 nt, Shigella flexneri 2a str. 301
cgucucgauacgc

SEQ ID NO: 3891290 - RNA, 20 nt, Shigella flexneri 2a str. 301
cgucucugguuuuacaacgu

SEQ ID NO: 3891291 - RNA, 15 nt, Shigella flexneri 2a str. 301
cgucugacggccuuc

SEQ ID NO: 3891292 - RNA, 15 nt, Shigella flexneri 2a str. 301
cgucugauguaauca

SEQ ID NO: 3891293 - RNA, 14 nt, Shigella flexneri 2a str. 301
cgucugcgccacca

SEQ ID NO: 3891294 - RNA, 18 nt, Shigella flexneri 2a str. 301
cgucugcgccaccacaac

SEQ ID NO: 3891295 - RNA, 23 nt, Shigella flexneri 2a str. 301
cgucuggaacggcagauccaaac

SEQ ID NO: 3891296 - RNA, 18 nt, Shigella flexneri 2a str. 301
cgucuggcagauccugaa

SEQ ID NO: 3891297 - RNA, 19 nt, Shigella flexneri 2a str. 301
cgucugggcaaaaucauca

SEQ ID NO: 3891298 - RNA, 19 nt, Shigella flexneri 2a str. 301
cgucuuaucaggccagcca

SEQ ID NO: 3891299 - RNA, 20 nt, Shigella flexneri 2a str. 301
cgucuuaucuggccuacaga

SEQ ID NO: 3891300 - RNA, 17 nt, Shigella flexneri 2a str. 301
cgucuuccgugccugac

SEQ ID NO: 3891301 - RNA, 13 nt, Shigella flexneri 2a str. 301
cgucuucguccca

SEQ ID NO: 3891302 - RNA, 16 nt, Shigella flexneri 2a str. 301
cgucuucugcagucac

SEQ ID NO: 3891303 - RNA, 18 nt, Shigella flexneri 2a str. 301
cgucuucugguugcgaaa

SEQ ID NO: 3891304 - RNA, 22 nt, Shigella flexneri 2a str. 301
cgucuuuauugaguaccagcgc

SEQ ID NO: 3891305 - RNA, 19 nt, Shigella flexneri 2a str. 301
cgucuuugcguuccaucag

SEQ ID NO: 3891306 - RNA, 14 nt, Shigella flexneri 2a str. 301
cgucuuuuacagcg

SEQ ID NO: 3891307 - RNA, 22 nt, Shigella flexneri 2a str. 301
cgucuuuuacagcgccagaagg

SEQ ID NO: 3891308 - RNA, 15 nt, Shigella flexneri 2a str. 301
cgugaaaaaucaaua

SEQ ID NO: 3891309 - RNA, 14 nt, Shigella flexneri 2a str. 301
cgugaaacgcguuu

SEQ ID NO: 3891310 - RNA, 13 nt, Shigella flexneri 2a str. 301
cgugaaaggaaaa

SEQ ID NO: 3891311 - RNA, 20 nt, Shigella flexneri 2a str. 301
cgugaacgccuaauccagcc

SEQ ID NO: 3891312 - RNA, 18 nt, Shigella flexneri 2a str. 301
cgugaacgugggucuguc

SEQ ID NO: 3891313 - RNA, 22 nt, Shigella flexneri 2a str. 301
cgugaacugggccugcauaucg

SEQ ID NO: 3891314 - RNA, 15 nt, Shigella flexneri 2a str. 301
cgugaagcagagcag

SEQ ID NO: 3891315 - RNA, 18 nt, Shigella flexneri 2a str. 301
cgugaagcuggcagaagu

SEQ ID NO: 3891316 - RNA, 16 nt, Shigella flexneri 2a str. 301
cgugaagguugcgccu

SEQ ID NO: 3891317 - RNA, 17 nt, Shigella flexneri 2a str. 301
cgugaaguaaaaggucu

SEQ ID NO: 3891318 - RNA, 20 nt, Shigella flexneri 2a str. 301
cgugaaugccuuauccggca

SEQ ID NO: 3891319 - RNA, 12 nt, Shigella flexneri 2a str. 301
cgugaauuacug

SEQ ID NO: 3891320 - RNA, 20 nt, Shigella flexneri 2a str. 301
cgugaauuuuaggaugcugc

SEQ ID NO: 3891321 - RNA, 16 nt, Shigella flexneri 2a str. 301
cgugacacgcagucuc

SEQ ID NO: 3891322 - RNA, 17 nt, Shigella flexneri 2a str. 301
cgugaccgccagaacac

SEQ ID NO: 3891323 - RNA, 15 nt, Shigella flexneri 2a str. 301
cgugacgaucaccac

SEQ ID NO: 3891324 - RNA, 23 nt, Shigella flexneri 2a str. 301
cgugacgucucaaucaccaccag

SEQ ID NO: 3891325 - RNA, 19 nt, Shigella flexneri 2a str. 301
cgugagcguauuggugaau

SEQ ID NO: 3891326 - RNA, 11 nt, Shigella flexneri 2a str. 301
cgugagcuggg

SEQ ID NO: 3891327 - RNA, 20 nt, Shigella flexneri 2a str. 301
cgugaguuuuuguccccuca

SEQ ID NO: 3891328 - RNA, 17 nt, Shigella flexneri 2a str. 301
cgugauaaacauccacc

SEQ ID NO: 3891329 - RNA, 18 nt, Shigella flexneri 2a str. 301
cgugaucgaacaucugcg

SEQ ID NO: 3891330 - RNA, 23 nt, Shigella flexneri 2a str. 301
cgugaucgucuucaaccgcagug

SEQ ID NO: 3891331 - RNA, 17 nt, Shigella flexneri 2a str. 301
cgugaucguggccauga

SEQ ID NO: 3891332 - RNA, 19 nt, Shigella flexneri 2a str. 301
cgugauucacguucgugaa

SEQ ID NO: 3891333 - RNA, 15 nt, Shigella flexneri 2a str. 301
cgugauuccagacgg

SEQ ID NO: 3891334 - RNA, 14 nt, Shigella flexneri 2a str. 301
cgugauugguuuca

SEQ ID NO: 3891335 - RNA, 16 nt, Shigella flexneri 2a str. 301
cgugauuuagcaccga

SEQ ID NO: 3891336 - RNA, 17 nt, Shigella flexneri 2a str. 301
cgugcaaaaucaaacag

SEQ ID NO: 3891337 - RNA, 21 nt, Shigella flexneri 2a str. 301
cgugcaaauauacauaaaguc

SEQ ID NO: 3891338 - RNA, 20 nt, Shigella flexneri 2a str. 301
cgugcacgaacgguccccuc

SEQ ID NO: 3891339 - RNA, 20 nt, Shigella flexneri 2a str. 301
cguuccaccacguuuuucaa

SEQ ID NO: 3891340 - RNA, 20 nt, Shigella flexneri 2a str. 301
cguuccacggggacuccaca

SEQ ID NO: 3891341 - RNA, 23 nt, Shigella flexneri 2a str. 301
cguuccccagaagcuuuccaucg

SEQ ID NO: 3891342 - RNA, 14 nt, Shigella flexneri 2a str. 301
cguuccccagaugc

SEQ ID NO: 3891343 - RNA, 23 nt, Shigella flexneri 2a str. 301
cguuccccaggguuucuccguca

SEQ ID NO: 3891344 - RNA, 22 nt, Shigella flexneri 2a str. 301
cguuccccuguugugccagacc

SEQ ID NO: 3891345 - RNA, 19 nt, Shigella flexneri 2a str. 301
cguuccuacaacugggaca

SEQ ID NO: 3891346 - RNA, 11 nt, Shigella flexneri 2a str. 301
cguuccuggcu

SEQ ID NO: 3891347 - RNA, 19 nt, Shigella flexneri 2a str. 301
cguuccuucaggacccuua

SEQ ID NO: 3891348 - RNA, 12 nt, Shigella flexneri 2a str. 301
cguuccuuucuu

SEQ ID NO: 3891349 - RNA, 21 nt, Shigella flexneri 2a str. 301
cguuccuuucuugcgcaaacc

SEQ ID NO: 3891350 - RNA, 15 nt, Shigella flexneri 2a str. 301
cguucgaacuggaua

SEQ ID NO: 3891351 - RNA, 17 nt, Shigella flexneri 2a str. 301
cguucgauggcgcgcca

SEQ ID NO: 3891352 - RNA, 15 nt, Shigella flexneri 2a str. 301
cguucgcccauucca

SEQ ID NO: 3891353 - RNA, 21 nt, Shigella flexneri 2a str. 301
cguucgcgccgcauccggcau

SEQ ID NO: 3891354 - RNA, 24 nt, Shigella flexneri 2a str. 301
cguucgcggggcuaccgccagacc

SEQ ID NO: 3891355 - RNA, 15 nt, Shigella flexneri 2a str. 301
cguucggcacccgua

SEQ ID NO: 3891356 - RNA, 14 nt, Shigella flexneri 2a str. 301
cguucggcgagcag

SEQ ID NO: 3891357 - RNA, 15 nt, Shigella flexneri 2a str. 301
cguucugccaaacgc

SEQ ID NO: 3891358 - RNA, 21 nt, Shigella flexneri 2a str. 301
cguucuuaggggguaucuuug

SEQ ID NO: 3891359 - RNA, 19 nt, Shigella flexneri 2a str. 301
cguucuucagacuccugaa

SEQ ID NO: 3891360 - RNA, 13 nt, Shigella flexneri 2a str. 301
cguucuucccucc

SEQ ID NO: 3891361 - RNA, 12 nt, Shigella flexneri 2a str. 301
cguucuuccugu

SEQ ID NO: 3891362 - RNA, 15 nt, Shigella flexneri 2a str. 301
cguucuucggcacug

SEQ ID NO: 3891363 - RNA, 23 nt, Shigella flexneri 2a str. 301
cguugaaaaaucaaaaaacugga

SEQ ID NO: 3891364 - RNA, 15 nt, Shigella flexneri 2a str. 301
cguugaauuucaggu

SEQ ID NO: 3891365 - RNA, 14 nt, Shigella flexneri 2a str. 301
cguugaccaccaua

SEQ ID NO: 3891366 - RNA, 16 nt, Shigella flexneri 2a str. 301
cguugaccagcauccc

SEQ ID NO: 3891367 - RNA, 22 nt, Shigella flexneri 2a str. 301
cguugagcaaucgacgccguuu

SEQ ID NO: 3891368 - RNA, 21 nt, Shigella flexneri 2a str. 301
cguugaggaacucaaaccauu

SEQ ID NO: 3891369 - RNA, 16 nt, Shigella flexneri 2a str. 301
cguugagggcgcaauu

SEQ ID NO: 3891370 - RNA, 19 nt, Shigella flexneri 2a str. 301
cguugagugcgacaugauc

SEQ ID NO: 3891371 - RNA, 21 nt, Shigella flexneri 2a str. 301
cguugaucacccacaucagcg

SEQ ID NO: 3891372 - RNA, 13 nt, Shigella flexneri 2a str. 301
cguugaucgcuuu

SEQ ID NO: 3891373 - RNA, 20 nt, Shigella flexneri 2a str. 301
cguugaugccgugcagcacg

SEQ ID NO: 3891374 - RNA, 19 nt, Shigella flexneri 2a str. 301
cguugauucacuuucugaa

SEQ ID NO: 3891375 - RNA, 20 nt, Shigella flexneri 2a str. 301
cguugcaauacuuccgcuuc

SEQ ID NO: 3891376 - RNA, 17 nt, Shigella flexneri 2a str. 301
cguugcccggagcagca

SEQ ID NO: 3891377 - RNA, 16 nt, Shigella flexneri 2a str. 301
cguugccuugccgaau

SEQ ID NO: 3891378 - RNA, 20 nt, Shigella flexneri 2a str. 301
cguugcgacacuccugacgc

SEQ ID NO: 3891379 - RNA, 17 nt, Shigella flexneri 2a str. 301
cguugcgcuucucaggc

SEQ ID NO: 3891380 - RNA, 17 nt, Shigella flexneri 2a str. 301
cguugcguugcagcagg

SEQ ID NO: 3891381 - RNA, 15 nt, Shigella flexneri 2a str. 301
cguugcuaugcugaa

SEQ ID NO: 3891382 - RNA, 12 nt, Shigella flexneri 2a str. 301
cguugcucagaa

SEQ ID NO: 3891383 - RNA, 22 nt, Shigella flexneri 2a str. 301
cguugcugacuguaggccggau

SEQ ID NO: 3891384 - RNA, 13 nt, Shigella flexneri 2a str. 301
cguugcuggaaaa

SEQ ID NO: 3891385 - RNA, 18 nt, Shigella flexneri 2a str. 301
cguugcuuauugccggau

SEQ ID NO: 3891386 - RNA, 20 nt, Shigella flexneri 2a str. 301
cguugcuuauugccggaugc

SEQ ID NO: 3891387 - RNA, 22 nt, Shigella flexneri 2a str. 301
cguugcuugaugcacugggaga

SEQ ID NO: 3891388 - RNA, 21 nt, Shigella flexneri 2a str. 301
cguugcuuuuugcgcauccag

SEQ ID NO: 3891389 - RNA, 22 nt, Shigella flexneri 2a str. 301
cguuggcggguaagaauauccg

SEQ ID NO: 3891390 - RNA, 16 nt, Shigella flexneri 2a str. 301
cguugguaaugacucc

SEQ ID NO: 3891391 - RNA, 14 nt, Shigella flexneri 2a str. 301
cguugugauuaaac

SEQ ID NO: 3891392 - RNA, 16 nt, Shigella flexneri 2a str. 301
cguuguuaaggguaaa

SEQ ID NO: 3891393 - RNA, 15 nt, Shigella flexneri 2a str. 301
cguuguucuacgugc

SEQ ID NO: 3891394 - RNA, 19 nt, Shigella flexneri 2a str. 301
cguuguuuucaugccgccg

SEQ ID NO: 3891395 - RNA, 18 nt, Shigella flexneri 2a str. 301
cguuuaaaccaggcgaga

SEQ ID NO: 3891396 - RNA, 17 nt, Shigella flexneri 2a str. 301
cguuuacgccgcauccg

SEQ ID NO: 3891397 - RNA, 16 nt, Shigella flexneri 2a str. 301
cguuuagccgccguua

SEQ ID NO: 3891398 - RNA, 16 nt, Shigella flexneri 2a str. 301
cguuuaugcagguucu

SEQ ID NO: 3891399 - RNA, 12 nt, Shigella flexneri 2a str. 301
cguuuauuuccc

SEQ ID NO: 3891400 - RNA, 14 nt, Shigella flexneri 2a str. 301
cguuucaaaaacaa

SEQ ID NO: 3891401 - RNA, 15 nt, Shigella flexneri 2a str. 301
cguuucaaaaacaaa

SEQ ID NO: 3891402 - RNA, 20 nt, Shigella flexneri 2a str. 301
cguuucagauuguugacaaa

SEQ ID NO: 3891403 - RNA, 18 nt, Shigella flexneri 2a str. 301
cguuucagcgguuugaaa

SEQ ID NO: 3891404 - RNA, 16 nt, Shigella flexneri 2a str. 301
cguuucagguuaaugc

SEQ ID NO: 3891405 - RNA, 14 nt, Shigella flexneri 2a str. 301
cguuucauucaggc

SEQ ID NO: 3891406 - RNA, 14 nt, Shigella flexneri 2a str. 301
cguuuccagcacca

SEQ ID NO: 3891407 - RNA, 17 nt, Shigella flexneri 2a str. 301
cguuuccagcaccaguu

SEQ ID NO: 3891408 - RNA, 17 nt, Shigella flexneri 2a str. 301
cguuuccagcaguucca

SEQ ID NO: 3891409 - RNA, 14 nt, Shigella flexneri 2a str. 301
cguuucgccaccca

SEQ ID NO: 3891410 - RNA, 20 nt, Shigella flexneri 2a str. 301
cguuucucugcuaauuuauc

SEQ ID NO: 3891411 - RNA, 13 nt, Shigella flexneri 2a str. 301
cguuucugcuggu

SEQ ID NO: 3891412 - RNA, 15 nt, Shigella flexneri 2a str. 301
cguuucuuucaucag

SEQ ID NO: 3891413 - RNA, 22 nt, Shigella flexneri 2a str. 301
cguuugauuaacgccagauuac

SEQ ID NO: 3891414 - RNA, 17 nt, Shigella flexneri 2a str. 301
cguuugccagugccguu

SEQ ID NO: 3891415 - RNA, 22 nt, Shigella flexneri 2a str. 301
cguuugccuuucggcgcaguca

SEQ ID NO: 3891416 - RNA, 17 nt, Shigella flexneri 2a str. 301
cguuugcugcaugaugu

SEQ ID NO: 3891417 - RNA, 19 nt, Shigella flexneri 2a str. 301
cguuuguaacccaccaugc

SEQ ID NO: 3891418 - RNA, 16 nt, Shigella flexneri 2a str. 301
cguuuguaggccggau

SEQ ID NO: 3891419 - RNA, 21 nt, Shigella flexneri 2a str. 301
cguuuguggugcgcgagcugg

SEQ ID NO: 3891420 - RNA, 14 nt, Shigella flexneri 2a str. 301
cguuuuacagcaac

SEQ ID NO: 3891421 - RNA, 19 nt, Shigella flexneri 2a str. 301
cguuuuacgcgucacgccu

SEQ ID NO: 3891422 - RNA, 15 nt, Shigella flexneri 2a str. 301
cguuuuaguaacaac

SEQ ID NO: 3891423 - RNA, 22 nt, Shigella flexneri 2a str. 301
cguuuuauaacggcuggccaca

SEQ ID NO: 3891424 - RNA, 16 nt, Shigella flexneri 2a str. 301
cguuuucaaccagccg

SEQ ID NO: 3891425 - RNA, 14 nt, Shigella flexneri 2a str. 301
cguuuucaccaguu

SEQ ID NO: 3891426 - RNA, 19 nt, Shigella flexneri 2a str. 301
cguuuucguuacuccgcca

SEQ ID NO: 3891427 - RNA, 18 nt, Shigella flexneri 2a str. 301
cguuuucuauuaucagaa

SEQ ID NO: 3891428 - RNA, 13 nt, Shigella flexneri 2a str. 301
cguuuugccgcca

SEQ ID NO: 3891429 - RNA, 16 nt, Shigella flexneri 2a str. 301
cguuuugccgccauca

SEQ ID NO: 3891430 - RNA, 20 nt, Shigella flexneri 2a str. 301
cguuuuggugaagugagaau

SEQ ID NO: 3891431 - RNA, 23 nt, Shigella flexneri 2a str. 301
cguuuuggugaagugagaauuuu

SEQ ID NO: 3891432 - RNA, 16 nt, Shigella flexneri 2a str. 301
cguuuuuugaaacagg

SEQ ID NO: 3891433 - RNA, 13 nt, Shigella flexneri 2a str. 301
cguuuuuuguccg

SEQ ID NO: 3891434 - RNA, 13 nt, Shigella flexneri 2a str. 301
cguuuuuuuucug

SEQ ID NO: 3891435 - RNA, 12 nt, Shigella flexneri 2a str. 301
cuaaaaaauccc

SEQ ID NO: 3891436 - RNA, 20 nt, Shigella flexneri 2a str. 301
cuaaaaaauuaacaaaacaa

SEQ ID NO: 3891437 - RNA, 20 nt, Shigella flexneri 2a str. 301
cuaaaaacagcaucaauaau

SEQ ID NO: 3891438 - RNA, 18 nt, Shigella flexneri 2a str. 301
cuaaaaauugcagacccg

SEQ ID NO: 3891439 - RNA, 13 nt, Shigella flexneri 2a str. 301
cuaccaaaccugc

SEQ ID NO: 3891440 - RNA, 12 nt, Shigella flexneri 2a str. 301
cuaccacaugau

SEQ ID NO: 3891441 - RNA, 17 nt, Shigella flexneri 2a str. 301
cuaccacugccugaguu

SEQ ID NO: 3891442 - RNA, 14 nt, Shigella flexneri 2a str. 301
cuaccagcgcggca

SEQ ID NO: 3891443 - RNA, 12 nt, Shigella flexneri 2a str. 301
cuaccagcucau

SEQ ID NO: 3891444 - RNA, 20 nt, Shigella flexneri 2a str. 301
cuaccagguuucgcaauaac

SEQ ID NO: 3891445 - RNA, 23 nt, Shigella flexneri 2a str. 301
cuaccaucagguaauaggcaggc

SEQ ID NO: 3891446 - RNA, 23 nt, Shigella flexneri 2a str. 301
cuaccaugaccugcaaauucaau

SEQ ID NO: 3891447 - RNA, 18 nt, Shigella flexneri 2a str. 301
cuaccaugaugauaucac

SEQ ID NO: 3891448 - RNA, 16 nt, Shigella flexneri 2a str. 301
cuacccauauuuaauc

SEQ ID NO: 3891449 - RNA, 23 nt, Shigella flexneri 2a str. 301
cuacccauauuuaaucaguucua

SEQ ID NO: 3891450 - RNA, 15 nt, Shigella flexneri 2a str. 301
cuacccggugaaucg

SEQ ID NO: 3891451 - RNA, 19 nt, Shigella flexneri 2a str. 301
cuaccgauccggcaccaau

SEQ ID NO: 3891452 - RNA, 17 nt, Shigella flexneri 2a str. 301
cuaccgcgaugacccaa

SEQ ID NO: 3891453 - RNA, 16 nt, Shigella flexneri 2a str. 301
cuaccgcgcaggguaa

SEQ ID NO: 3891454 - RNA, 15 nt, Shigella flexneri 2a str. 301
cuaccgcuuugccac

SEQ ID NO: 3891455 - RNA, 19 nt, Shigella flexneri 2a str. 301
cuaccgucuguaaccagau

SEQ ID NO: 3891456 - RNA, 20 nt, Shigella flexneri 2a str. 301
cuaccuuaacgguaucuuuc

SEQ ID NO: 3891457 - RNA, 19 nt, Shigella flexneri 2a str. 301
cuacgacgccaagaaagag

SEQ ID NO: 3891458 - RNA, 16 nt, Shigella flexneri 2a str. 301
cuacgacgggauucga

SEQ ID NO: 3891459 - RNA, 21 nt, Shigella flexneri 2a str. 301
cuacgaguaugacaacuuuca

SEQ ID NO: 3891460 - RNA, 17 nt, Shigella flexneri 2a str. 301
cuacgcucauucgcccg

SEQ ID NO: 3891461 - RNA, 21 nt, Shigella flexneri 2a str. 301
cuacgcucucuucaaacgcuu

SEQ ID NO: 3891462 - RNA, 16 nt, Shigella flexneri 2a str. 301
cuacggaguaaccugc

SEQ ID NO: 3891463 - RNA, 15 nt, Shigella flexneri 2a str. 301
cuacggcaaaagaau

SEQ ID NO: 3891464 - RNA, 20 nt, Shigella flexneri 2a str. 301
cuacggcaaaagaauaucag

SEQ ID NO: 3891465 - RNA, 22 nt, Shigella flexneri 2a str. 301
cuacguaggacagcguugccag

SEQ ID NO: 3891466 - RNA, 15 nt, Shigella flexneri 2a str. 301
cuacgucucaauuca

SEQ ID NO: 3891467 - RNA, 19 nt, Shigella flexneri 2a str. 301
cuacgucucaauucaucuu

SEQ ID NO: 3891468 - RNA, 18 nt, Shigella flexneri 2a str. 301
cuacgugaggcaucagac

SEQ ID NO: 3891469 - RNA, 23 nt, Shigella flexneri 2a str. 301
cuacguggaucgaucaauuuauu

SEQ ID NO: 3891470 - RNA, 16 nt, Shigella flexneri 2a str. 301
cuacuccaacccggca

SEQ ID NO: 3891471 - RNA, 13 nt, Shigella flexneri 2a str. 301
cuacuccaguucc

SEQ ID NO: 3891472 - RNA, 14 nt, Shigella flexneri 2a str. 301
cuacucguuuauua

SEQ ID NO: 3891473 - RNA, 21 nt, Shigella flexneri 2a str. 301
cuacugauggcuacguucugc

SEQ ID NO: 3891474 - RNA, 20 nt, Shigella flexneri 2a str. 301
cuacuucuuucaccaucgca

SEQ ID NO: 3891475 - RNA, 23 nt, Shigella flexneri 2a str. 301
cuacuuuguaaacgaagcgccau

SEQ ID NO: 3891476 - RNA, 16 nt, Shigella flexneri 2a str. 301
cuagaaaucauucaau

SEQ ID NO: 3891477 - RNA, 19 nt, Shigella flexneri 2a str. 301
cuagaaaucauucaauacu

SEQ ID NO: 3891478 - RNA, 19 nt, Shigella flexneri 2a str. 301
cuagacagcgacucucuga

SEQ ID NO: 3891479 - RNA, 16 nt, Shigella flexneri 2a str. 301
cuagccucccugccuc

SEQ ID NO: 3891480 - RNA, 17 nt, Shigella flexneri 2a str. 301
cuagccucccugccucc

SEQ ID NO: 3891481 - RNA, 13 nt, Shigella flexneri 2a str. 301
cuagccugcuccc

SEQ ID NO: 3891482 - RNA, 20 nt, Shigella flexneri 2a str. 301
cuagcgcuuuuucugaaacu

SEQ ID NO: 3891483 - RNA, 14 nt, Shigella flexneri 2a str. 301
cuagcucaauaaaa

SEQ ID NO: 3891484 - RNA, 17 nt, Shigella flexneri 2a str. 301
cuagcucaauaaaagaa

SEQ ID NO: 3891485 - RNA, 22 nt, Shigella flexneri 2a str. 301
cuagcucaauaaaagaaaucag

SEQ ID NO: 3891486 - RNA, 15 nt, Shigella flexneri 2a str. 301
cuagcuucagguguu

SEQ ID NO: 3891487 - RNA, 21 nt, Shigella flexneri 2a str. 301
cuagcuucagguguuaguguc

SEQ ID NO: 3891488 - RNA, 13 nt, Shigella flexneri 2a str. 301
cuaggcauagaaa

SEQ ID NO: 3891489 - RNA, 15 nt, Shigella flexneri 2a str. 301
cuaggcgaacauucc

SEQ ID NO: 3891490 - RNA, 18 nt, Shigella flexneri 2a str. 301
cuaggcgccaagggcggc

SEQ ID NO: 3891491 - RNA, 12 nt, Shigella flexneri 2a str. 301
cuaguauuuauu

SEQ ID NO: 3891492 - RNA, 23 nt, Shigella flexneri 2a str. 301
cuagugcagauaguugauuaauu

SEQ ID NO: 3891493 - RNA, 14 nt, Shigella flexneri 2a str. 301
cuaguguacccuuc

SEQ ID NO: 3891494 - RNA, 18 nt, Shigella flexneri 2a str. 301
cuauaacaaaacugagag

SEQ ID NO: 3891495 - RNA, 14 nt, Shigella flexneri 2a str. 301
cuauaaccguaaua

SEQ ID NO: 3891496 - RNA, 21 nt, Shigella flexneri 2a str. 301
cuauaacguugccggauauac

SEQ ID NO: 3891497 - RNA, 18 nt, Shigella flexneri 2a str. 301
cuauaaggccccuuccuc

SEQ ID NO: 3891498 - RNA, 13 nt, Shigella flexneri 2a str. 301
cuauacagcagcc

SEQ ID NO: 3891499 - RNA, 19 nt, Shigella flexneri 2a str. 301
cuauaccagauaaacaucg

SEQ ID NO: 3891500 - RNA, 15 nt, Shigella flexneri 2a str. 301
cuauacuuuugccga

SEQ ID NO: 3891501 - RNA, 14 nt, Shigella flexneri 2a str. 301
cuauagucuuuucg

SEQ ID NO: 3891502 - RNA, 16 nt, Shigella flexneri 2a str. 301
cuauauacccuucuca

SEQ ID NO: 3891503 - RNA, 16 nt, Shigella flexneri 2a str. 301
cuauauuccuuuauca

SEQ ID NO: 3891504 - RNA, 23 nt, Shigella flexneri 2a str. 301
cuauauuugaggaguuuaauaaa

SEQ ID NO: 3891505 - RNA, 15 nt, Shigella flexneri 2a str. 301
cuaucaaacugaccu

SEQ ID NO: 3891506 - RNA, 18 nt, Shigella flexneri 2a str. 301
cuaucagauuggcuucau

SEQ ID NO: 3891507 - RNA, 20 nt, Shigella flexneri 2a str. 301
cuaucagcaaacuaucccag

SEQ ID NO: 3891508 - RNA, 12 nt, Shigella flexneri 2a str. 301
cuaucagcgcca

SEQ ID NO: 3891509 - RNA, 22 nt, Shigella flexneri 2a str. 301
cuaucagcgccaccacaaaagc

SEQ ID NO: 3891510 - RNA, 14 nt, Shigella flexneri 2a str. 301
cuaucauacucauu

SEQ ID NO: 3891511 - RNA, 23 nt, Shigella flexneri 2a str. 301
cuaucauugcgugguuuuugcug

SEQ ID NO: 3891512 - RNA, 16 nt, Shigella flexneri 2a str. 301
cuauccagcucaucca

SEQ ID NO: 3891513 - RNA, 17 nt, Shigella flexneri 2a str. 301
cuaucccagccuauaac

SEQ ID NO: 3891514 - RNA, 18 nt, Shigella flexneri 2a str. 301
cuaucgaaaguuuaccag

SEQ ID NO: 3891515 - RNA, 20 nt, Shigella flexneri 2a str. 301
cuaucgaacaugcgggucuu

SEQ ID NO: 3891516 - RNA, 21 nt, Shigella flexneri 2a str. 301
cuaucggcagaguugagcagu

SEQ ID NO: 3891517 - RNA, 15 nt, Shigella flexneri 2a str. 301
cuaucguccacguca

SEQ ID NO: 3891518 - RNA, 14 nt, Shigella flexneri 2a str. 301
cuaucuguuugcca

SEQ ID NO: 3891519 - RNA, 15 nt, Shigella flexneri 2a str. 301
cuaucuguuugccag

SEQ ID NO: 3891520 - RNA, 18 nt, Shigella flexneri 2a str. 301
cuaucuucgauaaacuca

SEQ ID NO: 3891521 - RNA, 21 nt, Shigella flexneri 2a str. 301
cuaucuuucagaccuuuuacu

SEQ ID NO: 3891522 - RNA, 17 nt, Shigella flexneri 2a str. 301
cuaugaaagaaaaucaa

SEQ ID NO: 3891523 - RNA, 22 nt, Shigella flexneri 2a str. 301
cuaugaacacgaucucacgcug

SEQ ID NO: 3891524 - RNA, 16 nt, Shigella flexneri 2a str. 301
cuaugaagaacuggaa

SEQ ID NO: 3891525 - RNA, 17 nt, Shigella flexneri 2a str. 301
cuaugagaaaauuucau

SEQ ID NO: 3891526 - RNA, 11 nt, Shigella flexneri 2a str. 301
cuaugagcaga

SEQ ID NO: 3891527 - RNA, 17 nt, Shigella flexneri 2a str. 301
cuaugauuuuccugagg

SEQ ID NO: 3891528 - RNA, 18 nt, Shigella flexneri 2a str. 301
cuaugcauaauccugccg

SEQ ID NO: 3891529 - RNA, 17 nt, Shigella flexneri 2a str. 301
cuaugcggaugccauuc

SEQ ID NO: 3891530 - RNA, 18 nt, Shigella flexneri 2a str. 301
cuauggaacgcucaagcc

SEQ ID NO: 3891531 - RNA, 17 nt, Shigella flexneri 2a str. 301
cuaugggauauuuuuuu

SEQ ID NO: 3891532 - RNA, 13 nt, Shigella flexneri 2a str. 301
cuauggucuugua

SEQ ID NO: 3891533 - RNA, 17 nt, Shigella flexneri 2a str. 301
cuauuaugacuccagcg

SEQ ID NO: 3891534 - RNA, 17 nt, Shigella flexneri 2a str. 301
cuauuauuauuuuugug

SEQ ID NO: 3891535 - RNA, 21 nt, Shigella flexneri 2a str. 301
cuauuauuuuucauauggaua

SEQ ID NO: 3891536 - RNA, 16 nt, Shigella flexneri 2a str. 301
cuauucacgaaucuau

SEQ ID NO: 3891537 - RNA, 19 nt, Shigella flexneri 2a str. 301
cuauucacgaaucuauuca

SEQ ID NO: 3891538 - RNA, 23 nt, Shigella flexneri 2a str. 301
cuauucacgaaucuauucauuua

SEQ ID NO: 3891539 - RNA, 17 nt, Shigella flexneri 2a str. 301
cucagaagacgcuccag

SEQ ID NO: 3891540 - RNA, 15 nt, Shigella flexneri 2a str. 301
cucagaaucacgcca

SEQ ID NO: 3891541 - RNA, 16 nt, Shigella flexneri 2a str. 301
cucagaaucacgccaa

SEQ ID NO: 3891542 - RNA, 18 nt, Shigella flexneri 2a str. 301
cucagauaaaugcaaacg

SEQ ID NO: 3891543 - RNA, 19 nt, Shigella flexneri 2a str. 301
cucagauucagauuauguc

SEQ ID NO: 3891544 - RNA, 21 nt, Shigella flexneri 2a str. 301
cucagcaaauagauaaaauau

SEQ ID NO: 3891545 - RNA, 14 nt, Shigella flexneri 2a str. 301
cucagccugagcga

SEQ ID NO: 3891546 - RNA, 14 nt, Shigella flexneri 2a str. 301
cucagcgccacauc

SEQ ID NO: 3891547 - RNA, 24 nt, Shigella flexneri 2a str. 301
cucagcgccgcuuuccaggcugug

SEQ ID NO: 3891548 - RNA, 15 nt, Shigella flexneri 2a str. 301
cucagcgccugcugc

SEQ ID NO: 3891549 - RNA, 20 nt, Shigella flexneri 2a str. 301
cucagcgucagccugcucag

SEQ ID NO: 3891550 - RNA, 16 nt, Shigella flexneri 2a str. 301
cucagcuccucuuuca

SEQ ID NO: 3891551 - RNA, 13 nt, Shigella flexneri 2a str. 301
cucaggaaaagca

SEQ ID NO: 3891552 - RNA, 16 nt, Shigella flexneri 2a str. 301
cucaggccaaaugaca

SEQ ID NO: 3891553 - RNA, 23 nt, Shigella flexneri 2a str. 301
cucaggccgauuucaugaagcug

SEQ ID NO: 3891554 - RNA, 22 nt, Shigella flexneri 2a str. 301
cucaggccuacaaaaucuugca

SEQ ID NO: 3891555 - RNA, 22 nt, Shigella flexneri 2a str. 301
cucaggcgcacgccgacaaaga

SEQ ID NO: 3891556 - RNA, 20 nt, Shigella flexneri 2a str. 301
cucaggugucuggcagcgug

SEQ ID NO: 3891557 - RNA, 17 nt, Shigella flexneri 2a str. 301
cucaguaaaguuaccuu

SEQ ID NO: 3891558 - RNA, 19 nt, Shigella flexneri 2a str. 301
cucaguaaaguuaccuucg

SEQ ID NO: 3891559 - RNA, 13 nt, Shigella flexneri 2a str. 301
cucaguacaggcc

SEQ ID NO: 3891560 - RNA, 16 nt, Shigella flexneri 2a str. 301
cucaguaggcugacga

SEQ ID NO: 3891561 - RNA, 20 nt, Shigella flexneri 2a str. 301
cucaguuccgggaucaccag

SEQ ID NO: 3891562 - RNA, 16 nt, Shigella flexneri 2a str. 301
cucaguugucugaauc

SEQ ID NO: 3891563 - RNA, 21 nt, Shigella flexneri 2a str. 301
cucauaauacaggcuacuccc

SEQ ID NO: 3891564 - RNA, 16 nt, Shigella flexneri 2a str. 301
cucauacuuccacgca

SEQ ID NO: 3891565 - RNA, 14 nt, Shigella flexneri 2a str. 301
cucauagaccauug

SEQ ID NO: 3891566 - RNA, 19 nt, Shigella flexneri 2a str. 301
cucauagggugugacgaca

SEQ ID NO: 3891567 - RNA, 22 nt, Shigella flexneri 2a str. 301
cucauagggugugacgacacca

SEQ ID NO: 3891568 - RNA, 20 nt, Shigella flexneri 2a str. 301
cucaucaacguuuuuuugcu

SEQ ID NO: 3891569 - RNA, 21 nt, Shigella flexneri 2a str. 301
cucaucaccacagacaaacag

SEQ ID NO: 3891570 - RNA, 12 nt, Shigella flexneri 2a str. 301
cucaucaccauu

SEQ ID NO: 3891571 - RNA, 15 nt, Shigella flexneri 2a str. 301
cucaucagcccggca

SEQ ID NO: 3891572 - RNA, 18 nt, Shigella flexneri 2a str. 301
cucaucagugaacccaua

SEQ ID NO: 3891573 - RNA, 21 nt, Shigella flexneri 2a str. 301
cucaucgacggcuacgcucau

SEQ ID NO: 3891574 - RNA, 15 nt, Shigella flexneri 2a str. 301
cucaucgcugcgcuc

SEQ ID NO: 3891575 - RNA, 15 nt, Shigella flexneri 2a str. 301
cucaucggguaacgg

SEQ ID NO: 3891576 - RNA, 16 nt, Shigella flexneri 2a str. 301
cucaucuggcguacca

SEQ ID NO: 3891577 - RNA, 13 nt, Shigella flexneri 2a str. 301
cucaucuucauaa

SEQ ID NO: 3891578 - RNA, 20 nt, Shigella flexneri 2a str. 301
cucaucuuugaaaucacgca

SEQ ID NO: 3891579 - RNA, 15 nt, Shigella flexneri 2a str. 301
cucaugcauaaucga

SEQ ID NO: 3891580 - RNA, 20 nt, Shigella flexneri 2a str. 301
cucauguagccgcuuuuucu

SEQ ID NO: 3891581 - RNA, 21 nt, Shigella flexneri 2a str. 301
cucauguagccgcuuuuucug

SEQ ID NO: 3891582 - RNA, 15 nt, Shigella flexneri 2a str. 301
cucauuacagcgacu

SEQ ID NO: 3891583 - RNA, 13 nt, Shigella flexneri 2a str. 301
cucauuauuugcc

SEQ ID NO: 3891584 - RNA, 14 nt, Shigella flexneri 2a str. 301
cucauucaccaguu

SEQ ID NO: 3891585 - RNA, 23 nt, Shigella flexneri 2a str. 301
cucauugcuauuuccaccucccc

SEQ ID NO: 3891586 - RNA, 20 nt, Shigella flexneri 2a str. 301
cucauugguccaucuuuuug

SEQ ID NO: 3891587 - RNA, 15 nt, Shigella flexneri 2a str. 301
cucauuguuagaugu

SEQ ID NO: 3891588 - RNA, 13 nt, Shigella flexneri 2a str. 301
cucauuuaauauu

SEQ ID NO: 3891589 - RNA, 14 nt, Shigella flexneri 2a str. 301
cucauuuacagaaa

SEQ ID NO: 3891590 - RNA, 18 nt, Shigella flexneri 2a str. 301
cucauuugauugccggau

SEQ ID NO: 3891591 - RNA, 14 nt, Shigella flexneri 2a str. 301
cucauuugcagaaa

SEQ ID NO: 3891592 - RNA, 23 nt, Shigella flexneri 2a str. 301
cucauuuuucagcguuccccaga

SEQ ID NO: 3891593 - RNA, 14 nt, Shigella flexneri 2a str. 301
cuccaacuuacuga

SEQ ID NO: 3891594 - RNA, 12 nt, Shigella flexneri 2a str. 301
cuccacaagcuc

SEQ ID NO: 3891595 - RNA, 14 nt, Shigella flexneri 2a str. 301
cuccacaagcuccg

SEQ ID NO: 3891596 - RNA, 16 nt, Shigella flexneri 2a str. 301
cuccacagucaggcug

SEQ ID NO: 3891597 - RNA, 14 nt, Shigella flexneri 2a str. 301
cuccaccagcacca

SEQ ID NO: 3891598 - RNA, 16 nt, Shigella flexneri 2a str. 301
cuccacgauguucuga

SEQ ID NO: 3891599 - RNA, 18 nt, Shigella flexneri 2a str. 301
cuccacgauguucugagc

SEQ ID NO: 3891600 - RNA, 20 nt, Shigella flexneri 2a str. 301
cuccacgauguucugagcga

SEQ ID NO: 3891601 - RNA, 22 nt, Shigella flexneri 2a str. 301
cuccacgauguucugagcgaag

SEQ ID NO: 3891602 - RNA, 21 nt, Shigella flexneri 2a str. 301
cuccacgcuauacagcagcca

SEQ ID NO: 3891603 - RNA, 17 nt, Shigella flexneri 2a str. 301
cuccacgcugcaucgcc

SEQ ID NO: 3891604 - RNA, 18 nt, Shigella flexneri 2a str. 301
cuccacgcuuaacaaccc

SEQ ID NO: 3891605 - RNA, 13 nt, Shigella flexneri 2a str. 301
cuccacugcucac

SEQ ID NO: 3891606 - RNA, 17 nt, Shigella flexneri 2a str. 301
cuccacuucaccgcgaa

SEQ ID NO: 3891607 - RNA, 11 nt, Shigella flexneri 2a str. 301
cuccacuuccu

SEQ ID NO: 3891608 - RNA, 19 nt, Shigella flexneri 2a str. 301
cuccagacaccgcugcuuc

SEQ ID NO: 3891609 - RNA, 14 nt, Shigella flexneri 2a str. 301
cuccagcagaccag

SEQ ID NO: 3891610 - RNA, 17 nt, Shigella flexneri 2a str. 301
cuccagcgccagcgcgc

SEQ ID NO: 3891611 - RNA, 22 nt, Shigella flexneri 2a str. 301
cuccagcgccgcaucguccugc

SEQ ID NO: 3891612 - RNA, 14 nt, Shigella flexneri 2a str. 301
cuccagcgccgcca

SEQ ID NO: 3891613 - RNA, 16 nt, Shigella flexneri 2a str. 301
cuccagcgccgccaga

SEQ ID NO: 3891614 - RNA, 23 nt, Shigella flexneri 2a str. 301
cuccagcgggcgaaucaacucca

SEQ ID NO: 3891615 - RNA, 18 nt, Shigella flexneri 2a str. 301
cuccaggagcguauucag

SEQ ID NO: 3891616 - RNA, 22 nt, Shigella flexneri 2a str. 301
cuccaggagcguauucagcaau

SEQ ID NO: 3891617 - RNA, 23 nt, Shigella flexneri 2a str. 301
cuccaggcguuuugcagauucag

SEQ ID NO: 3891618 - RNA, 16 nt, Shigella flexneri 2a str. 301
cuccagguccuccugu

SEQ ID NO: 3891619 - RNA, 16 nt, Shigella flexneri 2a str. 301
cuccaguaccugcaaa

SEQ ID NO: 3891620 - RNA, 15 nt, Shigella flexneri 2a str. 301
cuccagucgcgugug

SEQ ID NO: 3891621 - RNA, 22 nt, Shigella flexneri 2a str. 301
cuccagucgcgugugauucagg

SEQ ID NO: 3891622 - RNA, 20 nt, Shigella flexneri 2a str. 301
cuccagugccugugacaaca

SEQ ID NO: 3891623 - RNA, 19 nt, Shigella flexneri 2a str. 301
cuccaguuuguucagcugc

SEQ ID NO: 3891624 - RNA, 11 nt, Shigella flexneri 2a str. 301
cuccauccagc

SEQ ID NO: 3891625 - RNA, 19 nt, Shigella flexneri 2a str. 301
cuccauccagcaacaacag

SEQ ID NO: 3891626 - RNA, 17 nt, Shigella flexneri 2a str. 301
cuccauccccagcucuu

SEQ ID NO: 3891627 - RNA, 18 nt, Shigella flexneri 2a str. 301
cuccaucucgccauccuu

SEQ ID NO: 3891628 - RNA, 16 nt, Shigella flexneri 2a str. 301
cuccauuccaucgccu

SEQ ID NO: 3891629 - RNA, 19 nt, Shigella flexneri 2a str. 301
cuccauugcccgcccgaca

SEQ ID NO: 3891630 - RNA, 24 nt, Shigella flexneri 2a str. 301
cuccauuuuuuugcauuacugcua

SEQ ID NO: 3891631 - RNA, 17 nt, Shigella flexneri 2a str. 301
cucccaguaagccuaaa

SEQ ID NO: 3891632 - RNA, 22 nt, Shigella flexneri 2a str. 301
cucccaguugugggugcccaca

SEQ ID NO: 3891633 - RNA, 12 nt, Shigella flexneri 2a str. 301
cuccccccucug

SEQ ID NO: 3891634 - RNA, 19 nt, Shigella flexneri 2a str. 301
cuccccuuucuuauuuuuc

SEQ ID NO: 3891635 - RNA, 23 nt, Shigella flexneri 2a str. 301
cuccccuuucuuauuuuucugca

SEQ ID NO: 3891636 - RNA, 13 nt, Shigella flexneri 2a str. 301
cucccgaaaaacc

SEQ ID NO: 3891637 - RNA, 19 nt, Shigella flexneri 2a str. 301
cucccgaaugaccgccccu

SEQ ID NO: 3891638 - RNA, 16 nt, Shigella flexneri 2a str. 301
cucccggcaaugcgcc

SEQ ID NO: 3891639 - RNA, 14 nt, Shigella flexneri 2a str. 301
cucggggccacagg

SEQ ID NO: 3891640 - RNA, 18 nt, Shigella flexneri 2a str. 301
cucgguaaaaucaacgcc

SEQ ID NO: 3891641 - RNA, 12 nt, Shigella flexneri 2a str. 301
cucggugaccga

SEQ ID NO: 3891642 - RNA, 22 nt, Shigella flexneri 2a str. 301
cucggugucguuacgccgcaga

SEQ ID NO: 3891643 - RNA, 18 nt, Shigella flexneri 2a str. 301
cucgguugauucgcucug

SEQ ID NO: 3891644 - RNA, 14 nt, Shigella flexneri 2a str. 301
cucguaaugcuccg

SEQ ID NO: 3891645 - RNA, 14 nt, Shigella flexneri 2a str. 301
cucguacuccaucu

SEQ ID NO: 3891646 - RNA, 16 nt, Shigella flexneri 2a str. 301
cucguacuccaucucg

SEQ ID NO: 3891647 - RNA, 17 nt, Shigella flexneri 2a str. 301
cucguaucaccccgccc

SEQ ID NO: 3891648 - RNA, 18 nt, Shigella flexneri 2a str. 301
cucgucacaucaccaaca

SEQ ID NO: 3891649 - RNA, 14 nt, Shigella flexneri 2a str. 301
cucgucgaacucau

SEQ ID NO: 3891650 - RNA, 20 nt, Shigella flexneri 2a str. 301
cucgucgcgacgaccaccca

SEQ ID NO: 3891651 - RNA, 19 nt, Shigella flexneri 2a str. 301
cucgucgcgcacgcccauc

SEQ ID NO: 3891652 - RNA, 18 nt, Shigella flexneri 2a str. 301
cucgucguagaaguucag

SEQ ID NO: 3891653 - RNA, 23 nt, Shigella flexneri 2a str. 301
cucgucguuguucuacgugcgcu

SEQ ID NO: 3891654 - RNA, 17 nt, Shigella flexneri 2a str. 301
cucgugauaguccagcc

SEQ ID NO: 3891655 - RNA, 14 nt, Shigella flexneri 2a str. 301
cucgugccaccagu

SEQ ID NO: 3891656 - RNA, 17 nt, Shigella flexneri 2a str. 301
cucgugccaccagugca

SEQ ID NO: 3891657 - RNA, 15 nt, Shigella flexneri 2a str. 301
cucgugggauugccg

SEQ ID NO: 3891658 - RNA, 18 nt, Shigella flexneri 2a str. 301
cucguuaccagcgccgcc

SEQ ID NO: 3891659 - RNA, 14 nt, Shigella flexneri 2a str. 301
cucguuauuggugg

SEQ ID NO: 3891660 - RNA, 19 nt, Shigella flexneri 2a str. 301
cucguuguuuuugccggau

SEQ ID NO: 3891661 - RNA, 14 nt, Shigella flexneri 2a str. 301
cucguuuauuaugc

SEQ ID NO: 3891662 - RNA, 18 nt, Shigella flexneri 2a str. 301
cucguuucgcccugccuu

SEQ ID NO: 3891663 - RNA, 18 nt, Shigella flexneri 2a str. 301
cucuaacccuuccagauu

SEQ ID NO: 3891664 - RNA, 20 nt, Shigella flexneri 2a str. 301
cucuaacccuuccagauuca

SEQ ID NO: 3891665 - RNA, 13 nt, Shigella flexneri 2a str. 301
cucuaaucaggaa

SEQ ID NO: 3891666 - RNA, 17 nt, Shigella flexneri 2a str. 301
cucuacaauauccucaa

SEQ ID NO: 3891667 - RNA, 13 nt, Shigella flexneri 2a str. 301
cucuacagcgccc

SEQ ID NO: 3891668 - RNA, 14 nt, Shigella flexneri 2a str. 301
cucuacaggaaugg

SEQ ID NO: 3891669 - RNA, 13 nt, Shigella flexneri 2a str. 301
cucuauaaaaaag

SEQ ID NO: 3891670 - RNA, 22 nt, Shigella flexneri 2a str. 301
cucuauccgaucauuagcugga

SEQ ID NO: 3891671 - RNA, 17 nt, Shigella flexneri 2a str. 301
cucucaaaacaacacaa

SEQ ID NO: 3891672 - RNA, 22 nt, Shigella flexneri 2a str. 301
cucucaaucucuuuuuccaccg

SEQ ID NO: 3891673 - RNA, 20 nt, Shigella flexneri 2a str. 301
cucucaccacgcuccaucau

SEQ ID NO: 3891674 - RNA, 21 nt, Shigella flexneri 2a str. 301
cucucaucuuugaaaucacgc

SEQ ID NO: 3891675 - RNA, 22 nt, Shigella flexneri 2a str. 301
cucucccgaaugaccgccccug

SEQ ID NO: 3891676 - RNA, 18 nt, Shigella flexneri 2a str. 301
cucuccguuaucacagca

SEQ ID NO: 3891677 - RNA, 22 nt, Shigella flexneri 2a str. 301
cucuccucgcgagaggcuuuuu

SEQ ID NO: 3891678 - RNA, 18 nt, Shigella flexneri 2a str. 301
cucucgcauggggagacc

SEQ ID NO: 3891679 - RNA, 19 nt, Shigella flexneri 2a str. 301
cucucgggaaggcccuucc

SEQ ID NO: 3891680 - RNA, 21 nt, Shigella flexneri 2a str. 301
cucucguuaaguaguguagca

SEQ ID NO: 3891681 - RNA, 17 nt, Shigella flexneri 2a str. 301
cucucuauuccaccauc

SEQ ID NO: 3891682 - RNA, 21 nt, Shigella flexneri 2a str. 301
cucucugaaguagccaguacc

SEQ ID NO: 3891683 - RNA, 23 nt, Shigella flexneri 2a str. 301
cucucugaaguagccaguaccac

SEQ ID NO: 3891684 - RNA, 11 nt, Shigella flexneri 2a str. 301
cucucugagcc

SEQ ID NO: 3891685 - RNA, 13 nt, Shigella flexneri 2a str. 301
cucucugagccag

SEQ ID NO: 3891686 - RNA, 18 nt, Shigella flexneri 2a str. 301
cucucuucaaacgcuucu

SEQ ID NO: 3891687 - RNA, 16 nt, Shigella flexneri 2a str. 301
cucucuuucuccagcg

SEQ ID NO: 3891688 - RNA, 13 nt, Shigella flexneri 2a str. 301
cucugaaucgcua

SEQ ID NO: 3891689 - RNA, 14 nt, Shigella flexneri 2a str. 301
cucugauugccuuc

SEQ ID NO: 3891690 - RNA, 22 nt, Shigella flexneri 2a str. 301
cucugauugccuuccaccagau

SEQ ID NO: 3891691 - RNA, 14 nt, Shigella flexneri 2a str. 301
cucugcaaauauua

SEQ ID NO: 3891692 - RNA, 16 nt, Shigella flexneri 2a str. 301
cucugcaaauauuaau

SEQ ID NO: 3891693 - RNA, 17 nt, Shigella flexneri 2a str. 301
cucugcaaauauuaaua

SEQ ID NO: 3891694 - RNA, 18 nt, Shigella flexneri 2a str. 301
cucugcaacgucuucccg

SEQ ID NO: 3891695 - RNA, 19 nt, Shigella flexneri 2a str. 301
cucugccagacuccaggcg

SEQ ID NO: 3891696 - RNA, 14 nt, Shigella flexneri 2a str. 301
cucugccagcugcu

SEQ ID NO: 3891697 - RNA, 18 nt, Shigella flexneri 2a str. 301
cucugccagcugcucaua

SEQ ID NO: 3891698 - RNA, 21 nt, Shigella flexneri 2a str. 301
cucugccguaccaucgccagc

SEQ ID NO: 3891699 - RNA, 15 nt, Shigella flexneri 2a str. 301
cucugcgcgugcagu

SEQ ID NO: 3891700 - RNA, 12 nt, Shigella flexneri 2a str. 301
cucugcggcaag

SEQ ID NO: 3891701 - RNA, 15 nt, Shigella flexneri 2a str. 301
cucugcguaacccac

SEQ ID NO: 3891702 - RNA, 19 nt, Shigella flexneri 2a str. 301
cucugcguaacccacugac

SEQ ID NO: 3891703 - RNA, 18 nt, Shigella flexneri 2a str. 301
cucugcgucauuccggag

SEQ ID NO: 3891704 - RNA, 13 nt, Shigella flexneri 2a str. 301
cucugcuaauuua

SEQ ID NO: 3891705 - RNA, 13 nt, Shigella flexneri 2a str. 301
cucugcugccaca

SEQ ID NO: 3891706 - RNA, 20 nt, Shigella flexneri 2a str. 301
cucugcuggcggaacaucgc

SEQ ID NO: 3891707 - RNA, 22 nt, Shigella flexneri 2a str. 301
cucugggcugaagaguaaaaaa

SEQ ID NO: 3891708 - RNA, 22 nt, Shigella flexneri 2a str. 301
cucugguccaacgguuaacagu

SEQ ID NO: 3891709 - RNA, 20 nt, Shigella flexneri 2a str. 301
cucugguguggagugcagca

SEQ ID NO: 3891710 - RNA, 21 nt, Shigella flexneri 2a str. 301
cucugguguggagugcagcau

SEQ ID NO: 3891711 - RNA, 19 nt, Shigella flexneri 2a str. 301
cucuguaaacuccuuucug

SEQ ID NO: 3891712 - RNA, 23 nt, Shigella flexneri 2a str. 301
cucuguaauuggaguaucaccau

SEQ ID NO: 3891713 - RNA, 13 nt, Shigella flexneri 2a str. 301
cucuguauauaaa

SEQ ID NO: 3891714 - RNA, 12 nt, Shigella flexneri 2a str. 301
cucuguucugcg

SEQ ID NO: 3891715 - RNA, 17 nt, Shigella flexneri 2a str. 301
cucuguuggcgacguuu

SEQ ID NO: 3891716 - RNA, 16 nt, Shigella flexneri 2a str. 301
cucuuacacuugacca

SEQ ID NO: 3891717 - RNA, 16 nt, Shigella flexneri 2a str. 301
cucuuaccguaggcca

SEQ ID NO: 3891718 - RNA, 18 nt, Shigella flexneri 2a str. 301
cucuuacucuuucaauuu

SEQ ID NO: 3891719 - RNA, 18 nt, Shigella flexneri 2a str. 301
cucuucaaacgcuucugg

SEQ ID NO: 3891720 - RNA, 18 nt, Shigella flexneri 2a str. 301
cucuucaaacucaccagu

SEQ ID NO: 3891721 - RNA, 20 nt, Shigella flexneri 2a str. 301
cucuucaaacucaccagugg

SEQ ID NO: 3891722 - RNA, 18 nt, Shigella flexneri 2a str. 301
cucuucaaacugaagauu

SEQ ID NO: 3891723 - RNA, 16 nt, Shigella flexneri 2a str. 301
cucuucaacacggcgc

SEQ ID NO: 3891724 - RNA, 14 nt, Shigella flexneri 2a str. 301
cucuucaaugguca

SEQ ID NO: 3891725 - RNA, 19 nt, Shigella flexneri 2a str. 301
cucuucagccgcaaaccug

SEQ ID NO: 3891726 - RNA, 19 nt, Shigella flexneri 2a str. 301
cucuucaucgcuaaaauac

SEQ ID NO: 3891727 - RNA, 11 nt, Shigella flexneri 2a str. 301
cucuuccaguc

SEQ ID NO: 3891728 - RNA, 13 nt, Shigella flexneri 2a str. 301
cucuuccaguucg

SEQ ID NO: 3891729 - RNA, 11 nt, Shigella flexneri 2a str. 301
cucuucccaga

SEQ ID NO: 3891730 - RNA, 15 nt, Shigella flexneri 2a str. 301
cucuucccagaccca

SEQ ID NO: 3891731 - RNA, 17 nt, Shigella flexneri 2a str. 301
cucuuccuucagcuccc

SEQ ID NO: 3891732 - RNA, 14 nt, Shigella flexneri 2a str. 301
cucuucgccugccu

SEQ ID NO: 3891733 - RNA, 17 nt, Shigella flexneri 2a str. 301
cucuucgccugccugca

SEQ ID NO: 3891734 - RNA, 17 nt, Shigella flexneri 2a str. 301
cucuucgcgaucaaacg

SEQ ID NO: 3891735 - RNA, 17 nt, Shigella flexneri 2a str. 301
cucuucgcgugugccgg

SEQ ID NO: 3891736 - RNA, 17 nt, Shigella flexneri 2a str. 301
cucuucguuuucaacgu

SEQ ID NO: 3891737 - RNA, 13 nt, Shigella flexneri 2a str. 301
cucuucugcuuug

SEQ ID NO: 3891738 - RNA, 14 nt, Shigella flexneri 2a str. 301
cucuucuggcacca

SEQ ID NO: 3891739 - RNA, 19 nt, Shigella flexneri 2a str. 301
cugaccugcggcaccagcg

SEQ ID NO: 3891740 - RNA, 18 nt, Shigella flexneri 2a str. 301
cugaccuucaaauccuca

SEQ ID NO: 3891741 - RNA, 13 nt, Shigella flexneri 2a str. 301
cugaccuucuuca

SEQ ID NO: 3891742 - RNA, 20 nt, Shigella flexneri 2a str. 301
cugacgaccacccagcaucu

SEQ ID NO: 3891743 - RNA, 13 nt, Shigella flexneri 2a str. 301
cugacgcaucuuc

SEQ ID NO: 3891744 - RNA, 19 nt, Shigella flexneri 2a str. 301
cugacgcccguuuucaccu

SEQ ID NO: 3891745 - RNA, 16 nt, Shigella flexneri 2a str. 301
cugacgccugcgggca

SEQ ID NO: 3891746 - RNA, 16 nt, Shigella flexneri 2a str. 301
cugacgcgucuuaucu

SEQ ID NO: 3891747 - RNA, 21 nt, Shigella flexneri 2a str. 301
cugacgcgucuuaucuggccu

SEQ ID NO: 3891748 - RNA, 22 nt, Shigella flexneri 2a str. 301
cugacgcgucuuaucuggccua

SEQ ID NO: 3891749 - RNA, 22 nt, Shigella flexneri 2a str. 301
cugacggaaaucaugcaacacg

SEQ ID NO: 3891750 - RNA, 17 nt, Shigella flexneri 2a str. 301
cugacggacgcgcggcg

SEQ ID NO: 3891751 - RNA, 15 nt, Shigella flexneri 2a str. 301
cugacggauagccuu

SEQ ID NO: 3891752 - RNA, 21 nt, Shigella flexneri 2a str. 301
cugacggauagccuuucgcuu

SEQ ID NO: 3891753 - RNA, 13 nt, Shigella flexneri 2a str. 301
cugacggcagcga

SEQ ID NO: 3891754 - RNA, 21 nt, Shigella flexneri 2a str. 301
cugacggccuucggugcgaca

SEQ ID NO: 3891755 - RNA, 19 nt, Shigella flexneri 2a str. 301
cugacggugauaaucaucc

SEQ ID NO: 3891756 - RNA, 21 nt, Shigella flexneri 2a str. 301
cugacggugauaaucauccca

SEQ ID NO: 3891757 - RNA, 21 nt, Shigella flexneri 2a str. 301
cugacggugauacagcaaaau

SEQ ID NO: 3891758 - RNA, 22 nt, Shigella flexneri 2a str. 301
cugacguaacgaccaccaccgc

SEQ ID NO: 3891759 - RNA, 20 nt, Shigella flexneri 2a str. 301
cugacgugauuuagcaccga

SEQ ID NO: 3891760 - RNA, 19 nt, Shigella flexneri 2a str. 301
cugacguuuucucguccag

SEQ ID NO: 3891761 - RNA, 14 nt, Shigella flexneri 2a str. 301
cugacguuuuuuag

SEQ ID NO: 3891762 - RNA, 22 nt, Shigella flexneri 2a str. 301
cugacuagaugugcaguuccug

SEQ ID NO: 3891763 - RNA, 13 nt, Shigella flexneri 2a str. 301
cugacuauuuccg

SEQ ID NO: 3891764 - RNA, 14 nt, Shigella flexneri 2a str. 301
cugacugaaugcca

SEQ ID NO: 3891765 - RNA, 22 nt, Shigella flexneri 2a str. 301
cugacugacuucaacaggaaaa

SEQ ID NO: 3891766 - RNA, 20 nt, Shigella flexneri 2a str. 301
cugacugauaacgcggcagc

SEQ ID NO: 3891767 - RNA, 17 nt, Shigella flexneri 2a str. 301
cugacugcgccacuucc

SEQ ID NO: 3891768 - RNA, 17 nt, Shigella flexneri 2a str. 301
cugacuggcucuuuuuc

SEQ ID NO: 3891769 - RNA, 16 nt, Shigella flexneri 2a str. 301
cugacuguaggccgga

SEQ ID NO: 3891770 - RNA, 17 nt, Shigella flexneri 2a str. 301
cugacugucgcagccag

SEQ ID NO: 3891771 - RNA, 17 nt, Shigella flexneri 2a str. 301
cugacuguuccagcacg

SEQ ID NO: 3891772 - RNA, 13 nt, Shigella flexneri 2a str. 301
cugacuugcccgu

SEQ ID NO: 3891773 - RNA, 13 nt, Shigella flexneri 2a str. 301
cugacuuuauacc

SEQ ID NO: 3891774 - RNA, 20 nt, Shigella flexneri 2a str. 301
cugacuuucguuugaaaacu

SEQ ID NO: 3891775 - RNA, 19 nt, Shigella flexneri 2a str. 301
cugacuuugacauguugcu

SEQ ID NO: 3891776 - RNA, 19 nt, Shigella flexneri 2a str. 301
cugacuuugauccagccau

SEQ ID NO: 3891777 - RNA, 21 nt, Shigella flexneri 2a str. 301
cugagaacaagauugccugau

SEQ ID NO: 3891778 - RNA, 21 nt, Shigella flexneri 2a str. 301
cugagaauaaauacacuauaa

SEQ ID NO: 3891779 - RNA, 18 nt, Shigella flexneri 2a str. 301
cugagacagacagccuca

SEQ ID NO: 3891780 - RNA, 23 nt, Shigella flexneri 2a str. 301
cugagacgcgcuugcauuacuac

SEQ ID NO: 3891781 - RNA, 18 nt, Shigella flexneri 2a str. 301
cugagaggaaaaaaauua

SEQ ID NO: 3891782 - RNA, 17 nt, Shigella flexneri 2a str. 301
cugagaucaaacucuuu

SEQ ID NO: 3891783 - RNA, 14 nt, Shigella flexneri 2a str. 301
cugagauggcuuca

SEQ ID NO: 3891784 - RNA, 13 nt, Shigella flexneri 2a str. 301
cugagcaaacagu

SEQ ID NO: 3891785 - RNA, 21 nt, Shigella flexneri 2a str. 301
cugagcaaacaguucugcagc

SEQ ID NO: 3891786 - RNA, 16 nt, Shigella flexneri 2a str. 301
cugagcacuggggcuu

SEQ ID NO: 3891787 - RNA, 16 nt, Shigella flexneri 2a str. 301
cugagcagccaccacu

SEQ ID NO: 3891788 - RNA, 18 nt, Shigella flexneri 2a str. 301
cugagcaucggucgcguu

SEQ ID NO: 3891789 - RNA, 21 nt, Shigella flexneri 2a str. 301
cugagcaugaugccugaugcg

SEQ ID NO: 3891790 - RNA, 18 nt, Shigella flexneri 2a str. 301
cugagccaguuuuucuuu

SEQ ID NO: 3891791 - RNA, 21 nt, Shigella flexneri 2a str. 301
cugagccaguuuuucuuuuuc

SEQ ID NO: 3891792 - RNA, 18 nt, Shigella flexneri 2a str. 301
cugagccugccauuggca

SEQ ID NO: 3891793 - RNA, 19 nt, Shigella flexneri 2a str. 301
cugagcggccuuuuccuuu

SEQ ID NO: 3891794 - RNA, 18 nt, Shigella flexneri 2a str. 301
cugagcgguuaacacggc

SEQ ID NO: 3891795 - RNA, 18 nt, Shigella flexneri 2a str. 301
cugagcuccugcauugac

SEQ ID NO: 3891796 - RNA, 18 nt, Shigella flexneri 2a str. 301
cugagcuggcagaccugc

SEQ ID NO: 3891797 - RNA, 22 nt, Shigella flexneri 2a str. 301
cugagcuugauccuacacauac

SEQ ID NO: 3891798 - RNA, 23 nt, Shigella flexneri 2a str. 301
cugaggccggaugucgcugcuag

SEQ ID NO: 3891799 - RNA, 23 nt, Shigella flexneri 2a str. 301
cugagguuuauaacggugcugca

SEQ ID NO: 3891800 - RNA, 22 nt, Shigella flexneri 2a str. 301
cugaguaauaacuuccugagug

SEQ ID NO: 3891801 - RNA, 15 nt, Shigella flexneri 2a str. 301
cugagugaaucagaa

SEQ ID NO: 3891802 - RNA, 16 nt, Shigella flexneri 2a str. 301
cugagugaaucagaag

SEQ ID NO: 3891803 - RNA, 19 nt, Shigella flexneri 2a str. 301
cugagugggcgucagcagu

SEQ ID NO: 3891804 - RNA, 16 nt, Shigella flexneri 2a str. 301
cugaguugcagcaacu

SEQ ID NO: 3891805 - RNA, 23 nt, Shigella flexneri 2a str. 301
cugaguugcagcaacucuuuuuc

SEQ ID NO: 3891806 - RNA, 16 nt, Shigella flexneri 2a str. 301
cugaguuucagaccaa

SEQ ID NO: 3891807 - RNA, 14 nt, Shigella flexneri 2a str. 301
cugauaaaaaaccc

SEQ ID NO: 3891808 - RNA, 23 nt, Shigella flexneri 2a str. 301
cugauaaaaaacccgcuuuuuga

SEQ ID NO: 3891809 - RNA, 21 nt, Shigella flexneri 2a str. 301
cugauaaaaaccauucaggcu

SEQ ID NO: 3891810 - RNA, 22 nt, Shigella flexneri 2a str. 301
cugauaaacaagcguacaaaau

SEQ ID NO: 3891811 - RNA, 17 nt, Shigella flexneri 2a str. 301
cugauaaaccuucaucg

SEQ ID NO: 3891812 - RNA, 18 nt, Shigella flexneri 2a str. 301
cugauaaaucaccugcgc

SEQ ID NO: 3891813 - RNA, 15 nt, Shigella flexneri 2a str. 301
cugauaacgugcagc

SEQ ID NO: 3891814 - RNA, 18 nt, Shigella flexneri 2a str. 301
cugauaagacgcgccagc

SEQ ID NO: 3891815 - RNA, 21 nt, Shigella flexneri 2a str. 301
cugauaagacgcguaaagcgu

SEQ ID NO: 3891816 - RNA, 16 nt, Shigella flexneri 2a str. 301
cugauaaguuucggag

SEQ ID NO: 3891817 - RNA, 15 nt, Shigella flexneri 2a str. 301
cugauaauccacgcg

SEQ ID NO: 3891818 - RNA, 16 nt, Shigella flexneri 2a str. 301
cugauaauuuuuucac

SEQ ID NO: 3891819 - RNA, 21 nt, Shigella flexneri 2a str. 301
cugauagcguagcgccucagg

SEQ ID NO: 3891820 - RNA, 22 nt, Shigella flexneri 2a str. 301
cugauagugauccaucagguag

SEQ ID NO: 3891821 - RNA, 21 nt, Shigella flexneri 2a str. 301
cugauaguguuuuauguucag

SEQ ID NO: 3891822 - RNA, 15 nt, Shigella flexneri 2a str. 301
cugauauacccuuca

SEQ ID NO: 3891823 - RNA, 17 nt, Shigella flexneri 2a str. 301
cugauaucucaccagau

SEQ ID NO: 3891824 - RNA, 17 nt, Shigella flexneri 2a str. 301
cugauaugccagacuuc

SEQ ID NO: 3891825 - RNA, 14 nt, Shigella flexneri 2a str. 301
cugauauucauauc

SEQ ID NO: 3891826 - RNA, 15 nt, Shigella flexneri 2a str. 301
cugauauugcccgug

SEQ ID NO: 3891827 - RNA, 15 nt, Shigella flexneri 2a str. 301
cugauccagcucuuc

SEQ ID NO: 3891828 - RNA, 19 nt, Shigella flexneri 2a str. 301
cugauccagcucuucuuca

SEQ ID NO: 3891829 - RNA, 17 nt, Shigella flexneri 2a str. 301
cugauccccgcaagucc

SEQ ID NO: 3891830 - RNA, 14 nt, Shigella flexneri 2a str. 301
cugauccugacaag

SEQ ID NO: 3891831 - RNA, 17 nt, Shigella flexneri 2a str. 301
cugaucgccauauuucu

SEQ ID NO: 3891832 - RNA, 23 nt, Shigella flexneri 2a str. 301
cugaucgcuguggaacaucaccc

SEQ ID NO: 3891833 - RNA, 12 nt, Shigella flexneri 2a str. 301
cugaucggcaag

SEQ ID NO: 3891834 - RNA, 16 nt, Shigella flexneri 2a str. 301
cugaucggcaagugcc

SEQ ID NO: 3891835 - RNA, 14 nt, Shigella flexneri 2a str. 301
cugaucuuucuuca

SEQ ID NO: 3891836 - RNA, 13 nt, Shigella flexneri 2a str. 301
cugaugacaaagu

SEQ ID NO: 3891837 - RNA, 19 nt, Shigella flexneri 2a str. 301
cugaugacaagcguaugau

SEQ ID NO: 3891838 - RNA, 20 nt, Shigella flexneri 2a str. 301
cugcauaaacgccgucauca

SEQ ID NO: 3891839 - RNA, 21 nt, Shigella flexneri 2a str. 301
cugcauaaacgccgucaucac

SEQ ID NO: 3891840 - RNA, 22 nt, Shigella flexneri 2a str. 301
cugcauaaacgccgucaucaca

SEQ ID NO: 3891841 - RNA, 18 nt, Shigella flexneri 2a str. 301
cugcauaaucgcaacgcc

SEQ ID NO: 3891842 - RNA, 16 nt, Shigella flexneri 2a str. 301
cugcaucaaccaacac

SEQ ID NO: 3891843 - RNA, 19 nt, Shigella flexneri 2a str. 301
cugcaucaaccaacaccug

SEQ ID NO: 3891844 - RNA, 12 nt, Shigella flexneri 2a str. 301
cugcaucaccau

SEQ ID NO: 3891845 - RNA, 21 nt, Shigella flexneri 2a str. 301
cugcauccgcuuaaucugguc

SEQ ID NO: 3891846 - RNA, 13 nt, Shigella flexneri 2a str. 301
cugcauccguucu

SEQ ID NO: 3891847 - RNA, 12 nt, Shigella flexneri 2a str. 301
cugcaucuuccg

SEQ ID NO: 3891848 - RNA, 19 nt, Shigella flexneri 2a str. 301
cugcaugacggcugaaaug

SEQ ID NO: 3891849 - RNA, 14 nt, Shigella flexneri 2a str. 301
cugcauguuggcga

SEQ ID NO: 3891850 - RNA, 13 nt, Shigella flexneri 2a str. 301
cugcauucaccag

SEQ ID NO: 3891851 - RNA, 23 nt, Shigella flexneri 2a str. 301
cugcauucccaucgcaucgucac

SEQ ID NO: 3891852 - RNA, 22 nt, Shigella flexneri 2a str. 301
cugcauuccgguguaaccauca

SEQ ID NO: 3891853 - RNA, 13 nt, Shigella flexneri 2a str. 301
cugcauugacaag

SEQ ID NO: 3891854 - RNA, 19 nt, Shigella flexneri 2a str. 301
cugcauugcccaauacagc

SEQ ID NO: 3891855 - RNA, 14 nt, Shigella flexneri 2a str. 301
cugcauuugaaacg

SEQ ID NO: 3891856 - RNA, 14 nt, Shigella flexneri 2a str. 301
cugcauuugcugca

SEQ ID NO: 3891857 - RNA, 13 nt, Shigella flexneri 2a str. 301
cugcauuuucucg

SEQ ID NO: 3891858 - RNA, 14 nt, Shigella flexneri 2a str. 301
cugccaauacaaaa

SEQ ID NO: 3891859 - RNA, 17 nt, Shigella flexneri 2a str. 301
cugccaaucaccuggau

SEQ ID NO: 3891860 - RNA, 13 nt, Shigella flexneri 2a str. 301
cugccacgccacg

SEQ ID NO: 3891861 - RNA, 23 nt, Shigella flexneri 2a str. 301
cugccacgguaugacccagcgcg

SEQ ID NO: 3891862 - RNA, 15 nt, Shigella flexneri 2a str. 301
cugccacuacccgca

SEQ ID NO: 3891863 - RNA, 14 nt, Shigella flexneri 2a str. 301
cugccacuucugcu

SEQ ID NO: 3891864 - RNA, 16 nt, Shigella flexneri 2a str. 301
cugccacuucuucgaa

SEQ ID NO: 3891865 - RNA, 23 nt, Shigella flexneri 2a str. 301
cugccacuuucucacucaccgca

SEQ ID NO: 3891866 - RNA, 21 nt, Shigella flexneri 2a str. 301
cugccagaaaucggccuucca

SEQ ID NO: 3891867 - RNA, 15 nt, Shigella flexneri 2a str. 301
cugccagaacaacca

SEQ ID NO: 3891868 - RNA, 17 nt, Shigella flexneri 2a str. 301
cugccagaacaaccaga

SEQ ID NO: 3891869 - RNA, 18 nt, Shigella flexneri 2a str. 301
cugccagaacaaccagag

SEQ ID NO: 3891870 - RNA, 23 nt, Shigella flexneri 2a str. 301
cugccagaacaaccagagcgccg

SEQ ID NO: 3891871 - RNA, 13 nt, Shigella flexneri 2a str. 301
cugccagaaccgc

SEQ ID NO: 3891872 - RNA, 14 nt, Shigella flexneri 2a str. 301
cugccagaaggauu

SEQ ID NO: 3891873 - RNA, 15 nt, Shigella flexneri 2a str. 301
cugccagaccugcga

SEQ ID NO: 3891874 - RNA, 17 nt, Shigella flexneri 2a str. 301
cugccagacuccaggcg

SEQ ID NO: 3891875 - RNA, 22 nt, Shigella flexneri 2a str. 301
cugccagaggagccaucaccau

SEQ ID NO: 3891876 - RNA, 23 nt, Shigella flexneri 2a str. 301
cugccagaggagccaucaccauc

SEQ ID NO: 3891877 - RNA, 13 nt, Shigella flexneri 2a str. 301
cugccagaucauc

SEQ ID NO: 3891878 - RNA, 24 nt, Shigella flexneri 2a str. 301
cugccagaucaucguuuccgaugg

SEQ ID NO: 3891879 - RNA, 13 nt, Shigella flexneri 2a str. 301
cugccagaucggc

SEQ ID NO: 3891880 - RNA, 18 nt, Shigella flexneri 2a str. 301
cugccagaucggccauca

SEQ ID NO: 3891881 - RNA, 20 nt, Shigella flexneri 2a str. 301
cugccagaucggccaucagu

SEQ ID NO: 3891882 - RNA, 21 nt, Shigella flexneri 2a str. 301
cugccagaucggccaucagua

SEQ ID NO: 3891883 - RNA, 16 nt, Shigella flexneri 2a str. 301
cugccagaugcagcgg

SEQ ID NO: 3891884 - RNA, 23 nt, Shigella flexneri 2a str. 301
cugccagaugcagcgguaauucc

SEQ ID NO: 3891885 - RNA, 16 nt, Shigella flexneri 2a str. 301
cugccagauucuccaa

SEQ ID NO: 3891886 - RNA, 17 nt, Shigella flexneri 2a str. 301
cugccagcaugcauaac

SEQ ID NO: 3891887 - RNA, 18 nt, Shigella flexneri 2a str. 301
cugccagcaugcauaaca

SEQ ID NO: 3891888 - RNA, 13 nt, Shigella flexneri 2a str. 301
cugccagcgccga

SEQ ID NO: 3891889 - RNA, 20 nt, Shigella flexneri 2a str. 301
cugccagcguaaauccugac

SEQ ID NO: 3891890 - RNA, 15 nt, Shigella flexneri 2a str. 301
cugccagcguggcga

SEQ ID NO: 3891891 - RNA, 15 nt, Shigella flexneri 2a str. 301
cugccaggagcacgc

SEQ ID NO: 3891892 - RNA, 20 nt, Shigella flexneri 2a str. 301
cugccaggucgugccagaaa

SEQ ID NO: 3891893 - RNA, 23 nt, Shigella flexneri 2a str. 301
cugccaggucgugccagaaaguc

SEQ ID NO: 3891894 - RNA, 18 nt, Shigella flexneri 2a str. 301
cugccagucaaucaucca

SEQ ID NO: 3891895 - RNA, 17 nt, Shigella flexneri 2a str. 301
cugccaguccugcucaa

SEQ ID NO: 3891896 - RNA, 19 nt, Shigella flexneri 2a str. 301
cugccaguuauagcgcaga

SEQ ID NO: 3891897 - RNA, 21 nt, Shigella flexneri 2a str. 301
cugccaguucccccugccaga

SEQ ID NO: 3891898 - RNA, 16 nt, Shigella flexneri 2a str. 301
cugccaguuguugcug

SEQ ID NO: 3891899 - RNA, 19 nt, Shigella flexneri 2a str. 301
cugccaguuguugcugaau

SEQ ID NO: 3891900 - RNA, 22 nt, Shigella flexneri 2a str. 301
cugccaucauggcauccuguuu

SEQ ID NO: 3891901 - RNA, 21 nt, Shigella flexneri 2a str. 301
cugccauuggcaggcucuggu

SEQ ID NO: 3891902 - RNA, 15 nt, Shigella flexneri 2a str. 301
cugccauuguuguug

SEQ ID NO: 3891903 - RNA, 20 nt, Shigella flexneri 2a str. 301
cugccauuguuguuggaucc

SEQ ID NO: 3891904 - RNA, 12 nt, Shigella flexneri 2a str. 301
cugcccaaccgu

SEQ ID NO: 3891905 - RNA, 20 nt, Shigella flexneri 2a str. 301
cugcccaucauaccugagug

SEQ ID NO: 3891906 - RNA, 15 nt, Shigella flexneri 2a str. 301
cugccccagugggcu

SEQ ID NO: 3891907 - RNA, 13 nt, Shigella flexneri 2a str. 301
cugccccaguucc

SEQ ID NO: 3891908 - RNA, 20 nt, Shigella flexneri 2a str. 301
cugcccccgcaugccuacca

SEQ ID NO: 3891909 - RNA, 15 nt, Shigella flexneri 2a str. 301
cugcccgcgcugucg

SEQ ID NO: 3891910 - RNA, 18 nt, Shigella flexneri 2a str. 301
cugcccgugggcaggccu

SEQ ID NO: 3891911 - RNA, 16 nt, Shigella flexneri 2a str. 301
cugcccguuaaccaua

SEQ ID NO: 3891912 - RNA, 18 nt, Shigella flexneri 2a str. 301
cugcccguugccaggacc

SEQ ID NO: 3891913 - RNA, 20 nt, Shigella flexneri 2a str. 301
cugcccuugccaacgcaaac

SEQ ID NO: 3891914 - RNA, 14 nt, Shigella flexneri 2a str. 301
cugccgacaaaugc

SEQ ID NO: 3891915 - RNA, 18 nt, Shigella flexneri 2a str. 301
cugccgagcgugcgggca

SEQ ID NO: 3891916 - RNA, 15 nt, Shigella flexneri 2a str. 301
cugccgaucaacugc

SEQ ID NO: 3891917 - RNA, 17 nt, Shigella flexneri 2a str. 301
cugccgauggcgcaaac

SEQ ID NO: 3891918 - RNA, 14 nt, Shigella flexneri 2a str. 301
cugccgcaauggcc

SEQ ID NO: 3891919 - RNA, 13 nt, Shigella flexneri 2a str. 301
cugccgcacuuug

SEQ ID NO: 3891920 - RNA, 23 nt, Shigella flexneri 2a str. 301
cugccgccaccauguugcgcaga

SEQ ID NO: 3891921 - RNA, 12 nt, Shigella flexneri 2a str. 301
cugccgccagca

SEQ ID NO: 3891922 - RNA, 15 nt, Shigella flexneri 2a str. 301
cugccgccaguucuu

SEQ ID NO: 3891923 - RNA, 20 nt, Shigella flexneri 2a str. 301
cugccgccaguucuuccagu

SEQ ID NO: 3891924 - RNA, 21 nt, Shigella flexneri 2a str. 301
cugccgcgcaggaugcagaaa

SEQ ID NO: 3891925 - RNA, 17 nt, Shigella flexneri 2a str. 301
cugccgcgccagaucag

SEQ ID NO: 3891926 - RNA, 13 nt, Shigella flexneri 2a str. 301
cugccgcgccuga

SEQ ID NO: 3891927 - RNA, 15 nt, Shigella flexneri 2a str. 301
cugccgcgccuucgu

SEQ ID NO: 3891928 - RNA, 16 nt, Shigella flexneri 2a str. 301
cugccgcugcgcguga

SEQ ID NO: 3891929 - RNA, 16 nt, Shigella flexneri 2a str. 301
cugccggaaccagcca

SEQ ID NO: 3891930 - RNA, 17 nt, Shigella flexneri 2a str. 301
cugccggaaccagccag

SEQ ID NO: 3891931 - RNA, 19 nt, Shigella flexneri 2a str. 301
cugccggaacugccugcuc

SEQ ID NO: 3891932 - RNA, 16 nt, Shigella flexneri 2a str. 301
cugccggagcgccacc

SEQ ID NO: 3891933 - RNA, 17 nt, Shigella flexneri 2a str. 301
cugccggagcgccacca

SEQ ID NO: 3891934 - RNA, 20 nt, Shigella flexneri 2a str. 301
cugccggaggaguaucugcu

SEQ ID NO: 3891935 - RNA, 21 nt, Shigella flexneri 2a str. 301
cugccggaggaguaucugcug

SEQ ID NO: 3891936 - RNA, 23 nt, Shigella flexneri 2a str. 301
cugccggaugcaucgcauccgac

SEQ ID NO: 3891937 - RNA, 21 nt, Shigella flexneri 2a str. 301
cugccggcacaggcaucacuu

SEQ ID NO: 3891938 - RNA, 21 nt, Shigella flexneri 2a str. 301
cugccgggaagcucucuucca

SEQ ID NO: 3891939 - RNA, 18 nt, Shigella flexneri 2a str. 301
cugccgggcaaucgcccc

SEQ ID NO: 3891940 - RNA, 23 nt, Shigella flexneri 2a str. 301
cugccguaauagauccuuuuucc

SEQ ID NO: 3891941 - RNA, 17 nt, Shigella flexneri 2a str. 301
cugccguacaggcagcu

SEQ ID NO: 3891942 - RNA, 20 nt, Shigella flexneri 2a str. 301
cugccguacaggcagcuuag

SEQ ID NO: 3891943 - RNA, 14 nt, Shigella flexneri 2a str. 301
cugccuccaugaaa

SEQ ID NO: 3891944 - RNA, 17 nt, Shigella flexneri 2a str. 301
cugccucucuucgcugc

SEQ ID NO: 3891945 - RNA, 18 nt, Shigella flexneri 2a str. 301
cugccucucuucgcugcu

SEQ ID NO: 3891946 - RNA, 18 nt, Shigella flexneri 2a str. 301
cugccugauccugggcua

SEQ ID NO: 3891947 - RNA, 10 nt, Shigella flexneri 2a str. 301
cugccugaug

SEQ ID NO: 3891948 - RNA, 13 nt, Shigella flexneri 2a str. 301
cugccugaugcgc

SEQ ID NO: 3891949 - RNA, 19 nt, Shigella flexneri 2a str. 301
cugccugcggaaugagcga

SEQ ID NO: 3891950 - RNA, 21 nt, Shigella flexneri 2a str. 301
cugccugcugauaagacgcau

SEQ ID NO: 3891951 - RNA, 19 nt, Shigella flexneri 2a str. 301
cugccuguacggcagugaa

SEQ ID NO: 3891952 - RNA, 22 nt, Shigella flexneri 2a str. 301
cugccuguugugcgagcaaagc

SEQ ID NO: 3891953 - RNA, 18 nt, Shigella flexneri 2a str. 301
cugccuucacuuccggca

SEQ ID NO: 3891954 - RNA, 16 nt, Shigella flexneri 2a str. 301
cugcgaaaguaccauu

SEQ ID NO: 3891955 - RNA, 19 nt, Shigella flexneri 2a str. 301
cugcgaacgcaaucaaaua

SEQ ID NO: 3891956 - RNA, 13 nt, Shigella flexneri 2a str. 301
cugcgaaucgcuu

SEQ ID NO: 3891957 - RNA, 17 nt, Shigella flexneri 2a str. 301
cugcgaaucgcuucauu

SEQ ID NO: 3891958 - RNA, 18 nt, Shigella flexneri 2a str. 301
cugcgaaucgcuucauuu

SEQ ID NO: 3891959 - RNA, 21 nt, Shigella flexneri 2a str. 301
cugcgaauugagaugacgcca

SEQ ID NO: 3891960 - RNA, 20 nt, Shigella flexneri 2a str. 301
cugcgacagggaucucuucc

SEQ ID NO: 3891961 - RNA, 22 nt, Shigella flexneri 2a str. 301
cugcgacagggaucucuuccag

SEQ ID NO: 3891962 - RNA, 15 nt, Shigella flexneri 2a str. 301
cugcgaccagaccag

SEQ ID NO: 3891963 - RNA, 21 nt, Shigella flexneri 2a str. 301
cugcgaccggcguaacggcca

SEQ ID NO: 3891964 - RNA, 19 nt, Shigella flexneri 2a str. 301
cugcgagauuccgccgcca

SEQ ID NO: 3891965 - RNA, 13 nt, Shigella flexneri 2a str. 301
cugcgaguccugu

SEQ ID NO: 3891966 - RNA, 14 nt, Shigella flexneri 2a str. 301
cugcgauagcagca

SEQ ID NO: 3891967 - RNA, 20 nt, Shigella flexneri 2a str. 301
cugcgauaguggaacaaaga

SEQ ID NO: 3891968 - RNA, 21 nt, Shigella flexneri 2a str. 301
cugcgauugugacacgcgcgc

SEQ ID NO: 3891969 - RNA, 14 nt, Shigella flexneri 2a str. 301
cugcgcacaagccc

SEQ ID NO: 3891970 - RNA, 17 nt, Shigella flexneri 2a str. 301
cugcgcagauuagccgg

SEQ ID NO: 3891971 - RNA, 15 nt, Shigella flexneri 2a str. 301
cugcgcauaacugcc

SEQ ID NO: 3891972 - RNA, 14 nt, Shigella flexneri 2a str. 301
cugcgcaucuuccc

SEQ ID NO: 3891973 - RNA, 15 nt, Shigella flexneri 2a str. 301
cugcgccaaacagau

SEQ ID NO: 3891974 - RNA, 22 nt, Shigella flexneri 2a str. 301
cugcgccaaacagaugaugcgu

SEQ ID NO: 3891975 - RNA, 12 nt, Shigella flexneri 2a str. 301
cugcgccaauac

SEQ ID NO: 3891976 - RNA, 13 nt, Shigella flexneri 2a str. 301
cugcgccaccaca

SEQ ID NO: 3891977 - RNA, 16 nt, Shigella flexneri 2a str. 301
cugcgccaccacaaca

SEQ ID NO: 3891978 - RNA, 12 nt, Shigella flexneri 2a str. 301
cugcgccagcca

SEQ ID NO: 3891979 - RNA, 12 nt, Shigella flexneri 2a str. 301
cugcgccagcgc

SEQ ID NO: 3891980 - RNA, 16 nt, Shigella flexneri 2a str. 301
cugcgccagcgcgcgu

SEQ ID NO: 3891981 - RNA, 18 nt, Shigella flexneri 2a str. 301
cugcgccagcggcaguaa

SEQ ID NO: 3891982 - RNA, 17 nt, Shigella flexneri 2a str. 301
cugcgcccagcgugcgu

SEQ ID NO: 3891983 - RNA, 18 nt, Shigella flexneri 2a str. 301
cugcgccccacaccacca

SEQ ID NO: 3891984 - RNA, 20 nt, Shigella flexneri 2a str. 301
cugcgcccgcccgcuguaag

SEQ ID NO: 3891985 - RNA, 14 nt, Shigella flexneri 2a str. 301
cugcgccgccuucu

SEQ ID NO: 3891986 - RNA, 15 nt, Shigella flexneri 2a str. 301
cugcgccucgccgcu

SEQ ID NO: 3891987 - RNA, 21 nt, Shigella flexneri 2a str. 301
cugcgcgaccaucggaucggc

SEQ ID NO: 3891988 - RNA, 21 nt, Shigella flexneri 2a str. 301
cugcgcgaccucuucugccug

SEQ ID NO: 3891989 - RNA, 17 nt, Shigella flexneri 2a str. 301
cugcgcgacuucauuca

SEQ ID NO: 3891990 - RNA, 18 nt, Shigella flexneri 2a str. 301
cugcgcgagguuaaaaag

SEQ ID NO: 3891991 - RNA, 15 nt, Shigella flexneri 2a str. 301
cugcgcgaugaugcc

SEQ ID NO: 3891992 - RNA, 21 nt, Shigella flexneri 2a str. 301
cugcgcgucuuaucaggccug

SEQ ID NO: 3891993 - RNA, 19 nt, Shigella flexneri 2a str. 301
cugcgcgugaagcacguaa

SEQ ID NO: 3891994 - RNA, 16 nt, Shigella flexneri 2a str. 301
cugcgcuaaacaggau

SEQ ID NO: 3891995 - RNA, 14 nt, Shigella flexneri 2a str. 301
cugcgcuaccagga

SEQ ID NO: 3891996 - RNA, 14 nt, Shigella flexneri 2a str. 301
cugcgcuauccagc

SEQ ID NO: 3891997 - RNA, 14 nt, Shigella flexneri 2a str. 301
cugcgcugacucua

SEQ ID NO: 3891998 - RNA, 14 nt, Shigella flexneri 2a str. 301
cugcgcuggaacaa

SEQ ID NO: 3891999 - RNA, 13 nt, Shigella flexneri 2a str. 301
cugcgcuuaucag

SEQ ID NO: 3892000 - RNA, 21 nt, Shigella flexneri 2a str. 301
cugcgcuuaucaggccugcaa

SEQ ID NO: 3892001 - RNA, 18 nt, Shigella flexneri 2a str. 301
cugcgcuuauccggccca

SEQ ID NO: 3892002 - RNA, 12 nt, Shigella flexneri 2a str. 301
cugcgcuuccag

SEQ ID NO: 3892003 - RNA, 15 nt, Shigella flexneri 2a str. 301
cugcgcuuccagcuc

SEQ ID NO: 3892004 - RNA, 16 nt, Shigella flexneri 2a str. 301
cugcgcuuccagcucc

SEQ ID NO: 3892005 - RNA, 16 nt, Shigella flexneri 2a str. 301
cugcgcuuccugcaac

SEQ ID NO: 3892006 - RNA, 16 nt, Shigella flexneri 2a str. 301
cugcggaaaaaagaaa

SEQ ID NO: 3892007 - RNA, 13 nt, Shigella flexneri 2a str. 301
cugcggacgcacc

SEQ ID NO: 3892008 - RNA, 21 nt, Shigella flexneri 2a str. 301
cugcggauuuguaauuucagc

SEQ ID NO: 3892009 - RNA, 23 nt, Shigella flexneri 2a str. 301
cugcggcaagaauuacuucuuga

SEQ ID NO: 3892010 - RNA, 14 nt, Shigella flexneri 2a str. 301
cugcggccagcagc

SEQ ID NO: 3892011 - RNA, 17 nt, Shigella flexneri 2a str. 301
cugcggccagcagcugu

SEQ ID NO: 3892012 - RNA, 22 nt, Shigella flexneri 2a str. 301
cugcggcgaugaccgccacggu

SEQ ID NO: 3892013 - RNA, 16 nt, Shigella flexneri 2a str. 301
cugcggcgcgcaucuu

SEQ ID NO: 3892014 - RNA, 21 nt, Shigella flexneri 2a str. 301
cugcggcgcgcaucuucguua

SEQ ID NO: 3892015 - RNA, 19 nt, Shigella flexneri 2a str. 301
cugcggcggcaucgccuuc

SEQ ID NO: 3892016 - RNA, 16 nt, Shigella flexneri 2a str. 301
cugcggcgugggcgcu

SEQ ID NO: 3892017 - RNA, 23 nt, Shigella flexneri 2a str. 301
cugcggcgugggcgcuguugcac

SEQ ID NO: 3892018 - RNA, 15 nt, Shigella flexneri 2a str. 301
cugcggcuggcacaa

SEQ ID NO: 3892019 - RNA, 13 nt, Shigella flexneri 2a str. 301
cugcggcuuccag

SEQ ID NO: 3892020 - RNA, 18 nt, Shigella flexneri 2a str. 301
cugcggcuuccagagcag

SEQ ID NO: 3892021 - RNA, 17 nt, Shigella flexneri 2a str. 301
cugcgggaguugcucca

SEQ ID NO: 3892022 - RNA, 18 nt, Shigella flexneri 2a str. 301
cugcgggcgaccaaucaa

SEQ ID NO: 3892023 - RNA, 16 nt, Shigella flexneri 2a str. 301
cugcggguuagucugc

SEQ ID NO: 3892024 - RNA, 21 nt, Shigella flexneri 2a str. 301
cugcggguuagucugcauuuu

SEQ ID NO: 3892025 - RNA, 14 nt, Shigella flexneri 2a str. 301
cugcggguuggcuu

SEQ ID NO: 3892026 - RNA, 14 nt, Shigella flexneri 2a str. 301
cugcgguaauccgg

SEQ ID NO: 3892027 - RNA, 21 nt, Shigella flexneri 2a str. 301
cugcgguaauccgggugaacu

SEQ ID NO: 3892028 - RNA, 15 nt, Shigella flexneri 2a str. 301
cugcgguucagcuuu

SEQ ID NO: 3892029 - RNA, 16 nt, Shigella flexneri 2a str. 301
cugcgguucagcuuuu

SEQ ID NO: 3892030 - RNA, 20 nt, Shigella flexneri 2a str. 301
cugcgguuucaacgacccag

SEQ ID NO: 3892031 - RNA, 19 nt, Shigella flexneri 2a str. 301
cugcguacugagucgggug

SEQ ID NO: 3892032 - RNA, 14 nt, Shigella flexneri 2a str. 301
cugcguacuggcau

SEQ ID NO: 3892033 - RNA, 14 nt, Shigella flexneri 2a str. 301
cugcguaucgcccu

SEQ ID NO: 3892034 - RNA, 18 nt, Shigella flexneri 2a str. 301
cugcguaucgcccugcca

SEQ ID NO: 3892035 - RNA, 16 nt, Shigella flexneri 2a str. 301
cugcguauuuccugcc

SEQ ID NO: 3892036 - RNA, 23 nt, Shigella flexneri 2a str. 301
cugcgucauuccggaguuuauga

SEQ ID NO: 3892037 - RNA, 19 nt, Shigella flexneri 2a str. 301
cugcgucgacauagccauc

SEQ ID NO: 3892038 - RNA, 22 nt, Shigella flexneri 2a str. 301
cuggacaaagagcuuucauuuc

SEQ ID NO: 3892039 - RNA, 15 nt, Shigella flexneri 2a str. 301
cuggacaacuucuga

SEQ ID NO: 3892040 - RNA, 22 nt, Shigella flexneri 2a str. 301
cuggacagcucguuaaucagaa

SEQ ID NO: 3892041 - RNA, 15 nt, Shigella flexneri 2a str. 301
cuggaccagcggguu

SEQ ID NO: 3892042 - RNA, 20 nt, Shigella flexneri 2a str. 301
cuggacucccagaacaaccc

SEQ ID NO: 3892043 - RNA, 15 nt, Shigella flexneri 2a str. 301
cuggagaagauauug

SEQ ID NO: 3892044 - RNA, 22 nt, Shigella flexneri 2a str. 301
cuggagauauuuuuauggcagg

SEQ ID NO: 3892045 - RNA, 16 nt, Shigella flexneri 2a str. 301
cuggagcacccgcgcu

SEQ ID NO: 3892046 - RNA, 18 nt, Shigella flexneri 2a str. 301
cuggagcacugcgcccgc

SEQ ID NO: 3892047 - RNA, 15 nt, Shigella flexneri 2a str. 301
cuggagcaggaacuu

SEQ ID NO: 3892048 - RNA, 22 nt, Shigella flexneri 2a str. 301
cuggauaaggcguuuacgccgc

SEQ ID NO: 3892049 - RNA, 20 nt, Shigella flexneri 2a str. 301
cuggauagauauucuccagc

SEQ ID NO: 3892050 - RNA, 16 nt, Shigella flexneri 2a str. 301
cuggauauugcggaac

SEQ ID NO: 3892051 - RNA, 18 nt, Shigella flexneri 2a str. 301
cuggauauugcggaacau

SEQ ID NO: 3892052 - RNA, 23 nt, Shigella flexneri 2a str. 301
cuggaucaaggauugcagcacug

SEQ ID NO: 3892053 - RNA, 23 nt, Shigella flexneri 2a str. 301
cuggaucacaauccgcucuuuca

SEQ ID NO: 3892054 - RNA, 22 nt, Shigella flexneri 2a str. 301
cuggaucagacgcagccagcgu

SEQ ID NO: 3892055 - RNA, 16 nt, Shigella flexneri 2a str. 301
cuggaucccagaagau

SEQ ID NO: 3892056 - RNA, 20 nt, Shigella flexneri 2a str. 301
cuggaucugcggguuagucu

SEQ ID NO: 3892057 - RNA, 20 nt, Shigella flexneri 2a str. 301
cuggaugaacauaaucugca

SEQ ID NO: 3892058 - RNA, 15 nt, Shigella flexneri 2a str. 301
cuggaugccagcgaa

SEQ ID NO: 3892059 - RNA, 13 nt, Shigella flexneri 2a str. 301
cuggauggcucug

SEQ ID NO: 3892060 - RNA, 13 nt, Shigella flexneri 2a str. 301
cuggauugccagc

SEQ ID NO: 3892061 - RNA, 16 nt, Shigella flexneri 2a str. 301
cuggauuuauauaaau

SEQ ID NO: 3892062 - RNA, 13 nt, Shigella flexneri 2a str. 301
cuggauuucaaua

SEQ ID NO: 3892063 - RNA, 19 nt, Shigella flexneri 2a str. 301
cuggauuucaauaacucca

SEQ ID NO: 3892064 - RNA, 23 nt, Shigella flexneri 2a str. 301
cuggauuucaauaacuccaucuu

SEQ ID NO: 3892065 - RNA, 22 nt, Shigella flexneri 2a str. 301
cuggauuuggcugccgagcaaa

SEQ ID NO: 3892066 - RNA, 22 nt, Shigella flexneri 2a str. 301
cuggauuuucucuguuuccaga

SEQ ID NO: 3892067 - RNA, 14 nt, Shigella flexneri 2a str. 301
cuggcaaaaauaag

SEQ ID NO: 3892068 - RNA, 15 nt, Shigella flexneri 2a str. 301
cuggcaaaguagagc

SEQ ID NO: 3892069 - RNA, 15 nt, Shigella flexneri 2a str. 301
cuggcaaaugacaua

SEQ ID NO: 3892070 - RNA, 18 nt, Shigella flexneri 2a str. 301
cuggcaaauucaggagca

SEQ ID NO: 3892071 - RNA, 16 nt, Shigella flexneri 2a str. 301
cuggcaacaauggcau

SEQ ID NO: 3892072 - RNA, 14 nt, Shigella flexneri 2a str. 301
cuggcaauagcgca

SEQ ID NO: 3892073 - RNA, 15 nt, Shigella flexneri 2a str. 301
cuggcaauccagcuc

SEQ ID NO: 3892074 - RNA, 13 nt, Shigella flexneri 2a str. 301
cuggcaaucgcca

SEQ ID NO: 3892075 - RNA, 17 nt, Shigella flexneri 2a str. 301
cuggcaaucgccagcgg

SEQ ID NO: 3892076 - RNA, 12 nt, Shigella flexneri 2a str. 301
cuggcaaugacc

SEQ ID NO: 3892077 - RNA, 17 nt, Shigella flexneri 2a str. 301
cuggcaaugacgggcuu

SEQ ID NO: 3892078 - RNA, 22 nt, Shigella flexneri 2a str. 301
cuggcaaugagcaguuugguua

SEQ ID NO: 3892079 - RNA, 19 nt, Shigella flexneri 2a str. 301
cuggcacaacucggcggcu

SEQ ID NO: 3892080 - RNA, 16 nt, Shigella flexneri 2a str. 301
cuggcacaugcauaaa

SEQ ID NO: 3892081 - RNA, 17 nt, Shigella flexneri 2a str. 301
cuggcaccgcagaucag

SEQ ID NO: 3892082 - RNA, 13 nt, Shigella flexneri 2a str. 301
cuggcacgaccug

SEQ ID NO: 3892083 - RNA, 14 nt, Shigella flexneri 2a str. 301
cuggcacgaccugg

SEQ ID NO: 3892084 - RNA, 18 nt, Shigella flexneri 2a str. 301
cuggcagaaaguucgcga

SEQ ID NO: 3892085 - RNA, 15 nt, Shigella flexneri 2a str. 301
cuggcagaugcgucu

SEQ ID NO: 3892086 - RNA, 17 nt, Shigella flexneri 2a str. 301
cuggcagcaagugcggc

SEQ ID NO: 3892087 - RNA, 19 nt, Shigella flexneri 2a str. 301
cuggcagcaagugcggcgc

SEQ ID NO: 3892088 - RNA, 17 nt, Shigella flexneri 2a str. 301
cuggcagccauaaucac

SEQ ID NO: 3892089 - RNA, 23 nt, Shigella flexneri 2a str. 301
cuggcagcguauucgcgcagaac

SEQ ID NO: 3892090 - RNA, 20 nt, Shigella flexneri 2a str. 301
cuggcaguggcaaccagcgg

SEQ ID NO: 3892091 - RNA, 16 nt, Shigella flexneri 2a str. 301
cuggcauaaacaaagc

SEQ ID NO: 3892092 - RNA, 23 nt, Shigella flexneri 2a str. 301
cuggcauccccgcccuuccagcu

SEQ ID NO: 3892093 - RNA, 15 nt, Shigella flexneri 2a str. 301
cuggcaucugccccc

SEQ ID NO: 3892094 - RNA, 13 nt, Shigella flexneri 2a str. 301
cuggcaugaaugg

SEQ ID NO: 3892095 - RNA, 17 nt, Shigella flexneri 2a str. 301
cuggcauguugauacac

SEQ ID NO: 3892096 - RNA, 16 nt, Shigella flexneri 2a str. 301
cuggcauuugcaccga

SEQ ID NO: 3892097 - RNA, 19 nt, Shigella flexneri 2a str. 301
cuggcauuuggcucucgau

SEQ ID NO: 3892098 - RNA, 17 nt, Shigella flexneri 2a str. 301
cuggccaaugccucuac

SEQ ID NO: 3892099 - RNA, 13 nt, Shigella flexneri 2a str. 301
cuggccacuucug

SEQ ID NO: 3892100 - RNA, 21 nt, Shigella flexneri 2a str. 301
cuggccacuucuguuacucca

SEQ ID NO: 3892101 - RNA, 16 nt, Shigella flexneri 2a str. 301
cuggccaugcggcgag

SEQ ID NO: 3892102 - RNA, 22 nt, Shigella flexneri 2a str. 301
cuggcccaguugauucgcgcgu

SEQ ID NO: 3892103 - RNA, 15 nt, Shigella flexneri 2a str. 301
cuggcccauagacag

SEQ ID NO: 3892104 - RNA, 13 nt, Shigella flexneri 2a str. 301
cuggcccaucaga

SEQ ID NO: 3892105 - RNA, 16 nt, Shigella flexneri 2a str. 301
cuggccguacccagcu

SEQ ID NO: 3892106 - RNA, 14 nt, Shigella flexneri 2a str. 301
cuggccgugcagac

SEQ ID NO: 3892107 - RNA, 15 nt, Shigella flexneri 2a str. 301
cuggccgugcagacc

SEQ ID NO: 3892108 - RNA, 18 nt, Shigella flexneri 2a str. 301
cuggcgaacauccagcag

SEQ ID NO: 3892109 - RNA, 19 nt, Shigella flexneri 2a str. 301
cuggcgaacauccagcagc

SEQ ID NO: 3892110 - RNA, 22 nt, Shigella flexneri 2a str. 301
cuggcgaagccucuuacacuug

SEQ ID NO: 3892111 - RNA, 20 nt, Shigella flexneri 2a str. 301
cuggcgacaugcaucacgcg

SEQ ID NO: 3892112 - RNA, 15 nt, Shigella flexneri 2a str. 301
cuggcgacauuuucu

SEQ ID NO: 3892113 - RNA, 19 nt, Shigella flexneri 2a str. 301
cuggcgacgccucuauuaa

SEQ ID NO: 3892114 - RNA, 18 nt, Shigella flexneri 2a str. 301
cuggcgcguuaucgacaa

SEQ ID NO: 3892115 - RNA, 18 nt, Shigella flexneri 2a str. 301
cuggcgcguuuaaucaca

SEQ ID NO: 3892116 - RNA, 15 nt, Shigella flexneri 2a str. 301
cuggcgcuaucaaua

SEQ ID NO: 3892117 - RNA, 13 nt, Shigella flexneri 2a str. 301
cuggcgcuggcgu

SEQ ID NO: 3892118 - RNA, 23 nt, Shigella flexneri 2a str. 301
cuggcgcuguucgggaguugcag

SEQ ID NO: 3892119 - RNA, 14 nt, Shigella flexneri 2a str. 301
cuggcggaaagcca

SEQ ID NO: 3892120 - RNA, 18 nt, Shigella flexneri 2a str. 301
cuggcggagcucccaggc

SEQ ID NO: 3892121 - RNA, 21 nt, Shigella flexneri 2a str. 301
cuggcggagcucccaggcucc

SEQ ID NO: 3892122 - RNA, 14 nt, Shigella flexneri 2a str. 301
cuggcggcaauaac

SEQ ID NO: 3892123 - RNA, 18 nt, Shigella flexneri 2a str. 301
cuggcggcaaucgccaga

SEQ ID NO: 3892124 - RNA, 13 nt, Shigella flexneri 2a str. 301
cuggcggcagcag

SEQ ID NO: 3892125 - RNA, 15 nt, Shigella flexneri 2a str. 301
cuggcggcggcaacg

SEQ ID NO: 3892126 - RNA, 17 nt, Shigella flexneri 2a str. 301
cuggcggcuuauauauu

SEQ ID NO: 3892127 - RNA, 19 nt, Shigella flexneri 2a str. 301
cuggcgggaauaaaagcca

SEQ ID NO: 3892128 - RNA, 18 nt, Shigella flexneri 2a str. 301
cuggcgggcagaggcaau

SEQ ID NO: 3892129 - RNA, 23 nt, Shigella flexneri 2a str. 301
cuggcguaccaaucagacucaua

SEQ ID NO: 3892130 - RNA, 14 nt, Shigella flexneri 2a str. 301
cuggcguacccauc

SEQ ID NO: 3892131 - RNA, 18 nt, Shigella flexneri 2a str. 301
cuggcguacccaucaaca

SEQ ID NO: 3892132 - RNA, 21 nt, Shigella flexneri 2a str. 301
cuggcgucuggcccaugccag

SEQ ID NO: 3892133 - RNA, 13 nt, Shigella flexneri 2a str. 301
cuggcgucugggc

SEQ ID NO: 3892134 - RNA, 22 nt, Shigella flexneri 2a str. 301
cuggcguguuucauuagcccgg

SEQ ID NO: 3892135 - RNA, 17 nt, Shigella flexneri 2a str. 301
cuggcguuuuuccaaaa

SEQ ID NO: 3892136 - RNA, 12 nt, Shigella flexneri 2a str. 301
cuggcucaagca

SEQ ID NO: 3892137 - RNA, 14 nt, Shigella flexneri 2a str. 301
cuggcucaagcacc

SEQ ID NO: 3892138 - RNA, 18 nt, Shigella flexneri 2a str. 301
cuguacagauccgccauu

SEQ ID NO: 3892139 - RNA, 14 nt, Shigella flexneri 2a str. 301
cuguacauugagcu

SEQ ID NO: 3892140 - RNA, 15 nt, Shigella flexneri 2a str. 301
cuguaccacaaccug

SEQ ID NO: 3892141 - RNA, 14 nt, Shigella flexneri 2a str. 301
cuguaccaccagaa

SEQ ID NO: 3892142 - RNA, 22 nt, Shigella flexneri 2a str. 301
cuguaccaccagaaucgccagc

SEQ ID NO: 3892143 - RNA, 21 nt, Shigella flexneri 2a str. 301
cuguaccuucacgcgcuccag

SEQ ID NO: 3892144 - RNA, 23 nt, Shigella flexneri 2a str. 301
cuguaccuucacgcgcuccagga

SEQ ID NO: 3892145 - RNA, 17 nt, Shigella flexneri 2a str. 301
cuguacgacaaaagaau

SEQ ID NO: 3892146 - RNA, 14 nt, Shigella flexneri 2a str. 301
cuguacggcaguga

SEQ ID NO: 3892147 - RNA, 18 nt, Shigella flexneri 2a str. 301
cuguacgguaauggcaaa

SEQ ID NO: 3892148 - RNA, 15 nt, Shigella flexneri 2a str. 301
cuguacgucagcguc

SEQ ID NO: 3892149 - RNA, 16 nt, Shigella flexneri 2a str. 301
cuguacuuucaacagg

SEQ ID NO: 3892150 - RNA, 13 nt, Shigella flexneri 2a str. 301
cuguagaagcuga

SEQ ID NO: 3892151 - RNA, 18 nt, Shigella flexneri 2a str. 301
cuguagagcuaccggcag

SEQ ID NO: 3892152 - RNA, 21 nt, Shigella flexneri 2a str. 301
cuguagagcuaccggcaggaa

SEQ ID NO: 3892153 - RNA, 19 nt, Shigella flexneri 2a str. 301
cuguagauaaaacacucuu

SEQ ID NO: 3892154 - RNA, 14 nt, Shigella flexneri 2a str. 301
cuguagccagcucg

SEQ ID NO: 3892155 - RNA, 14 nt, Shigella flexneri 2a str. 301
cuguagcuggaaaa

SEQ ID NO: 3892156 - RNA, 18 nt, Shigella flexneri 2a str. 301
cuguaggccagauaagac

SEQ ID NO: 3892157 - RNA, 16 nt, Shigella flexneri 2a str. 301
cuguaguacaaauuuu

SEQ ID NO: 3892158 - RNA, 14 nt, Shigella flexneri 2a str. 301
cuguauacgggcuu

SEQ ID NO: 3892159 - RNA, 20 nt, Shigella flexneri 2a str. 301
cuguaucaugcaguaccaga

SEQ ID NO: 3892160 - RNA, 19 nt, Shigella flexneri 2a str. 301
cuguaucccagcccagcgg

SEQ ID NO: 3892161 - RNA, 20 nt, Shigella flexneri 2a str. 301
cuguaucgucacugguucaa

SEQ ID NO: 3892162 - RNA, 11 nt, Shigella flexneri 2a str. 301
cuguaugcaug

SEQ ID NO: 3892163 - RNA, 13 nt, Shigella flexneri 2a str. 301
cuguaugcaugca

SEQ ID NO: 3892164 - RNA, 15 nt, Shigella flexneri 2a str. 301
cuguauguuccccuc

SEQ ID NO: 3892165 - RNA, 21 nt, Shigella flexneri 2a str. 301
cuguauuagcaucgcgauggc

SEQ ID NO: 3892166 - RNA, 16 nt, Shigella flexneri 2a str. 301
cuguauucuucagcga

SEQ ID NO: 3892167 - RNA, 11 nt, Shigella flexneri 2a str. 301
cuguauuuugc

SEQ ID NO: 3892168 - RNA, 20 nt, Shigella flexneri 2a str. 301
cuguauuuugcguuucugcu

SEQ ID NO: 3892169 - RNA, 20 nt, Shigella flexneri 2a str. 301
cugucaauaaacgccugcuu

SEQ ID NO: 3892170 - RNA, 22 nt, Shigella flexneri 2a str. 301
cugucaauaaacgccugcuuau

SEQ ID NO: 3892171 - RNA, 17 nt, Shigella flexneri 2a str. 301
cugucacaccuuauuua

SEQ ID NO: 3892172 - RNA, 13 nt, Shigella flexneri 2a str. 301
cugucaccaauca

SEQ ID NO: 3892173 - RNA, 20 nt, Shigella flexneri 2a str. 301
cugucaguggacgauaagca

SEQ ID NO: 3892174 - RNA, 13 nt, Shigella flexneri 2a str. 301
cugucaguucacc

SEQ ID NO: 3892175 - RNA, 15 nt, Shigella flexneri 2a str. 301
cugucaguuggcugu

SEQ ID NO: 3892176 - RNA, 15 nt, Shigella flexneri 2a str. 301
cuguccacacccaga

SEQ ID NO: 3892177 - RNA, 16 nt, Shigella flexneri 2a str. 301
cuguccgauuuguucu

SEQ ID NO: 3892178 - RNA, 17 nt, Shigella flexneri 2a str. 301
cuguccgauuuguucuc

SEQ ID NO: 3892179 - RNA, 23 nt, Shigella flexneri 2a str. 301
cuguccgcgucuuaucaggccua

SEQ ID NO: 3892180 - RNA, 19 nt, Shigella flexneri 2a str. 301
cuguccgcuucaccaccgc

SEQ ID NO: 3892181 - RNA, 16 nt, Shigella flexneri 2a str. 301
cuguccggcgcacugg

SEQ ID NO: 3892182 - RNA, 19 nt, Shigella flexneri 2a str. 301
cuguccgggcacauuuuua

SEQ ID NO: 3892183 - RNA, 22 nt, Shigella flexneri 2a str. 301
cuguccucuucagcaucaauga

SEQ ID NO: 3892184 - RNA, 18 nt, Shigella flexneri 2a str. 301
cugucgaacgcuaugacg

SEQ ID NO: 3892185 - RNA, 22 nt, Shigella flexneri 2a str. 301
cugucgacaaagccgcaggcgu

SEQ ID NO: 3892186 - RNA, 14 nt, Shigella flexneri 2a str. 301
cugucgaucuccgg

SEQ ID NO: 3892187 - RNA, 14 nt, Shigella flexneri 2a str. 301
cugucgcaaauccg

SEQ ID NO: 3892188 - RNA, 15 nt, Shigella flexneri 2a str. 301
cugucgcaaauccgc

SEQ ID NO: 3892189 - RNA, 13 nt, Shigella flexneri 2a str. 301
cugucgcagccag

SEQ ID NO: 3892190 - RNA, 14 nt, Shigella flexneri 2a str. 301
cugucgcagccagc

SEQ ID NO: 3892191 - RNA, 15 nt, Shigella flexneri 2a str. 301
cugucgcgcagcacu

SEQ ID NO: 3892192 - RNA, 15 nt, Shigella flexneri 2a str. 301
cugucgcuucacgca

SEQ ID NO: 3892193 - RNA, 23 nt, Shigella flexneri 2a str. 301
cugucggcaagauacugcauaau

SEQ ID NO: 3892194 - RNA, 20 nt, Shigella flexneri 2a str. 301
cugucggcacugaccaccac

SEQ ID NO: 3892195 - RNA, 22 nt, Shigella flexneri 2a str. 301
cugucggcacugaccaccacca

SEQ ID NO: 3892196 - RNA, 17 nt, Shigella flexneri 2a str. 301
cugucgggaacacuuua

SEQ ID NO: 3892197 - RNA, 22 nt, Shigella flexneri 2a str. 301
cugucggggccagcgcauccau

SEQ ID NO: 3892198 - RNA, 19 nt, Shigella flexneri 2a str. 301
cugucggguaagcgccaca

SEQ ID NO: 3892199 - RNA, 21 nt, Shigella flexneri 2a str. 301
cugucgggugcuuuuuucaau

SEQ ID NO: 3892200 - RNA, 15 nt, Shigella flexneri 2a str. 301
cugucguaacugcgc

SEQ ID NO: 3892201 - RNA, 14 nt, Shigella flexneri 2a str. 301
cugucguccggcag

SEQ ID NO: 3892202 - RNA, 18 nt, Shigella flexneri 2a str. 301
cugucguccggcagcaga

SEQ ID NO: 3892203 - RNA, 20 nt, Shigella flexneri 2a str. 301
cugucguuaaugcgccaagc

SEQ ID NO: 3892204 - RNA, 16 nt, Shigella flexneri 2a str. 301
cugucucucagcacac

SEQ ID NO: 3892205 - RNA, 15 nt, Shigella flexneri 2a str. 301
cugucugauaaaaaa

SEQ ID NO: 3892206 - RNA, 16 nt, Shigella flexneri 2a str. 301
cugucugcuucugccu

SEQ ID NO: 3892207 - RNA, 19 nt, Shigella flexneri 2a str. 301
cugucuggcgucuccugcc

SEQ ID NO: 3892208 - RNA, 15 nt, Shigella flexneri 2a str. 301
cugucuguacggcag

SEQ ID NO: 3892209 - RNA, 16 nt, Shigella flexneri 2a str. 301
cugucuguuauuuauu

SEQ ID NO: 3892210 - RNA, 13 nt, Shigella flexneri 2a str. 301
cugucuuaacgca

SEQ ID NO: 3892211 - RNA, 22 nt, Shigella flexneri 2a str. 301
cugucuucccugcugaaucccc

SEQ ID NO: 3892212 - RNA, 19 nt, Shigella flexneri 2a str. 301
cugugaagauggcuaacua

SEQ ID NO: 3892213 - RNA, 14 nt, Shigella flexneri 2a str. 301
cugugacagcagcg

SEQ ID NO: 3892214 - RNA, 16 nt, Shigella flexneri 2a str. 301
cugugacgacuuuuuc

SEQ ID NO: 3892215 - RNA, 18 nt, Shigella flexneri 2a str. 301
cugugacucaaugaaauc

SEQ ID NO: 3892216 - RNA, 19 nt, Shigella flexneri 2a str. 301
cugugagaguucugcgcau

SEQ ID NO: 3892217 - RNA, 16 nt, Shigella flexneri 2a str. 301
cugugcaaccuuuucc

SEQ ID NO: 3892218 - RNA, 17 nt, Shigella flexneri 2a str. 301
cugugcaauauuacuuc

SEQ ID NO: 3892219 - RNA, 12 nt, Shigella flexneri 2a str. 301
cugugcaccaga

SEQ ID NO: 3892220 - RNA, 15 nt, Shigella flexneri 2a str. 301
cugugcacccgcuuc

SEQ ID NO: 3892221 - RNA, 14 nt, Shigella flexneri 2a str. 301
cugugcagcgacgu

SEQ ID NO: 3892222 - RNA, 21 nt, Shigella flexneri 2a str. 301
cugugcagcgacgucugccgg

SEQ ID NO: 3892223 - RNA, 23 nt, Shigella flexneri 2a str. 301
cugugccagcguuucgcucucua

SEQ ID NO: 3892224 - RNA, 19 nt, Shigella flexneri 2a str. 301
cugugccagcucgugcaga

SEQ ID NO: 3892225 - RNA, 13 nt, Shigella flexneri 2a str. 301
cugugccagugcc

SEQ ID NO: 3892226 - RNA, 14 nt, Shigella flexneri 2a str. 301
cugugccagugcca

SEQ ID NO: 3892227 - RNA, 17 nt, Shigella flexneri 2a str. 301
cugugcccguaaaaaau

SEQ ID NO: 3892228 - RNA, 15 nt, Shigella flexneri 2a str. 301
cugugccgccgccac

SEQ ID NO: 3892229 - RNA, 19 nt, Shigella flexneri 2a str. 301
cugugccguaaaucccagu

SEQ ID NO: 3892230 - RNA, 22 nt, Shigella flexneri 2a str. 301
cugugccguaaaucccagugcc

SEQ ID NO: 3892231 - RNA, 19 nt, Shigella flexneri 2a str. 301
cugugccugagccggaguu

SEQ ID NO: 3892232 - RNA, 17 nt, Shigella flexneri 2a str. 301
cuguggaacgugcugca

SEQ ID NO: 3892233 - RNA, 16 nt, Shigella flexneri 2a str. 301
cuguggauguuuuacu

SEQ ID NO: 3892234 - RNA, 15 nt, Shigella flexneri 2a str. 301
cuguggauucagcac

SEQ ID NO: 3892235 - RNA, 17 nt, Shigella flexneri 2a str. 301
cuguggauucagcaccg

SEQ ID NO: 3892236 - RNA, 13 nt, Shigella flexneri 2a str. 301
cuguggcgcgaag

SEQ ID NO: 3892237 - RNA, 17 nt, Shigella flexneri 2a str. 301
cugugggguauuuccag

SEQ ID NO: 3892238 - RNA, 16 nt, Shigella flexneri 2a str. 301
cuuacucaugauguca

SEQ ID NO: 3892239 - RNA, 15 nt, Shigella flexneri 2a str. 301
cuuacugauaguguu

SEQ ID NO: 3892240 - RNA, 18 nt, Shigella flexneri 2a str. 301
cuuacugaugcacacacg

SEQ ID NO: 3892241 - RNA, 15 nt, Shigella flexneri 2a str. 301
cuuacuuacgaaaaa

SEQ ID NO: 3892242 - RNA, 13 nt, Shigella flexneri 2a str. 301
cuuacuucaacac

SEQ ID NO: 3892243 - RNA, 18 nt, Shigella flexneri 2a str. 301
cuuacuuuuaaugcuuua

SEQ ID NO: 3892244 - RNA, 16 nt, Shigella flexneri 2a str. 301
cuuagacagcgccgcu

SEQ ID NO: 3892245 - RNA, 14 nt, Shigella flexneri 2a str. 301
cuuagcgcaaguuu

SEQ ID NO: 3892246 - RNA, 18 nt, Shigella flexneri 2a str. 301
cuuaggggguaucuuuga

SEQ ID NO: 3892247 - RNA, 13 nt, Shigella flexneri 2a str. 301
cuuauagaaagca

SEQ ID NO: 3892248 - RNA, 14 nt, Shigella flexneri 2a str. 301
cuuauagacuaaau

SEQ ID NO: 3892249 - RNA, 17 nt, Shigella flexneri 2a str. 301
cuuauagcgcaucgcag

SEQ ID NO: 3892250 - RNA, 22 nt, Shigella flexneri 2a str. 301
cuuaucaggccaauugaacucu

SEQ ID NO: 3892251 - RNA, 17 nt, Shigella flexneri 2a str. 301
cuuaucaggccagccag

SEQ ID NO: 3892252 - RNA, 13 nt, Shigella flexneri 2a str. 301
cuuaucaggccua

SEQ ID NO: 3892253 - RNA, 17 nt, Shigella flexneri 2a str. 301
cuuaucaggccuacaaa

SEQ ID NO: 3892254 - RNA, 18 nt, Shigella flexneri 2a str. 301
cuuaucaggccuacaaaa

SEQ ID NO: 3892255 - RNA, 21 nt, Shigella flexneri 2a str. 301
cuuaucaggccuacaacuccg

SEQ ID NO: 3892256 - RNA, 18 nt, Shigella flexneri 2a str. 301
cuuaucaggccuacaagu

SEQ ID NO: 3892257 - RNA, 22 nt, Shigella flexneri 2a str. 301
cuuaucaggccuacaguuuuac

SEQ ID NO: 3892258 - RNA, 14 nt, Shigella flexneri 2a str. 301
cuuaucaggccugu

SEQ ID NO: 3892259 - RNA, 13 nt, Shigella flexneri 2a str. 301
cuuauccagcaga

SEQ ID NO: 3892260 - RNA, 17 nt, Shigella flexneri 2a str. 301
cuuauccagccuacaaa

SEQ ID NO: 3892261 - RNA, 17 nt, Shigella flexneri 2a str. 301
cuuauccgaccuacguu

SEQ ID NO: 3892262 - RNA, 14 nt, Shigella flexneri 2a str. 301
cuuauccgaugguu

SEQ ID NO: 3892263 - RNA, 12 nt, Shigella flexneri 2a str. 301
cuuauccggcau

SEQ ID NO: 3892264 - RNA, 23 nt, Shigella flexneri 2a str. 301
cuuauccggcccacaucaacucu

SEQ ID NO: 3892265 - RNA, 16 nt, Shigella flexneri 2a str. 301
cuuauccggccuacga

SEQ ID NO: 3892266 - RNA, 22 nt, Shigella flexneri 2a str. 301
cuuauccggccuccauaagagu

SEQ ID NO: 3892267 - RNA, 19 nt, Shigella flexneri 2a str. 301
cuuauccggcuuaccgcuc

SEQ ID NO: 3892268 - RNA, 16 nt, Shigella flexneri 2a str. 301
cuuauccguccuacga

SEQ ID NO: 3892269 - RNA, 20 nt, Shigella flexneri 2a str. 301
cuuaucgccagcgccacgca

SEQ ID NO: 3892270 - RNA, 17 nt, Shigella flexneri 2a str. 301
cuuaucgcccugcucca

SEQ ID NO: 3892271 - RNA, 15 nt, Shigella flexneri 2a str. 301
cuuaucgggaagcgg

SEQ ID NO: 3892272 - RNA, 23 nt, Shigella flexneri 2a str. 301
cuuaucgugccuacacauuaucu

SEQ ID NO: 3892273 - RNA, 19 nt, Shigella flexneri 2a str. 301
cuuaucuggauuuaacgau

SEQ ID NO: 3892274 - RNA, 11 nt, Shigella flexneri 2a str. 301
cuuaucuggca

SEQ ID NO: 3892275 - RNA, 19 nt, Shigella flexneri 2a str. 301
cuuaucuuuuucgguauau

SEQ ID NO: 3892276 - RNA, 16 nt, Shigella flexneri 2a str. 301
cuuaugauguaaauaa

SEQ ID NO: 3892277 - RNA, 17 nt, Shigella flexneri 2a str. 301
cuuaugauguaaauaac

SEQ ID NO: 3892278 - RNA, 18 nt, Shigella flexneri 2a str. 301
cuuaugcaaaauuuuuuu

SEQ ID NO: 3892279 - RNA, 18 nt, Shigella flexneri 2a str. 301
cuuaugccacgugagcuu

SEQ ID NO: 3892280 - RNA, 18 nt, Shigella flexneri 2a str. 301
cuuaugcccggcacguuu

SEQ ID NO: 3892281 - RNA, 18 nt, Shigella flexneri 2a str. 301
cuuaugcgccguuuuuuu

SEQ ID NO: 3892282 - RNA, 20 nt, Shigella flexneri 2a str. 301
cuuaugcugcgccaguugcu

SEQ ID NO: 3892283 - RNA, 13 nt, Shigella flexneri 2a str. 301
cuuaugguucacu

SEQ ID NO: 3892284 - RNA, 22 nt, Shigella flexneri 2a str. 301
cuuauuaacagucagucucaag

SEQ ID NO: 3892285 - RNA, 19 nt, Shigella flexneri 2a str. 301
cuuauuaugaaugauaaaa

SEQ ID NO: 3892286 - RNA, 11 nt, Shigella flexneri 2a str. 301
cuuauuuacau

SEQ ID NO: 3892287 - RNA, 15 nt, Shigella flexneri 2a str. 301
cuuauuucugugacu

SEQ ID NO: 3892288 - RNA, 14 nt, Shigella flexneri 2a str. 301
cuucaaaaaaguca

SEQ ID NO: 3892289 - RNA, 12 nt, Shigella flexneri 2a str. 301
cuucaaaaauaa

SEQ ID NO: 3892290 - RNA, 20 nt, Shigella flexneri 2a str. 301
cuucaaaaauaaguugccac

SEQ ID NO: 3892291 - RNA, 21 nt, Shigella flexneri 2a str. 301
cuucaaagcagaaacccauug

SEQ ID NO: 3892292 - RNA, 15 nt, Shigella flexneri 2a str. 301
cuucaaauccucaau

SEQ ID NO: 3892293 - RNA, 17 nt, Shigella flexneri 2a str. 301
cuucaacacaggccggc

SEQ ID NO: 3892294 - RNA, 21 nt, Shigella flexneri 2a str. 301
cuucaacacggcgcauugcca

SEQ ID NO: 3892295 - RNA, 20 nt, Shigella flexneri 2a str. 301
cuucaaccaggcggauaauu

SEQ ID NO: 3892296 - RNA, 18 nt, Shigella flexneri 2a str. 301
cuucaaccgucaccagcc

SEQ ID NO: 3892297 - RNA, 22 nt, Shigella flexneri 2a str. 301
cuucaaccguugcuggaaaacc

SEQ ID NO: 3892298 - RNA, 14 nt, Shigella flexneri 2a str. 301
cuucaacgacggcg

SEQ ID NO: 3892299 - RNA, 15 nt, Shigella flexneri 2a str. 301
cuucaagaauuaaaa

SEQ ID NO: 3892300 - RNA, 17 nt, Shigella flexneri 2a str. 301
cuucaagaauuaaaaua

SEQ ID NO: 3892301 - RNA, 18 nt, Shigella flexneri 2a str. 301
cuucaagaauuaaaauau

SEQ ID NO: 3892302 - RNA, 14 nt, Shigella flexneri 2a str. 301
cuucaauauaugca

SEQ ID NO: 3892303 - RNA, 22 nt, Shigella flexneri 2a str. 301
cuucaauauuaaugcugaccga

SEQ ID NO: 3892304 - RNA, 20 nt, Shigella flexneri 2a str. 301
cuucaaucaauaacagcgca

SEQ ID NO: 3892305 - RNA, 11 nt, Shigella flexneri 2a str. 301
cuucaaucgcc

SEQ ID NO: 3892306 - RNA, 17 nt, Shigella flexneri 2a str. 301
cuucaaucgccaccaca

SEQ ID NO: 3892307 - RNA, 18 nt, Shigella flexneri 2a str. 301
cuucaauggucagccaca

SEQ ID NO: 3892308 - RNA, 19 nt, Shigella flexneri 2a str. 301
cuucaauggucagccacag

SEQ ID NO: 3892309 - RNA, 22 nt, Shigella flexneri 2a str. 301
cuucaauuuuuucuggcgaacc

SEQ ID NO: 3892310 - RNA, 22 nt, Shigella flexneri 2a str. 301
cuucacacacuuuuauuaacuc

SEQ ID NO: 3892311 - RNA, 14 nt, Shigella flexneri 2a str. 301
cuucacaucaccau

SEQ ID NO: 3892312 - RNA, 14 nt, Shigella flexneri 2a str. 301
cuucaccaaucaga

SEQ ID NO: 3892313 - RNA, 18 nt, Shigella flexneri 2a str. 301
cuucaccagauugugaau

SEQ ID NO: 3892314 - RNA, 13 nt, Shigella flexneri 2a str. 301
cuucaccagcagc

SEQ ID NO: 3892315 - RNA, 15 nt, Shigella flexneri 2a str. 301
cuucaccagcagcgu

SEQ ID NO: 3892316 - RNA, 22 nt, Shigella flexneri 2a str. 301
cuucaccagcagcgucaacacu

SEQ ID NO: 3892317 - RNA, 13 nt, Shigella flexneri 2a str. 301
cuucaccagccug

SEQ ID NO: 3892318 - RNA, 16 nt, Shigella flexneri 2a str. 301
cuucacccaucgccag

SEQ ID NO: 3892319 - RNA, 23 nt, Shigella flexneri 2a str. 301
cuucacccauugccgccucugcc

SEQ ID NO: 3892320 - RNA, 15 nt, Shigella flexneri 2a str. 301
cuucacccgcagcac

SEQ ID NO: 3892321 - RNA, 15 nt, Shigella flexneri 2a str. 301
cuucaccgcaucguc

SEQ ID NO: 3892322 - RNA, 15 nt, Shigella flexneri 2a str. 301
cuucaccuuccagua

SEQ ID NO: 3892323 - RNA, 20 nt, Shigella flexneri 2a str. 301
cuucaccuucuuuacugccc

SEQ ID NO: 3892324 - RNA, 21 nt, Shigella flexneri 2a str. 301
cuucacgauagccacgcucau

SEQ ID NO: 3892325 - RNA, 14 nt, Shigella flexneri 2a str. 301
cuucacgcgcucca

SEQ ID NO: 3892326 - RNA, 18 nt, Shigella flexneri 2a str. 301
cuucacgcgcuccaggag

SEQ ID NO: 3892327 - RNA, 18 nt, Shigella flexneri 2a str. 301
cuucacgcggguugccac

SEQ ID NO: 3892328 - RNA, 19 nt, Shigella flexneri 2a str. 301
cuucacgcuaauaccggau

SEQ ID NO: 3892329 - RNA, 17 nt, Shigella flexneri 2a str. 301
cuucacgcuuugcaggc

SEQ ID NO: 3892330 - RNA, 20 nt, Shigella flexneri 2a str. 301
cuucacgcuuugcaggcugg

SEQ ID NO: 3892331 - RNA, 21 nt, Shigella flexneri 2a str. 301
cuucacggcugcuaauauuuu

SEQ ID NO: 3892332 - RNA, 20 nt, Shigella flexneri 2a str. 301
cuucacggcuuugucauuaa

SEQ ID NO: 3892333 - RNA, 23 nt, Shigella flexneri 2a str. 301
cuucacguuuuucgaaaaucuca

SEQ ID NO: 3892334 - RNA, 18 nt, Shigella flexneri 2a str. 301
cuucacuaaucaauuuuu

SEQ ID NO: 3892335 - RNA, 19 nt, Shigella flexneri 2a str. 301
cuucacuaaucaauuuuuc

SEQ ID NO: 3892336 - RNA, 21 nt, Shigella flexneri 2a str. 301
cuucacucucaccacgcucca

SEQ ID NO: 3892337 - RNA, 16 nt, Shigella flexneri 2a str. 301
cuucacucugcugcca

SEQ ID NO: 3892338 - RNA, 17 nt, Shigella flexneri 2a str. 301
cuuccgcaauacagcca

SEQ ID NO: 3892339 - RNA, 14 nt, Shigella flexneri 2a str. 301
cuuccgccagcggc

SEQ ID NO: 3892340 - RNA, 14 nt, Shigella flexneri 2a str. 301
cuuccgccaucagu

SEQ ID NO: 3892341 - RNA, 20 nt, Shigella flexneri 2a str. 301
cuuccgcuaguguacccuuc

SEQ ID NO: 3892342 - RNA, 19 nt, Shigella flexneri 2a str. 301
cuuccggacguucagccau

SEQ ID NO: 3892343 - RNA, 18 nt, Shigella flexneri 2a str. 301
cuuccggcaacaaugcca

SEQ ID NO: 3892344 - RNA, 21 nt, Shigella flexneri 2a str. 301
cuuccggucugcgaucgucgu

SEQ ID NO: 3892345 - RNA, 14 nt, Shigella flexneri 2a str. 301
cuuccggugcaauc

SEQ ID NO: 3892346 - RNA, 20 nt, Shigella flexneri 2a str. 301
cuuccgguuacgccaccagc

SEQ ID NO: 3892347 - RNA, 23 nt, Shigella flexneri 2a str. 301
cuuccguaccagccuugccagau

SEQ ID NO: 3892348 - RNA, 15 nt, Shigella flexneri 2a str. 301
cuuccguagcggcuc

SEQ ID NO: 3892349 - RNA, 17 nt, Shigella flexneri 2a str. 301
cuuccguuuaaagagca

SEQ ID NO: 3892350 - RNA, 21 nt, Shigella flexneri 2a str. 301
cuuccguuuaaagagcaaccc

SEQ ID NO: 3892351 - RNA, 17 nt, Shigella flexneri 2a str. 301
cuuccucaauuaacauu

SEQ ID NO: 3892352 - RNA, 13 nt, Shigella flexneri 2a str. 301
cuuccuccagcgg

SEQ ID NO: 3892353 - RNA, 21 nt, Shigella flexneri 2a str. 301
cuuccuccagcgguuuaucaa

SEQ ID NO: 3892354 - RNA, 12 nt, Shigella flexneri 2a str. 301
cuuccucgccag

SEQ ID NO: 3892355 - RNA, 15 nt, Shigella flexneri 2a str. 301
cuuccucgucccaaa

SEQ ID NO: 3892356 - RNA, 23 nt, Shigella flexneri 2a str. 301
cuuccucguuucgcccugccuuu

SEQ ID NO: 3892357 - RNA, 12 nt, Shigella flexneri 2a str. 301
cuuccugaguga

SEQ ID NO: 3892358 - RNA, 21 nt, Shigella flexneri 2a str. 301
cuuccugagugaauauuuaac

SEQ ID NO: 3892359 - RNA, 12 nt, Shigella flexneri 2a str. 301
cuuccugcaacg

SEQ ID NO: 3892360 - RNA, 20 nt, Shigella flexneri 2a str. 301
cuuccugcaacgagugcauc

SEQ ID NO: 3892361 - RNA, 12 nt, Shigella flexneri 2a str. 301
cuuccugcagcu

SEQ ID NO: 3892362 - RNA, 15 nt, Shigella flexneri 2a str. 301
cuuccugcagcuuca

SEQ ID NO: 3892363 - RNA, 15 nt, Shigella flexneri 2a str. 301
cuuccugccagaucc

SEQ ID NO: 3892364 - RNA, 15 nt, Shigella flexneri 2a str. 301
cuuccuggcgcuggc

SEQ ID NO: 3892365 - RNA, 16 nt, Shigella flexneri 2a str. 301
cuuccuggcgcuggcg

SEQ ID NO: 3892366 - RNA, 21 nt, Shigella flexneri 2a str. 301
cuuccugggauaugagcgauu

SEQ ID NO: 3892367 - RNA, 18 nt, Shigella flexneri 2a str. 301
cuuccuguucaucgacag

SEQ ID NO: 3892368 - RNA, 16 nt, Shigella flexneri 2a str. 301
cuuccuuaaucccugg

SEQ ID NO: 3892369 - RNA, 12 nt, Shigella flexneri 2a str. 301
cuuccuucagcu

SEQ ID NO: 3892370 - RNA, 18 nt, Shigella flexneri 2a str. 301
cuucgaaaguagaagcaa

SEQ ID NO: 3892371 - RNA, 20 nt, Shigella flexneri 2a str. 301
cuucgacagcguuucgccac

SEQ ID NO: 3892372 - RNA, 22 nt, Shigella flexneri 2a str. 301
cuucgacuuucaguggcuuauc

SEQ ID NO: 3892373 - RNA, 16 nt, Shigella flexneri 2a str. 301
cuucgagauucuuaaa

SEQ ID NO: 3892374 - RNA, 19 nt, Shigella flexneri 2a str. 301
cuucgaguacauccacugc

SEQ ID NO: 3892375 - RNA, 14 nt, Shigella flexneri 2a str. 301
cuucgauggcuggg

SEQ ID NO: 3892376 - RNA, 18 nt, Shigella flexneri 2a str. 301
cuucgauggcugggguac

SEQ ID NO: 3892377 - RNA, 19 nt, Shigella flexneri 2a str. 301
cuucgcaaaaaaccauccc

SEQ ID NO: 3892378 - RNA, 14 nt, Shigella flexneri 2a str. 301
cuucgccaaaucgc

SEQ ID NO: 3892379 - RNA, 14 nt, Shigella flexneri 2a str. 301
cuucgccaaugacc

SEQ ID NO: 3892380 - RNA, 19 nt, Shigella flexneri 2a str. 301
cuucgccaauguggguagc

SEQ ID NO: 3892381 - RNA, 15 nt, Shigella flexneri 2a str. 301
cuucgccgaugaagu

SEQ ID NO: 3892382 - RNA, 18 nt, Shigella flexneri 2a str. 301
cuucgccgaugaaguaca

SEQ ID NO: 3892383 - RNA, 22 nt, Shigella flexneri 2a str. 301
cuucgccgaugaaguacagccc

SEQ ID NO: 3892384 - RNA, 18 nt, Shigella flexneri 2a str. 301
cuucgccugccugcagcu

SEQ ID NO: 3892385 - RNA, 20 nt, Shigella flexneri 2a str. 301
cuucgccugccugcagcugc

SEQ ID NO: 3892386 - RNA, 15 nt, Shigella flexneri 2a str. 301
cuucgccuuacucac

SEQ ID NO: 3892387 - RNA, 13 nt, Shigella flexneri 2a str. 301
cuucgcgacggca

SEQ ID NO: 3892388 - RNA, 23 nt, Shigella flexneri 2a str. 301
cuucgcgacggcaucaacaucau

SEQ ID NO: 3892389 - RNA, 20 nt, Shigella flexneri 2a str. 301
cuucgcguaacugaagcauu

SEQ ID NO: 3892390 - RNA, 21 nt, Shigella flexneri 2a str. 301
cuucgcucauguuaucaagau

SEQ ID NO: 3892391 - RNA, 16 nt, Shigella flexneri 2a str. 301
cuucgcugcagcucug

SEQ ID NO: 3892392 - RNA, 13 nt, Shigella flexneri 2a str. 301
cuucgcugcugga

SEQ ID NO: 3892393 - RNA, 16 nt, Shigella flexneri 2a str. 301
cuucgcuggcaacaca

SEQ ID NO: 3892394 - RNA, 21 nt, Shigella flexneri 2a str. 301
cuucgcuguacgccuucaugu

SEQ ID NO: 3892395 - RNA, 19 nt, Shigella flexneri 2a str. 301
cuucgcuuacgccugccag

SEQ ID NO: 3892396 - RNA, 12 nt, Shigella flexneri 2a str. 301
cuucgcuucauu

SEQ ID NO: 3892397 - RNA, 17 nt, Shigella flexneri 2a str. 301
cuucggcacugaccacu

SEQ ID NO: 3892398 - RNA, 16 nt, Shigella flexneri 2a str. 301
cuucggcgucuccacc

SEQ ID NO: 3892399 - RNA, 12 nt, Shigella flexneri 2a str. 301
cuucgguagcag

SEQ ID NO: 3892400 - RNA, 15 nt, Shigella flexneri 2a str. 301
cuucgguagcagcuu

SEQ ID NO: 3892401 - RNA, 15 nt, Shigella flexneri 2a str. 301
cuucgguauccguuu

SEQ ID NO: 3892402 - RNA, 13 nt, Shigella flexneri 2a str. 301
cuucggucaccgu

SEQ ID NO: 3892403 - RNA, 17 nt, Shigella flexneri 2a str. 301
cuucggugcgacaaaca

SEQ ID NO: 3892404 - RNA, 23 nt, Shigella flexneri 2a str. 301
cuucgguuuuguugccgcccguu

SEQ ID NO: 3892405 - RNA, 13 nt, Shigella flexneri 2a str. 301
cuucgucccaguc

SEQ ID NO: 3892406 - RNA, 22 nt, Shigella flexneri 2a str. 301
cuucgucccagucgucauccca

SEQ ID NO: 3892407 - RNA, 16 nt, Shigella flexneri 2a str. 301
cuucgucgucuucguc

SEQ ID NO: 3892408 - RNA, 14 nt, Shigella flexneri 2a str. 301
cuucgugcaggcau

SEQ ID NO: 3892409 - RNA, 18 nt, Shigella flexneri 2a str. 301
cuucgugcggcugcaucu

SEQ ID NO: 3892410 - RNA, 19 nt, Shigella flexneri 2a str. 301
cuucgugcguuuguaggcc

SEQ ID NO: 3892411 - RNA, 23 nt, Shigella flexneri 2a str. 301
cuucguuaaacagcuuggauucu

SEQ ID NO: 3892412 - RNA, 14 nt, Shigella flexneri 2a str. 301
cuucguuaucccag

SEQ ID NO: 3892413 - RNA, 22 nt, Shigella flexneri 2a str. 301
cuucguuauccucugcaagaua

SEQ ID NO: 3892414 - RNA, 12 nt, Shigella flexneri 2a str. 301
cuucguucaucu

SEQ ID NO: 3892415 - RNA, 16 nt, Shigella flexneri 2a str. 301
cuucguugccccagug

SEQ ID NO: 3892416 - RNA, 23 nt, Shigella flexneri 2a str. 301
cuucuaacgacauuuucugccca

SEQ ID NO: 3892417 - RNA, 12 nt, Shigella flexneri 2a str. 301
cuucuaaucgca

SEQ ID NO: 3892418 - RNA, 18 nt, Shigella flexneri 2a str. 301
cuucuaauuuuuccagca

SEQ ID NO: 3892419 - RNA, 22 nt, Shigella flexneri 2a str. 301
cuucuaccgucuguaaccagau

SEQ ID NO: 3892420 - RNA, 19 nt, Shigella flexneri 2a str. 301
cuucuagugcuugcacaac

SEQ ID NO: 3892421 - RNA, 14 nt, Shigella flexneri 2a str. 301
cuucuauaccaaug

SEQ ID NO: 3892422 - RNA, 13 nt, Shigella flexneri 2a str. 301
cuucucaaucccu

SEQ ID NO: 3892423 - RNA, 21 nt, Shigella flexneri 2a str. 301
cuucucaaucccuuucucuuc

SEQ ID NO: 3892424 - RNA, 15 nt, Shigella flexneri 2a str. 301
cuucucagauauaaa

SEQ ID NO: 3892425 - RNA, 17 nt, Shigella flexneri 2a str. 301
cuucucaggccuacaaa

SEQ ID NO: 3892426 - RNA, 14 nt, Shigella flexneri 2a str. 301
cuucucauccuucc

SEQ ID NO: 3892427 - RNA, 15 nt, Shigella flexneri 2a str. 301
cuucucauccuuccc

SEQ ID NO: 3892428 - RNA, 12 nt, Shigella flexneri 2a str. 301
cuucuccacgcc

SEQ ID NO: 3892429 - RNA, 20 nt, Shigella flexneri 2a str. 301
cuucuccccggccaaaaugu

SEQ ID NO: 3892430 - RNA, 17 nt, Shigella flexneri 2a str. 301
cuucuccggcauccuua

SEQ ID NO: 3892431 - RNA, 14 nt, Shigella flexneri 2a str. 301
cuucucgauaaacc

SEQ ID NO: 3892432 - RNA, 23 nt, Shigella flexneri 2a str. 301
cuucucgauaaaccauccugcuc

SEQ ID NO: 3892433 - RNA, 16 nt, Shigella flexneri 2a str. 301
cuucucgccagccucc

SEQ ID NO: 3892434 - RNA, 22 nt, Shigella flexneri 2a str. 301
cuucucgcucgagagagaaaau

SEQ ID NO: 3892435 - RNA, 20 nt, Shigella flexneri 2a str. 301
cuucucgugaaacucacgca

SEQ ID NO: 3892436 - RNA, 16 nt, Shigella flexneri 2a str. 301
cuucucugaaaauuaa

SEQ ID NO: 3892437 - RNA, 14 nt, Shigella flexneri 2a str. 301
cuucucuuccccgg

SEQ ID NO: 3892438 - RNA, 21 nt, Shigella flexneri 2a str. 301
cuugucauacaccguuuuaca

SEQ ID NO: 3892439 - RNA, 21 nt, Shigella flexneri 2a str. 301
cuugucauacggauuacgacu

SEQ ID NO: 3892440 - RNA, 17 nt, Shigella flexneri 2a str. 301
cuugucaugcagcucca

SEQ ID NO: 3892441 - RNA, 22 nt, Shigella flexneri 2a str. 301
cuugucaugcagcuccaccgau

SEQ ID NO: 3892442 - RNA, 15 nt, Shigella flexneri 2a str. 301
cuugucugagccgaa

SEQ ID NO: 3892443 - RNA, 16 nt, Shigella flexneri 2a str. 301
cuugucugagccgaaa

SEQ ID NO: 3892444 - RNA, 16 nt, Shigella flexneri 2a str. 301
cuugugcaaaaagucc

SEQ ID NO: 3892445 - RNA, 13 nt, Shigella flexneri 2a str. 301
cuugugccggaug

SEQ ID NO: 3892446 - RNA, 15 nt, Shigella flexneri 2a str. 301
cuuguggugaaacua

SEQ ID NO: 3892447 - RNA, 18 nt, Shigella flexneri 2a str. 301
cuuguuaccugaugcagc

SEQ ID NO: 3892448 - RNA, 12 nt, Shigella flexneri 2a str. 301
cuuguuaugaga

SEQ ID NO: 3892449 - RNA, 13 nt, Shigella flexneri 2a str. 301
cuuguuaugagau

SEQ ID NO: 3892450 - RNA, 19 nt, Shigella flexneri 2a str. 301
cuuguuauuguguagccag

SEQ ID NO: 3892451 - RNA, 20 nt, Shigella flexneri 2a str. 301
cuuguuauuguguagccaga

SEQ ID NO: 3892452 - RNA, 22 nt, Shigella flexneri 2a str. 301
cuuguucacgccaucaucggca

SEQ ID NO: 3892453 - RNA, 13 nt, Shigella flexneri 2a str. 301
cuuguucaucacc

SEQ ID NO: 3892454 - RNA, 15 nt, Shigella flexneri 2a str. 301
cuuguucaucaccau

SEQ ID NO: 3892455 - RNA, 20 nt, Shigella flexneri 2a str. 301
cuuguucaucaccauugcau

SEQ ID NO: 3892456 - RNA, 16 nt, Shigella flexneri 2a str. 301
cuuguuccacuucauc

SEQ ID NO: 3892457 - RNA, 16 nt, Shigella flexneri 2a str. 301
cuuguucgaagacauc

SEQ ID NO: 3892458 - RNA, 23 nt, Shigella flexneri 2a str. 301
cuuguuguaaugacaacaucuuu

SEQ ID NO: 3892459 - RNA, 14 nt, Shigella flexneri 2a str. 301
cuuguuuaaggaaa

SEQ ID NO: 3892460 - RNA, 17 nt, Shigella flexneri 2a str. 301
cuuguuucugagcauga

SEQ ID NO: 3892461 - RNA, 13 nt, Shigella flexneri 2a str. 301
cuuguuuuuuucg

SEQ ID NO: 3892462 - RNA, 20 nt, Shigella flexneri 2a str. 301
cuuuaaacacgcgaccaaag

SEQ ID NO: 3892463 - RNA, 11 nt, Shigella flexneri 2a str. 301
cuuuaaacaga

SEQ ID NO: 3892464 - RNA, 17 nt, Shigella flexneri 2a str. 301
cuuuaaauaccuuacac

SEQ ID NO: 3892465 - RNA, 20 nt, Shigella flexneri 2a str. 301
cuuuaaaugcugcuuuauau

SEQ ID NO: 3892466 - RNA, 21 nt, Shigella flexneri 2a str. 301
cuuuaacgaaagcgccucaag

SEQ ID NO: 3892467 - RNA, 15 nt, Shigella flexneri 2a str. 301
cuuuaauaccugccu

SEQ ID NO: 3892468 - RNA, 16 nt, Shigella flexneri 2a str. 301
cuuuaauaugccacgc

SEQ ID NO: 3892469 - RNA, 21 nt, Shigella flexneri 2a str. 301
cuuuaauauuaacgccagccu

SEQ ID NO: 3892470 - RNA, 15 nt, Shigella flexneri 2a str. 301
cuuuaaugacacgaa

SEQ ID NO: 3892471 - RNA, 18 nt, Shigella flexneri 2a str. 301
cuuuaauuuugugcagca

SEQ ID NO: 3892472 - RNA, 19 nt, Shigella flexneri 2a str. 301
cuuuaauuuugugcagcau

SEQ ID NO: 3892473 - RNA, 20 nt, Shigella flexneri 2a str. 301
cuuuaccaccgucaaaaaaa

SEQ ID NO: 3892474 - RNA, 17 nt, Shigella flexneri 2a str. 301
cuuuacccagcggaugu

SEQ ID NO: 3892475 - RNA, 22 nt, Shigella flexneri 2a str. 301
cuuuaccgugguugcgccuggg

SEQ ID NO: 3892476 - RNA, 14 nt, Shigella flexneri 2a str. 301
cuuuaccuucaucc

SEQ ID NO: 3892477 - RNA, 16 nt, Shigella flexneri 2a str. 301
cuuuacgccaggcauc

SEQ ID NO: 3892478 - RNA, 14 nt, Shigella flexneri 2a str. 301
cuuuacucaacucc

SEQ ID NO: 3892479 - RNA, 15 nt, Shigella flexneri 2a str. 301
cuuuacucuuuuuug

SEQ ID NO: 3892480 - RNA, 19 nt, Shigella flexneri 2a str. 301
cuuuauaaucccuccagca

SEQ ID NO: 3892481 - RNA, 19 nt, Shigella flexneri 2a str. 301
cuuuauagggugccauuuu

SEQ ID NO: 3892482 - RNA, 21 nt, Shigella flexneri 2a str. 301
cuuuauagggugccauuuuuu

SEQ ID NO: 3892483 - RNA, 19 nt, Shigella flexneri 2a str. 301
cuuuauagugugcaaucac

SEQ ID NO: 3892484 - RNA, 14 nt, Shigella flexneri 2a str. 301
cuuuauccugacuc

SEQ ID NO: 3892485 - RNA, 23 nt, Shigella flexneri 2a str. 301
cuuuauccugcccacuccagcua

SEQ ID NO: 3892486 - RNA, 19 nt, Shigella flexneri 2a str. 301
cuuuaucgccgcuggaaau

SEQ ID NO: 3892487 - RNA, 17 nt, Shigella flexneri 2a str. 301
cuuuaucggcgcugcuu

SEQ ID NO: 3892488 - RNA, 16 nt, Shigella flexneri 2a str. 301
cuuuaugugcuucuac

SEQ ID NO: 3892489 - RNA, 17 nt, Shigella flexneri 2a str. 301
cuuuauuauuuucaaua

SEQ ID NO: 3892490 - RNA, 20 nt, Shigella flexneri 2a str. 301
cuuuauucaccaguaaggca

SEQ ID NO: 3892491 - RNA, 21 nt, Shigella flexneri 2a str. 301
cuuuauucggcauacauaauc

SEQ ID NO: 3892492 - RNA, 23 nt, Shigella flexneri 2a str. 301
cuuuauucugacgccaccauuca

SEQ ID NO: 3892493 - RNA, 15 nt, Shigella flexneri 2a str. 301
cuuuauugaguacca

SEQ ID NO: 3892494 - RNA, 13 nt, Shigella flexneri 2a str. 301
cuuuauugcaaac

SEQ ID NO: 3892495 - RNA, 17 nt, Shigella flexneri 2a str. 301
cuuuauugcaaacauuu

SEQ ID NO: 3892496 - RNA, 16 nt, Shigella flexneri 2a str. 301
cuuucaacagucgcca

SEQ ID NO: 3892497 - RNA, 16 nt, Shigella flexneri 2a str. 301
cuuucacaaaaauaau

SEQ ID NO: 3892498 - RNA, 22 nt, Shigella flexneri 2a str. 301
cuuucacccggaucaauuaauc

SEQ ID NO: 3892499 - RNA, 20 nt, Shigella flexneri 2a str. 301
cuuucacccggcgcuaauuc

SEQ ID NO: 3892500 - RNA, 14 nt, Shigella flexneri 2a str. 301
cuuucaccucuuca

SEQ ID NO: 3892501 - RNA, 17 nt, Shigella flexneri 2a str. 301
cuuucaccucuucauua

SEQ ID NO: 3892502 - RNA, 17 nt, Shigella flexneri 2a str. 301
cuuucacgcccaguccg

SEQ ID NO: 3892503 - RNA, 15 nt, Shigella flexneri 2a str. 301
cuuucacgccgccaa

SEQ ID NO: 3892504 - RNA, 20 nt, Shigella flexneri 2a str. 301
cuuucacgccgggaaauuuu

SEQ ID NO: 3892505 - RNA, 15 nt, Shigella flexneri 2a str. 301
cuuucacuauuucuu

SEQ ID NO: 3892506 - RNA, 18 nt, Shigella flexneri 2a str. 301
cuuucacucaguguugga

SEQ ID NO: 3892507 - RNA, 16 nt, Shigella flexneri 2a str. 301
cuuucacucauuaaga

SEQ ID NO: 3892508 - RNA, 18 nt, Shigella flexneri 2a str. 301
cuuucacucauuaagacu

SEQ ID NO: 3892509 - RNA, 12 nt, Shigella flexneri 2a str. 301
cuuucacugccc

SEQ ID NO: 3892510 - RNA, 21 nt, Shigella flexneri 2a str. 301
cuuucacuucagcaacgugcu

SEQ ID NO: 3892511 - RNA, 18 nt, Shigella flexneri 2a str. 301
cuuucagaaucagguuga

SEQ ID NO: 3892512 - RNA, 23 nt, Shigella flexneri 2a str. 301
cuuucagaccgccaauagaagca

SEQ ID NO: 3892513 - RNA, 18 nt, Shigella flexneri 2a str. 301
cuuucagagaagcaccgc

SEQ ID NO: 3892514 - RNA, 19 nt, Shigella flexneri 2a str. 301
cuuucagagaagcaccgcc

SEQ ID NO: 3892515 - RNA, 15 nt, Shigella flexneri 2a str. 301
cuuucagcaaaccac

SEQ ID NO: 3892516 - RNA, 15 nt, Shigella flexneri 2a str. 301
cuuucagcaccagcc

SEQ ID NO: 3892517 - RNA, 22 nt, Shigella flexneri 2a str. 301
cuuucagcaccagcccgacgau

SEQ ID NO: 3892518 - RNA, 23 nt, Shigella flexneri 2a str. 301
cuuucagcaccagcccgacgaua

SEQ ID NO: 3892519 - RNA, 14 nt, Shigella flexneri 2a str. 301
cuuucagcaccgcg

SEQ ID NO: 3892520 - RNA, 15 nt, Shigella flexneri 2a str. 301
cuuucagcgcauguc

SEQ ID NO: 3892521 - RNA, 18 nt, Shigella flexneri 2a str. 301
cuuucagcgccuucagau

SEQ ID NO: 3892522 - RNA, 16 nt, Shigella flexneri 2a str. 301
cuuucaggccgcgcag

SEQ ID NO: 3892523 - RNA, 22 nt, Shigella flexneri 2a str. 301
cuuucaguggcuuaucuuccug

SEQ ID NO: 3892524 - RNA, 14 nt, Shigella flexneri 2a str. 301
cuuucauacugccg

SEQ ID NO: 3892525 - RNA, 21 nt, Shigella flexneri 2a str. 301
cuuucaucgcgacguucagau

SEQ ID NO: 3892526 - RNA, 20 nt, Shigella flexneri 2a str. 301
cuuucauuucaauaaauucc

SEQ ID NO: 3892527 - RNA, 17 nt, Shigella flexneri 2a str. 301
cuuucauuuucggcagu

SEQ ID NO: 3892528 - RNA, 18 nt, Shigella flexneri 2a str. 301
cuuuccaaaccucagagu

SEQ ID NO: 3892529 - RNA, 20 nt, Shigella flexneri 2a str. 301
cuuuccaacuguaccagcaa

SEQ ID NO: 3892530 - RNA, 11 nt, Shigella flexneri 2a str. 301
cuuuccacgca

SEQ ID NO: 3892531 - RNA, 20 nt, Shigella flexneri 2a str. 301
cuuuccagcaaccaaugcca

SEQ ID NO: 3892532 - RNA, 15 nt, Shigella flexneri 2a str. 301
cuuuccagccacagu

SEQ ID NO: 3892533 - RNA, 13 nt, Shigella flexneri 2a str. 301
cuuuccaggcauc

SEQ ID NO: 3892534 - RNA, 20 nt, Shigella flexneri 2a str. 301
cuuuccaggcgugcuccuuc

SEQ ID NO: 3892535 - RNA, 16 nt, Shigella flexneri 2a str. 301
cuuuccagguggugca

SEQ ID NO: 3892536 - RNA, 18 nt, Shigella flexneri 2a str. 301
cuuuccagucuucuugcu

SEQ ID NO: 3892537 - RNA, 17 nt, Shigella flexneri 2a str. 301
cuuucccggcaaucacc

SEQ ID NO: 3892538 - RNA, 21 nt, Shigella flexneri 2a str. 301
cuuuucaucagaucgcgaccg

SEQ ID NO: 3892539 - RNA, 13 nt, Shigella flexneri 2a str. 301
cuuuucauuaucg

SEQ ID NO: 3892540 - RNA, 15 nt, Shigella flexneri 2a str. 301
cuuuuccagcauaau

SEQ ID NO: 3892541 - RNA, 17 nt, Shigella flexneri 2a str. 301
cuuuuccagcauaaugu

SEQ ID NO: 3892542 - RNA, 23 nt, Shigella flexneri 2a str. 301
cuuuuccagcauaaugugcgcac

SEQ ID NO: 3892543 - RNA, 16 nt, Shigella flexneri 2a str. 301
cuuuucgucaggauua

SEQ ID NO: 3892544 - RNA, 21 nt, Shigella flexneri 2a str. 301
cuuuucguuuugguccugguc

SEQ ID NO: 3892545 - RNA, 21 nt, Shigella flexneri 2a str. 301
cuuuucuaccaccaaaaccac

SEQ ID NO: 3892546 - RNA, 22 nt, Shigella flexneri 2a str. 301
cuuuucucauuacagcgacuuc

SEQ ID NO: 3892547 - RNA, 21 nt, Shigella flexneri 2a str. 301
cuuuucuggucaguuggcugg

SEQ ID NO: 3892548 - RNA, 13 nt, Shigella flexneri 2a str. 301
cuuuucuuuagcg

SEQ ID NO: 3892549 - RNA, 19 nt, Shigella flexneri 2a str. 301
cuuuugaacuuuaagcuga

SEQ ID NO: 3892550 - RNA, 21 nt, Shigella flexneri 2a str. 301
cuuuugcgccacuaacgcauu

SEQ ID NO: 3892551 - RNA, 14 nt, Shigella flexneri 2a str. 301
cuuuugcuuuuaac

SEQ ID NO: 3892552 - RNA, 14 nt, Shigella flexneri 2a str. 301
cuuuuggcaggaac

SEQ ID NO: 3892553 - RNA, 16 nt, Shigella flexneri 2a str. 301
cuuuuggggugcaguu

SEQ ID NO: 3892554 - RNA, 20 nt, Shigella flexneri 2a str. 301
cuuuugucacuuuuggugcu

SEQ ID NO: 3892555 - RNA, 15 nt, Shigella flexneri 2a str. 301
cuuuuuaaucgccau

SEQ ID NO: 3892556 - RNA, 18 nt, Shigella flexneri 2a str. 301
cuuuuuaccaacauacug

SEQ ID NO: 3892557 - RNA, 17 nt, Shigella flexneri 2a str. 301
cuuuuuacccaugguca

SEQ ID NO: 3892558 - RNA, 20 nt, Shigella flexneri 2a str. 301
cuuuuuacccauggucaucu

SEQ ID NO: 3892559 - RNA, 17 nt, Shigella flexneri 2a str. 301
cuuuuuaccuucauuug

SEQ ID NO: 3892560 - RNA, 19 nt, Shigella flexneri 2a str. 301
cuuuuuacuagccugcucc

SEQ ID NO: 3892561 - RNA, 21 nt, Shigella flexneri 2a str. 301
cuuuuuaguaucuauucauca

SEQ ID NO: 3892562 - RNA, 23 nt, Shigella flexneri 2a str. 301
cuuuuuauugaagauguugccac

SEQ ID NO: 3892563 - RNA, 13 nt, Shigella flexneri 2a str. 301
cuuuuucaugcua

SEQ ID NO: 3892564 - RNA, 20 nt, Shigella flexneri 2a str. 301
cuuuuuccacuuccaccagc

SEQ ID NO: 3892565 - RNA, 20 nt, Shigella flexneri 2a str. 301
cuuuuucccugguaaaaaau

SEQ ID NO: 3892566 - RNA, 18 nt, Shigella flexneri 2a str. 301
cuuuuucucccuuaaaaa

SEQ ID NO: 3892567 - RNA, 20 nt, Shigella flexneri 2a str. 301
cuuuuugaacggguugcggu

SEQ ID NO: 3892568 - RNA, 13 nt, Shigella flexneri 2a str. 301
cuuuuugcauaau

SEQ ID NO: 3892569 - RNA, 17 nt, Shigella flexneri 2a str. 301
cuuuuugcauuuccgcu

SEQ ID NO: 3892570 - RNA, 12 nt, Shigella flexneri 2a str. 301
cuuuuugcucuc

SEQ ID NO: 3892571 - RNA, 14 nt, Shigella flexneri 2a str. 301
cuuuuuuaaacauu

SEQ ID NO: 3892572 - RNA, 17 nt, Shigella flexneri 2a str. 301
cuuuuuuaagauccagu

SEQ ID NO: 3892573 - RNA, 15 nt, Shigella flexneri 2a str. 301
cuuuuuuacgccugu

SEQ ID NO: 3892574 - RNA, 20 nt, Shigella flexneri 2a str. 301
cuuuuuuagguacaaagcca

SEQ ID NO: 3892575 - RNA, 14 nt, Shigella flexneri 2a str. 301
cuuuuuuauggaau

SEQ ID NO: 3892576 - RNA, 13 nt, Shigella flexneri 2a str. 301
cuuuuuuccgcuu

SEQ ID NO: 3892577 - RNA, 16 nt, Shigella flexneri 2a str. 301
cuuuuuuccugccgcu

SEQ ID NO: 3892578 - RNA, 22 nt, Shigella flexneri 2a str. 301
cuuuuuugagcagcauuaccug

SEQ ID NO: 3892579 - RNA, 18 nt, Shigella flexneri 2a str. 301
cuuuuuugguaaugacuc

SEQ ID NO: 3892580 - RNA, 17 nt, Shigella flexneri 2a str. 301
cuuuuuuguucaguuca

SEQ ID NO: 3892581 - RNA, 13 nt, Shigella flexneri 2a str. 301
gaaaaaaaagaag

SEQ ID NO: 3892582 - RNA, 18 nt, Shigella flexneri 2a str. 301
gaaaaaaaucaugcaaua

SEQ ID NO: 3892583 - RNA, 17 nt, Shigella flexneri 2a str. 301
gaaaaaacguugucgcc

SEQ ID NO: 3892584 - RNA, 13 nt, Shigella flexneri 2a str. 301
gaaaaaagaaaga

SEQ ID NO: 3892585 - RNA, 18 nt, Shigella flexneri 2a str. 301
gaaaaaagcgcucccgca

SEQ ID NO: 3892586 - RNA, 16 nt, Shigella flexneri 2a str. 301
gaaaaaaugaccggcc

SEQ ID NO: 3892587 - RNA, 20 nt, Shigella flexneri 2a str. 301
gaaaaaaugaccggccagca

SEQ ID NO: 3892588 - RNA, 14 nt, Shigella flexneri 2a str. 301
gaaaaaaugaugau

SEQ ID NO: 3892589 - RNA, 12 nt, Shigella flexneri 2a str. 301
gaaaaacacaaa

SEQ ID NO: 3892590 - RNA, 18 nt, Shigella flexneri 2a str. 301
gaaaaacacaaaguaaac

SEQ ID NO: 3892591 - RNA, 16 nt, Shigella flexneri 2a str. 301
gaaaaacccaucaacu

SEQ ID NO: 3892592 - RNA, 18 nt, Shigella flexneri 2a str. 301
gaaaaacgggucgccaga

SEQ ID NO: 3892593 - RNA, 20 nt, Shigella flexneri 2a str. 301
gaaaaacuggcgcagcuuga

SEQ ID NO: 3892594 - RNA, 16 nt, Shigella flexneri 2a str. 301
gaaaaagagcaucagc

SEQ ID NO: 3892595 - RNA, 17 nt, Shigella flexneri 2a str. 301
gaaaaagagcaucagca

SEQ ID NO: 3892596 - RNA, 19 nt, Shigella flexneri 2a str. 301
gaaaaagagcaucagcagu

SEQ ID NO: 3892597 - RNA, 21 nt, Shigella flexneri 2a str. 301
gaaaaagagcaucagcagugc

SEQ ID NO: 3892598 - RNA, 23 nt, Shigella flexneri 2a str. 301
gaaaaauaaaagcgugaaacaaa

SEQ ID NO: 3892599 - RNA, 17 nt, Shigella flexneri 2a str. 301
gaaaaaucaaaaaacug

SEQ ID NO: 3892600 - RNA, 17 nt, Shigella flexneri 2a str. 301
gaaaacaacaccuggca

SEQ ID NO: 3892601 - RNA, 20 nt, Shigella flexneri 2a str. 301
gaaaacaauuacgccgagcg

SEQ ID NO: 3892602 - RNA, 17 nt, Shigella flexneri 2a str. 301
gaaaacagcgcaccaga

SEQ ID NO: 3892603 - RNA, 18 nt, Shigella flexneri 2a str. 301
gaaaacagcgcaccagaa

SEQ ID NO: 3892604 - RNA, 22 nt, Shigella flexneri 2a str. 301
gaaaacagcgcaccagaaacaa

SEQ ID NO: 3892605 - RNA, 16 nt, Shigella flexneri 2a str. 301
gaaaacaucaugguuu

SEQ ID NO: 3892606 - RNA, 14 nt, Shigella flexneri 2a str. 301
gaaaacccggccug

SEQ ID NO: 3892607 - RNA, 20 nt, Shigella flexneri 2a str. 301
gaaaacccucgaccaucucc

SEQ ID NO: 3892608 - RNA, 11 nt, Shigella flexneri 2a str. 301
gaaaaccgcac

SEQ ID NO: 3892609 - RNA, 15 nt, Shigella flexneri 2a str. 301
gaaaacgcauaccag

SEQ ID NO: 3892610 - RNA, 19 nt, Shigella flexneri 2a str. 301
gaaaacgcauaccagucua

SEQ ID NO: 3892611 - RNA, 14 nt, Shigella flexneri 2a str. 301
gaaaacgcccggca

SEQ ID NO: 3892612 - RNA, 22 nt, Shigella flexneri 2a str. 301
gaaaacgccggagugaaaauuc

SEQ ID NO: 3892613 - RNA, 13 nt, Shigella flexneri 2a str. 301
gaaaacgcuggca

SEQ ID NO: 3892614 - RNA, 11 nt, Shigella flexneri 2a str. 301
gaaaacgcugu

SEQ ID NO: 3892615 - RNA, 20 nt, Shigella flexneri 2a str. 301
gaaaacguuucaaacaggcu

SEQ ID NO: 3892616 - RNA, 21 nt, Shigella flexneri 2a str. 301
gaaaacguuucaaacaggcug

SEQ ID NO: 3892617 - RNA, 19 nt, Shigella flexneri 2a str. 301
gaaaacguuucaaccugca

SEQ ID NO: 3892618 - RNA, 17 nt, Shigella flexneri 2a str. 301
gaaaagauccguaaugc

SEQ ID NO: 3892619 - RNA, 17 nt, Shigella flexneri 2a str. 301
gaaaagccaaugaaauu

SEQ ID NO: 3892620 - RNA, 13 nt, Shigella flexneri 2a str. 301
gaaaagccggaau

SEQ ID NO: 3892621 - RNA, 22 nt, Shigella flexneri 2a str. 301
gaaaagcugcaaggugaaagca

SEQ ID NO: 3892622 - RNA, 22 nt, Shigella flexneri 2a str. 301
gaaaaggcguucacgccgcauc

SEQ ID NO: 3892623 - RNA, 17 nt, Shigella flexneri 2a str. 301
gaaaagguagaauaagg

SEQ ID NO: 3892624 - RNA, 17 nt, Shigella flexneri 2a str. 301
gaaaauaaaucaaaguc

SEQ ID NO: 3892625 - RNA, 23 nt, Shigella flexneri 2a str. 301
gaaaauaaccauauaugauaauu

SEQ ID NO: 3892626 - RNA, 13 nt, Shigella flexneri 2a str. 301
gaaaauacagcaa

SEQ ID NO: 3892627 - RNA, 19 nt, Shigella flexneri 2a str. 301
gaaaauacagcaauggaaa

SEQ ID NO: 3892628 - RNA, 17 nt, Shigella flexneri 2a str. 301
gaaaauaugcccauguu

SEQ ID NO: 3892629 - RNA, 17 nt, Shigella flexneri 2a str. 301
gaaaaucacaggcgcga

SEQ ID NO: 3892630 - RNA, 16 nt, Shigella flexneri 2a str. 301
gaaaaucaccucauca

SEQ ID NO: 3892631 - RNA, 18 nt, Shigella flexneri 2a str. 301
gaaaaucauucgccgguu

SEQ ID NO: 3892632 - RNA, 16 nt, Shigella flexneri 2a str. 301
gaaaaucgacaauaug

SEQ ID NO: 3892633 - RNA, 17 nt, Shigella flexneri 2a str. 301
gaaaaugccgcacauca

SEQ ID NO: 3892634 - RNA, 17 nt, Shigella flexneri 2a str. 301
gaaaaugccucagagcu

SEQ ID NO: 3892635 - RNA, 15 nt, Shigella flexneri 2a str. 301
gaaaauggccagcca

SEQ ID NO: 3892636 - RNA, 21 nt, Shigella flexneri 2a str. 301
gaaaauggccgucaggguugc

SEQ ID NO: 3892637 - RNA, 23 nt, Shigella flexneri 2a str. 301
gaaaauggcggaggauuucauuu

SEQ ID NO: 3892638 - RNA, 18 nt, Shigella flexneri 2a str. 301
gaaccaaaauagauaauc

SEQ ID NO: 3892639 - RNA, 16 nt, Shigella flexneri 2a str. 301
gaaccaaagaaaucag

SEQ ID NO: 3892640 - RNA, 17 nt, Shigella flexneri 2a str. 301
gaaccaaagaaaucagu

SEQ ID NO: 3892641 - RNA, 19 nt, Shigella flexneri 2a str. 301
gaaccaacgcugccagccg

SEQ ID NO: 3892642 - RNA, 13 nt, Shigella flexneri 2a str. 301
gaaccacagcgcc

SEQ ID NO: 3892643 - RNA, 21 nt, Shigella flexneri 2a str. 301
gaaccacggaaaggcaguuca

SEQ ID NO: 3892644 - RNA, 21 nt, Shigella flexneri 2a str. 301
gaaccacggaauaaccagcga

SEQ ID NO: 3892645 - RNA, 13 nt, Shigella flexneri 2a str. 301
gaaccaggcgcga

SEQ ID NO: 3892646 - RNA, 19 nt, Shigella flexneri 2a str. 301
gaaccagggaaaaaagccc

SEQ ID NO: 3892647 - RNA, 21 nt, Shigella flexneri 2a str. 301
gaaccagggaaaaaagccccg

SEQ ID NO: 3892648 - RNA, 16 nt, Shigella flexneri 2a str. 301
gaaccauaaaaucaca

SEQ ID NO: 3892649 - RNA, 21 nt, Shigella flexneri 2a str. 301
gaaccaucgagaaucagcgag

SEQ ID NO: 3892650 - RNA, 11 nt, Shigella flexneri 2a str. 301
gaaccaucggc

SEQ ID NO: 3892651 - RNA, 19 nt, Shigella flexneri 2a str. 301
gaaccauuucgauagacuc

SEQ ID NO: 3892652 - RNA, 13 nt, Shigella flexneri 2a str. 301
gaacccagcaggu

SEQ ID NO: 3892653 - RNA, 17 nt, Shigella flexneri 2a str. 301
gaacccguuggcacagg

SEQ ID NO: 3892654 - RNA, 17 nt, Shigella flexneri 2a str. 301
gaaccgcauacgcagca

SEQ ID NO: 3892655 - RNA, 21 nt, Shigella flexneri 2a str. 301
gaaccgccccggguuuccugg

SEQ ID NO: 3892656 - RNA, 23 nt, Shigella flexneri 2a str. 301
gaaccgcuguugucugaaugaua

SEQ ID NO: 3892657 - RNA, 22 nt, Shigella flexneri 2a str. 301
gaaccgcuuugccacugccggu

SEQ ID NO: 3892658 - RNA, 14 nt, Shigella flexneri 2a str. 301
gaaccggaaaucca

SEQ ID NO: 3892659 - RNA, 14 nt, Shigella flexneri 2a str. 301
gaaccggcgcguua

SEQ ID NO: 3892660 - RNA, 16 nt, Shigella flexneri 2a str. 301
gaaccggcuggccgua

SEQ ID NO: 3892661 - RNA, 14 nt, Shigella flexneri 2a str. 301
gaaccguacagcau

SEQ ID NO: 3892662 - RNA, 23 nt, Shigella flexneri 2a str. 301
gaaccucacagaggucuuuucuc

SEQ ID NO: 3892663 - RNA, 18 nt, Shigella flexneri 2a str. 301
gaaccugaacgccggguu

SEQ ID NO: 3892664 - RNA, 23 nt, Shigella flexneri 2a str. 301
gaaccugaacucgccgcacaggc

SEQ ID NO: 3892665 - RNA, 17 nt, Shigella flexneri 2a str. 301
gaaccugugacagcagc

SEQ ID NO: 3892666 - RNA, 16 nt, Shigella flexneri 2a str. 301
gaaccuguucaacaau

SEQ ID NO: 3892667 - RNA, 20 nt, Shigella flexneri 2a str. 301
gaacgacaaauucaggaaac

SEQ ID NO: 3892668 - RNA, 19 nt, Shigella flexneri 2a str. 301
gaacgacauggcccagccc

SEQ ID NO: 3892669 - RNA, 22 nt, Shigella flexneri 2a str. 301
gaacgagaaaagccaaccugcg

SEQ ID NO: 3892670 - RNA, 15 nt, Shigella flexneri 2a str. 301
gaacgcaaauguaaa

SEQ ID NO: 3892671 - RNA, 16 nt, Shigella flexneri 2a str. 301
gaacgcaccgaccauc

SEQ ID NO: 3892672 - RNA, 20 nt, Shigella flexneri 2a str. 301
gaacgcaccgaccaucggca

SEQ ID NO: 3892673 - RNA, 20 nt, Shigella flexneri 2a str. 301
gaacgcacuauacaaccaga

SEQ ID NO: 3892674 - RNA, 17 nt, Shigella flexneri 2a str. 301
gaacgccaaauucuuua

SEQ ID NO: 3892675 - RNA, 14 nt, Shigella flexneri 2a str. 301
gaacgcccacggcg

SEQ ID NO: 3892676 - RNA, 22 nt, Shigella flexneri 2a str. 301
gaacgcccacggcguggcauca

SEQ ID NO: 3892677 - RNA, 21 nt, Shigella flexneri 2a str. 301
gaacgccgaauaacgcgcagc

SEQ ID NO: 3892678 - RNA, 13 nt, Shigella flexneri 2a str. 301
gaacgccgccagu

SEQ ID NO: 3892679 - RNA, 15 nt, Shigella flexneri 2a str. 301
gaacgccuaauccag

SEQ ID NO: 3892680 - RNA, 14 nt, Shigella flexneri 2a str. 301
gaacgccugugucc

SEQ ID NO: 3892681 - RNA, 16 nt, Shigella flexneri 2a str. 301
gaacgccuuauccggc

SEQ ID NO: 3892682 - RNA, 17 nt, Shigella flexneri 2a str. 301
gaacgccuuauccggcc

SEQ ID NO: 3892683 - RNA, 16 nt, Shigella flexneri 2a str. 301
gaacgccuucgccauc

SEQ ID NO: 3892684 - RNA, 17 nt, Shigella flexneri 2a str. 301
gaacgcgcacaggcgcu

SEQ ID NO: 3892685 - RNA, 15 nt, Shigella flexneri 2a str. 301
gaacgcggcccaggc

SEQ ID NO: 3892686 - RNA, 14 nt, Shigella flexneri 2a str. 301
gaacgcguaucuuu

SEQ ID NO: 3892687 - RNA, 16 nt, Shigella flexneri 2a str. 301
gaacgcguucacugcc

SEQ ID NO: 3892688 - RNA, 19 nt, Shigella flexneri 2a str. 301
gaacgcguucacugccgua

SEQ ID NO: 3892689 - RNA, 15 nt, Shigella flexneri 2a str. 301
gaacgcuucugucgc

SEQ ID NO: 3892690 - RNA, 16 nt, Shigella flexneri 2a str. 301
gaacgcuuuugcaucg

SEQ ID NO: 3892691 - RNA, 19 nt, Shigella flexneri 2a str. 301
gaacgcuuuugcaucggca

SEQ ID NO: 3892692 - RNA, 21 nt, Shigella flexneri 2a str. 301
gaacggauagagcgcggcgca

SEQ ID NO: 3892693 - RNA, 18 nt, Shigella flexneri 2a str. 301
gaacggauaucgagaauc

SEQ ID NO: 3892694 - RNA, 15 nt, Shigella flexneri 2a str. 301
gaacggcggcggcgc

SEQ ID NO: 3892695 - RNA, 20 nt, Shigella flexneri 2a str. 301
gaacggcuucgccuccuguu

SEQ ID NO: 3892696 - RNA, 18 nt, Shigella flexneri 2a str. 301
gaacgggagaaacccggc

SEQ ID NO: 3892697 - RNA, 22 nt, Shigella flexneri 2a str. 301
gaacggucgccgcgcaaaucca

SEQ ID NO: 3892698 - RNA, 14 nt, Shigella flexneri 2a str. 301
gaacguaggcugga

SEQ ID NO: 3892699 - RNA, 16 nt, Shigella flexneri 2a str. 301
gaacgugcaaaaucaa

SEQ ID NO: 3892700 - RNA, 19 nt, Shigella flexneri 2a str. 301
gaacgugccaggguggcuc

SEQ ID NO: 3892701 - RNA, 17 nt, Shigella flexneri 2a str. 301
gaacgugggucuguccc

SEQ ID NO: 3892702 - RNA, 20 nt, Shigella flexneri 2a str. 301
gaacguuacaaucugcgcug

SEQ ID NO: 3892703 - RNA, 19 nt, Shigella flexneri 2a str. 301
gaacuaccgugcuguacag

SEQ ID NO: 3892704 - RNA, 19 nt, Shigella flexneri 2a str. 301
gaacuauauucucaaaaua

SEQ ID NO: 3892705 - RNA, 17 nt, Shigella flexneri 2a str. 301
gaacuauuaaaauuuca

SEQ ID NO: 3892706 - RNA, 18 nt, Shigella flexneri 2a str. 301
gaacuauuggucuggaac

SEQ ID NO: 3892707 - RNA, 14 nt, Shigella flexneri 2a str. 301
gaacucaaaccauu

SEQ ID NO: 3892708 - RNA, 14 nt, Shigella flexneri 2a str. 301
gaacucaacgccuu

SEQ ID NO: 3892709 - RNA, 18 nt, Shigella flexneri 2a str. 301
gaacucaacgccuucuuc

SEQ ID NO: 3892710 - RNA, 14 nt, Shigella flexneri 2a str. 301
gaacucacagggcu

SEQ ID NO: 3892711 - RNA, 18 nt, Shigella flexneri 2a str. 301
gaacucacagggcugcug

SEQ ID NO: 3892712 - RNA, 20 nt, Shigella flexneri 2a str. 301
gaacucaggcugccagauca

SEQ ID NO: 3892713 - RNA, 20 nt, Shigella flexneri 2a str. 301
gaacucauacaccagcggca

SEQ ID NO: 3892714 - RNA, 15 nt, Shigella flexneri 2a str. 301
gaacuccugaaagcg

SEQ ID NO: 3892715 - RNA, 17 nt, Shigella flexneri 2a str. 301
gaacucgacgcccugga

SEQ ID NO: 3892716 - RNA, 15 nt, Shigella flexneri 2a str. 301
gaacucgaggauaaa

SEQ ID NO: 3892717 - RNA, 17 nt, Shigella flexneri 2a str. 301
gaacucgauaacacggu

SEQ ID NO: 3892718 - RNA, 17 nt, Shigella flexneri 2a str. 301
gaacucgccagccacca

SEQ ID NO: 3892719 - RNA, 17 nt, Shigella flexneri 2a str. 301
gaacucgcugcgcggca

SEQ ID NO: 3892720 - RNA, 22 nt, Shigella flexneri 2a str. 301
gaacucggugaccgaucgcccg

SEQ ID NO: 3892721 - RNA, 23 nt, Shigella flexneri 2a str. 301
gaacucguucagcgcauuccagu

SEQ ID NO: 3892722 - RNA, 14 nt, Shigella flexneri 2a str. 301
gaacucuuccggca

SEQ ID NO: 3892723 - RNA, 22 nt, Shigella flexneri 2a str. 301
gaacucuuucaaaccguagucc

SEQ ID NO: 3892724 - RNA, 13 nt, Shigella flexneri 2a str. 301
gaacugaaaggcg

SEQ ID NO: 3892725 - RNA, 14 nt, Shigella flexneri 2a str. 301
gaacugacagccaa

SEQ ID NO: 3892726 - RNA, 17 nt, Shigella flexneri 2a str. 301
gaacugacugaaugcca

SEQ ID NO: 3892727 - RNA, 16 nt, Shigella flexneri 2a str. 301
gaacugauugccaccc

SEQ ID NO: 3892728 - RNA, 21 nt, Shigella flexneri 2a str. 301
gaacugauugccacccugcgg

SEQ ID NO: 3892729 - RNA, 15 nt, Shigella flexneri 2a str. 301
gaacugcaacucacc

SEQ ID NO: 3892730 - RNA, 16 nt, Shigella flexneri 2a str. 301
gaacugcauugucgga

SEQ ID NO: 3892731 - RNA, 19 nt, Shigella flexneri 2a str. 301
gaacugcgguaauccgggu

SEQ ID NO: 3892732 - RNA, 19 nt, Shigella flexneri 2a str. 301
gaacuggcaacaauggcau

SEQ ID NO: 3892733 - RNA, 19 nt, Shigella flexneri 2a str. 301
gaacuggcuguagaagcug

SEQ ID NO: 3892734 - RNA, 20 nt, Shigella flexneri 2a str. 301
gaacuggcuguagaagcuga

SEQ ID NO: 3892735 - RNA, 15 nt, Shigella flexneri 2a str. 301
gaacugggcgcggcc

SEQ ID NO: 3892736 - RNA, 15 nt, Shigella flexneri 2a str. 301
gaacuguagacaaaa

SEQ ID NO: 3892737 - RNA, 21 nt, Shigella flexneri 2a str. 301
gaacugugcacccgcuucagu

SEQ ID NO: 3892738 - RNA, 12 nt, Shigella flexneri 2a str. 301
gaauaauuucau

SEQ ID NO: 3892739 - RNA, 12 nt, Shigella flexneri 2a str. 301
gaauacagaaca

SEQ ID NO: 3892740 - RNA, 18 nt, Shigella flexneri 2a str. 301
gaauacagaacagugcca

SEQ ID NO: 3892741 - RNA, 22 nt, Shigella flexneri 2a str. 301
gaauaccaacgaggagacugca

SEQ ID NO: 3892742 - RNA, 15 nt, Shigella flexneri 2a str. 301
gaauaccuucuuccu

SEQ ID NO: 3892743 - RNA, 23 nt, Shigella flexneri 2a str. 301
gaauacgcucacgcgcugccucu

SEQ ID NO: 3892744 - RNA, 21 nt, Shigella flexneri 2a str. 301
gaauagaaccuaagaaccaga

SEQ ID NO: 3892745 - RNA, 20 nt, Shigella flexneri 2a str. 301
gaauagccuuuagcgagcga

SEQ ID NO: 3892746 - RNA, 15 nt, Shigella flexneri 2a str. 301
gaauagcggaaaucu

SEQ ID NO: 3892747 - RNA, 21 nt, Shigella flexneri 2a str. 301
gaauagcguuaauggcagaua

SEQ ID NO: 3892748 - RNA, 15 nt, Shigella flexneri 2a str. 301
gaauaguuucagccu

SEQ ID NO: 3892749 - RNA, 23 nt, Shigella flexneri 2a str. 301
gaauaguuucagccucugccgcg

SEQ ID NO: 3892750 - RNA, 22 nt, Shigella flexneri 2a str. 301
gaauaguuuccgcuucugcuuu

SEQ ID NO: 3892751 - RNA, 19 nt, Shigella flexneri 2a str. 301
gaauauaacgcagcgucag

SEQ ID NO: 3892752 - RNA, 14 nt, Shigella flexneri 2a str. 301
gaauauacgccaga

SEQ ID NO: 3892753 - RNA, 22 nt, Shigella flexneri 2a str. 301
gaauauaucagccugaaugcuu

SEQ ID NO: 3892754 - RNA, 20 nt, Shigella flexneri 2a str. 301
gaauauauccgaaaaaggau

SEQ ID NO: 3892755 - RNA, 20 nt, Shigella flexneri 2a str. 301
gaauaucaagaucaucaaac

SEQ ID NO: 3892756 - RNA, 21 nt, Shigella flexneri 2a str. 301
gaauaucaagaucaucaaacu

SEQ ID NO: 3892757 - RNA, 16 nt, Shigella flexneri 2a str. 301
gaauaucaauacauca

SEQ ID NO: 3892758 - RNA, 20 nt, Shigella flexneri 2a str. 301
gaauaucgcuggccuccagu

SEQ ID NO: 3892759 - RNA, 23 nt, Shigella flexneri 2a str. 301
gaauaugagucguaaacaacugg

SEQ ID NO: 3892760 - RNA, 17 nt, Shigella flexneri 2a str. 301
gaauaugcgccacacca

SEQ ID NO: 3892761 - RNA, 20 nt, Shigella flexneri 2a str. 301
gaauaugguuagagaacaac

SEQ ID NO: 3892762 - RNA, 16 nt, Shigella flexneri 2a str. 301
gaauauucaccgguuc

SEQ ID NO: 3892763 - RNA, 19 nt, Shigella flexneri 2a str. 301
gaauauucugaagcaaacu

SEQ ID NO: 3892764 - RNA, 17 nt, Shigella flexneri 2a str. 301
gaauauuucuauauccu

SEQ ID NO: 3892765 - RNA, 14 nt, Shigella flexneri 2a str. 301
gaaucaaaaucauc

SEQ ID NO: 3892766 - RNA, 21 nt, Shigella flexneri 2a str. 301
gaaucaaaaucaucaucuuua

SEQ ID NO: 3892767 - RNA, 13 nt, Shigella flexneri 2a str. 301
gaaucaacggcaa

SEQ ID NO: 3892768 - RNA, 16 nt, Shigella flexneri 2a str. 301
gaaucaccgccacgcc

SEQ ID NO: 3892769 - RNA, 20 nt, Shigella flexneri 2a str. 301
gaaucaccgccacgcccucc

SEQ ID NO: 3892770 - RNA, 18 nt, Shigella flexneri 2a str. 301
gaaucacgccaacaaaca

SEQ ID NO: 3892771 - RNA, 23 nt, Shigella flexneri 2a str. 301
gaaucacgccgcccauaaauucc

SEQ ID NO: 3892772 - RNA, 21 nt, Shigella flexneri 2a str. 301
gaaucacgucguucgggccga

SEQ ID NO: 3892773 - RNA, 21 nt, Shigella flexneri 2a str. 301
gaaucacuccauccccagcuc

SEQ ID NO: 3892774 - RNA, 22 nt, Shigella flexneri 2a str. 301
gaaucagaauccggugccuuac

SEQ ID NO: 3892775 - RNA, 17 nt, Shigella flexneri 2a str. 301
gaaucagauucaaauua

SEQ ID NO: 3892776 - RNA, 14 nt, Shigella flexneri 2a str. 301
gaaucagcccagcc

SEQ ID NO: 3892777 - RNA, 21 nt, Shigella flexneri 2a str. 301
gaaucaguaaugauucgggcu

SEQ ID NO: 3892778 - RNA, 22 nt, Shigella flexneri 2a str. 301
gaaucaguuguucagaaugccc

SEQ ID NO: 3892779 - RNA, 19 nt, Shigella flexneri 2a str. 301
gaaucauaaauacaaggcc

SEQ ID NO: 3892780 - RNA, 16 nt, Shigella flexneri 2a str. 301
gaaucauaacugccgu

SEQ ID NO: 3892781 - RNA, 13 nt, Shigella flexneri 2a str. 301
gaaucauaggcuu

SEQ ID NO: 3892782 - RNA, 19 nt, Shigella flexneri 2a str. 301
gaaucaucguucauauauu

SEQ ID NO: 3892783 - RNA, 21 nt, Shigella flexneri 2a str. 301
gaaucaucguucauauauucc

SEQ ID NO: 3892784 - RNA, 18 nt, Shigella flexneri 2a str. 301
gaaucaugccgaucgucu

SEQ ID NO: 3892785 - RNA, 23 nt, Shigella flexneri 2a str. 301
gaaucaugccgaucgucugggca

SEQ ID NO: 3892786 - RNA, 21 nt, Shigella flexneri 2a str. 301
gaaucaugguuuauuucccag

SEQ ID NO: 3892787 - RNA, 15 nt, Shigella flexneri 2a str. 301
gaaucauuguuauau

SEQ ID NO: 3892788 - RNA, 14 nt, Shigella flexneri 2a str. 301
gaauccccacugca

SEQ ID NO: 3892789 - RNA, 17 nt, Shigella flexneri 2a str. 301
gaauccgcaccaacucc

SEQ ID NO: 3892790 - RNA, 23 nt, Shigella flexneri 2a str. 301
gaaucgcaaagccgauaccuucc

SEQ ID NO: 3892791 - RNA, 16 nt, Shigella flexneri 2a str. 301
gaaucgccacaacuuc

SEQ ID NO: 3892792 - RNA, 13 nt, Shigella flexneri 2a str. 301
gaaucgccagcau

SEQ ID NO: 3892793 - RNA, 18 nt, Shigella flexneri 2a str. 301
gaaucgccagcaucggca

SEQ ID NO: 3892794 - RNA, 15 nt, Shigella flexneri 2a str. 301
gaaucgcuucauuua

SEQ ID NO: 3892795 - RNA, 13 nt, Shigella flexneri 2a str. 301
gaaucggcggcgg

SEQ ID NO: 3892796 - RNA, 14 nt, Shigella flexneri 2a str. 301
gaaucgggaccagc

SEQ ID NO: 3892797 - RNA, 14 nt, Shigella flexneri 2a str. 301
gaaucuccagaucu

SEQ ID NO: 3892798 - RNA, 14 nt, Shigella flexneri 2a str. 301
gaaucucuuuuguu

SEQ ID NO: 3892799 - RNA, 15 nt, Shigella flexneri 2a str. 301
gaaucugcguaaaua

SEQ ID NO: 3892800 - RNA, 15 nt, Shigella flexneri 2a str. 301
gaaucuucaugcguu

SEQ ID NO: 3892801 - RNA, 16 nt, Shigella flexneri 2a str. 301
gaaucuucgugcguuu

SEQ ID NO: 3892802 - RNA, 19 nt, Shigella flexneri 2a str. 301
gaaugacaacugcauuuuc

SEQ ID NO: 3892803 - RNA, 16 nt, Shigella flexneri 2a str. 301
gaaugacauaaugcaa

SEQ ID NO: 3892804 - RNA, 22 nt, Shigella flexneri 2a str. 301
gaaugacaucaucgccccgcuc

SEQ ID NO: 3892805 - RNA, 14 nt, Shigella flexneri 2a str. 301
gaaugagcaucuac

SEQ ID NO: 3892806 - RNA, 15 nt, Shigella flexneri 2a str. 301
gaaugaggcagcaag

SEQ ID NO: 3892807 - RNA, 18 nt, Shigella flexneri 2a str. 301
gaaugaguacugaugaau

SEQ ID NO: 3892808 - RNA, 19 nt, Shigella flexneri 2a str. 301
gaaugaguacugaugaaua

SEQ ID NO: 3892809 - RNA, 19 nt, Shigella flexneri 2a str. 301
gaaugaucaaacgaagcgg

SEQ ID NO: 3892810 - RNA, 16 nt, Shigella flexneri 2a str. 301
gaaugaugcggcgcuu

SEQ ID NO: 3892811 - RNA, 14 nt, Shigella flexneri 2a str. 301
gaaugcaggcgcgc

SEQ ID NO: 3892812 - RNA, 19 nt, Shigella flexneri 2a str. 301
gaaugcagucacgccagua

SEQ ID NO: 3892813 - RNA, 18 nt, Shigella flexneri 2a str. 301
gaaugccacgcaaacuuc

SEQ ID NO: 3892814 - RNA, 19 nt, Shigella flexneri 2a str. 301
gaaugccccuuuaaauacc

SEQ ID NO: 3892815 - RNA, 19 nt, Shigella flexneri 2a str. 301
gaaugccgcagcacccuga

SEQ ID NO: 3892816 - RNA, 21 nt, Shigella flexneri 2a str. 301
gaaugccgcagcacccugagu

SEQ ID NO: 3892817 - RNA, 21 nt, Shigella flexneri 2a str. 301
gaaugccggaaucagaauccg

SEQ ID NO: 3892818 - RNA, 16 nt, Shigella flexneri 2a str. 301
gaaugccggaugcggc

SEQ ID NO: 3892819 - RNA, 17 nt, Shigella flexneri 2a str. 301
gaaugccggguaauuuc

SEQ ID NO: 3892820 - RNA, 14 nt, Shigella flexneri 2a str. 301
gaaugccugugcga

SEQ ID NO: 3892821 - RNA, 18 nt, Shigella flexneri 2a str. 301
gaaugcgaaaauccucaa

SEQ ID NO: 3892822 - RNA, 17 nt, Shigella flexneri 2a str. 301
gaaugcgauggcaaaag

SEQ ID NO: 3892823 - RNA, 14 nt, Shigella flexneri 2a str. 301
gaaugcggcaggca

SEQ ID NO: 3892824 - RNA, 19 nt, Shigella flexneri 2a str. 301
gaaugcucgcuggcaggcc

SEQ ID NO: 3892825 - RNA, 20 nt, Shigella flexneri 2a str. 301
gaauggaaacagcaccaucc

SEQ ID NO: 3892826 - RNA, 21 nt, Shigella flexneri 2a str. 301
gaauggacaccagcucaguga

SEQ ID NO: 3892827 - RNA, 15 nt, Shigella flexneri 2a str. 301
gaauggacuccaccg

SEQ ID NO: 3892828 - RNA, 19 nt, Shigella flexneri 2a str. 301
gaauggcaucuacgcucuc

SEQ ID NO: 3892829 - RNA, 13 nt, Shigella flexneri 2a str. 301
gaauggcaucuga

SEQ ID NO: 3892830 - RNA, 18 nt, Shigella flexneri 2a str. 301
gaauggcgcacucaaaac

SEQ ID NO: 3892831 - RNA, 19 nt, Shigella flexneri 2a str. 301
gaauggcgguuuuuugcuc

SEQ ID NO: 3892832 - RNA, 18 nt, Shigella flexneri 2a str. 301
gaauggguucgauuucau

SEQ ID NO: 3892833 - RNA, 18 nt, Shigella flexneri 2a str. 301
gaaugucggaugcagaac

SEQ ID NO: 3892834 - RNA, 21 nt, Shigella flexneri 2a str. 301
gaaugucugucugacaaccgc

SEQ ID NO: 3892835 - RNA, 14 nt, Shigella flexneri 2a str. 301
gaauguggcagcaa

SEQ ID NO: 3892836 - RNA, 11 nt, Shigella flexneri 2a str. 301
gaauguuccau

SEQ ID NO: 3892837 - RNA, 23 nt, Shigella flexneri 2a str. 301
gacagaucugccuguccggaaua

SEQ ID NO: 3892838 - RNA, 15 nt, Shigella flexneri 2a str. 301
gacagauucaugcug

SEQ ID NO: 3892839 - RNA, 19 nt, Shigella flexneri 2a str. 301
gacagauuuugccagcaug

SEQ ID NO: 3892840 - RNA, 15 nt, Shigella flexneri 2a str. 301
gacagcaggcucaga

SEQ ID NO: 3892841 - RNA, 21 nt, Shigella flexneri 2a str. 301
gacagccauaaagaaaucacc

SEQ ID NO: 3892842 - RNA, 13 nt, Shigella flexneri 2a str. 301
gacagccuaccag

SEQ ID NO: 3892843 - RNA, 15 nt, Shigella flexneri 2a str. 301
gacagccucaagcac

SEQ ID NO: 3892844 - RNA, 20 nt, Shigella flexneri 2a str. 301
gacagcgcgcgccgccaauc

SEQ ID NO: 3892845 - RNA, 22 nt, Shigella flexneri 2a str. 301
gacagcgucacaucaggccauc

SEQ ID NO: 3892846 - RNA, 17 nt, Shigella flexneri 2a str. 301
gacaggcgaaacccgcu

SEQ ID NO: 3892847 - RNA, 18 nt, Shigella flexneri 2a str. 301
gacagggaucucuuccag

SEQ ID NO: 3892848 - RNA, 19 nt, Shigella flexneri 2a str. 301
gacagggaucucuuccagu

SEQ ID NO: 3892849 - RNA, 19 nt, Shigella flexneri 2a str. 301
gacagggugagcagggcac

SEQ ID NO: 3892850 - RNA, 15 nt, Shigella flexneri 2a str. 301
gacaggucaaaguaa

SEQ ID NO: 3892851 - RNA, 22 nt, Shigella flexneri 2a str. 301
gacaggucagcgccuggcugca

SEQ ID NO: 3892852 - RNA, 20 nt, Shigella flexneri 2a str. 301
gacaguaaucuaccccagug

SEQ ID NO: 3892853 - RNA, 18 nt, Shigella flexneri 2a str. 301
gacaguaccagcaguaca

SEQ ID NO: 3892854 - RNA, 16 nt, Shigella flexneri 2a str. 301
gacaguacccagauuc

SEQ ID NO: 3892855 - RNA, 14 nt, Shigella flexneri 2a str. 301
gacaguaucaucau

SEQ ID NO: 3892856 - RNA, 21 nt, Shigella flexneri 2a str. 301
gacaguaugguuacugucguu

SEQ ID NO: 3892857 - RNA, 20 nt, Shigella flexneri 2a str. 301
gacagugggauuaaaaagua

SEQ ID NO: 3892858 - RNA, 17 nt, Shigella flexneri 2a str. 301
gacaguuaucaaauuca

SEQ ID NO: 3892859 - RNA, 16 nt, Shigella flexneri 2a str. 301
gacaguucaaucuccg

SEQ ID NO: 3892860 - RNA, 16 nt, Shigella flexneri 2a str. 301
gacaguugauccagcu

SEQ ID NO: 3892861 - RNA, 17 nt, Shigella flexneri 2a str. 301
gacaguugauccagcuu

SEQ ID NO: 3892862 - RNA, 16 nt, Shigella flexneri 2a str. 301
gacauaaacaccagca

SEQ ID NO: 3892863 - RNA, 18 nt, Shigella flexneri 2a str. 301
gacauaaacauuccacuu

SEQ ID NO: 3892864 - RNA, 15 nt, Shigella flexneri 2a str. 301
gacauaguagccagc

SEQ ID NO: 3892865 - RNA, 20 nt, Shigella flexneri 2a str. 301
gacauagucaucaucucugu

SEQ ID NO: 3892866 - RNA, 16 nt, Shigella flexneri 2a str. 301
gacauauaaccggcaa

SEQ ID NO: 3892867 - RNA, 17 nt, Shigella flexneri 2a str. 301
gacaucaacgaugccuu

SEQ ID NO: 3892868 - RNA, 13 nt, Shigella flexneri 2a str. 301
gacaucaagaaau

SEQ ID NO: 3892869 - RNA, 18 nt, Shigella flexneri 2a str. 301
gacaucaauaaacaauga

SEQ ID NO: 3892870 - RNA, 22 nt, Shigella flexneri 2a str. 301
gacaucaauaaacaaugagaua

SEQ ID NO: 3892871 - RNA, 18 nt, Shigella flexneri 2a str. 301
gacaucagcauccgcacg

SEQ ID NO: 3892872 - RNA, 20 nt, Shigella flexneri 2a str. 301
gacauccagcccggcggcgu

SEQ ID NO: 3892873 - RNA, 15 nt, Shigella flexneri 2a str. 301
gacaucccagugcaa

SEQ ID NO: 3892874 - RNA, 17 nt, Shigella flexneri 2a str. 301
gacaucccgccagccgc

SEQ ID NO: 3892875 - RNA, 16 nt, Shigella flexneri 2a str. 301
gacaucccggcagaga

SEQ ID NO: 3892876 - RNA, 18 nt, Shigella flexneri 2a str. 301
gacaucccggcagagaaa

SEQ ID NO: 3892877 - RNA, 15 nt, Shigella flexneri 2a str. 301
gacauccugcguuaa

SEQ ID NO: 3892878 - RNA, 23 nt, Shigella flexneri 2a str. 301
gacaucgccacggcaugaaagcg

SEQ ID NO: 3892879 - RNA, 14 nt, Shigella flexneri 2a str. 301
gacaucguaaagcu

SEQ ID NO: 3892880 - RNA, 18 nt, Shigella flexneri 2a str. 301
gacaucguaaagcugcgc

SEQ ID NO: 3892881 - RNA, 17 nt, Shigella flexneri 2a str. 301
gacaucgucaggggcau

SEQ ID NO: 3892882 - RNA, 22 nt, Shigella flexneri 2a str. 301
gacaucuuucugcgcaucuucc

SEQ ID NO: 3892883 - RNA, 23 nt, Shigella flexneri 2a str. 301
gacaucuuucugcgcaucuuccc

SEQ ID NO: 3892884 - RNA, 13 nt, Shigella flexneri 2a str. 301
gacaugacccggc

SEQ ID NO: 3892885 - RNA, 22 nt, Shigella flexneri 2a str. 301
gacaugaucuuuuuauugaaga

SEQ ID NO: 3892886 - RNA, 18 nt, Shigella flexneri 2a str. 301
gacaugauguuuuaacac

SEQ ID NO: 3892887 - RNA, 12 nt, Shigella flexneri 2a str. 301
gacaugauucau

SEQ ID NO: 3892888 - RNA, 13 nt, Shigella flexneri 2a str. 301
gacaugcaucacg

SEQ ID NO: 3892889 - RNA, 22 nt, Shigella flexneri 2a str. 301
gacaugcaucacgcgcaucugu

SEQ ID NO: 3892890 - RNA, 13 nt, Shigella flexneri 2a str. 301
gacaugguuggcc

SEQ ID NO: 3892891 - RNA, 21 nt, Shigella flexneri 2a str. 301
gacauguggauuaaauugcgc

SEQ ID NO: 3892892 - RNA, 22 nt, Shigella flexneri 2a str. 301
gacauuaaguguccgccaauuu

SEQ ID NO: 3892893 - RNA, 17 nt, Shigella flexneri 2a str. 301
gacauuacggauuaaau

SEQ ID NO: 3892894 - RNA, 21 nt, Shigella flexneri 2a str. 301
gacauuauaaauucuggccac

SEQ ID NO: 3892895 - RNA, 15 nt, Shigella flexneri 2a str. 301
gacauuaucuggauc

SEQ ID NO: 3892896 - RNA, 19 nt, Shigella flexneri 2a str. 301
gacauucgcgcacggugca

SEQ ID NO: 3892897 - RNA, 13 nt, Shigella flexneri 2a str. 301
gacauugaagaau

SEQ ID NO: 3892898 - RNA, 22 nt, Shigella flexneri 2a str. 301
gacauugaguuuacgcagcaga

SEQ ID NO: 3892899 - RNA, 20 nt, Shigella flexneri 2a str. 301
gacauugcguuuaguuacac

SEQ ID NO: 3892900 - RNA, 13 nt, Shigella flexneri 2a str. 301
gacauuggcaucc

SEQ ID NO: 3892901 - RNA, 21 nt, Shigella flexneri 2a str. 301
gacauugugugaaaucagcac

SEQ ID NO: 3892902 - RNA, 16 nt, Shigella flexneri 2a str. 301
gacauuguuuccauau

SEQ ID NO: 3892903 - RNA, 13 nt, Shigella flexneri 2a str. 301
gacauuuucucua

SEQ ID NO: 3892904 - RNA, 14 nt, Shigella flexneri 2a str. 301
gacauuuuggacaa

SEQ ID NO: 3892905 - RNA, 21 nt, Shigella flexneri 2a str. 301
gaccaaaacgugcagcugccu

SEQ ID NO: 3892906 - RNA, 21 nt, Shigella flexneri 2a str. 301
gaccaaacugcucguucagca

SEQ ID NO: 3892907 - RNA, 22 nt, Shigella flexneri 2a str. 301
gaccaaagccuuucacuucggu

SEQ ID NO: 3892908 - RNA, 20 nt, Shigella flexneri 2a str. 301
gaccaaaugaaacaggggcu

SEQ ID NO: 3892909 - RNA, 23 nt, Shigella flexneri 2a str. 301
gaccaaaugaaacaggggcugga

SEQ ID NO: 3892910 - RNA, 18 nt, Shigella flexneri 2a str. 301
gaccaacuucagcaacaa

SEQ ID NO: 3892911 - RNA, 17 nt, Shigella flexneri 2a str. 301
gaccaauaaacgccagg

SEQ ID NO: 3892912 - RNA, 21 nt, Shigella flexneri 2a str. 301
gaccaauaauccccaauacga

SEQ ID NO: 3892913 - RNA, 18 nt, Shigella flexneri 2a str. 301
gaccaaucacacaaccau

SEQ ID NO: 3892914 - RNA, 20 nt, Shigella flexneri 2a str. 301
gaccaaucacacaaccaugc

SEQ ID NO: 3892915 - RNA, 22 nt, Shigella flexneri 2a str. 301
gaccaaucacacaaccaugcag

SEQ ID NO: 3892916 - RNA, 16 nt, Shigella flexneri 2a str. 301
gaccaaucccgccaua

SEQ ID NO: 3892917 - RNA, 13 nt, Shigella flexneri 2a str. 301
gaccaauccgcca

SEQ ID NO: 3892918 - RNA, 17 nt, Shigella flexneri 2a str. 301
gaccaauccgccagcca

SEQ ID NO: 3892919 - RNA, 14 nt, Shigella flexneri 2a str. 301
gaccaaugacagcc

SEQ ID NO: 3892920 - RNA, 18 nt, Shigella flexneri 2a str. 301
gaccacaguaucagcguu

SEQ ID NO: 3892921 - RNA, 23 nt, Shigella flexneri 2a str. 301
gaccaccaccgauauugccaccu

SEQ ID NO: 3892922 - RNA, 17 nt, Shigella flexneri 2a str. 301
gaccaccauauucgcca

SEQ ID NO: 3892923 - RNA, 17 nt, Shigella flexneri 2a str. 301
gaccacccaccgcagcc

SEQ ID NO: 3892924 - RNA, 21 nt, Shigella flexneri 2a str. 301
gaccacccaccgcagcccaga

SEQ ID NO: 3892925 - RNA, 18 nt, Shigella flexneri 2a str. 301
gaccaccgucccaguaau

SEQ ID NO: 3892926 - RNA, 16 nt, Shigella flexneri 2a str. 301
gaccacggccacagcc

SEQ ID NO: 3892927 - RNA, 18 nt, Shigella flexneri 2a str. 301
gaccacggccacagccag

SEQ ID NO: 3892928 - RNA, 20 nt, Shigella flexneri 2a str. 301
gaccacggccacagccagcc

SEQ ID NO: 3892929 - RNA, 16 nt, Shigella flexneri 2a str. 301
gaccacugcgccgcuc

SEQ ID NO: 3892930 - RNA, 15 nt, Shigella flexneri 2a str. 301
gaccacuucaugccc

SEQ ID NO: 3892931 - RNA, 22 nt, Shigella flexneri 2a str. 301
gaccacuucgguacccagacgc

SEQ ID NO: 3892932 - RNA, 16 nt, Shigella flexneri 2a str. 301
gaccagaaacgccacc

SEQ ID NO: 3892933 - RNA, 17 nt, Shigella flexneri 2a str. 301
gaccagaaacgccacca

SEQ ID NO: 3892934 - RNA, 22 nt, Shigella flexneri 2a str. 301
gaccagaccggcaaucgcgcca

SEQ ID NO: 3892935 - RNA, 16 nt, Shigella flexneri 2a str. 301
gaccagcaacaaauaa

SEQ ID NO: 3892936 - RNA, 16 nt, Shigella flexneri 2a str. 301
gacgauuacucgccuu

SEQ ID NO: 3892937 - RNA, 22 nt, Shigella flexneri 2a str. 301
gacgauuguagaaaaucucaau

SEQ ID NO: 3892938 - RNA, 14 nt, Shigella flexneri 2a str. 301
gacgauugugcugg

SEQ ID NO: 3892939 - RNA, 18 nt, Shigella flexneri 2a str. 301
gacgauugugcuggugau

SEQ ID NO: 3892940 - RNA, 18 nt, Shigella flexneri 2a str. 301
gacgcaaccgcaaaugau

SEQ ID NO: 3892941 - RNA, 19 nt, Shigella flexneri 2a str. 301
gacgcaaugccaguuccgc

SEQ ID NO: 3892942 - RNA, 20 nt, Shigella flexneri 2a str. 301
gacgcaaugccaguuccgcu

SEQ ID NO: 3892943 - RNA, 18 nt, Shigella flexneri 2a str. 301
gacgcacacguuucaggu

SEQ ID NO: 3892944 - RNA, 12 nt, Shigella flexneri 2a str. 301
gacgcagcaugc

SEQ ID NO: 3892945 - RNA, 19 nt, Shigella flexneri 2a str. 301
gacgcagucaugcgagaag

SEQ ID NO: 3892946 - RNA, 12 nt, Shigella flexneri 2a str. 301
gacgcaguccag

SEQ ID NO: 3892947 - RNA, 19 nt, Shigella flexneri 2a str. 301
gacgcauccgaucgcgcau

SEQ ID NO: 3892948 - RNA, 22 nt, Shigella flexneri 2a str. 301
gacgcauccgaucgcgcaucag

SEQ ID NO: 3892949 - RNA, 12 nt, Shigella flexneri 2a str. 301
gacgccaagaaa

SEQ ID NO: 3892950 - RNA, 19 nt, Shigella flexneri 2a str. 301
gacgccacaaucugauaau

SEQ ID NO: 3892951 - RNA, 20 nt, Shigella flexneri 2a str. 301
gacgccacaaucugauaauc

SEQ ID NO: 3892952 - RNA, 17 nt, Shigella flexneri 2a str. 301
gacgccaccauucacca

SEQ ID NO: 3892953 - RNA, 14 nt, Shigella flexneri 2a str. 301
gacgccagaugcgg

SEQ ID NO: 3892954 - RNA, 18 nt, Shigella flexneri 2a str. 301
gacgccaguuacugcuga

SEQ ID NO: 3892955 - RNA, 19 nt, Shigella flexneri 2a str. 301
gacgccaguuacugcugac

SEQ ID NO: 3892956 - RNA, 19 nt, Shigella flexneri 2a str. 301
gacgcccugcgcuggugaa

SEQ ID NO: 3892957 - RNA, 17 nt, Shigella flexneri 2a str. 301
gacgcccuggaagaaaa

SEQ ID NO: 3892958 - RNA, 19 nt, Shigella flexneri 2a str. 301
gacgccgcgguucuuccaa

SEQ ID NO: 3892959 - RNA, 21 nt, Shigella flexneri 2a str. 301
gacgcgacaagcgucgcauca

SEQ ID NO: 3892960 - RNA, 14 nt, Shigella flexneri 2a str. 301
gacgcgauccgccg

SEQ ID NO: 3892961 - RNA, 21 nt, Shigella flexneri 2a str. 301
gacgcgcaaaucagauugcca

SEQ ID NO: 3892962 - RNA, 14 nt, Shigella flexneri 2a str. 301
gacgcgcagcgucg

SEQ ID NO: 3892963 - RNA, 14 nt, Shigella flexneri 2a str. 301
gacgcgcagcuuca

SEQ ID NO: 3892964 - RNA, 18 nt, Shigella flexneri 2a str. 301
gacgcgcagcuucacuuc

SEQ ID NO: 3892965 - RNA, 13 nt, Shigella flexneri 2a str. 301
gacgcgcaucacg

SEQ ID NO: 3892966 - RNA, 16 nt, Shigella flexneri 2a str. 301
gacgcgccaacaaaug

SEQ ID NO: 3892967 - RNA, 15 nt, Shigella flexneri 2a str. 301
gacgcgccagcaccg

SEQ ID NO: 3892968 - RNA, 18 nt, Shigella flexneri 2a str. 301
gacgcgccagcgucgcau

SEQ ID NO: 3892969 - RNA, 23 nt, Shigella flexneri 2a str. 301
gacgcgcggcgaaccagccguug

SEQ ID NO: 3892970 - RNA, 18 nt, Shigella flexneri 2a str. 301
gacgcgcuaagcgaaccu

SEQ ID NO: 3892971 - RNA, 20 nt, Shigella flexneri 2a str. 301
gacgcgcuagccucaggugu

SEQ ID NO: 3892972 - RNA, 17 nt, Shigella flexneri 2a str. 301
gacgcgcuauugccgua

SEQ ID NO: 3892973 - RNA, 20 nt, Shigella flexneri 2a str. 301
gacgcggcagcgucgcauca

SEQ ID NO: 3892974 - RNA, 22 nt, Shigella flexneri 2a str. 301
gacgcggcauuuuuacugcgcg

SEQ ID NO: 3892975 - RNA, 12 nt, Shigella flexneri 2a str. 301
gacgcgguagca

SEQ ID NO: 3892976 - RNA, 19 nt, Shigella flexneri 2a str. 301
gacgcgucaagcgucgcau

SEQ ID NO: 3892977 - RNA, 21 nt, Shigella flexneri 2a str. 301
gacgcgucaagcgucgcauca

SEQ ID NO: 3892978 - RNA, 18 nt, Shigella flexneri 2a str. 301
gacgcgucagugucuuau

SEQ ID NO: 3892979 - RNA, 18 nt, Shigella flexneri 2a str. 301
gacgcgucuggcaucacc

SEQ ID NO: 3892980 - RNA, 19 nt, Shigella flexneri 2a str. 301
gacgcgucuuaucuggccu

SEQ ID NO: 3892981 - RNA, 18 nt, Shigella flexneri 2a str. 301
gacgcgugcgccaaguuu

SEQ ID NO: 3892982 - RNA, 18 nt, Shigella flexneri 2a str. 301
gacgcguuagugucuuau

SEQ ID NO: 3892983 - RNA, 19 nt, Shigella flexneri 2a str. 301
gacgcucgccauuuuucag

SEQ ID NO: 3892984 - RNA, 23 nt, Shigella flexneri 2a str. 301
gacgcucggcuguuucuggauga

SEQ ID NO: 3892985 - RNA, 16 nt, Shigella flexneri 2a str. 301
gacgcuggcagaaagu

SEQ ID NO: 3892986 - RNA, 19 nt, Shigella flexneri 2a str. 301
gacgcuggcuuugcccugg

SEQ ID NO: 3892987 - RNA, 20 nt, Shigella flexneri 2a str. 301
gacgcuguuccggcggcagg

SEQ ID NO: 3892988 - RNA, 18 nt, Shigella flexneri 2a str. 301
gacgcuucaguucagcga

SEQ ID NO: 3892989 - RNA, 14 nt, Shigella flexneri 2a str. 301
gacgcuugcagcgu

SEQ ID NO: 3892990 - RNA, 19 nt, Shigella flexneri 2a str. 301
gacggaaaucgggagagau

SEQ ID NO: 3892991 - RNA, 16 nt, Shigella flexneri 2a str. 301
gacggaauaaacccac

SEQ ID NO: 3892992 - RNA, 23 nt, Shigella flexneri 2a str. 301
gacggauaaggcguuuacgccgc

SEQ ID NO: 3892993 - RNA, 13 nt, Shigella flexneri 2a str. 301
gacggcaucagaa

SEQ ID NO: 3892994 - RNA, 18 nt, Shigella flexneri 2a str. 301
gacggccguugugacuuu

SEQ ID NO: 3892995 - RNA, 21 nt, Shigella flexneri 2a str. 301
gacggccucugcggaggccgu

SEQ ID NO: 3892996 - RNA, 23 nt, Shigella flexneri 2a str. 301
gacggcgcucuugcggcauuucg

SEQ ID NO: 3892997 - RNA, 15 nt, Shigella flexneri 2a str. 301
gacggcguauugcau

SEQ ID NO: 3892998 - RNA, 13 nt, Shigella flexneri 2a str. 301
gacggcguucuuu

SEQ ID NO: 3892999 - RNA, 16 nt, Shigella flexneri 2a str. 301
gacggcuacgcucauu

SEQ ID NO: 3893000 - RNA, 16 nt, Shigella flexneri 2a str. 301
gacggcugauaugcca

SEQ ID NO: 3893001 - RNA, 15 nt, Shigella flexneri 2a str. 301
gacggcuucucggca

SEQ ID NO: 3893002 - RNA, 22 nt, Shigella flexneri 2a str. 301
gacgggaaacucugcuggcgga

SEQ ID NO: 3893003 - RNA, 17 nt, Shigella flexneri 2a str. 301
gacgggcccauaacgcc

SEQ ID NO: 3893004 - RNA, 12 nt, Shigella flexneri 2a str. 301
gacgggcggcuu

SEQ ID NO: 3893005 - RNA, 19 nt, Shigella flexneri 2a str. 301
gacgggcuaaucgucauca

SEQ ID NO: 3893006 - RNA, 14 nt, Shigella flexneri 2a str. 301
gacgggcugguagg

SEQ ID NO: 3893007 - RNA, 17 nt, Shigella flexneri 2a str. 301
gacgggcugguagggcu

SEQ ID NO: 3893008 - RNA, 20 nt, Shigella flexneri 2a str. 301
gacgguaaaaagaaaguuug

SEQ ID NO: 3893009 - RNA, 23 nt, Shigella flexneri 2a str. 301
gacggucuuuuucuacagcgacu

SEQ ID NO: 3893010 - RNA, 22 nt, Shigella flexneri 2a str. 301
gacggugacacuuugcgccauc

SEQ ID NO: 3893011 - RNA, 21 nt, Shigella flexneri 2a str. 301
gacgguuuaucucaucuucca

SEQ ID NO: 3893012 - RNA, 19 nt, Shigella flexneri 2a str. 301
gacguaacgaccaccaccg

SEQ ID NO: 3893013 - RNA, 20 nt, Shigella flexneri 2a str. 301
gacguaaugauguaaaaaua

SEQ ID NO: 3893014 - RNA, 21 nt, Shigella flexneri 2a str. 301
gacguaaugauguaaaaauac

SEQ ID NO: 3893015 - RNA, 18 nt, Shigella flexneri 2a str. 301
gacguagugaaaucgcca

SEQ ID NO: 3893016 - RNA, 18 nt, Shigella flexneri 2a str. 301
gacguauaaccggaugac

SEQ ID NO: 3893017 - RNA, 18 nt, Shigella flexneri 2a str. 301
gacgucacaggccaucac

SEQ ID NO: 3893018 - RNA, 14 nt, Shigella flexneri 2a str. 301
gacgucauagcagu

SEQ ID NO: 3893019 - RNA, 16 nt, Shigella flexneri 2a str. 301
gacguccaaucagcac

SEQ ID NO: 3893020 - RNA, 20 nt, Shigella flexneri 2a str. 301
gacgugcaccgucacuucuu

SEQ ID NO: 3893021 - RNA, 21 nt, Shigella flexneri 2a str. 301
gacgugcgcaaacuucuucag

SEQ ID NO: 3893022 - RNA, 21 nt, Shigella flexneri 2a str. 301
gacgugcgggcgcaagggugc

SEQ ID NO: 3893023 - RNA, 18 nt, Shigella flexneri 2a str. 301
gacgugcucgaacauccc

SEQ ID NO: 3893024 - RNA, 17 nt, Shigella flexneri 2a str. 301
gacguggggguucaagu

SEQ ID NO: 3893025 - RNA, 22 nt, Shigella flexneri 2a str. 301
gacguggggguucaaguccccc

SEQ ID NO: 3893026 - RNA, 17 nt, Shigella flexneri 2a str. 301
gacgugucuuaucaggc

SEQ ID NO: 3893027 - RNA, 17 nt, Shigella flexneri 2a str. 301
gacguguugucagcuca

SEQ ID NO: 3893028 - RNA, 15 nt, Shigella flexneri 2a str. 301
gacguuaagaaaacg

SEQ ID NO: 3893029 - RNA, 19 nt, Shigella flexneri 2a str. 301
gacguucaccgucaccccu

SEQ ID NO: 3893030 - RNA, 14 nt, Shigella flexneri 2a str. 301
gacguucaguuccg

SEQ ID NO: 3893031 - RNA, 16 nt, Shigella flexneri 2a str. 301
gacguucgcguacugc

SEQ ID NO: 3893032 - RNA, 14 nt, Shigella flexneri 2a str. 301
gacguucugccaaa

SEQ ID NO: 3893033 - RNA, 14 nt, Shigella flexneri 2a str. 301
gacguucuuccugu

SEQ ID NO: 3893034 - RNA, 17 nt, Shigella flexneri 2a str. 301
gacguucuuccugugga

SEQ ID NO: 3893035 - RNA, 15 nt, Shigella flexneri 2a str. 301
gagaagcuggaaggg

SEQ ID NO: 3893036 - RNA, 18 nt, Shigella flexneri 2a str. 301
gagaagguugccauaucu

SEQ ID NO: 3893037 - RNA, 15 nt, Shigella flexneri 2a str. 301
gagaauaagcgcagc

SEQ ID NO: 3893038 - RNA, 14 nt, Shigella flexneri 2a str. 301
gagaaucagcgaga

SEQ ID NO: 3893039 - RNA, 16 nt, Shigella flexneri 2a str. 301
gagaaucaguuuuuuc

SEQ ID NO: 3893040 - RNA, 16 nt, Shigella flexneri 2a str. 301
gagaauggacaccagc

SEQ ID NO: 3893041 - RNA, 16 nt, Shigella flexneri 2a str. 301
gagaauugaaguuuaa

SEQ ID NO: 3893042 - RNA, 13 nt, Shigella flexneri 2a str. 301
gagacaaaaaagg

SEQ ID NO: 3893043 - RNA, 20 nt, Shigella flexneri 2a str. 301
gagacacaacaauucccagu

SEQ ID NO: 3893044 - RNA, 15 nt, Shigella flexneri 2a str. 301
gagacagaaucaggc

SEQ ID NO: 3893045 - RNA, 19 nt, Shigella flexneri 2a str. 301
gagacagccgaaaagguag

SEQ ID NO: 3893046 - RNA, 19 nt, Shigella flexneri 2a str. 301
gagacauuacguccaucac

SEQ ID NO: 3893047 - RNA, 21 nt, Shigella flexneri 2a str. 301
gagacauuccuuuacuuagaa

SEQ ID NO: 3893048 - RNA, 12 nt, Shigella flexneri 2a str. 301
gagacgcgcuug

SEQ ID NO: 3893049 - RNA, 21 nt, Shigella flexneri 2a str. 301
gagacgguuaaaaacagccag

SEQ ID NO: 3893050 - RNA, 15 nt, Shigella flexneri 2a str. 301
gagacuuuuccagcc

SEQ ID NO: 3893051 - RNA, 11 nt, Shigella flexneri 2a str. 301
gagagaaaaaa

SEQ ID NO: 3893052 - RNA, 16 nt, Shigella flexneri 2a str. 301
gagagaaaaaaaagca

SEQ ID NO: 3893053 - RNA, 15 nt, Shigella flexneri 2a str. 301
gagagaaaagcaaaa

SEQ ID NO: 3893054 - RNA, 15 nt, Shigella flexneri 2a str. 301
gagagaacugcgcca

SEQ ID NO: 3893055 - RNA, 20 nt, Shigella flexneri 2a str. 301
gagagaagcacguucauccc

SEQ ID NO: 3893056 - RNA, 12 nt, Shigella flexneri 2a str. 301
gagagcagcauc

SEQ ID NO: 3893057 - RNA, 16 nt, Shigella flexneri 2a str. 301
gagagcaugaaaugaa

SEQ ID NO: 3893058 - RNA, 15 nt, Shigella flexneri 2a str. 301
gagagcgccagaagu

SEQ ID NO: 3893059 - RNA, 15 nt, Shigella flexneri 2a str. 301
gagaggccuucgccu

SEQ ID NO: 3893060 - RNA, 17 nt, Shigella flexneri 2a str. 301
gagagguaaaaccugac

SEQ ID NO: 3893061 - RNA, 22 nt, Shigella flexneri 2a str. 301
gagagguaaaaccugacaacaa

SEQ ID NO: 3893062 - RNA, 19 nt, Shigella flexneri 2a str. 301
gagagugacgucauagcag

SEQ ID NO: 3893063 - RNA, 17 nt, Shigella flexneri 2a str. 301
gagauaaccacguucau

SEQ ID NO: 3893064 - RNA, 15 nt, Shigella flexneri 2a str. 301
gagauaacguuuugc

SEQ ID NO: 3893065 - RNA, 13 nt, Shigella flexneri 2a str. 301
gagauaauauccu

SEQ ID NO: 3893066 - RNA, 18 nt, Shigella flexneri 2a str. 301
gagauacaggccaccgcc

SEQ ID NO: 3893067 - RNA, 22 nt, Shigella flexneri 2a str. 301
gagauaccaguugaucaaauaa

SEQ ID NO: 3893068 - RNA, 21 nt, Shigella flexneri 2a str. 301
gagauagauuaguuguacauu

SEQ ID NO: 3893069 - RNA, 21 nt, Shigella flexneri 2a str. 301
gagaucauuauuaaacagaca

SEQ ID NO: 3893070 - RNA, 21 nt, Shigella flexneri 2a str. 301
gagauccggaucccaccagac

SEQ ID NO: 3893071 - RNA, 22 nt, Shigella flexneri 2a str. 301
gagaucgaccggguuagucugg

SEQ ID NO: 3893072 - RNA, 16 nt, Shigella flexneri 2a str. 301
gagaucgagcgccguu

SEQ ID NO: 3893073 - RNA, 13 nt, Shigella flexneri 2a str. 301
gagaucgccgcug

SEQ ID NO: 3893074 - RNA, 18 nt, Shigella flexneri 2a str. 301
gagaucgccgcuguaaua

SEQ ID NO: 3893075 - RNA, 16 nt, Shigella flexneri 2a str. 301
gagaucggccagcacc

SEQ ID NO: 3893076 - RNA, 20 nt, Shigella flexneri 2a str. 301
gagaugacgccacuggcugg

SEQ ID NO: 3893077 - RNA, 17 nt, Shigella flexneri 2a str. 301
gagauggcuucauccca

SEQ ID NO: 3893078 - RNA, 13 nt, Shigella flexneri 2a str. 301
gagauguugcaaa

SEQ ID NO: 3893079 - RNA, 20 nt, Shigella flexneri 2a str. 301
gagauuuaugacaaacgcaa

SEQ ID NO: 3893080 - RNA, 22 nt, Shigella flexneri 2a str. 301
gagauuuuacccaugacuuuga

SEQ ID NO: 3893081 - RNA, 18 nt, Shigella flexneri 2a str. 301
gagauuuuuccccaccuc

SEQ ID NO: 3893082 - RNA, 16 nt, Shigella flexneri 2a str. 301
gagcaaaccacaggcc

SEQ ID NO: 3893083 - RNA, 17 nt, Shigella flexneri 2a str. 301
gagcaaaccacaggccg

SEQ ID NO: 3893084 - RNA, 18 nt, Shigella flexneri 2a str. 301
gagcaaagcgcagccguc

SEQ ID NO: 3893085 - RNA, 13 nt, Shigella flexneri 2a str. 301
gagcaaccaccug

SEQ ID NO: 3893086 - RNA, 23 nt, Shigella flexneri 2a str. 301
gagcaauaaaaacuccgccgcau

SEQ ID NO: 3893087 - RNA, 10 nt, Shigella flexneri 2a str. 301
gagcaaugau

SEQ ID NO: 3893088 - RNA, 21 nt, Shigella flexneri 2a str. 301
gagcaaugaucucaauaguuc

SEQ ID NO: 3893089 - RNA, 22 nt, Shigella flexneri 2a str. 301
gagcaaugcgcaucaaagccag

SEQ ID NO: 3893090 - RNA, 19 nt, Shigella flexneri 2a str. 301
gagcaauguaaggugcauc

SEQ ID NO: 3893091 - RNA, 12 nt, Shigella flexneri 2a str. 301
gagcacaugcag

SEQ ID NO: 3893092 - RNA, 17 nt, Shigella flexneri 2a str. 301
gagcacggcaucccaac

SEQ ID NO: 3893093 - RNA, 15 nt, Shigella flexneri 2a str. 301
gagcacuauccgaca

SEQ ID NO: 3893094 - RNA, 19 nt, Shigella flexneri 2a str. 301
gagcacuguuacugucggc

SEQ ID NO: 3893095 - RNA, 21 nt, Shigella flexneri 2a str. 301
gagcagagaaacgccagcagc

SEQ ID NO: 3893096 - RNA, 18 nt, Shigella flexneri 2a str. 301
gagcagccaccacuugca

SEQ ID NO: 3893097 - RNA, 16 nt, Shigella flexneri 2a str. 301
gagcaggagcagcagg

SEQ ID NO: 3893098 - RNA, 13 nt, Shigella flexneri 2a str. 301
gagcaggccgggu

SEQ ID NO: 3893099 - RNA, 14 nt, Shigella flexneri 2a str. 301
gagcaggucaguca

SEQ ID NO: 3893100 - RNA, 13 nt, Shigella flexneri 2a str. 301
gagcauaaaaguu

SEQ ID NO: 3893101 - RNA, 15 nt, Shigella flexneri 2a str. 301
gagcauaggcauuaa

SEQ ID NO: 3893102 - RNA, 19 nt, Shigella flexneri 2a str. 301
gagcaucaguuaacggcac

SEQ ID NO: 3893103 - RNA, 17 nt, Shigella flexneri 2a str. 301
gagcaucgguaucuucc

SEQ ID NO: 3893104 - RNA, 22 nt, Shigella flexneri 2a str. 301
gagcaugguaacgccccacaaa

SEQ ID NO: 3893105 - RNA, 22 nt, Shigella flexneri 2a str. 301
gagcauuacuuucggugacuuc

SEQ ID NO: 3893106 - RNA, 19 nt, Shigella flexneri 2a str. 301
gagcauucccgccaucguu

SEQ ID NO: 3893107 - RNA, 17 nt, Shigella flexneri 2a str. 301
gagccaaacgcccagcu

SEQ ID NO: 3893108 - RNA, 16 nt, Shigella flexneri 2a str. 301
gagccagccccacagc

SEQ ID NO: 3893109 - RNA, 15 nt, Shigella flexneri 2a str. 301
gagccagcuucccaa

SEQ ID NO: 3893110 - RNA, 22 nt, Shigella flexneri 2a str. 301
gagccaguuggcguaccauuaa

SEQ ID NO: 3893111 - RNA, 15 nt, Shigella flexneri 2a str. 301
gagccauccaguuua

SEQ ID NO: 3893112 - RNA, 22 nt, Shigella flexneri 2a str. 301
gagccgaaauauggcucugcgg

SEQ ID NO: 3893113 - RNA, 22 nt, Shigella flexneri 2a str. 301
gagccgcuacggaagaugaaaa

SEQ ID NO: 3893114 - RNA, 18 nt, Shigella flexneri 2a str. 301
gagccggauggcauacca

SEQ ID NO: 3893115 - RNA, 17 nt, Shigella flexneri 2a str. 301
gagcgaauacuccccuu

SEQ ID NO: 3893116 - RNA, 22 nt, Shigella flexneri 2a str. 301
gagcgacaccucccagcgcggu

SEQ ID NO: 3893117 - RNA, 17 nt, Shigella flexneri 2a str. 301
gagcgacaucuuccuua

SEQ ID NO: 3893118 - RNA, 15 nt, Shigella flexneri 2a str. 301
gagcgagggagaaaa

SEQ ID NO: 3893119 - RNA, 22 nt, Shigella flexneri 2a str. 301
gagcgauacaucaucacugcca

SEQ ID NO: 3893120 - RNA, 16 nt, Shigella flexneri 2a str. 301
gagcgaucggcagcug

SEQ ID NO: 3893121 - RNA, 16 nt, Shigella flexneri 2a str. 301
gagcgcaaauugcugg

SEQ ID NO: 3893122 - RNA, 16 nt, Shigella flexneri 2a str. 301
gagcgccagcauggca

SEQ ID NO: 3893123 - RNA, 22 nt, Shigella flexneri 2a str. 301
gagcgccauuucuucuccggca

SEQ ID NO: 3893124 - RNA, 15 nt, Shigella flexneri 2a str. 301
gagcgccccagaccu

SEQ ID NO: 3893125 - RNA, 19 nt, Shigella flexneri 2a str. 301
gagcgccguugcgcccauc

SEQ ID NO: 3893126 - RNA, 20 nt, Shigella flexneri 2a str. 301
gagcgcuggugacaucgcca

SEQ ID NO: 3893127 - RNA, 22 nt, Shigella flexneri 2a str. 301
gagcgcuggugacaucgccaga

SEQ ID NO: 3893128 - RNA, 15 nt, Shigella flexneri 2a str. 301
gagcggacugaacgc

SEQ ID NO: 3893129 - RNA, 23 nt, Shigella flexneri 2a str. 301
gagcgguaaagaacugagcgccg

SEQ ID NO: 3893130 - RNA, 22 nt, Shigella flexneri 2a str. 301
gagcgguuuuuuuaauuacugc

SEQ ID NO: 3893131 - RNA, 19 nt, Shigella flexneri 2a str. 301
gagcguaucggcuccugga

SEQ ID NO: 3893132 - RNA, 23 nt, Shigella flexneri 2a str. 301
gagcgucauauagccgccuuguu

SEQ ID NO: 3893133 - RNA, 19 nt, Shigella flexneri 2a str. 301
gagcguuacccgcagccau

SEQ ID NO: 3893134 - RNA, 14 nt, Shigella flexneri 2a str. 301
gagcguuucaaaaa

SEQ ID NO: 3893135 - RNA, 20 nt, Shigella flexneri 2a str. 301
gauaaaguuagagccaggga

SEQ ID NO: 3893136 - RNA, 20 nt, Shigella flexneri 2a str. 301
gauaaauaacuuuuaucugu

SEQ ID NO: 3893137 - RNA, 13 nt, Shigella flexneri 2a str. 301
gauaaauacagcg

SEQ ID NO: 3893138 - RNA, 12 nt, Shigella flexneri 2a str. 301
gauaaauauuau

SEQ ID NO: 3893139 - RNA, 14 nt, Shigella flexneri 2a str. 301
gauaaauauuauug

SEQ ID NO: 3893140 - RNA, 15 nt, Shigella flexneri 2a str. 301
gauaaauccaucggg

SEQ ID NO: 3893141 - RNA, 17 nt, Shigella flexneri 2a str. 301
gauaaauuacugccgcu

SEQ ID NO: 3893142 - RNA, 19 nt, Shigella flexneri 2a str. 301
gauaaccacguucauuuca

SEQ ID NO: 3893143 - RNA, 20 nt, Shigella flexneri 2a str. 301
gauaaccacguucauuucau

SEQ ID NO: 3893144 - RNA, 19 nt, Shigella flexneri 2a str. 301
gauaaccaucuucuucacu

SEQ ID NO: 3893145 - RNA, 15 nt, Shigella flexneri 2a str. 301
gauaacccagcagcc

SEQ ID NO: 3893146 - RNA, 14 nt, Shigella flexneri 2a str. 301
gauaacccagcgca

SEQ ID NO: 3893147 - RNA, 22 nt, Shigella flexneri 2a str. 301
gauaacgccuagaaaucauuca

SEQ ID NO: 3893148 - RNA, 23 nt, Shigella flexneri 2a str. 301
gauaacgccuagaaaucauucaa

SEQ ID NO: 3893149 - RNA, 16 nt, Shigella flexneri 2a str. 301
gauaacgcggcagcag

SEQ ID NO: 3893150 - RNA, 20 nt, Shigella flexneri 2a str. 301
gauaacggugcaacccgcca

SEQ ID NO: 3893151 - RNA, 22 nt, Shigella flexneri 2a str. 301
gauaacguacugggcggcaaaa

SEQ ID NO: 3893152 - RNA, 23 nt, Shigella flexneri 2a str. 301
gauaacguguuccaguugcauac

SEQ ID NO: 3893153 - RNA, 21 nt, Shigella flexneri 2a str. 301
gauaacucaaaaauaaucauc

SEQ ID NO: 3893154 - RNA, 13 nt, Shigella flexneri 2a str. 301
gauaagacgcgca

SEQ ID NO: 3893155 - RNA, 14 nt, Shigella flexneri 2a str. 301
gauaagacgcgcua

SEQ ID NO: 3893156 - RNA, 17 nt, Shigella flexneri 2a str. 301
gauaagaugcgccagca

SEQ ID NO: 3893157 - RNA, 22 nt, Shigella flexneri 2a str. 301
gauaagaugguuauccagcuuc

SEQ ID NO: 3893158 - RNA, 20 nt, Shigella flexneri 2a str. 301
gauaagcguagcgcaucagg

SEQ ID NO: 3893159 - RNA, 19 nt, Shigella flexneri 2a str. 301
gauaaggugccaauccuuc

SEQ ID NO: 3893160 - RNA, 22 nt, Shigella flexneri 2a str. 301
gauaagugagcgauucaaauuc

SEQ ID NO: 3893161 - RNA, 14 nt, Shigella flexneri 2a str. 301
gauaauacgcguaa

SEQ ID NO: 3893162 - RNA, 16 nt, Shigella flexneri 2a str. 301
gauaauagcguuucag

SEQ ID NO: 3893163 - RNA, 20 nt, Shigella flexneri 2a str. 301
gauaauaggaaucauuguua

SEQ ID NO: 3893164 - RNA, 21 nt, Shigella flexneri 2a str. 301
gauaauauugaugcacaccau

SEQ ID NO: 3893165 - RNA, 22 nt, Shigella flexneri 2a str. 301
gauaauauuuuugcguccuggc

SEQ ID NO: 3893166 - RNA, 16 nt, Shigella flexneri 2a str. 301
gauaaucagcgccagc

SEQ ID NO: 3893167 - RNA, 23 nt, Shigella flexneri 2a str. 301
gauaaucaucccacaugaauucg

SEQ ID NO: 3893168 - RNA, 13 nt, Shigella flexneri 2a str. 301
gauaauccaggac

SEQ ID NO: 3893169 - RNA, 14 nt, Shigella flexneri 2a str. 301
gauaaucgcuuucg

SEQ ID NO: 3893170 - RNA, 14 nt, Shigella flexneri 2a str. 301
gauaaugcccagca

SEQ ID NO: 3893171 - RNA, 18 nt, Shigella flexneri 2a str. 301
gauaaugcccgaugaccu

SEQ ID NO: 3893172 - RNA, 12 nt, Shigella flexneri 2a str. 301
gauaauggcugu

SEQ ID NO: 3893173 - RNA, 20 nt, Shigella flexneri 2a str. 301
gauaauggcuguugaaugcc

SEQ ID NO: 3893174 - RNA, 20 nt, Shigella flexneri 2a str. 301
gauaaugguuuccagcaucg

SEQ ID NO: 3893175 - RNA, 20 nt, Shigella flexneri 2a str. 301
gauaauuaggauacuuaucu

SEQ ID NO: 3893176 - RNA, 21 nt, Shigella flexneri 2a str. 301
gauaauuaugccgaucaucau

SEQ ID NO: 3893177 - RNA, 15 nt, Shigella flexneri 2a str. 301
gauaauuauuauaau

SEQ ID NO: 3893178 - RNA, 18 nt, Shigella flexneri 2a str. 301
gauaauucagcagggcga

SEQ ID NO: 3893179 - RNA, 16 nt, Shigella flexneri 2a str. 301
gauaauuucacugccu

SEQ ID NO: 3893180 - RNA, 22 nt, Shigella flexneri 2a str. 301
gauacaacucgcuuaagccauc

SEQ ID NO: 3893181 - RNA, 15 nt, Shigella flexneri 2a str. 301
gauacagaagcaccg

SEQ ID NO: 3893182 - RNA, 15 nt, Shigella flexneri 2a str. 301
gauacagccaaauca

SEQ ID NO: 3893183 - RNA, 19 nt, Shigella flexneri 2a str. 301
gauacagccaaaucaucag

SEQ ID NO: 3893184 - RNA, 17 nt, Shigella flexneri 2a str. 301
gauacagcucaugggcu

SEQ ID NO: 3893185 - RNA, 15 nt, Shigella flexneri 2a str. 301
gauacaguuuuugcg

SEQ ID NO: 3893186 - RNA, 13 nt, Shigella flexneri 2a str. 301
gauacaucaucac

SEQ ID NO: 3893187 - RNA, 19 nt, Shigella flexneri 2a str. 301
gauacaucgcauaaaacaa

SEQ ID NO: 3893188 - RNA, 11 nt, Shigella flexneri 2a str. 301
gauacaugaau

SEQ ID NO: 3893189 - RNA, 13 nt, Shigella flexneri 2a str. 301
gauacaugaauga

SEQ ID NO: 3893190 - RNA, 17 nt, Shigella flexneri 2a str. 301
gauacaugaaugaugau

SEQ ID NO: 3893191 - RNA, 18 nt, Shigella flexneri 2a str. 301
gauaccaaaaucggcaac

SEQ ID NO: 3893192 - RNA, 17 nt, Shigella flexneri 2a str. 301
gauaccagauuaauuau

SEQ ID NO: 3893193 - RNA, 19 nt, Shigella flexneri 2a str. 301
gauaccaucgcuucaugcc

SEQ ID NO: 3893194 - RNA, 20 nt, Shigella flexneri 2a str. 301
gauacccgcgaggcgcauaa

SEQ ID NO: 3893195 - RNA, 16 nt, Shigella flexneri 2a str. 301
gauaccgaacauacca

SEQ ID NO: 3893196 - RNA, 18 nt, Shigella flexneri 2a str. 301
gauaccgacacaggucga

SEQ ID NO: 3893197 - RNA, 19 nt, Shigella flexneri 2a str. 301
gauaccgauagauucagca

SEQ ID NO: 3893198 - RNA, 19 nt, Shigella flexneri 2a str. 301
gauaccgguaaucaggcaa

SEQ ID NO: 3893199 - RNA, 22 nt, Shigella flexneri 2a str. 301
gauaccggugcaccuucaagua

SEQ ID NO: 3893200 - RNA, 21 nt, Shigella flexneri 2a str. 301
gauaccgguucgugccacagu

SEQ ID NO: 3893201 - RNA, 16 nt, Shigella flexneri 2a str. 301
gauaccuaacauuuua

SEQ ID NO: 3893202 - RNA, 19 nt, Shigella flexneri 2a str. 301
gauacgaccguuccauuca

SEQ ID NO: 3893203 - RNA, 20 nt, Shigella flexneri 2a str. 301
gauacgaccguuccauucaa

SEQ ID NO: 3893204 - RNA, 12 nt, Shigella flexneri 2a str. 301
gauacgcaguac

SEQ ID NO: 3893205 - RNA, 15 nt, Shigella flexneri 2a str. 301
gauacgccccgguua

SEQ ID NO: 3893206 - RNA, 21 nt, Shigella flexneri 2a str. 301
gauacgcuugccggacaugcu

SEQ ID NO: 3893207 - RNA, 18 nt, Shigella flexneri 2a str. 301
gauacggcgcaucuguuu

SEQ ID NO: 3893208 - RNA, 20 nt, Shigella flexneri 2a str. 301
gauacgguuuuuugaacaga

SEQ ID NO: 3893209 - RNA, 18 nt, Shigella flexneri 2a str. 301
gauacuacguucaaucac

SEQ ID NO: 3893210 - RNA, 14 nt, Shigella flexneri 2a str. 301
gauacucgcaguca

SEQ ID NO: 3893211 - RNA, 13 nt, Shigella flexneri 2a str. 301
gauacucugccau

SEQ ID NO: 3893212 - RNA, 20 nt, Shigella flexneri 2a str. 301
gauacugaugaacgcgcagg

SEQ ID NO: 3893213 - RNA, 21 nt, Shigella flexneri 2a str. 301
gauacugaugaacgcgcaggu

SEQ ID NO: 3893214 - RNA, 20 nt, Shigella flexneri 2a str. 301
gauacugcauucccaucgca

SEQ ID NO: 3893215 - RNA, 19 nt, Shigella flexneri 2a str. 301
gauagaaccacgcaaaggc

SEQ ID NO: 3893216 - RNA, 15 nt, Shigella flexneri 2a str. 301
gauagaauauuucua

SEQ ID NO: 3893217 - RNA, 22 nt, Shigella flexneri 2a str. 301
gauagaauauuucuauauccuc

SEQ ID NO: 3893218 - RNA, 20 nt, Shigella flexneri 2a str. 301
gauagagagcagucagguuc

SEQ ID NO: 3893219 - RNA, 20 nt, Shigella flexneri 2a str. 301
gauagcaagcgcugagacgc

SEQ ID NO: 3893220 - RNA, 20 nt, Shigella flexneri 2a str. 301
gauagccaauuacgcaggca

SEQ ID NO: 3893221 - RNA, 12 nt, Shigella flexneri 2a str. 301
gauagccaggcg

SEQ ID NO: 3893222 - RNA, 17 nt, Shigella flexneri 2a str. 301
gauagccauuaucauga

SEQ ID NO: 3893223 - RNA, 19 nt, Shigella flexneri 2a str. 301
gauagccgaccgcaaggaa

SEQ ID NO: 3893224 - RNA, 22 nt, Shigella flexneri 2a str. 301
gauagcgucauuucuacgggua

SEQ ID NO: 3893225 - RNA, 20 nt, Shigella flexneri 2a str. 301
gauagcguucggcaacgucg

SEQ ID NO: 3893226 - RNA, 14 nt, Shigella flexneri 2a str. 301
gauaggaauuaaaa

SEQ ID NO: 3893227 - RNA, 15 nt, Shigella flexneri 2a str. 301
gauaggcaucagcaa

SEQ ID NO: 3893228 - RNA, 21 nt, Shigella flexneri 2a str. 301
gauaguguuuuauguucagau

SEQ ID NO: 3893229 - RNA, 15 nt, Shigella flexneri 2a str. 301
gauaguuaaaauuca

SEQ ID NO: 3893230 - RNA, 17 nt, Shigella flexneri 2a str. 301
gauaguuaaaauucaag

SEQ ID NO: 3893231 - RNA, 16 nt, Shigella flexneri 2a str. 301
gauaguucaacagauu

SEQ ID NO: 3893232 - RNA, 20 nt, Shigella flexneri 2a str. 301
gauaguucgcgaucgcgcca

SEQ ID NO: 3893233 - RNA, 22 nt, Shigella flexneri 2a str. 301
gauaguucgcgaucgcgccaga

SEQ ID NO: 3893234 - RNA, 23 nt, Shigella flexneri 2a str. 301
gaucccacggcggugucgccaga

SEQ ID NO: 3893235 - RNA, 12 nt, Shigella flexneri 2a str. 301
gaucccaguuuu

SEQ ID NO: 3893236 - RNA, 22 nt, Shigella flexneri 2a str. 301
gauccccugcgcggcgacuucc

SEQ ID NO: 3893237 - RNA, 18 nt, Shigella flexneri 2a str. 301
gauccgcacccgcacgcu

SEQ ID NO: 3893238 - RNA, 17 nt, Shigella flexneri 2a str. 301
gauccggacaugcugca

SEQ ID NO: 3893239 - RNA, 17 nt, Shigella flexneri 2a str. 301
gauccggaucccaccag

SEQ ID NO: 3893240 - RNA, 20 nt, Shigella flexneri 2a str. 301
gauccucuaucuguuugcca

SEQ ID NO: 3893241 - RNA, 12 nt, Shigella flexneri 2a str. 301
gauccugaaauu

SEQ ID NO: 3893242 - RNA, 15 nt, Shigella flexneri 2a str. 301
gauccugcaacagca

SEQ ID NO: 3893243 - RNA, 15 nt, Shigella flexneri 2a str. 301
gauccugcacuuuca

SEQ ID NO: 3893244 - RNA, 22 nt, Shigella flexneri 2a str. 301
gauccuggcgaaaacgcccggc

SEQ ID NO: 3893245 - RNA, 23 nt, Shigella flexneri 2a str. 301
gauccuggcggggauuauugccg

SEQ ID NO: 3893246 - RNA, 15 nt, Shigella flexneri 2a str. 301
gauccuucuguucuu

SEQ ID NO: 3893247 - RNA, 16 nt, Shigella flexneri 2a str. 301
gauccuuuuucccaaa

SEQ ID NO: 3893248 - RNA, 15 nt, Shigella flexneri 2a str. 301
gaucgaacagcagca

SEQ ID NO: 3893249 - RNA, 15 nt, Shigella flexneri 2a str. 301
gaucgaucauauuuc

SEQ ID NO: 3893250 - RNA, 13 nt, Shigella flexneri 2a str. 301
gaucgauggcagu

SEQ ID NO: 3893251 - RNA, 16 nt, Shigella flexneri 2a str. 301
gaucgcauggcggauc

SEQ ID NO: 3893252 - RNA, 15 nt, Shigella flexneri 2a str. 301
gaucgccaauaucaa

SEQ ID NO: 3893253 - RNA, 11 nt, Shigella flexneri 2a str. 301
gaucgccauau

SEQ ID NO: 3893254 - RNA, 14 nt, Shigella flexneri 2a str. 301
gaucgccauauuuc

SEQ ID NO: 3893255 - RNA, 20 nt, Shigella flexneri 2a str. 301
gaucgccccggaagcaucaa

SEQ ID NO: 3893256 - RNA, 17 nt, Shigella flexneri 2a str. 301
gaucgccccggucauca

SEQ ID NO: 3893257 - RNA, 13 nt, Shigella flexneri 2a str. 301
gaucgcccgccaa

SEQ ID NO: 3893258 - RNA, 19 nt, Shigella flexneri 2a str. 301
gaucgccgcacuuucuccu

SEQ ID NO: 3893259 - RNA, 17 nt, Shigella flexneri 2a str. 301
gaucgccguaacgcccu

SEQ ID NO: 3893260 - RNA, 18 nt, Shigella flexneri 2a str. 301
gaucgccugaauuacugg

SEQ ID NO: 3893261 - RNA, 21 nt, Shigella flexneri 2a str. 301
gaucgccugcagggcuuucac

SEQ ID NO: 3893262 - RNA, 20 nt, Shigella flexneri 2a str. 301
gaucgccugguaccagcacc

SEQ ID NO: 3893263 - RNA, 14 nt, Shigella flexneri 2a str. 301
gaucgcgaucgcca

SEQ ID NO: 3893264 - RNA, 18 nt, Shigella flexneri 2a str. 301
gaucgcgcaaacagugac

SEQ ID NO: 3893265 - RNA, 13 nt, Shigella flexneri 2a str. 301
gaucgcgcaguaa

SEQ ID NO: 3893266 - RNA, 21 nt, Shigella flexneri 2a str. 301
gaucgcgccagaaagcagcau

SEQ ID NO: 3893267 - RNA, 14 nt, Shigella flexneri 2a str. 301
gaucgcgccgccgc

SEQ ID NO: 3893268 - RNA, 13 nt, Shigella flexneri 2a str. 301
gaucgcguaauaa

SEQ ID NO: 3893269 - RNA, 21 nt, Shigella flexneri 2a str. 301
gaucgcuaaggguauagaagc

SEQ ID NO: 3893270 - RNA, 19 nt, Shigella flexneri 2a str. 301
gaucgcucaucugcugcgu

SEQ ID NO: 3893271 - RNA, 20 nt, Shigella flexneri 2a str. 301
gaucgcugaacgcaccuucc

SEQ ID NO: 3893272 - RNA, 14 nt, Shigella flexneri 2a str. 301
gaucgcuucggucu

SEQ ID NO: 3893273 - RNA, 23 nt, Shigella flexneri 2a str. 301
gaucgcuuucgcuacuucaaaca

SEQ ID NO: 3893274 - RNA, 21 nt, Shigella flexneri 2a str. 301
gaucggacuucaugcgcagca

SEQ ID NO: 3893275 - RNA, 17 nt, Shigella flexneri 2a str. 301
gaucggaggcagcgucu

SEQ ID NO: 3893276 - RNA, 18 nt, Shigella flexneri 2a str. 301
gaucggcguacuggcaau

SEQ ID NO: 3893277 - RNA, 15 nt, Shigella flexneri 2a str. 301
gaucgggcauuucca

SEQ ID NO: 3893278 - RNA, 22 nt, Shigella flexneri 2a str. 301
gaucguaagaauaaucaucggc

SEQ ID NO: 3893279 - RNA, 17 nt, Shigella flexneri 2a str. 301
gaucgugcgcgccguga

SEQ ID NO: 3893280 - RNA, 22 nt, Shigella flexneri 2a str. 301
gaucguggccaugaccgccgca

SEQ ID NO: 3893281 - RNA, 20 nt, Shigella flexneri 2a str. 301
gaucgugugccaccagcgca

SEQ ID NO: 3893282 - RNA, 22 nt, Shigella flexneri 2a str. 301
gaucguguggauaauccauccc

SEQ ID NO: 3893283 - RNA, 16 nt, Shigella flexneri 2a str. 301
gaucguugcgcugguc

SEQ ID NO: 3893284 - RNA, 19 nt, Shigella flexneri 2a str. 301
gaucuaugucgcauccggc

SEQ ID NO: 3893285 - RNA, 13 nt, Shigella flexneri 2a str. 301
gaucucaaacggu

SEQ ID NO: 3893286 - RNA, 20 nt, Shigella flexneri 2a str. 301
gaucucaagacaauuagugg

SEQ ID NO: 3893287 - RNA, 12 nt, Shigella flexneri 2a str. 301
gaucucaccacg

SEQ ID NO: 3893288 - RNA, 13 nt, Shigella flexneri 2a str. 301
gaucuccgccuga

SEQ ID NO: 3893289 - RNA, 17 nt, Shigella flexneri 2a str. 301
gaucuccucaccauucc

SEQ ID NO: 3893290 - RNA, 17 nt, Shigella flexneri 2a str. 301
gaucuccuuggagaaag

SEQ ID NO: 3893291 - RNA, 22 nt, Shigella flexneri 2a str. 301
gaucucgccagugaccaccguc

SEQ ID NO: 3893292 - RNA, 14 nt, Shigella flexneri 2a str. 301
gaucucgguaacga

SEQ ID NO: 3893293 - RNA, 12 nt, Shigella flexneri 2a str. 301
gaucucuuccag

SEQ ID NO: 3893294 - RNA, 23 nt, Shigella flexneri 2a str. 301
gaucucuuccagugccucaagaa

SEQ ID NO: 3893295 - RNA, 17 nt, Shigella flexneri 2a str. 301
gaucucuucgccugccu

SEQ ID NO: 3893296 - RNA, 20 nt, Shigella flexneri 2a str. 301
gaucucuucgccugccugca

SEQ ID NO: 3893297 - RNA, 15 nt, Shigella flexneri 2a str. 301
gaucugauggaaaau

SEQ ID NO: 3893298 - RNA, 14 nt, Shigella flexneri 2a str. 301
gaucugauucugau

SEQ ID NO: 3893299 - RNA, 16 nt, Shigella flexneri 2a str. 301
gaucugauuuuccucc

SEQ ID NO: 3893300 - RNA, 23 nt, Shigella flexneri 2a str. 301
gaucugauuuuccuccagcagca

SEQ ID NO: 3893301 - RNA, 19 nt, Shigella flexneri 2a str. 301
gaucugcgcccaauauccu

SEQ ID NO: 3893302 - RNA, 15 nt, Shigella flexneri 2a str. 301
gaucugcgccugcac

SEQ ID NO: 3893303 - RNA, 18 nt, Shigella flexneri 2a str. 301
gaucugcgucgcuuucca

SEQ ID NO: 3893304 - RNA, 18 nt, Shigella flexneri 2a str. 301
gaucuggaauggaaacag

SEQ ID NO: 3893305 - RNA, 16 nt, Shigella flexneri 2a str. 301
gaucuguugcuggcuu

SEQ ID NO: 3893306 - RNA, 17 nt, Shigella flexneri 2a str. 301
gaucuuaugauguaaau

SEQ ID NO: 3893307 - RNA, 18 nt, Shigella flexneri 2a str. 301
gaucuuaugauguaaaua

SEQ ID NO: 3893308 - RNA, 18 nt, Shigella flexneri 2a str. 301
gaucuuccgcgucauuca

SEQ ID NO: 3893309 - RNA, 21 nt, Shigella flexneri 2a str. 301
gaucuugcgaccgcucuuuuu

SEQ ID NO: 3893310 - RNA, 17 nt, Shigella flexneri 2a str. 301
gaucuuuaucaaucacc

SEQ ID NO: 3893311 - RNA, 20 nt, Shigella flexneri 2a str. 301
gaucuuuaucaaucaccgcu

SEQ ID NO: 3893312 - RNA, 13 nt, Shigella flexneri 2a str. 301
gaucuuucacgcc

SEQ ID NO: 3893313 - RNA, 17 nt, Shigella flexneri 2a str. 301
gaucuuugacugaaauu

SEQ ID NO: 3893314 - RNA, 19 nt, Shigella flexneri 2a str. 301
gaucuuugacugaaauuua

SEQ ID NO: 3893315 - RNA, 23 nt, Shigella flexneri 2a str. 301
gaugaaaaaaccagaaagggaag

SEQ ID NO: 3893316 - RNA, 20 nt, Shigella flexneri 2a str. 301
gaugaaacguguuucucaaa

SEQ ID NO: 3893317 - RNA, 14 nt, Shigella flexneri 2a str. 301
gaugaaagaaaaaa

SEQ ID NO: 3893318 - RNA, 15 nt, Shigella flexneri 2a str. 301
gaugaacaacccuaa

SEQ ID NO: 3893319 - RNA, 19 nt, Shigella flexneri 2a str. 301
gaugaaguccacgcgguag

SEQ ID NO: 3893320 - RNA, 13 nt, Shigella flexneri 2a str. 301
gaugaauaaaauu

SEQ ID NO: 3893321 - RNA, 23 nt, Shigella flexneri 2a str. 301
gaugaauaaaauucuccagcgcc

SEQ ID NO: 3893322 - RNA, 18 nt, Shigella flexneri 2a str. 301
gaugaaucaguaggugca

SEQ ID NO: 3893323 - RNA, 22 nt, Shigella flexneri 2a str. 301
gaugaauuugugaacagccugu

SEQ ID NO: 3893324 - RNA, 22 nt, Shigella flexneri 2a str. 301
gaugacaaacuugauagaacaa

SEQ ID NO: 3893325 - RNA, 12 nt, Shigella flexneri 2a str. 301
gaugacagacuc

SEQ ID NO: 3893326 - RNA, 15 nt, Shigella flexneri 2a str. 301
gaugacaucgcagca

SEQ ID NO: 3893327 - RNA, 14 nt, Shigella flexneri 2a str. 301
gaugacaugcaaug

SEQ ID NO: 3893328 - RNA, 17 nt, Shigella flexneri 2a str. 301
gaugaccuugucaugca

SEQ ID NO: 3893329 - RNA, 20 nt, Shigella flexneri 2a str. 301
gaugaggcguuaacagcgca

SEQ ID NO: 3893330 - RNA, 14 nt, Shigella flexneri 2a str. 301
gaugagggcgcuaa

SEQ ID NO: 3893331 - RNA, 14 nt, Shigella flexneri 2a str. 301
gaugaguugaaaac

SEQ ID NO: 3893332 - RNA, 19 nt, Shigella flexneri 2a str. 301
gaugauaguuuucuaugcg

SEQ ID NO: 3893333 - RNA, 21 nt, Shigella flexneri 2a str. 301
gaugauaguuuucuaugcgcu

SEQ ID NO: 3893334 - RNA, 19 nt, Shigella flexneri 2a str. 301
gauguggugcaaggaaaua

SEQ ID NO: 3893335 - RNA, 17 nt, Shigella flexneri 2a str. 301
gauguguugcaaauaau

SEQ ID NO: 3893336 - RNA, 14 nt, Shigella flexneri 2a str. 301
gauguucaauaaaa

SEQ ID NO: 3893337 - RNA, 13 nt, Shigella flexneri 2a str. 301
gauguuccgccau

SEQ ID NO: 3893338 - RNA, 18 nt, Shigella flexneri 2a str. 301
gauguugccacacgccca

SEQ ID NO: 3893339 - RNA, 21 nt, Shigella flexneri 2a str. 301
gauguuguacagcgaaacaua

SEQ ID NO: 3893340 - RNA, 18 nt, Shigella flexneri 2a str. 301
gauguuguuuuuaaccaa

SEQ ID NO: 3893341 - RNA, 18 nt, Shigella flexneri 2a str. 301
gauuaaaaacccugcaga

SEQ ID NO: 3893342 - RNA, 21 nt, Shigella flexneri 2a str. 301
gauuaaacaagguuugaaaaa

SEQ ID NO: 3893343 - RNA, 18 nt, Shigella flexneri 2a str. 301
gauuaaacuucaccagca

SEQ ID NO: 3893344 - RNA, 18 nt, Shigella flexneri 2a str. 301
gauuaacgcgccggaaau

SEQ ID NO: 3893345 - RNA, 23 nt, Shigella flexneri 2a str. 301
gauuaacugggcgucaaagugaa

SEQ ID NO: 3893346 - RNA, 17 nt, Shigella flexneri 2a str. 301
gauuaagugaaccuuaa

SEQ ID NO: 3893347 - RNA, 18 nt, Shigella flexneri 2a str. 301
gauuaauaaaauuaucca

SEQ ID NO: 3893348 - RNA, 13 nt, Shigella flexneri 2a str. 301
gauuaauuacaca

SEQ ID NO: 3893349 - RNA, 18 nt, Shigella flexneri 2a str. 301
gauuaauuucccaccacu

SEQ ID NO: 3893350 - RNA, 13 nt, Shigella flexneri 2a str. 301
gauuacaaauaaa

SEQ ID NO: 3893351 - RNA, 20 nt, Shigella flexneri 2a str. 301
gauuaccagcgacaucaccg

SEQ ID NO: 3893352 - RNA, 14 nt, Shigella flexneri 2a str. 301
gauuaccauuucac

SEQ ID NO: 3893353 - RNA, 22 nt, Shigella flexneri 2a str. 301
gauuaccuuccucaauuaacau

SEQ ID NO: 3893354 - RNA, 18 nt, Shigella flexneri 2a str. 301
gauuacgcaccgggcagg

SEQ ID NO: 3893355 - RNA, 18 nt, Shigella flexneri 2a str. 301
gauuacgcgcucaccgcu

SEQ ID NO: 3893356 - RNA, 19 nt, Shigella flexneri 2a str. 301
gauuacucgccuuucacac

SEQ ID NO: 3893357 - RNA, 21 nt, Shigella flexneri 2a str. 301
gauuacucguuaucagaaccg

SEQ ID NO: 3893358 - RNA, 15 nt, Shigella flexneri 2a str. 301
gauuacuguacagau

SEQ ID NO: 3893359 - RNA, 15 nt, Shigella flexneri 2a str. 301
gauuacuuaacuuau

SEQ ID NO: 3893360 - RNA, 17 nt, Shigella flexneri 2a str. 301
gauuacuuuauuuauau

SEQ ID NO: 3893361 - RNA, 20 nt, Shigella flexneri 2a str. 301
gauuagcccccguuuuguug

SEQ ID NO: 3893362 - RNA, 17 nt, Shigella flexneri 2a str. 301
gauuauauggaaaaaua

SEQ ID NO: 3893363 - RNA, 15 nt, Shigella flexneri 2a str. 301
gauuaugaucgccac

SEQ ID NO: 3893364 - RNA, 20 nt, Shigella flexneri 2a str. 301
gauuaugcgcggcauacagc

SEQ ID NO: 3893365 - RNA, 13 nt, Shigella flexneri 2a str. 301
gauuauucacaau

SEQ ID NO: 3893366 - RNA, 22 nt, Shigella flexneri 2a str. 301
gauuauugcuugaucaggaaau

SEQ ID NO: 3893367 - RNA, 23 nt, Shigella flexneri 2a str. 301
gauuauuggacgguaaaaagaaa

SEQ ID NO: 3893368 - RNA, 13 nt, Shigella flexneri 2a str. 301
gauuauuucgcug

SEQ ID NO: 3893369 - RNA, 18 nt, Shigella flexneri 2a str. 301
gauucaaaagaugagaaa

SEQ ID NO: 3893370 - RNA, 19 nt, Shigella flexneri 2a str. 301
gauucaagauuagccugaa

SEQ ID NO: 3893371 - RNA, 18 nt, Shigella flexneri 2a str. 301
gauucacacaguucuucu

SEQ ID NO: 3893372 - RNA, 17 nt, Shigella flexneri 2a str. 301
gauucacauuuaaacaa

SEQ ID NO: 3893373 - RNA, 18 nt, Shigella flexneri 2a str. 301
gauucacgccaaccagcu

SEQ ID NO: 3893374 - RNA, 17 nt, Shigella flexneri 2a str. 301
gauucagauaaucccca

SEQ ID NO: 3893375 - RNA, 23 nt, Shigella flexneri 2a str. 301
gauucagauaauccccaaugacc

SEQ ID NO: 3893376 - RNA, 22 nt, Shigella flexneri 2a str. 301
gauucagcccgagguuauuuug

SEQ ID NO: 3893377 - RNA, 21 nt, Shigella flexneri 2a str. 301
gauucagcgucgucagcaguu

SEQ ID NO: 3893378 - RNA, 16 nt, Shigella flexneri 2a str. 301
gauucaucucuucuuc

SEQ ID NO: 3893379 - RNA, 12 nt, Shigella flexneri 2a str. 301
gauucaugcugc

SEQ ID NO: 3893380 - RNA, 19 nt, Shigella flexneri 2a str. 301
gauucauugagcugcaacc

SEQ ID NO: 3893381 - RNA, 20 nt, Shigella flexneri 2a str. 301
gauucauugagcugcaacca

SEQ ID NO: 3893382 - RNA, 13 nt, Shigella flexneri 2a str. 301
gauuccacucauu

SEQ ID NO: 3893383 - RNA, 14 nt, Shigella flexneri 2a str. 301
gauucccagucauc

SEQ ID NO: 3893384 - RNA, 19 nt, Shigella flexneri 2a str. 301
gauucccagucauccggcu

SEQ ID NO: 3893385 - RNA, 18 nt, Shigella flexneri 2a str. 301
gauucccauuauuucaac

SEQ ID NO: 3893386 - RNA, 15 nt, Shigella flexneri 2a str. 301
gauucccccggugcc

SEQ ID NO: 3893387 - RNA, 20 nt, Shigella flexneri 2a str. 301
gauuccugcgcuuccagcuc

SEQ ID NO: 3893388 - RNA, 11 nt, Shigella flexneri 2a str. 301
gauucgaaccu

SEQ ID NO: 3893389 - RNA, 15 nt, Shigella flexneri 2a str. 301
gauucgcccgcagcc

SEQ ID NO: 3893390 - RNA, 17 nt, Shigella flexneri 2a str. 301
gauucgcccugcauauu

SEQ ID NO: 3893391 - RNA, 19 nt, Shigella flexneri 2a str. 301
gauucguugguaaugacuc

SEQ ID NO: 3893392 - RNA, 17 nt, Shigella flexneri 2a str. 301
gauucguuuuucuucag

SEQ ID NO: 3893393 - RNA, 22 nt, Shigella flexneri 2a str. 301
gauucugagaaacucaguugau

SEQ ID NO: 3893394 - RNA, 15 nt, Shigella flexneri 2a str. 301
gauucugauccugca

SEQ ID NO: 3893395 - RNA, 23 nt, Shigella flexneri 2a str. 301
gauucuguguaaaugccuuucuc

SEQ ID NO: 3893396 - RNA, 18 nt, Shigella flexneri 2a str. 301
gauugagcuuuaucccuu

SEQ ID NO: 3893397 - RNA, 16 nt, Shigella flexneri 2a str. 301
gauugauuuaucaggu

SEQ ID NO: 3893398 - RNA, 22 nt, Shigella flexneri 2a str. 301
gauugcaacaagaggcaauagu

SEQ ID NO: 3893399 - RNA, 20 nt, Shigella flexneri 2a str. 301
gauugcaccaccagacgagc

SEQ ID NO: 3893400 - RNA, 18 nt, Shigella flexneri 2a str. 301
gauugcacuugcuuaaaa

SEQ ID NO: 3893401 - RNA, 19 nt, Shigella flexneri 2a str. 301
gauugcacuugcuuaaaau

SEQ ID NO: 3893402 - RNA, 19 nt, Shigella flexneri 2a str. 301
gauugcaggggagcugcaa

SEQ ID NO: 3893403 - RNA, 20 nt, Shigella flexneri 2a str. 301
gauugccacccugcggcugc

SEQ ID NO: 3893404 - RNA, 23 nt, Shigella flexneri 2a str. 301
gauugccagcauaaucaccauca

SEQ ID NO: 3893405 - RNA, 24 nt, Shigella flexneri 2a str. 301
gauugcccuguuugucgaucauca

SEQ ID NO: 3893406 - RNA, 12 nt, Shigella flexneri 2a str. 301
gauugccgauau

SEQ ID NO: 3893407 - RNA, 19 nt, Shigella flexneri 2a str. 301
gauugccgauauaaaccau

SEQ ID NO: 3893408 - RNA, 18 nt, Shigella flexneri 2a str. 301
gauugcuccugcucauca

SEQ ID NO: 3893409 - RNA, 16 nt, Shigella flexneri 2a str. 301
gauugcuucaguugcc

SEQ ID NO: 3893410 - RNA, 10 nt, Shigella flexneri 2a str. 301
gauugcuucu

SEQ ID NO: 3893411 - RNA, 12 nt, Shigella flexneri 2a str. 301
gauugcuucugc

SEQ ID NO: 3893412 - RNA, 13 nt, Shigella flexneri 2a str. 301
gauugcuucugcu

SEQ ID NO: 3893413 - RNA, 19 nt, Shigella flexneri 2a str. 301
gauuguugauuaacaggcu

SEQ ID NO: 3893414 - RNA, 17 nt, Shigella flexneri 2a str. 301
gauuuaaaaaauggcca

SEQ ID NO: 3893415 - RNA, 23 nt, Shigella flexneri 2a str. 301
gauuuaaacaccugggcaauggu

SEQ ID NO: 3893416 - RNA, 22 nt, Shigella flexneri 2a str. 301
gauuuaaccaacaauaaaauug

SEQ ID NO: 3893417 - RNA, 13 nt, Shigella flexneri 2a str. 301
gauuuaauaacaa

SEQ ID NO: 3893418 - RNA, 19 nt, Shigella flexneri 2a str. 301
gauuuaaucuguaucaggc

SEQ ID NO: 3893419 - RNA, 18 nt, Shigella flexneri 2a str. 301
gauuuacagucugcuccc

SEQ ID NO: 3893420 - RNA, 22 nt, Shigella flexneri 2a str. 301
gauuuaccguuaagcuggaaau

SEQ ID NO: 3893421 - RNA, 16 nt, Shigella flexneri 2a str. 301
gauuuacgcucuucca

SEQ ID NO: 3893422 - RNA, 20 nt, Shigella flexneri 2a str. 301
gauuuacuacguaauuucaa

SEQ ID NO: 3893423 - RNA, 17 nt, Shigella flexneri 2a str. 301
gauuuaugauauuuuuu

SEQ ID NO: 3893424 - RNA, 20 nt, Shigella flexneri 2a str. 301
gauuuauguaccgucaucgc

SEQ ID NO: 3893425 - RNA, 21 nt, Shigella flexneri 2a str. 301
gauuucaccaauuccgcagcg

SEQ ID NO: 3893426 - RNA, 17 nt, Shigella flexneri 2a str. 301
gauuucagcaccgcgcu

SEQ ID NO: 3893427 - RNA, 12 nt, Shigella flexneri 2a str. 301
gauuucaucgcc

SEQ ID NO: 3893428 - RNA, 11 nt, Shigella flexneri 2a str. 301
gauuucauuca

SEQ ID NO: 3893429 - RNA, 22 nt, Shigella flexneri 2a str. 301
gauuuccaagcgcggcaggcau

SEQ ID NO: 3893430 - RNA, 17 nt, Shigella flexneri 2a str. 301
gauuuccaucuccagcu

SEQ ID NO: 3893431 - RNA, 23 nt, Shigella flexneri 2a str. 301
gauuucgcaacgacaccguuaaa

SEQ ID NO: 3893432 - RNA, 15 nt, Shigella flexneri 2a str. 301
gauuucuccccccuc

SEQ ID NO: 3893433 - RNA, 12 nt, Shigella flexneri 2a str. 301
gcaacaacugaa

SEQ ID NO: 3893434 - RNA, 22 nt, Shigella flexneri 2a str. 301
gcaacaaugcucucuucgccaa

SEQ ID NO: 3893435 - RNA, 19 nt, Shigella flexneri 2a str. 301
gcaacaauggcauuuaucu

SEQ ID NO: 3893436 - RNA, 20 nt, Shigella flexneri 2a str. 301
gcaacagaaacgccauccag

SEQ ID NO: 3893437 - RNA, 14 nt, Shigella flexneri 2a str. 301
gcaacagaacgcgc

SEQ ID NO: 3893438 - RNA, 17 nt, Shigella flexneri 2a str. 301
gcaacagaacgcgccuu

SEQ ID NO: 3893439 - RNA, 17 nt, Shigella flexneri 2a str. 301
gcaacagcaauacguuu

SEQ ID NO: 3893440 - RNA, 23 nt, Shigella flexneri 2a str. 301
gcaacagcgccgagcaccgaccc

SEQ ID NO: 3893441 - RNA, 12 nt, Shigella flexneri 2a str. 301
gcaacaggccag

SEQ ID NO: 3893442 - RNA, 16 nt, Shigella flexneri 2a str. 301
gcaacaguaauaaugc

SEQ ID NO: 3893443 - RNA, 15 nt, Shigella flexneri 2a str. 301
gcaacauacugcccg

SEQ ID NO: 3893444 - RNA, 19 nt, Shigella flexneri 2a str. 301
gcaacaugaaacagaaaau

SEQ ID NO: 3893445 - RNA, 19 nt, Shigella flexneri 2a str. 301
gcaacaugucagcaaucac

SEQ ID NO: 3893446 - RNA, 15 nt, Shigella flexneri 2a str. 301
gcaacauguugaauc

SEQ ID NO: 3893447 - RNA, 18 nt, Shigella flexneri 2a str. 301
gcaacauguugaaucuuc

SEQ ID NO: 3893448 - RNA, 22 nt, Shigella flexneri 2a str. 301
gcaacauuaaauacagcuuaau

SEQ ID NO: 3893449 - RNA, 22 nt, Shigella flexneri 2a str. 301
gcaacauugcgccucaccggau

SEQ ID NO: 3893450 - RNA, 22 nt, Shigella flexneri 2a str. 301
gcaaccaacgccagcagcagcg

SEQ ID NO: 3893451 - RNA, 13 nt, Shigella flexneri 2a str. 301
gcaaccaacggcc

SEQ ID NO: 3893452 - RNA, 16 nt, Shigella flexneri 2a str. 301
gcaaccacaaccgccg

SEQ ID NO: 3893453 - RNA, 14 nt, Shigella flexneri 2a str. 301
gcaaccacaacgca

SEQ ID NO: 3893454 - RNA, 13 nt, Shigella flexneri 2a str. 301
gcaaccaccguuu

SEQ ID NO: 3893455 - RNA, 13 nt, Shigella flexneri 2a str. 301
gcaaccagcaccg

SEQ ID NO: 3893456 - RNA, 15 nt, Shigella flexneri 2a str. 301
gcaaccagcaggcug

SEQ ID NO: 3893457 - RNA, 23 nt, Shigella flexneri 2a str. 301
gcaaccagcccaugaaucagcaa

SEQ ID NO: 3893458 - RNA, 17 nt, Shigella flexneri 2a str. 301
gcaacccagaagaaagc

SEQ ID NO: 3893459 - RNA, 13 nt, Shigella flexneri 2a str. 301
gcaacccccacac

SEQ ID NO: 3893460 - RNA, 14 nt, Shigella flexneri 2a str. 301
gcaaccgagcgccc

SEQ ID NO: 3893461 - RNA, 14 nt, Shigella flexneri 2a str. 301
gcaaccggcgcggc

SEQ ID NO: 3893462 - RNA, 22 nt, Shigella flexneri 2a str. 301
gcaaccggggcauucaugaaca

SEQ ID NO: 3893463 - RNA, 19 nt, Shigella flexneri 2a str. 301
gcaaccgguaaagaagagc

SEQ ID NO: 3893464 - RNA, 23 nt, Shigella flexneri 2a str. 301
gcaaccgguaaagaagagcggca

SEQ ID NO: 3893465 - RNA, 13 nt, Shigella flexneri 2a str. 301
gcaaccguaaacg

SEQ ID NO: 3893466 - RNA, 20 nt, Shigella flexneri 2a str. 301
gcaaccgucguggucgugau

SEQ ID NO: 3893467 - RNA, 15 nt, Shigella flexneri 2a str. 301
gcaaccguggugagu

SEQ ID NO: 3893468 - RNA, 16 nt, Shigella flexneri 2a str. 301
gcaaccuuuuccauug

SEQ ID NO: 3893469 - RNA, 23 nt, Shigella flexneri 2a str. 301
gcaaccuuuuccauugccgcaga

SEQ ID NO: 3893470 - RNA, 14 nt, Shigella flexneri 2a str. 301
gcaacgaaagguga

SEQ ID NO: 3893471 - RNA, 19 nt, Shigella flexneri 2a str. 301
gcaacgaacuaaccgcgcu

SEQ ID NO: 3893472 - RNA, 21 nt, Shigella flexneri 2a str. 301
gcaacgacaccguuaaauaac

SEQ ID NO: 3893473 - RNA, 22 nt, Shigella flexneri 2a str. 301
gcaacgagacgguuaaaaacag

SEQ ID NO: 3893474 - RNA, 17 nt, Shigella flexneri 2a str. 301
gcaacgcccaucaacau

SEQ ID NO: 3893475 - RNA, 16 nt, Shigella flexneri 2a str. 301
gcaacgccuaaacuaa

SEQ ID NO: 3893476 - RNA, 23 nt, Shigella flexneri 2a str. 301
gcaacgccuaaacuaaucgacag

SEQ ID NO: 3893477 - RNA, 17 nt, Shigella flexneri 2a str. 301
gcaacgccucaugcagg

SEQ ID NO: 3893478 - RNA, 20 nt, Shigella flexneri 2a str. 301
gcaacgcuucaaccaacgca

SEQ ID NO: 3893479 - RNA, 22 nt, Shigella flexneri 2a str. 301
gcaacggcuucgccaaaucgcu

SEQ ID NO: 3893480 - RNA, 18 nt, Shigella flexneri 2a str. 301
gcaacgucaguaaccgcu

SEQ ID NO: 3893481 - RNA, 12 nt, Shigella flexneri 2a str. 301
gcaacgucaguc

SEQ ID NO: 3893482 - RNA, 23 nt, Shigella flexneri 2a str. 301
gcaacguccugagcauuugcacc

SEQ ID NO: 3893483 - RNA, 15 nt, Shigella flexneri 2a str. 301
gcaacgucuucccga

SEQ ID NO: 3893484 - RNA, 18 nt, Shigella flexneri 2a str. 301
gcaacgugguuugcggca

SEQ ID NO: 3893485 - RNA, 13 nt, Shigella flexneri 2a str. 301
gcaacguuccagc

SEQ ID NO: 3893486 - RNA, 15 nt, Shigella flexneri 2a str. 301
gcaacuacguuuuua

SEQ ID NO: 3893487 - RNA, 19 nt, Shigella flexneri 2a str. 301
gcaacucauuuacagaaac

SEQ ID NO: 3893488 - RNA, 20 nt, Shigella flexneri 2a str. 301
gcaacucauuuacagaaacu

SEQ ID NO: 3893489 - RNA, 16 nt, Shigella flexneri 2a str. 301
gcaacucgaugcugcc

SEQ ID NO: 3893490 - RNA, 18 nt, Shigella flexneri 2a str. 301
gcaacugacugacuucaa

SEQ ID NO: 3893491 - RNA, 17 nt, Shigella flexneri 2a str. 301
gcaacugacuggcucuu

SEQ ID NO: 3893492 - RNA, 19 nt, Shigella flexneri 2a str. 301
gcaacugaggcaauaauga

SEQ ID NO: 3893493 - RNA, 22 nt, Shigella flexneri 2a str. 301
gcaacugcuucaaaaaaauucu

SEQ ID NO: 3893494 - RNA, 16 nt, Shigella flexneri 2a str. 301
gcaacuggagcaggaa

SEQ ID NO: 3893495 - RNA, 15 nt, Shigella flexneri 2a str. 301
gcaacuguaacgcag

SEQ ID NO: 3893496 - RNA, 22 nt, Shigella flexneri 2a str. 301
gcaacuuuagccgguuuuucaa

SEQ ID NO: 3893497 - RNA, 13 nt, Shigella flexneri 2a str. 301
gcaagaaauaccg

SEQ ID NO: 3893498 - RNA, 19 nt, Shigella flexneri 2a str. 301
gcaagaauaauaccgucca

SEQ ID NO: 3893499 - RNA, 15 nt, Shigella flexneri 2a str. 301
gcaagagcaaauaaa

SEQ ID NO: 3893500 - RNA, 16 nt, Shigella flexneri 2a str. 301
gcaagagcaaauaaaa

SEQ ID NO: 3893501 - RNA, 17 nt, Shigella flexneri 2a str. 301
gcaagagcaggcuuuug

SEQ ID NO: 3893502 - RNA, 19 nt, Shigella flexneri 2a str. 301
gcaagaucgcucaucagcu

SEQ ID NO: 3893503 - RNA, 21 nt, Shigella flexneri 2a str. 301
gcaagcaccaggguaaaugca

SEQ ID NO: 3893504 - RNA, 19 nt, Shigella flexneri 2a str. 301
gcaagcaggucggcucagc

SEQ ID NO: 3893505 - RNA, 18 nt, Shigella flexneri 2a str. 301
gcaagccacaauaaacgc

SEQ ID NO: 3893506 - RNA, 20 nt, Shigella flexneri 2a str. 301
gcaagccgcuaacagcagca

SEQ ID NO: 3893507 - RNA, 13 nt, Shigella flexneri 2a str. 301
gcaagccugaaaa

SEQ ID NO: 3893508 - RNA, 17 nt, Shigella flexneri 2a str. 301
gcaagcgacucgguugc

SEQ ID NO: 3893509 - RNA, 20 nt, Shigella flexneri 2a str. 301
gcaagcgaguugcgccagua

SEQ ID NO: 3893510 - RNA, 15 nt, Shigella flexneri 2a str. 301
gcaagcggcgacuga

SEQ ID NO: 3893511 - RNA, 19 nt, Shigella flexneri 2a str. 301
gcaagcgggcggugguauu

SEQ ID NO: 3893512 - RNA, 15 nt, Shigella flexneri 2a str. 301
gcaagcgggguaaau

SEQ ID NO: 3893513 - RNA, 24 nt, Shigella flexneri 2a str. 301
gcaagcgggguaaaugccaucagg

SEQ ID NO: 3893514 - RNA, 22 nt, Shigella flexneri 2a str. 301
gcaaggaaacuaaacgccgcgc

SEQ ID NO: 3893515 - RNA, 18 nt, Shigella flexneri 2a str. 301
gcaaggaaagccacugug

SEQ ID NO: 3893516 - RNA, 13 nt, Shigella flexneri 2a str. 301
gcaaggaaauaau

SEQ ID NO: 3893517 - RNA, 14 nt, Shigella flexneri 2a str. 301
gcaaggccauccgc

SEQ ID NO: 3893518 - RNA, 18 nt, Shigella flexneri 2a str. 301
gcaaggcuggcgucacua

SEQ ID NO: 3893519 - RNA, 23 nt, Shigella flexneri 2a str. 301
gcaaggugaaagcaauuaacagu

SEQ ID NO: 3893520 - RNA, 14 nt, Shigella flexneri 2a str. 301
gcaaggugugggca

SEQ ID NO: 3893521 - RNA, 15 nt, Shigella flexneri 2a str. 301
gcaaguaauaauauc

SEQ ID NO: 3893522 - RNA, 16 nt, Shigella flexneri 2a str. 301
gcaaguagcgccauac

SEQ ID NO: 3893523 - RNA, 16 nt, Shigella flexneri 2a str. 301
gcaaguccccaguaau

SEQ ID NO: 3893524 - RNA, 22 nt, Shigella flexneri 2a str. 301
gcaagugcggcgcaccagcagg

SEQ ID NO: 3893525 - RNA, 19 nt, Shigella flexneri 2a str. 301
gcaaguuucgugcuuagau

SEQ ID NO: 3893526 - RNA, 14 nt, Shigella flexneri 2a str. 301
gcaauaaaacaggg

SEQ ID NO: 3893527 - RNA, 18 nt, Shigella flexneri 2a str. 301
gcaauaaaauaucuucca

SEQ ID NO: 3893528 - RNA, 19 nt, Shigella flexneri 2a str. 301
gcaauaaaauaucuuccac

SEQ ID NO: 3893529 - RNA, 18 nt, Shigella flexneri 2a str. 301
gcaauaaccaucagcugu

SEQ ID NO: 3893530 - RNA, 21 nt, Shigella flexneri 2a str. 301
gcaauaauagccccaaccgaa

SEQ ID NO: 3893531 - RNA, 15 nt, Shigella flexneri 2a str. 301
gcaauaaucucuaca

SEQ ID NO: 3893532 - RNA, 20 nt, Shigella flexneri 2a str. 301
gcaauaaucucuuuacccag

SEQ ID NO: 3893533 - RNA, 18 nt, Shigella flexneri 2a str. 301
gcacacuuuucuuuagcg

SEQ ID NO: 3893534 - RNA, 14 nt, Shigella flexneri 2a str. 301
gcacagaaccggag

SEQ ID NO: 3893535 - RNA, 12 nt, Shigella flexneri 2a str. 301
gcacagaccauc

SEQ ID NO: 3893536 - RNA, 18 nt, Shigella flexneri 2a str. 301
gcacagccagcgcuggca

SEQ ID NO: 3893537 - RNA, 23 nt, Shigella flexneri 2a str. 301
gcacagcggaguaaucgccagca

SEQ ID NO: 3893538 - RNA, 14 nt, Shigella flexneri 2a str. 301
gcacaggcaucacu

SEQ ID NO: 3893539 - RNA, 15 nt, Shigella flexneri 2a str. 301
gcacaggcugcccag

SEQ ID NO: 3893540 - RNA, 18 nt, Shigella flexneri 2a str. 301
gcacagguggcaaacgcc

SEQ ID NO: 3893541 - RNA, 23 nt, Shigella flexneri 2a str. 301
gcacaguagcccaccuacaccgg

SEQ ID NO: 3893542 - RNA, 22 nt, Shigella flexneri 2a str. 301
gcacaguuauaaaaugauacgc

SEQ ID NO: 3893543 - RNA, 17 nt, Shigella flexneri 2a str. 301
gcacauaagucagcccg

SEQ ID NO: 3893544 - RNA, 16 nt, Shigella flexneri 2a str. 301
gcacauacugcaucag

SEQ ID NO: 3893545 - RNA, 14 nt, Shigella flexneri 2a str. 301
gcacauagcaacuu

SEQ ID NO: 3893546 - RNA, 15 nt, Shigella flexneri 2a str. 301
gcacauagcaccacc

SEQ ID NO: 3893547 - RNA, 23 nt, Shigella flexneri 2a str. 301
gcacauagcgugacaccagcaca

SEQ ID NO: 3893548 - RNA, 13 nt, Shigella flexneri 2a str. 301
gcacauauuuuuc

SEQ ID NO: 3893549 - RNA, 15 nt, Shigella flexneri 2a str. 301
gcacaucagccagau

SEQ ID NO: 3893550 - RNA, 16 nt, Shigella flexneri 2a str. 301
gcacaucaucaaagcc

SEQ ID NO: 3893551 - RNA, 17 nt, Shigella flexneri 2a str. 301
gcacaucaucaaagcca

SEQ ID NO: 3893552 - RNA, 17 nt, Shigella flexneri 2a str. 301
gcacauccgcgucggca

SEQ ID NO: 3893553 - RNA, 20 nt, Shigella flexneri 2a str. 301
gcacaucgacggugacacuu

SEQ ID NO: 3893554 - RNA, 17 nt, Shigella flexneri 2a str. 301
gcacaugaugauggcua

SEQ ID NO: 3893555 - RNA, 17 nt, Shigella flexneri 2a str. 301
gcacaugcauaaagcgg

SEQ ID NO: 3893556 - RNA, 12 nt, Shigella flexneri 2a str. 301
gcacaugcugac

SEQ ID NO: 3893557 - RNA, 20 nt, Shigella flexneri 2a str. 301
gcacauugauggcgcuuucg

SEQ ID NO: 3893558 - RNA, 22 nt, Shigella flexneri 2a str. 301
gcacauugccguaauggucugc

SEQ ID NO: 3893559 - RNA, 20 nt, Shigella flexneri 2a str. 301
gcacauugcggacuuccggg

SEQ ID NO: 3893560 - RNA, 14 nt, Shigella flexneri 2a str. 301
gcacauuucaauca

SEQ ID NO: 3893561 - RNA, 17 nt, Shigella flexneri 2a str. 301
gcacauuucacucacgc

SEQ ID NO: 3893562 - RNA, 20 nt, Shigella flexneri 2a str. 301
gcacauuuuguaggccugau

SEQ ID NO: 3893563 - RNA, 21 nt, Shigella flexneri 2a str. 301
gcaccaaacgggcaagccagc

SEQ ID NO: 3893564 - RNA, 14 nt, Shigella flexneri 2a str. 301
gcaccaacaaauag

SEQ ID NO: 3893565 - RNA, 16 nt, Shigella flexneri 2a str. 301
gcaccaacaaauagag

SEQ ID NO: 3893566 - RNA, 22 nt, Shigella flexneri 2a str. 301
gcaccaauagccgcgccgagcg

SEQ ID NO: 3893567 - RNA, 16 nt, Shigella flexneri 2a str. 301
gcaccaauauugacug

SEQ ID NO: 3893568 - RNA, 19 nt, Shigella flexneri 2a str. 301
gcaccaaucaccgccagca

SEQ ID NO: 3893569 - RNA, 20 nt, Shigella flexneri 2a str. 301
gcaccaaucaccgccagcaa

SEQ ID NO: 3893570 - RNA, 17 nt, Shigella flexneri 2a str. 301
gcaccaccaaaaacgcc

SEQ ID NO: 3893571 - RNA, 19 nt, Shigella flexneri 2a str. 301
gcaccaccaaaaacgccau

SEQ ID NO: 3893572 - RNA, 16 nt, Shigella flexneri 2a str. 301
gcaccaccagcagcug

SEQ ID NO: 3893573 - RNA, 19 nt, Shigella flexneri 2a str. 301
gcaccaccagcagcugcuc

SEQ ID NO: 3893574 - RNA, 17 nt, Shigella flexneri 2a str. 301
gcaccaccgcauccggg

SEQ ID NO: 3893575 - RNA, 14 nt, Shigella flexneri 2a str. 301
gcaccaccgcccgu

SEQ ID NO: 3893576 - RNA, 19 nt, Shigella flexneri 2a str. 301
gcaccacgccggaugaaau

SEQ ID NO: 3893577 - RNA, 19 nt, Shigella flexneri 2a str. 301
gcaccacuuccggcaacaa

SEQ ID NO: 3893578 - RNA, 14 nt, Shigella flexneri 2a str. 301
gcaccacuugcaga

SEQ ID NO: 3893579 - RNA, 22 nt, Shigella flexneri 2a str. 301
gcaccagaaaguuuuucaacac

SEQ ID NO: 3893580 - RNA, 19 nt, Shigella flexneri 2a str. 301
gcaccagaauuccguaagc

SEQ ID NO: 3893581 - RNA, 22 nt, Shigella flexneri 2a str. 301
gcaccagcaacaagccagucca

SEQ ID NO: 3893582 - RNA, 19 nt, Shigella flexneri 2a str. 301
gcaccagccccuggaaaaa

SEQ ID NO: 3893583 - RNA, 13 nt, Shigella flexneri 2a str. 301
gcaccagcgcaga

SEQ ID NO: 3893584 - RNA, 22 nt, Shigella flexneri 2a str. 301
gcaccaggcaguuuauccagcc

SEQ ID NO: 3893585 - RNA, 24 nt, Shigella flexneri 2a str. 301
gcaccaguggucuuuagacugcca

SEQ ID NO: 3893586 - RNA, 14 nt, Shigella flexneri 2a str. 301
gcaccauaaaucca

SEQ ID NO: 3893587 - RNA, 15 nt, Shigella flexneri 2a str. 301
gcaccauaaauccaa

SEQ ID NO: 3893588 - RNA, 17 nt, Shigella flexneri 2a str. 301
gcaccaucccuaugcau

SEQ ID NO: 3893589 - RNA, 13 nt, Shigella flexneri 2a str. 301
gcaccaucucuua

SEQ ID NO: 3893590 - RNA, 17 nt, Shigella flexneri 2a str. 301
gcaccauugcugccgcc

SEQ ID NO: 3893591 - RNA, 18 nt, Shigella flexneri 2a str. 301
gcaccauugcugccgcca

SEQ ID NO: 3893592 - RNA, 20 nt, Shigella flexneri 2a str. 301
gcaccauugcugccgccagu

SEQ ID NO: 3893593 - RNA, 17 nt, Shigella flexneri 2a str. 301
gcaccauuuaaaucaau

SEQ ID NO: 3893594 - RNA, 20 nt, Shigella flexneri 2a str. 301
gcacccauuuauccagcggc

SEQ ID NO: 3893595 - RNA, 22 nt, Shigella flexneri 2a str. 301
gcacccauuuauccagcggcag

SEQ ID NO: 3893596 - RNA, 17 nt, Shigella flexneri 2a str. 301
gcaccccugauaaccgc

SEQ ID NO: 3893597 - RNA, 15 nt, Shigella flexneri 2a str. 301
gcacccgccagcgcg

SEQ ID NO: 3893598 - RNA, 14 nt, Shigella flexneri 2a str. 301
gcacccgcguggcc

SEQ ID NO: 3893599 - RNA, 18 nt, Shigella flexneri 2a str. 301
gcacccgcuucagugacu

SEQ ID NO: 3893600 - RNA, 16 nt, Shigella flexneri 2a str. 301
gcaccgacaauccggu

SEQ ID NO: 3893601 - RNA, 17 nt, Shigella flexneri 2a str. 301
gcaccgaccaucggcac

SEQ ID NO: 3893602 - RNA, 16 nt, Shigella flexneri 2a str. 301
gcaccgauugccggau

SEQ ID NO: 3893603 - RNA, 23 nt, Shigella flexneri 2a str. 301
gcaccgcacuggcuuuccagcgu

SEQ ID NO: 3893604 - RNA, 12 nt, Shigella flexneri 2a str. 301
gcaccgccgccg

SEQ ID NO: 3893605 - RNA, 18 nt, Shigella flexneri 2a str. 301
gcaccggaacaacccagc

SEQ ID NO: 3893606 - RNA, 15 nt, Shigella flexneri 2a str. 301
gcaccggacacugcu

SEQ ID NO: 3893607 - RNA, 17 nt, Shigella flexneri 2a str. 301
gcaccggacgcuuguca

SEQ ID NO: 3893608 - RNA, 17 nt, Shigella flexneri 2a str. 301
gcaccgggcuuccggca

SEQ ID NO: 3893609 - RNA, 20 nt, Shigella flexneri 2a str. 301
gcaccggugcgaacaaucac

SEQ ID NO: 3893610 - RNA, 15 nt, Shigella flexneri 2a str. 301
gcaccguaaacggcu

SEQ ID NO: 3893611 - RNA, 16 nt, Shigella flexneri 2a str. 301
gcaccgugacaguaau

SEQ ID NO: 3893612 - RNA, 18 nt, Shigella flexneri 2a str. 301
gcaccguuggcgcuggcg

SEQ ID NO: 3893613 - RNA, 19 nt, Shigella flexneri 2a str. 301
gcaccuaauaacucuccuc

SEQ ID NO: 3893614 - RNA, 24 nt, Shigella flexneri 2a str. 301
gcaccugaguaauuaauacgccag

SEQ ID NO: 3893615 - RNA, 16 nt, Shigella flexneri 2a str. 301
gcaccugauccagcuc

SEQ ID NO: 3893616 - RNA, 15 nt, Shigella flexneri 2a str. 301
gcaccugccagcgcc

SEQ ID NO: 3893617 - RNA, 21 nt, Shigella flexneri 2a str. 301
gcaccuggcgcauuaacggca

SEQ ID NO: 3893618 - RNA, 13 nt, Shigella flexneri 2a str. 301
gcaccuguaccag

SEQ ID NO: 3893619 - RNA, 14 nt, Shigella flexneri 2a str. 301
gcaccuguaccagc

SEQ ID NO: 3893620 - RNA, 17 nt, Shigella flexneri 2a str. 301
gcaccuguaccagcccg

SEQ ID NO: 3893621 - RNA, 16 nt, Shigella flexneri 2a str. 301
gcaccuucacuggacg

SEQ ID NO: 3893622 - RNA, 21 nt, Shigella flexneri 2a str. 301
gcaccuuuaaugcaucagcca

SEQ ID NO: 3893623 - RNA, 12 nt, Shigella flexneri 2a str. 301
gcaccuuuacca

SEQ ID NO: 3893624 - RNA, 24 nt, Shigella flexneri 2a str. 301
gcaccuuuuccaccaauggcggaa

SEQ ID NO: 3893625 - RNA, 16 nt, Shigella flexneri 2a str. 301
gcacgaaaccacugca

SEQ ID NO: 3893626 - RNA, 23 nt, Shigella flexneri 2a str. 301
gcacgaauucaacgcguuuuuuc

SEQ ID NO: 3893627 - RNA, 21 nt, Shigella flexneri 2a str. 301
gcacgacuuucucuucaucua

SEQ ID NO: 3893628 - RNA, 23 nt, Shigella flexneri 2a str. 301
gcacgaguguuacgccugccgca

SEQ ID NO: 3893629 - RNA, 18 nt, Shigella flexneri 2a str. 301
gcacgaugauauggucaa

SEQ ID NO: 3893630 - RNA, 20 nt, Shigella flexneri 2a str. 301
gcacgauuuguaggccggau

SEQ ID NO: 3893631 - RNA, 20 nt, Shigella flexneri 2a str. 301
gcacgauuuuguaggccgga

SEQ ID NO: 3893632 - RNA, 16 nt, Shigella flexneri 2a str. 301
gcacgccccggcggcc

SEQ ID NO: 3893633 - RNA, 16 nt, Shigella flexneri 2a str. 301
gcagagauacaggcca

SEQ ID NO: 3893634 - RNA, 17 nt, Shigella flexneri 2a str. 301
gcagagaucgccccggc

SEQ ID NO: 3893635 - RNA, 22 nt, Shigella flexneri 2a str. 301
gcagagaucgccccggcaagaa

SEQ ID NO: 3893636 - RNA, 22 nt, Shigella flexneri 2a str. 301
gcagagcaaaaaucgacagcag

SEQ ID NO: 3893637 - RNA, 20 nt, Shigella flexneri 2a str. 301
gcagagcauccuuguacucu

SEQ ID NO: 3893638 - RNA, 14 nt, Shigella flexneri 2a str. 301
gcagagccugaaua

SEQ ID NO: 3893639 - RNA, 22 nt, Shigella flexneri 2a str. 301
gcagagccugaauaaacgccau

SEQ ID NO: 3893640 - RNA, 12 nt, Shigella flexneri 2a str. 301
gcagagcuucac

SEQ ID NO: 3893641 - RNA, 19 nt, Shigella flexneri 2a str. 301
gcagagugaagguuucugc

SEQ ID NO: 3893642 - RNA, 13 nt, Shigella flexneri 2a str. 301
gcagaguuuccag

SEQ ID NO: 3893643 - RNA, 18 nt, Shigella flexneri 2a str. 301
gcagaguuuccaggcugg

SEQ ID NO: 3893644 - RNA, 15 nt, Shigella flexneri 2a str. 301
gcagauaacccagca

SEQ ID NO: 3893645 - RNA, 22 nt, Shigella flexneri 2a str. 301
gcagauaacccagcagcccgag

SEQ ID NO: 3893646 - RNA, 23 nt, Shigella flexneri 2a str. 301
gcagauacauugccaccaccagc

SEQ ID NO: 3893647 - RNA, 15 nt, Shigella flexneri 2a str. 301
gcagauaccacauca

SEQ ID NO: 3893648 - RNA, 23 nt, Shigella flexneri 2a str. 301
gcagauaucccgccagcaccagc

SEQ ID NO: 3893649 - RNA, 17 nt, Shigella flexneri 2a str. 301
gcagauauggaaagcgg

SEQ ID NO: 3893650 - RNA, 16 nt, Shigella flexneri 2a str. 301
gcagauauugcacccc

SEQ ID NO: 3893651 - RNA, 16 nt, Shigella flexneri 2a str. 301
gcagaucaaauucaau

SEQ ID NO: 3893652 - RNA, 15 nt, Shigella flexneri 2a str. 301
gcagauccugauuua

SEQ ID NO: 3893653 - RNA, 17 nt, Shigella flexneri 2a str. 301
gcagaucggcauucaca

SEQ ID NO: 3893654 - RNA, 14 nt, Shigella flexneri 2a str. 301
gcagaucuggaagc

SEQ ID NO: 3893655 - RNA, 17 nt, Shigella flexneri 2a str. 301
gcagaugacuugccgca

SEQ ID NO: 3893656 - RNA, 23 nt, Shigella flexneri 2a str. 301
gcagaugcgucuucugcagucac

SEQ ID NO: 3893657 - RNA, 22 nt, Shigella flexneri 2a str. 301
gcagauuagccgguaaaucacc

SEQ ID NO: 3893658 - RNA, 21 nt, Shigella flexneri 2a str. 301
gcagauucagccacauuugcg

SEQ ID NO: 3893659 - RNA, 13 nt, Shigella flexneri 2a str. 301
gcagauuugccag

SEQ ID NO: 3893660 - RNA, 16 nt, Shigella flexneri 2a str. 301
gcagcaaacgaaagca

SEQ ID NO: 3893661 - RNA, 16 nt, Shigella flexneri 2a str. 301
gcagcaaacgauucaa

SEQ ID NO: 3893662 - RNA, 15 nt, Shigella flexneri 2a str. 301
gcagcaaccgcuucc

SEQ ID NO: 3893663 - RNA, 18 nt, Shigella flexneri 2a str. 301
gcagcaaccgguaaagaa

SEQ ID NO: 3893664 - RNA, 20 nt, Shigella flexneri 2a str. 301
gcagcaaccgguaaagaaga

SEQ ID NO: 3893665 - RNA, 21 nt, Shigella flexneri 2a str. 301
gcagcaacgaacuaaccgcgc

SEQ ID NO: 3893666 - RNA, 13 nt, Shigella flexneri 2a str. 301
gcagcaagccauc

SEQ ID NO: 3893667 - RNA, 16 nt, Shigella flexneri 2a str. 301
gcagcaagucggcauc

SEQ ID NO: 3893668 - RNA, 16 nt, Shigella flexneri 2a str. 301
gcagcaauggcacugu

SEQ ID NO: 3893669 - RNA, 15 nt, Shigella flexneri 2a str. 301
gcagcaauugucgca

SEQ ID NO: 3893670 - RNA, 12 nt, Shigella flexneri 2a str. 301
gcagcaccauca

SEQ ID NO: 3893671 - RNA, 21 nt, Shigella flexneri 2a str. 301
gcagcacccagaacgccgaau

SEQ ID NO: 3893672 - RNA, 14 nt, Shigella flexneri 2a str. 301
gcagcaccgauccu

SEQ ID NO: 3893673 - RNA, 17 nt, Shigella flexneri 2a str. 301
gcagcacuacaccccag

SEQ ID NO: 3893674 - RNA, 17 nt, Shigella flexneri 2a str. 301
gcagcagagaaaauauc

SEQ ID NO: 3893675 - RNA, 13 nt, Shigella flexneri 2a str. 301
gcagcagccaagc

SEQ ID NO: 3893676 - RNA, 21 nt, Shigella flexneri 2a str. 301
gcagcagccgguauccagcgc

SEQ ID NO: 3893677 - RNA, 15 nt, Shigella flexneri 2a str. 301
gcagcagccugcgcu

SEQ ID NO: 3893678 - RNA, 12 nt, Shigella flexneri 2a str. 301
gcagcagcgcgc

SEQ ID NO: 3893679 - RNA, 20 nt, Shigella flexneri 2a str. 301
gcagcagucaggcgcgcggu

SEQ ID NO: 3893680 - RNA, 21 nt, Shigella flexneri 2a str. 301
gcagcauaugcaaaaggcugg

SEQ ID NO: 3893681 - RNA, 13 nt, Shigella flexneri 2a str. 301
gcagcaucaccgg

SEQ ID NO: 3893682 - RNA, 16 nt, Shigella flexneri 2a str. 301
gcagcaucaucauaau

SEQ ID NO: 3893683 - RNA, 16 nt, Shigella flexneri 2a str. 301
gcagcaucaugccgcu

SEQ ID NO: 3893684 - RNA, 15 nt, Shigella flexneri 2a str. 301
gcagcaucgccagga

SEQ ID NO: 3893685 - RNA, 16 nt, Shigella flexneri 2a str. 301
gcagcaucgccaggau

SEQ ID NO: 3893686 - RNA, 17 nt, Shigella flexneri 2a str. 301
gcagcaucgcucaccca

SEQ ID NO: 3893687 - RNA, 13 nt, Shigella flexneri 2a str. 301
gcagcaucgucau

SEQ ID NO: 3893688 - RNA, 13 nt, Shigella flexneri 2a str. 301
gcagcaugcaccc

SEQ ID NO: 3893689 - RNA, 16 nt, Shigella flexneri 2a str. 301
gcagcaugcacccuca

SEQ ID NO: 3893690 - RNA, 22 nt, Shigella flexneri 2a str. 301
gcagcaugcacccucaauaacu

SEQ ID NO: 3893691 - RNA, 13 nt, Shigella flexneri 2a str. 301
gcagcauggucag

SEQ ID NO: 3893692 - RNA, 18 nt, Shigella flexneri 2a str. 301
gcagcauguguaaccgcu

SEQ ID NO: 3893693 - RNA, 18 nt, Shigella flexneri 2a str. 301
gcagcauucagguugauc

SEQ ID NO: 3893694 - RNA, 21 nt, Shigella flexneri 2a str. 301
gcagcauucgccgcauugucu

SEQ ID NO: 3893695 - RNA, 21 nt, Shigella flexneri 2a str. 301
gcagcauuucaaaacggucac

SEQ ID NO: 3893696 - RNA, 12 nt, Shigella flexneri 2a str. 301
gcagccaaaaau

SEQ ID NO: 3893697 - RNA, 19 nt, Shigella flexneri 2a str. 301
gcagccaaaaaugacgccc

SEQ ID NO: 3893698 - RNA, 13 nt, Shigella flexneri 2a str. 301
gcagccagcgcgc

SEQ ID NO: 3893699 - RNA, 18 nt, Shigella flexneri 2a str. 301
gcagccagcgucacccag

SEQ ID NO: 3893700 - RNA, 20 nt, Shigella flexneri 2a str. 301
gcagccagcgucacccagac

SEQ ID NO: 3893701 - RNA, 19 nt, Shigella flexneri 2a str. 301
gcagccaggccauuuuuuc

SEQ ID NO: 3893702 - RNA, 15 nt, Shigella flexneri 2a str. 301
gcagccagugauuaa

SEQ ID NO: 3893703 - RNA, 17 nt, Shigella flexneri 2a str. 301
gcagccaucaccacgcu

SEQ ID NO: 3893704 - RNA, 23 nt, Shigella flexneri 2a str. 301
gcagcccauccggcgaauuacca

SEQ ID NO: 3893705 - RNA, 18 nt, Shigella flexneri 2a str. 301
gcagcccauucuccgagg

SEQ ID NO: 3893706 - RNA, 13 nt, Shigella flexneri 2a str. 301
gcagccccgccgg

SEQ ID NO: 3893707 - RNA, 15 nt, Shigella flexneri 2a str. 301
gcagccccgccggga

SEQ ID NO: 3893708 - RNA, 13 nt, Shigella flexneri 2a str. 301
gcagcccgcagcg

SEQ ID NO: 3893709 - RNA, 19 nt, Shigella flexneri 2a str. 301
gcagccgguauccagcgcg

SEQ ID NO: 3893710 - RNA, 20 nt, Shigella flexneri 2a str. 301
gcagccgucgccaguaccag

SEQ ID NO: 3893711 - RNA, 14 nt, Shigella flexneri 2a str. 301
gcagccgugcccaa

SEQ ID NO: 3893712 - RNA, 18 nt, Shigella flexneri 2a str. 301
gcagcgaaccgucgagau

SEQ ID NO: 3893713 - RNA, 22 nt, Shigella flexneri 2a str. 301
gcagcgcaauuaacgccccaag

SEQ ID NO: 3893714 - RNA, 16 nt, Shigella flexneri 2a str. 301
gcagcgccagcgaagc

SEQ ID NO: 3893715 - RNA, 21 nt, Shigella flexneri 2a str. 301
gcagcgccagcgaagccagcu

SEQ ID NO: 3893716 - RNA, 13 nt, Shigella flexneri 2a str. 301
gcagcggcgagau

SEQ ID NO: 3893717 - RNA, 16 nt, Shigella flexneri 2a str. 301
gcagcggcgaucguga

SEQ ID NO: 3893718 - RNA, 19 nt, Shigella flexneri 2a str. 301
gcagcgggcauuuucaggu

SEQ ID NO: 3893719 - RNA, 17 nt, Shigella flexneri 2a str. 301
gcagcgucacucgcugc

SEQ ID NO: 3893720 - RNA, 14 nt, Shigella flexneri 2a str. 301
gcagcgucagcacc

SEQ ID NO: 3893721 - RNA, 15 nt, Shigella flexneri 2a str. 301
gcagcgucagcacca

SEQ ID NO: 3893722 - RNA, 16 nt, Shigella flexneri 2a str. 301
gcagcgucagcaccag

SEQ ID NO: 3893723 - RNA, 17 nt, Shigella flexneri 2a str. 301
gcagcgucgcaucaggc

SEQ ID NO: 3893724 - RNA, 20 nt, Shigella flexneri 2a str. 301
gcagcgucgcaucaggcauu

SEQ ID NO: 3893725 - RNA, 18 nt, Shigella flexneri 2a str. 301
gcagcgugauccaccccu

SEQ ID NO: 3893726 - RNA, 19 nt, Shigella flexneri 2a str. 301
gcagcgugccaggcgcgcu

SEQ ID NO: 3893727 - RNA, 22 nt, Shigella flexneri 2a str. 301
gcagcguggugcugauacgcgc

SEQ ID NO: 3893728 - RNA, 19 nt, Shigella flexneri 2a str. 301
gcagcguuaaugauauccc

SEQ ID NO: 3893729 - RNA, 21 nt, Shigella flexneri 2a str. 301
gcagcguuucgaacaggccga

SEQ ID NO: 3893730 - RNA, 16 nt, Shigella flexneri 2a str. 301
gcagcucaucaagcug

SEQ ID NO: 3893731 - RNA, 18 nt, Shigella flexneri 2a str. 301
gcagcucaucaagcuguu

SEQ ID NO: 3893732 - RNA, 21 nt, Shigella flexneri 2a str. 301
gcagcucgcguucggaaauau

SEQ ID NO: 3893733 - RNA, 23 nt, Shigella flexneri 2a str. 301
gcaguaccuccuucacaguggcg

SEQ ID NO: 3893734 - RNA, 13 nt, Shigella flexneri 2a str. 301
gcaguacgccacc

SEQ ID NO: 3893735 - RNA, 15 nt, Shigella flexneri 2a str. 301
gcaguacgcggcggu

SEQ ID NO: 3893736 - RNA, 17 nt, Shigella flexneri 2a str. 301
gcaguacggcagcaauc

SEQ ID NO: 3893737 - RNA, 20 nt, Shigella flexneri 2a str. 301
gcaguagcgucgccagcagu

SEQ ID NO: 3893738 - RNA, 16 nt, Shigella flexneri 2a str. 301
gcagucaaaucuuaua

SEQ ID NO: 3893739 - RNA, 17 nt, Shigella flexneri 2a str. 301
gcagucacaccagcgau

SEQ ID NO: 3893740 - RNA, 17 nt, Shigella flexneri 2a str. 301
gcagucaccugcccucc

SEQ ID NO: 3893741 - RNA, 19 nt, Shigella flexneri 2a str. 301
gcagucaccugcccuccgg

SEQ ID NO: 3893742 - RNA, 12 nt, Shigella flexneri 2a str. 301
gcagucacggcg

SEQ ID NO: 3893743 - RNA, 17 nt, Shigella flexneri 2a str. 301
gcagucagguucagcgu

SEQ ID NO: 3893744 - RNA, 16 nt, Shigella flexneri 2a str. 301
gcagucauaaaaucaa

SEQ ID NO: 3893745 - RNA, 15 nt, Shigella flexneri 2a str. 301
gcagucauaaccagu

SEQ ID NO: 3893746 - RNA, 19 nt, Shigella flexneri 2a str. 301
gcaguccagcgccugacgc

SEQ ID NO: 3893747 - RNA, 21 nt, Shigella flexneri 2a str. 301
gcaguccagcgccugacgcgg

SEQ ID NO: 3893748 - RNA, 16 nt, Shigella flexneri 2a str. 301
gcagucccuuucccac

SEQ ID NO: 3893749 - RNA, 14 nt, Shigella flexneri 2a str. 301
gcagucuucccagc

SEQ ID NO: 3893750 - RNA, 14 nt, Shigella flexneri 2a str. 301
gcagugacugcccc

SEQ ID NO: 3893751 - RNA, 19 nt, Shigella flexneri 2a str. 301
gcagugaucgugugccacc

SEQ ID NO: 3893752 - RNA, 18 nt, Shigella flexneri 2a str. 301
gcagugcacgaaccagag

SEQ ID NO: 3893753 - RNA, 23 nt, Shigella flexneri 2a str. 301
gcagugcacgaaccagagacaga

SEQ ID NO: 3893754 - RNA, 16 nt, Shigella flexneri 2a str. 301
gcagugcuuucauuuc

SEQ ID NO: 3893755 - RNA, 22 nt, Shigella flexneri 2a str. 301
gcaguggcaaacugaguggagu

SEQ ID NO: 3893756 - RNA, 15 nt, Shigella flexneri 2a str. 301
gcaguggcuucggcg

SEQ ID NO: 3893757 - RNA, 18 nt, Shigella flexneri 2a str. 301
gcaguggguaagccagac

SEQ ID NO: 3893758 - RNA, 19 nt, Shigella flexneri 2a str. 301
gcaguggguaaugcuguga

SEQ ID NO: 3893759 - RNA, 14 nt, Shigella flexneri 2a str. 301
gcaguggugcggcu

SEQ ID NO: 3893760 - RNA, 19 nt, Shigella flexneri 2a str. 301
gcagugguuaacaaucaca

SEQ ID NO: 3893761 - RNA, 20 nt, Shigella flexneri 2a str. 301
gcaguguaacaaaaaacaaa

SEQ ID NO: 3893762 - RNA, 23 nt, Shigella flexneri 2a str. 301
gcaguguuuguuaaaacuuucca

SEQ ID NO: 3893763 - RNA, 18 nt, Shigella flexneri 2a str. 301
gcaguuaaacgccuugcg

SEQ ID NO: 3893764 - RNA, 23 nt, Shigella flexneri 2a str. 301
gcaguuaucugccgaacaggcug

SEQ ID NO: 3893765 - RNA, 18 nt, Shigella flexneri 2a str. 301
gcaguucacagcgcagau

SEQ ID NO: 3893766 - RNA, 13 nt, Shigella flexneri 2a str. 301
gcaguucacgcag

SEQ ID NO: 3893767 - RNA, 13 nt, Shigella flexneri 2a str. 301
gcaguuccgccag

SEQ ID NO: 3893768 - RNA, 18 nt, Shigella flexneri 2a str. 301
gcaguucugccaggcugg

SEQ ID NO: 3893769 - RNA, 17 nt, Shigella flexneri 2a str. 301
gcaguucuggcaccgga

SEQ ID NO: 3893770 - RNA, 18 nt, Shigella flexneri 2a str. 301
gcaguucuggcaccggac

SEQ ID NO: 3893771 - RNA, 16 nt, Shigella flexneri 2a str. 301
gcaguugacagccaca

SEQ ID NO: 3893772 - RNA, 17 nt, Shigella flexneri 2a str. 301
gcaguugcaguaccagu

SEQ ID NO: 3893773 - RNA, 16 nt, Shigella flexneri 2a str. 301
gcaguugcuucaucuc

SEQ ID NO: 3893774 - RNA, 22 nt, Shigella flexneri 2a str. 301
gcaguuggcgcacaaugccuga

SEQ ID NO: 3893775 - RNA, 12 nt, Shigella flexneri 2a str. 301
gcaguuuauaaa

SEQ ID NO: 3893776 - RNA, 21 nt, Shigella flexneri 2a str. 301
gcaguuuauccagccacggcu

SEQ ID NO: 3893777 - RNA, 17 nt, Shigella flexneri 2a str. 301
gcaguuucaccagcagu

SEQ ID NO: 3893778 - RNA, 21 nt, Shigella flexneri 2a str. 301
gcaguuucugauacugcuccg

SEQ ID NO: 3893779 - RNA, 17 nt, Shigella flexneri 2a str. 301
gcaguuuugccuucccc

SEQ ID NO: 3893780 - RNA, 19 nt, Shigella flexneri 2a str. 301
gcauaaaacaacgccaccc

SEQ ID NO: 3893781 - RNA, 13 nt, Shigella flexneri 2a str. 301
gcauaaaccacag

SEQ ID NO: 3893782 - RNA, 22 nt, Shigella flexneri 2a str. 301
gcauaaaccgggcguggaucug

SEQ ID NO: 3893783 - RNA, 13 nt, Shigella flexneri 2a str. 301
gcauaacagagcg

SEQ ID NO: 3893784 - RNA, 21 nt, Shigella flexneri 2a str. 301
gcauaacagauaaaucauaau

SEQ ID NO: 3893785 - RNA, 21 nt, Shigella flexneri 2a str. 301
gcauaacagcccgccaaccac

SEQ ID NO: 3893786 - RNA, 23 nt, Shigella flexneri 2a str. 301
gcauaaccagagagcuuauccag

SEQ ID NO: 3893787 - RNA, 19 nt, Shigella flexneri 2a str. 301
gcauaacgccgguauuuuu

SEQ ID NO: 3893788 - RNA, 22 nt, Shigella flexneri 2a str. 301
gcauaacguugcagcguuucgc

SEQ ID NO: 3893789 - RNA, 15 nt, Shigella flexneri 2a str. 301
gcauaacucaccauc

SEQ ID NO: 3893790 - RNA, 13 nt, Shigella flexneri 2a str. 301
gcauaagccaccu

SEQ ID NO: 3893791 - RNA, 21 nt, Shigella flexneri 2a str. 301
gcauaaucauuacaaccgcug

SEQ ID NO: 3893792 - RNA, 15 nt, Shigella flexneri 2a str. 301
gcauaaucgacauuu

SEQ ID NO: 3893793 - RNA, 14 nt, Shigella flexneri 2a str. 301
gcauaaugcagcca

SEQ ID NO: 3893794 - RNA, 21 nt, Shigella flexneri 2a str. 301
gcauaaugugcgcacauugcc

SEQ ID NO: 3893795 - RNA, 15 nt, Shigella flexneri 2a str. 301
gcauaauuuccagca

SEQ ID NO: 3893796 - RNA, 14 nt, Shigella flexneri 2a str. 301
gcauacaacgccau

SEQ ID NO: 3893797 - RNA, 19 nt, Shigella flexneri 2a str. 301
gcauacaacgccaugaaga

SEQ ID NO: 3893798 - RNA, 21 nt, Shigella flexneri 2a str. 301
gcauacagccaggugauacgu

SEQ ID NO: 3893799 - RNA, 13 nt, Shigella flexneri 2a str. 301
gcauacccagaac

SEQ ID NO: 3893800 - RNA, 13 nt, Shigella flexneri 2a str. 301
gcauaccccuuca

SEQ ID NO: 3893801 - RNA, 23 nt, Shigella flexneri 2a str. 301
gcauaccuucacagaaggccagg

SEQ ID NO: 3893802 - RNA, 20 nt, Shigella flexneri 2a str. 301
gcauacgcugccagccaucu

SEQ ID NO: 3893803 - RNA, 17 nt, Shigella flexneri 2a str. 301
gcauacggguaaaggcg

SEQ ID NO: 3893804 - RNA, 15 nt, Shigella flexneri 2a str. 301
gcauacucuccucca

SEQ ID NO: 3893805 - RNA, 16 nt, Shigella flexneri 2a str. 301
gcauacucuccuccag

SEQ ID NO: 3893806 - RNA, 20 nt, Shigella flexneri 2a str. 301
gcauacucuccuccagguua

SEQ ID NO: 3893807 - RNA, 17 nt, Shigella flexneri 2a str. 301
gcauacugaaccacgga

SEQ ID NO: 3893808 - RNA, 23 nt, Shigella flexneri 2a str. 301
gcauacugcgugucguaagccac

SEQ ID NO: 3893809 - RNA, 14 nt, Shigella flexneri 2a str. 301
gcauacuuucauca

SEQ ID NO: 3893810 - RNA, 14 nt, Shigella flexneri 2a str. 301
gcauagaaaaagaa

SEQ ID NO: 3893811 - RNA, 20 nt, Shigella flexneri 2a str. 301
gcauagagacuuuuccagcc

SEQ ID NO: 3893812 - RNA, 17 nt, Shigella flexneri 2a str. 301
gcauagcagcacaccac

SEQ ID NO: 3893813 - RNA, 22 nt, Shigella flexneri 2a str. 301
gcauagccaccuggcugcguuu

SEQ ID NO: 3893814 - RNA, 16 nt, Shigella flexneri 2a str. 301
gcauagccccagcgca

SEQ ID NO: 3893815 - RNA, 16 nt, Shigella flexneri 2a str. 301
gcauagcgcaauaaca

SEQ ID NO: 3893816 - RNA, 22 nt, Shigella flexneri 2a str. 301
gcauagcuaauccccuccagcg

SEQ ID NO: 3893817 - RNA, 13 nt, Shigella flexneri 2a str. 301
gcauaggcauuaa

SEQ ID NO: 3893818 - RNA, 17 nt, Shigella flexneri 2a str. 301
gcauaggcauuaaacau

SEQ ID NO: 3893819 - RNA, 23 nt, Shigella flexneri 2a str. 301
gcauaggcggcaaacaguuucug

SEQ ID NO: 3893820 - RNA, 15 nt, Shigella flexneri 2a str. 301
gcauauaccacaccc

SEQ ID NO: 3893821 - RNA, 18 nt, Shigella flexneri 2a str. 301
gcauauaccucagcagac

SEQ ID NO: 3893822 - RNA, 16 nt, Shigella flexneri 2a str. 301
gcauaucagcaacucu

SEQ ID NO: 3893823 - RNA, 14 nt, Shigella flexneri 2a str. 301
gcauauccaccacc

SEQ ID NO: 3893824 - RNA, 20 nt, Shigella flexneri 2a str. 301
gcauauccaccacccagcgc

SEQ ID NO: 3893825 - RNA, 17 nt, Shigella flexneri 2a str. 301
gcauaucgacgaaccau

SEQ ID NO: 3893826 - RNA, 18 nt, Shigella flexneri 2a str. 301
gcauaucguagccccagu

SEQ ID NO: 3893827 - RNA, 17 nt, Shigella flexneri 2a str. 301
gcauaugcaaaaggcug

SEQ ID NO: 3893828 - RNA, 18 nt, Shigella flexneri 2a str. 301
gcauaugcgggcguuuug

SEQ ID NO: 3893829 - RNA, 17 nt, Shigella flexneri 2a str. 301
gcauauuccaucgcuac

SEQ ID NO: 3893830 - RNA, 19 nt, Shigella flexneri 2a str. 301
gcauauuccgccaccugcg

SEQ ID NO: 3893831 - RNA, 19 nt, Shigella flexneri 2a str. 301
gcaucaaacgguugauaaa

SEQ ID NO: 3893832 - RNA, 15 nt, Shigella flexneri 2a str. 301
gcaucaaagccaggc

SEQ ID NO: 3893833 - RNA, 19 nt, Shigella flexneri 2a str. 301
gcaugauaccgauuacuca

SEQ ID NO: 3893834 - RNA, 15 nt, Shigella flexneri 2a str. 301
gcaugauagcccgga

SEQ ID NO: 3893835 - RNA, 21 nt, Shigella flexneri 2a str. 301
gcaugauagcccggauuucca

SEQ ID NO: 3893836 - RNA, 20 nt, Shigella flexneri 2a str. 301
gcaugauguaagaugaaaua

SEQ ID NO: 3893837 - RNA, 14 nt, Shigella flexneri 2a str. 301
gcaugcacccucaa

SEQ ID NO: 3893838 - RNA, 12 nt, Shigella flexneri 2a str. 301
gcaugcauaaca

SEQ ID NO: 3893839 - RNA, 14 nt, Shigella flexneri 2a str. 301
gcaugcauaacaga

SEQ ID NO: 3893840 - RNA, 16 nt, Shigella flexneri 2a str. 301
gcaugcaucccgccgu

SEQ ID NO: 3893841 - RNA, 20 nt, Shigella flexneri 2a str. 301
gcaugccuaccaaaccugca

SEQ ID NO: 3893842 - RNA, 19 nt, Shigella flexneri 2a str. 301
gcaugcgaaugcagggccg

SEQ ID NO: 3893843 - RNA, 11 nt, Shigella flexneri 2a str. 301
gcaugcucagu

SEQ ID NO: 3893844 - RNA, 19 nt, Shigella flexneri 2a str. 301
gcaugcucccaaaaacgcg

SEQ ID NO: 3893845 - RNA, 17 nt, Shigella flexneri 2a str. 301
gcauggcaauaaccgcu

SEQ ID NO: 3893846 - RNA, 15 nt, Shigella flexneri 2a str. 301
gcauggcauuuugca

SEQ ID NO: 3893847 - RNA, 13 nt, Shigella flexneri 2a str. 301
gcauggcgcggaa

SEQ ID NO: 3893848 - RNA, 14 nt, Shigella flexneri 2a str. 301
gcauggggagaccc

SEQ ID NO: 3893849 - RNA, 16 nt, Shigella flexneri 2a str. 301
gcauggggaucgugau

SEQ ID NO: 3893850 - RNA, 16 nt, Shigella flexneri 2a str. 301
gcauggggucagggcu

SEQ ID NO: 3893851 - RNA, 23 nt, Shigella flexneri 2a str. 301
gcauggggucagggcuucaaagu

SEQ ID NO: 3893852 - RNA, 21 nt, Shigella flexneri 2a str. 301
gcaugguguucagauggccaa

SEQ ID NO: 3893853 - RNA, 17 nt, Shigella flexneri 2a str. 301
gcaugucacaaauagag

SEQ ID NO: 3893854 - RNA, 24 nt, Shigella flexneri 2a str. 301
gcaugucacaaauagagcgccgga

SEQ ID NO: 3893855 - RNA, 21 nt, Shigella flexneri 2a str. 301
gcaugucgguuguacaaaaaa

SEQ ID NO: 3893856 - RNA, 16 nt, Shigella flexneri 2a str. 301
gcauguguaaccgcuu

SEQ ID NO: 3893857 - RNA, 13 nt, Shigella flexneri 2a str. 301
gcauuaaauugug

SEQ ID NO: 3893858 - RNA, 14 nt, Shigella flexneri 2a str. 301
gcauuaacagccag

SEQ ID NO: 3893859 - RNA, 14 nt, Shigella flexneri 2a str. 301
gcauuaaucugcuc

SEQ ID NO: 3893860 - RNA, 13 nt, Shigella flexneri 2a str. 301
gcauuacaagaau

SEQ ID NO: 3893861 - RNA, 17 nt, Shigella flexneri 2a str. 301
gcauuacgcaauuguuc

SEQ ID NO: 3893862 - RNA, 17 nt, Shigella flexneri 2a str. 301
gcauuacgcucacugca

SEQ ID NO: 3893863 - RNA, 21 nt, Shigella flexneri 2a str. 301
gcauuacuacgguaauacaac

SEQ ID NO: 3893864 - RNA, 13 nt, Shigella flexneri 2a str. 301
gcauuacugcuau

SEQ ID NO: 3893865 - RNA, 22 nt, Shigella flexneri 2a str. 301
gcauuacuuucggugacuucaa

SEQ ID NO: 3893866 - RNA, 14 nt, Shigella flexneri 2a str. 301
gcauuauccagcga

SEQ ID NO: 3893867 - RNA, 15 nt, Shigella flexneri 2a str. 301
gcauucacgccgcau

SEQ ID NO: 3893868 - RNA, 16 nt, Shigella flexneri 2a str. 301
gcauucagaguaucca

SEQ ID NO: 3893869 - RNA, 22 nt, Shigella flexneri 2a str. 301
gcauucagugcaaaugccagau

SEQ ID NO: 3893870 - RNA, 14 nt, Shigella flexneri 2a str. 301
gcauucaugaacac

SEQ ID NO: 3893871 - RNA, 24 nt, Shigella flexneri 2a str. 301
gcauucgaguaacguucugucucc

SEQ ID NO: 3893872 - RNA, 18 nt, Shigella flexneri 2a str. 301
gcauucucacuccagcca

SEQ ID NO: 3893873 - RNA, 12 nt, Shigella flexneri 2a str. 301
gcauucucauca

SEQ ID NO: 3893874 - RNA, 19 nt, Shigella flexneri 2a str. 301
gcauugaacucuucuuccg

SEQ ID NO: 3893875 - RNA, 15 nt, Shigella flexneri 2a str. 301
gcauugacaagcuca

SEQ ID NO: 3893876 - RNA, 22 nt, Shigella flexneri 2a str. 301
gcauugacgauaucgauaaaga

SEQ ID NO: 3893877 - RNA, 19 nt, Shigella flexneri 2a str. 301
gcauugagggcauuauucg

SEQ ID NO: 3893878 - RNA, 14 nt, Shigella flexneri 2a str. 301
gcauugcgccugca

SEQ ID NO: 3893879 - RNA, 17 nt, Shigella flexneri 2a str. 301
gcauugcucccugcggc

SEQ ID NO: 3893880 - RNA, 22 nt, Shigella flexneri 2a str. 301
gcauugcuuugguggucaccau

SEQ ID NO: 3893881 - RNA, 14 nt, Shigella flexneri 2a str. 301
gcauuggacagauu

SEQ ID NO: 3893882 - RNA, 16 nt, Shigella flexneri 2a str. 301
gcauuggguauucauu

SEQ ID NO: 3893883 - RNA, 21 nt, Shigella flexneri 2a str. 301
gcauuggguuacuuaaugcug

SEQ ID NO: 3893884 - RNA, 18 nt, Shigella flexneri 2a str. 301
gcauuguguugccgggcg

SEQ ID NO: 3893885 - RNA, 18 nt, Shigella flexneri 2a str. 301
gcauuguuugcaaaauca

SEQ ID NO: 3893886 - RNA, 22 nt, Shigella flexneri 2a str. 301
gcauuuaugccauguucaucaa

SEQ ID NO: 3893887 - RNA, 16 nt, Shigella flexneri 2a str. 301
gcauuucccagcaaga

SEQ ID NO: 3893888 - RNA, 17 nt, Shigella flexneri 2a str. 301
gcauuucccagcaagaa

SEQ ID NO: 3893889 - RNA, 17 nt, Shigella flexneri 2a str. 301
gcauuucgccaaaccaa

SEQ ID NO: 3893890 - RNA, 21 nt, Shigella flexneri 2a str. 301
gcauuucuccgcguucaauac

SEQ ID NO: 3893891 - RNA, 19 nt, Shigella flexneri 2a str. 301
gcauuugagcaggaugccu

SEQ ID NO: 3893892 - RNA, 22 nt, Shigella flexneri 2a str. 301
gcauuugcaccgauugccggau

SEQ ID NO: 3893893 - RNA, 22 nt, Shigella flexneri 2a str. 301
gcauuugcacugaaugccggau

SEQ ID NO: 3893894 - RNA, 17 nt, Shigella flexneri 2a str. 301
gcauuugcuccagacgc

SEQ ID NO: 3893895 - RNA, 23 nt, Shigella flexneri 2a str. 301
gcauuuggcucucgaugccugau

SEQ ID NO: 3893896 - RNA, 14 nt, Shigella flexneri 2a str. 301
gcauuuuacauccu

SEQ ID NO: 3893897 - RNA, 13 nt, Shigella flexneri 2a str. 301
gcauuuucgucaa

SEQ ID NO: 3893898 - RNA, 12 nt, Shigella flexneri 2a str. 301
gcauuuucucgc

SEQ ID NO: 3893899 - RNA, 19 nt, Shigella flexneri 2a str. 301
gcauuuucucgcggacugc

SEQ ID NO: 3893900 - RNA, 15 nt, Shigella flexneri 2a str. 301
gcauuuucugcgcau

SEQ ID NO: 3893901 - RNA, 11 nt, Shigella flexneri 2a str. 301
gcauuuugcag

SEQ ID NO: 3893902 - RNA, 13 nt, Shigella flexneri 2a str. 301
gcauuuugcagau

SEQ ID NO: 3893903 - RNA, 16 nt, Shigella flexneri 2a str. 301
gcauuuugcaguaaca

SEQ ID NO: 3893904 - RNA, 19 nt, Shigella flexneri 2a str. 301
gcauuuugcggaucugcuc

SEQ ID NO: 3893905 - RNA, 13 nt, Shigella flexneri 2a str. 301
gcauuuugcugau

SEQ ID NO: 3893906 - RNA, 19 nt, Shigella flexneri 2a str. 301
gcauuuuuucacauguuca

SEQ ID NO: 3893907 - RNA, 22 nt, Shigella flexneri 2a str. 301
gccaaaaaucgcaaauugacua

SEQ ID NO: 3893908 - RNA, 15 nt, Shigella flexneri 2a str. 301
gccaaaauaacuuaa

SEQ ID NO: 3893909 - RNA, 16 nt, Shigella flexneri 2a str. 301
gccaaaauaacuuaau

SEQ ID NO: 3893910 - RNA, 12 nt, Shigella flexneri 2a str. 301
gccaaaaucucu

SEQ ID NO: 3893911 - RNA, 17 nt, Shigella flexneri 2a str. 301
gccaaacagaccaaugg

SEQ ID NO: 3893912 - RNA, 12 nt, Shigella flexneri 2a str. 301
gccaaacaugca

SEQ ID NO: 3893913 - RNA, 15 nt, Shigella flexneri 2a str. 301
gccaaacgcucccug

SEQ ID NO: 3893914 - RNA, 19 nt, Shigella flexneri 2a str. 301
gccaaacgcucccugccag

SEQ ID NO: 3893915 - RNA, 17 nt, Shigella flexneri 2a str. 301
gccaaacucaccaucgg

SEQ ID NO: 3893916 - RNA, 19 nt, Shigella flexneri 2a str. 301
gccaaagcaccacuccuca

SEQ ID NO: 3893917 - RNA, 20 nt, Shigella flexneri 2a str. 301
gccaaagcaccacuccucaa

SEQ ID NO: 3893918 - RNA, 13 nt, Shigella flexneri 2a str. 301
gccaaagccgccg

SEQ ID NO: 3893919 - RNA, 16 nt, Shigella flexneri 2a str. 301
gccaaagccgccgagc

SEQ ID NO: 3893920 - RNA, 17 nt, Shigella flexneri 2a str. 301
gccaaagccgccgagca

SEQ ID NO: 3893921 - RNA, 18 nt, Shigella flexneri 2a str. 301
gccaaagcggcaguuaaa

SEQ ID NO: 3893922 - RNA, 17 nt, Shigella flexneri 2a str. 301
gccaaagggcuggcaau

SEQ ID NO: 3893923 - RNA, 20 nt, Shigella flexneri 2a str. 301
gccaaaguacggacgcggca

SEQ ID NO: 3893924 - RNA, 23 nt, Shigella flexneri 2a str. 301
gccaaagugacacaaucaaaucc

SEQ ID NO: 3893925 - RNA, 19 nt, Shigella flexneri 2a str. 301
gccaaaguuaucgagcugc

SEQ ID NO: 3893926 - RNA, 21 nt, Shigella flexneri 2a str. 301
gccaaaucauccagaccgcuc

SEQ ID NO: 3893927 - RNA, 21 nt, Shigella flexneri 2a str. 301
gccaaaucauccagacugcuc

SEQ ID NO: 3893928 - RNA, 15 nt, Shigella flexneri 2a str. 301
gccaaauccagcgca

SEQ ID NO: 3893929 - RNA, 18 nt, Shigella flexneri 2a str. 301
gccaaauccagcgccaca

SEQ ID NO: 3893930 - RNA, 14 nt, Shigella flexneri 2a str. 301
gccaaauccggcaa

SEQ ID NO: 3893931 - RNA, 19 nt, Shigella flexneri 2a str. 301
gccaaauccggcaaauaac

SEQ ID NO: 3893932 - RNA, 14 nt, Shigella flexneri 2a str. 301
gccaaaucgcugcu

SEQ ID NO: 3893933 - RNA, 22 nt, Shigella flexneri 2a str. 301
gccacggcgaccguucgccagg

SEQ ID NO: 3893934 - RNA, 13 nt, Shigella flexneri 2a str. 301
gccacggcuccag

SEQ ID NO: 3893935 - RNA, 14 nt, Shigella flexneri 2a str. 301
gccacggcuccagc

SEQ ID NO: 3893936 - RNA, 13 nt, Shigella flexneri 2a str. 301
gccacgguaaaac

SEQ ID NO: 3893937 - RNA, 15 nt, Shigella flexneri 2a str. 301
gccacgguaaaaccg

SEQ ID NO: 3893938 - RNA, 19 nt, Shigella flexneri 2a str. 301
gccacgguaucaagcccgc

SEQ ID NO: 3893939 - RNA, 21 nt, Shigella flexneri 2a str. 301
gccacgguaucaagcccgccg

SEQ ID NO: 3893940 - RNA, 13 nt, Shigella flexneri 2a str. 301
gccacgucaucag

SEQ ID NO: 3893941 - RNA, 13 nt, Shigella flexneri 2a str. 301
gccacgucauccg

SEQ ID NO: 3893942 - RNA, 13 nt, Shigella flexneri 2a str. 301
gccacuaacgcau

SEQ ID NO: 3893943 - RNA, 17 nt, Shigella flexneri 2a str. 301
gccacucgauaccagau

SEQ ID NO: 3893944 - RNA, 20 nt, Shigella flexneri 2a str. 301
gccacucggacaccucacca

SEQ ID NO: 3893945 - RNA, 20 nt, Shigella flexneri 2a str. 301
gccacugcccgagaacagca

SEQ ID NO: 3893946 - RNA, 11 nt, Shigella flexneri 2a str. 301
gccacuggccc

SEQ ID NO: 3893947 - RNA, 12 nt, Shigella flexneri 2a str. 301
gccacuggcgcg

SEQ ID NO: 3893948 - RNA, 19 nt, Shigella flexneri 2a str. 301
gccacuguuccggagaagc

SEQ ID NO: 3893949 - RNA, 18 nt, Shigella flexneri 2a str. 301
gccacuucguaaccagcc

SEQ ID NO: 3893950 - RNA, 20 nt, Shigella flexneri 2a str. 301
gccacuucguaaccagccug

SEQ ID NO: 3893951 - RNA, 11 nt, Shigella flexneri 2a str. 301
gccacuucugc

SEQ ID NO: 3893952 - RNA, 14 nt, Shigella flexneri 2a str. 301
gccacuucugccag

SEQ ID NO: 3893953 - RNA, 15 nt, Shigella flexneri 2a str. 301
gccacuucuuccagc

SEQ ID NO: 3893954 - RNA, 20 nt, Shigella flexneri 2a str. 301
gccacuucuuccagcggcag

SEQ ID NO: 3893955 - RNA, 22 nt, Shigella flexneri 2a str. 301
gccacuuucucacucaccgcag

SEQ ID NO: 3893956 - RNA, 21 nt, Shigella flexneri 2a str. 301
gccacuuuucggcaaccgcau

SEQ ID NO: 3893957 - RNA, 16 nt, Shigella flexneri 2a str. 301
gccacuuuuugcucaa

SEQ ID NO: 3893958 - RNA, 14 nt, Shigella flexneri 2a str. 301
gccagaaaaccugg

SEQ ID NO: 3893959 - RNA, 20 nt, Shigella flexneri 2a str. 301
gccagaaaaccuggcgcagu

SEQ ID NO: 3893960 - RNA, 21 nt, Shigella flexneri 2a str. 301
gccagaaaaccuggcgcagug

SEQ ID NO: 3893961 - RNA, 13 nt, Shigella flexneri 2a str. 301
gccagaaagaacc

SEQ ID NO: 3893962 - RNA, 12 nt, Shigella flexneri 2a str. 301
gccagaaaguac

SEQ ID NO: 3893963 - RNA, 12 nt, Shigella flexneri 2a str. 301
gccagaaaucag

SEQ ID NO: 3893964 - RNA, 14 nt, Shigella flexneri 2a str. 301
gccagaaaucagcu

SEQ ID NO: 3893965 - RNA, 13 nt, Shigella flexneri 2a str. 301
gccagaaauccag

SEQ ID NO: 3893966 - RNA, 18 nt, Shigella flexneri 2a str. 301
gccagaaauccaggcccg

SEQ ID NO: 3893967 - RNA, 20 nt, Shigella flexneri 2a str. 301
gccagaacacuguuaccgcu

SEQ ID NO: 3893968 - RNA, 19 nt, Shigella flexneri 2a str. 301
gccagaacagcuacagcau

SEQ ID NO: 3893969 - RNA, 21 nt, Shigella flexneri 2a str. 301
gccagaaccgcguagggcgga

SEQ ID NO: 3893970 - RNA, 13 nt, Shigella flexneri 2a str. 301
gccagaagcccgg

SEQ ID NO: 3893971 - RNA, 21 nt, Shigella flexneri 2a str. 301
gccagaauaacgugaucgaac

SEQ ID NO: 3893972 - RNA, 21 nt, Shigella flexneri 2a str. 301
gccagaauagccgcagccauc

SEQ ID NO: 3893973 - RNA, 13 nt, Shigella flexneri 2a str. 301
gccagaaucccca

SEQ ID NO: 3893974 - RNA, 17 nt, Shigella flexneri 2a str. 301
gccagaauccccacugc

SEQ ID NO: 3893975 - RNA, 14 nt, Shigella flexneri 2a str. 301
gccagacaauugcc

SEQ ID NO: 3893976 - RNA, 22 nt, Shigella flexneri 2a str. 301
gccagacaccccuucauucagg

SEQ ID NO: 3893977 - RNA, 14 nt, Shigella flexneri 2a str. 301
gccagacagcauca

SEQ ID NO: 3893978 - RNA, 20 nt, Shigella flexneri 2a str. 301
gccagaccacugcgccgcuc

SEQ ID NO: 3893979 - RNA, 16 nt, Shigella flexneri 2a str. 301
gccagaccgcagaagc

SEQ ID NO: 3893980 - RNA, 22 nt, Shigella flexneri 2a str. 301
gccagaccuaccaucuccugca

SEQ ID NO: 3893981 - RNA, 22 nt, Shigella flexneri 2a str. 301
gccagaccugcgacauauuccc

SEQ ID NO: 3893982 - RNA, 22 nt, Shigella flexneri 2a str. 301
gccagacgaauaaaacagaaac

SEQ ID NO: 3893983 - RNA, 12 nt, Shigella flexneri 2a str. 301
gccagacgcuga

SEQ ID NO: 3893984 - RNA, 22 nt, Shigella flexneri 2a str. 301
gccagacgguagccccgcuuca

SEQ ID NO: 3893985 - RNA, 23 nt, Shigella flexneri 2a str. 301
gccagacgguagccccgcuucag

SEQ ID NO: 3893986 - RNA, 13 nt, Shigella flexneri 2a str. 301
gccagacugcgcu

SEQ ID NO: 3893987 - RNA, 20 nt, Shigella flexneri 2a str. 301
gccagacugcgcuaccagga

SEQ ID NO: 3893988 - RNA, 12 nt, Shigella flexneri 2a str. 301
gccagagagcga

SEQ ID NO: 3893989 - RNA, 15 nt, Shigella flexneri 2a str. 301
gccagaggagccauc

SEQ ID NO: 3893990 - RNA, 22 nt, Shigella flexneri 2a str. 301
gccagaguggauuaucuucacc

SEQ ID NO: 3893991 - RNA, 19 nt, Shigella flexneri 2a str. 301
gccagauaaauauuauugg

SEQ ID NO: 3893992 - RNA, 21 nt, Shigella flexneri 2a str. 301
gccagauaaauauuauuggca

SEQ ID NO: 3893993 - RNA, 13 nt, Shigella flexneri 2a str. 301
gccagauaagaca

SEQ ID NO: 3893994 - RNA, 15 nt, Shigella flexneri 2a str. 301
gccagauaagacacu

SEQ ID NO: 3893995 - RNA, 15 nt, Shigella flexneri 2a str. 301
gccagauaagacgcg

SEQ ID NO: 3893996 - RNA, 16 nt, Shigella flexneri 2a str. 301
gccagauaauggcugu

SEQ ID NO: 3893997 - RNA, 23 nt, Shigella flexneri 2a str. 301
gccagauauugauucaucucuuc

SEQ ID NO: 3893998 - RNA, 17 nt, Shigella flexneri 2a str. 301
gccagaugccuugccaa

SEQ ID NO: 3893999 - RNA, 14 nt, Shigella flexneri 2a str. 301
gccagauggcaucc

SEQ ID NO: 3894000 - RNA, 16 nt, Shigella flexneri 2a str. 301
gccagauggcauccag

SEQ ID NO: 3894001 - RNA, 18 nt, Shigella flexneri 2a str. 301
gccagauggcuuugcccu

SEQ ID NO: 3894002 - RNA, 14 nt, Shigella flexneri 2a str. 301
gccagauguugucu

SEQ ID NO: 3894003 - RNA, 15 nt, Shigella flexneri 2a str. 301
gccagauguugucuc

SEQ ID NO: 3894004 - RNA, 16 nt, Shigella flexneri 2a str. 301
gccagauucuccaaca

SEQ ID NO: 3894005 - RNA, 19 nt, Shigella flexneri 2a str. 301
gccagcaaaaucaccauca

SEQ ID NO: 3894006 - RNA, 14 nt, Shigella flexneri 2a str. 301
gccagcaaauagau

SEQ ID NO: 3894007 - RNA, 14 nt, Shigella flexneri 2a str. 301
gccagcaacacaua

SEQ ID NO: 3894008 - RNA, 22 nt, Shigella flexneri 2a str. 301
gccagcaacaucaaaugcgcag

SEQ ID NO: 3894009 - RNA, 22 nt, Shigella flexneri 2a str. 301
gccagcaacugacugacuucaa

SEQ ID NO: 3894010 - RNA, 17 nt, Shigella flexneri 2a str. 301
gccagcaacugauaaac

SEQ ID NO: 3894011 - RNA, 19 nt, Shigella flexneri 2a str. 301
gccagcaagagcaaauaaa

SEQ ID NO: 3894012 - RNA, 21 nt, Shigella flexneri 2a str. 301
gccagcacagaucgcacuuaa

SEQ ID NO: 3894013 - RNA, 18 nt, Shigella flexneri 2a str. 301
gccagcagagggauaucu

SEQ ID NO: 3894014 - RNA, 14 nt, Shigella flexneri 2a str. 301
gccagcagccauuc

SEQ ID NO: 3894015 - RNA, 17 nt, Shigella flexneri 2a str. 301
gccagcagggcaaacag

SEQ ID NO: 3894016 - RNA, 23 nt, Shigella flexneri 2a str. 301
gccagcagggcaaacagcacggu

SEQ ID NO: 3894017 - RNA, 17 nt, Shigella flexneri 2a str. 301
gccagcaguuucuucug

SEQ ID NO: 3894018 - RNA, 22 nt, Shigella flexneri 2a str. 301
gccagcauaaucaccaucagca

SEQ ID NO: 3894019 - RNA, 15 nt, Shigella flexneri 2a str. 301
gccagcauacagcuu

SEQ ID NO: 3894020 - RNA, 14 nt, Shigella flexneri 2a str. 301
gccagcauccggca

SEQ ID NO: 3894021 - RNA, 19 nt, Shigella flexneri 2a str. 301
gccagcaucggcagcgcca

SEQ ID NO: 3894022 - RNA, 17 nt, Shigella flexneri 2a str. 301
gccagcaugaccaccgg

SEQ ID NO: 3894023 - RNA, 14 nt, Shigella flexneri 2a str. 301
gccagcaugacuac

SEQ ID NO: 3894024 - RNA, 18 nt, Shigella flexneri 2a str. 301
gccagcauggcaccugcg

SEQ ID NO: 3894025 - RNA, 21 nt, Shigella flexneri 2a str. 301
gccagcauucccgccagcggc

SEQ ID NO: 3894026 - RNA, 15 nt, Shigella flexneri 2a str. 301
gccagccaagcaugu

SEQ ID NO: 3894027 - RNA, 21 nt, Shigella flexneri 2a str. 301
gccagccaagcaugucauaca

SEQ ID NO: 3894028 - RNA, 16 nt, Shigella flexneri 2a str. 301
gccagccacaccacuu

SEQ ID NO: 3894029 - RNA, 16 nt, Shigella flexneri 2a str. 301
gccagccagcaccagg

SEQ ID NO: 3894030 - RNA, 12 nt, Shigella flexneri 2a str. 301
gccagccagcca

SEQ ID NO: 3894031 - RNA, 12 nt, Shigella flexneri 2a str. 301
gccagccauccg

SEQ ID NO: 3894032 - RNA, 13 nt, Shigella flexneri 2a str. 301
gccagccccagcg

SEQ ID NO: 3894033 - RNA, 20 nt, Shigella flexneri 2a str. 301
gccauaaacugagccaaacg

SEQ ID NO: 3894034 - RNA, 17 nt, Shigella flexneri 2a str. 301
gccauaaauguugccgu

SEQ ID NO: 3894035 - RNA, 13 nt, Shigella flexneri 2a str. 301
gccauaaauuuac

SEQ ID NO: 3894036 - RNA, 15 nt, Shigella flexneri 2a str. 301
gccauaaauuuaccu

SEQ ID NO: 3894037 - RNA, 23 nt, Shigella flexneri 2a str. 301
gccauaaccacgcagcgccgcgu

SEQ ID NO: 3894038 - RNA, 20 nt, Shigella flexneri 2a str. 301
gccauaaccccaccagcaug

SEQ ID NO: 3894039 - RNA, 22 nt, Shigella flexneri 2a str. 301
gccauaacggcuguccauacgu

SEQ ID NO: 3894040 - RNA, 14 nt, Shigella flexneri 2a str. 301
gccauaauaaucau

SEQ ID NO: 3894041 - RNA, 16 nt, Shigella flexneri 2a str. 301
gccauaauaaucauca

SEQ ID NO: 3894042 - RNA, 18 nt, Shigella flexneri 2a str. 301
gccauaauauugauaaua

SEQ ID NO: 3894043 - RNA, 15 nt, Shigella flexneri 2a str. 301
gccauacagacaccc

SEQ ID NO: 3894044 - RNA, 21 nt, Shigella flexneri 2a str. 301
gccauacccgccagugcugaa

SEQ ID NO: 3894045 - RNA, 18 nt, Shigella flexneri 2a str. 301
gccauacggaaaaucuca

SEQ ID NO: 3894046 - RNA, 18 nt, Shigella flexneri 2a str. 301
gccauagaaaggaccaaa

SEQ ID NO: 3894047 - RNA, 16 nt, Shigella flexneri 2a str. 301
gccauaucauucgaca

SEQ ID NO: 3894048 - RNA, 20 nt, Shigella flexneri 2a str. 301
gccauauuguuucaacacag

SEQ ID NO: 3894049 - RNA, 14 nt, Shigella flexneri 2a str. 301
gccaucaaauagcc

SEQ ID NO: 3894050 - RNA, 14 nt, Shigella flexneri 2a str. 301
gccaucaacacuuu

SEQ ID NO: 3894051 - RNA, 16 nt, Shigella flexneri 2a str. 301
gccaucaauaaccagc

SEQ ID NO: 3894052 - RNA, 17 nt, Shigella flexneri 2a str. 301
gccaucaaugccgcaac

SEQ ID NO: 3894053 - RNA, 18 nt, Shigella flexneri 2a str. 301
gccaucaaugccgcaacu

SEQ ID NO: 3894054 - RNA, 15 nt, Shigella flexneri 2a str. 301
gccaucaaugugcug

SEQ ID NO: 3894055 - RNA, 14 nt, Shigella flexneri 2a str. 301
gccaucaauugcuc

SEQ ID NO: 3894056 - RNA, 14 nt, Shigella flexneri 2a str. 301
gccaucacugacug

SEQ ID NO: 3894057 - RNA, 15 nt, Shigella flexneri 2a str. 301
gccaucacugacugc

SEQ ID NO: 3894058 - RNA, 12 nt, Shigella flexneri 2a str. 301
gccaucagcagc

SEQ ID NO: 3894059 - RNA, 14 nt, Shigella flexneri 2a str. 301
gccaucagcagcgg

SEQ ID NO: 3894060 - RNA, 15 nt, Shigella flexneri 2a str. 301
gccaucagugccagu

SEQ ID NO: 3894061 - RNA, 17 nt, Shigella flexneri 2a str. 301
gccaucauacgauggcc

SEQ ID NO: 3894062 - RNA, 14 nt, Shigella flexneri 2a str. 301
gccauccagcagac

SEQ ID NO: 3894063 - RNA, 18 nt, Shigella flexneri 2a str. 301
gccaucccuaccgcccgc

SEQ ID NO: 3894064 - RNA, 20 nt, Shigella flexneri 2a str. 301
gccaucccugucguccagac

SEQ ID NO: 3894065 - RNA, 15 nt, Shigella flexneri 2a str. 301
gccauccgcugcggu

SEQ ID NO: 3894066 - RNA, 13 nt, Shigella flexneri 2a str. 301
gccauccguaauu

SEQ ID NO: 3894067 - RNA, 15 nt, Shigella flexneri 2a str. 301
gccauccgucaucca

SEQ ID NO: 3894068 - RNA, 14 nt, Shigella flexneri 2a str. 301
gccauccguuucag

SEQ ID NO: 3894069 - RNA, 21 nt, Shigella flexneri 2a str. 301
gccaucgcauagcgcaauaac

SEQ ID NO: 3894070 - RNA, 16 nt, Shigella flexneri 2a str. 301
gccaucgccagcagcc

SEQ ID NO: 3894071 - RNA, 21 nt, Shigella flexneri 2a str. 301
gccaucgcgguuaaucggcag

SEQ ID NO: 3894072 - RNA, 21 nt, Shigella flexneri 2a str. 301
gccaucucaaaacguccggca

SEQ ID NO: 3894073 - RNA, 21 nt, Shigella flexneri 2a str. 301
gccaucuccgcauguuucgac

SEQ ID NO: 3894074 - RNA, 23 nt, Shigella flexneri 2a str. 301
gccaucucugcaacgucuucccg

SEQ ID NO: 3894075 - RNA, 14 nt, Shigella flexneri 2a str. 301
gccaucucuuccag

SEQ ID NO: 3894076 - RNA, 20 nt, Shigella flexneri 2a str. 301
gccaucucuucggcacugcg

SEQ ID NO: 3894077 - RNA, 22 nt, Shigella flexneri 2a str. 301
gccaucugaauaaacggcucau

SEQ ID NO: 3894078 - RNA, 17 nt, Shigella flexneri 2a str. 301
gccaucugccagcaagc

SEQ ID NO: 3894079 - RNA, 14 nt, Shigella flexneri 2a str. 301
gccaucugccugau

SEQ ID NO: 3894080 - RNA, 13 nt, Shigella flexneri 2a str. 301
gccaucuggcuga

SEQ ID NO: 3894081 - RNA, 14 nt, Shigella flexneri 2a str. 301
gccaucuggcugac

SEQ ID NO: 3894082 - RNA, 17 nt, Shigella flexneri 2a str. 301
gccaucuggcugacggu

SEQ ID NO: 3894083 - RNA, 15 nt, Shigella flexneri 2a str. 301
gccaucuucuugcag

SEQ ID NO: 3894084 - RNA, 16 nt, Shigella flexneri 2a str. 301
gccaucuuucgcagau

SEQ ID NO: 3894085 - RNA, 21 nt, Shigella flexneri 2a str. 301
gccaugagcggacugaacgcg

SEQ ID NO: 3894086 - RNA, 21 nt, Shigella flexneri 2a str. 301
gccaugcaccugcuuccugaa

SEQ ID NO: 3894087 - RNA, 16 nt, Shigella flexneri 2a str. 301
gccaugcacgcaagaa

SEQ ID NO: 3894088 - RNA, 20 nt, Shigella flexneri 2a str. 301
gccaugcacgcaagaacgca

SEQ ID NO: 3894089 - RNA, 21 nt, Shigella flexneri 2a str. 301
gccaugcacgcaagaacgcau

SEQ ID NO: 3894090 - RNA, 20 nt, Shigella flexneri 2a str. 301
gccaugcaugauuacuggcg

SEQ ID NO: 3894091 - RNA, 18 nt, Shigella flexneri 2a str. 301
gccaugcccgugcugaca

SEQ ID NO: 3894092 - RNA, 15 nt, Shigella flexneri 2a str. 301
gccaugcgaaugcca

SEQ ID NO: 3894093 - RNA, 22 nt, Shigella flexneri 2a str. 301
gccauggcuucucgccagccuc

SEQ ID NO: 3894094 - RNA, 13 nt, Shigella flexneri 2a str. 301
gccauuaaacaac

SEQ ID NO: 3894095 - RNA, 22 nt, Shigella flexneri 2a str. 301
gccauuagcaaauuauccccca

SEQ ID NO: 3894096 - RNA, 22 nt, Shigella flexneri 2a str. 301
gccauuccuggggucaucagca

SEQ ID NO: 3894097 - RNA, 17 nt, Shigella flexneri 2a str. 301
gccauugaccagcugcc

SEQ ID NO: 3894098 - RNA, 19 nt, Shigella flexneri 2a str. 301
gccauugcccgaugcgcaa

SEQ ID NO: 3894099 - RNA, 23 nt, Shigella flexneri 2a str. 301
gccauugcccgaugcgcaaacuu

SEQ ID NO: 3894100 - RNA, 20 nt, Shigella flexneri 2a str. 301
gccauugccggugauugcaa

SEQ ID NO: 3894101 - RNA, 19 nt, Shigella flexneri 2a str. 301
gccauuuaacgcaucacga

SEQ ID NO: 3894102 - RNA, 16 nt, Shigella flexneri 2a str. 301
gccauuugggcggcuu

SEQ ID NO: 3894103 - RNA, 20 nt, Shigella flexneri 2a str. 301
gccauuuuuucgauaaucaa

SEQ ID NO: 3894104 - RNA, 16 nt, Shigella flexneri 2a str. 301
gccauuuuuuugucug

SEQ ID NO: 3894105 - RNA, 15 nt, Shigella flexneri 2a str. 301
gcccaaaaggcagcg

SEQ ID NO: 3894106 - RNA, 22 nt, Shigella flexneri 2a str. 301
gcccaacauacuguaacugcgu

SEQ ID NO: 3894107 - RNA, 22 nt, Shigella flexneri 2a str. 301
gcccaacuaaaugcugcagcca

SEQ ID NO: 3894108 - RNA, 20 nt, Shigella flexneri 2a str. 301
gcccaacuguugauccagga

SEQ ID NO: 3894109 - RNA, 23 nt, Shigella flexneri 2a str. 301
gcccaauacagcgcggaccccac

SEQ ID NO: 3894110 - RNA, 22 nt, Shigella flexneri 2a str. 301
gcccaauauccauagugaagug

SEQ ID NO: 3894111 - RNA, 22 nt, Shigella flexneri 2a str. 301
gcccaauauccugagccggaac

SEQ ID NO: 3894112 - RNA, 16 nt, Shigella flexneri 2a str. 301
gcccaccaccagcgaa

SEQ ID NO: 3894113 - RNA, 21 nt, Shigella flexneri 2a str. 301
gcccaccaccagcgaaaucac

SEQ ID NO: 3894114 - RNA, 22 nt, Shigella flexneri 2a str. 301
gcccaccauguucacugccgua

SEQ ID NO: 3894115 - RNA, 23 nt, Shigella flexneri 2a str. 301
gcccaccgacgcagucaugcgag

SEQ ID NO: 3894116 - RNA, 18 nt, Shigella flexneri 2a str. 301
gcccaccugcggcaccua

SEQ ID NO: 3894117 - RNA, 12 nt, Shigella flexneri 2a str. 301
gcccaccuggcu

SEQ ID NO: 3894118 - RNA, 18 nt, Shigella flexneri 2a str. 301
gcccacgccaucauaccc

SEQ ID NO: 3894119 - RNA, 13 nt, Shigella flexneri 2a str. 301
gcccacgccgccc

SEQ ID NO: 3894120 - RNA, 14 nt, Shigella flexneri 2a str. 301
gcccacgccgccca

SEQ ID NO: 3894121 - RNA, 19 nt, Shigella flexneri 2a str. 301
gcccacgggugaucuucau

SEQ ID NO: 3894122 - RNA, 20 nt, Shigella flexneri 2a str. 301
gcccacguuucacugccgga

SEQ ID NO: 3894123 - RNA, 17 nt, Shigella flexneri 2a str. 301
gcccacuccagcuaucg

SEQ ID NO: 3894124 - RNA, 21 nt, Shigella flexneri 2a str. 301
gcccacuuucaggccagcggc

SEQ ID NO: 3894125 - RNA, 14 nt, Shigella flexneri 2a str. 301
gcccagaacaaaua

SEQ ID NO: 3894126 - RNA, 15 nt, Shigella flexneri 2a str. 301
gcccagaacaaauaa

SEQ ID NO: 3894127 - RNA, 16 nt, Shigella flexneri 2a str. 301
gcccagacaaaugaac

SEQ ID NO: 3894128 - RNA, 22 nt, Shigella flexneri 2a str. 301
gcccagaccugcguucagcagu

SEQ ID NO: 3894129 - RNA, 19 nt, Shigella flexneri 2a str. 301
gcccagagaacuggcggca

SEQ ID NO: 3894130 - RNA, 16 nt, Shigella flexneri 2a str. 301
gcccagaggaugcacu

SEQ ID NO: 3894131 - RNA, 22 nt, Shigella flexneri 2a str. 301
gcccagaugccggaugcggcgu

SEQ ID NO: 3894132 - RNA, 19 nt, Shigella flexneri 2a str. 301
gcccgcgcugucgggcagc

SEQ ID NO: 3894133 - RNA, 16 nt, Shigella flexneri 2a str. 301
gcccgcugaaaagcgg

SEQ ID NO: 3894134 - RNA, 14 nt, Shigella flexneri 2a str. 301
gcccgcuuccagcg

SEQ ID NO: 3894135 - RNA, 18 nt, Shigella flexneri 2a str. 301
gcccgcuuccagcgcauc

SEQ ID NO: 3894136 - RNA, 21 nt, Shigella flexneri 2a str. 301
gcccgcuuucaccaucgcgau

SEQ ID NO: 3894137 - RNA, 15 nt, Shigella flexneri 2a str. 301
gcccggagcagcagu

SEQ ID NO: 3894138 - RNA, 15 nt, Shigella flexneri 2a str. 301
gcccggcaacaacag

SEQ ID NO: 3894139 - RNA, 16 nt, Shigella flexneri 2a str. 301
gcccggcauucaccuc

SEQ ID NO: 3894140 - RNA, 12 nt, Shigella flexneri 2a str. 301
gcccgguaucaa

SEQ ID NO: 3894141 - RNA, 15 nt, Shigella flexneri 2a str. 301
gcccgguauccauca

SEQ ID NO: 3894142 - RNA, 14 nt, Shigella flexneri 2a str. 301
gcccgguccgcgca

SEQ ID NO: 3894143 - RNA, 18 nt, Shigella flexneri 2a str. 301
gcccgguuaucggcgcgc

SEQ ID NO: 3894144 - RNA, 16 nt, Shigella flexneri 2a str. 301
gcccgguuguaugugc

SEQ ID NO: 3894145 - RNA, 23 nt, Shigella flexneri 2a str. 301
gcccgguuucgccacggcgcagc

SEQ ID NO: 3894146 - RNA, 20 nt, Shigella flexneri 2a str. 301
gcccguaaaaaauggcuggc

SEQ ID NO: 3894147 - RNA, 14 nt, Shigella flexneri 2a str. 301
gcccguaaauucaa

SEQ ID NO: 3894148 - RNA, 23 nt, Shigella flexneri 2a str. 301
gcccguaacucacugaugccguu

SEQ ID NO: 3894149 - RNA, 11 nt, Shigella flexneri 2a str. 301
gcccguccauc

SEQ ID NO: 3894150 - RNA, 17 nt, Shigella flexneri 2a str. 301
gcccgucugggcgcggc

SEQ ID NO: 3894151 - RNA, 17 nt, Shigella flexneri 2a str. 301
gcccgugauuuuccugu

SEQ ID NO: 3894152 - RNA, 18 nt, Shigella flexneri 2a str. 301
gcccguuuucuccagcgc

SEQ ID NO: 3894153 - RNA, 19 nt, Shigella flexneri 2a str. 301
gcccguuuucuccagcgcc

SEQ ID NO: 3894154 - RNA, 21 nt, Shigella flexneri 2a str. 301
gcccguuuucuccagcgccgc

SEQ ID NO: 3894155 - RNA, 15 nt, Shigella flexneri 2a str. 301
gcccguuuugagaaa

SEQ ID NO: 3894156 - RNA, 13 nt, Shigella flexneri 2a str. 301
gcccuacaaacug

SEQ ID NO: 3894157 - RNA, 15 nt, Shigella flexneri 2a str. 301
gcccuaggcauagaa

SEQ ID NO: 3894158 - RNA, 21 nt, Shigella flexneri 2a str. 301
gcccucaaacaacacagcgau

SEQ ID NO: 3894159 - RNA, 15 nt, Shigella flexneri 2a str. 301
gcccucagcccacau

SEQ ID NO: 3894160 - RNA, 19 nt, Shigella flexneri 2a str. 301
gcccucauucgaaaccacc

SEQ ID NO: 3894161 - RNA, 12 nt, Shigella flexneri 2a str. 301
gcccucgacggc

SEQ ID NO: 3894162 - RNA, 15 nt, Shigella flexneri 2a str. 301
gcccucgaucggcuc

SEQ ID NO: 3894163 - RNA, 21 nt, Shigella flexneri 2a str. 301
gcccucgaucggcucuuccgc

SEQ ID NO: 3894164 - RNA, 17 nt, Shigella flexneri 2a str. 301
gcccucgccuuuuugcg

SEQ ID NO: 3894165 - RNA, 13 nt, Shigella flexneri 2a str. 301
gcccucucaaccg

SEQ ID NO: 3894166 - RNA, 21 nt, Shigella flexneri 2a str. 301
gcccugaaccaucgacgucca

SEQ ID NO: 3894167 - RNA, 21 nt, Shigella flexneri 2a str. 301
gcccugcagcaucaccggaug

SEQ ID NO: 3894168 - RNA, 17 nt, Shigella flexneri 2a str. 301
gcccugccaggucauca

SEQ ID NO: 3894169 - RNA, 18 nt, Shigella flexneri 2a str. 301
gcccugcggcugaccacc

SEQ ID NO: 3894170 - RNA, 13 nt, Shigella flexneri 2a str. 301
gcccugcuccagc

SEQ ID NO: 3894171 - RNA, 17 nt, Shigella flexneri 2a str. 301
gcccugcuccagcaacu

SEQ ID NO: 3894172 - RNA, 19 nt, Shigella flexneri 2a str. 301
gcccugcuccagcaacuca

SEQ ID NO: 3894173 - RNA, 17 nt, Shigella flexneri 2a str. 301
gcccuggacaacauucc

SEQ ID NO: 3894174 - RNA, 22 nt, Shigella flexneri 2a str. 301
gcccuggacaacauuccugcug

SEQ ID NO: 3894175 - RNA, 15 nt, Shigella flexneri 2a str. 301
gcccuggaugcaguc

SEQ ID NO: 3894176 - RNA, 14 nt, Shigella flexneri 2a str. 301
gcccuggcucugca

SEQ ID NO: 3894177 - RNA, 22 nt, Shigella flexneri 2a str. 301
gcccugggcuucauccagcagu

SEQ ID NO: 3894178 - RNA, 20 nt, Shigella flexneri 2a str. 301
gcccuguuugguugccagcc

SEQ ID NO: 3894179 - RNA, 17 nt, Shigella flexneri 2a str. 301
gcccuuaauuacguuuc

SEQ ID NO: 3894180 - RNA, 20 nt, Shigella flexneri 2a str. 301
gcccuucacccauugccgcc

SEQ ID NO: 3894181 - RNA, 12 nt, Shigella flexneri 2a str. 301
gcccuuccccuu

SEQ ID NO: 3894182 - RNA, 21 nt, Shigella flexneri 2a str. 301
gcccuucgggucguugccugc

SEQ ID NO: 3894183 - RNA, 18 nt, Shigella flexneri 2a str. 301
gcccuucuggucaugaac

SEQ ID NO: 3894184 - RNA, 23 nt, Shigella flexneri 2a str. 301
gcccuugcuggacuugaaccagc

SEQ ID NO: 3894185 - RNA, 17 nt, Shigella flexneri 2a str. 301
gcccuuuccugacucag

SEQ ID NO: 3894186 - RNA, 15 nt, Shigella flexneri 2a str. 301
gcccuuugcgcauga

SEQ ID NO: 3894187 - RNA, 22 nt, Shigella flexneri 2a str. 301
gcccuuuguaggccagauaaga

SEQ ID NO: 3894188 - RNA, 22 nt, Shigella flexneri 2a str. 301
gcccuuuuucacgcuaaaagcg

SEQ ID NO: 3894189 - RNA, 19 nt, Shigella flexneri 2a str. 301
gcccuuuuuucguaaguaa

SEQ ID NO: 3894190 - RNA, 21 nt, Shigella flexneri 2a str. 301
gcccuuuuuuugucuguuugc

SEQ ID NO: 3894191 - RNA, 21 nt, Shigella flexneri 2a str. 301
gccgaacagcgccagacaaac

SEQ ID NO: 3894192 - RNA, 18 nt, Shigella flexneri 2a str. 301
gccgaaccagugcuccac

SEQ ID NO: 3894193 - RNA, 23 nt, Shigella flexneri 2a str. 301
gccgaagaaauagaaacuggccc

SEQ ID NO: 3894194 - RNA, 15 nt, Shigella flexneri 2a str. 301
gccgaagcagcuacu

SEQ ID NO: 3894195 - RNA, 13 nt, Shigella flexneri 2a str. 301
gccgaauaacgcg

SEQ ID NO: 3894196 - RNA, 20 nt, Shigella flexneri 2a str. 301
gccgaauaccguaacgacug

SEQ ID NO: 3894197 - RNA, 12 nt, Shigella flexneri 2a str. 301
gccgacaaagau

SEQ ID NO: 3894198 - RNA, 16 nt, Shigella flexneri 2a str. 301
gccgacaaaugcaguu

SEQ ID NO: 3894199 - RNA, 21 nt, Shigella flexneri 2a str. 301
gccgaccgcaaggaagccuga

SEQ ID NO: 3894200 - RNA, 19 nt, Shigella flexneri 2a str. 301
gccgacgccaguucucuuc

SEQ ID NO: 3894201 - RNA, 16 nt, Shigella flexneri 2a str. 301
gccgacuggcgcgagc

SEQ ID NO: 3894202 - RNA, 22 nt, Shigella flexneri 2a str. 301
gccgagaagauuuuuugccagc

SEQ ID NO: 3894203 - RNA, 19 nt, Shigella flexneri 2a str. 301
gccgagaauaaaacaggca

SEQ ID NO: 3894204 - RNA, 21 nt, Shigella flexneri 2a str. 301
gccgagaauaaaacaggcagc

SEQ ID NO: 3894205 - RNA, 23 nt, Shigella flexneri 2a str. 301
gccgagacgagcauaaaaguuaa

SEQ ID NO: 3894206 - RNA, 11 nt, Shigella flexneri 2a str. 301
gccgagcgcca

SEQ ID NO: 3894207 - RNA, 22 nt, Shigella flexneri 2a str. 301
gccgagcgugcgggcacaggcg

SEQ ID NO: 3894208 - RNA, 24 nt, Shigella flexneri 2a str. 301
gccgaggauuuaccggagcgauua

SEQ ID NO: 3894209 - RNA, 21 nt, Shigella flexneri 2a str. 301
gccgaggccaaacucaccauc

SEQ ID NO: 3894210 - RNA, 16 nt, Shigella flexneri 2a str. 301
gccgaguaaaaaaaca

SEQ ID NO: 3894211 - RNA, 21 nt, Shigella flexneri 2a str. 301
gccgauaaauacagcguuaaa

SEQ ID NO: 3894212 - RNA, 18 nt, Shigella flexneri 2a str. 301
gccgauaauaaagccuau

SEQ ID NO: 3894213 - RNA, 13 nt, Shigella flexneri 2a str. 301
gccgauaauacuc

SEQ ID NO: 3894214 - RNA, 20 nt, Shigella flexneri 2a str. 301
gccgauaccaucacaccucg

SEQ ID NO: 3894215 - RNA, 18 nt, Shigella flexneri 2a str. 301
gccgaucaauuucacagu

SEQ ID NO: 3894216 - RNA, 21 nt, Shigella flexneri 2a str. 301
gccgaucaauuucacaguaau

SEQ ID NO: 3894217 - RNA, 17 nt, Shigella flexneri 2a str. 301
gccgaucauuggccgga

SEQ ID NO: 3894218 - RNA, 14 nt, Shigella flexneri 2a str. 301
gccgauccgcguca

SEQ ID NO: 3894219 - RNA, 20 nt, Shigella flexneri 2a str. 301
gccgauccggacaugcugca

SEQ ID NO: 3894220 - RNA, 18 nt, Shigella flexneri 2a str. 301
gccgaugaacggcggcgg

SEQ ID NO: 3894221 - RNA, 15 nt, Shigella flexneri 2a str. 301
gccgaugccgacgau

SEQ ID NO: 3894222 - RNA, 15 nt, Shigella flexneri 2a str. 301
gccgaugccgcugca

SEQ ID NO: 3894223 - RNA, 20 nt, Shigella flexneri 2a str. 301
gccgaugcgggauuccccca

SEQ ID NO: 3894224 - RNA, 16 nt, Shigella flexneri 2a str. 301
gccgauggcgcaaacu

SEQ ID NO: 3894225 - RNA, 20 nt, Shigella flexneri 2a str. 301
gccgauuaaagacagcgagg

SEQ ID NO: 3894226 - RNA, 16 nt, Shigella flexneri 2a str. 301
gccgauuaaucuucca

SEQ ID NO: 3894227 - RNA, 21 nt, Shigella flexneri 2a str. 301
gccgauuucaugaagcugaca

SEQ ID NO: 3894228 - RNA, 20 nt, Shigella flexneri 2a str. 301
gccgauuuugccuucauacu

SEQ ID NO: 3894229 - RNA, 17 nt, Shigella flexneri 2a str. 301
gccgcaaaacccaggcu

SEQ ID NO: 3894230 - RNA, 23 nt, Shigella flexneri 2a str. 301
gccgcaaacgacacugcucgcag

SEQ ID NO: 3894231 - RNA, 14 nt, Shigella flexneri 2a str. 301
gccggauaaggcau

SEQ ID NO: 3894232 - RNA, 22 nt, Shigella flexneri 2a str. 301
gccggauaaggcguucacgacg

SEQ ID NO: 3894233 - RNA, 14 nt, Shigella flexneri 2a str. 301
gccggauagacaug

SEQ ID NO: 3894234 - RNA, 23 nt, Shigella flexneri 2a str. 301
gccggauaugaaauccggcaccu

SEQ ID NO: 3894235 - RNA, 19 nt, Shigella flexneri 2a str. 301
gccggaucgguagaccgga

SEQ ID NO: 3894236 - RNA, 14 nt, Shigella flexneri 2a str. 301
gccggaugacagac

SEQ ID NO: 3894237 - RNA, 17 nt, Shigella flexneri 2a str. 301
gccggaugacagacucc

SEQ ID NO: 3894238 - RNA, 18 nt, Shigella flexneri 2a str. 301
gccggaugaucauccggc

SEQ ID NO: 3894239 - RNA, 23 nt, Shigella flexneri 2a str. 301
gccggaugccucuccuguucuca

SEQ ID NO: 3894240 - RNA, 18 nt, Shigella flexneri 2a str. 301
gccggaugcgaugcugac

SEQ ID NO: 3894241 - RNA, 21 nt, Shigella flexneri 2a str. 301
gccggaugcgaugcugacgca

SEQ ID NO: 3894242 - RNA, 18 nt, Shigella flexneri 2a str. 301
gccggaugcgccagcauc

SEQ ID NO: 3894243 - RNA, 14 nt, Shigella flexneri 2a str. 301
gccggaugcggcgu

SEQ ID NO: 3894244 - RNA, 22 nt, Shigella flexneri 2a str. 301
gccggaugcggcguaaacgccu

SEQ ID NO: 3894245 - RNA, 23 nt, Shigella flexneri 2a str. 301
gccggaugcggcguaaaugccuu

SEQ ID NO: 3894246 - RNA, 19 nt, Shigella flexneri 2a str. 301
gccggaugcggugcaagca

SEQ ID NO: 3894247 - RNA, 23 nt, Shigella flexneri 2a str. 301
gccggaugcggugcaagcaccuu

SEQ ID NO: 3894248 - RNA, 22 nt, Shigella flexneri 2a str. 301
gccggauggaaacauccggcaa

SEQ ID NO: 3894249 - RNA, 18 nt, Shigella flexneri 2a str. 301
gccggaugucuggaacga

SEQ ID NO: 3894250 - RNA, 21 nt, Shigella flexneri 2a str. 301
gccggaugugaugcauccggc

SEQ ID NO: 3894251 - RNA, 19 nt, Shigella flexneri 2a str. 301
gccggauguguugcauccg

SEQ ID NO: 3894252 - RNA, 21 nt, Shigella flexneri 2a str. 301
gccggauguguugcauccggc

SEQ ID NO: 3894253 - RNA, 20 nt, Shigella flexneri 2a str. 301
gccggauguuugcauccggc

SEQ ID NO: 3894254 - RNA, 15 nt, Shigella flexneri 2a str. 301
gccggcacaggcauc

SEQ ID NO: 3894255 - RNA, 17 nt, Shigella flexneri 2a str. 301
gccggccagcgccacca

SEQ ID NO: 3894256 - RNA, 23 nt, Shigella flexneri 2a str. 301
gccggccccgucucccgaugcca

SEQ ID NO: 3894257 - RNA, 22 nt, Shigella flexneri 2a str. 301
gccgggcuaaccgcuuuuccag

SEQ ID NO: 3894258 - RNA, 19 nt, Shigella flexneri 2a str. 301
gccgggcuucgguuaguaa

SEQ ID NO: 3894259 - RNA, 21 nt, Shigella flexneri 2a str. 301
gccggggagauauuccccaga

SEQ ID NO: 3894260 - RNA, 14 nt, Shigella flexneri 2a str. 301
gccggggcgcggcg

SEQ ID NO: 3894261 - RNA, 22 nt, Shigella flexneri 2a str. 301
gccgguaacgcuuucucaccau

SEQ ID NO: 3894262 - RNA, 21 nt, Shigella flexneri 2a str. 301
gccgguagucaccgcccagug

SEQ ID NO: 3894263 - RNA, 23 nt, Shigella flexneri 2a str. 301
gccgguagucaccgcccagugca

SEQ ID NO: 3894264 - RNA, 13 nt, Shigella flexneri 2a str. 301
gccgguauccagc

SEQ ID NO: 3894265 - RNA, 18 nt, Shigella flexneri 2a str. 301
gccggucaacgcgcggcu

SEQ ID NO: 3894266 - RNA, 12 nt, Shigella flexneri 2a str. 301
gccggugauuac

SEQ ID NO: 3894267 - RNA, 16 nt, Shigella flexneri 2a str. 301
gccgguggugaccugu

SEQ ID NO: 3894268 - RNA, 14 nt, Shigella flexneri 2a str. 301
gccgguuaauacgc

SEQ ID NO: 3894269 - RNA, 23 nt, Shigella flexneri 2a str. 301
gccgguugccccgcacgcuucau

SEQ ID NO: 3894270 - RNA, 14 nt, Shigella flexneri 2a str. 301
gccgguuuaucucc

SEQ ID NO: 3894271 - RNA, 23 nt, Shigella flexneri 2a str. 301
gccgguuucacuauuaccgaugu

SEQ ID NO: 3894272 - RNA, 17 nt, Shigella flexneri 2a str. 301
gccgguuugcgccgugc

SEQ ID NO: 3894273 - RNA, 20 nt, Shigella flexneri 2a str. 301
gccgguuuguuauccaccga

SEQ ID NO: 3894274 - RNA, 22 nt, Shigella flexneri 2a str. 301
gccgguuuuacagaaucuggcc

SEQ ID NO: 3894275 - RNA, 20 nt, Shigella flexneri 2a str. 301
gccguaauauuucucggcaa

SEQ ID NO: 3894276 - RNA, 18 nt, Shigella flexneri 2a str. 301
gccguacugcauaaugcc

SEQ ID NO: 3894277 - RNA, 15 nt, Shigella flexneri 2a str. 301
gccguaguuccacau

SEQ ID NO: 3894278 - RNA, 18 nt, Shigella flexneri 2a str. 301
gccguauaauaucuuuuc

SEQ ID NO: 3894279 - RNA, 16 nt, Shigella flexneri 2a str. 301
gccguauguucucugg

SEQ ID NO: 3894280 - RNA, 20 nt, Shigella flexneri 2a str. 301
gccgucaccagcaucaacaa

SEQ ID NO: 3894281 - RNA, 22 nt, Shigella flexneri 2a str. 301
gccgucaccgccugcgauggug

SEQ ID NO: 3894282 - RNA, 22 nt, Shigella flexneri 2a str. 301
gccgucagccacuucuuccagc

SEQ ID NO: 3894283 - RNA, 15 nt, Shigella flexneri 2a str. 301
gccgucaggguugcc

SEQ ID NO: 3894284 - RNA, 19 nt, Shigella flexneri 2a str. 301
gccgucaggugacacuuca

SEQ ID NO: 3894285 - RNA, 17 nt, Shigella flexneri 2a str. 301
gccgucaucacaccgcg

SEQ ID NO: 3894286 - RNA, 14 nt, Shigella flexneri 2a str. 301
gccguccagccgga

SEQ ID NO: 3894287 - RNA, 19 nt, Shigella flexneri 2a str. 301
gccguccugcguuucuucu

SEQ ID NO: 3894288 - RNA, 22 nt, Shigella flexneri 2a str. 301
gccgucgaugucuggcugagca

SEQ ID NO: 3894289 - RNA, 22 nt, Shigella flexneri 2a str. 301
gccgucguuaccggucacuggc

SEQ ID NO: 3894290 - RNA, 22 nt, Shigella flexneri 2a str. 301
gccgugauuccgccgcacgagc

SEQ ID NO: 3894291 - RNA, 14 nt, Shigella flexneri 2a str. 301
gccgugcagcacgg

SEQ ID NO: 3894292 - RNA, 16 nt, Shigella flexneri 2a str. 301
gccgugcccaacugcc

SEQ ID NO: 3894293 - RNA, 18 nt, Shigella flexneri 2a str. 301
gccgugcugccagcgauu

SEQ ID NO: 3894294 - RNA, 19 nt, Shigella flexneri 2a str. 301
gccgugcugugugccgcga

SEQ ID NO: 3894295 - RNA, 19 nt, Shigella flexneri 2a str. 301
gccguggaucacaucgccg

SEQ ID NO: 3894296 - RNA, 14 nt, Shigella flexneri 2a str. 301
gccguggcaaccuu

SEQ ID NO: 3894297 - RNA, 17 nt, Shigella flexneri 2a str. 301
gccgugucggugcucau

SEQ ID NO: 3894298 - RNA, 21 nt, Shigella flexneri 2a str. 301
gccgugucggugcucaucagc

SEQ ID NO: 3894299 - RNA, 13 nt, Shigella flexneri 2a str. 301
gccgugugcaaua

SEQ ID NO: 3894300 - RNA, 17 nt, Shigella flexneri 2a str. 301
gccguuaacccgucugg

SEQ ID NO: 3894301 - RNA, 22 nt, Shigella flexneri 2a str. 301
gccguuaccguaccaaccgcaa

SEQ ID NO: 3894302 - RNA, 20 nt, Shigella flexneri 2a str. 301
gccguuaccuucggccccau

SEQ ID NO: 3894303 - RNA, 13 nt, Shigella flexneri 2a str. 301
gccguuagcuuca

SEQ ID NO: 3894304 - RNA, 13 nt, Shigella flexneri 2a str. 301
gccguucuucagc

SEQ ID NO: 3894305 - RNA, 16 nt, Shigella flexneri 2a str. 301
gccguugaguucaaau

SEQ ID NO: 3894306 - RNA, 22 nt, Shigella flexneri 2a str. 301
gccguugcggguggcucucgcc

SEQ ID NO: 3894307 - RNA, 12 nt, Shigella flexneri 2a str. 301
gccguuguucuc

SEQ ID NO: 3894308 - RNA, 16 nt, Shigella flexneri 2a str. 301
gccguuuaccgccauc

SEQ ID NO: 3894309 - RNA, 16 nt, Shigella flexneri 2a str. 301
gccguuugcugcauga

SEQ ID NO: 3894310 - RNA, 11 nt, Shigella flexneri 2a str. 301
gccguuuucuu

SEQ ID NO: 3894311 - RNA, 15 nt, Shigella flexneri 2a str. 301
gccuaacaccaucag

SEQ ID NO: 3894312 - RNA, 17 nt, Shigella flexneri 2a str. 301
gccuaagccauuuaacu

SEQ ID NO: 3894313 - RNA, 22 nt, Shigella flexneri 2a str. 301
gccuaagcgaacuguugagagu

SEQ ID NO: 3894314 - RNA, 19 nt, Shigella flexneri 2a str. 301
gccuaauuacauaacacua

SEQ ID NO: 3894315 - RNA, 17 nt, Shigella flexneri 2a str. 301
gccuaauuccgcgcgaa

SEQ ID NO: 3894316 - RNA, 23 nt, Shigella flexneri 2a str. 301
gccuacaaauucaauaaauugca

SEQ ID NO: 3894317 - RNA, 14 nt, Shigella flexneri 2a str. 301
gccuacagaugauu

SEQ ID NO: 3894318 - RNA, 21 nt, Shigella flexneri 2a str. 301
gccuacagguuugugccgaac

SEQ ID NO: 3894319 - RNA, 15 nt, Shigella flexneri 2a str. 301
gccuaccaaaccugc

SEQ ID NO: 3894320 - RNA, 18 nt, Shigella flexneri 2a str. 301
gccuaccaaaccugcacg

SEQ ID NO: 3894321 - RNA, 15 nt, Shigella flexneri 2a str. 301
gccuaccauaaucag

SEQ ID NO: 3894322 - RNA, 16 nt, Shigella flexneri 2a str. 301
gccuaccuuaaccguu

SEQ ID NO: 3894323 - RNA, 15 nt, Shigella flexneri 2a str. 301
gccuacgcguccccu

SEQ ID NO: 3894324 - RNA, 15 nt, Shigella flexneri 2a str. 301
gccuacggcauucug

SEQ ID NO: 3894325 - RNA, 19 nt, Shigella flexneri 2a str. 301
gccuacggcauucugcaca

SEQ ID NO: 3894326 - RNA, 18 nt, Shigella flexneri 2a str. 301
gccuaguccguaggcagg

SEQ ID NO: 3894327 - RNA, 12 nt, Shigella flexneri 2a str. 301
gccuauccagaa

SEQ ID NO: 3894328 - RNA, 15 nt, Shigella flexneri 2a str. 301
gccuauccagaagcc

SEQ ID NO: 3894329 - RNA, 18 nt, Shigella flexneri 2a str. 301
gccuauccagaagccugc

SEQ ID NO: 3894330 - RNA, 19 nt, Shigella flexneri 2a str. 301
gccuguauuacgccuucga

SEQ ID NO: 3894331 - RNA, 17 nt, Shigella flexneri 2a str. 301
gccuguauuccuggccg

SEQ ID NO: 3894332 - RNA, 20 nt, Shigella flexneri 2a str. 301
gccugucaccgccuccaccu

SEQ ID NO: 3894333 - RNA, 14 nt, Shigella flexneri 2a str. 301
gccugugcagcgac

SEQ ID NO: 3894334 - RNA, 16 nt, Shigella flexneri 2a str. 301
gccugugccacggcuu

SEQ ID NO: 3894335 - RNA, 15 nt, Shigella flexneri 2a str. 301
gccugugccugagcc

SEQ ID NO: 3894336 - RNA, 14 nt, Shigella flexneri 2a str. 301
gccugugucaggcc

SEQ ID NO: 3894337 - RNA, 22 nt, Shigella flexneri 2a str. 301
gccuguucgccgccgcuuucgu

SEQ ID NO: 3894338 - RNA, 17 nt, Shigella flexneri 2a str. 301
gccuguugcgucgccgc

SEQ ID NO: 3894339 - RNA, 23 nt, Shigella flexneri 2a str. 301
gccuguuuagccgcuucugcagc

SEQ ID NO: 3894340 - RNA, 12 nt, Shigella flexneri 2a str. 301
gccuuaaacuca

SEQ ID NO: 3894341 - RNA, 14 nt, Shigella flexneri 2a str. 301
gccuuaccacucug

SEQ ID NO: 3894342 - RNA, 22 nt, Shigella flexneri 2a str. 301
gccuuacccggaccgucuuuuu

SEQ ID NO: 3894343 - RNA, 18 nt, Shigella flexneri 2a str. 301
gccuuauccgaugguuua

SEQ ID NO: 3894344 - RNA, 21 nt, Shigella flexneri 2a str. 301
gccuuauccggcuuaccgcuc

SEQ ID NO: 3894345 - RNA, 19 nt, Shigella flexneri 2a str. 301
gccuuauccguccuacgaa

SEQ ID NO: 3894346 - RNA, 18 nt, Shigella flexneri 2a str. 301
gccuucacaggccgccag

SEQ ID NO: 3894347 - RNA, 19 nt, Shigella flexneri 2a str. 301
gccuucacaggccgccagg

SEQ ID NO: 3894348 - RNA, 18 nt, Shigella flexneri 2a str. 301
gccuucaccgcuaaagcg

SEQ ID NO: 3894349 - RNA, 19 nt, Shigella flexneri 2a str. 301
gccuucaccgcuaaagcgg

SEQ ID NO: 3894350 - RNA, 20 nt, Shigella flexneri 2a str. 301
gccuucacgguuauuguagc

SEQ ID NO: 3894351 - RNA, 15 nt, Shigella flexneri 2a str. 301
gccuucacuuccggc

SEQ ID NO: 3894352 - RNA, 12 nt, Shigella flexneri 2a str. 301
gccuucaggaau

SEQ ID NO: 3894353 - RNA, 13 nt, Shigella flexneri 2a str. 301
gccuucagugccg

SEQ ID NO: 3894354 - RNA, 19 nt, Shigella flexneri 2a str. 301
gccuucaugcgacgacggu

SEQ ID NO: 3894355 - RNA, 17 nt, Shigella flexneri 2a str. 301
gccuucauucaggccaa

SEQ ID NO: 3894356 - RNA, 21 nt, Shigella flexneri 2a str. 301
gccuucauucaggccaaagcc

SEQ ID NO: 3894357 - RNA, 22 nt, Shigella flexneri 2a str. 301
gccuuccaccagauggcuuucc

SEQ ID NO: 3894358 - RNA, 15 nt, Shigella flexneri 2a str. 301
gccuucccuuucagc

SEQ ID NO: 3894359 - RNA, 15 nt, Shigella flexneri 2a str. 301
gccuuccgucagcaa

SEQ ID NO: 3894360 - RNA, 17 nt, Shigella flexneri 2a str. 301
gccuuccgucagcaaag

SEQ ID NO: 3894361 - RNA, 21 nt, Shigella flexneri 2a str. 301
gccuucgcaaaaaaccauccc

SEQ ID NO: 3894362 - RNA, 21 nt, Shigella flexneri 2a str. 301
gccuucugcgccgccucugcg

SEQ ID NO: 3894363 - RNA, 12 nt, Shigella flexneri 2a str. 301
gccuucugcggu

SEQ ID NO: 3894364 - RNA, 14 nt, Shigella flexneri 2a str. 301
gccuucuucaucca

SEQ ID NO: 3894365 - RNA, 16 nt, Shigella flexneri 2a str. 301
gccuucuucauccagc

SEQ ID NO: 3894366 - RNA, 21 nt, Shigella flexneri 2a str. 301
gccuucuucgcccacuuucug

SEQ ID NO: 3894367 - RNA, 20 nt, Shigella flexneri 2a str. 301
gccuugauauaaaucccagg

SEQ ID NO: 3894368 - RNA, 16 nt, Shigella flexneri 2a str. 301
gccuugcgcgcagugc

SEQ ID NO: 3894369 - RNA, 19 nt, Shigella flexneri 2a str. 301
gccuugcgugccuuagcca

SEQ ID NO: 3894370 - RNA, 19 nt, Shigella flexneri 2a str. 301
gccuugucaucgucggccu

SEQ ID NO: 3894371 - RNA, 19 nt, Shigella flexneri 2a str. 301
gccuugugaguuccgcugc

SEQ ID NO: 3894372 - RNA, 14 nt, Shigella flexneri 2a str. 301
gccuuguuugauca

SEQ ID NO: 3894373 - RNA, 16 nt, Shigella flexneri 2a str. 301
gccuuuaccgccacag

SEQ ID NO: 3894374 - RNA, 21 nt, Shigella flexneri 2a str. 301
gccuuuaccgcgcucgaagcg

SEQ ID NO: 3894375 - RNA, 21 nt, Shigella flexneri 2a str. 301
gccuuuccuccugucuucccu

SEQ ID NO: 3894376 - RNA, 23 nt, Shigella flexneri 2a str. 301
gccuuuccuccugucuucccugc

SEQ ID NO: 3894377 - RNA, 22 nt, Shigella flexneri 2a str. 301
gccuuucuuaauauuuuccgug

SEQ ID NO: 3894378 - RNA, 22 nt, Shigella flexneri 2a str. 301
gccuuugaaaauaacaucgcca

SEQ ID NO: 3894379 - RNA, 23 nt, Shigella flexneri 2a str. 301
gccuuugaaaauaacaucgccag

SEQ ID NO: 3894380 - RNA, 21 nt, Shigella flexneri 2a str. 301
gccuuuuaaugcgcuuccugc

SEQ ID NO: 3894381 - RNA, 18 nt, Shigella flexneri 2a str. 301
gccuuuuccuuucagagu

SEQ ID NO: 3894382 - RNA, 17 nt, Shigella flexneri 2a str. 301
gccuuuugcgccguaaa

SEQ ID NO: 3894383 - RNA, 16 nt, Shigella flexneri 2a str. 301
gccuuuuuucgccgca

SEQ ID NO: 3894384 - RNA, 15 nt, Shigella flexneri 2a str. 301
gcgaaaaagcguuca

SEQ ID NO: 3894385 - RNA, 19 nt, Shigella flexneri 2a str. 301
gcgaaaacgauguuugcug

SEQ ID NO: 3894386 - RNA, 18 nt, Shigella flexneri 2a str. 301
gcgaaaaucccggcaaca

SEQ ID NO: 3894387 - RNA, 15 nt, Shigella flexneri 2a str. 301
gcgaaaccuccgcaa

SEQ ID NO: 3894388 - RNA, 16 nt, Shigella flexneri 2a str. 301
gcgaaagcuggcacug

SEQ ID NO: 3894389 - RNA, 12 nt, Shigella flexneri 2a str. 301
gcgaaauaauca

SEQ ID NO: 3894390 - RNA, 13 nt, Shigella flexneri 2a str. 301
gcgaaauaaucaa

SEQ ID NO: 3894391 - RNA, 18 nt, Shigella flexneri 2a str. 301
gcgaacaacagaucaaca

SEQ ID NO: 3894392 - RNA, 16 nt, Shigella flexneri 2a str. 301
gcgaacauccagcagc

SEQ ID NO: 3894393 - RNA, 22 nt, Shigella flexneri 2a str. 301
gcgaacaucgagugcggcgagc

SEQ ID NO: 3894394 - RNA, 14 nt, Shigella flexneri 2a str. 301
gcgaaccaggaaga

SEQ ID NO: 3894395 - RNA, 23 nt, Shigella flexneri 2a str. 301
gcgaacggcgcgguuuccaccuu

SEQ ID NO: 3894396 - RNA, 15 nt, Shigella flexneri 2a str. 301
gcgaacgggauaaac

SEQ ID NO: 3894397 - RNA, 13 nt, Shigella flexneri 2a str. 301
gcgaacuaaacaa

SEQ ID NO: 3894398 - RNA, 17 nt, Shigella flexneri 2a str. 301
gcgaacuguugagagua

SEQ ID NO: 3894399 - RNA, 17 nt, Shigella flexneri 2a str. 301
gcgaagaaagcggguga

SEQ ID NO: 3894400 - RNA, 15 nt, Shigella flexneri 2a str. 301
gcgaagagaaagaac

SEQ ID NO: 3894401 - RNA, 17 nt, Shigella flexneri 2a str. 301
gcgaagcccacgccgcc

SEQ ID NO: 3894402 - RNA, 22 nt, Shigella flexneri 2a str. 301
gcgaagcgcauaccuucuugua

SEQ ID NO: 3894403 - RNA, 15 nt, Shigella flexneri 2a str. 301
gcgaaggccagaacc

SEQ ID NO: 3894404 - RNA, 16 nt, Shigella flexneri 2a str. 301
gcgaaggcgcacugau

SEQ ID NO: 3894405 - RNA, 18 nt, Shigella flexneri 2a str. 301
gcgaaguagacagcguuu

SEQ ID NO: 3894406 - RNA, 22 nt, Shigella flexneri 2a str. 301
gcgaagucguucagaucuuuca

SEQ ID NO: 3894407 - RNA, 14 nt, Shigella flexneri 2a str. 301
gcgaaguucgccau

SEQ ID NO: 3894408 - RNA, 22 nt, Shigella flexneri 2a str. 301
gcgaauaaaguagaaauuauuu

SEQ ID NO: 3894409 - RNA, 15 nt, Shigella flexneri 2a str. 301
gcgaauacuccccuu

SEQ ID NO: 3894410 - RNA, 14 nt, Shigella flexneri 2a str. 301
gcgaauagcgucua

SEQ ID NO: 3894411 - RNA, 15 nt, Shigella flexneri 2a str. 301
gcgaauauggcggcg

SEQ ID NO: 3894412 - RNA, 17 nt, Shigella flexneri 2a str. 301
gcgaaucacguugccgu

SEQ ID NO: 3894413 - RNA, 15 nt, Shigella flexneri 2a str. 301
gcgaauccagcaugc

SEQ ID NO: 3894414 - RNA, 18 nt, Shigella flexneri 2a str. 301
gcgaauccagcaugcuca

SEQ ID NO: 3894415 - RNA, 20 nt, Shigella flexneri 2a str. 301
gcgaaucgcuucauuuacau

SEQ ID NO: 3894416 - RNA, 20 nt, Shigella flexneri 2a str. 301
gcgaaucuacggacaguggc

SEQ ID NO: 3894417 - RNA, 16 nt, Shigella flexneri 2a str. 301
gcgaauggcaugcucc

SEQ ID NO: 3894418 - RNA, 22 nt, Shigella flexneri 2a str. 301
gcgaauucuugccuuuccuccu

SEQ ID NO: 3894419 - RNA, 18 nt, Shigella flexneri 2a str. 301
gcgaauuugaauauauac

SEQ ID NO: 3894420 - RNA, 12 nt, Shigella flexneri 2a str. 301
gcgaauuuuuuc

SEQ ID NO: 3894421 - RNA, 15 nt, Shigella flexneri 2a str. 301
gcgacaagcgucgca

SEQ ID NO: 3894422 - RNA, 15 nt, Shigella flexneri 2a str. 301
gcgacaaucccugca

SEQ ID NO: 3894423 - RNA, 12 nt, Shigella flexneri 2a str. 301
gcgacaccagcc

SEQ ID NO: 3894424 - RNA, 16 nt, Shigella flexneri 2a str. 301
gcgacagauucgcggg

SEQ ID NO: 3894425 - RNA, 17 nt, Shigella flexneri 2a str. 301
gcgacagggaucucuuc

SEQ ID NO: 3894426 - RNA, 20 nt, Shigella flexneri 2a str. 301
gcgacagggaucucuuccag

SEQ ID NO: 3894427 - RNA, 22 nt, Shigella flexneri 2a str. 301
gcgacagggaucucuuccagug

SEQ ID NO: 3894428 - RNA, 13 nt, Shigella flexneri 2a str. 301
gcgacauaucauu

SEQ ID NO: 3894429 - RNA, 16 nt, Shigella flexneri 2a str. 301
gcgacauauuccccuu

SEQ ID NO: 3894430 - RNA, 20 nt, Shigella flexneri 2a str. 301
gcgauugcagauauggaaag

SEQ ID NO: 3894431 - RNA, 23 nt, Shigella flexneri 2a str. 301
gcgauugccguuggcguugcacc

SEQ ID NO: 3894432 - RNA, 17 nt, Shigella flexneri 2a str. 301
gcgauugugacacgcgc

SEQ ID NO: 3894433 - RNA, 22 nt, Shigella flexneri 2a str. 301
gcgauuuaacgccugggcgagg

SEQ ID NO: 3894434 - RNA, 17 nt, Shigella flexneri 2a str. 301
gcgauuuaucggcaauu

SEQ ID NO: 3894435 - RNA, 16 nt, Shigella flexneri 2a str. 301
gcgcaaacuuaucgug

SEQ ID NO: 3894436 - RNA, 13 nt, Shigella flexneri 2a str. 301
gcgcaaaggccag

SEQ ID NO: 3894437 - RNA, 17 nt, Shigella flexneri 2a str. 301
gcgcaaaggccagcaau

SEQ ID NO: 3894438 - RNA, 21 nt, Shigella flexneri 2a str. 301
gcgcaaaucagauugccacag

SEQ ID NO: 3894439 - RNA, 21 nt, Shigella flexneri 2a str. 301
gcgcaaauccacguuccagau

SEQ ID NO: 3894440 - RNA, 15 nt, Shigella flexneri 2a str. 301
gcgcaacaaauaaaa

SEQ ID NO: 3894441 - RNA, 20 nt, Shigella flexneri 2a str. 301
gcgcaacaaauaaaagcaaa

SEQ ID NO: 3894442 - RNA, 18 nt, Shigella flexneri 2a str. 301
gcgcaacauccgcuuucg

SEQ ID NO: 3894443 - RNA, 15 nt, Shigella flexneri 2a str. 301
gcgcaacgcuuuccc

SEQ ID NO: 3894444 - RNA, 16 nt, Shigella flexneri 2a str. 301
gcgcaacugaggcaau

SEQ ID NO: 3894445 - RNA, 17 nt, Shigella flexneri 2a str. 301
gcgcaagggccgcagcu

SEQ ID NO: 3894446 - RNA, 12 nt, Shigella flexneri 2a str. 301
gcgcaauaauca

SEQ ID NO: 3894447 - RNA, 12 nt, Shigella flexneri 2a str. 301
gcgcaauaccga

SEQ ID NO: 3894448 - RNA, 13 nt, Shigella flexneri 2a str. 301
gcgcaaucgccag

SEQ ID NO: 3894449 - RNA, 16 nt, Shigella flexneri 2a str. 301
gcgcaaucgcccagcg

SEQ ID NO: 3894450 - RNA, 13 nt, Shigella flexneri 2a str. 301
gcgcaaugcguuu

SEQ ID NO: 3894451 - RNA, 24 nt, Shigella flexneri 2a str. 301
gcgcaauggcuggccccgucagca

SEQ ID NO: 3894452 - RNA, 20 nt, Shigella flexneri 2a str. 301
gcgcaauguugcgggggcuu

SEQ ID NO: 3894453 - RNA, 17 nt, Shigella flexneri 2a str. 301
gcgcaauucgcgucggc

SEQ ID NO: 3894454 - RNA, 16 nt, Shigella flexneri 2a str. 301
gcgcaauugccagaca

SEQ ID NO: 3894455 - RNA, 21 nt, Shigella flexneri 2a str. 301
gcgcaauuggcacgccgacau

SEQ ID NO: 3894456 - RNA, 17 nt, Shigella flexneri 2a str. 301
gcgcaauuuccauugcu

SEQ ID NO: 3894457 - RNA, 21 nt, Shigella flexneri 2a str. 301
gcgcacaaagccgcgugcgcu

SEQ ID NO: 3894458 - RNA, 17 nt, Shigella flexneri 2a str. 301
gcgcacaauggcgguga

SEQ ID NO: 3894459 - RNA, 13 nt, Shigella flexneri 2a str. 301
gcgcacaggcugc

SEQ ID NO: 3894460 - RNA, 13 nt, Shigella flexneri 2a str. 301
gcgcacaucagga

SEQ ID NO: 3894461 - RNA, 12 nt, Shigella flexneri 2a str. 301
gcgcaccagcgu

SEQ ID NO: 3894462 - RNA, 23 nt, Shigella flexneri 2a str. 301
gcgcaccggccccugaucggcca

SEQ ID NO: 3894463 - RNA, 23 nt, Shigella flexneri 2a str. 301
gcgcacguacaucccgcgaacga

SEQ ID NO: 3894464 - RNA, 21 nt, Shigella flexneri 2a str. 301
gcgcacgucaccgcagcaucg

SEQ ID NO: 3894465 - RNA, 15 nt, Shigella flexneri 2a str. 301
gcgcacgucagccuc

SEQ ID NO: 3894466 - RNA, 17 nt, Shigella flexneri 2a str. 301
gcgcacuauuccggcgu

SEQ ID NO: 3894467 - RNA, 16 nt, Shigella flexneri 2a str. 301
gcgcacucgcagacaa

SEQ ID NO: 3894468 - RNA, 16 nt, Shigella flexneri 2a str. 301
gcgcagaacauaaaaa

SEQ ID NO: 3894469 - RNA, 19 nt, Shigella flexneri 2a str. 301
gcgcagauuagccgguaaa

SEQ ID NO: 3894470 - RNA, 22 nt, Shigella flexneri 2a str. 301
gcgcagcaagucggcaucgcca

SEQ ID NO: 3894471 - RNA, 15 nt, Shigella flexneri 2a str. 301
gcgcagcagcgcgcc

SEQ ID NO: 3894472 - RNA, 15 nt, Shigella flexneri 2a str. 301
gcgcagcggugagcc

SEQ ID NO: 3894473 - RNA, 22 nt, Shigella flexneri 2a str. 301
gcgcagcguucauaaauacaga

SEQ ID NO: 3894474 - RNA, 20 nt, Shigella flexneri 2a str. 301
gcgcagcuuugugcuucagu

SEQ ID NO: 3894475 - RNA, 15 nt, Shigella flexneri 2a str. 301
gcgcaggauaaccuu

SEQ ID NO: 3894476 - RNA, 21 nt, Shigella flexneri 2a str. 301
gcgcaggaugcuaagcgcggu

SEQ ID NO: 3894477 - RNA, 21 nt, Shigella flexneri 2a str. 301
gcgcaggguuugcaucgccau

SEQ ID NO: 3894478 - RNA, 17 nt, Shigella flexneri 2a str. 301
gcgcaguaaauccgcca

SEQ ID NO: 3894479 - RNA, 19 nt, Shigella flexneri 2a str. 301
gcgcagucacaccagcgau

SEQ ID NO: 3894480 - RNA, 13 nt, Shigella flexneri 2a str. 301
gcgcagucaccag

SEQ ID NO: 3894481 - RNA, 20 nt, Shigella flexneri 2a str. 301
gcgcagucuggcggcuauuc

SEQ ID NO: 3894482 - RNA, 18 nt, Shigella flexneri 2a str. 301
gcgcagugccuucuggug

SEQ ID NO: 3894483 - RNA, 19 nt, Shigella flexneri 2a str. 301
gcgcagugccuucugguga

SEQ ID NO: 3894484 - RNA, 19 nt, Shigella flexneri 2a str. 301
gcgcaguucgcacaccgcu

SEQ ID NO: 3894485 - RNA, 17 nt, Shigella flexneri 2a str. 301
gcgcauaacugccggau

SEQ ID NO: 3894486 - RNA, 13 nt, Shigella flexneri 2a str. 301
gcgcaucaaagcc

SEQ ID NO: 3894487 - RNA, 14 nt, Shigella flexneri 2a str. 301
gcgcaucagcuccg

SEQ ID NO: 3894488 - RNA, 15 nt, Shigella flexneri 2a str. 301
gcgcaucagcuccgg

SEQ ID NO: 3894489 - RNA, 16 nt, Shigella flexneri 2a str. 301
gcgcaucagcuccggu

SEQ ID NO: 3894490 - RNA, 18 nt, Shigella flexneri 2a str. 301
gcgcaucagcuccgguau

SEQ ID NO: 3894491 - RNA, 14 nt, Shigella flexneri 2a str. 301
gcgcaucaggcaau

SEQ ID NO: 3894492 - RNA, 15 nt, Shigella flexneri 2a str. 301
gcgcaucaggcaguu

SEQ ID NO: 3894493 - RNA, 14 nt, Shigella flexneri 2a str. 301
gcgcauccagcgcu

SEQ ID NO: 3894494 - RNA, 14 nt, Shigella flexneri 2a str. 301
gcgcauccagcguu

SEQ ID NO: 3894495 - RNA, 17 nt, Shigella flexneri 2a str. 301
gcgcaucccauuucucc

SEQ ID NO: 3894496 - RNA, 12 nt, Shigella flexneri 2a str. 301
gcgcauccggca

SEQ ID NO: 3894497 - RNA, 15 nt, Shigella flexneri 2a str. 301
gcgcauccgggaugg

SEQ ID NO: 3894498 - RNA, 21 nt, Shigella flexneri 2a str. 301
gcgcauccgggauggucagcg

SEQ ID NO: 3894499 - RNA, 16 nt, Shigella flexneri 2a str. 301
gcgcaucgggcaaugg

SEQ ID NO: 3894500 - RNA, 18 nt, Shigella flexneri 2a str. 301
gcgcaucuuauccggccu

SEQ ID NO: 3894501 - RNA, 21 nt, Shigella flexneri 2a str. 301
gcgcauggcguccgucaucga

SEQ ID NO: 3894502 - RNA, 16 nt, Shigella flexneri 2a str. 301
gcgcauguuggcgcgg

SEQ ID NO: 3894503 - RNA, 12 nt, Shigella flexneri 2a str. 301
gcgcauugacga

SEQ ID NO: 3894504 - RNA, 16 nt, Shigella flexneri 2a str. 301
gcgcauuucccagcaa

SEQ ID NO: 3894505 - RNA, 22 nt, Shigella flexneri 2a str. 301
gcgcauuugcggcagggcaaac

SEQ ID NO: 3894506 - RNA, 15 nt, Shigella flexneri 2a str. 301
gcgccaaaugucagc

SEQ ID NO: 3894507 - RNA, 16 nt, Shigella flexneri 2a str. 301
gcgccaagcagcgcgc

SEQ ID NO: 3894508 - RNA, 18 nt, Shigella flexneri 2a str. 301
gcgccaaucagcgcagca

SEQ ID NO: 3894509 - RNA, 14 nt, Shigella flexneri 2a str. 301
gcgccaaucggcaa

SEQ ID NO: 3894510 - RNA, 15 nt, Shigella flexneri 2a str. 301
gcgccacaggucagc

SEQ ID NO: 3894511 - RNA, 24 nt, Shigella flexneri 2a str. 301
gcgccacauaagaucaucggccag

SEQ ID NO: 3894512 - RNA, 15 nt, Shigella flexneri 2a str. 301
gcgccaccaccagca

SEQ ID NO: 3894513 - RNA, 12 nt, Shigella flexneri 2a str. 301
gcgccaccaccc

SEQ ID NO: 3894514 - RNA, 14 nt, Shigella flexneri 2a str. 301
gcgccaccacccug

SEQ ID NO: 3894515 - RNA, 11 nt, Shigella flexneri 2a str. 301
gcgccaccagc

SEQ ID NO: 3894516 - RNA, 19 nt, Shigella flexneri 2a str. 301
gcgccaccucuuucaccaa

SEQ ID NO: 3894517 - RNA, 18 nt, Shigella flexneri 2a str. 301
gcgccacucgauaccaga

SEQ ID NO: 3894518 - RNA, 20 nt, Shigella flexneri 2a str. 301
gcgccagaacacgcucccag

SEQ ID NO: 3894519 - RNA, 15 nt, Shigella flexneri 2a str. 301
gcgccagaagggaca

SEQ ID NO: 3894520 - RNA, 16 nt, Shigella flexneri 2a str. 301
gcgccagacaaaccac

SEQ ID NO: 3894521 - RNA, 17 nt, Shigella flexneri 2a str. 301
gcgccagauagccgacc

SEQ ID NO: 3894522 - RNA, 19 nt, Shigella flexneri 2a str. 301
gcgccagcaagagcaaaua

SEQ ID NO: 3894523 - RNA, 22 nt, Shigella flexneri 2a str. 301
gcgccagcaagagcaaauaaaa

SEQ ID NO: 3894524 - RNA, 17 nt, Shigella flexneri 2a str. 301
gcgccagccaccacaau

SEQ ID NO: 3894525 - RNA, 13 nt, Shigella flexneri 2a str. 301
gcgccagccagcc

SEQ ID NO: 3894526 - RNA, 21 nt, Shigella flexneri 2a str. 301
gcgccagccaguuuacccagc

SEQ ID NO: 3894527 - RNA, 13 nt, Shigella flexneri 2a str. 301
gcgccagcgcgga

SEQ ID NO: 3894528 - RNA, 14 nt, Shigella flexneri 2a str. 301
gcgccagcgcuucc

SEQ ID NO: 3894529 - RNA, 12 nt, Shigella flexneri 2a str. 301
gcgccagcggca

SEQ ID NO: 3894530 - RNA, 23 nt, Shigella flexneri 2a str. 301
gcgcuagcuucagguguuagugu

SEQ ID NO: 3894531 - RNA, 20 nt, Shigella flexneri 2a str. 301
gcgcuauaucgcugauauca

SEQ ID NO: 3894532 - RNA, 14 nt, Shigella flexneri 2a str. 301
gcgcuauccugguu

SEQ ID NO: 3894533 - RNA, 14 nt, Shigella flexneri 2a str. 301
gcgcucagccagcc

SEQ ID NO: 3894534 - RNA, 21 nt, Shigella flexneri 2a str. 301
gcgcucauuuucucuuucagc

SEQ ID NO: 3894535 - RNA, 22 nt, Shigella flexneri 2a str. 301
gcgcucauuuucucuuucagcg

SEQ ID NO: 3894536 - RNA, 19 nt, Shigella flexneri 2a str. 301
gcgcuccagauuaccagcg

SEQ ID NO: 3894537 - RNA, 20 nt, Shigella flexneri 2a str. 301
gcgcuccgcuuaucaggccu

SEQ ID NO: 3894538 - RNA, 13 nt, Shigella flexneri 2a str. 301
gcgcuccuguucc

SEQ ID NO: 3894539 - RNA, 19 nt, Shigella flexneri 2a str. 301
gcgcucgaagcgggcgcgc

SEQ ID NO: 3894540 - RNA, 14 nt, Shigella flexneri 2a str. 301
gcgcucgcgccgca

SEQ ID NO: 3894541 - RNA, 18 nt, Shigella flexneri 2a str. 301
gcgcucugccagcaaaua

SEQ ID NO: 3894542 - RNA, 22 nt, Shigella flexneri 2a str. 301
gcgcugaagaaaauggccagcc

SEQ ID NO: 3894543 - RNA, 23 nt, Shigella flexneri 2a str. 301
gcgcugaagaaaauggccagcca

SEQ ID NO: 3894544 - RNA, 17 nt, Shigella flexneri 2a str. 301
gcgcugagguuaugcaa

SEQ ID NO: 3894545 - RNA, 14 nt, Shigella flexneri 2a str. 301
gcgcugcauuacua

SEQ ID NO: 3894546 - RNA, 12 nt, Shigella flexneri 2a str. 301
gcgcugccagaa

SEQ ID NO: 3894547 - RNA, 13 nt, Shigella flexneri 2a str. 301
gcgcugccggagc

SEQ ID NO: 3894548 - RNA, 21 nt, Shigella flexneri 2a str. 301
gcgcugccucucuucgcugcu

SEQ ID NO: 3894549 - RNA, 13 nt, Shigella flexneri 2a str. 301
gcgcugcggcgcg

SEQ ID NO: 3894550 - RNA, 23 nt, Shigella flexneri 2a str. 301
gcgcugcuguagcaguuccagca

SEQ ID NO: 3894551 - RNA, 11 nt, Shigella flexneri 2a str. 301
gcgcuggcaau

SEQ ID NO: 3894552 - RNA, 14 nt, Shigella flexneri 2a str. 301
gcgcuggcuccuga

SEQ ID NO: 3894553 - RNA, 18 nt, Shigella flexneri 2a str. 301
gcgcugguaaucaccacc

SEQ ID NO: 3894554 - RNA, 17 nt, Shigella flexneri 2a str. 301
gcgcuguacgguaaugg

SEQ ID NO: 3894555 - RNA, 19 nt, Shigella flexneri 2a str. 301
gcgcugucauuacgggcaa

SEQ ID NO: 3894556 - RNA, 16 nt, Shigella flexneri 2a str. 301
gcgcugugagcaggcg

SEQ ID NO: 3894557 - RNA, 19 nt, Shigella flexneri 2a str. 301
gcgcuuaacgcgggcuucu

SEQ ID NO: 3894558 - RNA, 15 nt, Shigella flexneri 2a str. 301
gcgcuuaucaggccu

SEQ ID NO: 3894559 - RNA, 19 nt, Shigella flexneri 2a str. 301
gcgcuuaucaggccuacag

SEQ ID NO: 3894560 - RNA, 15 nt, Shigella flexneri 2a str. 301
gcgcuuaucgccagc

SEQ ID NO: 3894561 - RNA, 22 nt, Shigella flexneri 2a str. 301
gcgcuucacaugccacacacga

SEQ ID NO: 3894562 - RNA, 12 nt, Shigella flexneri 2a str. 301
gcgcuuccagcu

SEQ ID NO: 3894563 - RNA, 13 nt, Shigella flexneri 2a str. 301
gcgcuuccagcuc

SEQ ID NO: 3894564 - RNA, 16 nt, Shigella flexneri 2a str. 301
gcgcuuccagcuccau

SEQ ID NO: 3894565 - RNA, 20 nt, Shigella flexneri 2a str. 301
gcgcuucgcuuauccgaccu

SEQ ID NO: 3894566 - RNA, 15 nt, Shigella flexneri 2a str. 301
gcgcuucucaggccu

SEQ ID NO: 3894567 - RNA, 13 nt, Shigella flexneri 2a str. 301
gcgcuucugccac

SEQ ID NO: 3894568 - RNA, 17 nt, Shigella flexneri 2a str. 301
gcgcuugcucuaacggu

SEQ ID NO: 3894569 - RNA, 20 nt, Shigella flexneri 2a str. 301
gcgcuuucagcacgacauaa

SEQ ID NO: 3894570 - RNA, 19 nt, Shigella flexneri 2a str. 301
gcgcuuucauggugagccu

SEQ ID NO: 3894571 - RNA, 14 nt, Shigella flexneri 2a str. 301
gcgcuuucgccagg

SEQ ID NO: 3894572 - RNA, 22 nt, Shigella flexneri 2a str. 301
gcgcuuuuggcaggaacugcuc

SEQ ID NO: 3894573 - RNA, 14 nt, Shigella flexneri 2a str. 301
gcggaaaucuccag

SEQ ID NO: 3894574 - RNA, 18 nt, Shigella flexneri 2a str. 301
gcggaacaucgccugccg

SEQ ID NO: 3894575 - RNA, 12 nt, Shigella flexneri 2a str. 301
gcggaacccagc

SEQ ID NO: 3894576 - RNA, 15 nt, Shigella flexneri 2a str. 301
gcggaacccagcgcg

SEQ ID NO: 3894577 - RNA, 19 nt, Shigella flexneri 2a str. 301
gcggaagacccggcggcgc

SEQ ID NO: 3894578 - RNA, 12 nt, Shigella flexneri 2a str. 301
gcggaauaacgc

SEQ ID NO: 3894579 - RNA, 18 nt, Shigella flexneri 2a str. 301
gcggaauagcguacggca

SEQ ID NO: 3894580 - RNA, 19 nt, Shigella flexneri 2a str. 301
gcggacaaugccuaccgca

SEQ ID NO: 3894581 - RNA, 16 nt, Shigella flexneri 2a str. 301
gcggaccaacaaaaau

SEQ ID NO: 3894582 - RNA, 21 nt, Shigella flexneri 2a str. 301
gcggacgagagagugacguca

SEQ ID NO: 3894583 - RNA, 18 nt, Shigella flexneri 2a str. 301
gcggacugaacgcggccc

SEQ ID NO: 3894584 - RNA, 14 nt, Shigella flexneri 2a str. 301
gcggacugaauacg

SEQ ID NO: 3894585 - RNA, 22 nt, Shigella flexneri 2a str. 301
gcggagacucaaaccccgcagc

SEQ ID NO: 3894586 - RNA, 20 nt, Shigella flexneri 2a str. 301
gcggagcucccaggcuccgc

SEQ ID NO: 3894587 - RNA, 15 nt, Shigella flexneri 2a str. 301
gcggaguaaucgcca

SEQ ID NO: 3894588 - RNA, 18 nt, Shigella flexneri 2a str. 301
gcggaguaaucgccagca

SEQ ID NO: 3894589 - RNA, 21 nt, Shigella flexneri 2a str. 301
gcggaguaaucgccagcaaaa

SEQ ID NO: 3894590 - RNA, 13 nt, Shigella flexneri 2a str. 301
gcggauaaagcag

SEQ ID NO: 3894591 - RNA, 19 nt, Shigella flexneri 2a str. 301
gcggauaaagcagagcagg

SEQ ID NO: 3894592 - RNA, 22 nt, Shigella flexneri 2a str. 301
gcggauaucuacaaaaccacac

SEQ ID NO: 3894593 - RNA, 23 nt, Shigella flexneri 2a str. 301
gcggaucguuaaacucugccgca

SEQ ID NO: 3894594 - RNA, 13 nt, Shigella flexneri 2a str. 301
gcggaugacccag

SEQ ID NO: 3894595 - RNA, 15 nt, Shigella flexneri 2a str. 301
gcggaugacccagcg

SEQ ID NO: 3894596 - RNA, 17 nt, Shigella flexneri 2a str. 301
gcggaugcggcguaaac

SEQ ID NO: 3894597 - RNA, 19 nt, Shigella flexneri 2a str. 301
gcggauggaguggggcgga

SEQ ID NO: 3894598 - RNA, 21 nt, Shigella flexneri 2a str. 301
gcggauggccucugccagcug

SEQ ID NO: 3894599 - RNA, 21 nt, Shigella flexneri 2a str. 301
gcggauguuggguuagccaac

SEQ ID NO: 3894600 - RNA, 18 nt, Shigella flexneri 2a str. 301
gcggauuuuauucagcag

SEQ ID NO: 3894601 - RNA, 18 nt, Shigella flexneri 2a str. 301
gcggcaaaaucgccggug

SEQ ID NO: 3894602 - RNA, 22 nt, Shigella flexneri 2a str. 301
gcggcaacauggcaaccuucgc

SEQ ID NO: 3894603 - RNA, 16 nt, Shigella flexneri 2a str. 301
gcggcaacggcuucgc

SEQ ID NO: 3894604 - RNA, 20 nt, Shigella flexneri 2a str. 301
gcggcaagaucgcgaugggu

SEQ ID NO: 3894605 - RNA, 15 nt, Shigella flexneri 2a str. 301
gcggcaagcccagcc

SEQ ID NO: 3894606 - RNA, 14 nt, Shigella flexneri 2a str. 301
gcggcaaucgccag

SEQ ID NO: 3894607 - RNA, 15 nt, Shigella flexneri 2a str. 301
gcggcaaucgcugcu

SEQ ID NO: 3894608 - RNA, 22 nt, Shigella flexneri 2a str. 301
gcggcaaugaaagcgagcgagc

SEQ ID NO: 3894609 - RNA, 23 nt, Shigella flexneri 2a str. 301
gcggcaauuagcggccagcgggc

SEQ ID NO: 3894610 - RNA, 18 nt, Shigella flexneri 2a str. 301
gcggcaauuagcggcugg

SEQ ID NO: 3894611 - RNA, 21 nt, Shigella flexneri 2a str. 301
gcggcaauuagcggcuggcug

SEQ ID NO: 3894612 - RNA, 22 nt, Shigella flexneri 2a str. 301
gcggcaauucuuucucgcucag

SEQ ID NO: 3894613 - RNA, 17 nt, Shigella flexneri 2a str. 301
gcggcacagccagcgcu

SEQ ID NO: 3894614 - RNA, 14 nt, Shigella flexneri 2a str. 301
gcggcaccagcggu

SEQ ID NO: 3894615 - RNA, 20 nt, Shigella flexneri 2a str. 301
gcggcacccauuuauccagc

SEQ ID NO: 3894616 - RNA, 18 nt, Shigella flexneri 2a str. 301
gcggcacuguuucgccag

SEQ ID NO: 3894617 - RNA, 20 nt, Shigella flexneri 2a str. 301
gcggcacuguuucgccaggu

SEQ ID NO: 3894618 - RNA, 17 nt, Shigella flexneri 2a str. 301
gcggcagcaauggcacu

SEQ ID NO: 3894619 - RNA, 20 nt, Shigella flexneri 2a str. 301
gcggcagcaggaucuccagc

SEQ ID NO: 3894620 - RNA, 12 nt, Shigella flexneri 2a str. 301
gcggcagcaggu

SEQ ID NO: 3894621 - RNA, 15 nt, Shigella flexneri 2a str. 301
gcggcagccaccgcc

SEQ ID NO: 3894622 - RNA, 21 nt, Shigella flexneri 2a str. 301
gcggcagcuuguacugcucgc

SEQ ID NO: 3894623 - RNA, 19 nt, Shigella flexneri 2a str. 301
gcggcagguugaugaugac

SEQ ID NO: 3894624 - RNA, 15 nt, Shigella flexneri 2a str. 301
gcggcaguaaauauu

SEQ ID NO: 3894625 - RNA, 19 nt, Shigella flexneri 2a str. 301
gcggcaguaaauauugucu

SEQ ID NO: 3894626 - RNA, 16 nt, Shigella flexneri 2a str. 301
gcggcauacagccagg

SEQ ID NO: 3894627 - RNA, 16 nt, Shigella flexneri 2a str. 301
gcggcauccgguaacc

SEQ ID NO: 3894628 - RNA, 22 nt, Shigella flexneri 2a str. 301
gcggcaugaacaccuucucagg

SEQ ID NO: 3894629 - RNA, 16 nt, Shigella flexneri 2a str. 301
gcggcauuacgcccga

SEQ ID NO: 3894630 - RNA, 16 nt, Shigella flexneri 2a str. 301
gcggugaccagcagca

SEQ ID NO: 3894631 - RNA, 14 nt, Shigella flexneri 2a str. 301
gcggugaugaugau

SEQ ID NO: 3894632 - RNA, 17 nt, Shigella flexneri 2a str. 301
gcggugcaagcaccuua

SEQ ID NO: 3894633 - RNA, 17 nt, Shigella flexneri 2a str. 301
gcggugcgaauugccac

SEQ ID NO: 3894634 - RNA, 16 nt, Shigella flexneri 2a str. 301
gcgguggauaaagcac

SEQ ID NO: 3894635 - RNA, 16 nt, Shigella flexneri 2a str. 301
gcgguggcuucgccuu

SEQ ID NO: 3894636 - RNA, 16 nt, Shigella flexneri 2a str. 301
gcggugggcuacggca

SEQ ID NO: 3894637 - RNA, 14 nt, Shigella flexneri 2a str. 301
gcggugguacggca

SEQ ID NO: 3894638 - RNA, 16 nt, Shigella flexneri 2a str. 301
gcgguggucgaugccc

SEQ ID NO: 3894639 - RNA, 15 nt, Shigella flexneri 2a str. 301
gcgguguaggccuga

SEQ ID NO: 3894640 - RNA, 17 nt, Shigella flexneri 2a str. 301
gcgguguauaccagcuc

SEQ ID NO: 3894641 - RNA, 20 nt, Shigella flexneri 2a str. 301
gcggugucaauucccgagcu

SEQ ID NO: 3894642 - RNA, 19 nt, Shigella flexneri 2a str. 301
gcgguuaacaauacgccca

SEQ ID NO: 3894643 - RNA, 17 nt, Shigella flexneri 2a str. 301
gcgguugacggaaagca

SEQ ID NO: 3894644 - RNA, 13 nt, Shigella flexneri 2a str. 301
gcgguugauccuc

SEQ ID NO: 3894645 - RNA, 16 nt, Shigella flexneri 2a str. 301
gcgguugcaggcuauu

SEQ ID NO: 3894646 - RNA, 20 nt, Shigella flexneri 2a str. 301
gcgguugcugucggcggcga

SEQ ID NO: 3894647 - RNA, 23 nt, Shigella flexneri 2a str. 301
gcgguuggcaaucaguuuuuguu

SEQ ID NO: 3894648 - RNA, 14 nt, Shigella flexneri 2a str. 301
gcgguugugccgga

SEQ ID NO: 3894649 - RNA, 17 nt, Shigella flexneri 2a str. 301
gcgguuuucucuuguuc

SEQ ID NO: 3894650 - RNA, 21 nt, Shigella flexneri 2a str. 301
gcgguuuucucuuuaaacaga

SEQ ID NO: 3894651 - RNA, 16 nt, Shigella flexneri 2a str. 301
gcguaaauccagcggc

SEQ ID NO: 3894652 - RNA, 22 nt, Shigella flexneri 2a str. 301
gcguaagcgcauccggcaccag

SEQ ID NO: 3894653 - RNA, 17 nt, Shigella flexneri 2a str. 301
gcguaagcgcggauuuu

SEQ ID NO: 3894654 - RNA, 21 nt, Shigella flexneri 2a str. 301
gcguacaauagccacauugcu

SEQ ID NO: 3894655 - RNA, 15 nt, Shigella flexneri 2a str. 301
gcguacaccaacauc

SEQ ID NO: 3894656 - RNA, 19 nt, Shigella flexneri 2a str. 301
gcguacagagggcaggcaa

SEQ ID NO: 3894657 - RNA, 13 nt, Shigella flexneri 2a str. 301
gcguacagcgagg

SEQ ID NO: 3894658 - RNA, 12 nt, Shigella flexneri 2a str. 301
gcguacagcgcg

SEQ ID NO: 3894659 - RNA, 15 nt, Shigella flexneri 2a str. 301
gcguaccaggcgugg

SEQ ID NO: 3894660 - RNA, 15 nt, Shigella flexneri 2a str. 301
gcguagccggugccg

SEQ ID NO: 3894661 - RNA, 18 nt, Shigella flexneri 2a str. 301
gcguagcgcaucaggcaa

SEQ ID NO: 3894662 - RNA, 20 nt, Shigella flexneri 2a str. 301
gcguagcuaccuugcucggc

SEQ ID NO: 3894663 - RNA, 14 nt, Shigella flexneri 2a str. 301
gcguagcugagcaa

SEQ ID NO: 3894664 - RNA, 16 nt, Shigella flexneri 2a str. 301
gcguagugaaggcaaa

SEQ ID NO: 3894665 - RNA, 22 nt, Shigella flexneri 2a str. 301
gcguaucaauuaacgguugcgg

SEQ ID NO: 3894666 - RNA, 18 nt, Shigella flexneri 2a str. 301
gcguauccgaugaaucac

SEQ ID NO: 3894667 - RNA, 19 nt, Shigella flexneri 2a str. 301
gcguaucgacaaucaccag

SEQ ID NO: 3894668 - RNA, 15 nt, Shigella flexneri 2a str. 301
gcguaucgcccugcc

SEQ ID NO: 3894669 - RNA, 14 nt, Shigella flexneri 2a str. 301
gcguaugcccagcg

SEQ ID NO: 3894670 - RNA, 17 nt, Shigella flexneri 2a str. 301
gcguaugcccggugcgg

SEQ ID NO: 3894671 - RNA, 17 nt, Shigella flexneri 2a str. 301
gcguauuaauuccggug

SEQ ID NO: 3894672 - RNA, 12 nt, Shigella flexneri 2a str. 301
gcgucaaacggc

SEQ ID NO: 3894673 - RNA, 16 nt, Shigella flexneri 2a str. 301
gcgucaacagggcaga

SEQ ID NO: 3894674 - RNA, 18 nt, Shigella flexneri 2a str. 301
gcgucaaggucaacaguu

SEQ ID NO: 3894675 - RNA, 23 nt, Shigella flexneri 2a str. 301
gcgucaauuuguuccgccagcga

SEQ ID NO: 3894676 - RNA, 20 nt, Shigella flexneri 2a str. 301
gcgucacgccgaccagaccg

SEQ ID NO: 3894677 - RNA, 13 nt, Shigella flexneri 2a str. 301
gcgucagaaacag

SEQ ID NO: 3894678 - RNA, 17 nt, Shigella flexneri 2a str. 301
gcgucagaguuuagcga

SEQ ID NO: 3894679 - RNA, 14 nt, Shigella flexneri 2a str. 301
gcgucagcaacaug

SEQ ID NO: 3894680 - RNA, 16 nt, Shigella flexneri 2a str. 301
gcgucagccagaaaga

SEQ ID NO: 3894681 - RNA, 17 nt, Shigella flexneri 2a str. 301
gcgucagccugcucagu

SEQ ID NO: 3894682 - RNA, 17 nt, Shigella flexneri 2a str. 301
gcgucagcuuucagaga

SEQ ID NO: 3894683 - RNA, 20 nt, Shigella flexneri 2a str. 301
gcgucaggucacccaacaug

SEQ ID NO: 3894684 - RNA, 15 nt, Shigella flexneri 2a str. 301
gcgucauaauccggc

SEQ ID NO: 3894685 - RNA, 22 nt, Shigella flexneri 2a str. 301
gcgucauauuacugcaacugcg

SEQ ID NO: 3894686 - RNA, 19 nt, Shigella flexneri 2a str. 301
gcgucauccagcacuugca

SEQ ID NO: 3894687 - RNA, 23 nt, Shigella flexneri 2a str. 301
gcgucaucggauggucugguuua

SEQ ID NO: 3894688 - RNA, 18 nt, Shigella flexneri 2a str. 301
gcgucauugacgcuggcu

SEQ ID NO: 3894689 - RNA, 20 nt, Shigella flexneri 2a str. 301
gcguccauuuugagggaaac

SEQ ID NO: 3894690 - RNA, 18 nt, Shigella flexneri 2a str. 301
gcgucccagauagcuguc

SEQ ID NO: 3894691 - RNA, 15 nt, Shigella flexneri 2a str. 301
gcgucccaucggcaa

SEQ ID NO: 3894692 - RNA, 21 nt, Shigella flexneri 2a str. 301
gcguccgcucggucacugaca

SEQ ID NO: 3894693 - RNA, 18 nt, Shigella flexneri 2a str. 301
gcguccggcgucgcuucu

SEQ ID NO: 3894694 - RNA, 18 nt, Shigella flexneri 2a str. 301
gcguccugccugggacgg

SEQ ID NO: 3894695 - RNA, 16 nt, Shigella flexneri 2a str. 301
gcgucgauugcucaac

SEQ ID NO: 3894696 - RNA, 22 nt, Shigella flexneri 2a str. 301
gcgucgcaucaggcaaugugcu

SEQ ID NO: 3894697 - RNA, 18 nt, Shigella flexneri 2a str. 301
gcgucgcaucaggcauca

SEQ ID NO: 3894698 - RNA, 19 nt, Shigella flexneri 2a str. 301
gcgucgcaucaggcaucug

SEQ ID NO: 3894699 - RNA, 16 nt, Shigella flexneri 2a str. 301
gcgucgcauccggcaa

SEQ ID NO: 3894700 - RNA, 20 nt, Shigella flexneri 2a str. 301
gcgucguccccacagcguca

SEQ ID NO: 3894701 - RNA, 21 nt, Shigella flexneri 2a str. 301
gcgucgugaaugccuuauccg

SEQ ID NO: 3894702 - RNA, 20 nt, Shigella flexneri 2a str. 301
gcgucguucgcgccaacagc

SEQ ID NO: 3894703 - RNA, 16 nt, Shigella flexneri 2a str. 301
gcgucucauaccggau

SEQ ID NO: 3894704 - RNA, 23 nt, Shigella flexneri 2a str. 301
gcgucucaucuuuaucggugaga

SEQ ID NO: 3894705 - RNA, 11 nt, Shigella flexneri 2a str. 301
gcgucuggaag

SEQ ID NO: 3894706 - RNA, 13 nt, Shigella flexneri 2a str. 301
gcgucuggaagaa

SEQ ID NO: 3894707 - RNA, 11 nt, Shigella flexneri 2a str. 301
gcgucugggcg

SEQ ID NO: 3894708 - RNA, 15 nt, Shigella flexneri 2a str. 301
gcgucuuaucaggcc

SEQ ID NO: 3894709 - RNA, 20 nt, Shigella flexneri 2a str. 301
gcgucuuaucaggccagcca

SEQ ID NO: 3894710 - RNA, 16 nt, Shigella flexneri 2a str. 301
gcgucuuaucaggccu

SEQ ID NO: 3894711 - RNA, 20 nt, Shigella flexneri 2a str. 301
gcgucuuaucaugccuacag

SEQ ID NO: 3894712 - RNA, 14 nt, Shigella flexneri 2a str. 301
gcgucuuauccggc

SEQ ID NO: 3894713 - RNA, 16 nt, Shigella flexneri 2a str. 301
gcgucuuaucuggccu

SEQ ID NO: 3894714 - RNA, 18 nt, Shigella flexneri 2a str. 301
gcgucuuccgugccugac

SEQ ID NO: 3894715 - RNA, 17 nt, Shigella flexneri 2a str. 301
gcgucuuguugaacagg

SEQ ID NO: 3894716 - RNA, 22 nt, Shigella flexneri 2a str. 301
gcgugaacgccuaauccagccu

SEQ ID NO: 3894717 - RNA, 19 nt, Shigella flexneri 2a str. 301
gcgugaacgugcaaaauca

SEQ ID NO: 3894718 - RNA, 14 nt, Shigella flexneri 2a str. 301
gcgugacaccagca

SEQ ID NO: 3894719 - RNA, 23 nt, Shigella flexneri 2a str. 301
gcgugacaccagcacaucaucaa

SEQ ID NO: 3894720 - RNA, 16 nt, Shigella flexneri 2a str. 301
gcgugaccaguugcuc

SEQ ID NO: 3894721 - RNA, 20 nt, Shigella flexneri 2a str. 301
gcgugacgaaagucugggcc

SEQ ID NO: 3894722 - RNA, 21 nt, Shigella flexneri 2a str. 301
gcgugauucauacagcggcca

SEQ ID NO: 3894723 - RNA, 22 nt, Shigella flexneri 2a str. 301
gcgugauucauacagcggccag

SEQ ID NO: 3894724 - RNA, 16 nt, Shigella flexneri 2a str. 301
gcgugauuguggcaau

SEQ ID NO: 3894725 - RNA, 21 nt, Shigella flexneri 2a str. 301
gcgugcaguggugcgaucucg

SEQ ID NO: 3894726 - RNA, 20 nt, Shigella flexneri 2a str. 301
gcgugccuaauuccgcgcga

SEQ ID NO: 3894727 - RNA, 10 nt, Shigella flexneri 2a str. 301
gcgugcuaac

SEQ ID NO: 3894728 - RNA, 13 nt, Shigella flexneri 2a str. 301
gcguggaaaccuu

SEQ ID NO: 3894729 - RNA, 21 nt, Shigella flexneri 2a str. 301
gcguggcaucaauaccgcgua

SEQ ID NO: 3894730 - RNA, 14 nt, Shigella flexneri 2a str. 301
gcuauugcggauga

SEQ ID NO: 3894731 - RNA, 13 nt, Shigella flexneri 2a str. 301
gcuauuuaacagu

SEQ ID NO: 3894732 - RNA, 15 nt, Shigella flexneri 2a str. 301
gcuauuuccggcgac

SEQ ID NO: 3894733 - RNA, 16 nt, Shigella flexneri 2a str. 301
gcuauuugcccaccug

SEQ ID NO: 3894734 - RNA, 13 nt, Shigella flexneri 2a str. 301
gcuauuuuuugca

SEQ ID NO: 3894735 - RNA, 16 nt, Shigella flexneri 2a str. 301
gcucaaaacaaaaacc

SEQ ID NO: 3894736 - RNA, 14 nt, Shigella flexneri 2a str. 301
gcucaaaccagcga

SEQ ID NO: 3894737 - RNA, 16 nt, Shigella flexneri 2a str. 301
gcucaaaccagcgacg

SEQ ID NO: 3894738 - RNA, 22 nt, Shigella flexneri 2a str. 301
gcucaaaguaaucaagcccugg

SEQ ID NO: 3894739 - RNA, 18 nt, Shigella flexneri 2a str. 301
gcucaaauccaucagacc

SEQ ID NO: 3894740 - RNA, 13 nt, Shigella flexneri 2a str. 301
gcucaacaauaaa

SEQ ID NO: 3894741 - RNA, 17 nt, Shigella flexneri 2a str. 301
gcucaacaauaaacugg

SEQ ID NO: 3894742 - RNA, 19 nt, Shigella flexneri 2a str. 301
gcucaacaauaaacuggcu

SEQ ID NO: 3894743 - RNA, 22 nt, Shigella flexneri 2a str. 301
gcucaacaauaaacuggcugug

SEQ ID NO: 3894744 - RNA, 22 nt, Shigella flexneri 2a str. 301
gcucaacgcguggaucaagcaa

SEQ ID NO: 3894745 - RNA, 16 nt, Shigella flexneri 2a str. 301
gcucaaggguuucgcg

SEQ ID NO: 3894746 - RNA, 16 nt, Shigella flexneri 2a str. 301
gcucaauacaacccac

SEQ ID NO: 3894747 - RNA, 16 nt, Shigella flexneri 2a str. 301
gcucaaucgcauggcu

SEQ ID NO: 3894748 - RNA, 12 nt, Shigella flexneri 2a str. 301
gcucaaucugcg

SEQ ID NO: 3894749 - RNA, 22 nt, Shigella flexneri 2a str. 301
gcucaaugagcaccuuuuuucu

SEQ ID NO: 3894750 - RNA, 19 nt, Shigella flexneri 2a str. 301
gcucaccacgcagcagcca

SEQ ID NO: 3894751 - RNA, 18 nt, Shigella flexneri 2a str. 301
gcucaccagcagcggucg

SEQ ID NO: 3894752 - RNA, 13 nt, Shigella flexneri 2a str. 301
gcucaccgccagc

SEQ ID NO: 3894753 - RNA, 17 nt, Shigella flexneri 2a str. 301
gcucaccgccagcaucg

SEQ ID NO: 3894754 - RNA, 13 nt, Shigella flexneri 2a str. 301
gcucaccugcaca

SEQ ID NO: 3894755 - RNA, 14 nt, Shigella flexneri 2a str. 301
gcucacgcccauca

SEQ ID NO: 3894756 - RNA, 14 nt, Shigella flexneri 2a str. 301
gcucacgcgcugcc

SEQ ID NO: 3894757 - RNA, 21 nt, Shigella flexneri 2a str. 301
gcucacgcgcugccucucuuc

SEQ ID NO: 3894758 - RNA, 16 nt, Shigella flexneri 2a str. 301
gcucacugcaaaacag

SEQ ID NO: 3894759 - RNA, 23 nt, Shigella flexneri 2a str. 301
gcucacuucgcuuacgccugcca

SEQ ID NO: 3894760 - RNA, 21 nt, Shigella flexneri 2a str. 301
gcucagaagacgcuccagugu

SEQ ID NO: 3894761 - RNA, 11 nt, Shigella flexneri 2a str. 301
gcucagacucu

SEQ ID NO: 3894762 - RNA, 21 nt, Shigella flexneri 2a str. 301
gcucagcuccucuuucauuuc

SEQ ID NO: 3894763 - RNA, 22 nt, Shigella flexneri 2a str. 301
gcucaggaguaaacuuucccug

SEQ ID NO: 3894764 - RNA, 13 nt, Shigella flexneri 2a str. 301
gcucaggguuuuc

SEQ ID NO: 3894765 - RNA, 18 nt, Shigella flexneri 2a str. 301
gcucaguugcaucgucug

SEQ ID NO: 3894766 - RNA, 13 nt, Shigella flexneri 2a str. 301
gcucaguuucgcg

SEQ ID NO: 3894767 - RNA, 21 nt, Shigella flexneri 2a str. 301
gcucauaaaaucacgcgccug

SEQ ID NO: 3894768 - RNA, 17 nt, Shigella flexneri 2a str. 301
gcucauacucugucuga

SEQ ID NO: 3894769 - RNA, 17 nt, Shigella flexneri 2a str. 301
gcucauacuuccacgca

SEQ ID NO: 3894770 - RNA, 15 nt, Shigella flexneri 2a str. 301
gcucauagcggcugc

SEQ ID NO: 3894771 - RNA, 15 nt, Shigella flexneri 2a str. 301
gcucauauuccugca

SEQ ID NO: 3894772 - RNA, 15 nt, Shigella flexneri 2a str. 301
gcucaucaauacgcc

SEQ ID NO: 3894773 - RNA, 14 nt, Shigella flexneri 2a str. 301
gcucaucagcuccg

SEQ ID NO: 3894774 - RNA, 16 nt, Shigella flexneri 2a str. 301
gcucaucagcuccggu

SEQ ID NO: 3894775 - RNA, 12 nt, Shigella flexneri 2a str. 301
gcucaucgccuu

SEQ ID NO: 3894776 - RNA, 21 nt, Shigella flexneri 2a str. 301
gcucaucggcauacagcgaca

SEQ ID NO: 3894777 - RNA, 22 nt, Shigella flexneri 2a str. 301
gcucaucggguaacggaccgca

SEQ ID NO: 3894778 - RNA, 20 nt, Shigella flexneri 2a str. 301
gcucaucuaaugcaggggcg

SEQ ID NO: 3894779 - RNA, 17 nt, Shigella flexneri 2a str. 301
gcucaucugcugcguuu

SEQ ID NO: 3894780 - RNA, 21 nt, Shigella flexneri 2a str. 301
gcucauucuuccuccagcggu

SEQ ID NO: 3894781 - RNA, 18 nt, Shigella flexneri 2a str. 301
gcucauugcggcaacaau

SEQ ID NO: 3894782 - RNA, 15 nt, Shigella flexneri 2a str. 301
gcucauuuuccggga

SEQ ID NO: 3894783 - RNA, 17 nt, Shigella flexneri 2a str. 301
gcucauuuucucuuuca

SEQ ID NO: 3894784 - RNA, 23 nt, Shigella flexneri 2a str. 301
gcuccacaagaaugccugccagc

SEQ ID NO: 3894785 - RNA, 18 nt, Shigella flexneri 2a str. 301
gcuccacaagcuccggcu

SEQ ID NO: 3894786 - RNA, 18 nt, Shigella flexneri 2a str. 301
gcuccaccgauuuugaga

SEQ ID NO: 3894787 - RNA, 12 nt, Shigella flexneri 2a str. 301
gcuccacgcugc

SEQ ID NO: 3894788 - RNA, 19 nt, Shigella flexneri 2a str. 301
gcuccagauuaccagcgac

SEQ ID NO: 3894789 - RNA, 20 nt, Shigella flexneri 2a str. 301
gcuccagcaaaaagcggcuc

SEQ ID NO: 3894790 - RNA, 18 nt, Shigella flexneri 2a str. 301
gcuccagccgcucccuuc

SEQ ID NO: 3894791 - RNA, 13 nt, Shigella flexneri 2a str. 301
gcuccagcgggcg

SEQ ID NO: 3894792 - RNA, 21 nt, Shigella flexneri 2a str. 301
gcuccagcgggcgaaucaacu

SEQ ID NO: 3894793 - RNA, 20 nt, Shigella flexneri 2a str. 301
gcuccagcguaccugccgcg

SEQ ID NO: 3894794 - RNA, 15 nt, Shigella flexneri 2a str. 301
gcuccagguccuccu

SEQ ID NO: 3894795 - RNA, 17 nt, Shigella flexneri 2a str. 301
gcuccagguccuccugu

SEQ ID NO: 3894796 - RNA, 10 nt, Shigella flexneri 2a str. 301
gcuccagugc

SEQ ID NO: 3894797 - RNA, 18 nt, Shigella flexneri 2a str. 301
gcuccagugcauccagca

SEQ ID NO: 3894798 - RNA, 22 nt, Shigella flexneri 2a str. 301
gcuccagugccugugacaacac

SEQ ID NO: 3894799 - RNA, 13 nt, Shigella flexneri 2a str. 301
gcuccagugcgcu

SEQ ID NO: 3894800 - RNA, 15 nt, Shigella flexneri 2a str. 301
gcuccaguguggcca

SEQ ID NO: 3894801 - RNA, 16 nt, Shigella flexneri 2a str. 301
gcuccauaauugccag

SEQ ID NO: 3894802 - RNA, 18 nt, Shigella flexneri 2a str. 301
gcuccauaauugccagcu

SEQ ID NO: 3894803 - RNA, 18 nt, Shigella flexneri 2a str. 301
gcuccauacugccggcau

SEQ ID NO: 3894804 - RNA, 14 nt, Shigella flexneri 2a str. 301
gcuccauccaccag

SEQ ID NO: 3894805 - RNA, 22 nt, Shigella flexneri 2a str. 301
gcuccaugagaagcugaaauca

SEQ ID NO: 3894806 - RNA, 19 nt, Shigella flexneri 2a str. 301
gcucccaggcuccgccaga

SEQ ID NO: 3894807 - RNA, 15 nt, Shigella flexneri 2a str. 301
gcucccgcagccacu

SEQ ID NO: 3894808 - RNA, 18 nt, Shigella flexneri 2a str. 301
gcucccgcagccacuccu

SEQ ID NO: 3894809 - RNA, 16 nt, Shigella flexneri 2a str. 301
gcucccguaauuccgc

SEQ ID NO: 3894810 - RNA, 22 nt, Shigella flexneri 2a str. 301
gcucccugaauaacaccagcca

SEQ ID NO: 3894811 - RNA, 17 nt, Shigella flexneri 2a str. 301
gcucccugcggcgauga

SEQ ID NO: 3894812 - RNA, 22 nt, Shigella flexneri 2a str. 301
gcuccgcaagcgaaugaggcag

SEQ ID NO: 3894813 - RNA, 19 nt, Shigella flexneri 2a str. 301
gcuccgccaucuucuugca

SEQ ID NO: 3894814 - RNA, 22 nt, Shigella flexneri 2a str. 301
gcuccggcgcgauaucgacgac

SEQ ID NO: 3894815 - RNA, 18 nt, Shigella flexneri 2a str. 301
gcuccggcggcacagcca

SEQ ID NO: 3894816 - RNA, 21 nt, Shigella flexneri 2a str. 301
gcuccggcgggguuuuuugua

SEQ ID NO: 3894817 - RNA, 21 nt, Shigella flexneri 2a str. 301
gcuccgggaaaacgcuggcag

SEQ ID NO: 3894818 - RNA, 19 nt, Shigella flexneri 2a str. 301
gcuccgggcugguuuucag

SEQ ID NO: 3894819 - RNA, 13 nt, Shigella flexneri 2a str. 301
gcuccguaaaccc

SEQ ID NO: 3894820 - RNA, 14 nt, Shigella flexneri 2a str. 301
gcuccguaaacccc

SEQ ID NO: 3894821 - RNA, 15 nt, Shigella flexneri 2a str. 301
gcuccguccagccac

SEQ ID NO: 3894822 - RNA, 18 nt, Shigella flexneri 2a str. 301
gcuccguccagccaccgc

SEQ ID NO: 3894823 - RNA, 14 nt, Shigella flexneri 2a str. 301
gcuccguuucccuc

SEQ ID NO: 3894824 - RNA, 17 nt, Shigella flexneri 2a str. 301
gcuccuccuucucaccu

SEQ ID NO: 3894825 - RNA, 19 nt, Shigella flexneri 2a str. 301
gcuccucgaguccuuccag

SEQ ID NO: 3894826 - RNA, 13 nt, Shigella flexneri 2a str. 301
gcuccucuuucau

SEQ ID NO: 3894827 - RNA, 14 nt, Shigella flexneri 2a str. 301
gcuccugcauugac

SEQ ID NO: 3894828 - RNA, 20 nt, Shigella flexneri 2a str. 301
gcuccuggcgaaucaggacc

SEQ ID NO: 3894829 - RNA, 21 nt, Shigella flexneri 2a str. 301
gcuccuggcgguuaauaauga

SEQ ID NO: 3894830 - RNA, 22 nt, Shigella flexneri 2a str. 301
gcugacuccccgauuguugaug

SEQ ID NO: 3894831 - RNA, 19 nt, Shigella flexneri 2a str. 301
gcugacugauauugcccgu

SEQ ID NO: 3894832 - RNA, 17 nt, Shigella flexneri 2a str. 301
gcugacuguaggccgga

SEQ ID NO: 3894833 - RNA, 21 nt, Shigella flexneri 2a str. 301
gcugacuuugacauguugcug

SEQ ID NO: 3894834 - RNA, 11 nt, Shigella flexneri 2a str. 301
gcugagauacu

SEQ ID NO: 3894835 - RNA, 21 nt, Shigella flexneri 2a str. 301
gcugagauacucaagcagcca

SEQ ID NO: 3894836 - RNA, 20 nt, Shigella flexneri 2a str. 301
gcugagaucaaacucuuuca

SEQ ID NO: 3894837 - RNA, 14 nt, Shigella flexneri 2a str. 301
gcugagcacuaucc

SEQ ID NO: 3894838 - RNA, 23 nt, Shigella flexneri 2a str. 301
gcugagcgugccccugaauaauc

SEQ ID NO: 3894839 - RNA, 18 nt, Shigella flexneri 2a str. 301
gcugagguuaugcaaacg

SEQ ID NO: 3894840 - RNA, 21 nt, Shigella flexneri 2a str. 301
gcugaguguaacgcuugcuga

SEQ ID NO: 3894841 - RNA, 19 nt, Shigella flexneri 2a str. 301
gcugauaaaacucucaucu

SEQ ID NO: 3894842 - RNA, 20 nt, Shigella flexneri 2a str. 301
gcugauaaaguguucuccau

SEQ ID NO: 3894843 - RNA, 22 nt, Shigella flexneri 2a str. 301
gcugauaaaucccgccgcuuca

SEQ ID NO: 3894844 - RNA, 15 nt, Shigella flexneri 2a str. 301
gcugauaugccagac

SEQ ID NO: 3894845 - RNA, 17 nt, Shigella flexneri 2a str. 301
gcugauauucgacacca

SEQ ID NO: 3894846 - RNA, 22 nt, Shigella flexneri 2a str. 301
gcugaugauuaacagcaaacag

SEQ ID NO: 3894847 - RNA, 16 nt, Shigella flexneri 2a str. 301
gcugaugcagcgauga

SEQ ID NO: 3894848 - RNA, 15 nt, Shigella flexneri 2a str. 301
gcugaugcaggcgau

SEQ ID NO: 3894849 - RNA, 18 nt, Shigella flexneri 2a str. 301
gcugaugccaggcucgga

SEQ ID NO: 3894850 - RNA, 15 nt, Shigella flexneri 2a str. 301
gcugaugucagcacu

SEQ ID NO: 3894851 - RNA, 21 nt, Shigella flexneri 2a str. 301
gcugauguuguuucucuuucu

SEQ ID NO: 3894852 - RNA, 22 nt, Shigella flexneri 2a str. 301
gcugauuaaaaccgaggggcug

SEQ ID NO: 3894853 - RNA, 22 nt, Shigella flexneri 2a str. 301
gcugauuaccuuccugccagau

SEQ ID NO: 3894854 - RNA, 23 nt, Shigella flexneri 2a str. 301
gcugauuaugucaucaucgccac

SEQ ID NO: 3894855 - RNA, 14 nt, Shigella flexneri 2a str. 301
gcugauuucaccau

SEQ ID NO: 3894856 - RNA, 16 nt, Shigella flexneri 2a str. 301
gcugauuucaccaucu

SEQ ID NO: 3894857 - RNA, 21 nt, Shigella flexneri 2a str. 301
gcugauuuugcugaucggcaa

SEQ ID NO: 3894858 - RNA, 13 nt, Shigella flexneri 2a str. 301
gcugauuuuucug

SEQ ID NO: 3894859 - RNA, 16 nt, Shigella flexneri 2a str. 301
gcugauuuuuuuucaa

SEQ ID NO: 3894860 - RNA, 19 nt, Shigella flexneri 2a str. 301
gcugauuuuuuuucaaccu

SEQ ID NO: 3894861 - RNA, 13 nt, Shigella flexneri 2a str. 301
gcugcaaaaaauu

SEQ ID NO: 3894862 - RNA, 21 nt, Shigella flexneri 2a str. 301
gcugcaaacccugagcgguua

SEQ ID NO: 3894863 - RNA, 21 nt, Shigella flexneri 2a str. 301
gcugcaaagcauuuuuucaca

SEQ ID NO: 3894864 - RNA, 22 nt, Shigella flexneri 2a str. 301
gcugcaagaugaauaauguuua

SEQ ID NO: 3894865 - RNA, 18 nt, Shigella flexneri 2a str. 301
gcugcaaggugaaagcaa

SEQ ID NO: 3894866 - RNA, 20 nt, Shigella flexneri 2a str. 301
gcugcacaauugccagcccu

SEQ ID NO: 3894867 - RNA, 22 nt, Shigella flexneri 2a str. 301
gcugcacacagggcgcuagcca

SEQ ID NO: 3894868 - RNA, 18 nt, Shigella flexneri 2a str. 301
gcugcaccaacaucaugc

SEQ ID NO: 3894869 - RNA, 18 nt, Shigella flexneri 2a str. 301
gcugcacguuuucaaccg

SEQ ID NO: 3894870 - RNA, 21 nt, Shigella flexneri 2a str. 301
gcugcacugguuuccgccagc

SEQ ID NO: 3894871 - RNA, 14 nt, Shigella flexneri 2a str. 301
gcugcagccagggu

SEQ ID NO: 3894872 - RNA, 15 nt, Shigella flexneri 2a str. 301
gcugcagcucuuuca

SEQ ID NO: 3894873 - RNA, 19 nt, Shigella flexneri 2a str. 301
gcugcaggaauaaucagca

SEQ ID NO: 3894874 - RNA, 22 nt, Shigella flexneri 2a str. 301
gcugcaggaauaaucagcaacg

SEQ ID NO: 3894875 - RNA, 17 nt, Shigella flexneri 2a str. 301
gcugcagugcaaugacu

SEQ ID NO: 3894876 - RNA, 13 nt, Shigella flexneri 2a str. 301
gcugcauccgcgc

SEQ ID NO: 3894877 - RNA, 14 nt, Shigella flexneri 2a str. 301
gcugcauccgcgcu

SEQ ID NO: 3894878 - RNA, 12 nt, Shigella flexneri 2a str. 301
gcugcaucugaa

SEQ ID NO: 3894879 - RNA, 20 nt, Shigella flexneri 2a str. 301
gcugcaucuguuuuccgaug

SEQ ID NO: 3894880 - RNA, 19 nt, Shigella flexneri 2a str. 301
gcugcauggcaauuuucgu

SEQ ID NO: 3894881 - RNA, 21 nt, Shigella flexneri 2a str. 301
gcugcauugcccaauacagcg

SEQ ID NO: 3894882 - RNA, 20 nt, Shigella flexneri 2a str. 301
gcugcauuugccccuguuga

SEQ ID NO: 3894883 - RNA, 22 nt, Shigella flexneri 2a str. 301
gcugccagaaaucggccuucca

SEQ ID NO: 3894884 - RNA, 20 nt, Shigella flexneri 2a str. 301
gcugccagaucaucguuucc

SEQ ID NO: 3894885 - RNA, 15 nt, Shigella flexneri 2a str. 301
gcugccagccaggau

SEQ ID NO: 3894886 - RNA, 14 nt, Shigella flexneri 2a str. 301
gcugccagccgccg

SEQ ID NO: 3894887 - RNA, 22 nt, Shigella flexneri 2a str. 301
gcugccagcgauuuaucggcaa

SEQ ID NO: 3894888 - RNA, 17 nt, Shigella flexneri 2a str. 301
gcugccaggucgugcca

SEQ ID NO: 3894889 - RNA, 14 nt, Shigella flexneri 2a str. 301
gcugcccaugcgcu

SEQ ID NO: 3894890 - RNA, 16 nt, Shigella flexneri 2a str. 301
gcugccgacaaaugca

SEQ ID NO: 3894891 - RNA, 15 nt, Shigella flexneri 2a str. 301
gcugccgccaguucu

SEQ ID NO: 3894892 - RNA, 21 nt, Shigella flexneri 2a str. 301
gcugccgccaguucuuccagu

SEQ ID NO: 3894893 - RNA, 23 nt, Shigella flexneri 2a str. 301
gcugccgcuucuucuucagcgcu

SEQ ID NO: 3894894 - RNA, 22 nt, Shigella flexneri 2a str. 301
gcugccggaaggcagccuuucu

SEQ ID NO: 3894895 - RNA, 23 nt, Shigella flexneri 2a str. 301
gcugccggaaggcagccuuucuc

SEQ ID NO: 3894896 - RNA, 21 nt, Shigella flexneri 2a str. 301
gcugccggcacaggcaucacu

SEQ ID NO: 3894897 - RNA, 17 nt, Shigella flexneri 2a str. 301
gcugccggggagauauu

SEQ ID NO: 3894898 - RNA, 23 nt, Shigella flexneri 2a str. 301
gcugccggggagauauuccccag

SEQ ID NO: 3894899 - RNA, 19 nt, Shigella flexneri 2a str. 301
gcugccgggguaaagcgcg

SEQ ID NO: 3894900 - RNA, 17 nt, Shigella flexneri 2a str. 301
gcugccucgcugaagcu

SEQ ID NO: 3894901 - RNA, 17 nt, Shigella flexneri 2a str. 301
gcugccucucuucgcug

SEQ ID NO: 3894902 - RNA, 20 nt, Shigella flexneri 2a str. 301
gcugccucucuucgcugcug

SEQ ID NO: 3894903 - RNA, 20 nt, Shigella flexneri 2a str. 301
gcugccuguacggcagugaa

SEQ ID NO: 3894904 - RNA, 19 nt, Shigella flexneri 2a str. 301
gcugccuucggcgucucca

SEQ ID NO: 3894905 - RNA, 19 nt, Shigella flexneri 2a str. 301
gcugcgaucgcaaauccau

SEQ ID NO: 3894906 - RNA, 20 nt, Shigella flexneri 2a str. 301
gcugcgcaggaugcuaagcg

SEQ ID NO: 3894907 - RNA, 23 nt, Shigella flexneri 2a str. 301
gcugcgccaguugcuuauccagc

SEQ ID NO: 3894908 - RNA, 19 nt, Shigella flexneri 2a str. 301
gcugcgggaguugcuccac

SEQ ID NO: 3894909 - RNA, 16 nt, Shigella flexneri 2a str. 301
gcugcgguugaacgcc

SEQ ID NO: 3894910 - RNA, 18 nt, Shigella flexneri 2a str. 301
gcugcgguuuacgccagg

SEQ ID NO: 3894911 - RNA, 18 nt, Shigella flexneri 2a str. 301
gcugcgugaggcggucug

SEQ ID NO: 3894912 - RNA, 15 nt, Shigella flexneri 2a str. 301
gcugcguggcgcuuu

SEQ ID NO: 3894913 - RNA, 23 nt, Shigella flexneri 2a str. 301
gcugcguuugcccuaaagcgcga

SEQ ID NO: 3894914 - RNA, 12 nt, Shigella flexneri 2a str. 301
gcugcuaauauu

SEQ ID NO: 3894915 - RNA, 13 nt, Shigella flexneri 2a str. 301
gcugcuauccagu

SEQ ID NO: 3894916 - RNA, 22 nt, Shigella flexneri 2a str. 301
gcugcucaggcgaggcggacug

SEQ ID NO: 3894917 - RNA, 19 nt, Shigella flexneri 2a str. 301
gcugcugauccagcuucca

SEQ ID NO: 3894918 - RNA, 22 nt, Shigella flexneri 2a str. 301
gcugcugcacauacugcaucag

SEQ ID NO: 3894919 - RNA, 12 nt, Shigella flexneri 2a str. 301
gcugcugccgcu

SEQ ID NO: 3894920 - RNA, 14 nt, Shigella flexneri 2a str. 301
gcugcugcggcgaa

SEQ ID NO: 3894921 - RNA, 17 nt, Shigella flexneri 2a str. 301
gcugcugcucaaaggca

SEQ ID NO: 3894922 - RNA, 13 nt, Shigella flexneri 2a str. 301
gcugcuggaucug

SEQ ID NO: 3894923 - RNA, 16 nt, Shigella flexneri 2a str. 301
gcugcuguuaacuaag

SEQ ID NO: 3894924 - RNA, 17 nt, Shigella flexneri 2a str. 301
gcugcuucggucagcac

SEQ ID NO: 3894925 - RNA, 17 nt, Shigella flexneri 2a str. 301
gcugcuuguuccacuuc

SEQ ID NO: 3894926 - RNA, 18 nt, Shigella flexneri 2a str. 301
gcugcuuguuccacuuca

SEQ ID NO: 3894927 - RNA, 19 nt, Shigella flexneri 2a str. 301
gcugcuuuaucagaucacg

SEQ ID NO: 3894928 - RNA, 15 nt, Shigella flexneri 2a str. 301
gcugcuuuccugcug

SEQ ID NO: 3894929 - RNA, 18 nt, Shigella flexneri 2a str. 301
gcuguuucaggaacaccg

SEQ ID NO: 3894930 - RNA, 12 nt, Shigella flexneri 2a str. 301
gcuguuucgcuu

SEQ ID NO: 3894931 - RNA, 19 nt, Shigella flexneri 2a str. 301
gcuguuuguucaagcgcaa

SEQ ID NO: 3894932 - RNA, 18 nt, Shigella flexneri 2a str. 301
gcuguuuucagcaccaga

SEQ ID NO: 3894933 - RNA, 23 nt, Shigella flexneri 2a str. 301
gcuguuuuccagcaccacuuccg

SEQ ID NO: 3894934 - RNA, 19 nt, Shigella flexneri 2a str. 301
gcuguuuuuucaggcccuc

SEQ ID NO: 3894935 - RNA, 20 nt, Shigella flexneri 2a str. 301
gcuuaaaccauuccagcaua

SEQ ID NO: 3894936 - RNA, 13 nt, Shigella flexneri 2a str. 301
gcuuaaauacgcc

SEQ ID NO: 3894937 - RNA, 18 nt, Shigella flexneri 2a str. 301
gcuuaaccccgggcugga

SEQ ID NO: 3894938 - RNA, 18 nt, Shigella flexneri 2a str. 301
gcuuaacgcgucuuauca

SEQ ID NO: 3894939 - RNA, 14 nt, Shigella flexneri 2a str. 301
gcuuaacugcgcuu

SEQ ID NO: 3894940 - RNA, 17 nt, Shigella flexneri 2a str. 301
gcuuaacugcgcuuucg

SEQ ID NO: 3894941 - RNA, 18 nt, Shigella flexneri 2a str. 301
gcuuaacugcgcuuucgc

SEQ ID NO: 3894942 - RNA, 16 nt, Shigella flexneri 2a str. 301
gcuuaaggcagaaaca

SEQ ID NO: 3894943 - RNA, 15 nt, Shigella flexneri 2a str. 301
gcuuaaucaauugca

SEQ ID NO: 3894944 - RNA, 21 nt, Shigella flexneri 2a str. 301
gcuuaaucaauugcaggaagg

SEQ ID NO: 3894945 - RNA, 13 nt, Shigella flexneri 2a str. 301
gcuuaaucaccag

SEQ ID NO: 3894946 - RNA, 14 nt, Shigella flexneri 2a str. 301
gcuuaaucaccagc

SEQ ID NO: 3894947 - RNA, 15 nt, Shigella flexneri 2a str. 301
gcuuaaucgcggcgg

SEQ ID NO: 3894948 - RNA, 20 nt, Shigella flexneri 2a str. 301
gcuuaauguuaaccaucuca

SEQ ID NO: 3894949 - RNA, 13 nt, Shigella flexneri 2a str. 301
gcuuaauguugag

SEQ ID NO: 3894950 - RNA, 15 nt, Shigella flexneri 2a str. 301
gcuuacacacccggc

SEQ ID NO: 3894951 - RNA, 13 nt, Shigella flexneri 2a str. 301
gcuuacaggcugg

SEQ ID NO: 3894952 - RNA, 16 nt, Shigella flexneri 2a str. 301
gcuuacccuaaauccg

SEQ ID NO: 3894953 - RNA, 19 nt, Shigella flexneri 2a str. 301
gcuuacccuaaauccgcca

SEQ ID NO: 3894954 - RNA, 20 nt, Shigella flexneri 2a str. 301
gcuuaccguccucuucccag

SEQ ID NO: 3894955 - RNA, 23 nt, Shigella flexneri 2a str. 301
gcuuacgaagccguauucugacu

SEQ ID NO: 3894956 - RNA, 16 nt, Shigella flexneri 2a str. 301
gcuuacgccugccagc

SEQ ID NO: 3894957 - RNA, 17 nt, Shigella flexneri 2a str. 301
gcuuacgccugccagcu

SEQ ID NO: 3894958 - RNA, 22 nt, Shigella flexneri 2a str. 301
gcuuacgcugauuaaagacggc

SEQ ID NO: 3894959 - RNA, 18 nt, Shigella flexneri 2a str. 301
gcuuacguaacccaccac

SEQ ID NO: 3894960 - RNA, 21 nt, Shigella flexneri 2a str. 301
gcuuacucuucguucuucuuc

SEQ ID NO: 3894961 - RNA, 13 nt, Shigella flexneri 2a str. 301
gcuuacugaaaau

SEQ ID NO: 3894962 - RNA, 13 nt, Shigella flexneri 2a str. 301
gcuuagaaauuca

SEQ ID NO: 3894963 - RNA, 14 nt, Shigella flexneri 2a str. 301
gcuuauauauuaau

SEQ ID NO: 3894964 - RNA, 14 nt, Shigella flexneri 2a str. 301
gcuuaucaggccua

SEQ ID NO: 3894965 - RNA, 19 nt, Shigella flexneri 2a str. 301
gcuuaucaggccuacagca

SEQ ID NO: 3894966 - RNA, 19 nt, Shigella flexneri 2a str. 301
gcuuaucaggccuacauga

SEQ ID NO: 3894967 - RNA, 17 nt, Shigella flexneri 2a str. 301
gcuuaucaggccuacca

SEQ ID NO: 3894968 - RNA, 18 nt, Shigella flexneri 2a str. 301
gcuuaucaggccuacgua

SEQ ID NO: 3894969 - RNA, 19 nt, Shigella flexneri 2a str. 301
gcuuauccggcaugcaauc

SEQ ID NO: 3894970 - RNA, 13 nt, Shigella flexneri 2a str. 301
gcuuaucgcccug

SEQ ID NO: 3894971 - RNA, 14 nt, Shigella flexneri 2a str. 301
gcuuauugccggau

SEQ ID NO: 3894972 - RNA, 22 nt, Shigella flexneri 2a str. 301
gcuuauuucugugacuuccgac

SEQ ID NO: 3894973 - RNA, 13 nt, Shigella flexneri 2a str. 301
gcuucaaaguuug

SEQ ID NO: 3894974 - RNA, 16 nt, Shigella flexneri 2a str. 301
gcuucaaaguuugcac

SEQ ID NO: 3894975 - RNA, 23 nt, Shigella flexneri 2a str. 301
gcuucaaaucauuacaguuucgg

SEQ ID NO: 3894976 - RNA, 14 nt, Shigella flexneri 2a str. 301
gcuucaaccaacgc

SEQ ID NO: 3894977 - RNA, 14 nt, Shigella flexneri 2a str. 301
gcuucaagaugcca

SEQ ID NO: 3894978 - RNA, 23 nt, Shigella flexneri 2a str. 301
gcuucaauacgcucgaacagcug

SEQ ID NO: 3894979 - RNA, 12 nt, Shigella flexneri 2a str. 301
gcuucaaucuga

SEQ ID NO: 3894980 - RNA, 15 nt, Shigella flexneri 2a str. 301
gcuucaauuuuuucu

SEQ ID NO: 3894981 - RNA, 14 nt, Shigella flexneri 2a str. 301
gcuucaccagcagc

SEQ ID NO: 3894982 - RNA, 17 nt, Shigella flexneri 2a str. 301
gcuucacgcgccagcuu

SEQ ID NO: 3894983 - RNA, 21 nt, Shigella flexneri 2a str. 301
gcuucacgcggguugccaccg

SEQ ID NO: 3894984 - RNA, 16 nt, Shigella flexneri 2a str. 301
gcuucacuaugacgaa

SEQ ID NO: 3894985 - RNA, 20 nt, Shigella flexneri 2a str. 301
gcuucacucccugccccauc

SEQ ID NO: 3894986 - RNA, 21 nt, Shigella flexneri 2a str. 301
gcuucacuucuuaccgcuuca

SEQ ID NO: 3894987 - RNA, 22 nt, Shigella flexneri 2a str. 301
gcuucagcgaucgcuuucgcuu

SEQ ID NO: 3894988 - RNA, 17 nt, Shigella flexneri 2a str. 301
gcuucaggaauaagaca

SEQ ID NO: 3894989 - RNA, 16 nt, Shigella flexneri 2a str. 301
gcuucaggugcccaac

SEQ ID NO: 3894990 - RNA, 20 nt, Shigella flexneri 2a str. 301
gcuucaggugcccaacauac

SEQ ID NO: 3894991 - RNA, 21 nt, Shigella flexneri 2a str. 301
gcuucagugacuucugccagc

SEQ ID NO: 3894992 - RNA, 22 nt, Shigella flexneri 2a str. 301
gcuucagugacuucugccagcu

SEQ ID NO: 3894993 - RNA, 17 nt, Shigella flexneri 2a str. 301
gcuucaucagacgcuua

SEQ ID NO: 3894994 - RNA, 20 nt, Shigella flexneri 2a str. 301
gcuucaucaucgcagauuuc

SEQ ID NO: 3894995 - RNA, 15 nt, Shigella flexneri 2a str. 301
gcuucauccagcagu

SEQ ID NO: 3894996 - RNA, 11 nt, Shigella flexneri 2a str. 301
gcuucaucgcc

SEQ ID NO: 3894997 - RNA, 15 nt, Shigella flexneri 2a str. 301
gcuucaucgcccaca

SEQ ID NO: 3894998 - RNA, 15 nt, Shigella flexneri 2a str. 301
gcuucaugcccgcca

SEQ ID NO: 3894999 - RNA, 16 nt, Shigella flexneri 2a str. 301
gcuucaugcuuaauca

SEQ ID NO: 3895000 - RNA, 11 nt, Shigella flexneri 2a str. 301
gcuucauugac

SEQ ID NO: 3895001 - RNA, 18 nt, Shigella flexneri 2a str. 301
gcuucauugcucucuucu

SEQ ID NO: 3895002 - RNA, 20 nt, Shigella flexneri 2a str. 301
gcuucauugcucucuucucc

SEQ ID NO: 3895003 - RNA, 14 nt, Shigella flexneri 2a str. 301
gcuuccagagcagc

SEQ ID NO: 3895004 - RNA, 16 nt, Shigella flexneri 2a str. 301
gcuuccagcagaccuu

SEQ ID NO: 3895005 - RNA, 13 nt, Shigella flexneri 2a str. 301
gcuucccaaagau

SEQ ID NO: 3895006 - RNA, 12 nt, Shigella flexneri 2a str. 301
gcuucccaacgc

SEQ ID NO: 3895007 - RNA, 13 nt, Shigella flexneri 2a str. 301
gcuucccaacgca

SEQ ID NO: 3895008 - RNA, 16 nt, Shigella flexneri 2a str. 301
gcuucccacgucagac

SEQ ID NO: 3895009 - RNA, 15 nt, Shigella flexneri 2a str. 301
gcuuccggcaagcaa

SEQ ID NO: 3895010 - RNA, 15 nt, Shigella flexneri 2a str. 301
gcuuccggucugcga

SEQ ID NO: 3895011 - RNA, 12 nt, Shigella flexneri 2a str. 301
gcuuccugcaac

SEQ ID NO: 3895012 - RNA, 12 nt, Shigella flexneri 2a str. 301
gcuuccugcagc

SEQ ID NO: 3895013 - RNA, 16 nt, Shigella flexneri 2a str. 301
gcuuccuggcgcuggg

SEQ ID NO: 3895014 - RNA, 18 nt, Shigella flexneri 2a str. 301
gcuucgagcuggaagcca

SEQ ID NO: 3895015 - RNA, 23 nt, Shigella flexneri 2a str. 301
gcuucgcaucccgguaucaaagc

SEQ ID NO: 3895016 - RNA, 19 nt, Shigella flexneri 2a str. 301
gcuucgcggacaucgucca

SEQ ID NO: 3895017 - RNA, 21 nt, Shigella flexneri 2a str. 301
gcuucgcggacaucguccagc

SEQ ID NO: 3895018 - RNA, 23 nt, Shigella flexneri 2a str. 301
gcuucgcggacaucguccagcuu

SEQ ID NO: 3895019 - RNA, 18 nt, Shigella flexneri 2a str. 301
gcuucgcuuaccaugcca

SEQ ID NO: 3895020 - RNA, 14 nt, Shigella flexneri 2a str. 301
gcuucggcggguuu

SEQ ID NO: 3895021 - RNA, 18 nt, Shigella flexneri 2a str. 301
gcuucgguaagcaaagcg

SEQ ID NO: 3895022 - RNA, 14 nt, Shigella flexneri 2a str. 301
gcuucggucagcac

SEQ ID NO: 3895023 - RNA, 22 nt, Shigella flexneri 2a str. 301
gcuucgguuuucgcgccagcca

SEQ ID NO: 3895024 - RNA, 23 nt, Shigella flexneri 2a str. 301
gcuucgguuuuguugccgcccgu

SEQ ID NO: 3895025 - RNA, 14 nt, Shigella flexneri 2a str. 301
gcuucguagaagcc

SEQ ID NO: 3895026 - RNA, 14 nt, Shigella flexneri 2a str. 301
gcuucguagacgcu

SEQ ID NO: 3895027 - RNA, 14 nt, Shigella flexneri 2a str. 301
gcuucguccaugcu

SEQ ID NO: 3895028 - RNA, 16 nt, Shigella flexneri 2a str. 301
gcuucgucgucaccug

SEQ ID NO: 3895029 - RNA, 14 nt, Shigella flexneri 2a str. 301
gcuucuaccaugau

SEQ ID NO: 3895030 - RNA, 17 nt, Shigella flexneri 2a str. 301
gcuuuucagugccaggu

SEQ ID NO: 3895031 - RNA, 12 nt, Shigella flexneri 2a str. 301
gcuuuuccauau

SEQ ID NO: 3895032 - RNA, 19 nt, Shigella flexneri 2a str. 301
gcuuuuccauaucaagcau

SEQ ID NO: 3895033 - RNA, 15 nt, Shigella flexneri 2a str. 301
gcuuuucccuccacu

SEQ ID NO: 3895034 - RNA, 17 nt, Shigella flexneri 2a str. 301
gcuuuuccggucagcaa

SEQ ID NO: 3895035 - RNA, 17 nt, Shigella flexneri 2a str. 301
gcuuuuguaggccugau

SEQ ID NO: 3895036 - RNA, 20 nt, Shigella flexneri 2a str. 301
gcuuuuuaaucucccgccag

SEQ ID NO: 3895037 - RNA, 19 nt, Shigella flexneri 2a str. 301
gcuuuuuaguaucuauuca

SEQ ID NO: 3895038 - RNA, 23 nt, Shigella flexneri 2a str. 301
gcuuuuuaguaucuauucaucaa

SEQ ID NO: 3895039 - RNA, 14 nt, Shigella flexneri 2a str. 301
gcuuuuuauagcaa

SEQ ID NO: 3895040 - RNA, 17 nt, Shigella flexneri 2a str. 301
gcuuuuucaauuuccag

SEQ ID NO: 3895041 - RNA, 19 nt, Shigella flexneri 2a str. 301
gcuuuuucccugguaaaaa

SEQ ID NO: 3895042 - RNA, 18 nt, Shigella flexneri 2a str. 301
gcuuuuucugcgcacaca

SEQ ID NO: 3895043 - RNA, 17 nt, Shigella flexneri 2a str. 301
gcuuuuuuacaucauca

SEQ ID NO: 3895044 - RNA, 22 nt, Shigella flexneri 2a str. 301
gcuuuuuuagguacaaagccaa

SEQ ID NO: 3895045 - RNA, 16 nt, Shigella flexneri 2a str. 301
gcuuuuuugagcagca

SEQ ID NO: 3895046 - RNA, 18 nt, Shigella flexneri 2a str. 301
gcuuuuuugauuacagcu

SEQ ID NO: 3895047 - RNA, 19 nt, Shigella flexneri 2a str. 301
gcuuuuuuggcgaucuccg

SEQ ID NO: 3895048 - RNA, 15 nt, Shigella flexneri 2a str. 301
ggaaaaacagaggcc

SEQ ID NO: 3895049 - RNA, 18 nt, Shigella flexneri 2a str. 301
ggaaaaucugcgggaaca

SEQ ID NO: 3895050 - RNA, 17 nt, Shigella flexneri 2a str. 301
ggaaaccaacuccagcg

SEQ ID NO: 3895051 - RNA, 19 nt, Shigella flexneri 2a str. 301
ggaaaccaucaucuacgaa

SEQ ID NO: 3895052 - RNA, 14 nt, Shigella flexneri 2a str. 301
ggaaacccaacgca

SEQ ID NO: 3895053 - RNA, 17 nt, Shigella flexneri 2a str. 301
ggaaacucacgccagca

SEQ ID NO: 3895054 - RNA, 13 nt, Shigella flexneri 2a str. 301
ggaaacuccagcc

SEQ ID NO: 3895055 - RNA, 15 nt, Shigella flexneri 2a str. 301
ggaaacucucaaaac

SEQ ID NO: 3895056 - RNA, 21 nt, Shigella flexneri 2a str. 301
ggaaacucucaaaacaacaca

SEQ ID NO: 3895057 - RNA, 19 nt, Shigella flexneri 2a str. 301
ggaaacugucaauaaacgc

SEQ ID NO: 3895058 - RNA, 14 nt, Shigella flexneri 2a str. 301
ggaaagaucgccac

SEQ ID NO: 3895059 - RNA, 18 nt, Shigella flexneri 2a str. 301
ggaaagggccgcagugga

SEQ ID NO: 3895060 - RNA, 22 nt, Shigella flexneri 2a str. 301
ggaaaguuuaauugccauuucu

SEQ ID NO: 3895061 - RNA, 16 nt, Shigella flexneri 2a str. 301
ggaaauaacaucccuu

SEQ ID NO: 3895062 - RNA, 22 nt, Shigella flexneri 2a str. 301
ggaaauaaucgggaauacagaa

SEQ ID NO: 3895063 - RNA, 17 nt, Shigella flexneri 2a str. 301
ggaaaucaccaccagca

SEQ ID NO: 3895064 - RNA, 23 nt, Shigella flexneri 2a str. 301
ggaaaucaugcaacacguuaaca

SEQ ID NO: 3895065 - RNA, 16 nt, Shigella flexneri 2a str. 301
ggaaauccaggucagc

SEQ ID NO: 3895066 - RNA, 20 nt, Shigella flexneri 2a str. 301
ggaaauccccuggcguuuga

SEQ ID NO: 3895067 - RNA, 18 nt, Shigella flexneri 2a str. 301
ggaaaucccgugacggua

SEQ ID NO: 3895068 - RNA, 21 nt, Shigella flexneri 2a str. 301
ggaaauccugccgcaguuucu

SEQ ID NO: 3895069 - RNA, 17 nt, Shigella flexneri 2a str. 301
ggaaaucgacgcugcug

SEQ ID NO: 3895070 - RNA, 21 nt, Shigella flexneri 2a str. 301
ggaaaugccggauggcagagu

SEQ ID NO: 3895071 - RNA, 22 nt, Shigella flexneri 2a str. 301
ggaaauuaccgcaaagcccacg

SEQ ID NO: 3895072 - RNA, 22 nt, Shigella flexneri 2a str. 301
ggaaauuaccgcaccaccagca

SEQ ID NO: 3895073 - RNA, 23 nt, Shigella flexneri 2a str. 301
ggaaauugcacugcaucauggca

SEQ ID NO: 3895074 - RNA, 17 nt, Shigella flexneri 2a str. 301
ggaaauugcagagcugc

SEQ ID NO: 3895075 - RNA, 13 nt, Shigella flexneri 2a str. 301
ggaaauugccacu

SEQ ID NO: 3895076 - RNA, 20 nt, Shigella flexneri 2a str. 301
ggaacaacagucccaggcag

SEQ ID NO: 3895077 - RNA, 11 nt, Shigella flexneri 2a str. 301
ggaacaagggu

SEQ ID NO: 3895078 - RNA, 19 nt, Shigella flexneri 2a str. 301
ggaacagccggaugucugg

SEQ ID NO: 3895079 - RNA, 21 nt, Shigella flexneri 2a str. 301
ggaacagccggaugucuggaa

SEQ ID NO: 3895080 - RNA, 16 nt, Shigella flexneri 2a str. 301
ggaacaggcagggcca

SEQ ID NO: 3895081 - RNA, 18 nt, Shigella flexneri 2a str. 301
ggaacaucaccaaguccc

SEQ ID NO: 3895082 - RNA, 19 nt, Shigella flexneri 2a str. 301
ggaacaucccuugugcacu

SEQ ID NO: 3895083 - RNA, 19 nt, Shigella flexneri 2a str. 301
ggaacauucgccgcuguga

SEQ ID NO: 3895084 - RNA, 14 nt, Shigella flexneri 2a str. 301
ggaaccacagcgcc

SEQ ID NO: 3895085 - RNA, 13 nt, Shigella flexneri 2a str. 301
ggaaccaggcgcg

SEQ ID NO: 3895086 - RNA, 19 nt, Shigella flexneri 2a str. 301
ggaacccggcuuucugcaa

SEQ ID NO: 3895087 - RNA, 15 nt, Shigella flexneri 2a str. 301
ggaaccggauuuuca

SEQ ID NO: 3895088 - RNA, 20 nt, Shigella flexneri 2a str. 301
ggaaccuccauguccagcuu

SEQ ID NO: 3895089 - RNA, 14 nt, Shigella flexneri 2a str. 301
ggaacgggcaagca

SEQ ID NO: 3895090 - RNA, 17 nt, Shigella flexneri 2a str. 301
ggaacuggcugccagcg

SEQ ID NO: 3895091 - RNA, 13 nt, Shigella flexneri 2a str. 301
ggaagaauuucau

SEQ ID NO: 3895092 - RNA, 21 nt, Shigella flexneri 2a str. 301
ggaagaauuugcuaccccuga

SEQ ID NO: 3895093 - RNA, 13 nt, Shigella flexneri 2a str. 301
ggaagagauggug

SEQ ID NO: 3895094 - RNA, 16 nt, Shigella flexneri 2a str. 301
ggaagcccaaaucaua

SEQ ID NO: 3895095 - RNA, 23 nt, Shigella flexneri 2a str. 301
ggaagccccuaagcgccggacca

SEQ ID NO: 3895096 - RNA, 18 nt, Shigella flexneri 2a str. 301
ggaagccggaauuuuccu

SEQ ID NO: 3895097 - RNA, 19 nt, Shigella flexneri 2a str. 301
ggaagccuuccgcaaacag

SEQ ID NO: 3895098 - RNA, 23 nt, Shigella flexneri 2a str. 301
ggaagccuuccgcaaacaggcgc

SEQ ID NO: 3895099 - RNA, 21 nt, Shigella flexneri 2a str. 301
ggaagcgauggugguggggga

SEQ ID NO: 3895100 - RNA, 20 nt, Shigella flexneri 2a str. 301
ggaagcgcccgucacugaau

SEQ ID NO: 3895101 - RNA, 19 nt, Shigella flexneri 2a str. 301
ggaagcgucaaggucaaca

SEQ ID NO: 3895102 - RNA, 14 nt, Shigella flexneri 2a str. 301
ggaagcuccaccag

SEQ ID NO: 3895103 - RNA, 21 nt, Shigella flexneri 2a str. 301
ggaagcuggauuaacgcuggg

SEQ ID NO: 3895104 - RNA, 20 nt, Shigella flexneri 2a str. 301
ggaaggaagacgcagcaugc

SEQ ID NO: 3895105 - RNA, 11 nt, Shigella flexneri 2a str. 301
ggaaggauucg

SEQ ID NO: 3895106 - RNA, 20 nt, Shigella flexneri 2a str. 301
ggaagggcuuucacugccca

SEQ ID NO: 3895107 - RNA, 14 nt, Shigella flexneri 2a str. 301
ggaaggucauccaa

SEQ ID NO: 3895108 - RNA, 20 nt, Shigella flexneri 2a str. 301
ggaagguuuuaaucgcuauc

SEQ ID NO: 3895109 - RNA, 14 nt, Shigella flexneri 2a str. 301
ggaaguauuucaau

SEQ ID NO: 3895110 - RNA, 19 nt, Shigella flexneri 2a str. 301
ggaauacauauauuacaac

SEQ ID NO: 3895111 - RNA, 14 nt, Shigella flexneri 2a str. 301
ggaauaccacuuuc

SEQ ID NO: 3895112 - RNA, 22 nt, Shigella flexneri 2a str. 301
ggaaucaacggcaacaauuccc

SEQ ID NO: 3895113 - RNA, 13 nt, Shigella flexneri 2a str. 301
ggaaucacucauc

SEQ ID NO: 3895114 - RNA, 21 nt, Shigella flexneri 2a str. 301
ggaaugagcuguacggagcgg

SEQ ID NO: 3895115 - RNA, 17 nt, Shigella flexneri 2a str. 301
ggaaugccggaaucaga

SEQ ID NO: 3895116 - RNA, 15 nt, Shigella flexneri 2a str. 301
ggaaugucaucauca

SEQ ID NO: 3895117 - RNA, 16 nt, Shigella flexneri 2a str. 301
ggaaugucaucaucaa

SEQ ID NO: 3895118 - RNA, 14 nt, Shigella flexneri 2a str. 301
ggaauguggcaaug

SEQ ID NO: 3895119 - RNA, 19 nt, Shigella flexneri 2a str. 301
ggaauuacgcaauuacaug

SEQ ID NO: 3895120 - RNA, 19 nt, Shigella flexneri 2a str. 301
ggaauuuuacagcccuggc

SEQ ID NO: 3895121 - RNA, 20 nt, Shigella flexneri 2a str. 301
ggaauuuuccuucggauuuc

SEQ ID NO: 3895122 - RNA, 14 nt, Shigella flexneri 2a str. 301
ggacaaagagcuuu

SEQ ID NO: 3895123 - RNA, 16 nt, Shigella flexneri 2a str. 301
ggacaaccauaaauuu

SEQ ID NO: 3895124 - RNA, 19 nt, Shigella flexneri 2a str. 301
ggacaauagcuaacgaaaa

SEQ ID NO: 3895125 - RNA, 16 nt, Shigella flexneri 2a str. 301
ggacacauuucuuuug

SEQ ID NO: 3895126 - RNA, 20 nt, Shigella flexneri 2a str. 301
ggacacucgcugacugauau

SEQ ID NO: 3895127 - RNA, 21 nt, Shigella flexneri 2a str. 301
ggacacugcuuacaggcuggu

SEQ ID NO: 3895128 - RNA, 20 nt, Shigella flexneri 2a str. 301
ggacagaccugcgucaccac

SEQ ID NO: 3895129 - RNA, 13 nt, Shigella flexneri 2a str. 301
ggauccccugccc

SEQ ID NO: 3895130 - RNA, 14 nt, Shigella flexneri 2a str. 301
ggauccccugcccg

SEQ ID NO: 3895131 - RNA, 23 nt, Shigella flexneri 2a str. 301
ggaucgaguucaucacaccaguc

SEQ ID NO: 3895132 - RNA, 12 nt, Shigella flexneri 2a str. 301
ggaucgccaggu

SEQ ID NO: 3895133 - RNA, 23 nt, Shigella flexneri 2a str. 301
ggaucgcuguccgcuucaccacc

SEQ ID NO: 3895134 - RNA, 16 nt, Shigella flexneri 2a str. 301
ggaucgguagaccgga

SEQ ID NO: 3895135 - RNA, 19 nt, Shigella flexneri 2a str. 301
ggaucgucaggaucagcca

SEQ ID NO: 3895136 - RNA, 21 nt, Shigella flexneri 2a str. 301
ggaucguucacaugagagaaa

SEQ ID NO: 3895137 - RNA, 14 nt, Shigella flexneri 2a str. 301
ggaucuccagcucc

SEQ ID NO: 3895138 - RNA, 18 nt, Shigella flexneri 2a str. 301
ggaucugaugggauuaga

SEQ ID NO: 3895139 - RNA, 23 nt, Shigella flexneri 2a str. 301
ggaucugauuuuccuccagcagc

SEQ ID NO: 3895140 - RNA, 20 nt, Shigella flexneri 2a str. 301
ggaucugcggguuagucugc

SEQ ID NO: 3895141 - RNA, 19 nt, Shigella flexneri 2a str. 301
ggaucuuugacugaaauuu

SEQ ID NO: 3895142 - RNA, 23 nt, Shigella flexneri 2a str. 301
ggaugaaaggcaagcacggcaac

SEQ ID NO: 3895143 - RNA, 21 nt, Shigella flexneri 2a str. 301
ggaugaacauaaucugcaaau

SEQ ID NO: 3895144 - RNA, 14 nt, Shigella flexneri 2a str. 301
ggaugacacgcagg

SEQ ID NO: 3895145 - RNA, 12 nt, Shigella flexneri 2a str. 301
ggaugacccagc

SEQ ID NO: 3895146 - RNA, 13 nt, Shigella flexneri 2a str. 301
ggaugacgcguca

SEQ ID NO: 3895147 - RNA, 12 nt, Shigella flexneri 2a str. 301
ggaugccaguau

SEQ ID NO: 3895148 - RNA, 17 nt, Shigella flexneri 2a str. 301
ggaugcccccagguugu

SEQ ID NO: 3895149 - RNA, 15 nt, Shigella flexneri 2a str. 301
ggaugccgaaaaaag

SEQ ID NO: 3895150 - RNA, 16 nt, Shigella flexneri 2a str. 301
ggaugccgaaaaaagu

SEQ ID NO: 3895151 - RNA, 16 nt, Shigella flexneri 2a str. 301
ggaugccucuccuguu

SEQ ID NO: 3895152 - RNA, 12 nt, Shigella flexneri 2a str. 301
ggaugcgccauc

SEQ ID NO: 3895153 - RNA, 18 nt, Shigella flexneri 2a str. 301
ggaugcgcuucgcuuauc

SEQ ID NO: 3895154 - RNA, 20 nt, Shigella flexneri 2a str. 301
ggaugcgggucaggccagga

SEQ ID NO: 3895155 - RNA, 19 nt, Shigella flexneri 2a str. 301
ggaugcucucaucacuaca

SEQ ID NO: 3895156 - RNA, 20 nt, Shigella flexneri 2a str. 301
ggaugcuuuugcaacaaggg

SEQ ID NO: 3895157 - RNA, 19 nt, Shigella flexneri 2a str. 301
ggauggccucugccagcug

SEQ ID NO: 3895158 - RNA, 19 nt, Shigella flexneri 2a str. 301
ggauggcgauacucugcca

SEQ ID NO: 3895159 - RNA, 11 nt, Shigella flexneri 2a str. 301
ggauggcggcu

SEQ ID NO: 3895160 - RNA, 18 nt, Shigella flexneri 2a str. 301
ggauggcguagcagcagc

SEQ ID NO: 3895161 - RNA, 20 nt, Shigella flexneri 2a str. 301
ggaugggcugucagcucauc

SEQ ID NO: 3895162 - RNA, 22 nt, Shigella flexneri 2a str. 301
ggaugugaaaaugaguauucag

SEQ ID NO: 3895163 - RNA, 19 nt, Shigella flexneri 2a str. 301
ggauguguuauucagcugg

SEQ ID NO: 3895164 - RNA, 20 nt, Shigella flexneri 2a str. 301
ggauguguuauucagcuggc

SEQ ID NO: 3895165 - RNA, 13 nt, Shigella flexneri 2a str. 301
ggauguugcugca

SEQ ID NO: 3895166 - RNA, 23 nt, Shigella flexneri 2a str. 301
ggauuacgacucaaccccagcca

SEQ ID NO: 3895167 - RNA, 13 nt, Shigella flexneri 2a str. 301
ggauuagccggau

SEQ ID NO: 3895168 - RNA, 23 nt, Shigella flexneri 2a str. 301
ggauucaugcggguauucauccg

SEQ ID NO: 3895169 - RNA, 21 nt, Shigella flexneri 2a str. 301
ggauuccagcgccgccagaag

SEQ ID NO: 3895170 - RNA, 22 nt, Shigella flexneri 2a str. 301
ggauuccugcgcuuccagcucc

SEQ ID NO: 3895171 - RNA, 22 nt, Shigella flexneri 2a str. 301
ggauucgaaccucggaaugccg

SEQ ID NO: 3895172 - RNA, 17 nt, Shigella flexneri 2a str. 301
ggauucgaaccuucgaa

SEQ ID NO: 3895173 - RNA, 15 nt, Shigella flexneri 2a str. 301
ggauugaucggucca

SEQ ID NO: 3895174 - RNA, 15 nt, Shigella flexneri 2a str. 301
ggauugccagaugcg

SEQ ID NO: 3895175 - RNA, 16 nt, Shigella flexneri 2a str. 301
ggauugccgcuucauu

SEQ ID NO: 3895176 - RNA, 15 nt, Shigella flexneri 2a str. 301
ggauugcuucugcuu

SEQ ID NO: 3895177 - RNA, 20 nt, Shigella flexneri 2a str. 301
ggauugugcaggcgcucaua

SEQ ID NO: 3895178 - RNA, 15 nt, Shigella flexneri 2a str. 301
ggauuuaaugccaau

SEQ ID NO: 3895179 - RNA, 21 nt, Shigella flexneri 2a str. 301
ggauuucugauuauggcggcg

SEQ ID NO: 3895180 - RNA, 19 nt, Shigella flexneri 2a str. 301
ggauuuucaccaucgccau

SEQ ID NO: 3895181 - RNA, 13 nt, Shigella flexneri 2a str. 301
ggauuuugcccug

SEQ ID NO: 3895182 - RNA, 14 nt, Shigella flexneri 2a str. 301
ggauuuuuauuccg

SEQ ID NO: 3895183 - RNA, 13 nt, Shigella flexneri 2a str. 301
ggauuuuuuauug

SEQ ID NO: 3895184 - RNA, 20 nt, Shigella flexneri 2a str. 301
ggcaaaaacccuucuuccau

SEQ ID NO: 3895185 - RNA, 14 nt, Shigella flexneri 2a str. 301
ggcaaaagucacca

SEQ ID NO: 3895186 - RNA, 23 nt, Shigella flexneri 2a str. 301
ggcaaaaucaucacucccuuucu

SEQ ID NO: 3895187 - RNA, 22 nt, Shigella flexneri 2a str. 301
ggcaaacaaacugcgauuuaac

SEQ ID NO: 3895188 - RNA, 16 nt, Shigella flexneri 2a str. 301
ggcaaacagacuggca

SEQ ID NO: 3895189 - RNA, 17 nt, Shigella flexneri 2a str. 301
ggcaaacagacuggcaa

SEQ ID NO: 3895190 - RNA, 18 nt, Shigella flexneri 2a str. 301
ggcaaacagcacggucag

SEQ ID NO: 3895191 - RNA, 13 nt, Shigella flexneri 2a str. 301
ggcaaacgcccuu

SEQ ID NO: 3895192 - RNA, 16 nt, Shigella flexneri 2a str. 301
ggcaaacuacaaaucc

SEQ ID NO: 3895193 - RNA, 19 nt, Shigella flexneri 2a str. 301
ggcaaagaaccaacgcugc

SEQ ID NO: 3895194 - RNA, 16 nt, Shigella flexneri 2a str. 301
ggcaaagcugucacca

SEQ ID NO: 3895195 - RNA, 20 nt, Shigella flexneri 2a str. 301
ggcaaagcugucaccaauca

SEQ ID NO: 3895196 - RNA, 21 nt, Shigella flexneri 2a str. 301
ggcaaauaacgccccggcaaa

SEQ ID NO: 3895197 - RNA, 23 nt, Shigella flexneri 2a str. 301
ggcaaauaacgccccggcaaaac

SEQ ID NO: 3895198 - RNA, 22 nt, Shigella flexneri 2a str. 301
ggcaaauaaucccgcgcaacaa

SEQ ID NO: 3895199 - RNA, 22 nt, Shigella flexneri 2a str. 301
ggcaaauacaguugcgccagua

SEQ ID NO: 3895200 - RNA, 18 nt, Shigella flexneri 2a str. 301
ggcaaaucaguggcugga

SEQ ID NO: 3895201 - RNA, 18 nt, Shigella flexneri 2a str. 301
ggcaaauucaggagcagg

SEQ ID NO: 3895202 - RNA, 16 nt, Shigella flexneri 2a str. 301
ggcaaauucuucacgg

SEQ ID NO: 3895203 - RNA, 21 nt, Shigella flexneri 2a str. 301
ggcaacaugacugcggcgugg

SEQ ID NO: 3895204 - RNA, 15 nt, Shigella flexneri 2a str. 301
ggcaaccacaaccgc

SEQ ID NO: 3895205 - RNA, 16 nt, Shigella flexneri 2a str. 301
ggcaaccagcagaugu

SEQ ID NO: 3895206 - RNA, 12 nt, Shigella flexneri 2a str. 301
ggcaaccugcuu

SEQ ID NO: 3895207 - RNA, 20 nt, Shigella flexneri 2a str. 301
ggcaaccugcuuuaaaagcu

SEQ ID NO: 3895208 - RNA, 16 nt, Shigella flexneri 2a str. 301
ggcaacgacgguaaac

SEQ ID NO: 3895209 - RNA, 18 nt, Shigella flexneri 2a str. 301
ggcaacgacugcgagcaa

SEQ ID NO: 3895210 - RNA, 20 nt, Shigella flexneri 2a str. 301
ggcaacgacugcgagcaaaa

SEQ ID NO: 3895211 - RNA, 12 nt, Shigella flexneri 2a str. 301
ggcaacguucca

SEQ ID NO: 3895212 - RNA, 13 nt, Shigella flexneri 2a str. 301
ggcaacguuccag

SEQ ID NO: 3895213 - RNA, 12 nt, Shigella flexneri 2a str. 301
ggcaacugcugc

SEQ ID NO: 3895214 - RNA, 20 nt, Shigella flexneri 2a str. 301
ggcaagagcgaucggcagcu

SEQ ID NO: 3895215 - RNA, 14 nt, Shigella flexneri 2a str. 301
ggcaagauacugca

SEQ ID NO: 3895216 - RNA, 14 nt, Shigella flexneri 2a str. 301
ggcaagaucgcgau

SEQ ID NO: 3895217 - RNA, 23 nt, Shigella flexneri 2a str. 301
ggcaagaucgcgaugggucgccg

SEQ ID NO: 3895218 - RNA, 14 nt, Shigella flexneri 2a str. 301
ggcaagcccagcac

SEQ ID NO: 3895219 - RNA, 20 nt, Shigella flexneri 2a str. 301
ggcaagccgcuaacagcagc

SEQ ID NO: 3895220 - RNA, 16 nt, Shigella flexneri 2a str. 301
ggcaaguaauaauauc

SEQ ID NO: 3895221 - RNA, 15 nt, Shigella flexneri 2a str. 301
ggcaaguagcgccau

SEQ ID NO: 3895222 - RNA, 19 nt, Shigella flexneri 2a str. 301
ggcaagugugaugguauuc

SEQ ID NO: 3895223 - RNA, 13 nt, Shigella flexneri 2a str. 301
ggcaaguuucgug

SEQ ID NO: 3895224 - RNA, 22 nt, Shigella flexneri 2a str. 301
ggcaauagcggacacuaccauu

SEQ ID NO: 3895225 - RNA, 14 nt, Shigella flexneri 2a str. 301
ggcaauaucgcggc

SEQ ID NO: 3895226 - RNA, 16 nt, Shigella flexneri 2a str. 301
ggcaauauucauuaaa

SEQ ID NO: 3895227 - RNA, 17 nt, Shigella flexneri 2a str. 301
ggcaauauucauuaaaa

SEQ ID NO: 3895228 - RNA, 21 nt, Shigella flexneri 2a str. 301
ggcaaucacaucaccauaaau

SEQ ID NO: 3895229 - RNA, 20 nt, Shigella flexneri 2a str. 301
ggcaucgccuucgcaaaaaa

SEQ ID NO: 3895230 - RNA, 13 nt, Shigella flexneri 2a str. 301
ggcaucgggcagc

SEQ ID NO: 3895231 - RNA, 15 nt, Shigella flexneri 2a str. 301
ggcaucggugcacaa

SEQ ID NO: 3895232 - RNA, 16 nt, Shigella flexneri 2a str. 301
ggcaucguccauuucu

SEQ ID NO: 3895233 - RNA, 14 nt, Shigella flexneri 2a str. 301
ggcaucuucuucau

SEQ ID NO: 3895234 - RNA, 16 nt, Shigella flexneri 2a str. 301
ggcaugacgcaggucg

SEQ ID NO: 3895235 - RNA, 22 nt, Shigella flexneri 2a str. 301
ggcaugagccgccgccacacgc

SEQ ID NO: 3895236 - RNA, 18 nt, Shigella flexneri 2a str. 301
ggcaugcuguccagcagg

SEQ ID NO: 3895237 - RNA, 22 nt, Shigella flexneri 2a str. 301
ggcaugucgguuguacaaaaaa

SEQ ID NO: 3895238 - RNA, 19 nt, Shigella flexneri 2a str. 301
ggcauguguuagcccuguc

SEQ ID NO: 3895239 - RNA, 23 nt, Shigella flexneri 2a str. 301
ggcauguuuaauucugcggcaau

SEQ ID NO: 3895240 - RNA, 22 nt, Shigella flexneri 2a str. 301
ggcauuacaagaaucaugccaa

SEQ ID NO: 3895241 - RNA, 18 nt, Shigella flexneri 2a str. 301
ggcauucucacuccagcc

SEQ ID NO: 3895242 - RNA, 18 nt, Shigella flexneri 2a str. 301
ggcauuuggcucucgaug

SEQ ID NO: 3895243 - RNA, 16 nt, Shigella flexneri 2a str. 301
ggcauuuugugcacga

SEQ ID NO: 3895244 - RNA, 17 nt, Shigella flexneri 2a str. 301
ggccaacaccagacauc

SEQ ID NO: 3895245 - RNA, 17 nt, Shigella flexneri 2a str. 301
ggccaauaacccgcugu

SEQ ID NO: 3895246 - RNA, 19 nt, Shigella flexneri 2a str. 301
ggccaauaacccgcuguaa

SEQ ID NO: 3895247 - RNA, 16 nt, Shigella flexneri 2a str. 301
ggccaauaccugucau

SEQ ID NO: 3895248 - RNA, 17 nt, Shigella flexneri 2a str. 301
ggccaaucagcaauaaa

SEQ ID NO: 3895249 - RNA, 22 nt, Shigella flexneri 2a str. 301
ggccaaugccucuacgcccggu

SEQ ID NO: 3895250 - RNA, 19 nt, Shigella flexneri 2a str. 301
ggccaauugcugugccgga

SEQ ID NO: 3895251 - RNA, 13 nt, Shigella flexneri 2a str. 301
ggccaauuggcug

SEQ ID NO: 3895252 - RNA, 16 nt, Shigella flexneri 2a str. 301
ggccaauuggcuggcc

SEQ ID NO: 3895253 - RNA, 14 nt, Shigella flexneri 2a str. 301
ggccaauuuggcug

SEQ ID NO: 3895254 - RNA, 20 nt, Shigella flexneri 2a str. 301
ggccacaaaccuuaaauggc

SEQ ID NO: 3895255 - RNA, 20 nt, Shigella flexneri 2a str. 301
ggccacaaacgacgggccag

SEQ ID NO: 3895256 - RNA, 14 nt, Shigella flexneri 2a str. 301
ggccacagcgccag

SEQ ID NO: 3895257 - RNA, 13 nt, Shigella flexneri 2a str. 301
ggccacggcgacc

SEQ ID NO: 3895258 - RNA, 12 nt, Shigella flexneri 2a str. 301
ggccagaaaaaa

SEQ ID NO: 3895259 - RNA, 15 nt, Shigella flexneri 2a str. 301
ggccagaacaaacua

SEQ ID NO: 3895260 - RNA, 16 nt, Shigella flexneri 2a str. 301
ggccagacauuauaaa

SEQ ID NO: 3895261 - RNA, 11 nt, Shigella flexneri 2a str. 301
ggccagagcau

SEQ ID NO: 3895262 - RNA, 14 nt, Shigella flexneri 2a str. 301
ggccagagcaucag

SEQ ID NO: 3895263 - RNA, 20 nt, Shigella flexneri 2a str. 301
ggccagauaagacgcgucag

SEQ ID NO: 3895264 - RNA, 15 nt, Shigella flexneri 2a str. 301
ggccagcaaucccca

SEQ ID NO: 3895265 - RNA, 17 nt, Shigella flexneri 2a str. 301
ggccagcaugugguuac

SEQ ID NO: 3895266 - RNA, 14 nt, Shigella flexneri 2a str. 301
ggccagccagagau

SEQ ID NO: 3895267 - RNA, 18 nt, Shigella flexneri 2a str. 301
ggccagccauccgucauc

SEQ ID NO: 3895268 - RNA, 14 nt, Shigella flexneri 2a str. 301
ggccagcgccacca

SEQ ID NO: 3895269 - RNA, 17 nt, Shigella flexneri 2a str. 301
ggccagcgccaccacca

SEQ ID NO: 3895270 - RNA, 17 nt, Shigella flexneri 2a str. 301
ggccagguuuucuuuca

SEQ ID NO: 3895271 - RNA, 18 nt, Shigella flexneri 2a str. 301
ggccagguuuucuuucac

SEQ ID NO: 3895272 - RNA, 21 nt, Shigella flexneri 2a str. 301
ggccaguaagcaguccagcgc

SEQ ID NO: 3895273 - RNA, 13 nt, Shigella flexneri 2a str. 301
ggccaguccaggu

SEQ ID NO: 3895274 - RNA, 15 nt, Shigella flexneri 2a str. 301
ggccaguuccgccgg

SEQ ID NO: 3895275 - RNA, 10 nt, Shigella flexneri 2a str. 301
ggccaguugc

SEQ ID NO: 3895276 - RNA, 15 nt, Shigella flexneri 2a str. 301
ggccaguuucauagu

SEQ ID NO: 3895277 - RNA, 14 nt, Shigella flexneri 2a str. 301
ggccaucagcagcg

SEQ ID NO: 3895278 - RNA, 19 nt, Shigella flexneri 2a str. 301
ggccauccgcgugacgcug

SEQ ID NO: 3895279 - RNA, 18 nt, Shigella flexneri 2a str. 301
ggccaugaccgccgcagc

SEQ ID NO: 3895280 - RNA, 16 nt, Shigella flexneri 2a str. 301
ggccaugcggcgagga

SEQ ID NO: 3895281 - RNA, 21 nt, Shigella flexneri 2a str. 301
ggccaugggcgcgauaaugcg

SEQ ID NO: 3895282 - RNA, 14 nt, Shigella flexneri 2a str. 301
ggccauuccagcac

SEQ ID NO: 3895283 - RNA, 19 nt, Shigella flexneri 2a str. 301
ggccauuccagcacccggc

SEQ ID NO: 3895284 - RNA, 17 nt, Shigella flexneri 2a str. 301
ggccauugaauauuuuu

SEQ ID NO: 3895285 - RNA, 23 nt, Shigella flexneri 2a str. 301
ggccauugaauauuuuucgucag

SEQ ID NO: 3895286 - RNA, 23 nt, Shigella flexneri 2a str. 301
ggcccaacuguugauccaggagc

SEQ ID NO: 3895287 - RNA, 16 nt, Shigella flexneri 2a str. 301
ggcccaccuggcugag

SEQ ID NO: 3895288 - RNA, 18 nt, Shigella flexneri 2a str. 301
ggcccagaccccagcucu

SEQ ID NO: 3895289 - RNA, 24 nt, Shigella flexneri 2a str. 301
ggcccagaccccagcucuucucaa

SEQ ID NO: 3895290 - RNA, 12 nt, Shigella flexneri 2a str. 301
ggcccaucaucu

SEQ ID NO: 3895291 - RNA, 17 nt, Shigella flexneri 2a str. 301
ggcccauuuucucggcu

SEQ ID NO: 3895292 - RNA, 19 nt, Shigella flexneri 2a str. 301
ggccccuuccucgggaggg

SEQ ID NO: 3895293 - RNA, 18 nt, Shigella flexneri 2a str. 301
ggcccgacgaugaccgca

SEQ ID NO: 3895294 - RNA, 17 nt, Shigella flexneri 2a str. 301
ggcccgcgugccggaag

SEQ ID NO: 3895295 - RNA, 19 nt, Shigella flexneri 2a str. 301
ggcccggauucagauugca

SEQ ID NO: 3895296 - RNA, 21 nt, Shigella flexneri 2a str. 301
ggcccuuccccuucucgucgg

SEQ ID NO: 3895297 - RNA, 21 nt, Shigella flexneri 2a str. 301
ggcccuuucccuucucgucgg

SEQ ID NO: 3895298 - RNA, 14 nt, Shigella flexneri 2a str. 301
ggccgacagcaggc

SEQ ID NO: 3895299 - RNA, 16 nt, Shigella flexneri 2a str. 301
ggccgacagcaggcuc

SEQ ID NO: 3895300 - RNA, 13 nt, Shigella flexneri 2a str. 301
ggccgaggcacag

SEQ ID NO: 3895301 - RNA, 16 nt, Shigella flexneri 2a str. 301
ggccgaggcacagcag

SEQ ID NO: 3895302 - RNA, 16 nt, Shigella flexneri 2a str. 301
ggccgcaaaccagcgc

SEQ ID NO: 3895303 - RNA, 21 nt, Shigella flexneri 2a str. 301
ggccgcaggcuguuaccccug

SEQ ID NO: 3895304 - RNA, 16 nt, Shigella flexneri 2a str. 301
ggccgccacacagcac

SEQ ID NO: 3895305 - RNA, 19 nt, Shigella flexneri 2a str. 301
ggccgcgccgacugcgcca

SEQ ID NO: 3895306 - RNA, 22 nt, Shigella flexneri 2a str. 301
ggccgcugaacuggcgaagccu

SEQ ID NO: 3895307 - RNA, 11 nt, Shigella flexneri 2a str. 301
ggccgcuuucu

SEQ ID NO: 3895308 - RNA, 13 nt, Shigella flexneri 2a str. 301
ggccggagccagc

SEQ ID NO: 3895309 - RNA, 16 nt, Shigella flexneri 2a str. 301
ggccggagccagccgu

SEQ ID NO: 3895310 - RNA, 16 nt, Shigella flexneri 2a str. 301
ggccggauaaggcgcu

SEQ ID NO: 3895311 - RNA, 15 nt, Shigella flexneri 2a str. 301
ggccggaugacagac

SEQ ID NO: 3895312 - RNA, 18 nt, Shigella flexneri 2a str. 301
ggccggaugucgcugcua

SEQ ID NO: 3895313 - RNA, 22 nt, Shigella flexneri 2a str. 301
ggccggcauauaccucagcaga

SEQ ID NO: 3895314 - RNA, 18 nt, Shigella flexneri 2a str. 301
ggccggguuuucucccuc

SEQ ID NO: 3895315 - RNA, 17 nt, Shigella flexneri 2a str. 301
ggccguaaucacuguca

SEQ ID NO: 3895316 - RNA, 16 nt, Shigella flexneri 2a str. 301
ggccgugaauuacugc

SEQ ID NO: 3895317 - RNA, 14 nt, Shigella flexneri 2a str. 301
ggccguuguucucg

SEQ ID NO: 3895318 - RNA, 16 nt, Shigella flexneri 2a str. 301
ggccuaacaccaucag

SEQ ID NO: 3895319 - RNA, 20 nt, Shigella flexneri 2a str. 301
ggccuacaaguccguugaaa

SEQ ID NO: 3895320 - RNA, 14 nt, Shigella flexneri 2a str. 301
ggccuacacaugcg

SEQ ID NO: 3895321 - RNA, 20 nt, Shigella flexneri 2a str. 301
ggccuacagcauauaaugca

SEQ ID NO: 3895322 - RNA, 19 nt, Shigella flexneri 2a str. 301
ggccuacauagucccugca

SEQ ID NO: 3895323 - RNA, 20 nt, Shigella flexneri 2a str. 301
ggccuacaucguuccugcaa

SEQ ID NO: 3895324 - RNA, 19 nt, Shigella flexneri 2a str. 301
ggccuacaugauuucugca

SEQ ID NO: 3895325 - RNA, 19 nt, Shigella flexneri 2a str. 301
ggccuaccaugaccugcaa

SEQ ID NO: 3895326 - RNA, 18 nt, Shigella flexneri 2a str. 301
ggccuauuaugacuccag

SEQ ID NO: 3895327 - RNA, 14 nt, Shigella flexneri 2a str. 301
ggccuccugcagcg

SEQ ID NO: 3895328 - RNA, 15 nt, Shigella flexneri 2a str. 301
ggccuccugcagcgu

SEQ ID NO: 3895329 - RNA, 18 nt, Shigella flexneri 2a str. 301
ggcgggcaagcggcggca

SEQ ID NO: 3895330 - RNA, 23 nt, Shigella flexneri 2a str. 301
ggcgggcuuuuuuugccccagaa

SEQ ID NO: 3895331 - RNA, 22 nt, Shigella flexneri 2a str. 301
ggcggguuaaccagcaccagcu

SEQ ID NO: 3895332 - RNA, 16 nt, Shigella flexneri 2a str. 301
ggcgguaaaaucaucc

SEQ ID NO: 3895333 - RNA, 19 nt, Shigella flexneri 2a str. 301
ggcgguagccccgcgaacg

SEQ ID NO: 3895334 - RNA, 19 nt, Shigella flexneri 2a str. 301
ggcgguaucgucgggcugg

SEQ ID NO: 3895335 - RNA, 20 nt, Shigella flexneri 2a str. 301
ggcgguaucgucgggcuggu

SEQ ID NO: 3895336 - RNA, 19 nt, Shigella flexneri 2a str. 301
ggcggucaugacgauacgg

SEQ ID NO: 3895337 - RNA, 17 nt, Shigella flexneri 2a str. 301
ggcggugaccagcagca

SEQ ID NO: 3895338 - RNA, 19 nt, Shigella flexneri 2a str. 301
ggcgguggauaaagcacug

SEQ ID NO: 3895339 - RNA, 12 nt, Shigella flexneri 2a str. 301
ggcguaaacgcc

SEQ ID NO: 3895340 - RNA, 18 nt, Shigella flexneri 2a str. 301
ggcguaaacgccuuaucc

SEQ ID NO: 3895341 - RNA, 18 nt, Shigella flexneri 2a str. 301
ggcguagugcccgcagua

SEQ ID NO: 3895342 - RNA, 12 nt, Shigella flexneri 2a str. 301
ggcgucaaacgg

SEQ ID NO: 3895343 - RNA, 23 nt, Shigella flexneri 2a str. 301
ggcgucaacaacacucucugaag

SEQ ID NO: 3895344 - RNA, 14 nt, Shigella flexneri 2a str. 301
ggcguccaccugcg

SEQ ID NO: 3895345 - RNA, 18 nt, Shigella flexneri 2a str. 301
ggcguccuggaacuggug

SEQ ID NO: 3895346 - RNA, 15 nt, Shigella flexneri 2a str. 301
ggcgucugaaucaac

SEQ ID NO: 3895347 - RNA, 15 nt, Shigella flexneri 2a str. 301
ggcgucuuguugaac

SEQ ID NO: 3895348 - RNA, 18 nt, Shigella flexneri 2a str. 301
ggcgugaacgccuuaucc

SEQ ID NO: 3895349 - RNA, 18 nt, Shigella flexneri 2a str. 301
ggcgugaacgccuuaucu

SEQ ID NO: 3895350 - RNA, 21 nt, Shigella flexneri 2a str. 301
ggcgugagcugccucgcugaa

SEQ ID NO: 3895351 - RNA, 20 nt, Shigella flexneri 2a str. 301
ggcgugauucauacagcggc

SEQ ID NO: 3895352 - RNA, 20 nt, Shigella flexneri 2a str. 301
ggcguggcccuaggcauaga

SEQ ID NO: 3895353 - RNA, 16 nt, Shigella flexneri 2a str. 301
ggcguggcgcucgccc

SEQ ID NO: 3895354 - RNA, 15 nt, Shigella flexneri 2a str. 301
ggcguggucgguuaa

SEQ ID NO: 3895355 - RNA, 14 nt, Shigella flexneri 2a str. 301
ggcguuacagcugg

SEQ ID NO: 3895356 - RNA, 14 nt, Shigella flexneri 2a str. 301
ggcguuaucacguu

SEQ ID NO: 3895357 - RNA, 20 nt, Shigella flexneri 2a str. 301
ggcguuaucggguccgggca

SEQ ID NO: 3895358 - RNA, 21 nt, Shigella flexneri 2a str. 301
ggcguucacgccgcauccgac

SEQ ID NO: 3895359 - RNA, 16 nt, Shigella flexneri 2a str. 301
ggcguucgcggcggca

SEQ ID NO: 3895360 - RNA, 22 nt, Shigella flexneri 2a str. 301
ggcguucugccuggcgcagcaa

SEQ ID NO: 3895361 - RNA, 18 nt, Shigella flexneri 2a str. 301
ggcguuuacgccgcauca

SEQ ID NO: 3895362 - RNA, 20 nt, Shigella flexneri 2a str. 301
ggcguuuguaacccaccaug

SEQ ID NO: 3895363 - RNA, 15 nt, Shigella flexneri 2a str. 301
ggcguuuucgccgca

SEQ ID NO: 3895364 - RNA, 14 nt, Shigella flexneri 2a str. 301
ggcguuuucuggca

SEQ ID NO: 3895365 - RNA, 23 nt, Shigella flexneri 2a str. 301
ggcguuuugauuuucaccagcau

SEQ ID NO: 3895366 - RNA, 20 nt, Shigella flexneri 2a str. 301
ggcuaaccgucugugugccu

SEQ ID NO: 3895367 - RNA, 19 nt, Shigella flexneri 2a str. 301
ggcuaaucuugaaaccaga

SEQ ID NO: 3895368 - RNA, 22 nt, Shigella flexneri 2a str. 301
ggcuauaaucacucaaaauauc

SEQ ID NO: 3895369 - RNA, 14 nt, Shigella flexneri 2a str. 301
ggcuauauucaaac

SEQ ID NO: 3895370 - RNA, 12 nt, Shigella flexneri 2a str. 301
ggcuaucccaaa

SEQ ID NO: 3895371 - RNA, 23 nt, Shigella flexneri 2a str. 301
ggcuauuagaaauuccuaugcaa

SEQ ID NO: 3895372 - RNA, 20 nt, Shigella flexneri 2a str. 301
ggcuauuccacgcaucaagc

SEQ ID NO: 3895373 - RNA, 17 nt, Shigella flexneri 2a str. 301
ggcuauuccaguugaag

SEQ ID NO: 3895374 - RNA, 18 nt, Shigella flexneri 2a str. 301
ggcucaaagacugugcca

SEQ ID NO: 3895375 - RNA, 13 nt, Shigella flexneri 2a str. 301
ggcucaacaacug

SEQ ID NO: 3895376 - RNA, 20 nt, Shigella flexneri 2a str. 301
ggcucaacgucuuccggcgu

SEQ ID NO: 3895377 - RNA, 14 nt, Shigella flexneri 2a str. 301
ggcucaaucgccac

SEQ ID NO: 3895378 - RNA, 15 nt, Shigella flexneri 2a str. 301
ggcucaaucgccacc

SEQ ID NO: 3895379 - RNA, 15 nt, Shigella flexneri 2a str. 301
ggcucaccugcacac

SEQ ID NO: 3895380 - RNA, 23 nt, Shigella flexneri 2a str. 301
ggcucagcucuggcacaugcaua

SEQ ID NO: 3895381 - RNA, 13 nt, Shigella flexneri 2a str. 301
ggcucaucaaaca

SEQ ID NO: 3895382 - RNA, 14 nt, Shigella flexneri 2a str. 301
ggcucaucggguaa

SEQ ID NO: 3895383 - RNA, 21 nt, Shigella flexneri 2a str. 301
ggcucaucucuucgguuggca

SEQ ID NO: 3895384 - RNA, 14 nt, Shigella flexneri 2a str. 301
ggcucaugcaucag

SEQ ID NO: 3895385 - RNA, 17 nt, Shigella flexneri 2a str. 301
ggcuccaacggcccgcu

SEQ ID NO: 3895386 - RNA, 14 nt, Shigella flexneri 2a str. 301
ggcuccagcaaugu

SEQ ID NO: 3895387 - RNA, 14 nt, Shigella flexneri 2a str. 301
ggcucccgcagcca

SEQ ID NO: 3895388 - RNA, 21 nt, Shigella flexneri 2a str. 301
ggcuccgguuaacgccgcgcc

SEQ ID NO: 3895389 - RNA, 22 nt, Shigella flexneri 2a str. 301
ggcucgccuuucggcugcagca

SEQ ID NO: 3895390 - RNA, 22 nt, Shigella flexneri 2a str. 301
ggcucguuagacggcgcugccg

SEQ ID NO: 3895391 - RNA, 13 nt, Shigella flexneri 2a str. 301
ggcucucgccagc

SEQ ID NO: 3895392 - RNA, 19 nt, Shigella flexneri 2a str. 301
ggcucugauugccuuccac

SEQ ID NO: 3895393 - RNA, 14 nt, Shigella flexneri 2a str. 301
ggcucugcggcgga

SEQ ID NO: 3895394 - RNA, 22 nt, Shigella flexneri 2a str. 301
ggcucuuaagcaccgacguuga

SEQ ID NO: 3895395 - RNA, 18 nt, Shigella flexneri 2a str. 301
ggcucuuuuucggggcug

SEQ ID NO: 3895396 - RNA, 22 nt, Shigella flexneri 2a str. 301
ggcugaacgacaaauucaggaa

SEQ ID NO: 3895397 - RNA, 13 nt, Shigella flexneri 2a str. 301
ggcugaagaagua

SEQ ID NO: 3895398 - RNA, 14 nt, Shigella flexneri 2a str. 301
ggcugacaaaucag

SEQ ID NO: 3895399 - RNA, 21 nt, Shigella flexneri 2a str. 301
ggcugaccccaaccgcccugc

SEQ ID NO: 3895400 - RNA, 19 nt, Shigella flexneri 2a str. 301
ggcugacguuaagaaaacg

SEQ ID NO: 3895401 - RNA, 22 nt, Shigella flexneri 2a str. 301
ggcugacugcuuugcacaggca

SEQ ID NO: 3895402 - RNA, 21 nt, Shigella flexneri 2a str. 301
ggcugacugucgcagccagcg

SEQ ID NO: 3895403 - RNA, 20 nt, Shigella flexneri 2a str. 301
ggcugagcaaacaguucugc

SEQ ID NO: 3895404 - RNA, 21 nt, Shigella flexneri 2a str. 301
ggcugagcaaacaguucugca

SEQ ID NO: 3895405 - RNA, 20 nt, Shigella flexneri 2a str. 301
ggcugauaaaguguucucca

SEQ ID NO: 3895406 - RNA, 10 nt, Shigella flexneri 2a str. 301
ggcugcagca

SEQ ID NO: 3895407 - RNA, 13 nt, Shigella flexneri 2a str. 301
ggcugccagcucu

SEQ ID NO: 3895408 - RNA, 10 nt, Shigella flexneri 2a str. 301
ggcugccgcc

SEQ ID NO: 3895409 - RNA, 20 nt, Shigella flexneri 2a str. 301
ggcugccggaaggcagccuu

SEQ ID NO: 3895410 - RNA, 23 nt, Shigella flexneri 2a str. 301
ggcugcgggaguugcuccacugc

SEQ ID NO: 3895411 - RNA, 20 nt, Shigella flexneri 2a str. 301
ggcugcugauguucgccaga

SEQ ID NO: 3895412 - RNA, 20 nt, Shigella flexneri 2a str. 301
ggcugcugcuguagccgaug

SEQ ID NO: 3895413 - RNA, 18 nt, Shigella flexneri 2a str. 301
ggcuggaagcuggauuaa

SEQ ID NO: 3895414 - RNA, 14 nt, Shigella flexneri 2a str. 301
ggcuggaucagacg

SEQ ID NO: 3895415 - RNA, 16 nt, Shigella flexneri 2a str. 301
ggcuggaucagacgca

SEQ ID NO: 3895416 - RNA, 14 nt, Shigella flexneri 2a str. 301
ggcuggcaaugacc

SEQ ID NO: 3895417 - RNA, 21 nt, Shigella flexneri 2a str. 301
ggcuggcauuuuuuauggugg

SEQ ID NO: 3895418 - RNA, 16 nt, Shigella flexneri 2a str. 301
ggcuggccacaaaccu

SEQ ID NO: 3895419 - RNA, 21 nt, Shigella flexneri 2a str. 301
ggcuggguuuccggaucgcca

SEQ ID NO: 3895420 - RNA, 18 nt, Shigella flexneri 2a str. 301
ggcugguuuucagcgaaa

SEQ ID NO: 3895421 - RNA, 13 nt, Shigella flexneri 2a str. 301
ggcuguaauucag

SEQ ID NO: 3895422 - RNA, 15 nt, Shigella flexneri 2a str. 301
ggcuguaauucagua

SEQ ID NO: 3895423 - RNA, 16 nt, Shigella flexneri 2a str. 301
ggcugucauccagcag

SEQ ID NO: 3895424 - RNA, 15 nt, Shigella flexneri 2a str. 301
ggcugucuuccugug

SEQ ID NO: 3895425 - RNA, 17 nt, Shigella flexneri 2a str. 301
ggcugugaaccgcacag

SEQ ID NO: 3895426 - RNA, 19 nt, Shigella flexneri 2a str. 301
ggcugugcccguaaaaaau

SEQ ID NO: 3895427 - RNA, 19 nt, Shigella flexneri 2a str. 301
ggcugugguacugccggcg

SEQ ID NO: 3895428 - RNA, 19 nt, Shigella flexneri 2a str. 301
ggcuguucacugugcuggu

SEQ ID NO: 3895429 - RNA, 21 nt, Shigella flexneri 2a str. 301
gggcuggcaaauucaggagca

SEQ ID NO: 3895430 - RNA, 12 nt, Shigella flexneri 2a str. 301
gggcuggccaau

SEQ ID NO: 3895431 - RNA, 20 nt, Shigella flexneri 2a str. 301
gggcuggcguacccaucaac

SEQ ID NO: 3895432 - RNA, 21 nt, Shigella flexneri 2a str. 301
gggcugugggguauuuccagg

SEQ ID NO: 3895433 - RNA, 14 nt, Shigella flexneri 2a str. 301
gggcuuaccacggg

SEQ ID NO: 3895434 - RNA, 12 nt, Shigella flexneri 2a str. 301
gggcuucaaagu

SEQ ID NO: 3895435 - RNA, 23 nt, Shigella flexneri 2a str. 301
gggcuuugcuacagccuggugaa

SEQ ID NO: 3895436 - RNA, 23 nt, Shigella flexneri 2a str. 301
ggggaagcgcaccaauucaugag

SEQ ID NO: 3895437 - RNA, 17 nt, Shigella flexneri 2a str. 301
ggggacauuuagcggcc

SEQ ID NO: 3895438 - RNA, 20 nt, Shigella flexneri 2a str. 301
ggggagcaacagaguugcca

SEQ ID NO: 3895439 - RNA, 14 nt, Shigella flexneri 2a str. 301
ggggauaagaauau

SEQ ID NO: 3895440 - RNA, 21 nt, Shigella flexneri 2a str. 301
ggggauguguuauucagcugg

SEQ ID NO: 3895441 - RNA, 23 nt, Shigella flexneri 2a str. 301
ggggauuuucacugugcuuuaca

SEQ ID NO: 3895442 - RNA, 16 nt, Shigella flexneri 2a str. 301
ggggccaauugcugug

SEQ ID NO: 3895443 - RNA, 14 nt, Shigella flexneri 2a str. 301
ggggcuucuuccgg

SEQ ID NO: 3895444 - RNA, 21 nt, Shigella flexneri 2a str. 301
ggggcuuucccguuucagccc

SEQ ID NO: 3895445 - RNA, 11 nt, Shigella flexneri 2a str. 301
gggggaaggau

SEQ ID NO: 3895446 - RNA, 18 nt, Shigella flexneri 2a str. 301
gggggauccagucccccc

SEQ ID NO: 3895447 - RNA, 20 nt, Shigella flexneri 2a str. 301
gggggcuaaucuugaaacca

SEQ ID NO: 3895448 - RNA, 23 nt, Shigella flexneri 2a str. 301
ggggguucaaguccccccccucg

SEQ ID NO: 3895449 - RNA, 14 nt, Shigella flexneri 2a str. 301
gggguaaagcgcgg

SEQ ID NO: 3895450 - RNA, 13 nt, Shigella flexneri 2a str. 301
ggggucagcaggu

SEQ ID NO: 3895451 - RNA, 12 nt, Shigella flexneri 2a str. 301
ggggugucggug

SEQ ID NO: 3895452 - RNA, 22 nt, Shigella flexneri 2a str. 301
gggguuuucucuuuccagcaac

SEQ ID NO: 3895453 - RNA, 14 nt, Shigella flexneri 2a str. 301
ggguaagggaggau

SEQ ID NO: 3895454 - RNA, 15 nt, Shigella flexneri 2a str. 301
ggguaauuucauuaa

SEQ ID NO: 3895455 - RNA, 15 nt, Shigella flexneri 2a str. 301
ggguacgacuuccug

SEQ ID NO: 3895456 - RNA, 14 nt, Shigella flexneri 2a str. 301
ggguaggaucagaa

SEQ ID NO: 3895457 - RNA, 20 nt, Shigella flexneri 2a str. 301
ggguauaaaacucaccgcgc

SEQ ID NO: 3895458 - RNA, 21 nt, Shigella flexneri 2a str. 301
ggguauggaucccucuuucug

SEQ ID NO: 3895459 - RNA, 10 nt, Shigella flexneri 2a str. 301
gggucaccgc

SEQ ID NO: 3895460 - RNA, 21 nt, Shigella flexneri 2a str. 301
gggucaccgccgauaccgaca

SEQ ID NO: 3895461 - RNA, 17 nt, Shigella flexneri 2a str. 301
gggucgccagaagguga

SEQ ID NO: 3895462 - RNA, 12 nt, Shigella flexneri 2a str. 301
gggugagcagaa

SEQ ID NO: 3895463 - RNA, 14 nt, Shigella flexneri 2a str. 301
gggugagggaggau

SEQ ID NO: 3895464 - RNA, 20 nt, Shigella flexneri 2a str. 301
gggugauuguucgcaccggu

SEQ ID NO: 3895465 - RNA, 21 nt, Shigella flexneri 2a str. 301
gggugcaaucaacaccacugc

SEQ ID NO: 3895466 - RNA, 23 nt, Shigella flexneri 2a str. 301
gggugcaaucaacaccacugcca

SEQ ID NO: 3895467 - RNA, 20 nt, Shigella flexneri 2a str. 301
gggugccauuuuuuauugcg

SEQ ID NO: 3895468 - RNA, 22 nt, Shigella flexneri 2a str. 301
gggugcgacaggagccgcagua

SEQ ID NO: 3895469 - RNA, 19 nt, Shigella flexneri 2a str. 301
ggguguauucaugcccugc

SEQ ID NO: 3895470 - RNA, 13 nt, Shigella flexneri 2a str. 301
ggguucagcauug

SEQ ID NO: 3895471 - RNA, 17 nt, Shigella flexneri 2a str. 301
ggguucgacgcgguuga

SEQ ID NO: 3895472 - RNA, 16 nt, Shigella flexneri 2a str. 301
gguaaaaccaugccau

SEQ ID NO: 3895473 - RNA, 21 nt, Shigella flexneri 2a str. 301
gguaaaaccugacaacaaaac

SEQ ID NO: 3895474 - RNA, 21 nt, Shigella flexneri 2a str. 301
gguaaaauggucagccagcgg

SEQ ID NO: 3895475 - RNA, 12 nt, Shigella flexneri 2a str. 301
gguaaacaacau

SEQ ID NO: 3895476 - RNA, 17 nt, Shigella flexneri 2a str. 301
gguaaacaacaugcuau

SEQ ID NO: 3895477 - RNA, 20 nt, Shigella flexneri 2a str. 301
gguaaacaccuucauccagc

SEQ ID NO: 3895478 - RNA, 22 nt, Shigella flexneri 2a str. 301
gguaaagaagagcggcaaacgu

SEQ ID NO: 3895479 - RNA, 15 nt, Shigella flexneri 2a str. 301
gguaaagcccucacc

SEQ ID NO: 3895480 - RNA, 11 nt, Shigella flexneri 2a str. 301
gguaaauuguu

SEQ ID NO: 3895481 - RNA, 12 nt, Shigella flexneri 2a str. 301
gguaacauccag

SEQ ID NO: 3895482 - RNA, 22 nt, Shigella flexneri 2a str. 301
gguaacggcgucaacaccgggu

SEQ ID NO: 3895483 - RNA, 22 nt, Shigella flexneri 2a str. 301
gguaacucugaugacugaugcu

SEQ ID NO: 3895484 - RNA, 17 nt, Shigella flexneri 2a str. 301
gguaacuuaucuguaau

SEQ ID NO: 3895485 - RNA, 13 nt, Shigella flexneri 2a str. 301
gguaagcaaaggu

SEQ ID NO: 3895486 - RNA, 13 nt, Shigella flexneri 2a str. 301
gguaaggauaaaa

SEQ ID NO: 3895487 - RNA, 20 nt, Shigella flexneri 2a str. 301
gguaagggaggauuucuccc

SEQ ID NO: 3895488 - RNA, 14 nt, Shigella flexneri 2a str. 301
gguaaggugauuag

SEQ ID NO: 3895489 - RNA, 22 nt, Shigella flexneri 2a str. 301
gguaauacuaaucucacccaua

SEQ ID NO: 3895490 - RNA, 14 nt, Shigella flexneri 2a str. 301
gguaaugccaguca

SEQ ID NO: 3895491 - RNA, 23 nt, Shigella flexneri 2a str. 301
gguaaugcgauuuucauccugca

SEQ ID NO: 3895492 - RNA, 14 nt, Shigella flexneri 2a str. 301
gguacaaacaucau

SEQ ID NO: 3895493 - RNA, 21 nt, Shigella flexneri 2a str. 301
gguacaaagccaacagcagcc

SEQ ID NO: 3895494 - RNA, 21 nt, Shigella flexneri 2a str. 301
gguacaaccaucccuccugug

SEQ ID NO: 3895495 - RNA, 12 nt, Shigella flexneri 2a str. 301
gguacagagcaa

SEQ ID NO: 3895496 - RNA, 16 nt, Shigella flexneri 2a str. 301
gguaccagaaucaccu

SEQ ID NO: 3895497 - RNA, 10 nt, Shigella flexneri 2a str. 301
gguacgcagc

SEQ ID NO: 3895498 - RNA, 18 nt, Shigella flexneri 2a str. 301
gguacuaucagcguaaag

SEQ ID NO: 3895499 - RNA, 17 nt, Shigella flexneri 2a str. 301
gguacuucaaucgccac

SEQ ID NO: 3895500 - RNA, 22 nt, Shigella flexneri 2a str. 301
gguagacaccaaggaacugugc

SEQ ID NO: 3895501 - RNA, 14 nt, Shigella flexneri 2a str. 301
gguagacgcgcuag

SEQ ID NO: 3895502 - RNA, 21 nt, Shigella flexneri 2a str. 301
gguagagcagcgcauucguaa

SEQ ID NO: 3895503 - RNA, 18 nt, Shigella flexneri 2a str. 301
gguagcacgucaucugca

SEQ ID NO: 3895504 - RNA, 18 nt, Shigella flexneri 2a str. 301
gguagccaaugcggcaac

SEQ ID NO: 3895505 - RNA, 16 nt, Shigella flexneri 2a str. 301
gguagcgcauaagcca

SEQ ID NO: 3895506 - RNA, 15 nt, Shigella flexneri 2a str. 301
gguaguccaugacca

SEQ ID NO: 3895507 - RNA, 17 nt, Shigella flexneri 2a str. 301
gguauaaaauagcaaua

SEQ ID NO: 3895508 - RNA, 15 nt, Shigella flexneri 2a str. 301
gguauacgucccggu

SEQ ID NO: 3895509 - RNA, 13 nt, Shigella flexneri 2a str. 301
gguaucaaacaca

SEQ ID NO: 3895510 - RNA, 15 nt, Shigella flexneri 2a str. 301
gguaucaaacacagg

SEQ ID NO: 3895511 - RNA, 11 nt, Shigella flexneri 2a str. 301
gguaucaaacc

SEQ ID NO: 3895512 - RNA, 18 nt, Shigella flexneri 2a str. 301
gguaucgcgccagccagu

SEQ ID NO: 3895513 - RNA, 18 nt, Shigella flexneri 2a str. 301
gguaucgggcaguuuacc

SEQ ID NO: 3895514 - RNA, 22 nt, Shigella flexneri 2a str. 301
gguaucguaaccuugauccugc

SEQ ID NO: 3895515 - RNA, 21 nt, Shigella flexneri 2a str. 301
gguaucgucgggcuggugcug

SEQ ID NO: 3895516 - RNA, 21 nt, Shigella flexneri 2a str. 301
gguaucuucccagccaaugca

SEQ ID NO: 3895517 - RNA, 21 nt, Shigella flexneri 2a str. 301
gguaucuuuaaucgagauacg

SEQ ID NO: 3895518 - RNA, 22 nt, Shigella flexneri 2a str. 301
gguauuagcgcaaagacggaug

SEQ ID NO: 3895519 - RNA, 19 nt, Shigella flexneri 2a str. 301
gguauucaaccguuuccag

SEQ ID NO: 3895520 - RNA, 13 nt, Shigella flexneri 2a str. 301
gguauuggugaaa

SEQ ID NO: 3895521 - RNA, 16 nt, Shigella flexneri 2a str. 301
gguauuuucugaaacg

SEQ ID NO: 3895522 - RNA, 21 nt, Shigella flexneri 2a str. 301
ggucaaacggcgcuuccagca

SEQ ID NO: 3895523 - RNA, 22 nt, Shigella flexneri 2a str. 301
ggucaaaugaccgggcuuuccg

SEQ ID NO: 3895524 - RNA, 16 nt, Shigella flexneri 2a str. 301
ggucaacgucaacuuu

SEQ ID NO: 3895525 - RNA, 18 nt, Shigella flexneri 2a str. 301
ggucaauggucagcgcca

SEQ ID NO: 3895526 - RNA, 22 nt, Shigella flexneri 2a str. 301
ggucaauuccuucugggcgcgg

SEQ ID NO: 3895527 - RNA, 15 nt, Shigella flexneri 2a str. 301
ggucacaucgcugac

SEQ ID NO: 3895528 - RNA, 13 nt, Shigella flexneri 2a str. 301
ggucaccaguuca

SEQ ID NO: 3895529 - RNA, 16 nt, Shigella flexneri 2a str. 301
gguuaaucggcaggga

SEQ ID NO: 3895530 - RNA, 17 nt, Shigella flexneri 2a str. 301
gguuaauuaccuuauca

SEQ ID NO: 3895531 - RNA, 20 nt, Shigella flexneri 2a str. 301
gguuacgcaccagauaagca

SEQ ID NO: 3895532 - RNA, 22 nt, Shigella flexneri 2a str. 301
gguuacuuuuuaugucauuaac

SEQ ID NO: 3895533 - RNA, 11 nt, Shigella flexneri 2a str. 301
gguuagccugu

SEQ ID NO: 3895534 - RNA, 15 nt, Shigella flexneri 2a str. 301
gguuagcucaacgca

SEQ ID NO: 3895535 - RNA, 19 nt, Shigella flexneri 2a str. 301
gguuaggcugugaaccgca

SEQ ID NO: 3895536 - RNA, 14 nt, Shigella flexneri 2a str. 301
gguuaguaugaaga

SEQ ID NO: 3895537 - RNA, 22 nt, Shigella flexneri 2a str. 301
gguuaguaugaagaacaaguuc

SEQ ID NO: 3895538 - RNA, 17 nt, Shigella flexneri 2a str. 301
gguuagucugcauuuuc

SEQ ID NO: 3895539 - RNA, 21 nt, Shigella flexneri 2a str. 301
gguuagucugcauuuucucgc

SEQ ID NO: 3895540 - RNA, 16 nt, Shigella flexneri 2a str. 301
gguuauccagcaacca

SEQ ID NO: 3895541 - RNA, 22 nt, Shigella flexneri 2a str. 301
gguuauuuguaguuugauaauu

SEQ ID NO: 3895542 - RNA, 10 nt, Shigella flexneri 2a str. 301
gguucaaagu

SEQ ID NO: 3895543 - RNA, 22 nt, Shigella flexneri 2a str. 301
gguucaccgcgagcauaggcau

SEQ ID NO: 3895544 - RNA, 13 nt, Shigella flexneri 2a str. 301
gguucaccgguga

SEQ ID NO: 3895545 - RNA, 23 nt, Shigella flexneri 2a str. 301
gguucaucgugcuguuugaaaug

SEQ ID NO: 3895546 - RNA, 20 nt, Shigella flexneri 2a str. 301
gguucauuggguucaucuga

SEQ ID NO: 3895547 - RNA, 20 nt, Shigella flexneri 2a str. 301
gguuccacuucugcggguga

SEQ ID NO: 3895548 - RNA, 23 nt, Shigella flexneri 2a str. 301
gguucgacugcccgcgagcgugg

SEQ ID NO: 3895549 - RNA, 17 nt, Shigella flexneri 2a str. 301
gguucgauauccgccaa

SEQ ID NO: 3895550 - RNA, 14 nt, Shigella flexneri 2a str. 301
gguucugcggguua

SEQ ID NO: 3895551 - RNA, 13 nt, Shigella flexneri 2a str. 301
gguucuuuuuuga

SEQ ID NO: 3895552 - RNA, 22 nt, Shigella flexneri 2a str. 301
gguucuuuuuugagaauaaccu

SEQ ID NO: 3895553 - RNA, 12 nt, Shigella flexneri 2a str. 301
gguugacugaaa

SEQ ID NO: 3895554 - RNA, 13 nt, Shigella flexneri 2a str. 301
gguugacugcuga

SEQ ID NO: 3895555 - RNA, 22 nt, Shigella flexneri 2a str. 301
gguugauacgagagccggaaga

SEQ ID NO: 3895556 - RNA, 13 nt, Shigella flexneri 2a str. 301
gguugauggcagu

SEQ ID NO: 3895557 - RNA, 13 nt, Shigella flexneri 2a str. 301
gguugcccagcgc

SEQ ID NO: 3895558 - RNA, 13 nt, Shigella flexneri 2a str. 301
gguuggcgugcgg

SEQ ID NO: 3895559 - RNA, 16 nt, Shigella flexneri 2a str. 301
gguugguggcgguaac

SEQ ID NO: 3895560 - RNA, 14 nt, Shigella flexneri 2a str. 301
gguuuaaacagaga

SEQ ID NO: 3895561 - RNA, 21 nt, Shigella flexneri 2a str. 301
gguuuacccgcuugaguauuu

SEQ ID NO: 3895562 - RNA, 14 nt, Shigella flexneri 2a str. 301
gguuuauccccaag

SEQ ID NO: 3895563 - RNA, 15 nt, Shigella flexneri 2a str. 301
gguuuauuucccaga

SEQ ID NO: 3895564 - RNA, 23 nt, Shigella flexneri 2a str. 301
gguuucaaagauuuuaccaaugg

SEQ ID NO: 3895565 - RNA, 20 nt, Shigella flexneri 2a str. 301
gguuucaaauuacgauccac

SEQ ID NO: 3895566 - RNA, 14 nt, Shigella flexneri 2a str. 301
gguuucacccacgg

SEQ ID NO: 3895567 - RNA, 18 nt, Shigella flexneri 2a str. 301
gguuucacguaccagaug

SEQ ID NO: 3895568 - RNA, 20 nt, Shigella flexneri 2a str. 301
gguuucagauuggugacaaa

SEQ ID NO: 3895569 - RNA, 18 nt, Shigella flexneri 2a str. 301
gguuucccgccguaacug

SEQ ID NO: 3895570 - RNA, 15 nt, Shigella flexneri 2a str. 301
gguuucgccugccag

SEQ ID NO: 3895571 - RNA, 11 nt, Shigella flexneri 2a str. 301
gguuucuuuuu

SEQ ID NO: 3895572 - RNA, 19 nt, Shigella flexneri 2a str. 301
gguuugacauaaauuccgc

SEQ ID NO: 3895573 - RNA, 11 nt, Shigella flexneri 2a str. 301
gguuuuaucca

SEQ ID NO: 3895574 - RNA, 23 nt, Shigella flexneri 2a str. 301
gguuuuauuauuccauccugcuc

SEQ ID NO: 3895575 - RNA, 17 nt, Shigella flexneri 2a str. 301
gguuuucaaucgacuuu

SEQ ID NO: 3895576 - RNA, 23 nt, Shigella flexneri 2a str. 301
gguuuucaucccgagucgcugag

SEQ ID NO: 3895577 - RNA, 18 nt, Shigella flexneri 2a str. 301
gguuuucgcgcgcaguua

SEQ ID NO: 3895578 - RNA, 19 nt, Shigella flexneri 2a str. 301
gguuuucucccucgcucug

SEQ ID NO: 3895579 - RNA, 15 nt, Shigella flexneri 2a str. 301
gguuuugaucuccag

SEQ ID NO: 3895580 - RNA, 20 nt, Shigella flexneri 2a str. 301
gguuuugcccacagagcuga

SEQ ID NO: 3895581 - RNA, 17 nt, Shigella flexneri 2a str. 301
gguuuugcuauccagua

SEQ ID NO: 3895582 - RNA, 15 nt, Shigella flexneri 2a str. 301
gguuuuguuuaaaua

SEQ ID NO: 3895583 - RNA, 23 nt, Shigella flexneri 2a str. 301
gguuuuucaguagacucaagcag

SEQ ID NO: 3895584 - RNA, 20 nt, Shigella flexneri 2a str. 301
gguuuuuguuuugagcacuc

SEQ ID NO: 3895585 - RNA, 20 nt, Shigella flexneri 2a str. 301
gguuuuuuauuuaagcuggg

SEQ ID NO: 3895586 - RNA, 15 nt, Shigella flexneri 2a str. 301
gguuuuuugaacaga

SEQ ID NO: 3895587 - RNA, 22 nt, Shigella flexneri 2a str. 301
gguuuuuugaacagaccacauu

SEQ ID NO: 3895588 - RNA, 12 nt, Shigella flexneri 2a str. 301
guaaaaagaaag

SEQ ID NO: 3895589 - RNA, 20 nt, Shigella flexneri 2a str. 301
guaaaaagaaaguuugcaga

SEQ ID NO: 3895590 - RNA, 12 nt, Shigella flexneri 2a str. 301
guaaaaccugac

SEQ ID NO: 3895591 - RNA, 13 nt, Shigella flexneri 2a str. 301
guaaaaggagaua

SEQ ID NO: 3895592 - RNA, 15 nt, Shigella flexneri 2a str. 301
guaaaaggauguuua

SEQ ID NO: 3895593 - RNA, 19 nt, Shigella flexneri 2a str. 301
guaaaaggcgccauuuuca

SEQ ID NO: 3895594 - RNA, 20 nt, Shigella flexneri 2a str. 301
guaaaaggcgccauuuucau

SEQ ID NO: 3895595 - RNA, 13 nt, Shigella flexneri 2a str. 301
guaaaaggucuga

SEQ ID NO: 3895596 - RNA, 15 nt, Shigella flexneri 2a str. 301
guaaaaucgauaacg

SEQ ID NO: 3895597 - RNA, 22 nt, Shigella flexneri 2a str. 301
guaaaaugagugccaaaaaaau

SEQ ID NO: 3895598 - RNA, 15 nt, Shigella flexneri 2a str. 301
guaaacaaacaacgc

SEQ ID NO: 3895599 - RNA, 11 nt, Shigella flexneri 2a str. 301
guaaacaacau

SEQ ID NO: 3895600 - RNA, 21 nt, Shigella flexneri 2a str. 301
guaaacagauaggcaucagca

SEQ ID NO: 3895601 - RNA, 18 nt, Shigella flexneri 2a str. 301
guaaaccacccaccagcg

SEQ ID NO: 3895602 - RNA, 21 nt, Shigella flexneri 2a str. 301
guaaaccacgccaguguuucg

SEQ ID NO: 3895603 - RNA, 19 nt, Shigella flexneri 2a str. 301
guaaacccuaacaucaucc

SEQ ID NO: 3895604 - RNA, 16 nt, Shigella flexneri 2a str. 301
guaaaccgcucgucac

SEQ ID NO: 3895605 - RNA, 19 nt, Shigella flexneri 2a str. 301
guaaaccgcucgucacauc

SEQ ID NO: 3895606 - RNA, 17 nt, Shigella flexneri 2a str. 301
guaaaccguuaucaccu

SEQ ID NO: 3895607 - RNA, 15 nt, Shigella flexneri 2a str. 301
guaaacgcagcauca

SEQ ID NO: 3895608 - RNA, 20 nt, Shigella flexneri 2a str. 301
guaaacgccuuauccagccu

SEQ ID NO: 3895609 - RNA, 19 nt, Shigella flexneri 2a str. 301
guaaacgccuuauccgacu

SEQ ID NO: 3895610 - RNA, 14 nt, Shigella flexneri 2a str. 301
guaaacucaaaguc

SEQ ID NO: 3895611 - RNA, 23 nt, Shigella flexneri 2a str. 301
guaaacugcgucgacauagccau

SEQ ID NO: 3895612 - RNA, 12 nt, Shigella flexneri 2a str. 301
guaaagcaauga

SEQ ID NO: 3895613 - RNA, 20 nt, Shigella flexneri 2a str. 301
guaaagcccauaccacagca

SEQ ID NO: 3895614 - RNA, 21 nt, Shigella flexneri 2a str. 301
guaaagcccgccaucgcccau

SEQ ID NO: 3895615 - RNA, 13 nt, Shigella flexneri 2a str. 301
guaaagccgauua

SEQ ID NO: 3895616 - RNA, 19 nt, Shigella flexneri 2a str. 301
guaaagcgcgucaccaccu

SEQ ID NO: 3895617 - RNA, 22 nt, Shigella flexneri 2a str. 301
guaaagcugcgcaggaugcuaa

SEQ ID NO: 3895618 - RNA, 14 nt, Shigella flexneri 2a str. 301
guaaaggcggcaga

SEQ ID NO: 3895619 - RNA, 18 nt, Shigella flexneri 2a str. 301
guaaaggcggcagaacag

SEQ ID NO: 3895620 - RNA, 22 nt, Shigella flexneri 2a str. 301
guaaaggcggcagaacagaaca

SEQ ID NO: 3895621 - RNA, 22 nt, Shigella flexneri 2a str. 301
guaaaguacaauaucccugugu

SEQ ID NO: 3895622 - RNA, 19 nt, Shigella flexneri 2a str. 301
guaaaguacguguggucuu

SEQ ID NO: 3895623 - RNA, 22 nt, Shigella flexneri 2a str. 301
guaaagugcgagucgucaguuc

SEQ ID NO: 3895624 - RNA, 23 nt, Shigella flexneri 2a str. 301
guaaaguuaccuucgaagaacuc

SEQ ID NO: 3895625 - RNA, 17 nt, Shigella flexneri 2a str. 301
guaaauaaaccaccugg

SEQ ID NO: 3895626 - RNA, 18 nt, Shigella flexneri 2a str. 301
guaaauaaaccaccuggg

SEQ ID NO: 3895627 - RNA, 15 nt, Shigella flexneri 2a str. 301
guaaauaucggcauu

SEQ ID NO: 3895628 - RNA, 23 nt, Shigella flexneri 2a str. 301
guaaauauggcgaacuggucugc

SEQ ID NO: 3895629 - RNA, 20 nt, Shigella flexneri 2a str. 301
guaauuggccugacagguga

SEQ ID NO: 3895630 - RNA, 19 nt, Shigella flexneri 2a str. 301
guaauuuaacaacucacca

SEQ ID NO: 3895631 - RNA, 11 nt, Shigella flexneri 2a str. 301
guaauuucaau

SEQ ID NO: 3895632 - RNA, 14 nt, Shigella flexneri 2a str. 301
guaauuucacaagu

SEQ ID NO: 3895633 - RNA, 15 nt, Shigella flexneri 2a str. 301
guaauuucacaaguu

SEQ ID NO: 3895634 - RNA, 16 nt, Shigella flexneri 2a str. 301
guaauuugaucgaugg

SEQ ID NO: 3895635 - RNA, 23 nt, Shigella flexneri 2a str. 301
guaauuugccguuaaucccagac

SEQ ID NO: 3895636 - RNA, 12 nt, Shigella flexneri 2a str. 301
guaauuuuuaua

SEQ ID NO: 3895637 - RNA, 21 nt, Shigella flexneri 2a str. 301
guacaaaauuagaaagggaag

SEQ ID NO: 3895638 - RNA, 13 nt, Shigella flexneri 2a str. 301
guacaaacaucau

SEQ ID NO: 3895639 - RNA, 17 nt, Shigella flexneri 2a str. 301
guacaaagccaacagca

SEQ ID NO: 3895640 - RNA, 20 nt, Shigella flexneri 2a str. 301
guacaaagccaacagcagcc

SEQ ID NO: 3895641 - RNA, 12 nt, Shigella flexneri 2a str. 301
guacaaccgcaa

SEQ ID NO: 3895642 - RNA, 18 nt, Shigella flexneri 2a str. 301
guacaaccgcaaagguug

SEQ ID NO: 3895643 - RNA, 14 nt, Shigella flexneri 2a str. 301
guacaacgccguuu

SEQ ID NO: 3895644 - RNA, 13 nt, Shigella flexneri 2a str. 301
guacaacuuucuc

SEQ ID NO: 3895645 - RNA, 19 nt, Shigella flexneri 2a str. 301
guacaaucguuucaugcca

SEQ ID NO: 3895646 - RNA, 15 nt, Shigella flexneri 2a str. 301
guacaccaacaucac

SEQ ID NO: 3895647 - RNA, 14 nt, Shigella flexneri 2a str. 301
guacacuuuccugg

SEQ ID NO: 3895648 - RNA, 12 nt, Shigella flexneri 2a str. 301
guacagaaucug

SEQ ID NO: 3895649 - RNA, 19 nt, Shigella flexneri 2a str. 301
guacagacagauaaaaugc

SEQ ID NO: 3895650 - RNA, 18 nt, Shigella flexneri 2a str. 301
guacagagggcaggcaac

SEQ ID NO: 3895651 - RNA, 23 nt, Shigella flexneri 2a str. 301
guacagagguaagauguucuauc

SEQ ID NO: 3895652 - RNA, 16 nt, Shigella flexneri 2a str. 301
guacagaugccaauca

SEQ ID NO: 3895653 - RNA, 14 nt, Shigella flexneri 2a str. 301
guacagccgccaga

SEQ ID NO: 3895654 - RNA, 15 nt, Shigella flexneri 2a str. 301
guacagccgccagac

SEQ ID NO: 3895655 - RNA, 18 nt, Shigella flexneri 2a str. 301
guacaggauauauuucau

SEQ ID NO: 3895656 - RNA, 12 nt, Shigella flexneri 2a str. 301
guacaggcagcu

SEQ ID NO: 3895657 - RNA, 16 nt, Shigella flexneri 2a str. 301
guacaggcagcuuaga

SEQ ID NO: 3895658 - RNA, 20 nt, Shigella flexneri 2a str. 301
guacauagccaucugccuga

SEQ ID NO: 3895659 - RNA, 19 nt, Shigella flexneri 2a str. 301
guacaucaauaccauuauc

SEQ ID NO: 3895660 - RNA, 17 nt, Shigella flexneri 2a str. 301
guacaugaagcacugca

SEQ ID NO: 3895661 - RNA, 16 nt, Shigella flexneri 2a str. 301
guacauggugcacauu

SEQ ID NO: 3895662 - RNA, 18 nt, Shigella flexneri 2a str. 301
guacauuguuuuccagac

SEQ ID NO: 3895663 - RNA, 18 nt, Shigella flexneri 2a str. 301
guaccaaccgcaauugcu

SEQ ID NO: 3895664 - RNA, 19 nt, Shigella flexneri 2a str. 301
guaccaccagaaucgccag

SEQ ID NO: 3895665 - RNA, 20 nt, Shigella flexneri 2a str. 301
guaccaccagaaucgccagc

SEQ ID NO: 3895666 - RNA, 18 nt, Shigella flexneri 2a str. 301
guaccaccggacgcacac

SEQ ID NO: 3895667 - RNA, 20 nt, Shigella flexneri 2a str. 301
guaccacgcaaagcacgcca

SEQ ID NO: 3895668 - RNA, 21 nt, Shigella flexneri 2a str. 301
guaccacgcacagcccgccgc

SEQ ID NO: 3895669 - RNA, 20 nt, Shigella flexneri 2a str. 301
guaccacgguacgccagagu

SEQ ID NO: 3895670 - RNA, 20 nt, Shigella flexneri 2a str. 301
guaccagaccaacauaguua

SEQ ID NO: 3895671 - RNA, 17 nt, Shigella flexneri 2a str. 301
guaccagacgcgggcaa

SEQ ID NO: 3895672 - RNA, 13 nt, Shigella flexneri 2a str. 301
guaccagcaccgu

SEQ ID NO: 3895673 - RNA, 11 nt, Shigella flexneri 2a str. 301
guaccagcgca

SEQ ID NO: 3895674 - RNA, 12 nt, Shigella flexneri 2a str. 301
guaccagcgcac

SEQ ID NO: 3895675 - RNA, 14 nt, Shigella flexneri 2a str. 301
guaccaucgccagc

SEQ ID NO: 3895676 - RNA, 19 nt, Shigella flexneri 2a str. 301
guaccaucguccagcagca

SEQ ID NO: 3895677 - RNA, 13 nt, Shigella flexneri 2a str. 301
guaccaucuucac

SEQ ID NO: 3895678 - RNA, 17 nt, Shigella flexneri 2a str. 301
guaccaugauccugcaa

SEQ ID NO: 3895679 - RNA, 17 nt, Shigella flexneri 2a str. 301
guaccaugcgcaucauc

SEQ ID NO: 3895680 - RNA, 23 nt, Shigella flexneri 2a str. 301
guaccauuaaucgauaaaccagc

SEQ ID NO: 3895681 - RNA, 14 nt, Shigella flexneri 2a str. 301
guaccccugauaau

SEQ ID NO: 3895682 - RNA, 15 nt, Shigella flexneri 2a str. 301
guacccgcugcugac

SEQ ID NO: 3895683 - RNA, 16 nt, Shigella flexneri 2a str. 301
guacccggaucgcggu

SEQ ID NO: 3895684 - RNA, 18 nt, Shigella flexneri 2a str. 301
guacccguucgaugcggu

SEQ ID NO: 3895685 - RNA, 12 nt, Shigella flexneri 2a str. 301
guaccgcagcaa

SEQ ID NO: 3895686 - RNA, 20 nt, Shigella flexneri 2a str. 301
guaccgccgccauaaacagc

SEQ ID NO: 3895687 - RNA, 21 nt, Shigella flexneri 2a str. 301
guaccgccgcgaaccugugaa

SEQ ID NO: 3895688 - RNA, 18 nt, Shigella flexneri 2a str. 301
guaccggacccuggucag

SEQ ID NO: 3895689 - RNA, 16 nt, Shigella flexneri 2a str. 301
guaccgguaaaccugg

SEQ ID NO: 3895690 - RNA, 14 nt, Shigella flexneri 2a str. 301
guaccguugcugcc

SEQ ID NO: 3895691 - RNA, 17 nt, Shigella flexneri 2a str. 301
guaccucuucgcuggca

SEQ ID NO: 3895692 - RNA, 17 nt, Shigella flexneri 2a str. 301
guaccuucagcggcagc

SEQ ID NO: 3895693 - RNA, 13 nt, Shigella flexneri 2a str. 301
guacgacaagucu

SEQ ID NO: 3895694 - RNA, 16 nt, Shigella flexneri 2a str. 301
guacgcccacgccagc

SEQ ID NO: 3895695 - RNA, 14 nt, Shigella flexneri 2a str. 301
guacgcccagcgcu

SEQ ID NO: 3895696 - RNA, 19 nt, Shigella flexneri 2a str. 301
guacgccuucaugugcggg

SEQ ID NO: 3895697 - RNA, 16 nt, Shigella flexneri 2a str. 301
guacgcgccccacugg

SEQ ID NO: 3895698 - RNA, 17 nt, Shigella flexneri 2a str. 301
guacgcgccccacugga

SEQ ID NO: 3895699 - RNA, 11 nt, Shigella flexneri 2a str. 301
guacgcuuuca

SEQ ID NO: 3895700 - RNA, 14 nt, Shigella flexneri 2a str. 301
guacgggucgggcu

SEQ ID NO: 3895701 - RNA, 19 nt, Shigella flexneri 2a str. 301
guacgguacugaaaccuga

SEQ ID NO: 3895702 - RNA, 19 nt, Shigella flexneri 2a str. 301
guacgucauccguggcgac

SEQ ID NO: 3895703 - RNA, 15 nt, Shigella flexneri 2a str. 301
guacguggaggaugg

SEQ ID NO: 3895704 - RNA, 19 nt, Shigella flexneri 2a str. 301
guacguguuguuccaguaa

SEQ ID NO: 3895705 - RNA, 20 nt, Shigella flexneri 2a str. 301
guacucaccagacaucccag

SEQ ID NO: 3895706 - RNA, 13 nt, Shigella flexneri 2a str. 301
guacuccagcaga

SEQ ID NO: 3895707 - RNA, 18 nt, Shigella flexneri 2a str. 301
guacuccaucucgccauc

SEQ ID NO: 3895708 - RNA, 21 nt, Shigella flexneri 2a str. 301
guacucccgaggaucacaaug

SEQ ID NO: 3895709 - RNA, 22 nt, Shigella flexneri 2a str. 301
guacucggcuacgaaccgagcg

SEQ ID NO: 3895710 - RNA, 15 nt, Shigella flexneri 2a str. 301
guacucuuccggugu

SEQ ID NO: 3895711 - RNA, 21 nt, Shigella flexneri 2a str. 301
guacugacggcguucuuuaca

SEQ ID NO: 3895712 - RNA, 12 nt, Shigella flexneri 2a str. 301
guacugaugaau

SEQ ID NO: 3895713 - RNA, 13 nt, Shigella flexneri 2a str. 301
guacugcauaaag

SEQ ID NO: 3895714 - RNA, 22 nt, Shigella flexneri 2a str. 301
guacugcauaaaggaagccccu

SEQ ID NO: 3895715 - RNA, 17 nt, Shigella flexneri 2a str. 301
guacuggcaaucgccag

SEQ ID NO: 3895716 - RNA, 18 nt, Shigella flexneri 2a str. 301
guacuggcaaucgccagc

SEQ ID NO: 3895717 - RNA, 14 nt, Shigella flexneri 2a str. 301
guacuggcagggau

SEQ ID NO: 3895718 - RNA, 14 nt, Shigella flexneri 2a str. 301
guacuggccuccac

SEQ ID NO: 3895719 - RNA, 23 nt, Shigella flexneri 2a str. 301
guacuguuucacuguugaagccg

SEQ ID NO: 3895720 - RNA, 17 nt, Shigella flexneri 2a str. 301
guacuucacaaucagcg

SEQ ID NO: 3895721 - RNA, 19 nt, Shigella flexneri 2a str. 301
guacuuuuacugucugcuc

SEQ ID NO: 3895722 - RNA, 13 nt, Shigella flexneri 2a str. 301
guacuuuugaaug

SEQ ID NO: 3895723 - RNA, 23 nt, Shigella flexneri 2a str. 301
guacuuuuuccuuaaacaccugg

SEQ ID NO: 3895724 - RNA, 14 nt, Shigella flexneri 2a str. 301
guagaaaaucucaa

SEQ ID NO: 3895725 - RNA, 15 nt, Shigella flexneri 2a str. 301
guagaaaaucucaau

SEQ ID NO: 3895726 - RNA, 22 nt, Shigella flexneri 2a str. 301
guagaagcugacgacgaagaaa

SEQ ID NO: 3895727 - RNA, 20 nt, Shigella flexneri 2a str. 301
guagacgagccguuccuaac

SEQ ID NO: 3895728 - RNA, 15 nt, Shigella flexneri 2a str. 301
guagacucaagcagu

SEQ ID NO: 3895729 - RNA, 18 nt, Shigella flexneri 2a str. 301
guagacugcagcggucac

SEQ ID NO: 3895730 - RNA, 14 nt, Shigella flexneri 2a str. 301
guauucaaccguuu

SEQ ID NO: 3895731 - RNA, 22 nt, Shigella flexneri 2a str. 301
guauucacuuucaaauccggcc

SEQ ID NO: 3895732 - RNA, 15 nt, Shigella flexneri 2a str. 301
guauucagcaauucu

SEQ ID NO: 3895733 - RNA, 15 nt, Shigella flexneri 2a str. 301
guauucuucagcgac

SEQ ID NO: 3895734 - RNA, 17 nt, Shigella flexneri 2a str. 301
guauugccaugcacgca

SEQ ID NO: 3895735 - RNA, 21 nt, Shigella flexneri 2a str. 301
guauugccguuucgcagguuc

SEQ ID NO: 3895736 - RNA, 17 nt, Shigella flexneri 2a str. 301
guauugcgcaaauguuu

SEQ ID NO: 3895737 - RNA, 21 nt, Shigella flexneri 2a str. 301
guauugcucaacuucgcuaaa

SEQ ID NO: 3895738 - RNA, 19 nt, Shigella flexneri 2a str. 301
guauugcugguauaaaaua

SEQ ID NO: 3895739 - RNA, 20 nt, Shigella flexneri 2a str. 301
guauuguccugcaagguggu

SEQ ID NO: 3895740 - RNA, 20 nt, Shigella flexneri 2a str. 301
guauuuauuuuccaaaauaa

SEQ ID NO: 3895741 - RNA, 13 nt, Shigella flexneri 2a str. 301
guauuuuggcuua

SEQ ID NO: 3895742 - RNA, 13 nt, Shigella flexneri 2a str. 301
guauuuuuugcuc

SEQ ID NO: 3895743 - RNA, 12 nt, Shigella flexneri 2a str. 301
gucaaaaaaacg

SEQ ID NO: 3895744 - RNA, 17 nt, Shigella flexneri 2a str. 301
gucaaaaucauccgucg

SEQ ID NO: 3895745 - RNA, 14 nt, Shigella flexneri 2a str. 301
gucaaauaauuccu

SEQ ID NO: 3895746 - RNA, 23 nt, Shigella flexneri 2a str. 301
gucaaaugaccgggcuuuccgcu

SEQ ID NO: 3895747 - RNA, 18 nt, Shigella flexneri 2a str. 301
gucaaaugcgacaacugg

SEQ ID NO: 3895748 - RNA, 12 nt, Shigella flexneri 2a str. 301
gucaacagggca

SEQ ID NO: 3895749 - RNA, 17 nt, Shigella flexneri 2a str. 301
gucaacaguucaugguu

SEQ ID NO: 3895750 - RNA, 15 nt, Shigella flexneri 2a str. 301
gucaaccugaccaaa

SEQ ID NO: 3895751 - RNA, 16 nt, Shigella flexneri 2a str. 301
gucaacguuaacuuuc

SEQ ID NO: 3895752 - RNA, 13 nt, Shigella flexneri 2a str. 301
gucaacuccaguu

SEQ ID NO: 3895753 - RNA, 21 nt, Shigella flexneri 2a str. 301
gucaacugcgccacucgauac

SEQ ID NO: 3895754 - RNA, 20 nt, Shigella flexneri 2a str. 301
gucaacuguacgccgacgcc

SEQ ID NO: 3895755 - RNA, 19 nt, Shigella flexneri 2a str. 301
gucaagggugucggcacac

SEQ ID NO: 3895756 - RNA, 14 nt, Shigella flexneri 2a str. 301
gucaauaaacgccu

SEQ ID NO: 3895757 - RNA, 22 nt, Shigella flexneri 2a str. 301
gucaauacuuucacaaaaauaa

SEQ ID NO: 3895758 - RNA, 19 nt, Shigella flexneri 2a str. 301
gucaauauuaucgauuuuc

SEQ ID NO: 3895759 - RNA, 21 nt, Shigella flexneri 2a str. 301
gucaauauucuggguagucca

SEQ ID NO: 3895760 - RNA, 16 nt, Shigella flexneri 2a str. 301
gucacaccuuauuuac

SEQ ID NO: 3895761 - RNA, 15 nt, Shigella flexneri 2a str. 301
gucacaucaggccau

SEQ ID NO: 3895762 - RNA, 16 nt, Shigella flexneri 2a str. 301
gucacaucaggccauc

SEQ ID NO: 3895763 - RNA, 12 nt, Shigella flexneri 2a str. 301
gucacaucuucc

SEQ ID NO: 3895764 - RNA, 17 nt, Shigella flexneri 2a str. 301
gucacaugcagcgccug

SEQ ID NO: 3895765 - RNA, 16 nt, Shigella flexneri 2a str. 301
gucacauguuccaggg

SEQ ID NO: 3895766 - RNA, 15 nt, Shigella flexneri 2a str. 301
gucaccacuucaccc

SEQ ID NO: 3895767 - RNA, 17 nt, Shigella flexneri 2a str. 301
gucaccagcaucaacaa

SEQ ID NO: 3895768 - RNA, 15 nt, Shigella flexneri 2a str. 301
gucacccaacaugcc

SEQ ID NO: 3895769 - RNA, 12 nt, Shigella flexneri 2a str. 301
gucacccagaca

SEQ ID NO: 3895770 - RNA, 15 nt, Shigella flexneri 2a str. 301
gucaccgccagguga

SEQ ID NO: 3895771 - RNA, 16 nt, Shigella flexneri 2a str. 301
gucaccggaauaauga

SEQ ID NO: 3895772 - RNA, 18 nt, Shigella flexneri 2a str. 301
gucaccggaauaaugaug

SEQ ID NO: 3895773 - RNA, 13 nt, Shigella flexneri 2a str. 301
gucaccggucaga

SEQ ID NO: 3895774 - RNA, 13 nt, Shigella flexneri 2a str. 301
gucaccugcccuc

SEQ ID NO: 3895775 - RNA, 19 nt, Shigella flexneri 2a str. 301
gucacgaucgcgccagccu

SEQ ID NO: 3895776 - RNA, 16 nt, Shigella flexneri 2a str. 301
gucacgccgaccagac

SEQ ID NO: 3895777 - RNA, 19 nt, Shigella flexneri 2a str. 301
gucacgccgaccagaccgg

SEQ ID NO: 3895778 - RNA, 19 nt, Shigella flexneri 2a str. 301
gucacggugcagcucgcaa

SEQ ID NO: 3895779 - RNA, 19 nt, Shigella flexneri 2a str. 301
gucacguucuccccgaggc

SEQ ID NO: 3895780 - RNA, 13 nt, Shigella flexneri 2a str. 301
gucacugauagug

SEQ ID NO: 3895781 - RNA, 16 nt, Shigella flexneri 2a str. 301
gucacugcaucuuccg

SEQ ID NO: 3895782 - RNA, 13 nt, Shigella flexneri 2a str. 301
gucacuggcagga

SEQ ID NO: 3895783 - RNA, 18 nt, Shigella flexneri 2a str. 301
gucacuggcaggauaaac

SEQ ID NO: 3895784 - RNA, 15 nt, Shigella flexneri 2a str. 301
gucacuggcgcagac

SEQ ID NO: 3895785 - RNA, 23 nt, Shigella flexneri 2a str. 301
gucacuggugugucaucugcgac

SEQ ID NO: 3895786 - RNA, 22 nt, Shigella flexneri 2a str. 301
gucacuuuuggugcuuuugcug

SEQ ID NO: 3895787 - RNA, 23 nt, Shigella flexneri 2a str. 301
gucagaaaaaucaauauuuucaa

SEQ ID NO: 3895788 - RNA, 16 nt, Shigella flexneri 2a str. 301
gucagaccaaaacgcg

SEQ ID NO: 3895789 - RNA, 19 nt, Shigella flexneri 2a str. 301
gucagaccaaaacgcgcca

SEQ ID NO: 3895790 - RNA, 20 nt, Shigella flexneri 2a str. 301
gucagaccaccgguuuuauc

SEQ ID NO: 3895791 - RNA, 20 nt, Shigella flexneri 2a str. 301
gucagaccggcaaccagcac

SEQ ID NO: 3895792 - RNA, 18 nt, Shigella flexneri 2a str. 301
gucagacgaagucaacaa

SEQ ID NO: 3895793 - RNA, 13 nt, Shigella flexneri 2a str. 301
gucagagcauuac

SEQ ID NO: 3895794 - RNA, 14 nt, Shigella flexneri 2a str. 301
gucagauuucaauc

SEQ ID NO: 3895795 - RNA, 21 nt, Shigella flexneri 2a str. 301
gucagcaaaauacugaacagg

SEQ ID NO: 3895796 - RNA, 14 nt, Shigella flexneri 2a str. 301
gucagcaacaugcc

SEQ ID NO: 3895797 - RNA, 17 nt, Shigella flexneri 2a str. 301
gucagcacaaacaauuu

SEQ ID NO: 3895798 - RNA, 18 nt, Shigella flexneri 2a str. 301
gucagcaccagagaacug

SEQ ID NO: 3895799 - RNA, 17 nt, Shigella flexneri 2a str. 301
gucagccacuucuucca

SEQ ID NO: 3895800 - RNA, 15 nt, Shigella flexneri 2a str. 301
gucagccagaaagaa

SEQ ID NO: 3895801 - RNA, 13 nt, Shigella flexneri 2a str. 301
gucagccagcggc

SEQ ID NO: 3895802 - RNA, 13 nt, Shigella flexneri 2a str. 301
gucagccgcccgc

SEQ ID NO: 3895803 - RNA, 16 nt, Shigella flexneri 2a str. 301
gucagcgaucagcauu

SEQ ID NO: 3895804 - RNA, 16 nt, Shigella flexneri 2a str. 301
gucagcgccuggcugc

SEQ ID NO: 3895805 - RNA, 15 nt, Shigella flexneri 2a str. 301
gucagcguuucaaca

SEQ ID NO: 3895806 - RNA, 17 nt, Shigella flexneri 2a str. 301
gucagcguuucaacaaa

SEQ ID NO: 3895807 - RNA, 14 nt, Shigella flexneri 2a str. 301
gucagcucacaaau

SEQ ID NO: 3895808 - RNA, 18 nt, Shigella flexneri 2a str. 301
gucagcucacaaauacgc

SEQ ID NO: 3895809 - RNA, 17 nt, Shigella flexneri 2a str. 301
gucagcuucaccuucca

SEQ ID NO: 3895810 - RNA, 13 nt, Shigella flexneri 2a str. 301
gucaggaucgugc

SEQ ID NO: 3895811 - RNA, 15 nt, Shigella flexneri 2a str. 301
gucaggauggccggg

SEQ ID NO: 3895812 - RNA, 16 nt, Shigella flexneri 2a str. 301
gucaggauuauguugc

SEQ ID NO: 3895813 - RNA, 15 nt, Shigella flexneri 2a str. 301
gucaggcaaccgcug

SEQ ID NO: 3895814 - RNA, 21 nt, Shigella flexneri 2a str. 301
gucaggcaaccgcugagcgau

SEQ ID NO: 3895815 - RNA, 20 nt, Shigella flexneri 2a str. 301
gucaggcaagccgcuaacag

SEQ ID NO: 3895816 - RNA, 19 nt, Shigella flexneri 2a str. 301
gucaggccggcauauaccu

SEQ ID NO: 3895817 - RNA, 18 nt, Shigella flexneri 2a str. 301
gucaggcgcgugaaugcc

SEQ ID NO: 3895818 - RNA, 17 nt, Shigella flexneri 2a str. 301
gucaggcuuuaaacgau

SEQ ID NO: 3895819 - RNA, 16 nt, Shigella flexneri 2a str. 301
gucaggggcauuuuca

SEQ ID NO: 3895820 - RNA, 12 nt, Shigella flexneri 2a str. 301
gucagguaacaa

SEQ ID NO: 3895821 - RNA, 23 nt, Shigella flexneri 2a str. 301
gucaggucacccaacaugccgag

SEQ ID NO: 3895822 - RNA, 12 nt, Shigella flexneri 2a str. 301
gucaguaaugac

SEQ ID NO: 3895823 - RNA, 16 nt, Shigella flexneri 2a str. 301
gucaguacgccgccgu

SEQ ID NO: 3895824 - RNA, 23 nt, Shigella flexneri 2a str. 301
gucagugccugcgccaccguuuc

SEQ ID NO: 3895825 - RNA, 19 nt, Shigella flexneri 2a str. 301
gucaguggacgauaagcac

SEQ ID NO: 3895826 - RNA, 15 nt, Shigella flexneri 2a str. 301
gucagugucuuaucu

SEQ ID NO: 3895827 - RNA, 17 nt, Shigella flexneri 2a str. 301
gucagugucuuaucugg

SEQ ID NO: 3895828 - RNA, 22 nt, Shigella flexneri 2a str. 301
gucagugucuuaucuggcauuu

SEQ ID NO: 3895829 - RNA, 13 nt, Shigella flexneri 2a str. 301
gucaguucaccau

SEQ ID NO: 3895830 - RNA, 14 nt, Shigella flexneri 2a str. 301
gucaguuccauaau

SEQ ID NO: 3895831 - RNA, 22 nt, Shigella flexneri 2a str. 301
gucgaugaugcagccagugauu

SEQ ID NO: 3895832 - RNA, 14 nt, Shigella flexneri 2a str. 301
gucgaugugccgga

SEQ ID NO: 3895833 - RNA, 14 nt, Shigella flexneri 2a str. 301
gucgauuucugggu

SEQ ID NO: 3895834 - RNA, 16 nt, Shigella flexneri 2a str. 301
gucgcaaauccgcugu

SEQ ID NO: 3895835 - RNA, 17 nt, Shigella flexneri 2a str. 301
gucgcaagacgaaaaau

SEQ ID NO: 3895836 - RNA, 22 nt, Shigella flexneri 2a str. 301
gucgcaagacgaaaaaugaaua

SEQ ID NO: 3895837 - RNA, 23 nt, Shigella flexneri 2a str. 301
gucgcacacaacagacauuaccc

SEQ ID NO: 3895838 - RNA, 14 nt, Shigella flexneri 2a str. 301
gucgcagccagcgc

SEQ ID NO: 3895839 - RNA, 15 nt, Shigella flexneri 2a str. 301
gucgcagccagcgcg

SEQ ID NO: 3895840 - RNA, 20 nt, Shigella flexneri 2a str. 301
gucgcaggcaguacugcaua

SEQ ID NO: 3895841 - RNA, 16 nt, Shigella flexneri 2a str. 301
gucgcaguagccaugc

SEQ ID NO: 3895842 - RNA, 22 nt, Shigella flexneri 2a str. 301
gucgcagugaagucgggcagaa

SEQ ID NO: 3895843 - RNA, 18 nt, Shigella flexneri 2a str. 301
gucgcaucaggcaucaug

SEQ ID NO: 3895844 - RNA, 23 nt, Shigella flexneri 2a str. 301
gucgcauccggcaugaacaaagc

SEQ ID NO: 3895845 - RNA, 20 nt, Shigella flexneri 2a str. 301
gucgcaucuggcauaaacaa

SEQ ID NO: 3895846 - RNA, 14 nt, Shigella flexneri 2a str. 301
gucgccaacuucau

SEQ ID NO: 3895847 - RNA, 21 nt, Shigella flexneri 2a str. 301
gucgccaaguucgaacgccgc

SEQ ID NO: 3895848 - RNA, 15 nt, Shigella flexneri 2a str. 301
gucgccacaccggug

SEQ ID NO: 3895849 - RNA, 15 nt, Shigella flexneri 2a str. 301
gucgccagacgcagc

SEQ ID NO: 3895850 - RNA, 15 nt, Shigella flexneri 2a str. 301
gucgccagcaacaca

SEQ ID NO: 3895851 - RNA, 12 nt, Shigella flexneri 2a str. 301
gucgccagcgcc

SEQ ID NO: 3895852 - RNA, 16 nt, Shigella flexneri 2a str. 301
gucgccagucccuuuc

SEQ ID NO: 3895853 - RNA, 14 nt, Shigella flexneri 2a str. 301
gucgccaucaaagg

SEQ ID NO: 3895854 - RNA, 13 nt, Shigella flexneri 2a str. 301
gucgccauccaga

SEQ ID NO: 3895855 - RNA, 22 nt, Shigella flexneri 2a str. 301
gucgccccggaacgggagaaac

SEQ ID NO: 3895856 - RNA, 15 nt, Shigella flexneri 2a str. 301
gucgccgccuguucc

SEQ ID NO: 3895857 - RNA, 20 nt, Shigella flexneri 2a str. 301
gucgccgcgauaaggucaga

SEQ ID NO: 3895858 - RNA, 17 nt, Shigella flexneri 2a str. 301
gucgccgcgcaaaucca

SEQ ID NO: 3895859 - RNA, 15 nt, Shigella flexneri 2a str. 301
gucgccgggaugcug

SEQ ID NO: 3895860 - RNA, 14 nt, Shigella flexneri 2a str. 301
gucgccguaccggg

SEQ ID NO: 3895861 - RNA, 13 nt, Shigella flexneri 2a str. 301
gucgcgcagcacu

SEQ ID NO: 3895862 - RNA, 17 nt, Shigella flexneri 2a str. 301
gucgcguuguaggucga

SEQ ID NO: 3895863 - RNA, 18 nt, Shigella flexneri 2a str. 301
gucgcuaggaaggcaaga

SEQ ID NO: 3895864 - RNA, 18 nt, Shigella flexneri 2a str. 301
gucgcuccugccacauau

SEQ ID NO: 3895865 - RNA, 17 nt, Shigella flexneri 2a str. 301
gucgcugaaagcugaac

SEQ ID NO: 3895866 - RNA, 19 nt, Shigella flexneri 2a str. 301
gucgcugaagucucgccag

SEQ ID NO: 3895867 - RNA, 17 nt, Shigella flexneri 2a str. 301
gucgcugacgcacuguu

SEQ ID NO: 3895868 - RNA, 21 nt, Shigella flexneri 2a str. 301
gucgcugguugcaugaugacu

SEQ ID NO: 3895869 - RNA, 13 nt, Shigella flexneri 2a str. 301
gucgcuguauuuu

SEQ ID NO: 3895870 - RNA, 16 nt, Shigella flexneri 2a str. 301
gucgcugucuuccugg

SEQ ID NO: 3895871 - RNA, 21 nt, Shigella flexneri 2a str. 301
gucgcuuaauugaccugccgg

SEQ ID NO: 3895872 - RNA, 20 nt, Shigella flexneri 2a str. 301
gucggaaaauuauuuuaaau

SEQ ID NO: 3895873 - RNA, 16 nt, Shigella flexneri 2a str. 301
gucggaaccacaacuc

SEQ ID NO: 3895874 - RNA, 18 nt, Shigella flexneri 2a str. 301
gucggaccauuauuucca

SEQ ID NO: 3895875 - RNA, 21 nt, Shigella flexneri 2a str. 301
gucggacgcuguuccggcggc

SEQ ID NO: 3895876 - RNA, 15 nt, Shigella flexneri 2a str. 301
gucggauaagacgcc

SEQ ID NO: 3895877 - RNA, 12 nt, Shigella flexneri 2a str. 301
gucggaugcggc

SEQ ID NO: 3895878 - RNA, 19 nt, Shigella flexneri 2a str. 301
gucggcaauguagcgcugc

SEQ ID NO: 3895879 - RNA, 13 nt, Shigella flexneri 2a str. 301
gucggcagauaac

SEQ ID NO: 3895880 - RNA, 15 nt, Shigella flexneri 2a str. 301
gucggcagauaacac

SEQ ID NO: 3895881 - RNA, 16 nt, Shigella flexneri 2a str. 301
gucggcauuaaccagu

SEQ ID NO: 3895882 - RNA, 17 nt, Shigella flexneri 2a str. 301
gucggccuuaaugccca

SEQ ID NO: 3895883 - RNA, 21 nt, Shigella flexneri 2a str. 301
gucggcggauaauaauauccu

SEQ ID NO: 3895884 - RNA, 18 nt, Shigella flexneri 2a str. 301
gucggcgucagcgccauc

SEQ ID NO: 3895885 - RNA, 15 nt, Shigella flexneri 2a str. 301
gucggcuuucagcgc

SEQ ID NO: 3895886 - RNA, 14 nt, Shigella flexneri 2a str. 301
gucggcuuucucau

SEQ ID NO: 3895887 - RNA, 21 nt, Shigella flexneri 2a str. 301
gucgggcaucacuauacuccu

SEQ ID NO: 3895888 - RNA, 14 nt, Shigella flexneri 2a str. 301
gucgggcaucagaa

SEQ ID NO: 3895889 - RNA, 24 nt, Shigella flexneri 2a str. 301
gucgggcuuuuggagaucacgcca

SEQ ID NO: 3895890 - RNA, 21 nt, Shigella flexneri 2a str. 301
gucgggugcgacaggagccgc

SEQ ID NO: 3895891 - RNA, 18 nt, Shigella flexneri 2a str. 301
gucggugcucaucagccc

SEQ ID NO: 3895892 - RNA, 15 nt, Shigella flexneri 2a str. 301
gucgguuuauggaaa

SEQ ID NO: 3895893 - RNA, 19 nt, Shigella flexneri 2a str. 301
gucgguuuguacucuuccg

SEQ ID NO: 3895894 - RNA, 15 nt, Shigella flexneri 2a str. 301
gucguaaacaacugg

SEQ ID NO: 3895895 - RNA, 19 nt, Shigella flexneri 2a str. 301
gucguaaacaacuggcgcu

SEQ ID NO: 3895896 - RNA, 14 nt, Shigella flexneri 2a str. 301
gucguaagccaccg

SEQ ID NO: 3895897 - RNA, 15 nt, Shigella flexneri 2a str. 301
gucguacccggcgac

SEQ ID NO: 3895898 - RNA, 14 nt, Shigella flexneri 2a str. 301
gucguaucaccacg

SEQ ID NO: 3895899 - RNA, 21 nt, Shigella flexneri 2a str. 301
gucguauucucaauaaaagga

SEQ ID NO: 3895900 - RNA, 18 nt, Shigella flexneri 2a str. 301
gucguauuucagccccag

SEQ ID NO: 3895901 - RNA, 20 nt, Shigella flexneri 2a str. 301
gucgucagcaguucacgcag

SEQ ID NO: 3895902 - RNA, 16 nt, Shigella flexneri 2a str. 301
gucgucaguuccauaa

SEQ ID NO: 3895903 - RNA, 15 nt, Shigella flexneri 2a str. 301
gucguccggcagcag

SEQ ID NO: 3895904 - RNA, 16 nt, Shigella flexneri 2a str. 301
gucgugaagcagagca

SEQ ID NO: 3895905 - RNA, 12 nt, Shigella flexneri 2a str. 301
gucguggcaaaa

SEQ ID NO: 3895906 - RNA, 14 nt, Shigella flexneri 2a str. 301
gucguucaggcgcu

SEQ ID NO: 3895907 - RNA, 15 nt, Shigella flexneri 2a str. 301
gucguucaggcgcug

SEQ ID NO: 3895908 - RNA, 22 nt, Shigella flexneri 2a str. 301
gucguugcaaucagcggugccg

SEQ ID NO: 3895909 - RNA, 20 nt, Shigella flexneri 2a str. 301
gucguugcuaacaauggagc

SEQ ID NO: 3895910 - RNA, 17 nt, Shigella flexneri 2a str. 301
gucguuguacaaaccau

SEQ ID NO: 3895911 - RNA, 14 nt, Shigella flexneri 2a str. 301
gucguuuagacguu

SEQ ID NO: 3895912 - RNA, 15 nt, Shigella flexneri 2a str. 301
gucuaaauuuugcau

SEQ ID NO: 3895913 - RNA, 23 nt, Shigella flexneri 2a str. 301
gucuaacaugagguccagcgagc

SEQ ID NO: 3895914 - RNA, 15 nt, Shigella flexneri 2a str. 301
gucuacaaaaacugc

SEQ ID NO: 3895915 - RNA, 16 nt, Shigella flexneri 2a str. 301
gucuacaaaaacugcc

SEQ ID NO: 3895916 - RNA, 19 nt, Shigella flexneri 2a str. 301
gucuacgccuuguuucuuc

SEQ ID NO: 3895917 - RNA, 16 nt, Shigella flexneri 2a str. 301
gucuaguaaagcagac

SEQ ID NO: 3895918 - RNA, 12 nt, Shigella flexneri 2a str. 301
gucucaaaccgg

SEQ ID NO: 3895919 - RNA, 13 nt, Shigella flexneri 2a str. 301
gucucacuaucgc

SEQ ID NO: 3895920 - RNA, 19 nt, Shigella flexneri 2a str. 301
gucucagcaccgucuggca

SEQ ID NO: 3895921 - RNA, 15 nt, Shigella flexneri 2a str. 301
gucucagcuucagau

SEQ ID NO: 3895922 - RNA, 12 nt, Shigella flexneri 2a str. 301
gucucaucuuua

SEQ ID NO: 3895923 - RNA, 18 nt, Shigella flexneri 2a str. 301
gucuccaccuuaucgaca

SEQ ID NO: 3895924 - RNA, 18 nt, Shigella flexneri 2a str. 301
gucucccgaugccagcac

SEQ ID NO: 3895925 - RNA, 18 nt, Shigella flexneri 2a str. 301
gucuccgcugagacgcgc

SEQ ID NO: 3895926 - RNA, 19 nt, Shigella flexneri 2a str. 301
gucucgauacgcccuggau

SEQ ID NO: 3895927 - RNA, 22 nt, Shigella flexneri 2a str. 301
gucucgauguagauauacugca

SEQ ID NO: 3895928 - RNA, 23 nt, Shigella flexneri 2a str. 301
gucucucuccguuaucacagcag

SEQ ID NO: 3895929 - RNA, 21 nt, Shigella flexneri 2a str. 301
gucucugccggguucgcacua

SEQ ID NO: 3895930 - RNA, 21 nt, Shigella flexneri 2a str. 301
gucugaauaucaucccccugc

SEQ ID NO: 3895931 - RNA, 15 nt, Shigella flexneri 2a str. 301
gugagcagggcacuu

SEQ ID NO: 3895932 - RNA, 21 nt, Shigella flexneri 2a str. 301
gugagccgaaauauggcucug

SEQ ID NO: 3895933 - RNA, 18 nt, Shigella flexneri 2a str. 301
gugagcgggcgaaccagg

SEQ ID NO: 3895934 - RNA, 16 nt, Shigella flexneri 2a str. 301
gugagcgguguugccg

SEQ ID NO: 3895935 - RNA, 22 nt, Shigella flexneri 2a str. 301
gugagcgguguugccgaagcag

SEQ ID NO: 3895936 - RNA, 14 nt, Shigella flexneri 2a str. 301
gugaggaucaccag

SEQ ID NO: 3895937 - RNA, 21 nt, Shigella flexneri 2a str. 301
gugagggcaaacaggcgcugg

SEQ ID NO: 3895938 - RNA, 22 nt, Shigella flexneri 2a str. 301
gugaggggaacccguuggcaca

SEQ ID NO: 3895939 - RNA, 12 nt, Shigella flexneri 2a str. 301
gugagguaacaa

SEQ ID NO: 3895940 - RNA, 21 nt, Shigella flexneri 2a str. 301
gugauaaaacgcagucuuccc

SEQ ID NO: 3895941 - RNA, 14 nt, Shigella flexneri 2a str. 301
gugauacagcaaaa

SEQ ID NO: 3895942 - RNA, 17 nt, Shigella flexneri 2a str. 301
gugauauccaccgcguu

SEQ ID NO: 3895943 - RNA, 11 nt, Shigella flexneri 2a str. 301
gugauccauca

SEQ ID NO: 3895944 - RNA, 19 nt, Shigella flexneri 2a str. 301
gugaucccaauauagacaa

SEQ ID NO: 3895945 - RNA, 18 nt, Shigella flexneri 2a str. 301
gugauccgccgcgcggug

SEQ ID NO: 3895946 - RNA, 21 nt, Shigella flexneri 2a str. 301
gugauccgccgcugucgcagc

SEQ ID NO: 3895947 - RNA, 17 nt, Shigella flexneri 2a str. 301
gugaucguggccaugac

SEQ ID NO: 3895948 - RNA, 21 nt, Shigella flexneri 2a str. 301
gugauguagucaucugcaccg

SEQ ID NO: 3895949 - RNA, 14 nt, Shigella flexneri 2a str. 301
gugauuaucggcau

SEQ ID NO: 3895950 - RNA, 21 nt, Shigella flexneri 2a str. 301
gugauuccgccaguugcggcu

SEQ ID NO: 3895951 - RNA, 22 nt, Shigella flexneri 2a str. 301
gugauugccgcaacgguugcgg

SEQ ID NO: 3895952 - RNA, 15 nt, Shigella flexneri 2a str. 301
gugauugccgcagaa

SEQ ID NO: 3895953 - RNA, 15 nt, Shigella flexneri 2a str. 301
gugauugccggaaug

SEQ ID NO: 3895954 - RNA, 17 nt, Shigella flexneri 2a str. 301
gugauugguuucaaaga

SEQ ID NO: 3895955 - RNA, 21 nt, Shigella flexneri 2a str. 301
gugauuucaggcuuuuuucca

SEQ ID NO: 3895956 - RNA, 14 nt, Shigella flexneri 2a str. 301
gugauuucuucauu

SEQ ID NO: 3895957 - RNA, 13 nt, Shigella flexneri 2a str. 301
gugauuuuuaaua

SEQ ID NO: 3895958 - RNA, 17 nt, Shigella flexneri 2a str. 301
gugcaaaaccugguugg

SEQ ID NO: 3895959 - RNA, 15 nt, Shigella flexneri 2a str. 301
gugcaaaugccagau

SEQ ID NO: 3895960 - RNA, 21 nt, Shigella flexneri 2a str. 301
gugcaaauugcaccauccauu

SEQ ID NO: 3895961 - RNA, 16 nt, Shigella flexneri 2a str. 301
gugcaaccuuuuccau

SEQ ID NO: 3895962 - RNA, 16 nt, Shigella flexneri 2a str. 301
gugcaauaccauggcu

SEQ ID NO: 3895963 - RNA, 16 nt, Shigella flexneri 2a str. 301
gugcaaucaaacucaa

SEQ ID NO: 3895964 - RNA, 14 nt, Shigella flexneri 2a str. 301
gugcacccgcuuca

SEQ ID NO: 3895965 - RNA, 16 nt, Shigella flexneri 2a str. 301
gugcacccgcuucagu

SEQ ID NO: 3895966 - RNA, 22 nt, Shigella flexneri 2a str. 301
gugcaccggguaccagaaucac

SEQ ID NO: 3895967 - RNA, 19 nt, Shigella flexneri 2a str. 301
gugcacgaaccagagacag

SEQ ID NO: 3895968 - RNA, 15 nt, Shigella flexneri 2a str. 301
gugcacgugccagau

SEQ ID NO: 3895969 - RNA, 21 nt, Shigella flexneri 2a str. 301
gugcagacaugacgcccggca

SEQ ID NO: 3895970 - RNA, 17 nt, Shigella flexneri 2a str. 301
gugcaggcaccagcccc

SEQ ID NO: 3895971 - RNA, 19 nt, Shigella flexneri 2a str. 301
gugcaguggcuccagcgca

SEQ ID NO: 3895972 - RNA, 21 nt, Shigella flexneri 2a str. 301
gugcauaaauaccggcauguu

SEQ ID NO: 3895973 - RNA, 15 nt, Shigella flexneri 2a str. 301
gugcaucauggaagc

SEQ ID NO: 3895974 - RNA, 20 nt, Shigella flexneri 2a str. 301
gugcaucauggaagcaaugu

SEQ ID NO: 3895975 - RNA, 15 nt, Shigella flexneri 2a str. 301
gugcauccagcagcc

SEQ ID NO: 3895976 - RNA, 15 nt, Shigella flexneri 2a str. 301
gugcaucggugcgcu

SEQ ID NO: 3895977 - RNA, 18 nt, Shigella flexneri 2a str. 301
gugcauuucucacuuuuc

SEQ ID NO: 3895978 - RNA, 13 nt, Shigella flexneri 2a str. 301
gugccaaaaaaau

SEQ ID NO: 3895979 - RNA, 16 nt, Shigella flexneri 2a str. 301
gugccaaaaaucgcaa

SEQ ID NO: 3895980 - RNA, 15 nt, Shigella flexneri 2a str. 301
gugccaagcuccagc

SEQ ID NO: 3895981 - RNA, 17 nt, Shigella flexneri 2a str. 301
gugccacaccagcuuuc

SEQ ID NO: 3895982 - RNA, 14 nt, Shigella flexneri 2a str. 301
gugccacauccagu

SEQ ID NO: 3895983 - RNA, 22 nt, Shigella flexneri 2a str. 301
gugccacauccaguggcagagu

SEQ ID NO: 3895984 - RNA, 17 nt, Shigella flexneri 2a str. 301
gugccagaccaaacagc

SEQ ID NO: 3895985 - RNA, 14 nt, Shigella flexneri 2a str. 301
gugccagauagcca

SEQ ID NO: 3895986 - RNA, 20 nt, Shigella flexneri 2a str. 301
gugccagcgauuuugccagc

SEQ ID NO: 3895987 - RNA, 16 nt, Shigella flexneri 2a str. 301
gugccaggaccauuca

SEQ ID NO: 3895988 - RNA, 18 nt, Shigella flexneri 2a str. 301
gugccagguaaacaccuu

SEQ ID NO: 3895989 - RNA, 13 nt, Shigella flexneri 2a str. 301
gugccaucgauaa

SEQ ID NO: 3895990 - RNA, 22 nt, Shigella flexneri 2a str. 301
gugcccccguuuuaccccugca

SEQ ID NO: 3895991 - RNA, 14 nt, Shigella flexneri 2a str. 301
gugccccgagcggu

SEQ ID NO: 3895992 - RNA, 15 nt, Shigella flexneri 2a str. 301
gugcccgaccacuuc

SEQ ID NO: 3895993 - RNA, 12 nt, Shigella flexneri 2a str. 301
gugcccgcgugg

SEQ ID NO: 3895994 - RNA, 17 nt, Shigella flexneri 2a str. 301
gugcccgggucagcgcc

SEQ ID NO: 3895995 - RNA, 15 nt, Shigella flexneri 2a str. 301
gugcccguaaaaaau

SEQ ID NO: 3895996 - RNA, 21 nt, Shigella flexneri 2a str. 301
gugccgaaccguaggccggau

SEQ ID NO: 3895997 - RNA, 16 nt, Shigella flexneri 2a str. 301
gugccgaugauuuaca

SEQ ID NO: 3895998 - RNA, 18 nt, Shigella flexneri 2a str. 301
gugccgcacauagcacca

SEQ ID NO: 3895999 - RNA, 20 nt, Shigella flexneri 2a str. 301
gugccgcacauagcaccacc

SEQ ID NO: 3896000 - RNA, 23 nt, Shigella flexneri 2a str. 301
gugccgcaccgacacaaauggca

SEQ ID NO: 3896001 - RNA, 12 nt, Shigella flexneri 2a str. 301
gugccgccgcca

SEQ ID NO: 3896002 - RNA, 20 nt, Shigella flexneri 2a str. 301
gugccgcgauaccacccgca

SEQ ID NO: 3896003 - RNA, 22 nt, Shigella flexneri 2a str. 301
gugccgcgauaccacccgcagu

SEQ ID NO: 3896004 - RNA, 19 nt, Shigella flexneri 2a str. 301
gugccgcuggcauacaguu

SEQ ID NO: 3896005 - RNA, 16 nt, Shigella flexneri 2a str. 301
gugccggaagucucuu

SEQ ID NO: 3896006 - RNA, 19 nt, Shigella flexneri 2a str. 301
gugccgggguagaccgcgc

SEQ ID NO: 3896007 - RNA, 20 nt, Shigella flexneri 2a str. 301
gugccgggguagaccgcgcu

SEQ ID NO: 3896008 - RNA, 18 nt, Shigella flexneri 2a str. 301
gugccgguaaagcaauga

SEQ ID NO: 3896009 - RNA, 19 nt, Shigella flexneri 2a str. 301
gugccggucugaauacgcc

SEQ ID NO: 3896010 - RNA, 16 nt, Shigella flexneri 2a str. 301
gugccgguggaagggc

SEQ ID NO: 3896011 - RNA, 15 nt, Shigella flexneri 2a str. 301
gugccgguuucacgu

SEQ ID NO: 3896012 - RNA, 23 nt, Shigella flexneri 2a str. 301
gugccguaaaucccagugccugc

SEQ ID NO: 3896013 - RNA, 22 nt, Shigella flexneri 2a str. 301
gugccuaacaauucgccagggc

SEQ ID NO: 3896014 - RNA, 20 nt, Shigella flexneri 2a str. 301
gugccucguucacauauugc

SEQ ID NO: 3896015 - RNA, 17 nt, Shigella flexneri 2a str. 301
gugccugcauaaacgcc

SEQ ID NO: 3896016 - RNA, 14 nt, Shigella flexneri 2a str. 301
gugccuuagccaca

SEQ ID NO: 3896017 - RNA, 19 nt, Shigella flexneri 2a str. 301
gugcgaauugccaccaucc

SEQ ID NO: 3896018 - RNA, 19 nt, Shigella flexneri 2a str. 301
gugcgcaaacuucuucagu

SEQ ID NO: 3896019 - RNA, 18 nt, Shigella flexneri 2a str. 301
gugcgcaauacguugcaa

SEQ ID NO: 3896020 - RNA, 18 nt, Shigella flexneri 2a str. 301
gugcgccacauccggcau

SEQ ID NO: 3896021 - RNA, 13 nt, Shigella flexneri 2a str. 301
gugcgccagcgau

SEQ ID NO: 3896022 - RNA, 19 nt, Shigella flexneri 2a str. 301
gugcgcccuguucugcaag

SEQ ID NO: 3896023 - RNA, 16 nt, Shigella flexneri 2a str. 301
gugcgcgcccauacgg

SEQ ID NO: 3896024 - RNA, 13 nt, Shigella flexneri 2a str. 301
gugcgcggcuuaa

SEQ ID NO: 3896025 - RNA, 18 nt, Shigella flexneri 2a str. 301
gugcgcgugagcugggau

SEQ ID NO: 3896026 - RNA, 12 nt, Shigella flexneri 2a str. 301
gugcggcagggg

SEQ ID NO: 3896027 - RNA, 15 nt, Shigella flexneri 2a str. 301
gugcggcaucgcugu

SEQ ID NO: 3896028 - RNA, 15 nt, Shigella flexneri 2a str. 301
gugcgggcacaggcg

SEQ ID NO: 3896029 - RNA, 16 nt, Shigella flexneri 2a str. 301
gugcggguaaccagcc

SEQ ID NO: 3896030 - RNA, 12 nt, Shigella flexneri 2a str. 301
gugcgucagggc

SEQ ID NO: 3896031 - RNA, 14 nt, Shigella flexneri 2a str. 301
gugugacaccaacc

SEQ ID NO: 3896032 - RNA, 23 nt, Shigella flexneri 2a str. 301
gugugcucaaucugauagugauc

SEQ ID NO: 3896033 - RNA, 14 nt, Shigella flexneri 2a str. 301
guguggccaguucc

SEQ ID NO: 3896034 - RNA, 16 nt, Shigella flexneri 2a str. 301
gugugggcacucgaag

SEQ ID NO: 3896035 - RNA, 19 nt, Shigella flexneri 2a str. 301
guguggucuuuucaacagu

SEQ ID NO: 3896036 - RNA, 21 nt, Shigella flexneri 2a str. 301
gugugguuauugggugacugg

SEQ ID NO: 3896037 - RNA, 15 nt, Shigella flexneri 2a str. 301
guguguauacggcaa

SEQ ID NO: 3896038 - RNA, 17 nt, Shigella flexneri 2a str. 301
guguguauggcauuguc

SEQ ID NO: 3896039 - RNA, 12 nt, Shigella flexneri 2a str. 301
guguguccaucc

SEQ ID NO: 3896040 - RNA, 11 nt, Shigella flexneri 2a str. 301
gugugugcuga

SEQ ID NO: 3896041 - RNA, 17 nt, Shigella flexneri 2a str. 301
guguguuccucugcucc

SEQ ID NO: 3896042 - RNA, 18 nt, Shigella flexneri 2a str. 301
guguguuuucuguuaaug

SEQ ID NO: 3896043 - RNA, 16 nt, Shigella flexneri 2a str. 301
guguuaaccaacggcg

SEQ ID NO: 3896044 - RNA, 18 nt, Shigella flexneri 2a str. 301
guguucaauaucgaaaug

SEQ ID NO: 3896045 - RNA, 22 nt, Shigella flexneri 2a str. 301
guguucacgccgcauccggcau

SEQ ID NO: 3896046 - RNA, 12 nt, Shigella flexneri 2a str. 301
guguucaugacc

SEQ ID NO: 3896047 - RNA, 16 nt, Shigella flexneri 2a str. 301
guguucgucacuggcg

SEQ ID NO: 3896048 - RNA, 16 nt, Shigella flexneri 2a str. 301
guguucucaucgccau

SEQ ID NO: 3896049 - RNA, 15 nt, Shigella flexneri 2a str. 301
guguugauuuccaac

SEQ ID NO: 3896050 - RNA, 11 nt, Shigella flexneri 2a str. 301
guguugcugaa

SEQ ID NO: 3896051 - RNA, 20 nt, Shigella flexneri 2a str. 301
guguugcugaacuuaugcaa

SEQ ID NO: 3896052 - RNA, 22 nt, Shigella flexneri 2a str. 301
guguuuugacauuggcauccgu

SEQ ID NO: 3896053 - RNA, 19 nt, Shigella flexneri 2a str. 301
guguuuuuuuaugguagug

SEQ ID NO: 3896054 - RNA, 16 nt, Shigella flexneri 2a str. 301
guuaaaaacagccagc

SEQ ID NO: 3896055 - RNA, 17 nt, Shigella flexneri 2a str. 301
guuaaaaacagccagca

SEQ ID NO: 3896056 - RNA, 17 nt, Shigella flexneri 2a str. 301
guuaaaacgcacgcugu

SEQ ID NO: 3896057 - RNA, 20 nt, Shigella flexneri 2a str. 301
guuaaaacuaaaaacagcau

SEQ ID NO: 3896058 - RNA, 20 nt, Shigella flexneri 2a str. 301
guuaaaacuuuccaugccau

SEQ ID NO: 3896059 - RNA, 17 nt, Shigella flexneri 2a str. 301
guuaaaacuuuuagcau

SEQ ID NO: 3896060 - RNA, 23 nt, Shigella flexneri 2a str. 301
guuaaaauaccagaucucaccac

SEQ ID NO: 3896061 - RNA, 19 nt, Shigella flexneri 2a str. 301
guuaaagagccgguuugua

SEQ ID NO: 3896062 - RNA, 21 nt, Shigella flexneri 2a str. 301
guuaaauugaucgaugguugc

SEQ ID NO: 3896063 - RNA, 12 nt, Shigella flexneri 2a str. 301
guuaacaacaac

SEQ ID NO: 3896064 - RNA, 23 nt, Shigella flexneri 2a str. 301
guuaacaccaccgccgacuguca

SEQ ID NO: 3896065 - RNA, 12 nt, Shigella flexneri 2a str. 301
guuaaccagcac

SEQ ID NO: 3896066 - RNA, 23 nt, Shigella flexneri 2a str. 301
guuaaccggaggauaugcaucau

SEQ ID NO: 3896067 - RNA, 18 nt, Shigella flexneri 2a str. 301
guuaacgugucauaacug

SEQ ID NO: 3896068 - RNA, 14 nt, Shigella flexneri 2a str. 301
guuaacguuuuucg

SEQ ID NO: 3896069 - RNA, 17 nt, Shigella flexneri 2a str. 301
guuaagcccaguucagc

SEQ ID NO: 3896070 - RNA, 23 nt, Shigella flexneri 2a str. 301
guuaaucaaaucaacaaccugca

SEQ ID NO: 3896071 - RNA, 11 nt, Shigella flexneri 2a str. 301
guuaaugguug

SEQ ID NO: 3896072 - RNA, 16 nt, Shigella flexneri 2a str. 301
guuacaacaucaacaa

SEQ ID NO: 3896073 - RNA, 16 nt, Shigella flexneri 2a str. 301
guuacaaccuccuccg

SEQ ID NO: 3896074 - RNA, 16 nt, Shigella flexneri 2a str. 301
guuacagcagguguua

SEQ ID NO: 3896075 - RNA, 14 nt, Shigella flexneri 2a str. 301
guuacagcuggagu

SEQ ID NO: 3896076 - RNA, 13 nt, Shigella flexneri 2a str. 301
guuacccagcacg

SEQ ID NO: 3896077 - RNA, 17 nt, Shigella flexneri 2a str. 301
guuacccccauccacgc

SEQ ID NO: 3896078 - RNA, 16 nt, Shigella flexneri 2a str. 301
guuacccgacgcgcca

SEQ ID NO: 3896079 - RNA, 18 nt, Shigella flexneri 2a str. 301
guuaccgacugcggccug

SEQ ID NO: 3896080 - RNA, 17 nt, Shigella flexneri 2a str. 301
guuaccucauggagaua

SEQ ID NO: 3896081 - RNA, 13 nt, Shigella flexneri 2a str. 301
guuaccuucaucc

SEQ ID NO: 3896082 - RNA, 18 nt, Shigella flexneri 2a str. 301
guuaccuucggccccauc

SEQ ID NO: 3896083 - RNA, 19 nt, Shigella flexneri 2a str. 301
guuaccuucggccccaucg

SEQ ID NO: 3896084 - RNA, 20 nt, Shigella flexneri 2a str. 301
guuacgcaaaaccucuucca

SEQ ID NO: 3896085 - RNA, 16 nt, Shigella flexneri 2a str. 301
guuacgcauaaaacca

SEQ ID NO: 3896086 - RNA, 22 nt, Shigella flexneri 2a str. 301
guuacgcauaaaaccagcaaac

SEQ ID NO: 3896087 - RNA, 17 nt, Shigella flexneri 2a str. 301
guuacgccccaacacaa

SEQ ID NO: 3896088 - RNA, 21 nt, Shigella flexneri 2a str. 301
guuacggacuuuuuauuuaug

SEQ ID NO: 3896089 - RNA, 18 nt, Shigella flexneri 2a str. 301
guuacggcuggaagguga

SEQ ID NO: 3896090 - RNA, 17 nt, Shigella flexneri 2a str. 301
guuacgugaagucucaa

SEQ ID NO: 3896091 - RNA, 16 nt, Shigella flexneri 2a str. 301
guuacugccaucuucc

SEQ ID NO: 3896092 - RNA, 17 nt, Shigella flexneri 2a str. 301
guuacugucgcgcagca

SEQ ID NO: 3896093 - RNA, 18 nt, Shigella flexneri 2a str. 301
guuacuuuuuaugucauu

SEQ ID NO: 3896094 - RNA, 17 nt, Shigella flexneri 2a str. 301
guuagaaacaaaaaaac

SEQ ID NO: 3896095 - RNA, 18 nt, Shigella flexneri 2a str. 301
guuagacgcguuuacaga

SEQ ID NO: 3896096 - RNA, 20 nt, Shigella flexneri 2a str. 301
guuagacgcguuuacagagc

SEQ ID NO: 3896097 - RNA, 13 nt, Shigella flexneri 2a str. 301
guuagagaacaac

SEQ ID NO: 3896098 - RNA, 14 nt, Shigella flexneri 2a str. 301
guuagagcacagau

SEQ ID NO: 3896099 - RNA, 18 nt, Shigella flexneri 2a str. 301
guuagcggcgguaaaauc

SEQ ID NO: 3896100 - RNA, 14 nt, Shigella flexneri 2a str. 301
guuagcucaacgca

SEQ ID NO: 3896101 - RNA, 13 nt, Shigella flexneri 2a str. 301
guuagucaucauc

SEQ ID NO: 3896102 - RNA, 20 nt, Shigella flexneri 2a str. 301
guuaguccacacgccaggcc

SEQ ID NO: 3896103 - RNA, 17 nt, Shigella flexneri 2a str. 301
guuagucugcauuuucu

SEQ ID NO: 3896104 - RNA, 15 nt, Shigella flexneri 2a str. 301
guuagugucuuaucu

SEQ ID NO: 3896105 - RNA, 20 nt, Shigella flexneri 2a str. 301
guuaguguuaaccaacggcg

SEQ ID NO: 3896106 - RNA, 21 nt, Shigella flexneri 2a str. 301
guuauaaacgcucggcaacac

SEQ ID NO: 3896107 - RNA, 15 nt, Shigella flexneri 2a str. 301
guuauacagaguguu

SEQ ID NO: 3896108 - RNA, 19 nt, Shigella flexneri 2a str. 301
guuauacaucgcuuuccag

SEQ ID NO: 3896109 - RNA, 14 nt, Shigella flexneri 2a str. 301
guuauaccagucca

SEQ ID NO: 3896110 - RNA, 23 nt, Shigella flexneri 2a str. 301
guuaucagaaccgcccagaccug

SEQ ID NO: 3896111 - RNA, 20 nt, Shigella flexneri 2a str. 301
guuauccacgauacgcugca

SEQ ID NO: 3896112 - RNA, 22 nt, Shigella flexneri 2a str. 301
guuauccagcuucacuuucagu

SEQ ID NO: 3896113 - RNA, 20 nt, Shigella flexneri 2a str. 301
guuauccgacuuauucuuca

SEQ ID NO: 3896114 - RNA, 21 nt, Shigella flexneri 2a str. 301
guuauccugaucaagcacaug

SEQ ID NO: 3896115 - RNA, 18 nt, Shigella flexneri 2a str. 301
guuaucguaccaggcgac

SEQ ID NO: 3896116 - RNA, 16 nt, Shigella flexneri 2a str. 301
guuaucgucugcgcca

SEQ ID NO: 3896117 - RNA, 13 nt, Shigella flexneri 2a str. 301
guuaugaaacucc

SEQ ID NO: 3896118 - RNA, 13 nt, Shigella flexneri 2a str. 301
guuaugccucaac

SEQ ID NO: 3896119 - RNA, 13 nt, Shigella flexneri 2a str. 301
guuaugcucggca

SEQ ID NO: 3896120 - RNA, 18 nt, Shigella flexneri 2a str. 301
guuauguaacaacuggcg

SEQ ID NO: 3896121 - RNA, 22 nt, Shigella flexneri 2a str. 301
guuauuacugcguauuuccugc

SEQ ID NO: 3896122 - RNA, 16 nt, Shigella flexneri 2a str. 301
guuauuauucauaaau

SEQ ID NO: 3896123 - RNA, 11 nt, Shigella flexneri 2a str. 301
guuauuuccag

SEQ ID NO: 3896124 - RNA, 16 nt, Shigella flexneri 2a str. 301
guuauuuccaggagau

SEQ ID NO: 3896125 - RNA, 18 nt, Shigella flexneri 2a str. 301
guuauuuguucagcaaau

SEQ ID NO: 3896126 - RNA, 17 nt, Shigella flexneri 2a str. 301
guucaaaaacuaauuca

SEQ ID NO: 3896127 - RNA, 17 nt, Shigella flexneri 2a str. 301
guucaaaguaauauuca

SEQ ID NO: 3896128 - RNA, 23 nt, Shigella flexneri 2a str. 301
guucaacaauauuaaucccugcu

SEQ ID NO: 3896129 - RNA, 15 nt, Shigella flexneri 2a str. 301
guucaacgaccagau

SEQ ID NO: 3896130 - RNA, 18 nt, Shigella flexneri 2a str. 301
guucaacgcccgcuuuca

SEQ ID NO: 3896131 - RNA, 16 nt, Shigella flexneri 2a str. 301
guucugccguccagcc

SEQ ID NO: 3896132 - RNA, 16 nt, Shigella flexneri 2a str. 301
guucugcgccaaacag

SEQ ID NO: 3896133 - RNA, 23 nt, Shigella flexneri 2a str. 301
guucugcgccguccacaaaccgu

SEQ ID NO: 3896134 - RNA, 18 nt, Shigella flexneri 2a str. 301
guucugcggcguaacgca

SEQ ID NO: 3896135 - RNA, 22 nt, Shigella flexneri 2a str. 301
guucugcggguuagucugcauu

SEQ ID NO: 3896136 - RNA, 23 nt, Shigella flexneri 2a str. 301
guucuggccuuuaauaugccacg

SEQ ID NO: 3896137 - RNA, 13 nt, Shigella flexneri 2a str. 301
guucuguggcagg

SEQ ID NO: 3896138 - RNA, 19 nt, Shigella flexneri 2a str. 301
guucugugucuuauuggca

SEQ ID NO: 3896139 - RNA, 22 nt, Shigella flexneri 2a str. 301
guucuuaccggugacagcggug

SEQ ID NO: 3896140 - RNA, 23 nt, Shigella flexneri 2a str. 301
guucuuaggggguaucuuugacu

SEQ ID NO: 3896141 - RNA, 16 nt, Shigella flexneri 2a str. 301
guucuucgcugacagu

SEQ ID NO: 3896142 - RNA, 18 nt, Shigella flexneri 2a str. 301
guucuucucaaccuuucc

SEQ ID NO: 3896143 - RNA, 15 nt, Shigella flexneri 2a str. 301
guucuuuucgagcag

SEQ ID NO: 3896144 - RNA, 12 nt, Shigella flexneri 2a str. 301
guugaaaaacca

SEQ ID NO: 3896145 - RNA, 22 nt, Shigella flexneri 2a str. 301
guugaaaaaucaaaaaacugga

SEQ ID NO: 3896146 - RNA, 17 nt, Shigella flexneri 2a str. 301
guugaacaggcgcugau

SEQ ID NO: 3896147 - RNA, 19 nt, Shigella flexneri 2a str. 301
guugaacgguuuggugaug

SEQ ID NO: 3896148 - RNA, 12 nt, Shigella flexneri 2a str. 301
guugaagucagg

SEQ ID NO: 3896149 - RNA, 18 nt, Shigella flexneri 2a str. 301
guugacguucaugccggu

SEQ ID NO: 3896150 - RNA, 16 nt, Shigella flexneri 2a str. 301
guugacucggagucga

SEQ ID NO: 3896151 - RNA, 16 nt, Shigella flexneri 2a str. 301
guugagagaagaaacg

SEQ ID NO: 3896152 - RNA, 15 nt, Shigella flexneri 2a str. 301
guugagcggcaguaa

SEQ ID NO: 3896153 - RNA, 11 nt, Shigella flexneri 2a str. 301
guugaggaagc

SEQ ID NO: 3896154 - RNA, 14 nt, Shigella flexneri 2a str. 301
guugaggcacaucu

SEQ ID NO: 3896155 - RNA, 17 nt, Shigella flexneri 2a str. 301
guugagggcgcaauuuc

SEQ ID NO: 3896156 - RNA, 21 nt, Shigella flexneri 2a str. 301
guugauacaggaacagccacu

SEQ ID NO: 3896157 - RNA, 19 nt, Shigella flexneri 2a str. 301
guugauccaggagcuccag

SEQ ID NO: 3896158 - RNA, 23 nt, Shigella flexneri 2a str. 301
guugaucgccccggaagcaucaa

SEQ ID NO: 3896159 - RNA, 14 nt, Shigella flexneri 2a str. 301
guugaucgcuuuca

SEQ ID NO: 3896160 - RNA, 15 nt, Shigella flexneri 2a str. 301
guugaucuauaccac

SEQ ID NO: 3896161 - RNA, 19 nt, Shigella flexneri 2a str. 301
guugaugcgcccuugcagg

SEQ ID NO: 3896162 - RNA, 14 nt, Shigella flexneri 2a str. 301
guugaugcguaccu

SEQ ID NO: 3896163 - RNA, 15 nt, Shigella flexneri 2a str. 301
guugaugcuccuggc

SEQ ID NO: 3896164 - RNA, 14 nt, Shigella flexneri 2a str. 301
guugaugguaaaau

SEQ ID NO: 3896165 - RNA, 20 nt, Shigella flexneri 2a str. 301
guugauguuuggccgcgcca

SEQ ID NO: 3896166 - RNA, 16 nt, Shigella flexneri 2a str. 301
guugauuggcgcaggu

SEQ ID NO: 3896167 - RNA, 17 nt, Shigella flexneri 2a str. 301
guugauuuuauaaucaa

SEQ ID NO: 3896168 - RNA, 23 nt, Shigella flexneri 2a str. 301
guugcaauacaccuccggcuggg

SEQ ID NO: 3896169 - RNA, 13 nt, Shigella flexneri 2a str. 301
guugcaccagcaa

SEQ ID NO: 3896170 - RNA, 22 nt, Shigella flexneri 2a str. 301
guugcacgucaauggugagaug

SEQ ID NO: 3896171 - RNA, 16 nt, Shigella flexneri 2a str. 301
guugcagaaacaaccu

SEQ ID NO: 3896172 - RNA, 18 nt, Shigella flexneri 2a str. 301
guugcagcaagccaucgu

SEQ ID NO: 3896173 - RNA, 15 nt, Shigella flexneri 2a str. 301
guugcagcgucauca

SEQ ID NO: 3896174 - RNA, 14 nt, Shigella flexneri 2a str. 301
guugcaucgccugc

SEQ ID NO: 3896175 - RNA, 17 nt, Shigella flexneri 2a str. 301
guugcauuuccauaaau

SEQ ID NO: 3896176 - RNA, 14 nt, Shigella flexneri 2a str. 301
guugcauuugcaga

SEQ ID NO: 3896177 - RNA, 12 nt, Shigella flexneri 2a str. 301
guugccagcgcc

SEQ ID NO: 3896178 - RNA, 22 nt, Shigella flexneri 2a str. 301
guugccauuguuggcaggccaa

SEQ ID NO: 3896179 - RNA, 16 nt, Shigella flexneri 2a str. 301
guugccauuucugcug

SEQ ID NO: 3896180 - RNA, 13 nt, Shigella flexneri 2a str. 301
guugcccagcgca

SEQ ID NO: 3896181 - RNA, 17 nt, Shigella flexneri 2a str. 301
guugcccagcgcaucag

SEQ ID NO: 3896182 - RNA, 18 nt, Shigella flexneri 2a str. 301
guugcccagcgcaucagg

SEQ ID NO: 3896183 - RNA, 23 nt, Shigella flexneri 2a str. 301
guugcccagcgcgccgccaauaa

SEQ ID NO: 3896184 - RNA, 22 nt, Shigella flexneri 2a str. 301
guugccccgcacgcuucaucgg

SEQ ID NO: 3896185 - RNA, 15 nt, Shigella flexneri 2a str. 301
guugcccgcauuauu

SEQ ID NO: 3896186 - RNA, 12 nt, Shigella flexneri 2a str. 301
guugcccugcug

SEQ ID NO: 3896187 - RNA, 21 nt, Shigella flexneri 2a str. 301
guugcccuuuucaccaugggc

SEQ ID NO: 3896188 - RNA, 20 nt, Shigella flexneri 2a str. 301
guugccgaacguaggcugga

SEQ ID NO: 3896189 - RNA, 12 nt, Shigella flexneri 2a str. 301
guugccgcccgu

SEQ ID NO: 3896190 - RNA, 16 nt, Shigella flexneri 2a str. 301
guugccgcuuuuucca

SEQ ID NO: 3896191 - RNA, 18 nt, Shigella flexneri 2a str. 301
guugccuugccgaaucag

SEQ ID NO: 3896192 - RNA, 13 nt, Shigella flexneri 2a str. 301
guugcgaaaaaau

SEQ ID NO: 3896193 - RNA, 16 nt, Shigella flexneri 2a str. 301
guugcgcaugaccuuu

SEQ ID NO: 3896194 - RNA, 22 nt, Shigella flexneri 2a str. 301
guugcgccaguaaauuuaucaa

SEQ ID NO: 3896195 - RNA, 14 nt, Shigella flexneri 2a str. 301
guugcgcccaucau

SEQ ID NO: 3896196 - RNA, 16 nt, Shigella flexneri 2a str. 301
guugcgccuugucuuu

SEQ ID NO: 3896197 - RNA, 18 nt, Shigella flexneri 2a str. 301
guugcggcugcccaucau

SEQ ID NO: 3896198 - RNA, 21 nt, Shigella flexneri 2a str. 301
guugcggcugcccaucaucgu

SEQ ID NO: 3896199 - RNA, 22 nt, Shigella flexneri 2a str. 301
guugcggcuuauucauuacuca

SEQ ID NO: 3896200 - RNA, 15 nt, Shigella flexneri 2a str. 301
guugcgguuucaacu

SEQ ID NO: 3896201 - RNA, 18 nt, Shigella flexneri 2a str. 301
guugcguaacugaucgua

SEQ ID NO: 3896202 - RNA, 19 nt, Shigella flexneri 2a str. 301
guugcguuuuuaucuucac

SEQ ID NO: 3896203 - RNA, 15 nt, Shigella flexneri 2a str. 301
guugcuaacggccac

SEQ ID NO: 3896204 - RNA, 14 nt, Shigella flexneri 2a str. 301
guugcuaugcugaa

SEQ ID NO: 3896205 - RNA, 22 nt, Shigella flexneri 2a str. 301
guugcuccccagaauccaggaa

SEQ ID NO: 3896206 - RNA, 13 nt, Shigella flexneri 2a str. 301
guugcugaccuuc

SEQ ID NO: 3896207 - RNA, 19 nt, Shigella flexneri 2a str. 301
guugcugagaucaaacucu

SEQ ID NO: 3896208 - RNA, 23 nt, Shigella flexneri 2a str. 301
guugcugccgacaaaugcaguuu

SEQ ID NO: 3896209 - RNA, 19 nt, Shigella flexneri 2a str. 301
guugcugccuugcgggcug

SEQ ID NO: 3896210 - RNA, 14 nt, Shigella flexneri 2a str. 301
guugcuggaaagag

SEQ ID NO: 3896211 - RNA, 21 nt, Shigella flexneri 2a str. 301
guugcuggcagauaaauuacu

SEQ ID NO: 3896212 - RNA, 12 nt, Shigella flexneri 2a str. 301
guugcuucaucu

SEQ ID NO: 3896213 - RNA, 15 nt, Shigella flexneri 2a str. 301
guugcuuuucacaac

SEQ ID NO: 3896214 - RNA, 18 nt, Shigella flexneri 2a str. 301
guuggaaaucccgugacg

SEQ ID NO: 3896215 - RNA, 21 nt, Shigella flexneri 2a str. 301
guuggauggcauacuccggca

SEQ ID NO: 3896216 - RNA, 21 nt, Shigella flexneri 2a str. 301
guuggcaugcguauccuccug

SEQ ID NO: 3896217 - RNA, 14 nt, Shigella flexneri 2a str. 301
guuggcgaaaaucu

SEQ ID NO: 3896218 - RNA, 23 nt, Shigella flexneri 2a str. 301
guuggcgacgucaguuuccagca

SEQ ID NO: 3896219 - RNA, 22 nt, Shigella flexneri 2a str. 301
guuggcgcauaacucaccauca

SEQ ID NO: 3896220 - RNA, 17 nt, Shigella flexneri 2a str. 301
guuggcgcuggcggcug

SEQ ID NO: 3896221 - RNA, 21 nt, Shigella flexneri 2a str. 301
guuggcggugccaucgauaau

SEQ ID NO: 3896222 - RNA, 17 nt, Shigella flexneri 2a str. 301
guuggcguguuucagcu

SEQ ID NO: 3896223 - RNA, 16 nt, Shigella flexneri 2a str. 301
guuggcguugcaccga

SEQ ID NO: 3896224 - RNA, 17 nt, Shigella flexneri 2a str. 301
guuggguucacuuuccc

SEQ ID NO: 3896225 - RNA, 15 nt, Shigella flexneri 2a str. 301
guugguacuguggca

SEQ ID NO: 3896226 - RNA, 22 nt, Shigella flexneri 2a str. 301
guugguucagugggcgcugcug

SEQ ID NO: 3896227 - RNA, 21 nt, Shigella flexneri 2a str. 301
guuguaaaaaaccccgcuccg

SEQ ID NO: 3896228 - RNA, 18 nt, Shigella flexneri 2a str. 301
guuguaaucauauuaaau

SEQ ID NO: 3896229 - RNA, 14 nt, Shigella flexneri 2a str. 301
guuguacauuacca

SEQ ID NO: 3896230 - RNA, 17 nt, Shigella flexneri 2a str. 301
guugucacugcaucuuc

SEQ ID NO: 3896231 - RNA, 18 nt, Shigella flexneri 2a str. 301
guuuggugaaauauagaa

SEQ ID NO: 3896232 - RNA, 16 nt, Shigella flexneri 2a str. 301
guuugguugccagcca

SEQ ID NO: 3896233 - RNA, 22 nt, Shigella flexneri 2a str. 301
guuuguaacccaccaugccgau

SEQ ID NO: 3896234 - RNA, 13 nt, Shigella flexneri 2a str. 301
guuuguagcagaa

SEQ ID NO: 3896235 - RNA, 13 nt, Shigella flexneri 2a str. 301
guuugucauaaau

SEQ ID NO: 3896236 - RNA, 14 nt, Shigella flexneri 2a str. 301
guuugucuauuccg

SEQ ID NO: 3896237 - RNA, 20 nt, Shigella flexneri 2a str. 301
guuugugccgaaccguaggc

SEQ ID NO: 3896238 - RNA, 17 nt, Shigella flexneri 2a str. 301
guuuguuacgauagaau

SEQ ID NO: 3896239 - RNA, 16 nt, Shigella flexneri 2a str. 301
guuuguucaagcgcaa

SEQ ID NO: 3896240 - RNA, 13 nt, Shigella flexneri 2a str. 301
guuuuaauuccua

SEQ ID NO: 3896241 - RNA, 16 nt, Shigella flexneri 2a str. 301
guuuuaauuccuaucg

SEQ ID NO: 3896242 - RNA, 21 nt, Shigella flexneri 2a str. 301
guuuuacaacgcuguugcgua

SEQ ID NO: 3896243 - RNA, 20 nt, Shigella flexneri 2a str. 301
guuuuacaacguuaccgggu

SEQ ID NO: 3896244 - RNA, 17 nt, Shigella flexneri 2a str. 301
guuuuacgcauaucucc

SEQ ID NO: 3896245 - RNA, 17 nt, Shigella flexneri 2a str. 301
guuuuacuuugccuuuc

SEQ ID NO: 3896246 - RNA, 18 nt, Shigella flexneri 2a str. 301
guuuuacuuuuuaacuuu

SEQ ID NO: 3896247 - RNA, 17 nt, Shigella flexneri 2a str. 301
guuuuaguguuuguauu

SEQ ID NO: 3896248 - RNA, 16 nt, Shigella flexneri 2a str. 301
guuuuaguuucgccgu

SEQ ID NO: 3896249 - RNA, 22 nt, Shigella flexneri 2a str. 301
guuuuauaaucgcaucaaucuu

SEQ ID NO: 3896250 - RNA, 14 nt, Shigella flexneri 2a str. 301
guuuuauauaacgc

SEQ ID NO: 3896251 - RNA, 14 nt, Shigella flexneri 2a str. 301
guuuuaucagaccg

SEQ ID NO: 3896252 - RNA, 14 nt, Shigella flexneri 2a str. 301
guuuuaucccgcuc

SEQ ID NO: 3896253 - RNA, 16 nt, Shigella flexneri 2a str. 301
guuuuaucuccauccg

SEQ ID NO: 3896254 - RNA, 19 nt, Shigella flexneri 2a str. 301
guuuuauuauuccauccug

SEQ ID NO: 3896255 - RNA, 20 nt, Shigella flexneri 2a str. 301
guuuucaaagguaaugguca

SEQ ID NO: 3896256 - RNA, 13 nt, Shigella flexneri 2a str. 301
guuuucaagacgc

SEQ ID NO: 3896257 - RNA, 20 nt, Shigella flexneri 2a str. 301
guuuucaccgcggauuucac

SEQ ID NO: 3896258 - RNA, 14 nt, Shigella flexneri 2a str. 301
guuuucaccggcac

SEQ ID NO: 3896259 - RNA, 17 nt, Shigella flexneri 2a str. 301
guuuucagaagcaugaa

SEQ ID NO: 3896260 - RNA, 20 nt, Shigella flexneri 2a str. 301
guuuucagaccagacugcuc

SEQ ID NO: 3896261 - RNA, 16 nt, Shigella flexneri 2a str. 301
guuuucagaugaaaac

SEQ ID NO: 3896262 - RNA, 16 nt, Shigella flexneri 2a str. 301
guuuucagcaccagau

SEQ ID NO: 3896263 - RNA, 20 nt, Shigella flexneri 2a str. 301
guuuucagcuucgguuucac

SEQ ID NO: 3896264 - RNA, 11 nt, Shigella flexneri 2a str. 301
guuuucaucau

SEQ ID NO: 3896265 - RNA, 14 nt, Shigella flexneri 2a str. 301
guuuuccagcacca

SEQ ID NO: 3896266 - RNA, 13 nt, Shigella flexneri 2a str. 301
guuuuccaguuca

SEQ ID NO: 3896267 - RNA, 13 nt, Shigella flexneri 2a str. 301
guuuucggauuua

SEQ ID NO: 3896268 - RNA, 20 nt, Shigella flexneri 2a str. 301
guuuucgucaacguagcuau

SEQ ID NO: 3896269 - RNA, 16 nt, Shigella flexneri 2a str. 301
guuuucuaacucauuu

SEQ ID NO: 3896270 - RNA, 20 nt, Shigella flexneri 2a str. 301
guuuucuaacucauuuuuua

SEQ ID NO: 3896271 - RNA, 14 nt, Shigella flexneri 2a str. 301
guuuucuccagcgc

SEQ ID NO: 3896272 - RNA, 18 nt, Shigella flexneri 2a str. 301
guuuucucgcuccauucc

SEQ ID NO: 3896273 - RNA, 13 nt, Shigella flexneri 2a str. 301
guuuucuuugcca

SEQ ID NO: 3896274 - RNA, 14 nt, Shigella flexneri 2a str. 301
guuuugaucuccag

SEQ ID NO: 3896275 - RNA, 13 nt, Shigella flexneri 2a str. 301
guuuugaugaauc

SEQ ID NO: 3896276 - RNA, 17 nt, Shigella flexneri 2a str. 301
guuuugcaucaacugcg

SEQ ID NO: 3896277 - RNA, 17 nt, Shigella flexneri 2a str. 301
guuuugccagucagcuc

SEQ ID NO: 3896278 - RNA, 16 nt, Shigella flexneri 2a str. 301
guuuugccgccaucau

SEQ ID NO: 3896279 - RNA, 16 nt, Shigella flexneri 2a str. 301
guuuuguaggccggau

SEQ ID NO: 3896280 - RNA, 13 nt, Shigella flexneri 2a str. 301
guuuuuacagauu

SEQ ID NO: 3896281 - RNA, 16 nt, Shigella flexneri 2a str. 301
guuuuuacccagcagc

SEQ ID NO: 3896282 - RNA, 17 nt, Shigella flexneri 2a str. 301
guuuuuacccagcagca

SEQ ID NO: 3896283 - RNA, 16 nt, Shigella flexneri 2a str. 301
guuuuuacgaaacaga

SEQ ID NO: 3896284 - RNA, 15 nt, Shigella flexneri 2a str. 301
guuuuuaucuucaca

SEQ ID NO: 3896285 - RNA, 14 nt, Shigella flexneri 2a str. 301
guuuuuauugguca

SEQ ID NO: 3896286 - RNA, 19 nt, Shigella flexneri 2a str. 301
guuuuucagcgccagcgcg

SEQ ID NO: 3896287 - RNA, 22 nt, Shigella flexneri 2a str. 301
guuuuucauugcacucuccucc

SEQ ID NO: 3896288 - RNA, 18 nt, Shigella flexneri 2a str. 301
guuuuuccccugccagau

SEQ ID NO: 3896289 - RNA, 19 nt, Shigella flexneri 2a str. 301
guuuuugccagcaacggcc

SEQ ID NO: 3896290 - RNA, 22 nt, Shigella flexneri 2a str. 301
guuuuuguccccucaucaguga

SEQ ID NO: 3896291 - RNA, 15 nt, Shigella flexneri 2a str. 301
guuuuuguugauaaa

SEQ ID NO: 3896292 - RNA, 23 nt, Shigella flexneri 2a str. 301
guuuuuguuucugaaucucuaag

SEQ ID NO: 3896293 - RNA, 21 nt, Shigella flexneri 2a str. 301
guuuuuuaaaggaaaguaaau

SEQ ID NO: 3896294 - RNA, 15 nt, Shigella flexneri 2a str. 301
guuuuuuaucuucaa

SEQ ID NO: 3896295 - RNA, 16 nt, Shigella flexneri 2a str. 301
guuuuuuaucuucaag

SEQ ID NO: 3896296 - RNA, 14 nt, Shigella flexneri 2a str. 301
guuuuuuauuucag

SEQ ID NO: 3896297 - RNA, 15 nt, Shigella flexneri 2a str. 301
guuuuuucaaccuaa

SEQ ID NO: 3896298 - RNA, 16 nt, Shigella flexneri 2a str. 301
guuuuuucaaccuaaa

SEQ ID NO: 3896299 - RNA, 18 nt, Shigella flexneri 2a str. 301
guuuuuugaugucauuca

SEQ ID NO: 3896300 - RNA, 12 nt, Shigella flexneri 2a str. 301
guuuuuugcucc

SEQ ID NO: 3896301 - RNA, 17 nt, Shigella flexneri 2a str. 301
guuuuuuuauagcuuau

SEQ ID NO: 3896302 - RNA, 17 nt, Shigella flexneri 2a str. 301
guuuuuuuauaucucag

SEQ ID NO: 3896303 - RNA, 23 nt, Shigella flexneri 2a str. 301
guuuuuuuauaucucagauaaau

SEQ ID NO: 3896304 - RNA, 18 nt, Shigella flexneri 2a str. 301
uaaaaaaagcauuuaaua

SEQ ID NO: 3896305 - RNA, 20 nt, Shigella flexneri 2a str. 301
uaaaaaagaaggaaaauaca

SEQ ID NO: 3896306 - RNA, 17 nt, Shigella flexneri 2a str. 301
uaaaaaagggugcugca

SEQ ID NO: 3896307 - RNA, 21 nt, Shigella flexneri 2a str. 301
uaaaaaaggugcucaaugagc

SEQ ID NO: 3896308 - RNA, 21 nt, Shigella flexneri 2a str. 301
uaaaaacagcaucaauaauca

SEQ ID NO: 3896309 - RNA, 14 nt, Shigella flexneri 2a str. 301
uaaaaacagccagc

SEQ ID NO: 3896310 - RNA, 13 nt, Shigella flexneri 2a str. 301
uaaaaagaaaaaa

SEQ ID NO: 3896311 - RNA, 12 nt, Shigella flexneri 2a str. 301
uaaaaagaaagu

SEQ ID NO: 3896312 - RNA, 15 nt, Shigella flexneri 2a str. 301
uaaaaagccuaacaa

SEQ ID NO: 3896313 - RNA, 18 nt, Shigella flexneri 2a str. 301
uaaaaaguaagaauugau

SEQ ID NO: 3896314 - RNA, 13 nt, Shigella flexneri 2a str. 301
uaaaaauauuucu

SEQ ID NO: 3896315 - RNA, 15 nt, Shigella flexneri 2a str. 301
uaaaaauccgccaga

SEQ ID NO: 3896316 - RNA, 17 nt, Shigella flexneri 2a str. 301
uaaaaaucgaugcuguu

SEQ ID NO: 3896317 - RNA, 18 nt, Shigella flexneri 2a str. 301
uaaaaaucgaugcuguug

SEQ ID NO: 3896318 - RNA, 19 nt, Shigella flexneri 2a str. 301
uaaaacaacggaacgaaaa

SEQ ID NO: 3896319 - RNA, 21 nt, Shigella flexneri 2a str. 301
uaaaacaacggaacgaaaaaa

SEQ ID NO: 3896320 - RNA, 22 nt, Shigella flexneri 2a str. 301
uaaaacagcacuccugccacca

SEQ ID NO: 3896321 - RNA, 16 nt, Shigella flexneri 2a str. 301
uaaaacagccagcgcu

SEQ ID NO: 3896322 - RNA, 22 nt, Shigella flexneri 2a str. 301
uaaaacauuguugaguuuuuug

SEQ ID NO: 3896323 - RNA, 23 nt, Shigella flexneri 2a str. 301
uaaaaccaacaguaucugaauca

SEQ ID NO: 3896324 - RNA, 20 nt, Shigella flexneri 2a str. 301
uaaaaccaguaaugaucggc

SEQ ID NO: 3896325 - RNA, 14 nt, Shigella flexneri 2a str. 301
uaaaaccccaaaaa

SEQ ID NO: 3896326 - RNA, 16 nt, Shigella flexneri 2a str. 301
uaaaaccgacuuaaaa

SEQ ID NO: 3896327 - RNA, 16 nt, Shigella flexneri 2a str. 301
uaaaacgagauagcgu

SEQ ID NO: 3896328 - RNA, 23 nt, Shigella flexneri 2a str. 301
uaaaacgcacgcugucaccagug

SEQ ID NO: 3896329 - RNA, 18 nt, Shigella flexneri 2a str. 301
uaaaacgcagucuuccca

SEQ ID NO: 3896330 - RNA, 23 nt, Shigella flexneri 2a str. 301
uaaaacgcagucuucccagcccc

SEQ ID NO: 3896331 - RNA, 21 nt, Shigella flexneri 2a str. 301
uaaagcccucaccgaagcgag

SEQ ID NO: 3896332 - RNA, 22 nt, Shigella flexneri 2a str. 301
uaaagccggugcggucaggcau

SEQ ID NO: 3896333 - RNA, 20 nt, Shigella flexneri 2a str. 301
uaaagccgugcugcugccaa

SEQ ID NO: 3896334 - RNA, 23 nt, Shigella flexneri 2a str. 301
uaaagccguggguauauuucagg

SEQ ID NO: 3896335 - RNA, 17 nt, Shigella flexneri 2a str. 301
uaaagccuauccagaag

SEQ ID NO: 3896336 - RNA, 19 nt, Shigella flexneri 2a str. 301
uaaagccuauccagaagcc

SEQ ID NO: 3896337 - RNA, 16 nt, Shigella flexneri 2a str. 301
uaaagccugcuggcag

SEQ ID NO: 3896338 - RNA, 19 nt, Shigella flexneri 2a str. 301
uaaagcgcgaucgcuaccu

SEQ ID NO: 3896339 - RNA, 17 nt, Shigella flexneri 2a str. 301
uaaagcuaauaccguuu

SEQ ID NO: 3896340 - RNA, 23 nt, Shigella flexneri 2a str. 301
uaaagcugcggauccugagcaaa

SEQ ID NO: 3896341 - RNA, 15 nt, Shigella flexneri 2a str. 301
uaaaggaaaguaaau

SEQ ID NO: 3896342 - RNA, 16 nt, Shigella flexneri 2a str. 301
uaaaggaaaguaaauu

SEQ ID NO: 3896343 - RNA, 20 nt, Shigella flexneri 2a str. 301
uaaaggagaggcccuggaaa

SEQ ID NO: 3896344 - RNA, 16 nt, Shigella flexneri 2a str. 301
uaaaggcaaaaugcca

SEQ ID NO: 3896345 - RNA, 18 nt, Shigella flexneri 2a str. 301
uaaaggggugaaaaaaac

SEQ ID NO: 3896346 - RNA, 15 nt, Shigella flexneri 2a str. 301
uaaaggucaucacau

SEQ ID NO: 3896347 - RNA, 18 nt, Shigella flexneri 2a str. 301
uaaaggucgacagcagcc

SEQ ID NO: 3896348 - RNA, 18 nt, Shigella flexneri 2a str. 301
uaaaguacgcuuucccuu

SEQ ID NO: 3896349 - RNA, 17 nt, Shigella flexneri 2a str. 301
uaaaguacucuuugaac

SEQ ID NO: 3896350 - RNA, 19 nt, Shigella flexneri 2a str. 301
uaaaguagaaauuauuucu

SEQ ID NO: 3896351 - RNA, 21 nt, Shigella flexneri 2a str. 301
uaaaguaggccagauaagacg

SEQ ID NO: 3896352 - RNA, 22 nt, Shigella flexneri 2a str. 301
uaaagucagcguuauagcgcau

SEQ ID NO: 3896353 - RNA, 16 nt, Shigella flexneri 2a str. 301
uaaagucuuuguauuu

SEQ ID NO: 3896354 - RNA, 23 nt, Shigella flexneri 2a str. 301
uaaagugcgcuuuguuuaugcca

SEQ ID NO: 3896355 - RNA, 20 nt, Shigella flexneri 2a str. 301
uaaaguggcggggaucacuc

SEQ ID NO: 3896356 - RNA, 19 nt, Shigella flexneri 2a str. 301
uaaaguugcucucaaagac

SEQ ID NO: 3896357 - RNA, 18 nt, Shigella flexneri 2a str. 301
uaaaguuuggcugugccc

SEQ ID NO: 3896358 - RNA, 16 nt, Shigella flexneri 2a str. 301
uaaauaaacucucuau

SEQ ID NO: 3896359 - RNA, 21 nt, Shigella flexneri 2a str. 301
uaaauaacuggugcuaacagc

SEQ ID NO: 3896360 - RNA, 14 nt, Shigella flexneri 2a str. 301
uaaauaauaucccc

SEQ ID NO: 3896361 - RNA, 14 nt, Shigella flexneri 2a str. 301
uaaauaaucgaucg

SEQ ID NO: 3896362 - RNA, 11 nt, Shigella flexneri 2a str. 301
uaaauacagag

SEQ ID NO: 3896363 - RNA, 12 nt, Shigella flexneri 2a str. 301
uaaauacagagc

SEQ ID NO: 3896364 - RNA, 13 nt, Shigella flexneri 2a str. 301
uaaauacagagca

SEQ ID NO: 3896365 - RNA, 15 nt, Shigella flexneri 2a str. 301
uaaauaccguucauu

SEQ ID NO: 3896366 - RNA, 22 nt, Shigella flexneri 2a str. 301
uaaauaccguucauuaacgccc

SEQ ID NO: 3896367 - RNA, 15 nt, Shigella flexneri 2a str. 301
uaaauaccuuacacu

SEQ ID NO: 3896368 - RNA, 22 nt, Shigella flexneri 2a str. 301
uaaauaccuuacacucaaauau

SEQ ID NO: 3896369 - RNA, 18 nt, Shigella flexneri 2a str. 301
uaaauaccuuccggcgua

SEQ ID NO: 3896370 - RNA, 18 nt, Shigella flexneri 2a str. 301
uaaauacgccccacagac

SEQ ID NO: 3896371 - RNA, 23 nt, Shigella flexneri 2a str. 301
uaaauacgccccacagacccagg

SEQ ID NO: 3896372 - RNA, 21 nt, Shigella flexneri 2a str. 301
uaaauacgccucuucauacau

SEQ ID NO: 3896373 - RNA, 16 nt, Shigella flexneri 2a str. 301
uaaauacuccauaacu

SEQ ID NO: 3896374 - RNA, 17 nt, Shigella flexneri 2a str. 301
uaaauagaggaaucuga

SEQ ID NO: 3896375 - RNA, 16 nt, Shigella flexneri 2a str. 301
uaaauaucaucaaaau

SEQ ID NO: 3896376 - RNA, 21 nt, Shigella flexneri 2a str. 301
uaaauauuaaggguaaaagga

SEQ ID NO: 3896377 - RNA, 18 nt, Shigella flexneri 2a str. 301
uaaauauuaauacaacaa

SEQ ID NO: 3896378 - RNA, 21 nt, Shigella flexneri 2a str. 301
uaaauauuaauacaacaacac

SEQ ID NO: 3896379 - RNA, 14 nt, Shigella flexneri 2a str. 301
uaaauauuauuggc

SEQ ID NO: 3896380 - RNA, 21 nt, Shigella flexneri 2a str. 301
uaaauauugucuauacgccuc

SEQ ID NO: 3896381 - RNA, 14 nt, Shigella flexneri 2a str. 301
uaaaucacaccauu

SEQ ID NO: 3896382 - RNA, 20 nt, Shigella flexneri 2a str. 301
uaaaucacgcuuaucgcccu

SEQ ID NO: 3896383 - RNA, 16 nt, Shigella flexneri 2a str. 301
uaaaucauauaucgca

SEQ ID NO: 3896384 - RNA, 16 nt, Shigella flexneri 2a str. 301
uaaaucaucggguuac

SEQ ID NO: 3896385 - RNA, 15 nt, Shigella flexneri 2a str. 301
uaaauccaacaacac

SEQ ID NO: 3896386 - RNA, 14 nt, Shigella flexneri 2a str. 301
uaaauccauaagau

SEQ ID NO: 3896387 - RNA, 15 nt, Shigella flexneri 2a str. 301
uaaauccaucgggcu

SEQ ID NO: 3896388 - RNA, 14 nt, Shigella flexneri 2a str. 301
uaaaucccagugcc

SEQ ID NO: 3896389 - RNA, 20 nt, Shigella flexneri 2a str. 301
uaaaucccgccgcuucacca

SEQ ID NO: 3896390 - RNA, 16 nt, Shigella flexneri 2a str. 301
uaaaucgguauuucca

SEQ ID NO: 3896391 - RNA, 18 nt, Shigella flexneri 2a str. 301
uaaaucgguauuuccauu

SEQ ID NO: 3896392 - RNA, 23 nt, Shigella flexneri 2a str. 301
uaaaucucaucguugcgaucgac

SEQ ID NO: 3896393 - RNA, 15 nt, Shigella flexneri 2a str. 301
uaaaucuguucaucu

SEQ ID NO: 3896394 - RNA, 16 nt, Shigella flexneri 2a str. 301
uaaaucuuugcccgca

SEQ ID NO: 3896395 - RNA, 11 nt, Shigella flexneri 2a str. 301
uaaaugccacc

SEQ ID NO: 3896396 - RNA, 15 nt, Shigella flexneri 2a str. 301
uaaaugccaucaggg

SEQ ID NO: 3896397 - RNA, 18 nt, Shigella flexneri 2a str. 301
uaaaugccggaagcugca

SEQ ID NO: 3896398 - RNA, 18 nt, Shigella flexneri 2a str. 301
uaaaugcugcagccaggg

SEQ ID NO: 3896399 - RNA, 17 nt, Shigella flexneri 2a str. 301
uaaauggcgaacgggau

SEQ ID NO: 3896400 - RNA, 15 nt, Shigella flexneri 2a str. 301
uaaaugguuaacaug

SEQ ID NO: 3896401 - RNA, 21 nt, Shigella flexneri 2a str. 301
uaaauguguuuuuauuugauu

SEQ ID NO: 3896402 - RNA, 14 nt, Shigella flexneri 2a str. 301
uaaauguuaagacu

SEQ ID NO: 3896403 - RNA, 15 nt, Shigella flexneri 2a str. 301
uaaauuacccuuuau

SEQ ID NO: 3896404 - RNA, 18 nt, Shigella flexneri 2a str. 301
uaaauuacugccgcuguu

SEQ ID NO: 3896405 - RNA, 23 nt, Shigella flexneri 2a str. 301
uaaauucaauaaccuucggauug

SEQ ID NO: 3896406 - RNA, 21 nt, Shigella flexneri 2a str. 301
uaaauucaaugaauuaaaaaa

SEQ ID NO: 3896407 - RNA, 13 nt, Shigella flexneri 2a str. 301
uaaauuccacgcg

SEQ ID NO: 3896408 - RNA, 17 nt, Shigella flexneri 2a str. 301
uaaauucucaauaucau

SEQ ID NO: 3896409 - RNA, 21 nt, Shigella flexneri 2a str. 301
uaaauugcaaaccucaggaau

SEQ ID NO: 3896410 - RNA, 15 nt, Shigella flexneri 2a str. 301
uaaauugcagcacac

SEQ ID NO: 3896411 - RNA, 15 nt, Shigella flexneri 2a str. 301
uaaauugcagcgauu

SEQ ID NO: 3896412 - RNA, 17 nt, Shigella flexneri 2a str. 301
uaaauugcgauucaccg

SEQ ID NO: 3896413 - RNA, 20 nt, Shigella flexneri 2a str. 301
uaaauugcguaaagccugcu

SEQ ID NO: 3896414 - RNA, 17 nt, Shigella flexneri 2a str. 301
uaaauuuaaaacugccu

SEQ ID NO: 3896415 - RNA, 14 nt, Shigella flexneri 2a str. 301
uaaauuuaauaaua

SEQ ID NO: 3896416 - RNA, 17 nt, Shigella flexneri 2a str. 301
uaaauuuaucaaugcau

SEQ ID NO: 3896417 - RNA, 21 nt, Shigella flexneri 2a str. 301
uaaauuucacugcuuaauauu

SEQ ID NO: 3896418 - RNA, 14 nt, Shigella flexneri 2a str. 301
uaaauuucccacuc

SEQ ID NO: 3896419 - RNA, 13 nt, Shigella flexneri 2a str. 301
uaaauuucugcca

SEQ ID NO: 3896420 - RNA, 14 nt, Shigella flexneri 2a str. 301
uaacaaaaaacaaa

SEQ ID NO: 3896421 - RNA, 22 nt, Shigella flexneri 2a str. 301
uaacaaaacaaugggaaaacag

SEQ ID NO: 3896422 - RNA, 21 nt, Shigella flexneri 2a str. 301
uaacaaaaucgugaaaaauca

SEQ ID NO: 3896423 - RNA, 19 nt, Shigella flexneri 2a str. 301
uaacaaaugugccauuaau

SEQ ID NO: 3896424 - RNA, 13 nt, Shigella flexneri 2a str. 301
uaacaaccggagu

SEQ ID NO: 3896425 - RNA, 22 nt, Shigella flexneri 2a str. 301
uaacaacuggcggucaugacga

SEQ ID NO: 3896426 - RNA, 16 nt, Shigella flexneri 2a str. 301
uaacaauacgcccacg

SEQ ID NO: 3896427 - RNA, 19 nt, Shigella flexneri 2a str. 301
uaacaauagcgaacagaca

SEQ ID NO: 3896428 - RNA, 23 nt, Shigella flexneri 2a str. 301
uaacaauagcgaacagacaaaaa

SEQ ID NO: 3896429 - RNA, 20 nt, Shigella flexneri 2a str. 301
uaacaauucccgauagucuu

SEQ ID NO: 3896430 - RNA, 14 nt, Shigella flexneri 2a str. 301
uaacaauuuaucag

SEQ ID NO: 3896431 - RNA, 17 nt, Shigella flexneri 2a str. 301
uaacgcguuuucaccga

SEQ ID NO: 3896432 - RNA, 18 nt, Shigella flexneri 2a str. 301
uaacgcuggcagcaagug

SEQ ID NO: 3896433 - RNA, 13 nt, Shigella flexneri 2a str. 301
uaacgcuggggau

SEQ ID NO: 3896434 - RNA, 16 nt, Shigella flexneri 2a str. 301
uaacgcuucucccagc

SEQ ID NO: 3896435 - RNA, 21 nt, Shigella flexneri 2a str. 301
uaacggaggacuuauggcugg

SEQ ID NO: 3896436 - RNA, 20 nt, Shigella flexneri 2a str. 301
uaacggcagcaaggcuauuc

SEQ ID NO: 3896437 - RNA, 14 nt, Shigella flexneri 2a str. 301
uaacggccugacca

SEQ ID NO: 3896438 - RNA, 21 nt, Shigella flexneri 2a str. 301
uaacggcuggccacaaaccuu

SEQ ID NO: 3896439 - RNA, 22 nt, Shigella flexneri 2a str. 301
uaacggcuggccacaaaccuua

SEQ ID NO: 3896440 - RNA, 17 nt, Shigella flexneri 2a str. 301
uaacgguaucuuuccag

SEQ ID NO: 3896441 - RNA, 19 nt, Shigella flexneri 2a str. 301
uaacggucgguuagaacaa

SEQ ID NO: 3896442 - RNA, 20 nt, Shigella flexneri 2a str. 301
uaacggugcaacccgccagg

SEQ ID NO: 3896443 - RNA, 18 nt, Shigella flexneri 2a str. 301
uaacgguguaaugccagu

SEQ ID NO: 3896444 - RNA, 13 nt, Shigella flexneri 2a str. 301
uaacguaaugcuu

SEQ ID NO: 3896445 - RNA, 15 nt, Shigella flexneri 2a str. 301
uaacgucaccauccc

SEQ ID NO: 3896446 - RNA, 23 nt, Shigella flexneri 2a str. 301
uaacguggugaaagcauagcucg

SEQ ID NO: 3896447 - RNA, 18 nt, Shigella flexneri 2a str. 301
uaacgugucauaacuggu

SEQ ID NO: 3896448 - RNA, 15 nt, Shigella flexneri 2a str. 301
uaacguuauauccca

SEQ ID NO: 3896449 - RNA, 19 nt, Shigella flexneri 2a str. 301
uaacguugaaccgccccac

SEQ ID NO: 3896450 - RNA, 20 nt, Shigella flexneri 2a str. 301
uaacguuucuuucaucaggu

SEQ ID NO: 3896451 - RNA, 22 nt, Shigella flexneri 2a str. 301
uaacguuuuuucgucaguucau

SEQ ID NO: 3896452 - RNA, 22 nt, Shigella flexneri 2a str. 301
uaacuacccaaccgauaaccac

SEQ ID NO: 3896453 - RNA, 20 nt, Shigella flexneri 2a str. 301
uaacuauaaccguaauaguu

SEQ ID NO: 3896454 - RNA, 20 nt, Shigella flexneri 2a str. 301
uaacucaaaaauaaucaucu

SEQ ID NO: 3896455 - RNA, 19 nt, Shigella flexneri 2a str. 301
uaacucacccaugaagaau

SEQ ID NO: 3896456 - RNA, 15 nt, Shigella flexneri 2a str. 301
uaacucagcauuauu

SEQ ID NO: 3896457 - RNA, 19 nt, Shigella flexneri 2a str. 301
uaacuccccgagaaauacu

SEQ ID NO: 3896458 - RNA, 23 nt, Shigella flexneri 2a str. 301
uaacuccuucuaaagcaacucca

SEQ ID NO: 3896459 - RNA, 20 nt, Shigella flexneri 2a str. 301
uaacucucuuuugcuugaca

SEQ ID NO: 3896460 - RNA, 14 nt, Shigella flexneri 2a str. 301
uaacucuuucaaug

SEQ ID NO: 3896461 - RNA, 20 nt, Shigella flexneri 2a str. 301
uaacucuuucaaugcuuuuu

SEQ ID NO: 3896462 - RNA, 19 nt, Shigella flexneri 2a str. 301
uaacucuuugaugaaacau

SEQ ID NO: 3896463 - RNA, 17 nt, Shigella flexneri 2a str. 301
uaacugacuuccgcuag

SEQ ID NO: 3896464 - RNA, 22 nt, Shigella flexneri 2a str. 301
uaacugauggcaaaugcagcau

SEQ ID NO: 3896465 - RNA, 17 nt, Shigella flexneri 2a str. 301
uaacugccggaugcggc

SEQ ID NO: 3896466 - RNA, 18 nt, Shigella flexneri 2a str. 301
uaacugcuauucaccagc

SEQ ID NO: 3896467 - RNA, 14 nt, Shigella flexneri 2a str. 301
uaacugcugcucaa

SEQ ID NO: 3896468 - RNA, 15 nt, Shigella flexneri 2a str. 301
uaacugcugcucaau

SEQ ID NO: 3896469 - RNA, 17 nt, Shigella flexneri 2a str. 301
uaacuggcgggcuuuuu

SEQ ID NO: 3896470 - RNA, 13 nt, Shigella flexneri 2a str. 301
uaacugugccaaa

SEQ ID NO: 3896471 - RNA, 19 nt, Shigella flexneri 2a str. 301
uaacuguggcguuauggca

SEQ ID NO: 3896472 - RNA, 17 nt, Shigella flexneri 2a str. 301
uaacuuaauaaacauca

SEQ ID NO: 3896473 - RNA, 16 nt, Shigella flexneri 2a str. 301
uaacuuacgcgucaga

SEQ ID NO: 3896474 - RNA, 12 nt, Shigella flexneri 2a str. 301
uaacuucaucag

SEQ ID NO: 3896475 - RNA, 22 nt, Shigella flexneri 2a str. 301
uaacuucuuuacuggcuuucau

SEQ ID NO: 3896476 - RNA, 21 nt, Shigella flexneri 2a str. 301
uaacuuuaauuuugugcagca

SEQ ID NO: 3896477 - RNA, 13 nt, Shigella flexneri 2a str. 301
uaacuuuacucuu

SEQ ID NO: 3896478 - RNA, 21 nt, Shigella flexneri 2a str. 301
uaagaacuccagcccggaaga

SEQ ID NO: 3896479 - RNA, 20 nt, Shigella flexneri 2a str. 301
uaagaacuccugaaagcgaa

SEQ ID NO: 3896480 - RNA, 17 nt, Shigella flexneri 2a str. 301
uaagaagccuuuaucug

SEQ ID NO: 3896481 - RNA, 16 nt, Shigella flexneri 2a str. 301
uaagaagggcuggcca

SEQ ID NO: 3896482 - RNA, 17 nt, Shigella flexneri 2a str. 301
uaagaaugcgaaaacga

SEQ ID NO: 3896483 - RNA, 22 nt, Shigella flexneri 2a str. 301
uaagaauguccauuauuucaau

SEQ ID NO: 3896484 - RNA, 17 nt, Shigella flexneri 2a str. 301
uaagaauugauaaaaaa

SEQ ID NO: 3896485 - RNA, 18 nt, Shigella flexneri 2a str. 301
uaagaauugauaaaaaaa

SEQ ID NO: 3896486 - RNA, 14 nt, Shigella flexneri 2a str. 301
uaagacaauugaug

SEQ ID NO: 3896487 - RNA, 21 nt, Shigella flexneri 2a str. 301
uaagacagcgucacaucaggc

SEQ ID NO: 3896488 - RNA, 15 nt, Shigella flexneri 2a str. 301
uaagacgcgaccggc

SEQ ID NO: 3896489 - RNA, 22 nt, Shigella flexneri 2a str. 301
uaagacgcgcagcgucgcauca

SEQ ID NO: 3896490 - RNA, 16 nt, Shigella flexneri 2a str. 301
uaagacgcgccagcgu

SEQ ID NO: 3896491 - RNA, 22 nt, Shigella flexneri 2a str. 301
uaagacgcguuagcaucgcauc

SEQ ID NO: 3896492 - RNA, 18 nt, Shigella flexneri 2a str. 301
uaagacuggcaaaugaca

SEQ ID NO: 3896493 - RNA, 23 nt, Shigella flexneri 2a str. 301
uaagacuuuuuucaugggugcca

SEQ ID NO: 3896494 - RNA, 14 nt, Shigella flexneri 2a str. 301
uaagagcuggcauc

SEQ ID NO: 3896495 - RNA, 22 nt, Shigella flexneri 2a str. 301
uaagaggaauugauucaucaag

SEQ ID NO: 3896496 - RNA, 17 nt, Shigella flexneri 2a str. 301
uaagaguucuacuccag

SEQ ID NO: 3896497 - RNA, 23 nt, Shigella flexneri 2a str. 301
uaagauaaauuccugcuuauugu

SEQ ID NO: 3896498 - RNA, 19 nt, Shigella flexneri 2a str. 301
uaagauaccccagcgcaag

SEQ ID NO: 3896499 - RNA, 18 nt, Shigella flexneri 2a str. 301
uaagaucaucggccagau

SEQ ID NO: 3896500 - RNA, 19 nt, Shigella flexneri 2a str. 301
uaagaucgacggcuuuuag

SEQ ID NO: 3896501 - RNA, 18 nt, Shigella flexneri 2a str. 301
uaagaucgguugcgauau

SEQ ID NO: 3896502 - RNA, 17 nt, Shigella flexneri 2a str. 301
uaagaugcgaguaaaca

SEQ ID NO: 3896503 - RNA, 15 nt, Shigella flexneri 2a str. 301
uaagaugcuacaaca

SEQ ID NO: 3896504 - RNA, 20 nt, Shigella flexneri 2a str. 301
uaagaugcuacaacaucgua

SEQ ID NO: 3896505 - RNA, 16 nt, Shigella flexneri 2a str. 301
uaagaugguuauccag

SEQ ID NO: 3896506 - RNA, 18 nt, Shigella flexneri 2a str. 301
uaagaugguuauccagcu

SEQ ID NO: 3896507 - RNA, 20 nt, Shigella flexneri 2a str. 301
uaagcacuacucuauacagg

SEQ ID NO: 3896508 - RNA, 18 nt, Shigella flexneri 2a str. 301
uaagcaggcuggcuacga

SEQ ID NO: 3896509 - RNA, 17 nt, Shigella flexneri 2a str. 301
uaagcaguccagcgccu

SEQ ID NO: 3896510 - RNA, 16 nt, Shigella flexneri 2a str. 301
uaagcaugaauaucaa

SEQ ID NO: 3896511 - RNA, 20 nt, Shigella flexneri 2a str. 301
uaagccaaauccagcgccac

SEQ ID NO: 3896512 - RNA, 23 nt, Shigella flexneri 2a str. 301
uaagccaagcgccgccucagcca

SEQ ID NO: 3896513 - RNA, 22 nt, Shigella flexneri 2a str. 301
uaagccagaccacccguaaucc

SEQ ID NO: 3896514 - RNA, 23 nt, Shigella flexneri 2a str. 301
uaagccagaccacccguaauccc

SEQ ID NO: 3896515 - RNA, 13 nt, Shigella flexneri 2a str. 301
uaagcccaguuca

SEQ ID NO: 3896516 - RNA, 19 nt, Shigella flexneri 2a str. 301
uaagcccgguccgcgcagc

SEQ ID NO: 3896517 - RNA, 13 nt, Shigella flexneri 2a str. 301
uaagccgucccua

SEQ ID NO: 3896518 - RNA, 15 nt, Shigella flexneri 2a str. 301
uaagccuuccgcuga

SEQ ID NO: 3896519 - RNA, 23 nt, Shigella flexneri 2a str. 301
uaagccuuccgcugacagcgcgu

SEQ ID NO: 3896520 - RNA, 14 nt, Shigella flexneri 2a str. 301
uaagccuuucagga

SEQ ID NO: 3896521 - RNA, 24 nt, Shigella flexneri 2a str. 301
uaagcgacgggcgacaaacgcugu

SEQ ID NO: 3896522 - RNA, 18 nt, Shigella flexneri 2a str. 301
uaagcgauaacgcuggca

SEQ ID NO: 3896523 - RNA, 14 nt, Shigella flexneri 2a str. 301
uaagcgcaaaggcc

SEQ ID NO: 3896524 - RNA, 22 nt, Shigella flexneri 2a str. 301
uaagcgcacuuugucaucaguc

SEQ ID NO: 3896525 - RNA, 17 nt, Shigella flexneri 2a str. 301
uaagcgcgcuagccugu

SEQ ID NO: 3896526 - RNA, 21 nt, Shigella flexneri 2a str. 301
uaagcguaaaaccucacgcau

SEQ ID NO: 3896527 - RNA, 17 nt, Shigella flexneri 2a str. 301
uaagcuggguaaaugca

SEQ ID NO: 3896528 - RNA, 22 nt, Shigella flexneri 2a str. 301
uaagcugucacguuuugugaug

SEQ ID NO: 3896529 - RNA, 20 nt, Shigella flexneri 2a str. 301
uaagcuuuccggcaucacau

SEQ ID NO: 3896530 - RNA, 17 nt, Shigella flexneri 2a str. 301
uaauccacuuucuuaaa

SEQ ID NO: 3896531 - RNA, 15 nt, Shigella flexneri 2a str. 301
uaauccccaaugacc

SEQ ID NO: 3896532 - RNA, 20 nt, Shigella flexneri 2a str. 301
uaauccccauaucaggcaca

SEQ ID NO: 3896533 - RNA, 20 nt, Shigella flexneri 2a str. 301
uaauccgcuguaauugccgc

SEQ ID NO: 3896534 - RNA, 15 nt, Shigella flexneri 2a str. 301
uaauccguaaagccc

SEQ ID NO: 3896535 - RNA, 18 nt, Shigella flexneri 2a str. 301
uaauccucuuugcuuccu

SEQ ID NO: 3896536 - RNA, 21 nt, Shigella flexneri 2a str. 301
uaauccucuuugcuuccugag

SEQ ID NO: 3896537 - RNA, 15 nt, Shigella flexneri 2a str. 301
uaauccuuucucaau

SEQ ID NO: 3896538 - RNA, 18 nt, Shigella flexneri 2a str. 301
uaaucgacaguugcugcg

SEQ ID NO: 3896539 - RNA, 13 nt, Shigella flexneri 2a str. 301
uaaucgcaauuac

SEQ ID NO: 3896540 - RNA, 16 nt, Shigella flexneri 2a str. 301
uaaucgcacaaaauca

SEQ ID NO: 3896541 - RNA, 17 nt, Shigella flexneri 2a str. 301
uaaucgcauugacgcca

SEQ ID NO: 3896542 - RNA, 20 nt, Shigella flexneri 2a str. 301
uaaucgcauugguuuuuugg

SEQ ID NO: 3896543 - RNA, 18 nt, Shigella flexneri 2a str. 301
uaaucgccagcaaaauca

SEQ ID NO: 3896544 - RNA, 21 nt, Shigella flexneri 2a str. 301
uaaucgccagcaaaaucacca

SEQ ID NO: 3896545 - RNA, 16 nt, Shigella flexneri 2a str. 301
uaaucgcccggauauc

SEQ ID NO: 3896546 - RNA, 16 nt, Shigella flexneri 2a str. 301
uaaucgcccucgccuu

SEQ ID NO: 3896547 - RNA, 19 nt, Shigella flexneri 2a str. 301
uaaucgccguauaauaucu

SEQ ID NO: 3896548 - RNA, 14 nt, Shigella flexneri 2a str. 301
uaaucgccuuaccc

SEQ ID NO: 3896549 - RNA, 15 nt, Shigella flexneri 2a str. 301
uaaucgcuucuucuu

SEQ ID NO: 3896550 - RNA, 14 nt, Shigella flexneri 2a str. 301
uaaucgcuuuauag

SEQ ID NO: 3896551 - RNA, 14 nt, Shigella flexneri 2a str. 301
uaaucgcuuucgga

SEQ ID NO: 3896552 - RNA, 16 nt, Shigella flexneri 2a str. 301
uaaucguaugcgcagu

SEQ ID NO: 3896553 - RNA, 23 nt, Shigella flexneri 2a str. 301
uaaucguccgauuaaaaacccug

SEQ ID NO: 3896554 - RNA, 14 nt, Shigella flexneri 2a str. 301
uaaucguugucuua

SEQ ID NO: 3896555 - RNA, 18 nt, Shigella flexneri 2a str. 301
uaaucuaccguuacggcu

SEQ ID NO: 3896556 - RNA, 15 nt, Shigella flexneri 2a str. 301
uaaucuauauuucug

SEQ ID NO: 3896557 - RNA, 13 nt, Shigella flexneri 2a str. 301
uaaucucgccuua

SEQ ID NO: 3896558 - RNA, 15 nt, Shigella flexneri 2a str. 301
uaaucucuacaccaa

SEQ ID NO: 3896559 - RNA, 12 nt, Shigella flexneri 2a str. 301
uaaucugccagc

SEQ ID NO: 3896560 - RNA, 22 nt, Shigella flexneri 2a str. 301
uaaucugguaucgaguggcgca

SEQ ID NO: 3896561 - RNA, 19 nt, Shigella flexneri 2a str. 301
uaaucuuagguaaugacuc

SEQ ID NO: 3896562 - RNA, 22 nt, Shigella flexneri 2a str. 301
uaaucuuccagaucaccgcaga

SEQ ID NO: 3896563 - RNA, 21 nt, Shigella flexneri 2a str. 301
uaaugaaucgucggaauggca

SEQ ID NO: 3896564 - RNA, 17 nt, Shigella flexneri 2a str. 301
uaaugaaugaugcggcg

SEQ ID NO: 3896565 - RNA, 20 nt, Shigella flexneri 2a str. 301
uaaugacaaaauugcuguua

SEQ ID NO: 3896566 - RNA, 21 nt, Shigella flexneri 2a str. 301
uaaugacccaccccagcagca

SEQ ID NO: 3896567 - RNA, 22 nt, Shigella flexneri 2a str. 301
uaaugacuccaacuuacugaua

SEQ ID NO: 3896568 - RNA, 21 nt, Shigella flexneri 2a str. 301
uaaugacuuuuggaccacgga

SEQ ID NO: 3896569 - RNA, 16 nt, Shigella flexneri 2a str. 301
uaaugagaauaaucac

SEQ ID NO: 3896570 - RNA, 19 nt, Shigella flexneri 2a str. 301
uaaugagaauaaucaccuu

SEQ ID NO: 3896571 - RNA, 22 nt, Shigella flexneri 2a str. 301
uaaugauacuauaaguguaaaa

SEQ ID NO: 3896572 - RNA, 18 nt, Shigella flexneri 2a str. 301
uaaugauuuaaaaccacu

SEQ ID NO: 3896573 - RNA, 15 nt, Shigella flexneri 2a str. 301
uaaugcaaaaugccg

SEQ ID NO: 3896574 - RNA, 19 nt, Shigella flexneri 2a str. 301
uaaugcagaucuuacggcu

SEQ ID NO: 3896575 - RNA, 19 nt, Shigella flexneri 2a str. 301
uaaugcaggcagcacugcu

SEQ ID NO: 3896576 - RNA, 21 nt, Shigella flexneri 2a str. 301
uaaugccagucaguuaagcaa

SEQ ID NO: 3896577 - RNA, 23 nt, Shigella flexneri 2a str. 301
uaaugcccaucucuucuucaagc

SEQ ID NO: 3896578 - RNA, 17 nt, Shigella flexneri 2a str. 301
uaaugcccgaugaccuu

SEQ ID NO: 3896579 - RNA, 21 nt, Shigella flexneri 2a str. 301
uaaugcccgaugaccuuguca

SEQ ID NO: 3896580 - RNA, 16 nt, Shigella flexneri 2a str. 301
uaaugccguuuggcaa

SEQ ID NO: 3896581 - RNA, 22 nt, Shigella flexneri 2a str. 301
uaaugccucuccccagcggaaa

SEQ ID NO: 3896582 - RNA, 19 nt, Shigella flexneri 2a str. 301
uaaugcgacaacagaaaua

SEQ ID NO: 3896583 - RNA, 17 nt, Shigella flexneri 2a str. 301
uaaugcgccaagcagcg

SEQ ID NO: 3896584 - RNA, 14 nt, Shigella flexneri 2a str. 301
uaaugcgcuuuuac

SEQ ID NO: 3896585 - RNA, 16 nt, Shigella flexneri 2a str. 301
uaaugcugucgguuua

SEQ ID NO: 3896586 - RNA, 18 nt, Shigella flexneri 2a str. 301
uaaugcuguuccagacca

SEQ ID NO: 3896587 - RNA, 23 nt, Shigella flexneri 2a str. 301
uaauggcaauacugacaucagca

SEQ ID NO: 3896588 - RNA, 19 nt, Shigella flexneri 2a str. 301
uaauggccuuuucgccacc

SEQ ID NO: 3896589 - RNA, 22 nt, Shigella flexneri 2a str. 301
uaauggcugcgggcgaccaauc

SEQ ID NO: 3896590 - RNA, 20 nt, Shigella flexneri 2a str. 301
uaaugucauaagcaucccuu

SEQ ID NO: 3896591 - RNA, 13 nt, Shigella flexneri 2a str. 301
uaauguggcuggg

SEQ ID NO: 3896592 - RNA, 14 nt, Shigella flexneri 2a str. 301
uaauguggcugggg

SEQ ID NO: 3896593 - RNA, 20 nt, Shigella flexneri 2a str. 301
uaaugugucugaaagcagac

SEQ ID NO: 3896594 - RNA, 17 nt, Shigella flexneri 2a str. 301
uaauguuaaccaucuca

SEQ ID NO: 3896595 - RNA, 14 nt, Shigella flexneri 2a str. 301
uaauguuuaucuac

SEQ ID NO: 3896596 - RNA, 14 nt, Shigella flexneri 2a str. 301
uaauuacacccuua

SEQ ID NO: 3896597 - RNA, 24 nt, Shigella flexneri 2a str. 301
uaauuaccuuaucaaucucagcaa

SEQ ID NO: 3896598 - RNA, 23 nt, Shigella flexneri 2a str. 301
uaauuacugccuuaaucaagaaa

SEQ ID NO: 3896599 - RNA, 18 nt, Shigella flexneri 2a str. 301
uaauuacugcuuaaaugc

SEQ ID NO: 3896600 - RNA, 12 nt, Shigella flexneri 2a str. 301
uaauuagcuguu

SEQ ID NO: 3896601 - RNA, 16 nt, Shigella flexneri 2a str. 301
uaauuaggauacuuau

SEQ ID NO: 3896602 - RNA, 17 nt, Shigella flexneri 2a str. 301
uaauuaggcuaaauaac

SEQ ID NO: 3896603 - RNA, 15 nt, Shigella flexneri 2a str. 301
uaauuauuaacaaaa

SEQ ID NO: 3896604 - RNA, 15 nt, Shigella flexneri 2a str. 301
uaauuauuauaauaa

SEQ ID NO: 3896605 - RNA, 15 nt, Shigella flexneri 2a str. 301
uaauucaaaaaccug

SEQ ID NO: 3896606 - RNA, 13 nt, Shigella flexneri 2a str. 301
uaauucauuugcu

SEQ ID NO: 3896607 - RNA, 21 nt, Shigella flexneri 2a str. 301
uaauucccugcgccagcggca

SEQ ID NO: 3896608 - RNA, 20 nt, Shigella flexneri 2a str. 301
uaauuccgggcguugauuaa

SEQ ID NO: 3896609 - RNA, 17 nt, Shigella flexneri 2a str. 301
uaauuccggugaaaggc

SEQ ID NO: 3896610 - RNA, 15 nt, Shigella flexneri 2a str. 301
uaauuccugcgcugc

SEQ ID NO: 3896611 - RNA, 14 nt, Shigella flexneri 2a str. 301
uaauugaaggcuua

SEQ ID NO: 3896612 - RNA, 19 nt, Shigella flexneri 2a str. 301
uaauugaccagaucuucau

SEQ ID NO: 3896613 - RNA, 23 nt, Shigella flexneri 2a str. 301
uaauugccagcuugcuuuccagc

SEQ ID NO: 3896614 - RNA, 16 nt, Shigella flexneri 2a str. 301
uaauugcgaugccagu

SEQ ID NO: 3896615 - RNA, 17 nt, Shigella flexneri 2a str. 301
uaauugcuccauccauu

SEQ ID NO: 3896616 - RNA, 18 nt, Shigella flexneri 2a str. 301
uaauugcuuuuuuccaua

SEQ ID NO: 3896617 - RNA, 22 nt, Shigella flexneri 2a str. 301
uaauuggaauacauauauuaca

SEQ ID NO: 3896618 - RNA, 18 nt, Shigella flexneri 2a str. 301
uaauuggaguaucaccau

SEQ ID NO: 3896619 - RNA, 19 nt, Shigella flexneri 2a str. 301
uaauuggaguaucaccauc

SEQ ID NO: 3896620 - RNA, 21 nt, Shigella flexneri 2a str. 301
uaauuuacagccugccagcau

SEQ ID NO: 3896621 - RNA, 20 nt, Shigella flexneri 2a str. 301
uaauuucacaccaucaacaa

SEQ ID NO: 3896622 - RNA, 13 nt, Shigella flexneri 2a str. 301
uaauuuccacgcc

SEQ ID NO: 3896623 - RNA, 23 nt, Shigella flexneri 2a str. 301
uaauuuccccaaaacguaaccau

SEQ ID NO: 3896624 - RNA, 15 nt, Shigella flexneri 2a str. 301
uaauuucgcuuucau

SEQ ID NO: 3896625 - RNA, 18 nt, Shigella flexneri 2a str. 301
uaauuucuucguucgcug

SEQ ID NO: 3896626 - RNA, 15 nt, Shigella flexneri 2a str. 301
uaauuucuuuucaua

SEQ ID NO: 3896627 - RNA, 19 nt, Shigella flexneri 2a str. 301
uaauuucuuuucauaauca

SEQ ID NO: 3896628 - RNA, 18 nt, Shigella flexneri 2a str. 301
uaauuuggcugagugaau

SEQ ID NO: 3896629 - RNA, 14 nt, Shigella flexneri 2a str. 301
uacauauuuuucau

SEQ ID NO: 3896630 - RNA, 18 nt, Shigella flexneri 2a str. 301
uacaucaccguucagcuu

SEQ ID NO: 3896631 - RNA, 12 nt, Shigella flexneri 2a str. 301
uacaucagcgac

SEQ ID NO: 3896632 - RNA, 17 nt, Shigella flexneri 2a str. 301
uacaucgcauaaaacaa

SEQ ID NO: 3896633 - RNA, 20 nt, Shigella flexneri 2a str. 301
uacaucgcgcuuaucgccag

SEQ ID NO: 3896634 - RNA, 14 nt, Shigella flexneri 2a str. 301
uacaucuacaaaaa

SEQ ID NO: 3896635 - RNA, 23 nt, Shigella flexneri 2a str. 301
uacaucuacaaaaaacuggccuc

SEQ ID NO: 3896636 - RNA, 14 nt, Shigella flexneri 2a str. 301
uacaucuuaaucuu

SEQ ID NO: 3896637 - RNA, 16 nt, Shigella flexneri 2a str. 301
uacaugaagcacugca

SEQ ID NO: 3896638 - RNA, 15 nt, Shigella flexneri 2a str. 301
uacauggugcacauu

SEQ ID NO: 3896639 - RNA, 23 nt, Shigella flexneri 2a str. 301
uacauguaaaaggcgcuaaaaau

SEQ ID NO: 3896640 - RNA, 17 nt, Shigella flexneri 2a str. 301
uacauguucaaaaaaau

SEQ ID NO: 3896641 - RNA, 22 nt, Shigella flexneri 2a str. 301
uacauuaaacgccguucuucag

SEQ ID NO: 3896642 - RNA, 16 nt, Shigella flexneri 2a str. 301
uacauuaguaauuucc

SEQ ID NO: 3896643 - RNA, 19 nt, Shigella flexneri 2a str. 301
uacauuaucgcgucuaaau

SEQ ID NO: 3896644 - RNA, 16 nt, Shigella flexneri 2a str. 301
uacauugagaauaucg

SEQ ID NO: 3896645 - RNA, 20 nt, Shigella flexneri 2a str. 301
uacauugauauacagcccgg

SEQ ID NO: 3896646 - RNA, 17 nt, Shigella flexneri 2a str. 301
uacauugccgacauggc

SEQ ID NO: 3896647 - RNA, 12 nt, Shigella flexneri 2a str. 301
uaccaaaccugc

SEQ ID NO: 3896648 - RNA, 14 nt, Shigella flexneri 2a str. 301
uaccaaaccugcac

SEQ ID NO: 3896649 - RNA, 14 nt, Shigella flexneri 2a str. 301
uaccaacauacugc

SEQ ID NO: 3896650 - RNA, 15 nt, Shigella flexneri 2a str. 301
uaccaauaaucaauu

SEQ ID NO: 3896651 - RNA, 22 nt, Shigella flexneri 2a str. 301
uaccaaucgcaauaccggcaaa

SEQ ID NO: 3896652 - RNA, 17 nt, Shigella flexneri 2a str. 301
uaccacaaugcaauaau

SEQ ID NO: 3896653 - RNA, 11 nt, Shigella flexneri 2a str. 301
uaccacaucaa

SEQ ID NO: 3896654 - RNA, 20 nt, Shigella flexneri 2a str. 301
uaccacaucaacccgcccag

SEQ ID NO: 3896655 - RNA, 23 nt, Shigella flexneri 2a str. 301
uaccaccaaugucgaaagcccca

SEQ ID NO: 3896656 - RNA, 13 nt, Shigella flexneri 2a str. 301
uaccaccagugcc

SEQ ID NO: 3896657 - RNA, 14 nt, Shigella flexneri 2a str. 301
uaccacccgcagug

SEQ ID NO: 3896658 - RNA, 21 nt, Shigella flexneri 2a str. 301
uaccaccuuacuuacacauca

SEQ ID NO: 3896659 - RNA, 22 nt, Shigella flexneri 2a str. 301
uaccaccuuacuuacacaucaa

SEQ ID NO: 3896660 - RNA, 15 nt, Shigella flexneri 2a str. 301
uaccacgauuuugac

SEQ ID NO: 3896661 - RNA, 16 nt, Shigella flexneri 2a str. 301
uaccacgcacagcccg

SEQ ID NO: 3896662 - RNA, 22 nt, Shigella flexneri 2a str. 301
uaccacgcacagcccgccgcca

SEQ ID NO: 3896663 - RNA, 19 nt, Shigella flexneri 2a str. 301
uaccacggaaaggcaacau

SEQ ID NO: 3896664 - RNA, 18 nt, Shigella flexneri 2a str. 301
uaccacggcauuuccgcc

SEQ ID NO: 3896665 - RNA, 19 nt, Shigella flexneri 2a str. 301
uaccacggguuucccaugc

SEQ ID NO: 3896666 - RNA, 19 nt, Shigella flexneri 2a str. 301
uaccacguugacaaacugc

SEQ ID NO: 3896667 - RNA, 16 nt, Shigella flexneri 2a str. 301
uaccacucucgggaag

SEQ ID NO: 3896668 - RNA, 15 nt, Shigella flexneri 2a str. 301
uaccagaaucaccuu

SEQ ID NO: 3896669 - RNA, 17 nt, Shigella flexneri 2a str. 301
uaccagaccgcacaccg

SEQ ID NO: 3896670 - RNA, 16 nt, Shigella flexneri 2a str. 301
uaccagauaaacaucg

SEQ ID NO: 3896671 - RNA, 21 nt, Shigella flexneri 2a str. 301
uaccagauaaucaccugccuu

SEQ ID NO: 3896672 - RNA, 22 nt, Shigella flexneri 2a str. 301
uaccagaugcucuuuucugaag

SEQ ID NO: 3896673 - RNA, 16 nt, Shigella flexneri 2a str. 301
uaccagauuaauuauu

SEQ ID NO: 3896674 - RNA, 19 nt, Shigella flexneri 2a str. 301
uaccagcaccugcuugaac

SEQ ID NO: 3896675 - RNA, 11 nt, Shigella flexneri 2a str. 301
uaccagccaga

SEQ ID NO: 3896676 - RNA, 22 nt, Shigella flexneri 2a str. 301
uaccagccccgaugccaucaug

SEQ ID NO: 3896677 - RNA, 14 nt, Shigella flexneri 2a str. 301
uaccagcccgucuc

SEQ ID NO: 3896678 - RNA, 20 nt, Shigella flexneri 2a str. 301
uaccagccuucuucauccag

SEQ ID NO: 3896679 - RNA, 20 nt, Shigella flexneri 2a str. 301
uaccagcgacaucaccgccg

SEQ ID NO: 3896680 - RNA, 14 nt, Shigella flexneri 2a str. 301
uaccagcgccgcca

SEQ ID NO: 3896681 - RNA, 23 nt, Shigella flexneri 2a str. 301
uaccaggauaggcuucuauacca

SEQ ID NO: 3896682 - RNA, 18 nt, Shigella flexneri 2a str. 301
uaccaggugugcgcggua

SEQ ID NO: 3896683 - RNA, 16 nt, Shigella flexneri 2a str. 301
uaccaguccuacacac

SEQ ID NO: 3896684 - RNA, 13 nt, Shigella flexneri 2a str. 301
uaccaguugauca

SEQ ID NO: 3896685 - RNA, 18 nt, Shigella flexneri 2a str. 301
uaccaucaauggaugaac

SEQ ID NO: 3896686 - RNA, 17 nt, Shigella flexneri 2a str. 301
uaccaucggcagcgcca

SEQ ID NO: 3896687 - RNA, 16 nt, Shigella flexneri 2a str. 301
uaccaucuucaccgcc

SEQ ID NO: 3896688 - RNA, 17 nt, Shigella flexneri 2a str. 301
uaccaugcgcaucaucg

SEQ ID NO: 3896689 - RNA, 15 nt, Shigella flexneri 2a str. 301
uaccauuaucaccaa

SEQ ID NO: 3896690 - RNA, 19 nt, Shigella flexneri 2a str. 301
uaccauugaagcaauccau

SEQ ID NO: 3896691 - RNA, 12 nt, Shigella flexneri 2a str. 301
uaccauuuguuc

SEQ ID NO: 3896692 - RNA, 14 nt, Shigella flexneri 2a str. 301
uacccaaaaaauag

SEQ ID NO: 3896693 - RNA, 15 nt, Shigella flexneri 2a str. 301
uacccaaacuuaaca

SEQ ID NO: 3896694 - RNA, 23 nt, Shigella flexneri 2a str. 301
uacccaaccgauaaccacgcuca

SEQ ID NO: 3896695 - RNA, 15 nt, Shigella flexneri 2a str. 301
uacccaaucccccac

SEQ ID NO: 3896696 - RNA, 12 nt, Shigella flexneri 2a str. 301
uacccagcagca

SEQ ID NO: 3896697 - RNA, 17 nt, Shigella flexneri 2a str. 301
uacccagcagcagcggu

SEQ ID NO: 3896698 - RNA, 19 nt, Shigella flexneri 2a str. 301
uacccagcguguugaggaa

SEQ ID NO: 3896699 - RNA, 22 nt, Shigella flexneri 2a str. 301
uacccagcguguugaggaagcg

SEQ ID NO: 3896700 - RNA, 16 nt, Shigella flexneri 2a str. 301
uacccaguauguaacu

SEQ ID NO: 3896701 - RNA, 15 nt, Shigella flexneri 2a str. 301
uacccauauuuaauc

SEQ ID NO: 3896702 - RNA, 15 nt, Shigella flexneri 2a str. 301
uaccccaucagcgua

SEQ ID NO: 3896703 - RNA, 19 nt, Shigella flexneri 2a str. 301
uaccccucuauccagcuca

SEQ ID NO: 3896704 - RNA, 14 nt, Shigella flexneri 2a str. 301
uaccccugauuuug

SEQ ID NO: 3896705 - RNA, 18 nt, Shigella flexneri 2a str. 301
uacccgcuaacugguggc

SEQ ID NO: 3896706 - RNA, 21 nt, Shigella flexneri 2a str. 301
uacccgcucgaaguuuuccuc

SEQ ID NO: 3896707 - RNA, 22 nt, Shigella flexneri 2a str. 301
uacccgcugcugacuuugacau

SEQ ID NO: 3896708 - RNA, 21 nt, Shigella flexneri 2a str. 301
uacccgcuggcguaccaucuu

SEQ ID NO: 3896709 - RNA, 17 nt, Shigella flexneri 2a str. 301
uacccguccagauauag

SEQ ID NO: 3896710 - RNA, 17 nt, Shigella flexneri 2a str. 301
uacccguugguuugaua

SEQ ID NO: 3896711 - RNA, 14 nt, Shigella flexneri 2a str. 301
uacccugaaucaau

SEQ ID NO: 3896712 - RNA, 18 nt, Shigella flexneri 2a str. 301
uacccugaaucaaucaga

SEQ ID NO: 3896713 - RNA, 22 nt, Shigella flexneri 2a str. 301
uacccugaaucaaucagagcca

SEQ ID NO: 3896714 - RNA, 13 nt, Shigella flexneri 2a str. 301
uacccugacccag

SEQ ID NO: 3896715 - RNA, 19 nt, Shigella flexneri 2a str. 301
uacccuuaacucuuccuga

SEQ ID NO: 3896716 - RNA, 17 nt, Shigella flexneri 2a str. 301
uacccuucgucaaucag

SEQ ID NO: 3896717 - RNA, 17 nt, Shigella flexneri 2a str. 301
uaccgaagaguaaccaa

SEQ ID NO: 3896718 - RNA, 24 nt, Shigella flexneri 2a str. 301
uaccgaauccaguaagcugugcga

SEQ ID NO: 3896719 - RNA, 15 nt, Shigella flexneri 2a str. 301
uaccgaucaccgaug

SEQ ID NO: 3896720 - RNA, 14 nt, Shigella flexneri 2a str. 301
uaccgauccccgga

SEQ ID NO: 3896721 - RNA, 19 nt, Shigella flexneri 2a str. 301
uaccgcaccaccagcagcu

SEQ ID NO: 3896722 - RNA, 19 nt, Shigella flexneri 2a str. 301
uaccgcaccuuccggaaua

SEQ ID NO: 3896723 - RNA, 12 nt, Shigella flexneri 2a str. 301
uaccgcaucagc

SEQ ID NO: 3896724 - RNA, 17 nt, Shigella flexneri 2a str. 301
uaccgccacagcagccu

SEQ ID NO: 3896725 - RNA, 18 nt, Shigella flexneri 2a str. 301
uaccgcccaccaccagcg

SEQ ID NO: 3896726 - RNA, 20 nt, Shigella flexneri 2a str. 301
uaccgccgaucucaccgauc

SEQ ID NO: 3896727 - RNA, 13 nt, Shigella flexneri 2a str. 301
uaccgccgcacaa

SEQ ID NO: 3896728 - RNA, 16 nt, Shigella flexneri 2a str. 301
uaccgccucgcggcag

SEQ ID NO: 3896729 - RNA, 18 nt, Shigella flexneri 2a str. 301
uacgguucgggcacagau

SEQ ID NO: 3896730 - RNA, 20 nt, Shigella flexneri 2a str. 301
uacgguuuucucgccaccgg

SEQ ID NO: 3896731 - RNA, 17 nt, Shigella flexneri 2a str. 301
uacgguuuuuugaacag

SEQ ID NO: 3896732 - RNA, 15 nt, Shigella flexneri 2a str. 301
uacguaacccaccac

SEQ ID NO: 3896733 - RNA, 17 nt, Shigella flexneri 2a str. 301
uacguaaugcucauucu

SEQ ID NO: 3896734 - RNA, 19 nt, Shigella flexneri 2a str. 301
uacguaccacgcacagccc

SEQ ID NO: 3896735 - RNA, 13 nt, Shigella flexneri 2a str. 301
uacgucacuucau

SEQ ID NO: 3896736 - RNA, 22 nt, Shigella flexneri 2a str. 301
uacgucacuucaucgucauaau

SEQ ID NO: 3896737 - RNA, 15 nt, Shigella flexneri 2a str. 301
uacguguuguuccag

SEQ ID NO: 3896738 - RNA, 12 nt, Shigella flexneri 2a str. 301
uacguucuuaca

SEQ ID NO: 3896739 - RNA, 22 nt, Shigella flexneri 2a str. 301
uacguugcauuuccauaaauug

SEQ ID NO: 3896740 - RNA, 18 nt, Shigella flexneri 2a str. 301
uacguuucgccugcaaau

SEQ ID NO: 3896741 - RNA, 22 nt, Shigella flexneri 2a str. 301
uacuaagaguucuacuccaguu

SEQ ID NO: 3896742 - RNA, 14 nt, Shigella flexneri 2a str. 301
uacuaauaaaucgu

SEQ ID NO: 3896743 - RNA, 21 nt, Shigella flexneri 2a str. 301
uacuaaucucacccauagaua

SEQ ID NO: 3896744 - RNA, 16 nt, Shigella flexneri 2a str. 301
uacuacguaauuucaa

SEQ ID NO: 3896745 - RNA, 12 nt, Shigella flexneri 2a str. 301
uacuacguucaa

SEQ ID NO: 3896746 - RNA, 20 nt, Shigella flexneri 2a str. 301
uacuacguucaaucaccgca

SEQ ID NO: 3896747 - RNA, 21 nt, Shigella flexneri 2a str. 301
uacuauaaguguaaaauucua

SEQ ID NO: 3896748 - RNA, 16 nt, Shigella flexneri 2a str. 301
uacuaugauuuuccug

SEQ ID NO: 3896749 - RNA, 12 nt, Shigella flexneri 2a str. 301
uacucaacuccc

SEQ ID NO: 3896750 - RNA, 18 nt, Shigella flexneri 2a str. 301
uacucaagagucgguaga

SEQ ID NO: 3896751 - RNA, 16 nt, Shigella flexneri 2a str. 301
uacucaccagacaucc

SEQ ID NO: 3896752 - RNA, 14 nt, Shigella flexneri 2a str. 301
uacucagcgccugc

SEQ ID NO: 3896753 - RNA, 13 nt, Shigella flexneri 2a str. 301
uacuccaguuccg

SEQ ID NO: 3896754 - RNA, 22 nt, Shigella flexneri 2a str. 301
uacuccaugaguaacagucagu

SEQ ID NO: 3896755 - RNA, 17 nt, Shigella flexneri 2a str. 301
uacuccccuuucuuauu

SEQ ID NO: 3896756 - RNA, 18 nt, Shigella flexneri 2a str. 301
uacucccgcuucagccgu

SEQ ID NO: 3896757 - RNA, 17 nt, Shigella flexneri 2a str. 301
uacuccugcucgccgau

SEQ ID NO: 3896758 - RNA, 19 nt, Shigella flexneri 2a str. 301
uacuccugguaucuuuaca

SEQ ID NO: 3896759 - RNA, 20 nt, Shigella flexneri 2a str. 301
uacuccuuagcaacaggcca

SEQ ID NO: 3896760 - RNA, 20 nt, Shigella flexneri 2a str. 301
uacucguuuauuaugccaca

SEQ ID NO: 3896761 - RNA, 23 nt, Shigella flexneri 2a str. 301
uacucuccugcggcgacaaaugu

SEQ ID NO: 3896762 - RNA, 13 nt, Shigella flexneri 2a str. 301
uacucugacccag

SEQ ID NO: 3896763 - RNA, 15 nt, Shigella flexneri 2a str. 301
uacucugucugaucu

SEQ ID NO: 3896764 - RNA, 18 nt, Shigella flexneri 2a str. 301
uacucuugugccaguuca

SEQ ID NO: 3896765 - RNA, 13 nt, Shigella flexneri 2a str. 301
uacucuuuccauu

SEQ ID NO: 3896766 - RNA, 21 nt, Shigella flexneri 2a str. 301
uacucuuucccggcaaucacc

SEQ ID NO: 3896767 - RNA, 23 nt, Shigella flexneri 2a str. 301
uacucuuucccggcaaucaccgc

SEQ ID NO: 3896768 - RNA, 16 nt, Shigella flexneri 2a str. 301
uacucuuugacaacau

SEQ ID NO: 3896769 - RNA, 21 nt, Shigella flexneri 2a str. 301
uacucuuugacaacaucaucu

SEQ ID NO: 3896770 - RNA, 13 nt, Shigella flexneri 2a str. 301
uacugaaaccuga

SEQ ID NO: 3896771 - RNA, 19 nt, Shigella flexneri 2a str. 301
uacugaaaguggaaaaaua

SEQ ID NO: 3896772 - RNA, 18 nt, Shigella flexneri 2a str. 301
uacugaaggcgcauugcu

SEQ ID NO: 3896773 - RNA, 13 nt, Shigella flexneri 2a str. 301
uacugaaucccug

SEQ ID NO: 3896774 - RNA, 17 nt, Shigella flexneri 2a str. 301
uacugaaucccugcgaa

SEQ ID NO: 3896775 - RNA, 19 nt, Shigella flexneri 2a str. 301
uacugaauguaugagguuu

SEQ ID NO: 3896776 - RNA, 15 nt, Shigella flexneri 2a str. 301
uacugacaauuugcc

SEQ ID NO: 3896777 - RNA, 21 nt, Shigella flexneri 2a str. 301
uacugaccccaaaaaguugga

SEQ ID NO: 3896778 - RNA, 21 nt, Shigella flexneri 2a str. 301
uacugaccgucgccuucaacg

SEQ ID NO: 3896779 - RNA, 14 nt, Shigella flexneri 2a str. 301
uacugacuggcaag

SEQ ID NO: 3896780 - RNA, 13 nt, Shigella flexneri 2a str. 301
uacugagagaaaa

SEQ ID NO: 3896781 - RNA, 14 nt, Shigella flexneri 2a str. 301
uacugagagaaaaa

SEQ ID NO: 3896782 - RNA, 15 nt, Shigella flexneri 2a str. 301
uacugauaacuucac

SEQ ID NO: 3896783 - RNA, 20 nt, Shigella flexneri 2a str. 301
uacugauaauuuuuucacua

SEQ ID NO: 3896784 - RNA, 13 nt, Shigella flexneri 2a str. 301
uacugaucaucau

SEQ ID NO: 3896785 - RNA, 14 nt, Shigella flexneri 2a str. 301
uacugaugaauaaa

SEQ ID NO: 3896786 - RNA, 15 nt, Shigella flexneri 2a str. 301
uacugaugaauaaau

SEQ ID NO: 3896787 - RNA, 18 nt, Shigella flexneri 2a str. 301
uacugauggcuacguucu

SEQ ID NO: 3896788 - RNA, 22 nt, Shigella flexneri 2a str. 301
uacugauugacgcguucgcuaa

SEQ ID NO: 3896789 - RNA, 13 nt, Shigella flexneri 2a str. 301
uacugauuuuauu

SEQ ID NO: 3896790 - RNA, 13 nt, Shigella flexneri 2a str. 301
uacugcagccagc

SEQ ID NO: 3896791 - RNA, 17 nt, Shigella flexneri 2a str. 301
uacugccccggagaaau

SEQ ID NO: 3896792 - RNA, 14 nt, Shigella flexneri 2a str. 301
uacugcccgcuugc

SEQ ID NO: 3896793 - RNA, 22 nt, Shigella flexneri 2a str. 301
uacugcugaaugaggcuuuaau

SEQ ID NO: 3896794 - RNA, 20 nt, Shigella flexneri 2a str. 301
uacugcuuuguucacgcguc

SEQ ID NO: 3896795 - RNA, 23 nt, Shigella flexneri 2a str. 301
uacuggauagauauucuccagcu

SEQ ID NO: 3896796 - RNA, 14 nt, Shigella flexneri 2a str. 301
uacuggauggaggg

SEQ ID NO: 3896797 - RNA, 23 nt, Shigella flexneri 2a str. 301
uacuggauggagggaaauuaaau

SEQ ID NO: 3896798 - RNA, 11 nt, Shigella flexneri 2a str. 301
uacuggcaaua

SEQ ID NO: 3896799 - RNA, 22 nt, Shigella flexneri 2a str. 301
uacuggcaaucgccagcggcag

SEQ ID NO: 3896800 - RNA, 16 nt, Shigella flexneri 2a str. 301
uacugggcggcaaaau

SEQ ID NO: 3896801 - RNA, 18 nt, Shigella flexneri 2a str. 301
uacuggugcaaaaccugg

SEQ ID NO: 3896802 - RNA, 23 nt, Shigella flexneri 2a str. 301
uacuguauacgggcuuuuuaauu

SEQ ID NO: 3896803 - RNA, 23 nt, Shigella flexneri 2a str. 301
uacugucacggugcgcguugcuu

SEQ ID NO: 3896804 - RNA, 13 nt, Shigella flexneri 2a str. 301
uacugucugcuuc

SEQ ID NO: 3896805 - RNA, 20 nt, Shigella flexneri 2a str. 301
uacuguuuaucuucccagcg

SEQ ID NO: 3896806 - RNA, 14 nt, Shigella flexneri 2a str. 301
uacuuauaaaccac

SEQ ID NO: 3896807 - RNA, 15 nt, Shigella flexneri 2a str. 301
uacuuauaaaccacg

SEQ ID NO: 3896808 - RNA, 15 nt, Shigella flexneri 2a str. 301
uacuucaacacauaa

SEQ ID NO: 3896809 - RNA, 13 nt, Shigella flexneri 2a str. 301
uacuucaccaguu

SEQ ID NO: 3896810 - RNA, 14 nt, Shigella flexneri 2a str. 301
uacuucaccuucuu

SEQ ID NO: 3896811 - RNA, 21 nt, Shigella flexneri 2a str. 301
uacuucaccuucuuuacugcc

SEQ ID NO: 3896812 - RNA, 20 nt, Shigella flexneri 2a str. 301
uacuucagacggucagcgag

SEQ ID NO: 3896813 - RNA, 21 nt, Shigella flexneri 2a str. 301
uacuucagacggucagcgaga

SEQ ID NO: 3896814 - RNA, 12 nt, Shigella flexneri 2a str. 301
uacuucagcaag

SEQ ID NO: 3896815 - RNA, 20 nt, Shigella flexneri 2a str. 301
uacuuccccggcagugcuuu

SEQ ID NO: 3896816 - RNA, 17 nt, Shigella flexneri 2a str. 301
uacuuccgcuuccagcu

SEQ ID NO: 3896817 - RNA, 16 nt, Shigella flexneri 2a str. 301
uacuuccgggaaaacc

SEQ ID NO: 3896818 - RNA, 21 nt, Shigella flexneri 2a str. 301
uacuucucaccgguaaaguca

SEQ ID NO: 3896819 - RNA, 15 nt, Shigella flexneri 2a str. 301
uacuucugaccagga

SEQ ID NO: 3896820 - RNA, 23 nt, Shigella flexneri 2a str. 301
uacuucuucaugccaaaagggag

SEQ ID NO: 3896821 - RNA, 16 nt, Shigella flexneri 2a str. 301
uacuugcaagaucgcg

SEQ ID NO: 3896822 - RNA, 17 nt, Shigella flexneri 2a str. 301
uacuuucacaaaaauaa

SEQ ID NO: 3896823 - RNA, 12 nt, Shigella flexneri 2a str. 301
uacuuucaucaa

SEQ ID NO: 3896824 - RNA, 16 nt, Shigella flexneri 2a str. 301
uacuuuccagccacag

SEQ ID NO: 3896825 - RNA, 15 nt, Shigella flexneri 2a str. 301
uacuuugccuuucau

SEQ ID NO: 3896826 - RNA, 17 nt, Shigella flexneri 2a str. 301
uacuuuucaggauggua

SEQ ID NO: 3896827 - RNA, 16 nt, Shigella flexneri 2a str. 301
uacuuuuuucacccac

SEQ ID NO: 3896828 - RNA, 17 nt, Shigella flexneri 2a str. 301
uacuuuuuucacccaca

SEQ ID NO: 3896829 - RNA, 15 nt, Shigella flexneri 2a str. 301
uagcccggauagcgu

SEQ ID NO: 3896830 - RNA, 22 nt, Shigella flexneri 2a str. 301
uagccgaccgcaaggaagccug

SEQ ID NO: 3896831 - RNA, 23 nt, Shigella flexneri 2a str. 301
uagccgaccgcaaggaagccuga

SEQ ID NO: 3896832 - RNA, 18 nt, Shigella flexneri 2a str. 301
uagccgcagccaucagcg

SEQ ID NO: 3896833 - RNA, 13 nt, Shigella flexneri 2a str. 301
uagccgcgcaguu

SEQ ID NO: 3896834 - RNA, 14 nt, Shigella flexneri 2a str. 301
uagccgcuucugca

SEQ ID NO: 3896835 - RNA, 15 nt, Shigella flexneri 2a str. 301
uagccgcuucugcag

SEQ ID NO: 3896836 - RNA, 17 nt, Shigella flexneri 2a str. 301
uagccgcuucugcagcu

SEQ ID NO: 3896837 - RNA, 20 nt, Shigella flexneri 2a str. 301
uagccgcuuggcaagcccag

SEQ ID NO: 3896838 - RNA, 21 nt, Shigella flexneri 2a str. 301
uagccgcuuggcaagcccagc

SEQ ID NO: 3896839 - RNA, 19 nt, Shigella flexneri 2a str. 301
uagccgguaaaucaccagc

SEQ ID NO: 3896840 - RNA, 23 nt, Shigella flexneri 2a str. 301
uagccucacuuuguacugacccc

SEQ ID NO: 3896841 - RNA, 16 nt, Shigella flexneri 2a str. 301
uagccucccugccucc

SEQ ID NO: 3896842 - RNA, 14 nt, Shigella flexneri 2a str. 301
uagccucucggcau

SEQ ID NO: 3896843 - RNA, 12 nt, Shigella flexneri 2a str. 301
uagccugccaga

SEQ ID NO: 3896844 - RNA, 16 nt, Shigella flexneri 2a str. 301
uagccuguuuucgauu

SEQ ID NO: 3896845 - RNA, 22 nt, Shigella flexneri 2a str. 301
uagccuguuuucgauuuuuucc

SEQ ID NO: 3896846 - RNA, 14 nt, Shigella flexneri 2a str. 301
uagccuucaucaga

SEQ ID NO: 3896847 - RNA, 19 nt, Shigella flexneri 2a str. 301
uagccuucaucagaugaag

SEQ ID NO: 3896848 - RNA, 22 nt, Shigella flexneri 2a str. 301
uagcgaagaagacugaugacaa

SEQ ID NO: 3896849 - RNA, 17 nt, Shigella flexneri 2a str. 301
uagcgaauaaucccggc

SEQ ID NO: 3896850 - RNA, 21 nt, Shigella flexneri 2a str. 301
uagcgaauaaucccggcacca

SEQ ID NO: 3896851 - RNA, 14 nt, Shigella flexneri 2a str. 301
uagcgaauuuuucg

SEQ ID NO: 3896852 - RNA, 19 nt, Shigella flexneri 2a str. 301
uagcgaccauacagcagca

SEQ ID NO: 3896853 - RNA, 18 nt, Shigella flexneri 2a str. 301
uagcgaccgaacagauca

SEQ ID NO: 3896854 - RNA, 18 nt, Shigella flexneri 2a str. 301
uagcgauaaaugucggca

SEQ ID NO: 3896855 - RNA, 19 nt, Shigella flexneri 2a str. 301
uagcgcaauaacccugaac

SEQ ID NO: 3896856 - RNA, 16 nt, Shigella flexneri 2a str. 301
uagcgcauaagccacc

SEQ ID NO: 3896857 - RNA, 13 nt, Shigella flexneri 2a str. 301
uagcgcaucacuu

SEQ ID NO: 3896858 - RNA, 15 nt, Shigella flexneri 2a str. 301
uagcgcaucaggcaa

SEQ ID NO: 3896859 - RNA, 22 nt, Shigella flexneri 2a str. 301
uagcgccggguuuuuuauuaau

SEQ ID NO: 3896860 - RNA, 18 nt, Shigella flexneri 2a str. 301
uagcgccucuuuauaaau

SEQ ID NO: 3896861 - RNA, 12 nt, Shigella flexneri 2a str. 301
uagcgccugcug

SEQ ID NO: 3896862 - RNA, 14 nt, Shigella flexneri 2a str. 301
uagcgccuucuaca

SEQ ID NO: 3896863 - RNA, 23 nt, Shigella flexneri 2a str. 301
uagcggcgacuugcucaggagua

SEQ ID NO: 3896864 - RNA, 21 nt, Shigella flexneri 2a str. 301
uagcggcgguaaaaucauccu

SEQ ID NO: 3896865 - RNA, 15 nt, Shigella flexneri 2a str. 301
uagcggcugcgcagc

SEQ ID NO: 3896866 - RNA, 17 nt, Shigella flexneri 2a str. 301
uagcggucgaugaugau

SEQ ID NO: 3896867 - RNA, 22 nt, Shigella flexneri 2a str. 301
uagcgucaacuuuagcgaugug

SEQ ID NO: 3896868 - RNA, 18 nt, Shigella flexneri 2a str. 301
uagcguccggcugccagc

SEQ ID NO: 3896869 - RNA, 16 nt, Shigella flexneri 2a str. 301
uagcgucgcaucaggc

SEQ ID NO: 3896870 - RNA, 18 nt, Shigella flexneri 2a str. 301
uagcgugauggccagaua

SEQ ID NO: 3896871 - RNA, 14 nt, Shigella flexneri 2a str. 301
uagcguuaccagca

SEQ ID NO: 3896872 - RNA, 15 nt, Shigella flexneri 2a str. 301
uagcuaacgaaagaa

SEQ ID NO: 3896873 - RNA, 21 nt, Shigella flexneri 2a str. 301
uagcuaaucaucuguugugcc

SEQ ID NO: 3896874 - RNA, 15 nt, Shigella flexneri 2a str. 301
uagcuauauuuugcc

SEQ ID NO: 3896875 - RNA, 18 nt, Shigella flexneri 2a str. 301
uagcuccguaauuucgcu

SEQ ID NO: 3896876 - RNA, 18 nt, Shigella flexneri 2a str. 301
uagcucgcuucaucugcc

SEQ ID NO: 3896877 - RNA, 22 nt, Shigella flexneri 2a str. 301
uagcucugccacugguuuuccu

SEQ ID NO: 3896878 - RNA, 21 nt, Shigella flexneri 2a str. 301
uagcuggcuucgguuuuuauu

SEQ ID NO: 3896879 - RNA, 18 nt, Shigella flexneri 2a str. 301
uagcugucccaagugauu

SEQ ID NO: 3896880 - RNA, 23 nt, Shigella flexneri 2a str. 301
uagcuuacggcgcugugagcagg

SEQ ID NO: 3896881 - RNA, 21 nt, Shigella flexneri 2a str. 301
uagcuucaaauagugccuggc

SEQ ID NO: 3896882 - RNA, 15 nt, Shigella flexneri 2a str. 301
uagcuucaccgcauc

SEQ ID NO: 3896883 - RNA, 23 nt, Shigella flexneri 2a str. 301
uagcuucaccgcaucgucacuga

SEQ ID NO: 3896884 - RNA, 13 nt, Shigella flexneri 2a str. 301
uagcuuuggugcc

SEQ ID NO: 3896885 - RNA, 15 nt, Shigella flexneri 2a str. 301
uaggaagccggaauu

SEQ ID NO: 3896886 - RNA, 22 nt, Shigella flexneri 2a str. 301
uaggaagccggaauuuuccuuc

SEQ ID NO: 3896887 - RNA, 20 nt, Shigella flexneri 2a str. 301
uaggaauccgggucuguaaa

SEQ ID NO: 3896888 - RNA, 21 nt, Shigella flexneri 2a str. 301
uaggagguuuccgggucggca

SEQ ID NO: 3896889 - RNA, 12 nt, Shigella flexneri 2a str. 301
uaggaucagaau

SEQ ID NO: 3896890 - RNA, 18 nt, Shigella flexneri 2a str. 301
uaggcaaaaaaaaugccc

SEQ ID NO: 3896891 - RNA, 14 nt, Shigella flexneri 2a str. 301
uaggcaagccacaa

SEQ ID NO: 3896892 - RNA, 18 nt, Shigella flexneri 2a str. 301
uaggcaauuggcgcauca

SEQ ID NO: 3896893 - RNA, 19 nt, Shigella flexneri 2a str. 301
uaggcaucccgcaccagcg

SEQ ID NO: 3896894 - RNA, 18 nt, Shigella flexneri 2a str. 301
uaggccugauaagcguag

SEQ ID NO: 3896895 - RNA, 19 nt, Shigella flexneri 2a str. 301
uaggcggcaaacaguuucu

SEQ ID NO: 3896896 - RNA, 14 nt, Shigella flexneri 2a str. 301
uaggcuggaucaga

SEQ ID NO: 3896897 - RNA, 21 nt, Shigella flexneri 2a str. 301
uaggcuuuacuuaaucccauc

SEQ ID NO: 3896898 - RNA, 20 nt, Shigella flexneri 2a str. 301
uagggcacgccgagcgcauc

SEQ ID NO: 3896899 - RNA, 21 nt, Shigella flexneri 2a str. 301
uagggcgcggaggacguuaaa

SEQ ID NO: 3896900 - RNA, 19 nt, Shigella flexneri 2a str. 301
uagggugauuucaccugca

SEQ ID NO: 3896901 - RNA, 17 nt, Shigella flexneri 2a str. 301
uaggguggggaaaaaca

SEQ ID NO: 3896902 - RNA, 16 nt, Shigella flexneri 2a str. 301
uagguaaacaucacau

SEQ ID NO: 3896903 - RNA, 13 nt, Shigella flexneri 2a str. 301
uagguaaacaucc

SEQ ID NO: 3896904 - RNA, 14 nt, Shigella flexneri 2a str. 301
uagguaaucauauu

SEQ ID NO: 3896905 - RNA, 20 nt, Shigella flexneri 2a str. 301
uagguacaaagccaacagca

SEQ ID NO: 3896906 - RNA, 19 nt, Shigella flexneri 2a str. 301
uagguccugaccaaagccc

SEQ ID NO: 3896907 - RNA, 16 nt, Shigella flexneri 2a str. 301
uaggucggauaagacg

SEQ ID NO: 3896908 - RNA, 23 nt, Shigella flexneri 2a str. 301
uaggucuuugacgucgaaacuga

SEQ ID NO: 3896909 - RNA, 15 nt, Shigella flexneri 2a str. 301
uagguggcaccugac

SEQ ID NO: 3896910 - RNA, 13 nt, Shigella flexneri 2a str. 301
uaguacaaauuuu

SEQ ID NO: 3896911 - RNA, 18 nt, Shigella flexneri 2a str. 301
uaguaccguuuuguagau

SEQ ID NO: 3896912 - RNA, 22 nt, Shigella flexneri 2a str. 301
uaguacgggcaauuucacguuc

SEQ ID NO: 3896913 - RNA, 21 nt, Shigella flexneri 2a str. 301
uaguagguccugaccaaagcc

SEQ ID NO: 3896914 - RNA, 16 nt, Shigella flexneri 2a str. 301
uaguaguucauccccu

SEQ ID NO: 3896915 - RNA, 21 nt, Shigella flexneri 2a str. 301
uaguaguucauccccucuucc

SEQ ID NO: 3896916 - RNA, 16 nt, Shigella flexneri 2a str. 301
uaguaucgcucaauau

SEQ ID NO: 3896917 - RNA, 16 nt, Shigella flexneri 2a str. 301
uaguaucuauucauca

SEQ ID NO: 3896918 - RNA, 14 nt, Shigella flexneri 2a str. 301
uaguauuaagccag

SEQ ID NO: 3896919 - RNA, 16 nt, Shigella flexneri 2a str. 301
uaguauuguuaaauau

SEQ ID NO: 3896920 - RNA, 23 nt, Shigella flexneri 2a str. 301
uaguauuuauuugcaaaguuccu

SEQ ID NO: 3896921 - RNA, 20 nt, Shigella flexneri 2a str. 301
uaguauuugaguucacugcc

SEQ ID NO: 3896922 - RNA, 14 nt, Shigella flexneri 2a str. 301
uagucaauuaaaaa

SEQ ID NO: 3896923 - RNA, 15 nt, Shigella flexneri 2a str. 301
uagucaauuaaaaaa

SEQ ID NO: 3896924 - RNA, 13 nt, Shigella flexneri 2a str. 301
uagucacaaaucu

SEQ ID NO: 3896925 - RNA, 13 nt, Shigella flexneri 2a str. 301
uagucauuuuuug

SEQ ID NO: 3896926 - RNA, 16 nt, Shigella flexneri 2a str. 301
uaguccggaagaugcg

SEQ ID NO: 3896927 - RNA, 17 nt, Shigella flexneri 2a str. 301
uagucugaccucuucua

SEQ ID NO: 3896928 - RNA, 18 nt, Shigella flexneri 2a str. 301
uagucugguugagcagua

SEQ ID NO: 3896929 - RNA, 12 nt, Shigella flexneri 2a str. 301
uaucagagcccu

SEQ ID NO: 3896930 - RNA, 14 nt, Shigella flexneri 2a str. 301
uaucagauucgaua

SEQ ID NO: 3896931 - RNA, 17 nt, Shigella flexneri 2a str. 301
uaucagcaaagcaaauu

SEQ ID NO: 3896932 - RNA, 12 nt, Shigella flexneri 2a str. 301
uaucagcaacuc

SEQ ID NO: 3896933 - RNA, 19 nt, Shigella flexneri 2a str. 301
uaucagcgccaccacaaaa

SEQ ID NO: 3896934 - RNA, 20 nt, Shigella flexneri 2a str. 301
uaucagcguuaucagggagg

SEQ ID NO: 3896935 - RNA, 18 nt, Shigella flexneri 2a str. 301
uaucaggcacauuacacc

SEQ ID NO: 3896936 - RNA, 21 nt, Shigella flexneri 2a str. 301
uaucaggccuacaaaaucuau

SEQ ID NO: 3896937 - RNA, 18 nt, Shigella flexneri 2a str. 301
uaucaggccuacaacucc

SEQ ID NO: 3896938 - RNA, 22 nt, Shigella flexneri 2a str. 301
uaucaggccuacauuuucuccg

SEQ ID NO: 3896939 - RNA, 15 nt, Shigella flexneri 2a str. 301
uaucaucauuugcau

SEQ ID NO: 3896940 - RNA, 20 nt, Shigella flexneri 2a str. 301
uaucaucggucagcgcagug

SEQ ID NO: 3896941 - RNA, 19 nt, Shigella flexneri 2a str. 301
uaucaugcucugccagcgu

SEQ ID NO: 3896942 - RNA, 16 nt, Shigella flexneri 2a str. 301
uaucauucgacaacug

SEQ ID NO: 3896943 - RNA, 18 nt, Shigella flexneri 2a str. 301
uaucauugcgugguuuuu

SEQ ID NO: 3896944 - RNA, 21 nt, Shigella flexneri 2a str. 301
uaucauugcgugguuuuugcu

SEQ ID NO: 3896945 - RNA, 18 nt, Shigella flexneri 2a str. 301
uaucauuuuacguugcau

SEQ ID NO: 3896946 - RNA, 15 nt, Shigella flexneri 2a str. 301
uaucauuuugcugcc

SEQ ID NO: 3896947 - RNA, 21 nt, Shigella flexneri 2a str. 301
uauccacaccaagccggaauu

SEQ ID NO: 3896948 - RNA, 22 nt, Shigella flexneri 2a str. 301
uauccaccgcguucagcagcuc

SEQ ID NO: 3896949 - RNA, 20 nt, Shigella flexneri 2a str. 301
uauccaccgggguaaaucca

SEQ ID NO: 3896950 - RNA, 23 nt, Shigella flexneri 2a str. 301
uauccaccuccagcuccgccagc

SEQ ID NO: 3896951 - RNA, 21 nt, Shigella flexneri 2a str. 301
uauccacgauacgcugcacaa

SEQ ID NO: 3896952 - RNA, 21 nt, Shigella flexneri 2a str. 301
uauccagcgauaccggugcac

SEQ ID NO: 3896953 - RNA, 12 nt, Shigella flexneri 2a str. 301
uauccagcgcau

SEQ ID NO: 3896954 - RNA, 16 nt, Shigella flexneri 2a str. 301
uauccagcggcagcca

SEQ ID NO: 3896955 - RNA, 13 nt, Shigella flexneri 2a str. 301
uauccaguacauu

SEQ ID NO: 3896956 - RNA, 15 nt, Shigella flexneri 2a str. 301
uauccaguuucugcc

SEQ ID NO: 3896957 - RNA, 19 nt, Shigella flexneri 2a str. 301
uauccaguuucugccucag

SEQ ID NO: 3896958 - RNA, 13 nt, Shigella flexneri 2a str. 301
uauccaugcgcau

SEQ ID NO: 3896959 - RNA, 20 nt, Shigella flexneri 2a str. 301
uauccccugcgauggugaag

SEQ ID NO: 3896960 - RNA, 19 nt, Shigella flexneri 2a str. 301
uaucccgccagcaccagca

SEQ ID NO: 3896961 - RNA, 21 nt, Shigella flexneri 2a str. 301
uaucccugacgaccaaugaca

SEQ ID NO: 3896962 - RNA, 13 nt, Shigella flexneri 2a str. 301
uaucccuguuaaa

SEQ ID NO: 3896963 - RNA, 23 nt, Shigella flexneri 2a str. 301
uaucccuuacgcguucauacuuu

SEQ ID NO: 3896964 - RNA, 21 nt, Shigella flexneri 2a str. 301
uaucccuucuccacaccguug

SEQ ID NO: 3896965 - RNA, 19 nt, Shigella flexneri 2a str. 301
uauccgacauuucugcugc

SEQ ID NO: 3896966 - RNA, 16 nt, Shigella flexneri 2a str. 301
uauccgaccuacaaaa

SEQ ID NO: 3896967 - RNA, 21 nt, Shigella flexneri 2a str. 301
uauccgaccuacaaaaccugc

SEQ ID NO: 3896968 - RNA, 19 nt, Shigella flexneri 2a str. 301
uauccgaugaaucaccaca

SEQ ID NO: 3896969 - RNA, 21 nt, Shigella flexneri 2a str. 301
uauccgccagugccaaagcca

SEQ ID NO: 3896970 - RNA, 21 nt, Shigella flexneri 2a str. 301
uauccggcacuuacuuuccuu

SEQ ID NO: 3896971 - RNA, 22 nt, Shigella flexneri 2a str. 301
uauccggcacuuacuuuccuua

SEQ ID NO: 3896972 - RNA, 19 nt, Shigella flexneri 2a str. 301
uauccggcccacaucaacu

SEQ ID NO: 3896973 - RNA, 17 nt, Shigella flexneri 2a str. 301
uauccggccuacaaaac

SEQ ID NO: 3896974 - RNA, 15 nt, Shigella flexneri 2a str. 301
uauccggccuacaca

SEQ ID NO: 3896975 - RNA, 14 nt, Shigella flexneri 2a str. 301
uauccggcuaacaa

SEQ ID NO: 3896976 - RNA, 13 nt, Shigella flexneri 2a str. 301
uauccgguucacu

SEQ ID NO: 3896977 - RNA, 20 nt, Shigella flexneri 2a str. 301
uauccgguucacuucacgca

SEQ ID NO: 3896978 - RNA, 17 nt, Shigella flexneri 2a str. 301
uauccuauauagccccu

SEQ ID NO: 3896979 - RNA, 18 nt, Shigella flexneri 2a str. 301
uauccucaguugucugaa

SEQ ID NO: 3896980 - RNA, 23 nt, Shigella flexneri 2a str. 301
uauccugacgagcuuucuuauuu

SEQ ID NO: 3896981 - RNA, 15 nt, Shigella flexneri 2a str. 301
uauccugauaaaaac

SEQ ID NO: 3896982 - RNA, 21 nt, Shigella flexneri 2a str. 301
uauccugcccacuccagcuau

SEQ ID NO: 3896983 - RNA, 20 nt, Shigella flexneri 2a str. 301
uauccuguggacgcagcuca

SEQ ID NO: 3896984 - RNA, 14 nt, Shigella flexneri 2a str. 301
uauccuucacacau

SEQ ID NO: 3896985 - RNA, 14 nt, Shigella flexneri 2a str. 301
uaucgaacguccag

SEQ ID NO: 3896986 - RNA, 17 nt, Shigella flexneri 2a str. 301
uaucgacagacgccagc

SEQ ID NO: 3896987 - RNA, 16 nt, Shigella flexneri 2a str. 301
uaucgacgaaccauuu

SEQ ID NO: 3896988 - RNA, 13 nt, Shigella flexneri 2a str. 301
uaucgacgccagu

SEQ ID NO: 3896989 - RNA, 16 nt, Shigella flexneri 2a str. 301
uaucgacgcgccagca

SEQ ID NO: 3896990 - RNA, 19 nt, Shigella flexneri 2a str. 301
uaucgacggcguauugcau

SEQ ID NO: 3896991 - RNA, 21 nt, Shigella flexneri 2a str. 301
uaucgagagaauggggucagc

SEQ ID NO: 3896992 - RNA, 22 nt, Shigella flexneri 2a str. 301
uaucgauaaauggcgcauccag

SEQ ID NO: 3896993 - RNA, 19 nt, Shigella flexneri 2a str. 301
uaucgauuucuacacccag

SEQ ID NO: 3896994 - RNA, 16 nt, Shigella flexneri 2a str. 301
uaucgauuuucaaaau

SEQ ID NO: 3896995 - RNA, 20 nt, Shigella flexneri 2a str. 301
uaucgcacagaugcgacggc

SEQ ID NO: 3896996 - RNA, 20 nt, Shigella flexneri 2a str. 301
uaucgcagccuuaccggaga

SEQ ID NO: 3896997 - RNA, 15 nt, Shigella flexneri 2a str. 301
uaucgcauuaucaaa

SEQ ID NO: 3896998 - RNA, 21 nt, Shigella flexneri 2a str. 301
uaucgccacaauaacugccgg

SEQ ID NO: 3896999 - RNA, 14 nt, Shigella flexneri 2a str. 301
uaucgccguacaua

SEQ ID NO: 3897000 - RNA, 18 nt, Shigella flexneri 2a str. 301
uaucgccguacauagcgu

SEQ ID NO: 3897001 - RNA, 17 nt, Shigella flexneri 2a str. 301
uaucgcgauacaccaga

SEQ ID NO: 3897002 - RNA, 19 nt, Shigella flexneri 2a str. 301
uaucgcgaugauuuucgcu

SEQ ID NO: 3897003 - RNA, 15 nt, Shigella flexneri 2a str. 301
uaucgcgcagaaauu

SEQ ID NO: 3897004 - RNA, 18 nt, Shigella flexneri 2a str. 301
uaucgcgccaucaaaucu

SEQ ID NO: 3897005 - RNA, 22 nt, Shigella flexneri 2a str. 301
uaucgcggauaugcagcagcca

SEQ ID NO: 3897006 - RNA, 22 nt, Shigella flexneri 2a str. 301
uaucgcgucaacagggcagaca

SEQ ID NO: 3897007 - RNA, 19 nt, Shigella flexneri 2a str. 301
uaucgcucaauauccugac

SEQ ID NO: 3897008 - RNA, 13 nt, Shigella flexneri 2a str. 301
uaucgcuggccuc

SEQ ID NO: 3897009 - RNA, 15 nt, Shigella flexneri 2a str. 301
uaucgcuuuccugga

SEQ ID NO: 3897010 - RNA, 18 nt, Shigella flexneri 2a str. 301
uaucggagaacaggaaua

SEQ ID NO: 3897011 - RNA, 13 nt, Shigella flexneri 2a str. 301
uaucggcaaggaa

SEQ ID NO: 3897012 - RNA, 17 nt, Shigella flexneri 2a str. 301
uaucggccaucuguucu

SEQ ID NO: 3897013 - RNA, 23 nt, Shigella flexneri 2a str. 301
uaucggcgcugcuuuccugcugc

SEQ ID NO: 3897014 - RNA, 23 nt, Shigella flexneri 2a str. 301
uaucguagccccagucuuccugc

SEQ ID NO: 3897015 - RNA, 19 nt, Shigella flexneri 2a str. 301
uaucgugacaauaauaccc

SEQ ID NO: 3897016 - RNA, 21 nt, Shigella flexneri 2a str. 301
uaucgugcuggauuuguguca

SEQ ID NO: 3897017 - RNA, 16 nt, Shigella flexneri 2a str. 301
uaucuaccacugccug

SEQ ID NO: 3897018 - RNA, 18 nt, Shigella flexneri 2a str. 301
uaucuauauacaaucaca

SEQ ID NO: 3897019 - RNA, 20 nt, Shigella flexneri 2a str. 301
uaucuauucacgaaucuauu

SEQ ID NO: 3897020 - RNA, 12 nt, Shigella flexneri 2a str. 301
uaucucaacaca

SEQ ID NO: 3897021 - RNA, 12 nt, Shigella flexneri 2a str. 301
uaucuccagcua

SEQ ID NO: 3897022 - RNA, 12 nt, Shigella flexneri 2a str. 301
uaucuccauccg

SEQ ID NO: 3897023 - RNA, 22 nt, Shigella flexneri 2a str. 301
uaucuccauucugagugacgcg

SEQ ID NO: 3897024 - RNA, 14 nt, Shigella flexneri 2a str. 301
uaucuccucugcuu

SEQ ID NO: 3897025 - RNA, 13 nt, Shigella flexneri 2a str. 301
uaucucuuuaccu

SEQ ID NO: 3897026 - RNA, 17 nt, Shigella flexneri 2a str. 301
uaucugaaucaaaauca

SEQ ID NO: 3897027 - RNA, 17 nt, Shigella flexneri 2a str. 301
uaucugccguucagcua

SEQ ID NO: 3897028 - RNA, 20 nt, Shigella flexneri 2a str. 301
uauuaugcgaccauaugaau

SEQ ID NO: 3897029 - RNA, 18 nt, Shigella flexneri 2a str. 301
uauuauuaaagagcgccu

SEQ ID NO: 3897030 - RNA, 19 nt, Shigella flexneri 2a str. 301
uauuauuacuuaucccugu

SEQ ID NO: 3897031 - RNA, 13 nt, Shigella flexneri 2a str. 301
uauuauuauuuuu

SEQ ID NO: 3897032 - RNA, 16 nt, Shigella flexneri 2a str. 301
uauuauucauaaugcc

SEQ ID NO: 3897033 - RNA, 12 nt, Shigella flexneri 2a str. 301
uauuauugaaau

SEQ ID NO: 3897034 - RNA, 15 nt, Shigella flexneri 2a str. 301
uauucaaaggcucca

SEQ ID NO: 3897035 - RNA, 17 nt, Shigella flexneri 2a str. 301
uauucaaucucuucaca

SEQ ID NO: 3897036 - RNA, 21 nt, Shigella flexneri 2a str. 301
uauucaccgcaucaauauuaa

SEQ ID NO: 3897037 - RNA, 18 nt, Shigella flexneri 2a str. 301
uauucacugcgccucgcc

SEQ ID NO: 3897038 - RNA, 14 nt, Shigella flexneri 2a str. 301
uauucagcagcaga

SEQ ID NO: 3897039 - RNA, 13 nt, Shigella flexneri 2a str. 301
uauucagcuuauu

SEQ ID NO: 3897040 - RNA, 21 nt, Shigella flexneri 2a str. 301
uauucaggcguugaaaaauca

SEQ ID NO: 3897041 - RNA, 23 nt, Shigella flexneri 2a str. 301
uauucaguggcauuuagaucuau

SEQ ID NO: 3897042 - RNA, 21 nt, Shigella flexneri 2a str. 301
uauucauaauauauaaagauu

SEQ ID NO: 3897043 - RNA, 19 nt, Shigella flexneri 2a str. 301
uauucaucaauagcaacug

SEQ ID NO: 3897044 - RNA, 12 nt, Shigella flexneri 2a str. 301
uauucaugcccu

SEQ ID NO: 3897045 - RNA, 16 nt, Shigella flexneri 2a str. 301
uauucauggugaauau

SEQ ID NO: 3897046 - RNA, 14 nt, Shigella flexneri 2a str. 301
uauucauuuauguu

SEQ ID NO: 3897047 - RNA, 21 nt, Shigella flexneri 2a str. 301
uauucccaacgcgccaccgac

SEQ ID NO: 3897048 - RNA, 12 nt, Shigella flexneri 2a str. 301
uauuccccagac

SEQ ID NO: 3897049 - RNA, 17 nt, Shigella flexneri 2a str. 301
uauuccucguaguucuu

SEQ ID NO: 3897050 - RNA, 14 nt, Shigella flexneri 2a str. 301
uauuccuuaugguu

SEQ ID NO: 3897051 - RNA, 17 nt, Shigella flexneri 2a str. 301
uauuccuuaugguucac

SEQ ID NO: 3897052 - RNA, 16 nt, Shigella flexneri 2a str. 301
uauucgacaccaucuu

SEQ ID NO: 3897053 - RNA, 16 nt, Shigella flexneri 2a str. 301
uauucgccaucgcuuu

SEQ ID NO: 3897054 - RNA, 21 nt, Shigella flexneri 2a str. 301
uauucgccaucgcuuuuacca

SEQ ID NO: 3897055 - RNA, 15 nt, Shigella flexneri 2a str. 301
uauucggcuccagau

SEQ ID NO: 3897056 - RNA, 15 nt, Shigella flexneri 2a str. 301
uauucgggauugcca

SEQ ID NO: 3897057 - RNA, 15 nt, Shigella flexneri 2a str. 301
uauucucaaaauaca

SEQ ID NO: 3897058 - RNA, 17 nt, Shigella flexneri 2a str. 301
uauucugggaacuauau

SEQ ID NO: 3897059 - RNA, 12 nt, Shigella flexneri 2a str. 301
uauucuuauaaa

SEQ ID NO: 3897060 - RNA, 16 nt, Shigella flexneri 2a str. 301
uauucuuauaaagaaa

SEQ ID NO: 3897061 - RNA, 21 nt, Shigella flexneri 2a str. 301
uauucuuauaaagaaaaucug

SEQ ID NO: 3897062 - RNA, 17 nt, Shigella flexneri 2a str. 301
uauugaagauguugcca

SEQ ID NO: 3897063 - RNA, 21 nt, Shigella flexneri 2a str. 301
uauugaagauguugccacacg

SEQ ID NO: 3897064 - RNA, 12 nt, Shigella flexneri 2a str. 301
uauugaagcuca

SEQ ID NO: 3897065 - RNA, 18 nt, Shigella flexneri 2a str. 301
uauugaauuagcaauauu

SEQ ID NO: 3897066 - RNA, 19 nt, Shigella flexneri 2a str. 301
uauugaauuagcaauauuu

SEQ ID NO: 3897067 - RNA, 21 nt, Shigella flexneri 2a str. 301
uauugacgaaaagcugaaaac

SEQ ID NO: 3897068 - RNA, 13 nt, Shigella flexneri 2a str. 301
uauugagaucacc

SEQ ID NO: 3897069 - RNA, 13 nt, Shigella flexneri 2a str. 301
uauugagaucgcu

SEQ ID NO: 3897070 - RNA, 12 nt, Shigella flexneri 2a str. 301
uauugaugcuca

SEQ ID NO: 3897071 - RNA, 17 nt, Shigella flexneri 2a str. 301
uauugauuuucuuguca

SEQ ID NO: 3897072 - RNA, 14 nt, Shigella flexneri 2a str. 301
uauugcaaucaucu

SEQ ID NO: 3897073 - RNA, 22 nt, Shigella flexneri 2a str. 301
uauugcaccccgagcuuaugca

SEQ ID NO: 3897074 - RNA, 16 nt, Shigella flexneri 2a str. 301
uauugccaccugccgg

SEQ ID NO: 3897075 - RNA, 13 nt, Shigella flexneri 2a str. 301
uauugccccacac

SEQ ID NO: 3897076 - RNA, 18 nt, Shigella flexneri 2a str. 301
uauugccgaagaccagau

SEQ ID NO: 3897077 - RNA, 16 nt, Shigella flexneri 2a str. 301
uauugcgcaaauguuu

SEQ ID NO: 3897078 - RNA, 21 nt, Shigella flexneri 2a str. 301
uauugcgcacaucaauuugcc

SEQ ID NO: 3897079 - RNA, 19 nt, Shigella flexneri 2a str. 301
uauugcggauaaagcugcc

SEQ ID NO: 3897080 - RNA, 22 nt, Shigella flexneri 2a str. 301
uauugcuaugguccguucucac

SEQ ID NO: 3897081 - RNA, 15 nt, Shigella flexneri 2a str. 301
uauugcuucaccagc

SEQ ID NO: 3897082 - RNA, 14 nt, Shigella flexneri 2a str. 301
uauugggugacugg

SEQ ID NO: 3897083 - RNA, 18 nt, Shigella flexneri 2a str. 301
uauugguaaacucaaagu

SEQ ID NO: 3897084 - RNA, 16 nt, Shigella flexneri 2a str. 301
uauuggugaauugcac

SEQ ID NO: 3897085 - RNA, 22 nt, Shigella flexneri 2a str. 301
uauugugggucgauuaaauuca

SEQ ID NO: 3897086 - RNA, 23 nt, Shigella flexneri 2a str. 301
uauugugggucgauuaaauucac

SEQ ID NO: 3897087 - RNA, 19 nt, Shigella flexneri 2a str. 301
uauuguuauucgccagacc

SEQ ID NO: 3897088 - RNA, 21 nt, Shigella flexneri 2a str. 301
uauuguugauaaggaaauuca

SEQ ID NO: 3897089 - RNA, 13 nt, Shigella flexneri 2a str. 301
uauuguuggcaug

SEQ ID NO: 3897090 - RNA, 15 nt, Shigella flexneri 2a str. 301
uauuguuuugaugaa

SEQ ID NO: 3897091 - RNA, 22 nt, Shigella flexneri 2a str. 301
uauuuaaaugauuacucguauu

SEQ ID NO: 3897092 - RNA, 15 nt, Shigella flexneri 2a str. 301
uauuuaccaauauaa

SEQ ID NO: 3897093 - RNA, 16 nt, Shigella flexneri 2a str. 301
uauuuaccaauauaau

SEQ ID NO: 3897094 - RNA, 15 nt, Shigella flexneri 2a str. 301
uauuuacucuccugc

SEQ ID NO: 3897095 - RNA, 15 nt, Shigella flexneri 2a str. 301
uauuuauuaauccag

SEQ ID NO: 3897096 - RNA, 15 nt, Shigella flexneri 2a str. 301
uauuuauuucagaac

SEQ ID NO: 3897097 - RNA, 13 nt, Shigella flexneri 2a str. 301
uauuuauuuucag

SEQ ID NO: 3897098 - RNA, 13 nt, Shigella flexneri 2a str. 301
uauuuauuuucca

SEQ ID NO: 3897099 - RNA, 14 nt, Shigella flexneri 2a str. 301
uauuuauuuuccaa

SEQ ID NO: 3897100 - RNA, 19 nt, Shigella flexneri 2a str. 301
uauuuauuuuccaaaauaa

SEQ ID NO: 3897101 - RNA, 16 nt, Shigella flexneri 2a str. 301
uauuucaauaugauaa

SEQ ID NO: 3897102 - RNA, 17 nt, Shigella flexneri 2a str. 301
uauuucaauaugauaaa

SEQ ID NO: 3897103 - RNA, 15 nt, Shigella flexneri 2a str. 301
uauuucaaugcauua

SEQ ID NO: 3897104 - RNA, 19 nt, Shigella flexneri 2a str. 301
uauuucacauaacugccuc

SEQ ID NO: 3897105 - RNA, 22 nt, Shigella flexneri 2a str. 301
uauuucacccgcgaccaccagc

SEQ ID NO: 3897106 - RNA, 14 nt, Shigella flexneri 2a str. 301
uauuucacuucaac

SEQ ID NO: 3897107 - RNA, 20 nt, Shigella flexneri 2a str. 301
uauuucagaacaguuuucag

SEQ ID NO: 3897108 - RNA, 14 nt, Shigella flexneri 2a str. 301
uauuucagaccugu

SEQ ID NO: 3897109 - RNA, 15 nt, Shigella flexneri 2a str. 301
uauuucauguuugaa

SEQ ID NO: 3897110 - RNA, 11 nt, Shigella flexneri 2a str. 301
uauuuccaggg

SEQ ID NO: 3897111 - RNA, 17 nt, Shigella flexneri 2a str. 301
uauuuccagggccucuc

SEQ ID NO: 3897112 - RNA, 15 nt, Shigella flexneri 2a str. 301
uauuuccggcgacgu

SEQ ID NO: 3897113 - RNA, 22 nt, Shigella flexneri 2a str. 301
uauuuccuuccuuggauauuuu

SEQ ID NO: 3897114 - RNA, 19 nt, Shigella flexneri 2a str. 301
uauuuccuucgcuuuaauu

SEQ ID NO: 3897115 - RNA, 16 nt, Shigella flexneri 2a str. 301
uauuucuguuugcguc

SEQ ID NO: 3897116 - RNA, 19 nt, Shigella flexneri 2a str. 301
uauuucuucauacuaccug

SEQ ID NO: 3897117 - RNA, 15 nt, Shigella flexneri 2a str. 301
uauuucuuuaucacc

SEQ ID NO: 3897118 - RNA, 22 nt, Shigella flexneri 2a str. 301
uauuucuuuguagaugauuuuu

SEQ ID NO: 3897119 - RNA, 14 nt, Shigella flexneri 2a str. 301
uauuucuuuuacau

SEQ ID NO: 3897120 - RNA, 18 nt, Shigella flexneri 2a str. 301
uauuugaguucacugccg

SEQ ID NO: 3897121 - RNA, 20 nt, Shigella flexneri 2a str. 301
uauuugcccaccugcggcac

SEQ ID NO: 3897122 - RNA, 22 nt, Shigella flexneri 2a str. 301
uauuugccgugcguguucggua

SEQ ID NO: 3897123 - RNA, 21 nt, Shigella flexneri 2a str. 301
uauuugccuaauaaaucuaaa

SEQ ID NO: 3897124 - RNA, 23 nt, Shigella flexneri 2a str. 301
uauuugccuaauaaaucuaaaac

SEQ ID NO: 3897125 - RNA, 16 nt, Shigella flexneri 2a str. 301
uauuuggcauugguca

SEQ ID NO: 3897126 - RNA, 20 nt, Shigella flexneri 2a str. 301
uauuuguaguuugauaauuu

SEQ ID NO: 3897127 - RNA, 18 nt, Shigella flexneri 2a str. 301
uauuugucauacugccca

SEQ ID NO: 3897128 - RNA, 15 nt, Shigella flexneri 2a str. 301
ucaacaccgaugcaa

SEQ ID NO: 3897129 - RNA, 12 nt, Shigella flexneri 2a str. 301
ucaacaccgguu

SEQ ID NO: 3897130 - RNA, 22 nt, Shigella flexneri 2a str. 301
ucaacagguuguuucggugaau

SEQ ID NO: 3897131 - RNA, 18 nt, Shigella flexneri 2a str. 301
ucaacagguuuuguugcc

SEQ ID NO: 3897132 - RNA, 13 nt, Shigella flexneri 2a str. 301
ucaacaguaaacu

SEQ ID NO: 3897133 - RNA, 20 nt, Shigella flexneri 2a str. 301
ucaacauaacgcaucccguu

SEQ ID NO: 3897134 - RNA, 16 nt, Shigella flexneri 2a str. 301
ucaacauacaaauagc

SEQ ID NO: 3897135 - RNA, 21 nt, Shigella flexneri 2a str. 301
ucaacauacaaauagccaauu

SEQ ID NO: 3897136 - RNA, 12 nt, Shigella flexneri 2a str. 301
ucaacaucaucu

SEQ ID NO: 3897137 - RNA, 13 nt, Shigella flexneri 2a str. 301
ucaacaucaucuu

SEQ ID NO: 3897138 - RNA, 14 nt, Shigella flexneri 2a str. 301
ucaacaucgcguug

SEQ ID NO: 3897139 - RNA, 14 nt, Shigella flexneri 2a str. 301
ucaacaugaaaaua

SEQ ID NO: 3897140 - RNA, 15 nt, Shigella flexneri 2a str. 301
ucaaccaacgcaccg

SEQ ID NO: 3897141 - RNA, 19 nt, Shigella flexneri 2a str. 301
ucaaccaccggcaccacuu

SEQ ID NO: 3897142 - RNA, 12 nt, Shigella flexneri 2a str. 301
ucaaccacucac

SEQ ID NO: 3897143 - RNA, 22 nt, Shigella flexneri 2a str. 301
ucaaccacucaccgcuggcgua

SEQ ID NO: 3897144 - RNA, 18 nt, Shigella flexneri 2a str. 301
ucaaccagcacaaagugg

SEQ ID NO: 3897145 - RNA, 13 nt, Shigella flexneri 2a str. 301
ucaacccauuucg

SEQ ID NO: 3897146 - RNA, 13 nt, Shigella flexneri 2a str. 301
ucaacccgcccag

SEQ ID NO: 3897147 - RNA, 14 nt, Shigella flexneri 2a str. 301
ucaacccuuuccag

SEQ ID NO: 3897148 - RNA, 16 nt, Shigella flexneri 2a str. 301
ucaacccuuuccagcg

SEQ ID NO: 3897149 - RNA, 17 nt, Shigella flexneri 2a str. 301
ucaaccgcagugauuuc

SEQ ID NO: 3897150 - RNA, 15 nt, Shigella flexneri 2a str. 301
ucaaccgucaccagc

SEQ ID NO: 3897151 - RNA, 22 nt, Shigella flexneri 2a str. 301
ucaaccgucgcgcccuccugca

SEQ ID NO: 3897152 - RNA, 21 nt, Shigella flexneri 2a str. 301
ucaaccgugacguaugaaaau

SEQ ID NO: 3897153 - RNA, 14 nt, Shigella flexneri 2a str. 301
ucaaccuaaaguaa

SEQ ID NO: 3897154 - RNA, 16 nt, Shigella flexneri 2a str. 301
ucaaccuaaaguaaag

SEQ ID NO: 3897155 - RNA, 19 nt, Shigella flexneri 2a str. 301
ucaaccugugcgccaggau

SEQ ID NO: 3897156 - RNA, 18 nt, Shigella flexneri 2a str. 301
ucaacgaucagcguggca

SEQ ID NO: 3897157 - RNA, 22 nt, Shigella flexneri 2a str. 301
ucaacgaucagcguggcaucgg

SEQ ID NO: 3897158 - RNA, 17 nt, Shigella flexneri 2a str. 301
ucaacgauucaagaaac

SEQ ID NO: 3897159 - RNA, 22 nt, Shigella flexneri 2a str. 301
ucaacgcaccgacaaauuucau

SEQ ID NO: 3897160 - RNA, 16 nt, Shigella flexneri 2a str. 301
ucaacgccaucgccag

SEQ ID NO: 3897161 - RNA, 17 nt, Shigella flexneri 2a str. 301
ucaacgccaucgccagg

SEQ ID NO: 3897162 - RNA, 14 nt, Shigella flexneri 2a str. 301
ucaacgcgccgcca

SEQ ID NO: 3897163 - RNA, 23 nt, Shigella flexneri 2a str. 301
ucaacgcucaggccgauuucaug

SEQ ID NO: 3897164 - RNA, 19 nt, Shigella flexneri 2a str. 301
ucaacgcucuccugcggaa

SEQ ID NO: 3897165 - RNA, 19 nt, Shigella flexneri 2a str. 301
ucaacggauauuguuugcu

SEQ ID NO: 3897166 - RNA, 21 nt, Shigella flexneri 2a str. 301
ucaacggcaacaauucccgca

SEQ ID NO: 3897167 - RNA, 12 nt, Shigella flexneri 2a str. 301
ucaacggccuga

SEQ ID NO: 3897168 - RNA, 15 nt, Shigella flexneri 2a str. 301
ucaacggugucgaua

SEQ ID NO: 3897169 - RNA, 18 nt, Shigella flexneri 2a str. 301
ucaacguaguaucguaau

SEQ ID NO: 3897170 - RNA, 17 nt, Shigella flexneri 2a str. 301
ucaacgucacuggguuc

SEQ ID NO: 3897171 - RNA, 19 nt, Shigella flexneri 2a str. 301
ucaacgucauuaucugcag

SEQ ID NO: 3897172 - RNA, 16 nt, Shigella flexneri 2a str. 301
ucaacgucugcgccuu

SEQ ID NO: 3897173 - RNA, 17 nt, Shigella flexneri 2a str. 301
ucaacgucuuccggcgu

SEQ ID NO: 3897174 - RNA, 14 nt, Shigella flexneri 2a str. 301
ucaacgugucuuuu

SEQ ID NO: 3897175 - RNA, 18 nt, Shigella flexneri 2a str. 301
ucaacguugaauuucagg

SEQ ID NO: 3897176 - RNA, 22 nt, Shigella flexneri 2a str. 301
ucaacguuuacccaauccccca

SEQ ID NO: 3897177 - RNA, 12 nt, Shigella flexneri 2a str. 301
ucaacugcgguu

SEQ ID NO: 3897178 - RNA, 17 nt, Shigella flexneri 2a str. 301
ucaacugcguucugucg

SEQ ID NO: 3897179 - RNA, 23 nt, Shigella flexneri 2a str. 301
ucaacuuuaccuucauccuggua

SEQ ID NO: 3897180 - RNA, 22 nt, Shigella flexneri 2a str. 301
ucaacuuuguuagcgaauaaag

SEQ ID NO: 3897181 - RNA, 19 nt, Shigella flexneri 2a str. 301
ucaacuuuguucugaauca

SEQ ID NO: 3897182 - RNA, 21 nt, Shigella flexneri 2a str. 301
ucaagacgaauaccuucuucc

SEQ ID NO: 3897183 - RNA, 20 nt, Shigella flexneri 2a str. 301
ucaagauagggaaugagcug

SEQ ID NO: 3897184 - RNA, 19 nt, Shigella flexneri 2a str. 301
ucaagauauuucaccagcg

SEQ ID NO: 3897185 - RNA, 14 nt, Shigella flexneri 2a str. 301
ucaagaucaucaaa

SEQ ID NO: 3897186 - RNA, 18 nt, Shigella flexneri 2a str. 301
ucaagauuaaaagugauu

SEQ ID NO: 3897187 - RNA, 15 nt, Shigella flexneri 2a str. 301
ucaagauuagccccc

SEQ ID NO: 3897188 - RNA, 19 nt, Shigella flexneri 2a str. 301
ucaagauuagcgacgaaca

SEQ ID NO: 3897189 - RNA, 17 nt, Shigella flexneri 2a str. 301
ucaagcaacauaaccug

SEQ ID NO: 3897190 - RNA, 16 nt, Shigella flexneri 2a str. 301
ucaagcaaggccaggu

SEQ ID NO: 3897191 - RNA, 13 nt, Shigella flexneri 2a str. 301
ucaagcacaauca

SEQ ID NO: 3897192 - RNA, 17 nt, Shigella flexneri 2a str. 301
ucaagcaccauccuguu

SEQ ID NO: 3897193 - RNA, 20 nt, Shigella flexneri 2a str. 301
ucaagcaguugguuaaucuu

SEQ ID NO: 3897194 - RNA, 18 nt, Shigella flexneri 2a str. 301
ucaagcaucgcaacgccu

SEQ ID NO: 3897195 - RNA, 22 nt, Shigella flexneri 2a str. 301
ucaagcaucguuguuacaacau

SEQ ID NO: 3897196 - RNA, 23 nt, Shigella flexneri 2a str. 301
ucaagcaugauauucacagggaa

SEQ ID NO: 3897197 - RNA, 16 nt, Shigella flexneri 2a str. 301
ucaagccacuuuccuu

SEQ ID NO: 3897198 - RNA, 15 nt, Shigella flexneri 2a str. 301
ucaagccauagcgcc

SEQ ID NO: 3897199 - RNA, 16 nt, Shigella flexneri 2a str. 301
ucaagccauagcgccg

SEQ ID NO: 3897200 - RNA, 19 nt, Shigella flexneri 2a str. 301
ucaagccccagcaggaugu

SEQ ID NO: 3897201 - RNA, 22 nt, Shigella flexneri 2a str. 301
ucaagcccugguaacugccagg

SEQ ID NO: 3897202 - RNA, 22 nt, Shigella flexneri 2a str. 301
ucaagcgccgaguaaaaaaaca

SEQ ID NO: 3897203 - RNA, 13 nt, Shigella flexneri 2a str. 301
ucaagcgccgcca

SEQ ID NO: 3897204 - RNA, 15 nt, Shigella flexneri 2a str. 301
ucaagcgccgccagu

SEQ ID NO: 3897205 - RNA, 15 nt, Shigella flexneri 2a str. 301
ucaagcgucgcauca

SEQ ID NO: 3897206 - RNA, 17 nt, Shigella flexneri 2a str. 301
ucaagcgucgcaucagg

SEQ ID NO: 3897207 - RNA, 18 nt, Shigella flexneri 2a str. 301
ucaagcgucgcaucaggc

SEQ ID NO: 3897208 - RNA, 20 nt, Shigella flexneri 2a str. 301
ucaagcguuucaucuucagu

SEQ ID NO: 3897209 - RNA, 13 nt, Shigella flexneri 2a str. 301
ucaagcucaaaau

SEQ ID NO: 3897210 - RNA, 14 nt, Shigella flexneri 2a str. 301
ucaagcucaaaaua

SEQ ID NO: 3897211 - RNA, 15 nt, Shigella flexneri 2a str. 301
ucaagcucaaaauaa

SEQ ID NO: 3897212 - RNA, 20 nt, Shigella flexneri 2a str. 301
ucaaggauugcagcacugau

SEQ ID NO: 3897213 - RNA, 23 nt, Shigella flexneri 2a str. 301
ucaaggcauauaccacacccgca

SEQ ID NO: 3897214 - RNA, 14 nt, Shigella flexneri 2a str. 301
ucaaggucaacauu

SEQ ID NO: 3897215 - RNA, 17 nt, Shigella flexneri 2a str. 301
ucaaggugcgcgaugcu

SEQ ID NO: 3897216 - RNA, 21 nt, Shigella flexneri 2a str. 301
ucaaguguggccgccagugau

SEQ ID NO: 3897217 - RNA, 13 nt, Shigella flexneri 2a str. 301
ucaaguuaccggu

SEQ ID NO: 3897218 - RNA, 13 nt, Shigella flexneri 2a str. 301
ucaaguugacucu

SEQ ID NO: 3897219 - RNA, 14 nt, Shigella flexneri 2a str. 301
ucaauaaaagaaau

SEQ ID NO: 3897220 - RNA, 15 nt, Shigella flexneri 2a str. 301
ucaauaaaagaaauc

SEQ ID NO: 3897221 - RNA, 13 nt, Shigella flexneri 2a str. 301
ucaauaaaagcau

SEQ ID NO: 3897222 - RNA, 13 nt, Shigella flexneri 2a str. 301
ucaauaaacggga

SEQ ID NO: 3897223 - RNA, 15 nt, Shigella flexneri 2a str. 301
ucaauaacagcgcaa

SEQ ID NO: 3897224 - RNA, 10 nt, Shigella flexneri 2a str. 301
ucaauaauca

SEQ ID NO: 3897225 - RNA, 13 nt, Shigella flexneri 2a str. 301
ucaauaaucaacg

SEQ ID NO: 3897226 - RNA, 20 nt, Shigella flexneri 2a str. 301
ucaauaaucugauuugucgg

SEQ ID NO: 3897227 - RNA, 19 nt, Shigella flexneri 2a str. 301
ucaauacaacccaccgggc

SEQ ID NO: 3897228 - RNA, 18 nt, Shigella flexneri 2a str. 301
ucacgcccggaauuucaa

SEQ ID NO: 3897229 - RNA, 18 nt, Shigella flexneri 2a str. 301
ucacgccgcauccggcaa

SEQ ID NO: 3897230 - RNA, 19 nt, Shigella flexneri 2a str. 301
ucacgccgcauccggcaua

SEQ ID NO: 3897231 - RNA, 21 nt, Shigella flexneri 2a str. 301
ucacgccgcauccggcauaaa

SEQ ID NO: 3897232 - RNA, 15 nt, Shigella flexneri 2a str. 301
ucacgccgcaucugg

SEQ ID NO: 3897233 - RNA, 16 nt, Shigella flexneri 2a str. 301
ucacgcgccugccagg

SEQ ID NO: 3897234 - RNA, 20 nt, Shigella flexneri 2a str. 301
ucacgcguugcuaugcugaa

SEQ ID NO: 3897235 - RNA, 22 nt, Shigella flexneri 2a str. 301
ucacgcuauacaaccaccccac

SEQ ID NO: 3897236 - RNA, 22 nt, Shigella flexneri 2a str. 301
ucacgcuuaucgcccuggauuu

SEQ ID NO: 3897237 - RNA, 19 nt, Shigella flexneri 2a str. 301
ucacggaaucccguaaucc

SEQ ID NO: 3897238 - RNA, 13 nt, Shigella flexneri 2a str. 301
ucacggcaccagc

SEQ ID NO: 3897239 - RNA, 14 nt, Shigella flexneri 2a str. 301
ucacggcaccagcc

SEQ ID NO: 3897240 - RNA, 15 nt, Shigella flexneri 2a str. 301
ucacggcaccagcca

SEQ ID NO: 3897241 - RNA, 19 nt, Shigella flexneri 2a str. 301
ucacggcccauuccucaug

SEQ ID NO: 3897242 - RNA, 15 nt, Shigella flexneri 2a str. 301
ucacggcgcaugccu

SEQ ID NO: 3897243 - RNA, 21 nt, Shigella flexneri 2a str. 301
ucacguacaaaacgcaccacu

SEQ ID NO: 3897244 - RNA, 22 nt, Shigella flexneri 2a str. 301
ucacguacaaaacgcaccacuu

SEQ ID NO: 3897245 - RNA, 16 nt, Shigella flexneri 2a str. 301
ucacguaggccugaua

SEQ ID NO: 3897246 - RNA, 21 nt, Shigella flexneri 2a str. 301
ucacgucaggaucgugcggca

SEQ ID NO: 3897247 - RNA, 13 nt, Shigella flexneri 2a str. 301
ucacgucgcccac

SEQ ID NO: 3897248 - RNA, 15 nt, Shigella flexneri 2a str. 301
ucacgucucaucagg

SEQ ID NO: 3897249 - RNA, 21 nt, Shigella flexneri 2a str. 301
ucacguucacccaucacuacc

SEQ ID NO: 3897250 - RNA, 16 nt, Shigella flexneri 2a str. 301
ucacguugacgcauac

SEQ ID NO: 3897251 - RNA, 20 nt, Shigella flexneri 2a str. 301
ucacuaagaauguccauuau

SEQ ID NO: 3897252 - RNA, 19 nt, Shigella flexneri 2a str. 301
ucacuaaggguaaaacgac

SEQ ID NO: 3897253 - RNA, 21 nt, Shigella flexneri 2a str. 301
ucacuacaaccgggaucaccg

SEQ ID NO: 3897254 - RNA, 22 nt, Shigella flexneri 2a str. 301
ucacuacaaccgggaucaccga

SEQ ID NO: 3897255 - RNA, 23 nt, Shigella flexneri 2a str. 301
ucacuaccagcgccaccgguuua

SEQ ID NO: 3897256 - RNA, 16 nt, Shigella flexneri 2a str. 301
ucacuaccuucuuccc

SEQ ID NO: 3897257 - RNA, 23 nt, Shigella flexneri 2a str. 301
ucacuauccgccccauuuuuaac

SEQ ID NO: 3897258 - RNA, 14 nt, Shigella flexneri 2a str. 301
ucacuauuaaagaa

SEQ ID NO: 3897259 - RNA, 13 nt, Shigella flexneri 2a str. 301
ucacucaaaauau

SEQ ID NO: 3897260 - RNA, 12 nt, Shigella flexneri 2a str. 301
ucacucaccgca

SEQ ID NO: 3897261 - RNA, 22 nt, Shigella flexneri 2a str. 301
ucacucacgccguuaacuucac

SEQ ID NO: 3897262 - RNA, 12 nt, Shigella flexneri 2a str. 301
ucacucaggcca

SEQ ID NO: 3897263 - RNA, 20 nt, Shigella flexneri 2a str. 301
ucacucaggccaaaugacau

SEQ ID NO: 3897264 - RNA, 13 nt, Shigella flexneri 2a str. 301
ucacucauacuca

SEQ ID NO: 3897265 - RNA, 12 nt, Shigella flexneri 2a str. 301
ucacucaucaac

SEQ ID NO: 3897266 - RNA, 16 nt, Shigella flexneri 2a str. 301
ucacuccacaccauau

SEQ ID NO: 3897267 - RNA, 16 nt, Shigella flexneri 2a str. 301
ucacuccauccagcaa

SEQ ID NO: 3897268 - RNA, 17 nt, Shigella flexneri 2a str. 301
ucacucggggcuuuucu

SEQ ID NO: 3897269 - RNA, 20 nt, Shigella flexneri 2a str. 301
ucacucugcugccacauucc

SEQ ID NO: 3897270 - RNA, 15 nt, Shigella flexneri 2a str. 301
ucacugacaccagca

SEQ ID NO: 3897271 - RNA, 16 nt, Shigella flexneri 2a str. 301
ucacugacaccagcau

SEQ ID NO: 3897272 - RNA, 16 nt, Shigella flexneri 2a str. 301
ucacugaccacuucgg

SEQ ID NO: 3897273 - RNA, 19 nt, Shigella flexneri 2a str. 301
ucacugauagugcugccau

SEQ ID NO: 3897274 - RNA, 15 nt, Shigella flexneri 2a str. 301
ucacugccugcugau

SEQ ID NO: 3897275 - RNA, 22 nt, Shigella flexneri 2a str. 301
ucacugcgaaagcgucagcuuu

SEQ ID NO: 3897276 - RNA, 16 nt, Shigella flexneri 2a str. 301
ucacugcuuaauauua

SEQ ID NO: 3897277 - RNA, 12 nt, Shigella flexneri 2a str. 301
ucacuggcaaug

SEQ ID NO: 3897278 - RNA, 16 nt, Shigella flexneri 2a str. 301
ucacuggcaggauaaa

SEQ ID NO: 3897279 - RNA, 14 nt, Shigella flexneri 2a str. 301
ucacuggcgucaug

SEQ ID NO: 3897280 - RNA, 13 nt, Shigella flexneri 2a str. 301
ucacugggcgauu

SEQ ID NO: 3897281 - RNA, 20 nt, Shigella flexneri 2a str. 301
ucacuggguucaaaaacuaa

SEQ ID NO: 3897282 - RNA, 19 nt, Shigella flexneri 2a str. 301
ucacugugacguugcgaca

SEQ ID NO: 3897283 - RNA, 20 nt, Shigella flexneri 2a str. 301
ucacugugauggaccgugcc

SEQ ID NO: 3897284 - RNA, 17 nt, Shigella flexneri 2a str. 301
ucacuguugaagccgcc

SEQ ID NO: 3897285 - RNA, 11 nt, Shigella flexneri 2a str. 301
ucacuuaaucc

SEQ ID NO: 3897286 - RNA, 20 nt, Shigella flexneri 2a str. 301
ucacuuaguagccagacaau

SEQ ID NO: 3897287 - RNA, 15 nt, Shigella flexneri 2a str. 301
ucacuucaucgccgu

SEQ ID NO: 3897288 - RNA, 18 nt, Shigella flexneri 2a str. 301
ucacuuccaguacgcgca

SEQ ID NO: 3897289 - RNA, 12 nt, Shigella flexneri 2a str. 301
ucacuuccucaa

SEQ ID NO: 3897290 - RNA, 18 nt, Shigella flexneri 2a str. 301
ucacuucgauccagugau

SEQ ID NO: 3897291 - RNA, 16 nt, Shigella flexneri 2a str. 301
ucacuucgucagaaau

SEQ ID NO: 3897292 - RNA, 13 nt, Shigella flexneri 2a str. 301
ucacuucugaguu

SEQ ID NO: 3897293 - RNA, 23 nt, Shigella flexneri 2a str. 301
ucacuucugaguucggcaugggg

SEQ ID NO: 3897294 - RNA, 18 nt, Shigella flexneri 2a str. 301
ucacuucugccucugucg

SEQ ID NO: 3897295 - RNA, 12 nt, Shigella flexneri 2a str. 301
ucacuugcuacc

SEQ ID NO: 3897296 - RNA, 20 nt, Shigella flexneri 2a str. 301
ucacuuucaaauccggccag

SEQ ID NO: 3897297 - RNA, 18 nt, Shigella flexneri 2a str. 301
ucacuuucgagcaauuuu

SEQ ID NO: 3897298 - RNA, 12 nt, Shigella flexneri 2a str. 301
ucacuuucugaa

SEQ ID NO: 3897299 - RNA, 19 nt, Shigella flexneri 2a str. 301
ucacuuuugccagacgaau

SEQ ID NO: 3897300 - RNA, 13 nt, Shigella flexneri 2a str. 301
ucacuuuuuuccg

SEQ ID NO: 3897301 - RNA, 17 nt, Shigella flexneri 2a str. 301
ucagaaacacacuuucc

SEQ ID NO: 3897302 - RNA, 22 nt, Shigella flexneri 2a str. 301
ucagaaacgcucauaaauugca

SEQ ID NO: 3897303 - RNA, 20 nt, Shigella flexneri 2a str. 301
ucagaaagccgccgacaugu

SEQ ID NO: 3897304 - RNA, 16 nt, Shigella flexneri 2a str. 301
ucagaaagugccacgc

SEQ ID NO: 3897305 - RNA, 20 nt, Shigella flexneri 2a str. 301
ucagaaaugccaguaacuca

SEQ ID NO: 3897306 - RNA, 23 nt, Shigella flexneri 2a str. 301
ucagaaauuuggcuccucugacu

SEQ ID NO: 3897307 - RNA, 18 nt, Shigella flexneri 2a str. 301
ucagaacacuucuucugu

SEQ ID NO: 3897308 - RNA, 22 nt, Shigella flexneri 2a str. 301
ucagaacaguuuucagugcuuc

SEQ ID NO: 3897309 - RNA, 14 nt, Shigella flexneri 2a str. 301
ucagaacguaaacg

SEQ ID NO: 3897310 - RNA, 16 nt, Shigella flexneri 2a str. 301
ucagaacguaaacgca

SEQ ID NO: 3897311 - RNA, 15 nt, Shigella flexneri 2a str. 301
ucagaagacgcucca

SEQ ID NO: 3897312 - RNA, 19 nt, Shigella flexneri 2a str. 301
ucagaagacgcuccagugu

SEQ ID NO: 3897313 - RNA, 11 nt, Shigella flexneri 2a str. 301
ucagaaucagg

SEQ ID NO: 3897314 - RNA, 16 nt, Shigella flexneri 2a str. 301
ucagaaucgcgcccca

SEQ ID NO: 3897315 - RNA, 20 nt, Shigella flexneri 2a str. 301
ucagaaugcccacgccgcau

SEQ ID NO: 3897316 - RNA, 18 nt, Shigella flexneri 2a str. 301
ucagaaugcgcucuuccg

SEQ ID NO: 3897317 - RNA, 20 nt, Shigella flexneri 2a str. 301
ucagacaaaugucacugcuu

SEQ ID NO: 3897318 - RNA, 16 nt, Shigella flexneri 2a str. 301
ucagacaacuucccug

SEQ ID NO: 3897319 - RNA, 13 nt, Shigella flexneri 2a str. 301
ucagacaccgauu

SEQ ID NO: 3897320 - RNA, 19 nt, Shigella flexneri 2a str. 301
ucagacacgccgccagacc

SEQ ID NO: 3897321 - RNA, 22 nt, Shigella flexneri 2a str. 301
ucagacacgccgccagaccaau

SEQ ID NO: 3897322 - RNA, 17 nt, Shigella flexneri 2a str. 301
ucagaccaaucaccacu

SEQ ID NO: 3897323 - RNA, 20 nt, Shigella flexneri 2a str. 301
ucagaccaaucaccacuucg

SEQ ID NO: 3897324 - RNA, 16 nt, Shigella flexneri 2a str. 301
ucagaccaauccagcc

SEQ ID NO: 3897325 - RNA, 22 nt, Shigella flexneri 2a str. 301
ucagaccaauccagccggcaaa

SEQ ID NO: 3897326 - RNA, 14 nt, Shigella flexneri 2a str. 301
ucagaccaccgguu

SEQ ID NO: 3897327 - RNA, 19 nt, Shigella flexneri 2a str. 301
ucagaccagacugcuccug

SEQ ID NO: 3897328 - RNA, 12 nt, Shigella flexneri 2a str. 301
ucagcggugcgg

SEQ ID NO: 3897329 - RNA, 14 nt, Shigella flexneri 2a str. 301
ucagcgguuuugcc

SEQ ID NO: 3897330 - RNA, 22 nt, Shigella flexneri 2a str. 301
ucagcgucuguuuuaucacauc

SEQ ID NO: 3897331 - RNA, 13 nt, Shigella flexneri 2a str. 301
ucagcgugcccac

SEQ ID NO: 3897332 - RNA, 15 nt, Shigella flexneri 2a str. 301
ucagcguuccccaga

SEQ ID NO: 3897333 - RNA, 14 nt, Shigella flexneri 2a str. 301
ucagcguugaaugc

SEQ ID NO: 3897334 - RNA, 15 nt, Shigella flexneri 2a str. 301
ucagcguugccagua

SEQ ID NO: 3897335 - RNA, 14 nt, Shigella flexneri 2a str. 301
ucagcuaauggcug

SEQ ID NO: 3897336 - RNA, 23 nt, Shigella flexneri 2a str. 301
ucagcuauucuuauaaagaaaau

SEQ ID NO: 3897337 - RNA, 19 nt, Shigella flexneri 2a str. 301
ucagcuccacaagaaugcc

SEQ ID NO: 3897338 - RNA, 21 nt, Shigella flexneri 2a str. 301
ucagcuccucuuucauuucac

SEQ ID NO: 3897339 - RNA, 15 nt, Shigella flexneri 2a str. 301
ucagcucgcugccau

SEQ ID NO: 3897340 - RNA, 17 nt, Shigella flexneri 2a str. 301
ucagcugcacacagggc

SEQ ID NO: 3897341 - RNA, 14 nt, Shigella flexneri 2a str. 301
ucagcugccagggc

SEQ ID NO: 3897342 - RNA, 15 nt, Shigella flexneri 2a str. 301
ucagcugccagggca

SEQ ID NO: 3897343 - RNA, 15 nt, Shigella flexneri 2a str. 301
ucagcuggaucgaga

SEQ ID NO: 3897344 - RNA, 23 nt, Shigella flexneri 2a str. 301
ucagcuucagauugcaccacauc

SEQ ID NO: 3897345 - RNA, 17 nt, Shigella flexneri 2a str. 301
ucagcuugucuacgccu

SEQ ID NO: 3897346 - RNA, 19 nt, Shigella flexneri 2a str. 301
ucagcuuuggugaaaaaau

SEQ ID NO: 3897347 - RNA, 14 nt, Shigella flexneri 2a str. 301
ucagcuuuuccaua

SEQ ID NO: 3897348 - RNA, 16 nt, Shigella flexneri 2a str. 301
ucaggaaauaaauaau

SEQ ID NO: 3897349 - RNA, 22 nt, Shigella flexneri 2a str. 301
ucaggaaccacaaccacuuugu

SEQ ID NO: 3897350 - RNA, 15 nt, Shigella flexneri 2a str. 301
ucaggaauauguuca

SEQ ID NO: 3897351 - RNA, 13 nt, Shigella flexneri 2a str. 301
ucaggagcaggcu

SEQ ID NO: 3897352 - RNA, 13 nt, Shigella flexneri 2a str. 301
ucaggaguuuaau

SEQ ID NO: 3897353 - RNA, 21 nt, Shigella flexneri 2a str. 301
ucaggaucagccauuuugcac

SEQ ID NO: 3897354 - RNA, 16 nt, Shigella flexneri 2a str. 301
ucaggaucugacaucc

SEQ ID NO: 3897355 - RNA, 17 nt, Shigella flexneri 2a str. 301
ucaggcaacccagaaga

SEQ ID NO: 3897356 - RNA, 18 nt, Shigella flexneri 2a str. 301
ucaggcaacccagaagaa

SEQ ID NO: 3897357 - RNA, 22 nt, Shigella flexneri 2a str. 301
ucaggcaagccgcuaacagcag

SEQ ID NO: 3897358 - RNA, 18 nt, Shigella flexneri 2a str. 301
ucaggcacuucuucugca

SEQ ID NO: 3897359 - RNA, 22 nt, Shigella flexneri 2a str. 301
ucaggcagauacaaccaaucgc

SEQ ID NO: 3897360 - RNA, 18 nt, Shigella flexneri 2a str. 301
ucaggcaggucuuucacc

SEQ ID NO: 3897361 - RNA, 17 nt, Shigella flexneri 2a str. 301
ucaggcaguuuugcguu

SEQ ID NO: 3897362 - RNA, 16 nt, Shigella flexneri 2a str. 301
ucaggcaucugagcau

SEQ ID NO: 3897363 - RNA, 17 nt, Shigella flexneri 2a str. 301
ucaggcauuacugugca

SEQ ID NO: 3897364 - RNA, 20 nt, Shigella flexneri 2a str. 301
ucaggcauucucgaauuaau

SEQ ID NO: 3897365 - RNA, 17 nt, Shigella flexneri 2a str. 301
ucaggcauuugcuccag

SEQ ID NO: 3897366 - RNA, 21 nt, Shigella flexneri 2a str. 301
ucaggccacgucuuaauguaa

SEQ ID NO: 3897367 - RNA, 11 nt, Shigella flexneri 2a str. 301
ucaggccagga

SEQ ID NO: 3897368 - RNA, 21 nt, Shigella flexneri 2a str. 301
ucaggccaggauuacgcucac

SEQ ID NO: 3897369 - RNA, 21 nt, Shigella flexneri 2a str. 301
ucaggcccgccagcgccuggg

SEQ ID NO: 3897370 - RNA, 16 nt, Shigella flexneri 2a str. 301
ucaggccgaggcacag

SEQ ID NO: 3897371 - RNA, 18 nt, Shigella flexneri 2a str. 301
ucaggccgaggcacagca

SEQ ID NO: 3897372 - RNA, 15 nt, Shigella flexneri 2a str. 301
ucaggccuacaaaau

SEQ ID NO: 3897373 - RNA, 21 nt, Shigella flexneri 2a str. 301
ucaggccuacaaaaugugcca

SEQ ID NO: 3897374 - RNA, 19 nt, Shigella flexneri 2a str. 301
ucaggccuacaaaugggca

SEQ ID NO: 3897375 - RNA, 16 nt, Shigella flexneri 2a str. 301
ucaggccuacaggauu

SEQ ID NO: 3897376 - RNA, 23 nt, Shigella flexneri 2a str. 301
ucaggcgaaucuuagugcgccug

SEQ ID NO: 3897377 - RNA, 12 nt, Shigella flexneri 2a str. 301
ucaggcgcugca

SEQ ID NO: 3897378 - RNA, 15 nt, Shigella flexneri 2a str. 301
ucaggcggcucaccu

SEQ ID NO: 3897379 - RNA, 16 nt, Shigella flexneri 2a str. 301
ucaggcggcucaccug

SEQ ID NO: 3897380 - RNA, 18 nt, Shigella flexneri 2a str. 301
ucaggcgugauucauaca

SEQ ID NO: 3897381 - RNA, 14 nt, Shigella flexneri 2a str. 301
ucaggcguugaaaa

SEQ ID NO: 3897382 - RNA, 22 nt, Shigella flexneri 2a str. 301
ucaggcguuuguaacccaccau

SEQ ID NO: 3897383 - RNA, 16 nt, Shigella flexneri 2a str. 301
ucaggcuacuuuucca

SEQ ID NO: 3897384 - RNA, 14 nt, Shigella flexneri 2a str. 301
ucaggcugcuaucc

SEQ ID NO: 3897385 - RNA, 20 nt, Shigella flexneri 2a str. 301
ucaggcuguguuuaagacgc

SEQ ID NO: 3897386 - RNA, 15 nt, Shigella flexneri 2a str. 301
ucaggcuucuguacc

SEQ ID NO: 3897387 - RNA, 20 nt, Shigella flexneri 2a str. 301
ucagggagucuugcuggaug

SEQ ID NO: 3897388 - RNA, 16 nt, Shigella flexneri 2a str. 301
ucagggccgaucaacg

SEQ ID NO: 3897389 - RNA, 22 nt, Shigella flexneri 2a str. 301
ucagggcgacaaucaucgccuu

SEQ ID NO: 3897390 - RNA, 17 nt, Shigella flexneri 2a str. 301
ucaggggcagcaccauc

SEQ ID NO: 3897391 - RNA, 15 nt, Shigella flexneri 2a str. 301
ucaggguaucccgcc

SEQ ID NO: 3897392 - RNA, 16 nt, Shigella flexneri 2a str. 301
ucagggucuuccagca

SEQ ID NO: 3897393 - RNA, 18 nt, Shigella flexneri 2a str. 301
ucagggucuuccagcaaa

SEQ ID NO: 3897394 - RNA, 22 nt, Shigella flexneri 2a str. 301
ucaggguugccauacagacacc

SEQ ID NO: 3897395 - RNA, 15 nt, Shigella flexneri 2a str. 301
ucagguaacagggaa

SEQ ID NO: 3897396 - RNA, 17 nt, Shigella flexneri 2a str. 301
ucagguaacagggaacu

SEQ ID NO: 3897397 - RNA, 18 nt, Shigella flexneri 2a str. 301
ucagguagcgcauaagcc

SEQ ID NO: 3897398 - RNA, 20 nt, Shigella flexneri 2a str. 301
ucagguauucguuaaaacca

SEQ ID NO: 3897399 - RNA, 14 nt, Shigella flexneri 2a str. 301
ucaggucagcgaau

SEQ ID NO: 3897400 - RNA, 15 nt, Shigella flexneri 2a str. 301
ucaggucugcaaaau

SEQ ID NO: 3897401 - RNA, 14 nt, Shigella flexneri 2a str. 301
ucaggugucuggca

SEQ ID NO: 3897402 - RNA, 15 nt, Shigella flexneri 2a str. 301
ucagguguuaguguu

SEQ ID NO: 3897403 - RNA, 18 nt, Shigella flexneri 2a str. 301
ucagguguuaguguucau

SEQ ID NO: 3897404 - RNA, 20 nt, Shigella flexneri 2a str. 301
ucagguuguuuucuggcuga

SEQ ID NO: 3897405 - RNA, 19 nt, Shigella flexneri 2a str. 301
ucaguaaccgcuuuuucaa

SEQ ID NO: 3897406 - RNA, 12 nt, Shigella flexneri 2a str. 301
ucaguaagccuu

SEQ ID NO: 3897407 - RNA, 18 nt, Shigella flexneri 2a str. 301
ucaguaagccuuucagga

SEQ ID NO: 3897408 - RNA, 23 nt, Shigella flexneri 2a str. 301
ucaguaagccuuucaggaaacug

SEQ ID NO: 3897409 - RNA, 19 nt, Shigella flexneri 2a str. 301
ucaguaauccuuucucaau

SEQ ID NO: 3897410 - RNA, 16 nt, Shigella flexneri 2a str. 301
ucaguagaauaaucug

SEQ ID NO: 3897411 - RNA, 15 nt, Shigella flexneri 2a str. 301
ucaguagauuucguu

SEQ ID NO: 3897412 - RNA, 14 nt, Shigella flexneri 2a str. 301
ucaguagcgcaauc

SEQ ID NO: 3897413 - RNA, 21 nt, Shigella flexneri 2a str. 301
ucaguagcgcaaucaccacca

SEQ ID NO: 3897414 - RNA, 22 nt, Shigella flexneri 2a str. 301
ucaguagcgcaaucaccaccac

SEQ ID NO: 3897415 - RNA, 13 nt, Shigella flexneri 2a str. 301
ucaguauaacuac

SEQ ID NO: 3897416 - RNA, 17 nt, Shigella flexneri 2a str. 301
ucaguauaacuacugau

SEQ ID NO: 3897417 - RNA, 13 nt, Shigella flexneri 2a str. 301
ucaguauuuccac

SEQ ID NO: 3897418 - RNA, 15 nt, Shigella flexneri 2a str. 301
ucaguauuuccacaa

SEQ ID NO: 3897419 - RNA, 23 nt, Shigella flexneri 2a str. 301
ucagucacgacaaagacaucaaa

SEQ ID NO: 3897420 - RNA, 13 nt, Shigella flexneri 2a str. 301
ucagucagcagug

SEQ ID NO: 3897421 - RNA, 20 nt, Shigella flexneri 2a str. 301
ucagucaguggcagcaaauc

SEQ ID NO: 3897422 - RNA, 17 nt, Shigella flexneri 2a str. 301
ucagucgccagcgccag

SEQ ID NO: 3897423 - RNA, 15 nt, Shigella flexneri 2a str. 301
ucagucgugauuguc

SEQ ID NO: 3897424 - RNA, 16 nt, Shigella flexneri 2a str. 301
ucagucuagcccgaug

SEQ ID NO: 3897425 - RNA, 13 nt, Shigella flexneri 2a str. 301
ucagucucaaacc

SEQ ID NO: 3897426 - RNA, 21 nt, Shigella flexneri 2a str. 301
ucagucucaaaccggcuccag

SEQ ID NO: 3897427 - RNA, 18 nt, Shigella flexneri 2a str. 301
ucagugaacaauuaacgu

SEQ ID NO: 3897428 - RNA, 15 nt, Shigella flexneri 2a str. 301
ucaucagcauucuca

SEQ ID NO: 3897429 - RNA, 19 nt, Shigella flexneri 2a str. 301
ucaucagcggcgaagccua

SEQ ID NO: 3897430 - RNA, 17 nt, Shigella flexneri 2a str. 301
ucaucagcgucgguuuc

SEQ ID NO: 3897431 - RNA, 18 nt, Shigella flexneri 2a str. 301
ucaucaggccuggacucu

SEQ ID NO: 3897432 - RNA, 21 nt, Shigella flexneri 2a str. 301
ucaucaguaagccagcaccau

SEQ ID NO: 3897433 - RNA, 21 nt, Shigella flexneri 2a str. 301
ucaucaguucaggaucugaca

SEQ ID NO: 3897434 - RNA, 12 nt, Shigella flexneri 2a str. 301
ucaucaucacga

SEQ ID NO: 3897435 - RNA, 19 nt, Shigella flexneri 2a str. 301
ucaucaucaggaacauccc

SEQ ID NO: 3897436 - RNA, 22 nt, Shigella flexneri 2a str. 301
ucaucaucgcagauuucuucug

SEQ ID NO: 3897437 - RNA, 21 nt, Shigella flexneri 2a str. 301
ucaucaucgcgcccaaaccac

SEQ ID NO: 3897438 - RNA, 15 nt, Shigella flexneri 2a str. 301
ucaucaucuuuauau

SEQ ID NO: 3897439 - RNA, 18 nt, Shigella flexneri 2a str. 301
ucaucaugggcaagguau

SEQ ID NO: 3897440 - RNA, 16 nt, Shigella flexneri 2a str. 301
ucaucauguggcugga

SEQ ID NO: 3897441 - RNA, 17 nt, Shigella flexneri 2a str. 301
ucaucauugcagucaua

SEQ ID NO: 3897442 - RNA, 18 nt, Shigella flexneri 2a str. 301
ucaucauuuuuucaccaa

SEQ ID NO: 3897443 - RNA, 17 nt, Shigella flexneri 2a str. 301
ucauccaaaucgcccag

SEQ ID NO: 3897444 - RNA, 12 nt, Shigella flexneri 2a str. 301
ucauccaacaau

SEQ ID NO: 3897445 - RNA, 22 nt, Shigella flexneri 2a str. 301
ucauccagaccgcucagcuccu

SEQ ID NO: 3897446 - RNA, 16 nt, Shigella flexneri 2a str. 301
ucauccagacugcuca

SEQ ID NO: 3897447 - RNA, 18 nt, Shigella flexneri 2a str. 301
ucauccagacugcucagc

SEQ ID NO: 3897448 - RNA, 11 nt, Shigella flexneri 2a str. 301
ucauccagcac

SEQ ID NO: 3897449 - RNA, 18 nt, Shigella flexneri 2a str. 301
ucauccagcacggugaag

SEQ ID NO: 3897450 - RNA, 13 nt, Shigella flexneri 2a str. 301
ucauccagcacuu

SEQ ID NO: 3897451 - RNA, 23 nt, Shigella flexneri 2a str. 301
ucauccagcacuugcaggaacag

SEQ ID NO: 3897452 - RNA, 13 nt, Shigella flexneri 2a str. 301
ucauccagcagcg

SEQ ID NO: 3897453 - RNA, 13 nt, Shigella flexneri 2a str. 301
ucauccagcauca

SEQ ID NO: 3897454 - RNA, 15 nt, Shigella flexneri 2a str. 301
ucauccagugccgcc

SEQ ID NO: 3897455 - RNA, 15 nt, Shigella flexneri 2a str. 301
ucauccagugcuuca

SEQ ID NO: 3897456 - RNA, 14 nt, Shigella flexneri 2a str. 301
ucauccauacggca

SEQ ID NO: 3897457 - RNA, 14 nt, Shigella flexneri 2a str. 301
ucauccaugauaau

SEQ ID NO: 3897458 - RNA, 14 nt, Shigella flexneri 2a str. 301
ucauccccucuucc

SEQ ID NO: 3897459 - RNA, 16 nt, Shigella flexneri 2a str. 301
ucaucccuacagguaa

SEQ ID NO: 3897460 - RNA, 18 nt, Shigella flexneri 2a str. 301
ucauccgcacaaucccuu

SEQ ID NO: 3897461 - RNA, 20 nt, Shigella flexneri 2a str. 301
ucauccggcaccuuuucauc

SEQ ID NO: 3897462 - RNA, 19 nt, Shigella flexneri 2a str. 301
ucauccggcacgcuaccau

SEQ ID NO: 3897463 - RNA, 18 nt, Shigella flexneri 2a str. 301
ucauccggcuuucuucug

SEQ ID NO: 3897464 - RNA, 23 nt, Shigella flexneri 2a str. 301
ucauccgucaccggaauaaugau

SEQ ID NO: 3897465 - RNA, 19 nt, Shigella flexneri 2a str. 301
ucauccguuucucuguuca

SEQ ID NO: 3897466 - RNA, 14 nt, Shigella flexneri 2a str. 301
ucauccugacccag

SEQ ID NO: 3897467 - RNA, 22 nt, Shigella flexneri 2a str. 301
ucauccuguacgacaaaagaau

SEQ ID NO: 3897468 - RNA, 12 nt, Shigella flexneri 2a str. 301
ucauccuucagu

SEQ ID NO: 3897469 - RNA, 15 nt, Shigella flexneri 2a str. 301
ucauccuucagugcc

SEQ ID NO: 3897470 - RNA, 20 nt, Shigella flexneri 2a str. 301
ucauccuucauuauccuucg

SEQ ID NO: 3897471 - RNA, 23 nt, Shigella flexneri 2a str. 301
ucauccuuugggcauuugcacaa

SEQ ID NO: 3897472 - RNA, 22 nt, Shigella flexneri 2a str. 301
ucaucgacaaaaacccugccgu

SEQ ID NO: 3897473 - RNA, 14 nt, Shigella flexneri 2a str. 301
ucaucgaccccagg

SEQ ID NO: 3897474 - RNA, 15 nt, Shigella flexneri 2a str. 301
ucaucgauaccaaua

SEQ ID NO: 3897475 - RNA, 17 nt, Shigella flexneri 2a str. 301
ucaucgaugagaugacg

SEQ ID NO: 3897476 - RNA, 16 nt, Shigella flexneri 2a str. 301
ucaucgaugcgaucau

SEQ ID NO: 3897477 - RNA, 19 nt, Shigella flexneri 2a str. 301
ucaucgauuuggcucaaca

SEQ ID NO: 3897478 - RNA, 12 nt, Shigella flexneri 2a str. 301
ucaucgcaaaug

SEQ ID NO: 3897479 - RNA, 14 nt, Shigella flexneri 2a str. 301
ucaucgcaaugauu

SEQ ID NO: 3897480 - RNA, 19 nt, Shigella flexneri 2a str. 301
ucaucgcagauuucuucug

SEQ ID NO: 3897481 - RNA, 13 nt, Shigella flexneri 2a str. 301
ucaucgcauccag

SEQ ID NO: 3897482 - RNA, 22 nt, Shigella flexneri 2a str. 301
ucaucgcaucgaugguugcccu

SEQ ID NO: 3897483 - RNA, 22 nt, Shigella flexneri 2a str. 301
ucaucgcccaguugaucaccag

SEQ ID NO: 3897484 - RNA, 20 nt, Shigella flexneri 2a str. 301
ucaucgcccuuuuuucaggu

SEQ ID NO: 3897485 - RNA, 21 nt, Shigella flexneri 2a str. 301
ucaucgccgcuggccauuucu

SEQ ID NO: 3897486 - RNA, 23 nt, Shigella flexneri 2a str. 301
ucaucgccgguaaaaaugcgcag

SEQ ID NO: 3897487 - RNA, 18 nt, Shigella flexneri 2a str. 301
ucaucgccgucacgguaa

SEQ ID NO: 3897488 - RNA, 16 nt, Shigella flexneri 2a str. 301
ucaucgccuuccagcg

SEQ ID NO: 3897489 - RNA, 17 nt, Shigella flexneri 2a str. 301
ucaucgcggcacacagc

SEQ ID NO: 3897490 - RNA, 23 nt, Shigella flexneri 2a str. 301
ucaucgcuuucggaaagaucgcc

SEQ ID NO: 3897491 - RNA, 21 nt, Shigella flexneri 2a str. 301
ucaucggcggcagaugacuug

SEQ ID NO: 3897492 - RNA, 19 nt, Shigella flexneri 2a str. 301
ucaucgggaagaggaucug

SEQ ID NO: 3897493 - RNA, 16 nt, Shigella flexneri 2a str. 301
ucaucggguuacugau

SEQ ID NO: 3897494 - RNA, 16 nt, Shigella flexneri 2a str. 301
ucaucgguauaaccaa

SEQ ID NO: 3897495 - RNA, 20 nt, Shigella flexneri 2a str. 301
ucaucgguaugcaacaucag

SEQ ID NO: 3897496 - RNA, 13 nt, Shigella flexneri 2a str. 301
ucaucguagaaca

SEQ ID NO: 3897497 - RNA, 17 nt, Shigella flexneri 2a str. 301
ucaucucccacgcggca

SEQ ID NO: 3897498 - RNA, 15 nt, Shigella flexneri 2a str. 301
ucaucucuccuuucg

SEQ ID NO: 3897499 - RNA, 22 nt, Shigella flexneri 2a str. 301
ucaucucuuccggcaccacaaa

SEQ ID NO: 3897500 - RNA, 16 nt, Shigella flexneri 2a str. 301
ucaucugaccacggcc

SEQ ID NO: 3897501 - RNA, 19 nt, Shigella flexneri 2a str. 301
ucaucugauaucucaccag

SEQ ID NO: 3897502 - RNA, 20 nt, Shigella flexneri 2a str. 301
ucaucugauaucucaccaga

SEQ ID NO: 3897503 - RNA, 22 nt, Shigella flexneri 2a str. 301
ucaucugaugauauuuuucccu

SEQ ID NO: 3897504 - RNA, 15 nt, Shigella flexneri 2a str. 301
ucaucugcaccgauu

SEQ ID NO: 3897505 - RNA, 15 nt, Shigella flexneri 2a str. 301
ucaucuggcguacca

SEQ ID NO: 3897506 - RNA, 19 nt, Shigella flexneri 2a str. 301
ucaucuggcguaccaauca

SEQ ID NO: 3897507 - RNA, 22 nt, Shigella flexneri 2a str. 301
ucaucuguugugccacauccag

SEQ ID NO: 3897508 - RNA, 14 nt, Shigella flexneri 2a str. 301
ucaucuuaacuucg

SEQ ID NO: 3897509 - RNA, 16 nt, Shigella flexneri 2a str. 301
ucaucuucaacugcca

SEQ ID NO: 3897510 - RNA, 15 nt, Shigella flexneri 2a str. 301
ucaucuucagucagg

SEQ ID NO: 3897511 - RNA, 19 nt, Shigella flexneri 2a str. 301
ucaucuucgaaaguagaag

SEQ ID NO: 3897512 - RNA, 13 nt, Shigella flexneri 2a str. 301
ucaucuucuucug

SEQ ID NO: 3897513 - RNA, 17 nt, Shigella flexneri 2a str. 301
ucaucuuuccaaaccuc

SEQ ID NO: 3897514 - RNA, 15 nt, Shigella flexneri 2a str. 301
ucaucuuugaaauca

SEQ ID NO: 3897515 - RNA, 20 nt, Shigella flexneri 2a str. 301
ucaucuuugaaaucacgcau

SEQ ID NO: 3897516 - RNA, 16 nt, Shigella flexneri 2a str. 301
ucaugaaaaccguuag

SEQ ID NO: 3897517 - RNA, 17 nt, Shigella flexneri 2a str. 301
ucaugaacacacccgga

SEQ ID NO: 3897518 - RNA, 22 nt, Shigella flexneri 2a str. 301
ucaugacgauacggaauaucgc

SEQ ID NO: 3897519 - RNA, 16 nt, Shigella flexneri 2a str. 301
ucaugacgccaccagc

SEQ ID NO: 3897520 - RNA, 17 nt, Shigella flexneri 2a str. 301
ucaugacgccaccagcg

SEQ ID NO: 3897521 - RNA, 17 nt, Shigella flexneri 2a str. 301
ucaugaguuccacuggu

SEQ ID NO: 3897522 - RNA, 17 nt, Shigella flexneri 2a str. 301
ucaugauacagccgaca

SEQ ID NO: 3897523 - RNA, 12 nt, Shigella flexneri 2a str. 301
ucaugaugaccg

SEQ ID NO: 3897524 - RNA, 23 nt, Shigella flexneri 2a str. 301
ucaugcaacacguuaacaauguu

SEQ ID NO: 3897525 - RNA, 12 nt, Shigella flexneri 2a str. 301
ucaugcaauaaa

SEQ ID NO: 3897526 - RNA, 20 nt, Shigella flexneri 2a str. 301
ucaugcagcuccaccgauuu

SEQ ID NO: 3897527 - RNA, 12 nt, Shigella flexneri 2a str. 301
ucaugcaucagg

SEQ ID NO: 3897528 - RNA, 13 nt, Shigella flexneri 2a str. 301
uccaccuggccug

SEQ ID NO: 3897529 - RNA, 18 nt, Shigella flexneri 2a str. 301
uccaccuucuguaacugg

SEQ ID NO: 3897530 - RNA, 18 nt, Shigella flexneri 2a str. 301
uccacgaaacggcguuga

SEQ ID NO: 3897531 - RNA, 22 nt, Shigella flexneri 2a str. 301
uccacgaaacggcguugagcaa

SEQ ID NO: 3897532 - RNA, 22 nt, Shigella flexneri 2a str. 301
uccacgccguuuuuacccagca

SEQ ID NO: 3897533 - RNA, 13 nt, Shigella flexneri 2a str. 301
uccacgccugcau

SEQ ID NO: 3897534 - RNA, 17 nt, Shigella flexneri 2a str. 301
uccacgcgccacgcacg

SEQ ID NO: 3897535 - RNA, 19 nt, Shigella flexneri 2a str. 301
uccacgcuauacagcagcc

SEQ ID NO: 3897536 - RNA, 19 nt, Shigella flexneri 2a str. 301
uccacggggacuccacacc

SEQ ID NO: 3897537 - RNA, 15 nt, Shigella flexneri 2a str. 301
uccacgguucuccac

SEQ ID NO: 3897538 - RNA, 19 nt, Shigella flexneri 2a str. 301
uccacgguugguuuuaucc

SEQ ID NO: 3897539 - RNA, 14 nt, Shigella flexneri 2a str. 301
uccacuaacuguuu

SEQ ID NO: 3897540 - RNA, 16 nt, Shigella flexneri 2a str. 301
uccacuauaaaaaaac

SEQ ID NO: 3897541 - RNA, 18 nt, Shigella flexneri 2a str. 301
uccacuauuucaauauga

SEQ ID NO: 3897542 - RNA, 19 nt, Shigella flexneri 2a str. 301
uccacucauuaauuuccug

SEQ ID NO: 3897543 - RNA, 19 nt, Shigella flexneri 2a str. 301
uccacuccgguguuuucuc

SEQ ID NO: 3897544 - RNA, 20 nt, Shigella flexneri 2a str. 301
uccacuccgguguuuucucu

SEQ ID NO: 3897545 - RNA, 15 nt, Shigella flexneri 2a str. 301
uccacugcgagaaaa

SEQ ID NO: 3897546 - RNA, 19 nt, Shigella flexneri 2a str. 301
uccacuggcugcuuucuuu

SEQ ID NO: 3897547 - RNA, 15 nt, Shigella flexneri 2a str. 301
uccacugucaaaucc

SEQ ID NO: 3897548 - RNA, 16 nt, Shigella flexneri 2a str. 301
uccacugucaaaucca

SEQ ID NO: 3897549 - RNA, 17 nt, Shigella flexneri 2a str. 301
uccacuucauaauccag

SEQ ID NO: 3897550 - RNA, 13 nt, Shigella flexneri 2a str. 301
uccacuucaucaa

SEQ ID NO: 3897551 - RNA, 14 nt, Shigella flexneri 2a str. 301
uccacuuccaccac

SEQ ID NO: 3897552 - RNA, 21 nt, Shigella flexneri 2a str. 301
uccacuuccaccacuuccugc

SEQ ID NO: 3897553 - RNA, 16 nt, Shigella flexneri 2a str. 301
uccacuuccaccagcg

SEQ ID NO: 3897554 - RNA, 19 nt, Shigella flexneri 2a str. 301
uccacuuccaccagcggcu

SEQ ID NO: 3897555 - RNA, 20 nt, Shigella flexneri 2a str. 301
uccacuuccgcgucaaucug

SEQ ID NO: 3897556 - RNA, 21 nt, Shigella flexneri 2a str. 301
uccacuuccgcgucaaucugc

SEQ ID NO: 3897557 - RNA, 14 nt, Shigella flexneri 2a str. 301
uccacuugaaaauu

SEQ ID NO: 3897558 - RNA, 16 nt, Shigella flexneri 2a str. 301
uccacuuucacgccca

SEQ ID NO: 3897559 - RNA, 17 nt, Shigella flexneri 2a str. 301
uccagaauaucuucaac

SEQ ID NO: 3897560 - RNA, 20 nt, Shigella flexneri 2a str. 301
uccagacacuccagagaauu

SEQ ID NO: 3897561 - RNA, 18 nt, Shigella flexneri 2a str. 301
uccagaccauauuuucau

SEQ ID NO: 3897562 - RNA, 14 nt, Shigella flexneri 2a str. 301
uccagacccuucau

SEQ ID NO: 3897563 - RNA, 21 nt, Shigella flexneri 2a str. 301
uccagacgcgcagcuucacuu

SEQ ID NO: 3897564 - RNA, 18 nt, Shigella flexneri 2a str. 301
uccagacggagcugccag

SEQ ID NO: 3897565 - RNA, 22 nt, Shigella flexneri 2a str. 301
uccagacggguacaguuuucca

SEQ ID NO: 3897566 - RNA, 16 nt, Shigella flexneri 2a str. 301
uccagacucaacaggc

SEQ ID NO: 3897567 - RNA, 21 nt, Shigella flexneri 2a str. 301
uccagagcagcgaauuucuca

SEQ ID NO: 3897568 - RNA, 23 nt, Shigella flexneri 2a str. 301
uccagauagaacaucucuuccca

SEQ ID NO: 3897569 - RNA, 22 nt, Shigella flexneri 2a str. 301
uccagaucacgcagcaagccgu

SEQ ID NO: 3897570 - RNA, 20 nt, Shigella flexneri 2a str. 301
uccagauccauaagguccuc

SEQ ID NO: 3897571 - RNA, 22 nt, Shigella flexneri 2a str. 301
uccagaucgaucauauuuccuu

SEQ ID NO: 3897572 - RNA, 18 nt, Shigella flexneri 2a str. 301
uccagauuaccagcgaca

SEQ ID NO: 3897573 - RNA, 22 nt, Shigella flexneri 2a str. 301
uccagauucaguuucaccgcgu

SEQ ID NO: 3897574 - RNA, 22 nt, Shigella flexneri 2a str. 301
uccagauugaucucuaaggcau

SEQ ID NO: 3897575 - RNA, 21 nt, Shigella flexneri 2a str. 301
uccagauuuauaaaagaaaaa

SEQ ID NO: 3897576 - RNA, 21 nt, Shigella flexneri 2a str. 301
uccagauuuugcuuacgcgug

SEQ ID NO: 3897577 - RNA, 17 nt, Shigella flexneri 2a str. 301
uccagcacacuguaagc

SEQ ID NO: 3897578 - RNA, 14 nt, Shigella flexneri 2a str. 301
uccagcaccaguuc

SEQ ID NO: 3897579 - RNA, 21 nt, Shigella flexneri 2a str. 301
uccagcaccaguucacccuca

SEQ ID NO: 3897580 - RNA, 17 nt, Shigella flexneri 2a str. 301
uccagcacggugaagaa

SEQ ID NO: 3897581 - RNA, 18 nt, Shigella flexneri 2a str. 301
uccagcacgucgagcagg

SEQ ID NO: 3897582 - RNA, 17 nt, Shigella flexneri 2a str. 301
uccagcagaccagcaaa

SEQ ID NO: 3897583 - RNA, 20 nt, Shigella flexneri 2a str. 301
uccagcagaccuucugccag

SEQ ID NO: 3897584 - RNA, 14 nt, Shigella flexneri 2a str. 301
uccagcagcggauc

SEQ ID NO: 3897585 - RNA, 17 nt, Shigella flexneri 2a str. 301
uccagcauaaugacucu

SEQ ID NO: 3897586 - RNA, 22 nt, Shigella flexneri 2a str. 301
uccagcauaccuuccagcgcgu

SEQ ID NO: 3897587 - RNA, 22 nt, Shigella flexneri 2a str. 301
uccagcauacgcugccagccau

SEQ ID NO: 3897588 - RNA, 12 nt, Shigella flexneri 2a str. 301
uccagcaucaga

SEQ ID NO: 3897589 - RNA, 17 nt, Shigella flexneri 2a str. 301
uccagcaucgaccagga

SEQ ID NO: 3897590 - RNA, 16 nt, Shigella flexneri 2a str. 301
uccagcaucuccugca

SEQ ID NO: 3897591 - RNA, 21 nt, Shigella flexneri 2a str. 301
uccagccacggcuccagcaau

SEQ ID NO: 3897592 - RNA, 20 nt, Shigella flexneri 2a str. 301
uccagccagucggaaccggc

SEQ ID NO: 3897593 - RNA, 17 nt, Shigella flexneri 2a str. 301
uccagccaguguuaacc

SEQ ID NO: 3897594 - RNA, 16 nt, Shigella flexneri 2a str. 301
uccagcccggcggcgu

SEQ ID NO: 3897595 - RNA, 15 nt, Shigella flexneri 2a str. 301
uccagcccugccagg

SEQ ID NO: 3897596 - RNA, 20 nt, Shigella flexneri 2a str. 301
uccagccgaccauugccagu

SEQ ID NO: 3897597 - RNA, 14 nt, Shigella flexneri 2a str. 301
uccagcgauaauga

SEQ ID NO: 3897598 - RNA, 17 nt, Shigella flexneri 2a str. 301
uccagcgcaauuggcac

SEQ ID NO: 3897599 - RNA, 16 nt, Shigella flexneri 2a str. 301
uccagcgcaucgaucu

SEQ ID NO: 3897600 - RNA, 22 nt, Shigella flexneri 2a str. 301
uccagcgccgccagaagggaag

SEQ ID NO: 3897601 - RNA, 17 nt, Shigella flexneri 2a str. 301
uccagcgccgcggcguu

SEQ ID NO: 3897602 - RNA, 20 nt, Shigella flexneri 2a str. 301
uccagcgcggcgaaggugcc

SEQ ID NO: 3897603 - RNA, 20 nt, Shigella flexneri 2a str. 301
uccagcgcuuucauggugag

SEQ ID NO: 3897604 - RNA, 14 nt, Shigella flexneri 2a str. 301
uccagcggcaggcc

SEQ ID NO: 3897605 - RNA, 18 nt, Shigella flexneri 2a str. 301
uccagcggccaguggaca

SEQ ID NO: 3897606 - RNA, 16 nt, Shigella flexneri 2a str. 301
uccagcguugagcccu

SEQ ID NO: 3897607 - RNA, 13 nt, Shigella flexneri 2a str. 301
uccagcucaacca

SEQ ID NO: 3897608 - RNA, 19 nt, Shigella flexneri 2a str. 301
uccagcucaaccagauucg

SEQ ID NO: 3897609 - RNA, 14 nt, Shigella flexneri 2a str. 301
uccagcucuucuuc

SEQ ID NO: 3897610 - RNA, 15 nt, Shigella flexneri 2a str. 301
uccagcucuucuuca

SEQ ID NO: 3897611 - RNA, 23 nt, Shigella flexneri 2a str. 301
uccagcuuauuagggaucaucuu

SEQ ID NO: 3897612 - RNA, 15 nt, Shigella flexneri 2a str. 301
uccagcuuccaggca

SEQ ID NO: 3897613 - RNA, 23 nt, Shigella flexneri 2a str. 301
uccaggaagggcauaucagcaac

SEQ ID NO: 3897614 - RNA, 19 nt, Shigella flexneri 2a str. 301
uccaggagcguauucagca

SEQ ID NO: 3897615 - RNA, 13 nt, Shigella flexneri 2a str. 301
uccaggagcucca

SEQ ID NO: 3897616 - RNA, 17 nt, Shigella flexneri 2a str. 301
uccaggagcuccagguc

SEQ ID NO: 3897617 - RNA, 17 nt, Shigella flexneri 2a str. 301
uccaggaguuccggguc

SEQ ID NO: 3897618 - RNA, 23 nt, Shigella flexneri 2a str. 301
uccaggaguuccgggucauccag

SEQ ID NO: 3897619 - RNA, 20 nt, Shigella flexneri 2a str. 301
uccaggcugcaaagucuggg

SEQ ID NO: 3897620 - RNA, 13 nt, Shigella flexneri 2a str. 301
uccagggccucuc

SEQ ID NO: 3897621 - RNA, 22 nt, Shigella flexneri 2a str. 301
uccagggggaagcgcaccaauu

SEQ ID NO: 3897622 - RNA, 15 nt, Shigella flexneri 2a str. 301
uccaggguaaacauc

SEQ ID NO: 3897623 - RNA, 15 nt, Shigella flexneri 2a str. 301
uccagguauuuaacc

SEQ ID NO: 3897624 - RNA, 20 nt, Shigella flexneri 2a str. 301
uccaggucaaccuagccuuc

SEQ ID NO: 3897625 - RNA, 23 nt, Shigella flexneri 2a str. 301
uccagguccuccuguaccuucac

SEQ ID NO: 3897626 - RNA, 16 nt, Shigella flexneri 2a str. 301
uccaguaagcugugcg

SEQ ID NO: 3897627 - RNA, 16 nt, Shigella flexneri 2a str. 301
ucccagucuuuccaua

SEQ ID NO: 3897628 - RNA, 16 nt, Shigella flexneri 2a str. 301
ucccaguuauuaaaac

SEQ ID NO: 3897629 - RNA, 16 nt, Shigella flexneri 2a str. 301
ucccauaaccaacaau

SEQ ID NO: 3897630 - RNA, 17 nt, Shigella flexneri 2a str. 301
ucccauaggaugagguu

SEQ ID NO: 3897631 - RNA, 16 nt, Shigella flexneri 2a str. 301
ucccauuagacuauuu

SEQ ID NO: 3897632 - RNA, 23 nt, Shigella flexneri 2a str. 301
ucccauuuauuuuuccuccauug

SEQ ID NO: 3897633 - RNA, 16 nt, Shigella flexneri 2a str. 301
uccccacagaaacaau

SEQ ID NO: 3897634 - RNA, 16 nt, Shigella flexneri 2a str. 301
uccccaccucaucaga

SEQ ID NO: 3897635 - RNA, 23 nt, Shigella flexneri 2a str. 301
uccccacucgccccgagaaaaau

SEQ ID NO: 3897636 - RNA, 17 nt, Shigella flexneri 2a str. 301
uccccagaagcuuucca

SEQ ID NO: 3897637 - RNA, 17 nt, Shigella flexneri 2a str. 301
uccccagaauccaggaa

SEQ ID NO: 3897638 - RNA, 22 nt, Shigella flexneri 2a str. 301
uccccagaauccaggaaagcca

SEQ ID NO: 3897639 - RNA, 13 nt, Shigella flexneri 2a str. 301
uccccagacaaaa

SEQ ID NO: 3897640 - RNA, 11 nt, Shigella flexneri 2a str. 301
uccccagaccu

SEQ ID NO: 3897641 - RNA, 17 nt, Shigella flexneri 2a str. 301
uccccagcggaaaauau

SEQ ID NO: 3897642 - RNA, 18 nt, Shigella flexneri 2a str. 301
uccccagcggaaaauauc

SEQ ID NO: 3897643 - RNA, 16 nt, Shigella flexneri 2a str. 301
uccccagggaacauuu

SEQ ID NO: 3897644 - RNA, 19 nt, Shigella flexneri 2a str. 301
uccccagggaacauuucuu

SEQ ID NO: 3897645 - RNA, 22 nt, Shigella flexneri 2a str. 301
uccccaguaaucgggcaacugc

SEQ ID NO: 3897646 - RNA, 16 nt, Shigella flexneri 2a str. 301
uccccauaucaggcac

SEQ ID NO: 3897647 - RNA, 20 nt, Shigella flexneri 2a str. 301
ucccccacagcucugcuguc

SEQ ID NO: 3897648 - RNA, 23 nt, Shigella flexneri 2a str. 301
ucccccacuuuuaaaucgccaag

SEQ ID NO: 3897649 - RNA, 15 nt, Shigella flexneri 2a str. 301
uccccccaugaaaua

SEQ ID NO: 3897650 - RNA, 21 nt, Shigella flexneri 2a str. 301
ucccccccacuaagcaccaaa

SEQ ID NO: 3897651 - RNA, 19 nt, Shigella flexneri 2a str. 301
uccccccggcaucgcauuc

SEQ ID NO: 3897652 - RNA, 16 nt, Shigella flexneri 2a str. 301
ucccccugccagacca

SEQ ID NO: 3897653 - RNA, 15 nt, Shigella flexneri 2a str. 301
uccccgagaaauacu

SEQ ID NO: 3897654 - RNA, 16 nt, Shigella flexneri 2a str. 301
uccccgagcacaugca

SEQ ID NO: 3897655 - RNA, 16 nt, Shigella flexneri 2a str. 301
uccccgcuugggcaga

SEQ ID NO: 3897656 - RNA, 14 nt, Shigella flexneri 2a str. 301
uccccggaaucaga

SEQ ID NO: 3897657 - RNA, 17 nt, Shigella flexneri 2a str. 301
uccccggcaaccacacc

SEQ ID NO: 3897658 - RNA, 21 nt, Shigella flexneri 2a str. 301
uccccggcaaccacacccaca

SEQ ID NO: 3897659 - RNA, 17 nt, Shigella flexneri 2a str. 301
uccccggcagugcuuuc

SEQ ID NO: 3897660 - RNA, 20 nt, Shigella flexneri 2a str. 301
uccccggcagugcuuucauu

SEQ ID NO: 3897661 - RNA, 22 nt, Shigella flexneri 2a str. 301
uccccggcuuuuugggccaggg

SEQ ID NO: 3897662 - RNA, 12 nt, Shigella flexneri 2a str. 301
uccccggugaaa

SEQ ID NO: 3897663 - RNA, 16 nt, Shigella flexneri 2a str. 301
uccccguucugccagu

SEQ ID NO: 3897664 - RNA, 15 nt, Shigella flexneri 2a str. 301
uccccuaacucuuuc

SEQ ID NO: 3897665 - RNA, 16 nt, Shigella flexneri 2a str. 301
uccccucacccuaacc

SEQ ID NO: 3897666 - RNA, 14 nt, Shigella flexneri 2a str. 301
uccccuccagcgag

SEQ ID NO: 3897667 - RNA, 16 nt, Shigella flexneri 2a str. 301
uccccuccagcgagcu

SEQ ID NO: 3897668 - RNA, 14 nt, Shigella flexneri 2a str. 301
uccccucgccccuu

SEQ ID NO: 3897669 - RNA, 13 nt, Shigella flexneri 2a str. 301
uccccucgcuccu

SEQ ID NO: 3897670 - RNA, 13 nt, Shigella flexneri 2a str. 301
uccccugcaauau

SEQ ID NO: 3897671 - RNA, 21 nt, Shigella flexneri 2a str. 301
uccccugcccgcgauccagcg

SEQ ID NO: 3897672 - RNA, 15 nt, Shigella flexneri 2a str. 301
ucccgacucgccauu

SEQ ID NO: 3897673 - RNA, 19 nt, Shigella flexneri 2a str. 301
ucccgauaaccuucuucau

SEQ ID NO: 3897674 - RNA, 20 nt, Shigella flexneri 2a str. 301
ucccgauggucagcuucacc

SEQ ID NO: 3897675 - RNA, 16 nt, Shigella flexneri 2a str. 301
ucccgcagcuccagcc

SEQ ID NO: 3897676 - RNA, 17 nt, Shigella flexneri 2a str. 301
ucccgcagcuccagccc

SEQ ID NO: 3897677 - RNA, 16 nt, Shigella flexneri 2a str. 301
ucccgcaggagcgccg

SEQ ID NO: 3897678 - RNA, 19 nt, Shigella flexneri 2a str. 301
ucccgcaggagcgccgaau

SEQ ID NO: 3897679 - RNA, 14 nt, Shigella flexneri 2a str. 301
ucccgccagcacca

SEQ ID NO: 3897680 - RNA, 18 nt, Shigella flexneri 2a str. 301
ucccgccgcuaucccaug

SEQ ID NO: 3897681 - RNA, 21 nt, Shigella flexneri 2a str. 301
ucccgcgaacgagaauuucuc

SEQ ID NO: 3897682 - RNA, 20 nt, Shigella flexneri 2a str. 301
ucccgcgauggcccggcggu

SEQ ID NO: 3897683 - RNA, 19 nt, Shigella flexneri 2a str. 301
ucccgcgauuuccugaccc

SEQ ID NO: 3897684 - RNA, 12 nt, Shigella flexneri 2a str. 301
ucccgcuggugc

SEQ ID NO: 3897685 - RNA, 17 nt, Shigella flexneri 2a str. 301
ucccgcuucguuuucag

SEQ ID NO: 3897686 - RNA, 14 nt, Shigella flexneri 2a str. 301
ucccggaagccacc

SEQ ID NO: 3897687 - RNA, 22 nt, Shigella flexneri 2a str. 301
ucccggaccgucaucuuccacc

SEQ ID NO: 3897688 - RNA, 14 nt, Shigella flexneri 2a str. 301
ucccggauauccca

SEQ ID NO: 3897689 - RNA, 16 nt, Shigella flexneri 2a str. 301
ucccggaugcaccauc

SEQ ID NO: 3897690 - RNA, 21 nt, Shigella flexneri 2a str. 301
ucccggcaagauuccagugcc

SEQ ID NO: 3897691 - RNA, 20 nt, Shigella flexneri 2a str. 301
ucccggcaaugcgccgaaau

SEQ ID NO: 3897692 - RNA, 14 nt, Shigella flexneri 2a str. 301
ucccggcagagaaa

SEQ ID NO: 3897693 - RNA, 14 nt, Shigella flexneri 2a str. 301
ucccggcugauaaa

SEQ ID NO: 3897694 - RNA, 18 nt, Shigella flexneri 2a str. 301
ucccggcugcaaccagau

SEQ ID NO: 3897695 - RNA, 21 nt, Shigella flexneri 2a str. 301
ucccgggucgcgacugccagc

SEQ ID NO: 3897696 - RNA, 17 nt, Shigella flexneri 2a str. 301
ucccggucaguagaaua

SEQ ID NO: 3897697 - RNA, 24 nt, Shigella flexneri 2a str. 301
ucccguacccagcaagaccgcgac

SEQ ID NO: 3897698 - RNA, 17 nt, Shigella flexneri 2a str. 301
ucccguauuacugagau

SEQ ID NO: 3897699 - RNA, 14 nt, Shigella flexneri 2a str. 301
ucccuaaaauauug

SEQ ID NO: 3897700 - RNA, 19 nt, Shigella flexneri 2a str. 301
ucccuacucucgcaugggg

SEQ ID NO: 3897701 - RNA, 15 nt, Shigella flexneri 2a str. 301
ucccuauuuuuucgu

SEQ ID NO: 3897702 - RNA, 22 nt, Shigella flexneri 2a str. 301
ucccucaacaacagucucugcc

SEQ ID NO: 3897703 - RNA, 18 nt, Shigella flexneri 2a str. 301
ucccuccacuccgguguu

SEQ ID NO: 3897704 - RNA, 17 nt, Shigella flexneri 2a str. 301
ucccucccguuucccug

SEQ ID NO: 3897705 - RNA, 21 nt, Shigella flexneri 2a str. 301
ucccucgucgguggugguccc

SEQ ID NO: 3897706 - RNA, 14 nt, Shigella flexneri 2a str. 301
ucccucuacauuca

SEQ ID NO: 3897707 - RNA, 11 nt, Shigella flexneri 2a str. 301
ucccugaaggc

SEQ ID NO: 3897708 - RNA, 22 nt, Shigella flexneri 2a str. 301
ucccugaauaacaccagccaga

SEQ ID NO: 3897709 - RNA, 22 nt, Shigella flexneri 2a str. 301
ucccugacaaaucaugcggaua

SEQ ID NO: 3897710 - RNA, 18 nt, Shigella flexneri 2a str. 301
ucccugacgauagauaga

SEQ ID NO: 3897711 - RNA, 20 nt, Shigella flexneri 2a str. 301
ucccugaugcaucagucacg

SEQ ID NO: 3897712 - RNA, 22 nt, Shigella flexneri 2a str. 301
ucccugcaauagauugaauuag

SEQ ID NO: 3897713 - RNA, 11 nt, Shigella flexneri 2a str. 301
ucccugcauau

SEQ ID NO: 3897714 - RNA, 13 nt, Shigella flexneri 2a str. 301
ucccugccagucc

SEQ ID NO: 3897715 - RNA, 16 nt, Shigella flexneri 2a str. 301
ucccugccuccaugaa

SEQ ID NO: 3897716 - RNA, 18 nt, Shigella flexneri 2a str. 301
ucccugcgccagcggcag

SEQ ID NO: 3897717 - RNA, 20 nt, Shigella flexneri 2a str. 301
ucccugcggauauuugcgau

SEQ ID NO: 3897718 - RNA, 19 nt, Shigella flexneri 2a str. 301
ucccugcugaauccccuuc

SEQ ID NO: 3897719 - RNA, 15 nt, Shigella flexneri 2a str. 301
ucccugguaaaaaau

SEQ ID NO: 3897720 - RNA, 19 nt, Shigella flexneri 2a str. 301
ucccugguaaaaaaugauu

SEQ ID NO: 3897721 - RNA, 13 nt, Shigella flexneri 2a str. 301
ucccuuaaaaaau

SEQ ID NO: 3897722 - RNA, 15 nt, Shigella flexneri 2a str. 301
ucccuuacccuuacu

SEQ ID NO: 3897723 - RNA, 17 nt, Shigella flexneri 2a str. 301
ucccuuagcuaauuuuu

SEQ ID NO: 3897724 - RNA, 18 nt, Shigella flexneri 2a str. 301
ucccuuaguaacgccagc

SEQ ID NO: 3897725 - RNA, 18 nt, Shigella flexneri 2a str. 301
ucccuucagccaccaggu

SEQ ID NO: 3897726 - RNA, 13 nt, Shigella flexneri 2a str. 301
ucccuucccagcc

SEQ ID NO: 3897727 - RNA, 20 nt, Shigella flexneri 2a str. 301
uccggcugggcgugaaucug

SEQ ID NO: 3897728 - RNA, 23 nt, Shigella flexneri 2a str. 301
uccggcugggcgugaaucugccu

SEQ ID NO: 3897729 - RNA, 17 nt, Shigella flexneri 2a str. 301
uccggcuugaaccagcc

SEQ ID NO: 3897730 - RNA, 17 nt, Shigella flexneri 2a str. 301
uccggcuuuggcaaacu

SEQ ID NO: 3897731 - RNA, 15 nt, Shigella flexneri 2a str. 301
uccggcuuuuuacuu

SEQ ID NO: 3897732 - RNA, 20 nt, Shigella flexneri 2a str. 301
uccgggaaauccucaaccgg

SEQ ID NO: 3897733 - RNA, 15 nt, Shigella flexneri 2a str. 301
uccgggaucaccaga

SEQ ID NO: 3897734 - RNA, 16 nt, Shigella flexneri 2a str. 301
uccgggaucaccagac

SEQ ID NO: 3897735 - RNA, 12 nt, Shigella flexneri 2a str. 301
uccgggccagcg

SEQ ID NO: 3897736 - RNA, 16 nt, Shigella flexneri 2a str. 301
uccgggccagcggcuc

SEQ ID NO: 3897737 - RNA, 19 nt, Shigella flexneri 2a str. 301
uccgggccgaacaucagau

SEQ ID NO: 3897738 - RNA, 17 nt, Shigella flexneri 2a str. 301
uccgggccgcaaaccag

SEQ ID NO: 3897739 - RNA, 16 nt, Shigella flexneri 2a str. 301
uccgggguucgaaucc

SEQ ID NO: 3897740 - RNA, 14 nt, Shigella flexneri 2a str. 301
uccgggucuguaaa

SEQ ID NO: 3897741 - RNA, 15 nt, Shigella flexneri 2a str. 301
uccggguucucgcaa

SEQ ID NO: 3897742 - RNA, 14 nt, Shigella flexneri 2a str. 301
uccggguuuucaac

SEQ ID NO: 3897743 - RNA, 18 nt, Shigella flexneri 2a str. 301
uccgguaacgguguugag

SEQ ID NO: 3897744 - RNA, 12 nt, Shigella flexneri 2a str. 301
uccgguaauuuu

SEQ ID NO: 3897745 - RNA, 20 nt, Shigella flexneri 2a str. 301
uccggucuaccgauccggca

SEQ ID NO: 3897746 - RNA, 15 nt, Shigella flexneri 2a str. 301
uccggugcaacugcu

SEQ ID NO: 3897747 - RNA, 22 nt, Shigella flexneri 2a str. 301
uccgguguuuucucucucugca

SEQ ID NO: 3897748 - RNA, 15 nt, Shigella flexneri 2a str. 301
uccgguucacuucac

SEQ ID NO: 3897749 - RNA, 22 nt, Shigella flexneri 2a str. 301
uccgguuguucaaccaccggca

SEQ ID NO: 3897750 - RNA, 14 nt, Shigella flexneri 2a str. 301
uccguaaaacucag

SEQ ID NO: 3897751 - RNA, 21 nt, Shigella flexneri 2a str. 301
uccguaccagccuugccagau

SEQ ID NO: 3897752 - RNA, 14 nt, Shigella flexneri 2a str. 301
uccguagugaaaaa

SEQ ID NO: 3897753 - RNA, 15 nt, Shigella flexneri 2a str. 301
uccguagugaaaaag

SEQ ID NO: 3897754 - RNA, 18 nt, Shigella flexneri 2a str. 301
uccguauaccgucaggau

SEQ ID NO: 3897755 - RNA, 22 nt, Shigella flexneri 2a str. 301
uccguaucgguguuauccacga

SEQ ID NO: 3897756 - RNA, 18 nt, Shigella flexneri 2a str. 301
uccgucaagaucggcgaa

SEQ ID NO: 3897757 - RNA, 16 nt, Shigella flexneri 2a str. 301
uccgucauccauacca

SEQ ID NO: 3897758 - RNA, 15 nt, Shigella flexneri 2a str. 301
uccgucccagccuug

SEQ ID NO: 3897759 - RNA, 20 nt, Shigella flexneri 2a str. 301
uccgucccagccuugccaga

SEQ ID NO: 3897760 - RNA, 20 nt, Shigella flexneri 2a str. 301
uccgucgaaagcccaucauc

SEQ ID NO: 3897761 - RNA, 15 nt, Shigella flexneri 2a str. 301
uccguuaucacagca

SEQ ID NO: 3897762 - RNA, 20 nt, Shigella flexneri 2a str. 301
uccguuaucacagcagaacu

SEQ ID NO: 3897763 - RNA, 19 nt, Shigella flexneri 2a str. 301
uccguuaugucucccgccc

SEQ ID NO: 3897764 - RNA, 13 nt, Shigella flexneri 2a str. 301
uccguucagaucg

SEQ ID NO: 3897765 - RNA, 16 nt, Shigella flexneri 2a str. 301
uccguucucaccagcu

SEQ ID NO: 3897766 - RNA, 15 nt, Shigella flexneri 2a str. 301
uccguuuuccagccu

SEQ ID NO: 3897767 - RNA, 23 nt, Shigella flexneri 2a str. 301
uccuaaaaaauuaacaaaacaau

SEQ ID NO: 3897768 - RNA, 15 nt, Shigella flexneri 2a str. 301
uccuacaacugggac

SEQ ID NO: 3897769 - RNA, 18 nt, Shigella flexneri 2a str. 301
uccuacaccgaacaacug

SEQ ID NO: 3897770 - RNA, 13 nt, Shigella flexneri 2a str. 301
uccuauugcugcu

SEQ ID NO: 3897771 - RNA, 21 nt, Shigella flexneri 2a str. 301
uccucaagaauaugcuuugcc

SEQ ID NO: 3897772 - RNA, 19 nt, Shigella flexneri 2a str. 301
uccucaguuucgacgccuu

SEQ ID NO: 3897773 - RNA, 15 nt, Shigella flexneri 2a str. 301
uccuccagcagcaca

SEQ ID NO: 3897774 - RNA, 13 nt, Shigella flexneri 2a str. 301
uccuccagcuccu

SEQ ID NO: 3897775 - RNA, 13 nt, Shigella flexneri 2a str. 301
uccucccguuaug

SEQ ID NO: 3897776 - RNA, 17 nt, Shigella flexneri 2a str. 301
uccuccguauccuguca

SEQ ID NO: 3897777 - RNA, 23 nt, Shigella flexneri 2a str. 301
uccuccguauccugucauacgcg

SEQ ID NO: 3897778 - RNA, 16 nt, Shigella flexneri 2a str. 301
uccuccugucuucccu

SEQ ID NO: 3897779 - RNA, 11 nt, Shigella flexneri 2a str. 301
uccucgccguu

SEQ ID NO: 3897780 - RNA, 16 nt, Shigella flexneri 2a str. 301
uccucgccguuaauga

SEQ ID NO: 3897781 - RNA, 15 nt, Shigella flexneri 2a str. 301
uccucuauauuucac

SEQ ID NO: 3897782 - RNA, 18 nt, Shigella flexneri 2a str. 301
uccucuguaaacuccuuu

SEQ ID NO: 3897783 - RNA, 13 nt, Shigella flexneri 2a str. 301
uccucuucccaga

SEQ ID NO: 3897784 - RNA, 21 nt, Shigella flexneri 2a str. 301
uccugaaacgcggcguaaccg

SEQ ID NO: 3897785 - RNA, 17 nt, Shigella flexneri 2a str. 301
uccugaaauuccugaga

SEQ ID NO: 3897786 - RNA, 22 nt, Shigella flexneri 2a str. 301
uccugaacucgccagccaccau

SEQ ID NO: 3897787 - RNA, 14 nt, Shigella flexneri 2a str. 301
uccugaagacgccu

SEQ ID NO: 3897788 - RNA, 20 nt, Shigella flexneri 2a str. 301
uccugaagacgccucgcauu

SEQ ID NO: 3897789 - RNA, 15 nt, Shigella flexneri 2a str. 301
uccugaagaugcugc

SEQ ID NO: 3897790 - RNA, 16 nt, Shigella flexneri 2a str. 301
uccugaagaugcugca

SEQ ID NO: 3897791 - RNA, 15 nt, Shigella flexneri 2a str. 301
uccugaaucaccuga

SEQ ID NO: 3897792 - RNA, 17 nt, Shigella flexneri 2a str. 301
uccugaauggugaccug

SEQ ID NO: 3897793 - RNA, 18 nt, Shigella flexneri 2a str. 301
uccugacaagguacgaaa

SEQ ID NO: 3897794 - RNA, 14 nt, Shigella flexneri 2a str. 301
uccugaccaccaua

SEQ ID NO: 3897795 - RNA, 18 nt, Shigella flexneri 2a str. 301
uccugacccucucggcau

SEQ ID NO: 3897796 - RNA, 20 nt, Shigella flexneri 2a str. 301
uccugacuccuguaucguca

SEQ ID NO: 3897797 - RNA, 20 nt, Shigella flexneri 2a str. 301
uccugacuuugccccagcgg

SEQ ID NO: 3897798 - RNA, 15 nt, Shigella flexneri 2a str. 301
uccugagcacugggg

SEQ ID NO: 3897799 - RNA, 17 nt, Shigella flexneri 2a str. 301
uccugagcacuggggcu

SEQ ID NO: 3897800 - RNA, 15 nt, Shigella flexneri 2a str. 301
uccugauacaugaau

SEQ ID NO: 3897801 - RNA, 19 nt, Shigella flexneri 2a str. 301
uccugauggacauuuuucc

SEQ ID NO: 3897802 - RNA, 17 nt, Shigella flexneri 2a str. 301
uccugauuuaacaucuc

SEQ ID NO: 3897803 - RNA, 23 nt, Shigella flexneri 2a str. 301
uccugcaaacaguaacccggcac

SEQ ID NO: 3897804 - RNA, 14 nt, Shigella flexneri 2a str. 301
uccugcaacagcac

SEQ ID NO: 3897805 - RNA, 21 nt, Shigella flexneri 2a str. 301
uccugcaacuucucuuucggc

SEQ ID NO: 3897806 - RNA, 14 nt, Shigella flexneri 2a str. 301
uccugcaagccaac

SEQ ID NO: 3897807 - RNA, 17 nt, Shigella flexneri 2a str. 301
uccugcaauaccgccgu

SEQ ID NO: 3897808 - RNA, 16 nt, Shigella flexneri 2a str. 301
uccugcaucgccugau

SEQ ID NO: 3897809 - RNA, 16 nt, Shigella flexneri 2a str. 301
uccugccaguuuuucc

SEQ ID NO: 3897810 - RNA, 17 nt, Shigella flexneri 2a str. 301
uccugccaguuuuuccg

SEQ ID NO: 3897811 - RNA, 18 nt, Shigella flexneri 2a str. 301
uccugcccacuccagcua

SEQ ID NO: 3897812 - RNA, 19 nt, Shigella flexneri 2a str. 301
uccugccgcguuggcaaug

SEQ ID NO: 3897813 - RNA, 13 nt, Shigella flexneri 2a str. 301
uccugcgccagcc

SEQ ID NO: 3897814 - RNA, 17 nt, Shigella flexneri 2a str. 301
uccugcgcugcguagcc

SEQ ID NO: 3897815 - RNA, 13 nt, Shigella flexneri 2a str. 301
uccugcgcuucca

SEQ ID NO: 3897816 - RNA, 17 nt, Shigella flexneri 2a str. 301
uccugcgcuuccagcuc

SEQ ID NO: 3897817 - RNA, 18 nt, Shigella flexneri 2a str. 301
uccugcggagcaaccugc

SEQ ID NO: 3897818 - RNA, 20 nt, Shigella flexneri 2a str. 301
uccugcggaugcgccaucca

SEQ ID NO: 3897819 - RNA, 21 nt, Shigella flexneri 2a str. 301
uccugcggcagacgcucgcca

SEQ ID NO: 3897820 - RNA, 23 nt, Shigella flexneri 2a str. 301
uccugcggcagacgcucgccauu

SEQ ID NO: 3897821 - RNA, 11 nt, Shigella flexneri 2a str. 301
uccugcggcga

SEQ ID NO: 3897822 - RNA, 17 nt, Shigella flexneri 2a str. 301
uccugcggcgacaaaug

SEQ ID NO: 3897823 - RNA, 23 nt, Shigella flexneri 2a str. 301
uccugcgggagcgcuuuuuuccu

SEQ ID NO: 3897824 - RNA, 13 nt, Shigella flexneri 2a str. 301
uccugcgucgcua

SEQ ID NO: 3897825 - RNA, 12 nt, Shigella flexneri 2a str. 301
uccugcuggugc

SEQ ID NO: 3897826 - RNA, 23 nt, Shigella flexneri 2a str. 301
uccugcuguacgucagcgucaua

SEQ ID NO: 3897827 - RNA, 23 nt, Shigella flexneri 2a str. 301
ucgaggccaauuuggcugccaug

SEQ ID NO: 3897828 - RNA, 15 nt, Shigella flexneri 2a str. 301
ucgaggcucugauug

SEQ ID NO: 3897829 - RNA, 16 nt, Shigella flexneri 2a str. 301
ucgaguaaaaauauuu

SEQ ID NO: 3897830 - RNA, 19 nt, Shigella flexneri 2a str. 301
ucgaguagcaaucggcuuu

SEQ ID NO: 3897831 - RNA, 17 nt, Shigella flexneri 2a str. 301
ucgaguccuuccagguc

SEQ ID NO: 3897832 - RNA, 16 nt, Shigella flexneri 2a str. 301
ucgagugaauaauuga

SEQ ID NO: 3897833 - RNA, 22 nt, Shigella flexneri 2a str. 301
ucgauaaacaguuccgcaaagc

SEQ ID NO: 3897834 - RNA, 14 nt, Shigella flexneri 2a str. 301
ucgauaaaccagca

SEQ ID NO: 3897835 - RNA, 12 nt, Shigella flexneri 2a str. 301
ucgauaaaccau

SEQ ID NO: 3897836 - RNA, 23 nt, Shigella flexneri 2a str. 301
ucgauaaacgccggaugacacau

SEQ ID NO: 3897837 - RNA, 22 nt, Shigella flexneri 2a str. 301
ucgauaaauggcgcauccagcc

SEQ ID NO: 3897838 - RNA, 20 nt, Shigella flexneri 2a str. 301
ucgauaacacgguaaugacu

SEQ ID NO: 3897839 - RNA, 13 nt, Shigella flexneri 2a str. 301
ucgauaaccaucc

SEQ ID NO: 3897840 - RNA, 21 nt, Shigella flexneri 2a str. 301
ucgauaaccaucuucuucacu

SEQ ID NO: 3897841 - RNA, 18 nt, Shigella flexneri 2a str. 301
ucgauaccaucgcuucau

SEQ ID NO: 3897842 - RNA, 13 nt, Shigella flexneri 2a str. 301
ucgauaucaagcc

SEQ ID NO: 3897843 - RNA, 19 nt, Shigella flexneri 2a str. 301
ucgauaucguacuugccaa

SEQ ID NO: 3897844 - RNA, 15 nt, Shigella flexneri 2a str. 301
ucgauaugaccauug

SEQ ID NO: 3897845 - RNA, 13 nt, Shigella flexneri 2a str. 301
ucgaucacuucgc

SEQ ID NO: 3897846 - RNA, 16 nt, Shigella flexneri 2a str. 301
ucgaucacuuucugcg

SEQ ID NO: 3897847 - RNA, 22 nt, Shigella flexneri 2a str. 301
ucgaucgagagugguaaaggag

SEQ ID NO: 3897848 - RNA, 19 nt, Shigella flexneri 2a str. 301
ucgaugccuugugggccug

SEQ ID NO: 3897849 - RNA, 12 nt, Shigella flexneri 2a str. 301
ucgauggcagua

SEQ ID NO: 3897850 - RNA, 16 nt, Shigella flexneri 2a str. 301
ucgauucacauuuaaa

SEQ ID NO: 3897851 - RNA, 19 nt, Shigella flexneri 2a str. 301
ucgauugcacaaagguuuc

SEQ ID NO: 3897852 - RNA, 20 nt, Shigella flexneri 2a str. 301
ucgauugcacauucccugca

SEQ ID NO: 3897853 - RNA, 12 nt, Shigella flexneri 2a str. 301
ucgauuucugac

SEQ ID NO: 3897854 - RNA, 18 nt, Shigella flexneri 2a str. 301
ucgauuuugcaauaaugg

SEQ ID NO: 3897855 - RNA, 15 nt, Shigella flexneri 2a str. 301
ucgauuuuuaaugaa

SEQ ID NO: 3897856 - RNA, 18 nt, Shigella flexneri 2a str. 301
ucgauuuuuaaugaacgg

SEQ ID NO: 3897857 - RNA, 15 nt, Shigella flexneri 2a str. 301
ucgauuuuuuccagc

SEQ ID NO: 3897858 - RNA, 22 nt, Shigella flexneri 2a str. 301
ucgcaaaccacgguuucagugg

SEQ ID NO: 3897859 - RNA, 18 nt, Shigella flexneri 2a str. 301
ucgcaaauauuucacccg

SEQ ID NO: 3897860 - RNA, 21 nt, Shigella flexneri 2a str. 301
ucgcaaauugacuacaccauu

SEQ ID NO: 3897861 - RNA, 12 nt, Shigella flexneri 2a str. 301
ucgcaaccagcg

SEQ ID NO: 3897862 - RNA, 19 nt, Shigella flexneri 2a str. 301
ucgcaacgccuuccgucag

SEQ ID NO: 3897863 - RNA, 20 nt, Shigella flexneri 2a str. 301
ucgcaagacgaaaaaugaau

SEQ ID NO: 3897864 - RNA, 18 nt, Shigella flexneri 2a str. 301
ucgcaagccacgccgaac

SEQ ID NO: 3897865 - RNA, 21 nt, Shigella flexneri 2a str. 301
ucgcaauaaucaucucuccuu

SEQ ID NO: 3897866 - RNA, 21 nt, Shigella flexneri 2a str. 301
ucgcaauccgccgauguugca

SEQ ID NO: 3897867 - RNA, 16 nt, Shigella flexneri 2a str. 301
ucgcaaugauuuugau

SEQ ID NO: 3897868 - RNA, 10 nt, Shigella flexneri 2a str. 301
ucgcaauuac

SEQ ID NO: 3897869 - RNA, 14 nt, Shigella flexneri 2a str. 301
ucgcacaaaaucau

SEQ ID NO: 3897870 - RNA, 20 nt, Shigella flexneri 2a str. 301
ucgcacaaaaucaugagguu

SEQ ID NO: 3897871 - RNA, 14 nt, Shigella flexneri 2a str. 301
ucgcaccaaaaauc

SEQ ID NO: 3897872 - RNA, 14 nt, Shigella flexneri 2a str. 301
ucgcaccuuucaac

SEQ ID NO: 3897873 - RNA, 18 nt, Shigella flexneri 2a str. 301
ucgcacuaaguucugccc

SEQ ID NO: 3897874 - RNA, 16 nt, Shigella flexneri 2a str. 301
ucgcacuuaccuucac

SEQ ID NO: 3897875 - RNA, 23 nt, Shigella flexneri 2a str. 301
ucgcagaaauaccccgccagcag

SEQ ID NO: 3897876 - RNA, 22 nt, Shigella flexneri 2a str. 301
ucgcagagaucauacagaugcu

SEQ ID NO: 3897877 - RNA, 15 nt, Shigella flexneri 2a str. 301
ucgcagaguuuugag

SEQ ID NO: 3897878 - RNA, 14 nt, Shigella flexneri 2a str. 301
ucgcagcugccugc

SEQ ID NO: 3897879 - RNA, 19 nt, Shigella flexneri 2a str. 301
ucgcaggcaguacugcaua

SEQ ID NO: 3897880 - RNA, 20 nt, Shigella flexneri 2a str. 301
ucgcaggcgguggaagcacc

SEQ ID NO: 3897881 - RNA, 22 nt, Shigella flexneri 2a str. 301
ucgcagggaucauccacccgca

SEQ ID NO: 3897882 - RNA, 16 nt, Shigella flexneri 2a str. 301
ucgcaguagccaugca

SEQ ID NO: 3897883 - RNA, 17 nt, Shigella flexneri 2a str. 301
ucgcaguagccaugcau

SEQ ID NO: 3897884 - RNA, 18 nt, Shigella flexneri 2a str. 301
ucgcauaaaccacagacc

SEQ ID NO: 3897885 - RNA, 16 nt, Shigella flexneri 2a str. 301
ucgcauaacagagcga

SEQ ID NO: 3897886 - RNA, 19 nt, Shigella flexneri 2a str. 301
ucgcaucaggcaucaugcu

SEQ ID NO: 3897887 - RNA, 23 nt, Shigella flexneri 2a str. 301
ucgcaucaggcaucaugcucaga

SEQ ID NO: 3897888 - RNA, 16 nt, Shigella flexneri 2a str. 301
ucgcaucaggcaugau

SEQ ID NO: 3897889 - RNA, 19 nt, Shigella flexneri 2a str. 301
ucgcaucaggcauugugcu

SEQ ID NO: 3897890 - RNA, 20 nt, Shigella flexneri 2a str. 301
ucgcaucaggcauuugcucc

SEQ ID NO: 3897891 - RNA, 22 nt, Shigella flexneri 2a str. 301
ucgcaucccgguaucaaagcgc

SEQ ID NO: 3897892 - RNA, 16 nt, Shigella flexneri 2a str. 301
ucgcauccgacaucaa

SEQ ID NO: 3897893 - RNA, 19 nt, Shigella flexneri 2a str. 301
ucgcauccgacaucaaccg

SEQ ID NO: 3897894 - RNA, 13 nt, Shigella flexneri 2a str. 301
ucgcauccucuuu

SEQ ID NO: 3897895 - RNA, 22 nt, Shigella flexneri 2a str. 301
ucgcaucgaugguugcccugcu

SEQ ID NO: 3897896 - RNA, 15 nt, Shigella flexneri 2a str. 301
ucgcaucuggcacua

SEQ ID NO: 3897897 - RNA, 14 nt, Shigella flexneri 2a str. 301
ucgcaucuggcaua

SEQ ID NO: 3897898 - RNA, 17 nt, Shigella flexneri 2a str. 301
ucgcauggcggaucacg

SEQ ID NO: 3897899 - RNA, 16 nt, Shigella flexneri 2a str. 301
ucgcauuaacagccag

SEQ ID NO: 3897900 - RNA, 21 nt, Shigella flexneri 2a str. 301
ucgccaaauuuggugcucagu

SEQ ID NO: 3897901 - RNA, 16 nt, Shigella flexneri 2a str. 301
ucgccaacaaucucuu

SEQ ID NO: 3897902 - RNA, 19 nt, Shigella flexneri 2a str. 301
ucgccaacaaucucuucca

SEQ ID NO: 3897903 - RNA, 20 nt, Shigella flexneri 2a str. 301
ucgccaacaaucucuuccag

SEQ ID NO: 3897904 - RNA, 23 nt, Shigella flexneri 2a str. 301
ucgccaaguucgaacgccgccag

SEQ ID NO: 3897905 - RNA, 21 nt, Shigella flexneri 2a str. 301
ucgccacaccaguaaagccca

SEQ ID NO: 3897906 - RNA, 14 nt, Shigella flexneri 2a str. 301
ucgccacaccggug

SEQ ID NO: 3897907 - RNA, 19 nt, Shigella flexneri 2a str. 301
ucgccacggcaugaaagcg

SEQ ID NO: 3897908 - RNA, 13 nt, Shigella flexneri 2a str. 301
ucgccagaaauca

SEQ ID NO: 3897909 - RNA, 14 nt, Shigella flexneri 2a str. 301
ucgccagaaggugg

SEQ ID NO: 3897910 - RNA, 18 nt, Shigella flexneri 2a str. 301
ucgccagaccgcagaagc

SEQ ID NO: 3897911 - RNA, 22 nt, Shigella flexneri 2a str. 301
ucgccagauagauugcgcuggc

SEQ ID NO: 3897912 - RNA, 23 nt, Shigella flexneri 2a str. 301
ucgccagauagauugcgcuggca

SEQ ID NO: 3897913 - RNA, 19 nt, Shigella flexneri 2a str. 301
ucgccagcccguagcuucc

SEQ ID NO: 3897914 - RNA, 23 nt, Shigella flexneri 2a str. 301
ucgccagcccguagcuucccaua

SEQ ID NO: 3897915 - RNA, 19 nt, Shigella flexneri 2a str. 301
ucgccagccucccagccau

SEQ ID NO: 3897916 - RNA, 17 nt, Shigella flexneri 2a str. 301
ucgccagcgccagcgcu

SEQ ID NO: 3897917 - RNA, 12 nt, Shigella flexneri 2a str. 301
ucgccagcggca

SEQ ID NO: 3897918 - RNA, 15 nt, Shigella flexneri 2a str. 301
ucgccagcggcagcu

SEQ ID NO: 3897919 - RNA, 12 nt, Shigella flexneri 2a str. 301
ucgccagcucaa

SEQ ID NO: 3897920 - RNA, 18 nt, Shigella flexneri 2a str. 301
ucgccaguaccagcagcg

SEQ ID NO: 3897921 - RNA, 19 nt, Shigella flexneri 2a str. 301
ucgccagucccuuucaggu

SEQ ID NO: 3897922 - RNA, 20 nt, Shigella flexneri 2a str. 301
ucgccagugccgcccaccac

SEQ ID NO: 3897923 - RNA, 21 nt, Shigella flexneri 2a str. 301
ucgccaguucgcgauccugau

SEQ ID NO: 3897924 - RNA, 19 nt, Shigella flexneri 2a str. 301
ucgccauaauaagcgccau

SEQ ID NO: 3897925 - RNA, 15 nt, Shigella flexneri 2a str. 301
ucgccaucaaaucac

SEQ ID NO: 3897926 - RNA, 12 nt, Shigella flexneri 2a str. 301
ucgccaucaggc

SEQ ID NO: 3897927 - RNA, 17 nt, Shigella flexneri 2a str. 301
ucgcugauucuggcguu

SEQ ID NO: 3897928 - RNA, 21 nt, Shigella flexneri 2a str. 301
ucgcugauugcuuucuuucac

SEQ ID NO: 3897929 - RNA, 17 nt, Shigella flexneri 2a str. 301
ucgcugcagcucugcgc

SEQ ID NO: 3897930 - RNA, 11 nt, Shigella flexneri 2a str. 301
ucgcugccaca

SEQ ID NO: 3897931 - RNA, 15 nt, Shigella flexneri 2a str. 301
ucgcugccgcgcagg

SEQ ID NO: 3897932 - RNA, 23 nt, Shigella flexneri 2a str. 301
ucgcugcgcucuaaaaucaucac

SEQ ID NO: 3897933 - RNA, 15 nt, Shigella flexneri 2a str. 301
ucgcugcuggaucug

SEQ ID NO: 3897934 - RNA, 11 nt, Shigella flexneri 2a str. 301
ucgcuggaagc

SEQ ID NO: 3897935 - RNA, 12 nt, Shigella flexneri 2a str. 301
ucgcuggcagac

SEQ ID NO: 3897936 - RNA, 13 nt, Shigella flexneri 2a str. 301
ucgcuggcaggcc

SEQ ID NO: 3897937 - RNA, 21 nt, Shigella flexneri 2a str. 301
ucgcuggcgucggauauaaaa

SEQ ID NO: 3897938 - RNA, 15 nt, Shigella flexneri 2a str. 301
ucgcuguauuuugcg

SEQ ID NO: 3897939 - RNA, 19 nt, Shigella flexneri 2a str. 301
ucgcugucuuccugguuuc

SEQ ID NO: 3897940 - RNA, 13 nt, Shigella flexneri 2a str. 301
ucgcuuaagccau

SEQ ID NO: 3897941 - RNA, 15 nt, Shigella flexneri 2a str. 301
ucgcuuaccaugcca

SEQ ID NO: 3897942 - RNA, 16 nt, Shigella flexneri 2a str. 301
ucgcuucaugcccgcc

SEQ ID NO: 3897943 - RNA, 18 nt, Shigella flexneri 2a str. 301
ucgcuuccauugagaaag

SEQ ID NO: 3897944 - RNA, 15 nt, Shigella flexneri 2a str. 301
ucgcuucguagcagg

SEQ ID NO: 3897945 - RNA, 22 nt, Shigella flexneri 2a str. 301
ucgcuucgucgucaccugcguc

SEQ ID NO: 3897946 - RNA, 21 nt, Shigella flexneri 2a str. 301
ucgcuugcaggaucagcuccg

SEQ ID NO: 3897947 - RNA, 19 nt, Shigella flexneri 2a str. 301
ucgcuuucaggucagcgaa

SEQ ID NO: 3897948 - RNA, 13 nt, Shigella flexneri 2a str. 301
ucgcuuuccaggu

SEQ ID NO: 3897949 - RNA, 12 nt, Shigella flexneri 2a str. 301
ucgcuuucucuu

SEQ ID NO: 3897950 - RNA, 13 nt, Shigella flexneri 2a str. 301
ucgcuuucucuuc

SEQ ID NO: 3897951 - RNA, 14 nt, Shigella flexneri 2a str. 301
ucggaaaauuauuu

SEQ ID NO: 3897952 - RNA, 23 nt, Shigella flexneri 2a str. 301
ucggaaaccgcuuugccacggua

SEQ ID NO: 3897953 - RNA, 17 nt, Shigella flexneri 2a str. 301
ucggaaauaaucaccug

SEQ ID NO: 3897954 - RNA, 18 nt, Shigella flexneri 2a str. 301
ucggaacaguaaagcgca

SEQ ID NO: 3897955 - RNA, 15 nt, Shigella flexneri 2a str. 301
ucggaaugcaccgcc

SEQ ID NO: 3897956 - RNA, 20 nt, Shigella flexneri 2a str. 301
ucggaaugcaccgccugaua

SEQ ID NO: 3897957 - RNA, 21 nt, Shigella flexneri 2a str. 301
ucggaaugccggaaucagaau

SEQ ID NO: 3897958 - RNA, 17 nt, Shigella flexneri 2a str. 301
ucggacgauauuuuucc

SEQ ID NO: 3897959 - RNA, 21 nt, Shigella flexneri 2a str. 301
ucggagaacugcaacucaccu

SEQ ID NO: 3897960 - RNA, 18 nt, Shigella flexneri 2a str. 301
ucggagagaaaagcaaaa

SEQ ID NO: 3897961 - RNA, 22 nt, Shigella flexneri 2a str. 301
ucggaguggcagccccaggauu

SEQ ID NO: 3897962 - RNA, 21 nt, Shigella flexneri 2a str. 301
ucggauaagacgcgccagcgu

SEQ ID NO: 3897963 - RNA, 22 nt, Shigella flexneri 2a str. 301
ucggauuggucgcucgcgccgc

SEQ ID NO: 3897964 - RNA, 15 nt, Shigella flexneri 2a str. 301
ucggauuuaccggga

SEQ ID NO: 3897965 - RNA, 14 nt, Shigella flexneri 2a str. 301
ucggcaaaauacau

SEQ ID NO: 3897966 - RNA, 19 nt, Shigella flexneri 2a str. 301
ucggcaaaauacaugaccg

SEQ ID NO: 3897967 - RNA, 15 nt, Shigella flexneri 2a str. 301
ucggcaaacugcuga

SEQ ID NO: 3897968 - RNA, 16 nt, Shigella flexneri 2a str. 301
ucggcaaacugcugau

SEQ ID NO: 3897969 - RNA, 14 nt, Shigella flexneri 2a str. 301
ucggcaaagcgcug

SEQ ID NO: 3897970 - RNA, 19 nt, Shigella flexneri 2a str. 301
ucggcaaagcgcugaagaa

SEQ ID NO: 3897971 - RNA, 22 nt, Shigella flexneri 2a str. 301
ucggcaacuuuggguugccgcc

SEQ ID NO: 3897972 - RNA, 18 nt, Shigella flexneri 2a str. 301
ucggcaagauaaaucgca

SEQ ID NO: 3897973 - RNA, 17 nt, Shigella flexneri 2a str. 301
ucggcaauuucgcugcc

SEQ ID NO: 3897974 - RNA, 16 nt, Shigella flexneri 2a str. 301
ucggcacacacaucac

SEQ ID NO: 3897975 - RNA, 23 nt, Shigella flexneri 2a str. 301
ucggcacugcgaccgaucaccac

SEQ ID NO: 3897976 - RNA, 20 nt, Shigella flexneri 2a str. 301
ucggcagaguugagcagucc

SEQ ID NO: 3897977 - RNA, 15 nt, Shigella flexneri 2a str. 301
ucggcagccaguucg

SEQ ID NO: 3897978 - RNA, 17 nt, Shigella flexneri 2a str. 301
ucggcagcgccaaucgc

SEQ ID NO: 3897979 - RNA, 22 nt, Shigella flexneri 2a str. 301
ucggcagucacuuuuuuccgag

SEQ ID NO: 3897980 - RNA, 14 nt, Shigella flexneri 2a str. 301
ucggcagucugcug

SEQ ID NO: 3897981 - RNA, 17 nt, Shigella flexneri 2a str. 301
ucggcagugaaaacgca

SEQ ID NO: 3897982 - RNA, 16 nt, Shigella flexneri 2a str. 301
ucggcauaaagcugcg

SEQ ID NO: 3897983 - RNA, 13 nt, Shigella flexneri 2a str. 301
ucggcauaaucau

SEQ ID NO: 3897984 - RNA, 14 nt, Shigella flexneri 2a str. 301
ucggcaucgcucca

SEQ ID NO: 3897985 - RNA, 17 nt, Shigella flexneri 2a str. 301
ucggcauuaaccagucg

SEQ ID NO: 3897986 - RNA, 15 nt, Shigella flexneri 2a str. 301
ucggcauucugcugg

SEQ ID NO: 3897987 - RNA, 18 nt, Shigella flexneri 2a str. 301
ucggcauucugcuggccu

SEQ ID NO: 3897988 - RNA, 19 nt, Shigella flexneri 2a str. 301
ucggcauucugcuggccug

SEQ ID NO: 3897989 - RNA, 14 nt, Shigella flexneri 2a str. 301
ucggcauuggcaua

SEQ ID NO: 3897990 - RNA, 14 nt, Shigella flexneri 2a str. 301
ucggccagcguguu

SEQ ID NO: 3897991 - RNA, 18 nt, Shigella flexneri 2a str. 301
ucggccaguaaccuuuca

SEQ ID NO: 3897992 - RNA, 19 nt, Shigella flexneri 2a str. 301
ucggcgagucgcuccugcc

SEQ ID NO: 3897993 - RNA, 12 nt, Shigella flexneri 2a str. 301
ucggcggcggca

SEQ ID NO: 3897994 - RNA, 18 nt, Shigella flexneri 2a str. 301
ucggcgguaagccauguu

SEQ ID NO: 3897995 - RNA, 19 nt, Shigella flexneri 2a str. 301
ucggcggugaccagcagca

SEQ ID NO: 3897996 - RNA, 19 nt, Shigella flexneri 2a str. 301
ucggcguaauccugaaagc

SEQ ID NO: 3897997 - RNA, 22 nt, Shigella flexneri 2a str. 301
ucggcgucaucgacaucaacga

SEQ ID NO: 3897998 - RNA, 22 nt, Shigella flexneri 2a str. 301
ucggcgugaacgcgcucgacuu

SEQ ID NO: 3897999 - RNA, 20 nt, Shigella flexneri 2a str. 301
ucggcugacgauaccaggug

SEQ ID NO: 3898000 - RNA, 15 nt, Shigella flexneri 2a str. 301
ucggcugccagccau

SEQ ID NO: 3898001 - RNA, 22 nt, Shigella flexneri 2a str. 301
ucggcuucugccuuauccagca

SEQ ID NO: 3898002 - RNA, 14 nt, Shigella flexneri 2a str. 301
ucgggaaccggcug

SEQ ID NO: 3898003 - RNA, 18 nt, Shigella flexneri 2a str. 301
ucgggaacgcuuuugcau

SEQ ID NO: 3898004 - RNA, 22 nt, Shigella flexneri 2a str. 301
ucgggaaggcccuuucccuucu

SEQ ID NO: 3898005 - RNA, 17 nt, Shigella flexneri 2a str. 301
ucgggagguaaugacuc

SEQ ID NO: 3898006 - RNA, 19 nt, Shigella flexneri 2a str. 301
ucgggagguaaugacucca

SEQ ID NO: 3898007 - RNA, 20 nt, Shigella flexneri 2a str. 301
ucgggcaauggcuccgggug

SEQ ID NO: 3898008 - RNA, 14 nt, Shigella flexneri 2a str. 301
ucgggcaucagaag

SEQ ID NO: 3898009 - RNA, 15 nt, Shigella flexneri 2a str. 301
ucgggccguugucga

SEQ ID NO: 3898010 - RNA, 15 nt, Shigella flexneri 2a str. 301
ucgggcguuaucgcg

SEQ ID NO: 3898011 - RNA, 22 nt, Shigella flexneri 2a str. 301
ucgggcuagacugaugacaaag

SEQ ID NO: 3898012 - RNA, 21 nt, Shigella flexneri 2a str. 301
ucgggcuuugcuacagccugg

SEQ ID NO: 3898013 - RNA, 20 nt, Shigella flexneri 2a str. 301
ucggggcggcuaucccaaag

SEQ ID NO: 3898014 - RNA, 19 nt, Shigella flexneri 2a str. 301
ucggggcuguuuuccagca

SEQ ID NO: 3898015 - RNA, 13 nt, Shigella flexneri 2a str. 301
ucggguaacggac

SEQ ID NO: 3898016 - RNA, 16 nt, Shigella flexneri 2a str. 301
ucgguagcagcuuuca

SEQ ID NO: 3898017 - RNA, 14 nt, Shigella flexneri 2a str. 301
ucgguauuuccauu

SEQ ID NO: 3898018 - RNA, 14 nt, Shigella flexneri 2a str. 301
ucggucaaguaauu

SEQ ID NO: 3898019 - RNA, 11 nt, Shigella flexneri 2a str. 301
ucggucacagu

SEQ ID NO: 3898020 - RNA, 15 nt, Shigella flexneri 2a str. 301
ucggucagacccagu

SEQ ID NO: 3898021 - RNA, 13 nt, Shigella flexneri 2a str. 301
ucggucagagaau

SEQ ID NO: 3898022 - RNA, 15 nt, Shigella flexneri 2a str. 301
ucgguccaccacgua

SEQ ID NO: 3898023 - RNA, 16 nt, Shigella flexneri 2a str. 301
ucgguccgacgugcuc

SEQ ID NO: 3898024 - RNA, 15 nt, Shigella flexneri 2a str. 301
ucggugagacgcacc

SEQ ID NO: 3898025 - RNA, 22 nt, Shigella flexneri 2a str. 301
ucggugagcuaaugcaaaucac

SEQ ID NO: 3898026 - RNA, 14 nt, Shigella flexneri 2a str. 301
ucggugaugaaccc

SEQ ID NO: 3898027 - RNA, 16 nt, Shigella flexneri 2a str. 301
ucuaucuuucagaccu

SEQ ID NO: 3898028 - RNA, 16 nt, Shigella flexneri 2a str. 301
ucuaugagaaaauuuc

SEQ ID NO: 3898029 - RNA, 17 nt, Shigella flexneri 2a str. 301
ucuaugguuuuuucuac

SEQ ID NO: 3898030 - RNA, 21 nt, Shigella flexneri 2a str. 301
ucuauucaccgcaucaauauu

SEQ ID NO: 3898031 - RNA, 21 nt, Shigella flexneri 2a str. 301
ucucaaacacgccgauaucgc

SEQ ID NO: 3898032 - RNA, 22 nt, Shigella flexneri 2a str. 301
ucucaaccuuuccuuguaacgc

SEQ ID NO: 3898033 - RNA, 14 nt, Shigella flexneri 2a str. 301
ucucaagagugaac

SEQ ID NO: 3898034 - RNA, 12 nt, Shigella flexneri 2a str. 301
ucucaagccacu

SEQ ID NO: 3898035 - RNA, 20 nt, Shigella flexneri 2a str. 301
ucucaagggaggagucaucc

SEQ ID NO: 3898036 - RNA, 13 nt, Shigella flexneri 2a str. 301
ucucaauaaaagg

SEQ ID NO: 3898037 - RNA, 13 nt, Shigella flexneri 2a str. 301
ucucaaucaccac

SEQ ID NO: 3898038 - RNA, 22 nt, Shigella flexneri 2a str. 301
ucucaaucccuuucucuucaaa

SEQ ID NO: 3898039 - RNA, 12 nt, Shigella flexneri 2a str. 301
ucucaaucuuca

SEQ ID NO: 3898040 - RNA, 15 nt, Shigella flexneri 2a str. 301
ucucaauuacaguuu

SEQ ID NO: 3898041 - RNA, 17 nt, Shigella flexneri 2a str. 301
ucucaauuacugucguu

SEQ ID NO: 3898042 - RNA, 22 nt, Shigella flexneri 2a str. 301
ucucaccguugccaaccugaac

SEQ ID NO: 3898043 - RNA, 23 nt, Shigella flexneri 2a str. 301
ucucaccuauguggaaacaguga

SEQ ID NO: 3898044 - RNA, 13 nt, Shigella flexneri 2a str. 301
ucucacucaccgc

SEQ ID NO: 3898045 - RNA, 19 nt, Shigella flexneri 2a str. 301
ucucacuccagccagagcc

SEQ ID NO: 3898046 - RNA, 19 nt, Shigella flexneri 2a str. 301
ucucacuccggccagagca

SEQ ID NO: 3898047 - RNA, 17 nt, Shigella flexneri 2a str. 301
ucucacuguucacuuuu

SEQ ID NO: 3898048 - RNA, 18 nt, Shigella flexneri 2a str. 301
ucucacuguucacuuuug

SEQ ID NO: 3898049 - RNA, 21 nt, Shigella flexneri 2a str. 301
ucucagagaacuguagacaaa

SEQ ID NO: 3898050 - RNA, 11 nt, Shigella flexneri 2a str. 301
ucucagcacac

SEQ ID NO: 3898051 - RNA, 18 nt, Shigella flexneri 2a str. 301
ucucagcacauugauggc

SEQ ID NO: 3898052 - RNA, 23 nt, Shigella flexneri 2a str. 301
ucucagcgccgcuuuccaggcug

SEQ ID NO: 3898053 - RNA, 15 nt, Shigella flexneri 2a str. 301
ucucagcugcaagau

SEQ ID NO: 3898054 - RNA, 19 nt, Shigella flexneri 2a str. 301
ucucaguggcuauuuacca

SEQ ID NO: 3898055 - RNA, 22 nt, Shigella flexneri 2a str. 301
ucucaguggcuauuuaccaaua

SEQ ID NO: 3898056 - RNA, 22 nt, Shigella flexneri 2a str. 301
ucucaucgccaucaauaaccag

SEQ ID NO: 3898057 - RNA, 21 nt, Shigella flexneri 2a str. 301
ucucaucgcugcgcucuaaaa

SEQ ID NO: 3898058 - RNA, 22 nt, Shigella flexneri 2a str. 301
ucucaucguugcgaucgaccug

SEQ ID NO: 3898059 - RNA, 21 nt, Shigella flexneri 2a str. 301
ucuccaacaucgaaaacgcca

SEQ ID NO: 3898060 - RNA, 22 nt, Shigella flexneri 2a str. 301
ucuccaacaucgaaaacgccac

SEQ ID NO: 3898061 - RNA, 14 nt, Shigella flexneri 2a str. 301
ucuccacagucagg

SEQ ID NO: 3898062 - RNA, 19 nt, Shigella flexneri 2a str. 301
ucuccacuauaaaaaaacc

SEQ ID NO: 3898063 - RNA, 18 nt, Shigella flexneri 2a str. 301
ucuccagcgcaucgaucu

SEQ ID NO: 3898064 - RNA, 12 nt, Shigella flexneri 2a str. 301
ucuccagcuccc

SEQ ID NO: 3898065 - RNA, 18 nt, Shigella flexneri 2a str. 301
ucuccagcuccccacgau

SEQ ID NO: 3898066 - RNA, 11 nt, Shigella flexneri 2a str. 301
ucuccccccuc

SEQ ID NO: 3898067 - RNA, 19 nt, Shigella flexneri 2a str. 301
ucuccccccucugaucagu

SEQ ID NO: 3898068 - RNA, 20 nt, Shigella flexneri 2a str. 301
ucucccgaaaaaccugacgu

SEQ ID NO: 3898069 - RNA, 14 nt, Shigella flexneri 2a str. 301
ucucccgccagcga

SEQ ID NO: 3898070 - RNA, 20 nt, Shigella flexneri 2a str. 301
ucucccuacagagcgaggga

SEQ ID NO: 3898071 - RNA, 15 nt, Shigella flexneri 2a str. 301
ucuccuccggggaag

SEQ ID NO: 3898072 - RNA, 12 nt, Shigella flexneri 2a str. 301
ucuccugcgcac

SEQ ID NO: 3898073 - RNA, 21 nt, Shigella flexneri 2a str. 301
ucuccugcgccucuccacacg

SEQ ID NO: 3898074 - RNA, 15 nt, Shigella flexneri 2a str. 301
ucuccugcgccuguc

SEQ ID NO: 3898075 - RNA, 20 nt, Shigella flexneri 2a str. 301
ucuccugcggcgacaaaugu

SEQ ID NO: 3898076 - RNA, 23 nt, Shigella flexneri 2a str. 301
ucuccuggcgcaccuuuuuuuau

SEQ ID NO: 3898077 - RNA, 17 nt, Shigella flexneri 2a str. 301
ucuccuguucucacuaa

SEQ ID NO: 3898078 - RNA, 17 nt, Shigella flexneri 2a str. 301
ucuccuguugugaugca

SEQ ID NO: 3898079 - RNA, 18 nt, Shigella flexneri 2a str. 301
ucuccuguugugaugcaa

SEQ ID NO: 3898080 - RNA, 15 nt, Shigella flexneri 2a str. 301
ucuccuguuucacuu

SEQ ID NO: 3898081 - RNA, 11 nt, Shigella flexneri 2a str. 301
ucuccuucacg

SEQ ID NO: 3898082 - RNA, 13 nt, Shigella flexneri 2a str. 301
ucuccuucacgau

SEQ ID NO: 3898083 - RNA, 15 nt, Shigella flexneri 2a str. 301
ucuccuucacucuau

SEQ ID NO: 3898084 - RNA, 13 nt, Shigella flexneri 2a str. 301
ucuccuucgcaca

SEQ ID NO: 3898085 - RNA, 15 nt, Shigella flexneri 2a str. 301
ucuccuuugccaaaa

SEQ ID NO: 3898086 - RNA, 15 nt, Shigella flexneri 2a str. 301
ucucgaucacuucgc

SEQ ID NO: 3898087 - RNA, 16 nt, Shigella flexneri 2a str. 301
ucucgcccguuuugag

SEQ ID NO: 3898088 - RNA, 21 nt, Shigella flexneri 2a str. 301
ucucgcucgagagagaaaaua

SEQ ID NO: 3898089 - RNA, 13 nt, Shigella flexneri 2a str. 301
ucucgcugauucu

SEQ ID NO: 3898090 - RNA, 22 nt, Shigella flexneri 2a str. 301
ucucgcuucguagcaggcaggc

SEQ ID NO: 3898091 - RNA, 15 nt, Shigella flexneri 2a str. 301
ucucggcuuugguau

SEQ ID NO: 3898092 - RNA, 13 nt, Shigella flexneri 2a str. 301
ucucgggaaggcc

SEQ ID NO: 3898093 - RNA, 17 nt, Shigella flexneri 2a str. 301
ucucgggaaggcccuuu

SEQ ID NO: 3898094 - RNA, 22 nt, Shigella flexneri 2a str. 301
ucucgggcaguaaaucaauauc

SEQ ID NO: 3898095 - RNA, 21 nt, Shigella flexneri 2a str. 301
ucucggucggcauuuuucggc

SEQ ID NO: 3898096 - RNA, 16 nt, Shigella flexneri 2a str. 301
ucucgguuugcggcag

SEQ ID NO: 3898097 - RNA, 18 nt, Shigella flexneri 2a str. 301
ucucguccaguuugccuu

SEQ ID NO: 3898098 - RNA, 13 nt, Shigella flexneri 2a str. 301
ucucgugccacca

SEQ ID NO: 3898099 - RNA, 13 nt, Shigella flexneri 2a str. 301
ucucgugccgcca

SEQ ID NO: 3898100 - RNA, 15 nt, Shigella flexneri 2a str. 301
ucucgugccgccagc

SEQ ID NO: 3898101 - RNA, 17 nt, Shigella flexneri 2a str. 301
ucucguugaucacccac

SEQ ID NO: 3898102 - RNA, 16 nt, Shigella flexneri 2a str. 301
ucucguuggucaucac

SEQ ID NO: 3898103 - RNA, 14 nt, Shigella flexneri 2a str. 301
ucucuacaccauua

SEQ ID NO: 3898104 - RNA, 16 nt, Shigella flexneri 2a str. 301
ucucuauuccaccauc

SEQ ID NO: 3898105 - RNA, 13 nt, Shigella flexneri 2a str. 301
ucucucagcacac

SEQ ID NO: 3898106 - RNA, 20 nt, Shigella flexneri 2a str. 301
ucucucugauuacccuucgc

SEQ ID NO: 3898107 - RNA, 17 nt, Shigella flexneri 2a str. 301
ucucugacgcucucuac

SEQ ID NO: 3898108 - RNA, 18 nt, Shigella flexneri 2a str. 301
ucucugcgcuauccagcg

SEQ ID NO: 3898109 - RNA, 19 nt, Shigella flexneri 2a str. 301
ucucuggcccgcuuuucau

SEQ ID NO: 3898110 - RNA, 18 nt, Shigella flexneri 2a str. 301
ucucuggcuguuucgcuu

SEQ ID NO: 3898111 - RNA, 17 nt, Shigella flexneri 2a str. 301
ucucugggagauuaccu

SEQ ID NO: 3898112 - RNA, 21 nt, Shigella flexneri 2a str. 301
ucucuguuuccagauuuugcu

SEQ ID NO: 3898113 - RNA, 20 nt, Shigella flexneri 2a str. 301
ucucuucaacacggcgcauu

SEQ ID NO: 3898114 - RNA, 14 nt, Shigella flexneri 2a str. 301
ucucuucagccaac

SEQ ID NO: 3898115 - RNA, 23 nt, Shigella flexneri 2a str. 301
ucucuucggcuucugccuuaucc

SEQ ID NO: 3898116 - RNA, 15 nt, Shigella flexneri 2a str. 301
ucucuucguuuucaa

SEQ ID NO: 3898117 - RNA, 13 nt, Shigella flexneri 2a str. 301
ucucuucugcuuu

SEQ ID NO: 3898118 - RNA, 23 nt, Shigella flexneri 2a str. 301
ucucuugcuggcauuacaagaau

SEQ ID NO: 3898119 - RNA, 17 nt, Shigella flexneri 2a str. 301
ucugaaaucaucaauac

SEQ ID NO: 3898120 - RNA, 12 nt, Shigella flexneri 2a str. 301
ucugaacugaac

SEQ ID NO: 3898121 - RNA, 22 nt, Shigella flexneri 2a str. 301
ucugaagacgcgucuggcauca

SEQ ID NO: 3898122 - RNA, 20 nt, Shigella flexneri 2a str. 301
ucugaaggauuagccggaua

SEQ ID NO: 3898123 - RNA, 19 nt, Shigella flexneri 2a str. 301
ucugaaguagccaguacca

SEQ ID NO: 3898124 - RNA, 11 nt, Shigella flexneri 2a str. 301
ucugaauaaac

SEQ ID NO: 3898125 - RNA, 17 nt, Shigella flexneri 2a str. 301
ucugaauaacacccaua

SEQ ID NO: 3898126 - RNA, 21 nt, Shigella flexneri 2a str. 301
ucugaauauucggcuccagau

SEQ ID NO: 3898127 - RNA, 16 nt, Shigella flexneri 2a str. 301
ucugguaucgaguggc

SEQ ID NO: 3898128 - RNA, 17 nt, Shigella flexneri 2a str. 301
ucuggucaguuggcugg

SEQ ID NO: 3898129 - RNA, 15 nt, Shigella flexneri 2a str. 301
ucuggugaccuggga

SEQ ID NO: 3898130 - RNA, 15 nt, Shigella flexneri 2a str. 301
ucugguggaaaagaa

SEQ ID NO: 3898131 - RNA, 19 nt, Shigella flexneri 2a str. 301
ucugguguggagugcagca

SEQ ID NO: 3898132 - RNA, 15 nt, Shigella flexneri 2a str. 301
ucugguuaccggcau

SEQ ID NO: 3898133 - RNA, 23 nt, Shigella flexneri 2a str. 301
ucugguucgccaaaugucaccag

SEQ ID NO: 3898134 - RNA, 13 nt, Shigella flexneri 2a str. 301
ucugguugagcag

SEQ ID NO: 3898135 - RNA, 14 nt, Shigella flexneri 2a str. 301
ucugguuguggugg

SEQ ID NO: 3898136 - RNA, 21 nt, Shigella flexneri 2a str. 301
ucugguuucaguaauccuuuc

SEQ ID NO: 3898137 - RNA, 22 nt, Shigella flexneri 2a str. 301
ucugguuuuucugaaaacuguu

SEQ ID NO: 3898138 - RNA, 14 nt, Shigella flexneri 2a str. 301
ucuguaugacaaca

SEQ ID NO: 3898139 - RNA, 16 nt, Shigella flexneri 2a str. 301
ucugucagguaacaag

SEQ ID NO: 3898140 - RNA, 22 nt, Shigella flexneri 2a str. 301
ucugucaguggacgauaagcac

SEQ ID NO: 3898141 - RNA, 16 nt, Shigella flexneri 2a str. 301
ucugucaguuggcugu

SEQ ID NO: 3898142 - RNA, 18 nt, Shigella flexneri 2a str. 301
ucugucaguuggcugugg

SEQ ID NO: 3898143 - RNA, 14 nt, Shigella flexneri 2a str. 301
ucugugccgcugac

SEQ ID NO: 3898144 - RNA, 14 nt, Shigella flexneri 2a str. 301
ucuguggacugauu

SEQ ID NO: 3898145 - RNA, 15 nt, Shigella flexneri 2a str. 301
ucuguggcagggcag

SEQ ID NO: 3898146 - RNA, 21 nt, Shigella flexneri 2a str. 301
ucuguuaucacuuaacccauu

SEQ ID NO: 3898147 - RNA, 13 nt, Shigella flexneri 2a str. 301
ucuguucagcaaa

SEQ ID NO: 3898148 - RNA, 15 nt, Shigella flexneri 2a str. 301
ucuguucaucuauac

SEQ ID NO: 3898149 - RNA, 14 nt, Shigella flexneri 2a str. 301
ucuguuccggcgua

SEQ ID NO: 3898150 - RNA, 19 nt, Shigella flexneri 2a str. 301
ucuguugccgcuacaucac

SEQ ID NO: 3898151 - RNA, 16 nt, Shigella flexneri 2a str. 301
ucuguuucaucucuuc

SEQ ID NO: 3898152 - RNA, 16 nt, Shigella flexneri 2a str. 301
ucuguuuccagauuuu

SEQ ID NO: 3898153 - RNA, 18 nt, Shigella flexneri 2a str. 301
ucuuaaaauaguccugag

SEQ ID NO: 3898154 - RNA, 19 nt, Shigella flexneri 2a str. 301
ucuuaaaggggugaaaaaa

SEQ ID NO: 3898155 - RNA, 15 nt, Shigella flexneri 2a str. 301
ucuuaacgucgcaag

SEQ ID NO: 3898156 - RNA, 17 nt, Shigella flexneri 2a str. 301
ucuuaaucgcuucuucu

SEQ ID NO: 3898157 - RNA, 20 nt, Shigella flexneri 2a str. 301
ucuuaaucgcuucuucuuua

SEQ ID NO: 3898158 - RNA, 13 nt, Shigella flexneri 2a str. 301
ucuuacauuccgu

SEQ ID NO: 3898159 - RNA, 14 nt, Shigella flexneri 2a str. 301
ucuuaccccugauu

SEQ ID NO: 3898160 - RNA, 21 nt, Shigella flexneri 2a str. 301
ucuuacccuuccuuagcaaaa

SEQ ID NO: 3898161 - RNA, 17 nt, Shigella flexneri 2a str. 301
ucuuaccgcuucaauua

SEQ ID NO: 3898162 - RNA, 21 nt, Shigella flexneri 2a str. 301
ucuuaccggucccuucaaucu

SEQ ID NO: 3898163 - RNA, 18 nt, Shigella flexneri 2a str. 301
ucuuacguaauuuauaau

SEQ ID NO: 3898164 - RNA, 19 nt, Shigella flexneri 2a str. 301
ucuuacuaaguacauuaag

SEQ ID NO: 3898165 - RNA, 13 nt, Shigella flexneri 2a str. 301
ucuuacuuuuaau

SEQ ID NO: 3898166 - RNA, 20 nt, Shigella flexneri 2a str. 301
ucuuagcccuuaauuacguu

SEQ ID NO: 3898167 - RNA, 16 nt, Shigella flexneri 2a str. 301
ucuuagugcgccugau

SEQ ID NO: 3898168 - RNA, 17 nt, Shigella flexneri 2a str. 301
ucuuagugcgccugauc

SEQ ID NO: 3898169 - RNA, 15 nt, Shigella flexneri 2a str. 301
ucuuauaaagaaaau

SEQ ID NO: 3898170 - RNA, 17 nt, Shigella flexneri 2a str. 301
ucuuauaugaugaaacu

SEQ ID NO: 3898171 - RNA, 17 nt, Shigella flexneri 2a str. 301
ucuuaucaggccuacaa

SEQ ID NO: 3898172 - RNA, 22 nt, Shigella flexneri 2a str. 301
ucuuaucaggccuaccuuaacc

SEQ ID NO: 3898173 - RNA, 17 nt, Shigella flexneri 2a str. 301
ucuuaucaugccuacau

SEQ ID NO: 3898174 - RNA, 20 nt, Shigella flexneri 2a str. 301
ucuuaucaugccuacauauu

SEQ ID NO: 3898175 - RNA, 19 nt, Shigella flexneri 2a str. 301
ucuuauccagcugcgcgcg

SEQ ID NO: 3898176 - RNA, 19 nt, Shigella flexneri 2a str. 301
ucuuauccggccuuccugu

SEQ ID NO: 3898177 - RNA, 20 nt, Shigella flexneri 2a str. 301
ucuuauccugcguuuguccg

SEQ ID NO: 3898178 - RNA, 16 nt, Shigella flexneri 2a str. 301
ucuuaucuaacaaccu

SEQ ID NO: 3898179 - RNA, 21 nt, Shigella flexneri 2a str. 301
ucuuaucuggccuacuuuaau

SEQ ID NO: 3898180 - RNA, 19 nt, Shigella flexneri 2a str. 301
ucuuaugauguaaauaaca

SEQ ID NO: 3898181 - RNA, 16 nt, Shigella flexneri 2a str. 301
ucuucaaacucaccag

SEQ ID NO: 3898182 - RNA, 16 nt, Shigella flexneri 2a str. 301
ucuucaaacugaagau

SEQ ID NO: 3898183 - RNA, 12 nt, Shigella flexneri 2a str. 301
ucuucaaagcca

SEQ ID NO: 3898184 - RNA, 13 nt, Shigella flexneri 2a str. 301
ucuucaacacacu

SEQ ID NO: 3898185 - RNA, 22 nt, Shigella flexneri 2a str. 301
ucuucaaccgcagugauuucaa

SEQ ID NO: 3898186 - RNA, 20 nt, Shigella flexneri 2a str. 301
ucuucaaccgucaccagccc

SEQ ID NO: 3898187 - RNA, 13 nt, Shigella flexneri 2a str. 301
ucuucaacuucag

SEQ ID NO: 3898188 - RNA, 17 nt, Shigella flexneri 2a str. 301
ucuucaacuucagcagc

SEQ ID NO: 3898189 - RNA, 18 nt, Shigella flexneri 2a str. 301
ucuucaacuucagcagca

SEQ ID NO: 3898190 - RNA, 19 nt, Shigella flexneri 2a str. 301
ucuucaagaaucauaggcu

SEQ ID NO: 3898191 - RNA, 13 nt, Shigella flexneri 2a str. 301
ucuucaaugguca

SEQ ID NO: 3898192 - RNA, 15 nt, Shigella flexneri 2a str. 301
ucuucaccagauugu

SEQ ID NO: 3898193 - RNA, 15 nt, Shigella flexneri 2a str. 301
ucuucaccgguacgg

SEQ ID NO: 3898194 - RNA, 18 nt, Shigella flexneri 2a str. 301
ucuucacgcgcagaucgu

SEQ ID NO: 3898195 - RNA, 21 nt, Shigella flexneri 2a str. 301
ucuucacguuuuucgaaaauc

SEQ ID NO: 3898196 - RNA, 18 nt, Shigella flexneri 2a str. 301
ucuucacuguccgucaga

SEQ ID NO: 3898197 - RNA, 15 nt, Shigella flexneri 2a str. 301
ucuucacuucuucaa

SEQ ID NO: 3898198 - RNA, 14 nt, Shigella flexneri 2a str. 301
ucuucagcaguuca

SEQ ID NO: 3898199 - RNA, 16 nt, Shigella flexneri 2a str. 301
ucuucagccccuccac

SEQ ID NO: 3898200 - RNA, 14 nt, Shigella flexneri 2a str. 301
ucuucagccugcac

SEQ ID NO: 3898201 - RNA, 12 nt, Shigella flexneri 2a str. 301
ucuucaucaucc

SEQ ID NO: 3898202 - RNA, 13 nt, Shigella flexneri 2a str. 301
ucuucaucauccu

SEQ ID NO: 3898203 - RNA, 15 nt, Shigella flexneri 2a str. 301
ucuucaucauccucu

SEQ ID NO: 3898204 - RNA, 17 nt, Shigella flexneri 2a str. 301
ucuucaucauccucuuc

SEQ ID NO: 3898205 - RNA, 18 nt, Shigella flexneri 2a str. 301
ucuucaucgauacugcuc

SEQ ID NO: 3898206 - RNA, 17 nt, Shigella flexneri 2a str. 301
ucuucaucgcuaaaaua

SEQ ID NO: 3898207 - RNA, 20 nt, Shigella flexneri 2a str. 301
ucuucaugccucguuucccu

SEQ ID NO: 3898208 - RNA, 21 nt, Shigella flexneri 2a str. 301
ucuucauuaaauuuccgcgaa

SEQ ID NO: 3898209 - RNA, 22 nt, Shigella flexneri 2a str. 301
ucuucauuaugaauagcggaaa

SEQ ID NO: 3898210 - RNA, 18 nt, Shigella flexneri 2a str. 301
ucuucauugugguucuca

SEQ ID NO: 3898211 - RNA, 14 nt, Shigella flexneri 2a str. 301
ucuuccacgccugc

SEQ ID NO: 3898212 - RNA, 19 nt, Shigella flexneri 2a str. 301
ucuuccagaauaaacaacu

SEQ ID NO: 3898213 - RNA, 21 nt, Shigella flexneri 2a str. 301
ucuuccagaucaccgcagaag

SEQ ID NO: 3898214 - RNA, 16 nt, Shigella flexneri 2a str. 301
ucuuccagcaaaucca

SEQ ID NO: 3898215 - RNA, 21 nt, Shigella flexneri 2a str. 301
ucuuccagcagcggcagauca

SEQ ID NO: 3898216 - RNA, 11 nt, Shigella flexneri 2a str. 301
ucuucccagcc

SEQ ID NO: 3898217 - RNA, 18 nt, Shigella flexneri 2a str. 301
ucuucccagccaaugcag

SEQ ID NO: 3898218 - RNA, 20 nt, Shigella flexneri 2a str. 301
ucuuccccugcgauaacggu

SEQ ID NO: 3898219 - RNA, 20 nt, Shigella flexneri 2a str. 301
ucuucccgagacauuccuuu

SEQ ID NO: 3898220 - RNA, 22 nt, Shigella flexneri 2a str. 301
ucuucccuuguuauuguguagc

SEQ ID NO: 3898221 - RNA, 17 nt, Shigella flexneri 2a str. 301
ucuuccgcgccaaacau

SEQ ID NO: 3898222 - RNA, 14 nt, Shigella flexneri 2a str. 301
ucuuccgcuucaau

SEQ ID NO: 3898223 - RNA, 19 nt, Shigella flexneri 2a str. 301
ucuuccggcaccauuccac

SEQ ID NO: 3898224 - RNA, 17 nt, Shigella flexneri 2a str. 301
ucuuccggcgauucuuu

SEQ ID NO: 3898225 - RNA, 18 nt, Shigella flexneri 2a str. 301
ucuuccggcgauucuuug

SEQ ID NO: 3898226 - RNA, 22 nt, Shigella flexneri 2a str. 301
ucuuccgggcuauauacccuuc

SEQ ID NO: 3898227 - RNA, 22 nt, Shigella flexneri 2a str. 301
ugaaaacccuauuuuuggaggu

SEQ ID NO: 3898228 - RNA, 15 nt, Shigella flexneri 2a str. 301
ugaaaacccugcgca

SEQ ID NO: 3898229 - RNA, 21 nt, Shigella flexneri 2a str. 301
ugaaaaccggacugaaaguac

SEQ ID NO: 3898230 - RNA, 21 nt, Shigella flexneri 2a str. 301
ugaaaacgccggagugaaaau

SEQ ID NO: 3898231 - RNA, 16 nt, Shigella flexneri 2a str. 301
ugaaaagcugugcuug

SEQ ID NO: 3898232 - RNA, 17 nt, Shigella flexneri 2a str. 301
ugaaaaguccaggcugc

SEQ ID NO: 3898233 - RNA, 18 nt, Shigella flexneri 2a str. 301
ugaaaaguccaggcugca

SEQ ID NO: 3898234 - RNA, 14 nt, Shigella flexneri 2a str. 301
ugaaaaugcugguu

SEQ ID NO: 3898235 - RNA, 13 nt, Shigella flexneri 2a str. 301
ugaaaauguggua

SEQ ID NO: 3898236 - RNA, 14 nt, Shigella flexneri 2a str. 301
ugaaaauuauaucu

SEQ ID NO: 3898237 - RNA, 17 nt, Shigella flexneri 2a str. 301
ugaaacaggggcuggaa

SEQ ID NO: 3898238 - RNA, 18 nt, Shigella flexneri 2a str. 301
ugaaacaggggcuggaag

SEQ ID NO: 3898239 - RNA, 17 nt, Shigella flexneri 2a str. 301
ugaaaccagacacuuca

SEQ ID NO: 3898240 - RNA, 16 nt, Shigella flexneri 2a str. 301
ugaaaccuuuaugcag

SEQ ID NO: 3898241 - RNA, 15 nt, Shigella flexneri 2a str. 301
ugaaacgaaaucuug

SEQ ID NO: 3898242 - RNA, 21 nt, Shigella flexneri 2a str. 301
ugaaacggaaucgcccgcugu

SEQ ID NO: 3898243 - RNA, 14 nt, Shigella flexneri 2a str. 301
ugaaacucacgcag

SEQ ID NO: 3898244 - RNA, 19 nt, Shigella flexneri 2a str. 301
ugaaacucagcauggaaau

SEQ ID NO: 3898245 - RNA, 17 nt, Shigella flexneri 2a str. 301
ugaaacugauaauuuuc

SEQ ID NO: 3898246 - RNA, 17 nt, Shigella flexneri 2a str. 301
ugaaagaagcggugaaa

SEQ ID NO: 3898247 - RNA, 19 nt, Shigella flexneri 2a str. 301
ugaaagaagcggugaaaaa

SEQ ID NO: 3898248 - RNA, 21 nt, Shigella flexneri 2a str. 301
ugaaagauaaucacacagcgg

SEQ ID NO: 3898249 - RNA, 19 nt, Shigella flexneri 2a str. 301
ugaaagccccaccagcaaa

SEQ ID NO: 3898250 - RNA, 16 nt, Shigella flexneri 2a str. 301
ugaaagcgugucaugu

SEQ ID NO: 3898251 - RNA, 24 nt, Shigella flexneri 2a str. 301
ugaaagcguuuaugcgcauugcca

SEQ ID NO: 3898252 - RNA, 18 nt, Shigella flexneri 2a str. 301
ugaaagcugaacaaagcc

SEQ ID NO: 3898253 - RNA, 14 nt, Shigella flexneri 2a str. 301
ugaaaggaaaaaau

SEQ ID NO: 3898254 - RNA, 18 nt, Shigella flexneri 2a str. 301
ugaaaggaaaaaauacag

SEQ ID NO: 3898255 - RNA, 23 nt, Shigella flexneri 2a str. 301
ugaaaggcgcgguuucugcuugu

SEQ ID NO: 3898256 - RNA, 22 nt, Shigella flexneri 2a str. 301
ugaaaggcgcucauuuucucuu

SEQ ID NO: 3898257 - RNA, 23 nt, Shigella flexneri 2a str. 301
ugaaaggcgcucauuuucucuuu

SEQ ID NO: 3898258 - RNA, 15 nt, Shigella flexneri 2a str. 301
ugaaagggcaaauaa

SEQ ID NO: 3898259 - RNA, 16 nt, Shigella flexneri 2a str. 301
ugaaaguaaaaaagaa

SEQ ID NO: 3898260 - RNA, 20 nt, Shigella flexneri 2a str. 301
ugaaaguuuaacuaccgugu

SEQ ID NO: 3898261 - RNA, 17 nt, Shigella flexneri 2a str. 301
ugaaauaaaaauaagaa

SEQ ID NO: 3898262 - RNA, 15 nt, Shigella flexneri 2a str. 301
ugaaauaaugcagcg

SEQ ID NO: 3898263 - RNA, 22 nt, Shigella flexneri 2a str. 301
ugaaauaguugcauuccagucc

SEQ ID NO: 3898264 - RNA, 15 nt, Shigella flexneri 2a str. 301
ugaaaucagcacaua

SEQ ID NO: 3898265 - RNA, 23 nt, Shigella flexneri 2a str. 301
ugaaauccggcaccugucagacu

SEQ ID NO: 3898266 - RNA, 19 nt, Shigella flexneri 2a str. 301
ugaaaucgggcagcacaua

SEQ ID NO: 3898267 - RNA, 22 nt, Shigella flexneri 2a str. 301
ugaaaucguuugcauccagcuc

SEQ ID NO: 3898268 - RNA, 16 nt, Shigella flexneri 2a str. 301
ugaaaucugaaaucau

SEQ ID NO: 3898269 - RNA, 22 nt, Shigella flexneri 2a str. 301
ugaaaugugccggaugcaucac

SEQ ID NO: 3898270 - RNA, 19 nt, Shigella flexneri 2a str. 301
ugaaauuacuuuccaucuu

SEQ ID NO: 3898271 - RNA, 13 nt, Shigella flexneri 2a str. 301
ugaaauugcuggu

SEQ ID NO: 3898272 - RNA, 22 nt, Shigella flexneri 2a str. 301
ugaaauuuaugcgcuaaauguu

SEQ ID NO: 3898273 - RNA, 22 nt, Shigella flexneri 2a str. 301
ugaacaaaaaagaguaaaguua

SEQ ID NO: 3898274 - RNA, 12 nt, Shigella flexneri 2a str. 301
ugaacaaagccg

SEQ ID NO: 3898275 - RNA, 13 nt, Shigella flexneri 2a str. 301
ugaacaagcaaga

SEQ ID NO: 3898276 - RNA, 17 nt, Shigella flexneri 2a str. 301
ugaacaauuaacguauc

SEQ ID NO: 3898277 - RNA, 16 nt, Shigella flexneri 2a str. 301
ugaacaauuggauagu

SEQ ID NO: 3898278 - RNA, 13 nt, Shigella flexneri 2a str. 301
ugaacaauuucag

SEQ ID NO: 3898279 - RNA, 16 nt, Shigella flexneri 2a str. 301
ugaacacacccggaga

SEQ ID NO: 3898280 - RNA, 21 nt, Shigella flexneri 2a str. 301
ugaacaccaaacccugaguga

SEQ ID NO: 3898281 - RNA, 17 nt, Shigella flexneri 2a str. 301
ugaacaccuucucaggc

SEQ ID NO: 3898282 - RNA, 13 nt, Shigella flexneri 2a str. 301
ugaacagccugug

SEQ ID NO: 3898283 - RNA, 17 nt, Shigella flexneri 2a str. 301
ugaacagcuuuuuccug

SEQ ID NO: 3898284 - RNA, 15 nt, Shigella flexneri 2a str. 301
ugaacauaaucugca

SEQ ID NO: 3898285 - RNA, 13 nt, Shigella flexneri 2a str. 301
ugaacauaucagc

SEQ ID NO: 3898286 - RNA, 14 nt, Shigella flexneri 2a str. 301
ugaacauaucagcg

SEQ ID NO: 3898287 - RNA, 18 nt, Shigella flexneri 2a str. 301
ugaacaucgccgccguug

SEQ ID NO: 3898288 - RNA, 13 nt, Shigella flexneri 2a str. 301
ugaacauuuucuu

SEQ ID NO: 3898289 - RNA, 18 nt, Shigella flexneri 2a str. 301
ugaacauuuucuucugcc

SEQ ID NO: 3898290 - RNA, 21 nt, Shigella flexneri 2a str. 301
ugaaccagacugcacauggcg

SEQ ID NO: 3898291 - RNA, 21 nt, Shigella flexneri 2a str. 301
ugaacccugaaggacgccaga

SEQ ID NO: 3898292 - RNA, 16 nt, Shigella flexneri 2a str. 301
ugaaccgaaauggcug

SEQ ID NO: 3898293 - RNA, 16 nt, Shigella flexneri 2a str. 301
ugaaccgcacagguug

SEQ ID NO: 3898294 - RNA, 22 nt, Shigella flexneri 2a str. 301
ugaacgagaaaagccaaccugc

SEQ ID NO: 3898295 - RNA, 22 nt, Shigella flexneri 2a str. 301
ugaacgagaaaaugacgaugac

SEQ ID NO: 3898296 - RNA, 18 nt, Shigella flexneri 2a str. 301
ugaacgagucaacgcuuc

SEQ ID NO: 3898297 - RNA, 20 nt, Shigella flexneri 2a str. 301
ugaacgcaaauguaaaacca

SEQ ID NO: 3898298 - RNA, 20 nt, Shigella flexneri 2a str. 301
ugaacgcaccuuccaguuug

SEQ ID NO: 3898299 - RNA, 17 nt, Shigella flexneri 2a str. 301
ugaacgccaaauucuuu

SEQ ID NO: 3898300 - RNA, 15 nt, Shigella flexneri 2a str. 301
ugaacgccaccccac

SEQ ID NO: 3898301 - RNA, 21 nt, Shigella flexneri 2a str. 301
ugaacgccacgcucacucauc

SEQ ID NO: 3898302 - RNA, 14 nt, Shigella flexneri 2a str. 301
ugaacgccuuaucc

SEQ ID NO: 3898303 - RNA, 20 nt, Shigella flexneri 2a str. 301
ugaacgccuuauccgcccua

SEQ ID NO: 3898304 - RNA, 20 nt, Shigella flexneri 2a str. 301
ugaacgccuuauccggccua

SEQ ID NO: 3898305 - RNA, 20 nt, Shigella flexneri 2a str. 301
ugaacgccuuauccggucua

SEQ ID NO: 3898306 - RNA, 14 nt, Shigella flexneri 2a str. 301
ugaacgccuuaucu

SEQ ID NO: 3898307 - RNA, 21 nt, Shigella flexneri 2a str. 301
ugaacgcuggcggcaggccua

SEQ ID NO: 3898308 - RNA, 14 nt, Shigella flexneri 2a str. 301
ugaacgugcaaaau

SEQ ID NO: 3898309 - RNA, 18 nt, Shigella flexneri 2a str. 301
ugaacgugcaaaaucaaa

SEQ ID NO: 3898310 - RNA, 19 nt, Shigella flexneri 2a str. 301
ugaacgugcaaaaucaaac

SEQ ID NO: 3898311 - RNA, 21 nt, Shigella flexneri 2a str. 301
ugaacgugcaaaaucaaacag

SEQ ID NO: 3898312 - RNA, 18 nt, Shigella flexneri 2a str. 301
ugaacguggcaacccgcg

SEQ ID NO: 3898313 - RNA, 22 nt, Shigella flexneri 2a str. 301
ugaacucgacgcccuggaagaa

SEQ ID NO: 3898314 - RNA, 18 nt, Shigella flexneri 2a str. 301
ugaacucgccgcacaggc

SEQ ID NO: 3898315 - RNA, 20 nt, Shigella flexneri 2a str. 301
ugaacucgccgcacaggcgu

SEQ ID NO: 3898316 - RNA, 17 nt, Shigella flexneri 2a str. 301
ugaacucuucuuccggc

SEQ ID NO: 3898317 - RNA, 21 nt, Shigella flexneri 2a str. 301
ugaacugauugccacccugcg

SEQ ID NO: 3898318 - RNA, 19 nt, Shigella flexneri 2a str. 301
ugaacugcuuuuuaaucuc

SEQ ID NO: 3898319 - RNA, 16 nt, Shigella flexneri 2a str. 301
ugaacuggcuuuuuuc

SEQ ID NO: 3898320 - RNA, 19 nt, Shigella flexneri 2a str. 301
ugaacuggcuuuuuucaau

SEQ ID NO: 3898321 - RNA, 19 nt, Shigella flexneri 2a str. 301
ugaacugggccugcauauc

SEQ ID NO: 3898322 - RNA, 16 nt, Shigella flexneri 2a str. 301
ugaacugggcgcggcc

SEQ ID NO: 3898323 - RNA, 19 nt, Shigella flexneri 2a str. 301
ugaacugggcgcggcccac

SEQ ID NO: 3898324 - RNA, 13 nt, Shigella flexneri 2a str. 301
ugaacuucacgua

SEQ ID NO: 3898325 - RNA, 13 nt, Shigella flexneri 2a str. 301
ugaacuucggccu

SEQ ID NO: 3898326 - RNA, 17 nt, Shigella flexneri 2a str. 301
ugacagaguuccggccc

SEQ ID NO: 3898327 - RNA, 17 nt, Shigella flexneri 2a str. 301
ugacagccaaagggcug

SEQ ID NO: 3898328 - RNA, 20 nt, Shigella flexneri 2a str. 301
ugacagccagcaagucuuca

SEQ ID NO: 3898329 - RNA, 23 nt, Shigella flexneri 2a str. 301
ugacagccccugugccagcucgu

SEQ ID NO: 3898330 - RNA, 17 nt, Shigella flexneri 2a str. 301
ugacagccuugcgugcc

SEQ ID NO: 3898331 - RNA, 19 nt, Shigella flexneri 2a str. 301
ugacagcgcccgacaagau

SEQ ID NO: 3898332 - RNA, 23 nt, Shigella flexneri 2a str. 301
ugacagcgcccgacaagauccug

SEQ ID NO: 3898333 - RNA, 15 nt, Shigella flexneri 2a str. 301
ugacagggugagcag

SEQ ID NO: 3898334 - RNA, 16 nt, Shigella flexneri 2a str. 301
ugacagggugagcagg

SEQ ID NO: 3898335 - RNA, 21 nt, Shigella flexneri 2a str. 301
ugacagguugcucauaaaaug

SEQ ID NO: 3898336 - RNA, 22 nt, Shigella flexneri 2a str. 301
ugacagguugcucauaaaauga

SEQ ID NO: 3898337 - RNA, 14 nt, Shigella flexneri 2a str. 301
ugacaguagccuuu

SEQ ID NO: 3898338 - RNA, 17 nt, Shigella flexneri 2a str. 301
ugacaguaucgugacaa

SEQ ID NO: 3898339 - RNA, 18 nt, Shigella flexneri 2a str. 301
ugacauaaacaccagcaa

SEQ ID NO: 3898340 - RNA, 18 nt, Shigella flexneri 2a str. 301
ugacauaguagccagcca

SEQ ID NO: 3898341 - RNA, 19 nt, Shigella flexneri 2a str. 301
ugacauaguagccagccag

SEQ ID NO: 3898342 - RNA, 21 nt, Shigella flexneri 2a str. 301
ugacauauaaccggcaacaga

SEQ ID NO: 3898343 - RNA, 16 nt, Shigella flexneri 2a str. 301
ugacaucauuuuuucc

SEQ ID NO: 3898344 - RNA, 17 nt, Shigella flexneri 2a str. 301
ugacaucuccagcgcau

SEQ ID NO: 3898345 - RNA, 21 nt, Shigella flexneri 2a str. 301
ugacauuaaccaaccaccaaa

SEQ ID NO: 3898346 - RNA, 21 nt, Shigella flexneri 2a str. 301
ugacauucaccucacgacgua

SEQ ID NO: 3898347 - RNA, 20 nt, Shigella flexneri 2a str. 301
ugacauucugacuggucagu

SEQ ID NO: 3898348 - RNA, 23 nt, Shigella flexneri 2a str. 301
ugacauuugcuuuuguuaauugc

SEQ ID NO: 3898349 - RNA, 14 nt, Shigella flexneri 2a str. 301
ugaccaccaccgau

SEQ ID NO: 3898350 - RNA, 23 nt, Shigella flexneri 2a str. 301
ugaccaccgucccaguaauuacc

SEQ ID NO: 3898351 - RNA, 14 nt, Shigella flexneri 2a str. 301
ugaccagacuggag

SEQ ID NO: 3898352 - RNA, 17 nt, Shigella flexneri 2a str. 301
ugaccagcgauaaaaau

SEQ ID NO: 3898353 - RNA, 13 nt, Shigella flexneri 2a str. 301
ugaccagcuccag

SEQ ID NO: 3898354 - RNA, 19 nt, Shigella flexneri 2a str. 301
ugaccaggacuuugaaagc

SEQ ID NO: 3898355 - RNA, 20 nt, Shigella flexneri 2a str. 301
ugaccaggacuuugaaagcg

SEQ ID NO: 3898356 - RNA, 19 nt, Shigella flexneri 2a str. 301
ugaccaguaauauccccag

SEQ ID NO: 3898357 - RNA, 23 nt, Shigella flexneri 2a str. 301
ugaccaguaauauccccagccua

SEQ ID NO: 3898358 - RNA, 17 nt, Shigella flexneri 2a str. 301
ugaccaguaccaccgcg

SEQ ID NO: 3898359 - RNA, 12 nt, Shigella flexneri 2a str. 301
ugaccagucaga

SEQ ID NO: 3898360 - RNA, 16 nt, Shigella flexneri 2a str. 301
ugaccaguccggcuuu

SEQ ID NO: 3898361 - RNA, 20 nt, Shigella flexneri 2a str. 301
ugaccaguugcuccagcaau

SEQ ID NO: 3898362 - RNA, 22 nt, Shigella flexneri 2a str. 301
ugaccaguugcuccagcaauaa

SEQ ID NO: 3898363 - RNA, 14 nt, Shigella flexneri 2a str. 301
ugaccauaaaaggc

SEQ ID NO: 3898364 - RNA, 16 nt, Shigella flexneri 2a str. 301
ugaccaucuuccagca

SEQ ID NO: 3898365 - RNA, 13 nt, Shigella flexneri 2a str. 301
ugaccaugcucaa

SEQ ID NO: 3898366 - RNA, 17 nt, Shigella flexneri 2a str. 301
ugaccauuaucaaacag

SEQ ID NO: 3898367 - RNA, 15 nt, Shigella flexneri 2a str. 301
ugacccaccccagca

SEQ ID NO: 3898368 - RNA, 12 nt, Shigella flexneri 2a str. 301
ugacccagaccg

SEQ ID NO: 3898369 - RNA, 22 nt, Shigella flexneri 2a str. 301
ugacccgcaccguccucacugu

SEQ ID NO: 3898370 - RNA, 21 nt, Shigella flexneri 2a str. 301
ugacccggugguugcuuaucc

SEQ ID NO: 3898371 - RNA, 21 nt, Shigella flexneri 2a str. 301
ugacccgguugaccggccagu

SEQ ID NO: 3898372 - RNA, 19 nt, Shigella flexneri 2a str. 301
ugaccgaaccuguuuucac

SEQ ID NO: 3898373 - RNA, 14 nt, Shigella flexneri 2a str. 301
ugaccgaaugcagu

SEQ ID NO: 3898374 - RNA, 22 nt, Shigella flexneri 2a str. 301
ugaccgcccgcuaugagcagau

SEQ ID NO: 3898375 - RNA, 18 nt, Shigella flexneri 2a str. 301
ugaccgccgcagcaaccg

SEQ ID NO: 3898376 - RNA, 20 nt, Shigella flexneri 2a str. 301
ugaccgccuuauccggccua

SEQ ID NO: 3898377 - RNA, 20 nt, Shigella flexneri 2a str. 301
ugaccgcgaguaaucacauc

SEQ ID NO: 3898378 - RNA, 16 nt, Shigella flexneri 2a str. 301
ugaccgcgcuggcaau

SEQ ID NO: 3898379 - RNA, 19 nt, Shigella flexneri 2a str. 301
ugaccgguugcuggaucaa

SEQ ID NO: 3898380 - RNA, 16 nt, Shigella flexneri 2a str. 301
ugaccuacgcuuucga

SEQ ID NO: 3898381 - RNA, 15 nt, Shigella flexneri 2a str. 301
ugaccugacauuaag

SEQ ID NO: 3898382 - RNA, 11 nt, Shigella flexneri 2a str. 301
ugaccugcaaa

SEQ ID NO: 3898383 - RNA, 14 nt, Shigella flexneri 2a str. 301
ugaccugcagcguu

SEQ ID NO: 3898384 - RNA, 21 nt, Shigella flexneri 2a str. 301
ugaccugcggcaccagcggua

SEQ ID NO: 3898385 - RNA, 14 nt, Shigella flexneri 2a str. 301
ugaccuuuuuucag

SEQ ID NO: 3898386 - RNA, 22 nt, Shigella flexneri 2a str. 301
ugacgaagauguuguacagcga

SEQ ID NO: 3898387 - RNA, 16 nt, Shigella flexneri 2a str. 301
ugacgaccacccagca

SEQ ID NO: 3898388 - RNA, 17 nt, Shigella flexneri 2a str. 301
ugacgacuuuuuccauu

SEQ ID NO: 3898389 - RNA, 17 nt, Shigella flexneri 2a str. 301
ugacgauagcgccgcca

SEQ ID NO: 3898390 - RNA, 14 nt, Shigella flexneri 2a str. 301
ugacgaucaccaca

SEQ ID NO: 3898391 - RNA, 19 nt, Shigella flexneri 2a str. 301
ugacgaucaccacaccguc

SEQ ID NO: 3898392 - RNA, 20 nt, Shigella flexneri 2a str. 301
ugacgaucauauuguucccc

SEQ ID NO: 3898393 - RNA, 13 nt, Shigella flexneri 2a str. 301
ugacgaugacugg

SEQ ID NO: 3898394 - RNA, 16 nt, Shigella flexneri 2a str. 301
ugacgcauccgaucgc

SEQ ID NO: 3898395 - RNA, 23 nt, Shigella flexneri 2a str. 301
ugacgcauccgaucgcgcaucag

SEQ ID NO: 3898396 - RNA, 21 nt, Shigella flexneri 2a str. 301
ugacgccaaaauaacuuaaug

SEQ ID NO: 3898397 - RNA, 20 nt, Shigella flexneri 2a str. 301
ugacgccaccauucaccaag

SEQ ID NO: 3898398 - RNA, 15 nt, Shigella flexneri 2a str. 301
ugacgcccccaaacu

SEQ ID NO: 3898399 - RNA, 22 nt, Shigella flexneri 2a str. 301
ugacgccccuggcgaugccccc

SEQ ID NO: 3898400 - RNA, 22 nt, Shigella flexneri 2a str. 301
ugacgcgcgcccgauuaacugg

SEQ ID NO: 3898401 - RNA, 15 nt, Shigella flexneri 2a str. 301
ugacgcgggcagcag

SEQ ID NO: 3898402 - RNA, 16 nt, Shigella flexneri 2a str. 301
ugacgcgucuuaucag

SEQ ID NO: 3898403 - RNA, 16 nt, Shigella flexneri 2a str. 301
ugacgcuggcagaaag

SEQ ID NO: 3898404 - RNA, 23 nt, Shigella flexneri 2a str. 301
ugacgcuguuguuuuuucaaccu

SEQ ID NO: 3898405 - RNA, 17 nt, Shigella flexneri 2a str. 301
ugacgcuugagcaggag

SEQ ID NO: 3898406 - RNA, 23 nt, Shigella flexneri 2a str. 301
ugacgcuugagcaggagcagcag

SEQ ID NO: 3898407 - RNA, 16 nt, Shigella flexneri 2a str. 301
ugacggugauaaucau

SEQ ID NO: 3898408 - RNA, 18 nt, Shigella flexneri 2a str. 301
ugacguaauccgccuguu

SEQ ID NO: 3898409 - RNA, 21 nt, Shigella flexneri 2a str. 301
ugacguagcagcuccgccagc

SEQ ID NO: 3898410 - RNA, 22 nt, Shigella flexneri 2a str. 301
ugacguagcagcuccgccagcu

SEQ ID NO: 3898411 - RNA, 18 nt, Shigella flexneri 2a str. 301
ugacgucgaaacugacau

SEQ ID NO: 3898412 - RNA, 17 nt, Shigella flexneri 2a str. 301
ugacgucuuaauaaaug

SEQ ID NO: 3898413 - RNA, 19 nt, Shigella flexneri 2a str. 301
ugacgugccugugcagcga

SEQ ID NO: 3898414 - RNA, 16 nt, Shigella flexneri 2a str. 301
ugacgugucuuaucag

SEQ ID NO: 3898415 - RNA, 14 nt, Shigella flexneri 2a str. 301
ugacguuaagaaaa

SEQ ID NO: 3898416 - RNA, 19 nt, Shigella flexneri 2a str. 301
ugacguugucauacgggcu

SEQ ID NO: 3898417 - RNA, 13 nt, Shigella flexneri 2a str. 301
ugacuaaaacccu

SEQ ID NO: 3898418 - RNA, 14 nt, Shigella flexneri 2a str. 301
ugacuaacacuuca

SEQ ID NO: 3898419 - RNA, 13 nt, Shigella flexneri 2a str. 301
ugacuacaccauu

SEQ ID NO: 3898420 - RNA, 19 nt, Shigella flexneri 2a str. 301
ugacuaccggggacaggcg

SEQ ID NO: 3898421 - RNA, 20 nt, Shigella flexneri 2a str. 301
ugacuagaugugcaguuccu

SEQ ID NO: 3898422 - RNA, 22 nt, Shigella flexneri 2a str. 301
ugacuauauaaauuacccuuua

SEQ ID NO: 3898423 - RNA, 21 nt, Shigella flexneri 2a str. 301
ugacuauccuggacuuuaaac

SEQ ID NO: 3898424 - RNA, 23 nt, Shigella flexneri 2a str. 301
ugacuauuuccgauauucaggcg

SEQ ID NO: 3898425 - RNA, 16 nt, Shigella flexneri 2a str. 301
ugagucaauuucugca

SEQ ID NO: 3898426 - RNA, 20 nt, Shigella flexneri 2a str. 301
ugagucaauuucugcaaaau

SEQ ID NO: 3898427 - RNA, 24 nt, Shigella flexneri 2a str. 301
ugagucacuuuacgaccagccgau

SEQ ID NO: 3898428 - RNA, 14 nt, Shigella flexneri 2a str. 301
ugagucagaaaucu

SEQ ID NO: 3898429 - RNA, 16 nt, Shigella flexneri 2a str. 301
ugagucgcaaaacuca

SEQ ID NO: 3898430 - RNA, 13 nt, Shigella flexneri 2a str. 301
ugagugaaucaga

SEQ ID NO: 3898431 - RNA, 16 nt, Shigella flexneri 2a str. 301
ugagugccaaaaaaau

SEQ ID NO: 3898432 - RNA, 19 nt, Shigella flexneri 2a str. 301
ugagugccggggcgcggcg

SEQ ID NO: 3898433 - RNA, 14 nt, Shigella flexneri 2a str. 301
ugaguuaagaagau

SEQ ID NO: 3898434 - RNA, 14 nt, Shigella flexneri 2a str. 301
ugaguucacugccg

SEQ ID NO: 3898435 - RNA, 22 nt, Shigella flexneri 2a str. 301
ugaguucccggcagggaagcuc

SEQ ID NO: 3898436 - RNA, 23 nt, Shigella flexneri 2a str. 301
ugaguuucgucuuugguauagug

SEQ ID NO: 3898437 - RNA, 15 nt, Shigella flexneri 2a str. 301
ugauaaaaaacccgc

SEQ ID NO: 3898438 - RNA, 18 nt, Shigella flexneri 2a str. 301
ugauaaaaaccauucagg

SEQ ID NO: 3898439 - RNA, 21 nt, Shigella flexneri 2a str. 301
ugauaaaauucauucaauuaa

SEQ ID NO: 3898440 - RNA, 17 nt, Shigella flexneri 2a str. 301
ugauaaacaaacagcgc

SEQ ID NO: 3898441 - RNA, 16 nt, Shigella flexneri 2a str. 301
ugauaaaucaccugcg

SEQ ID NO: 3898442 - RNA, 18 nt, Shigella flexneri 2a str. 301
ugauaaaugagugaugau

SEQ ID NO: 3898443 - RNA, 20 nt, Shigella flexneri 2a str. 301
ugauaaccccgcaauuucau

SEQ ID NO: 3898444 - RNA, 18 nt, Shigella flexneri 2a str. 301
ugauaacgcggcagcagg

SEQ ID NO: 3898445 - RNA, 18 nt, Shigella flexneri 2a str. 301
ugauaacgugcagcuuuc

SEQ ID NO: 3898446 - RNA, 22 nt, Shigella flexneri 2a str. 301
ugauaacgugcagcuuucccuu

SEQ ID NO: 3898447 - RNA, 14 nt, Shigella flexneri 2a str. 301
ugauaacuucuacc

SEQ ID NO: 3898448 - RNA, 20 nt, Shigella flexneri 2a str. 301
ugauaagaugguuauccagc

SEQ ID NO: 3898449 - RNA, 14 nt, Shigella flexneri 2a str. 301
ugauaagcguagcg

SEQ ID NO: 3898450 - RNA, 23 nt, Shigella flexneri 2a str. 301
ugauaauaggaaucauuguuaua

SEQ ID NO: 3898451 - RNA, 19 nt, Shigella flexneri 2a str. 301
ugauaauccaucacuucau

SEQ ID NO: 3898452 - RNA, 22 nt, Shigella flexneri 2a str. 301
ugauaauccaucacuucaucau

SEQ ID NO: 3898453 - RNA, 16 nt, Shigella flexneri 2a str. 301
ugauaauguuauuuaa

SEQ ID NO: 3898454 - RNA, 15 nt, Shigella flexneri 2a str. 301
ugauaauuauuauaa

SEQ ID NO: 3898455 - RNA, 18 nt, Shigella flexneri 2a str. 301
ugauaauuauuauaauaa

SEQ ID NO: 3898456 - RNA, 15 nt, Shigella flexneri 2a str. 301
ugauacaggcgcugu

SEQ ID NO: 3898457 - RNA, 14 nt, Shigella flexneri 2a str. 301
ugauacaucaaguc

SEQ ID NO: 3898458 - RNA, 17 nt, Shigella flexneri 2a str. 301
ugauacaucaagucaga

SEQ ID NO: 3898459 - RNA, 11 nt, Shigella flexneri 2a str. 301
ugauacaugaa

SEQ ID NO: 3898460 - RNA, 22 nt, Shigella flexneri 2a str. 301
ugauaccgauuacucagcaacu

SEQ ID NO: 3898461 - RNA, 19 nt, Shigella flexneri 2a str. 301
ugauacgcgcaccggaaca

SEQ ID NO: 3898462 - RNA, 12 nt, Shigella flexneri 2a str. 301
ugauacgcgcca

SEQ ID NO: 3898463 - RNA, 22 nt, Shigella flexneri 2a str. 301
ugauagcaauaccaucaccaac

SEQ ID NO: 3898464 - RNA, 16 nt, Shigella flexneri 2a str. 301
ugauagcccggauuuc

SEQ ID NO: 3898465 - RNA, 21 nt, Shigella flexneri 2a str. 301
ugauagcuuacggcgcuguga

SEQ ID NO: 3898466 - RNA, 14 nt, Shigella flexneri 2a str. 301
ugauaggcuuccac

SEQ ID NO: 3898467 - RNA, 13 nt, Shigella flexneri 2a str. 301
ugauagugcugcc

SEQ ID NO: 3898468 - RNA, 19 nt, Shigella flexneri 2a str. 301
ugauaguguuuuauguuca

SEQ ID NO: 3898469 - RNA, 14 nt, Shigella flexneri 2a str. 301
ugauaguuaaaauu

SEQ ID NO: 3898470 - RNA, 20 nt, Shigella flexneri 2a str. 301
ugauauacccuucaucacgc

SEQ ID NO: 3898471 - RNA, 22 nt, Shigella flexneri 2a str. 301
ugauauacgucacuucaucguc

SEQ ID NO: 3898472 - RNA, 16 nt, Shigella flexneri 2a str. 301
ugauauauuuuuaaau

SEQ ID NO: 3898473 - RNA, 15 nt, Shigella flexneri 2a str. 301
ugauaucaaaacgcu

SEQ ID NO: 3898474 - RNA, 19 nt, Shigella flexneri 2a str. 301
ugauaucaaaacgcucuga

SEQ ID NO: 3898475 - RNA, 13 nt, Shigella flexneri 2a str. 301
ugauaucccugcu

SEQ ID NO: 3898476 - RNA, 12 nt, Shigella flexneri 2a str. 301
ugauauguuuau

SEQ ID NO: 3898477 - RNA, 15 nt, Shigella flexneri 2a str. 301
ugauauguuuauuag

SEQ ID NO: 3898478 - RNA, 18 nt, Shigella flexneri 2a str. 301
ugauauguuuuaaagcga

SEQ ID NO: 3898479 - RNA, 23 nt, Shigella flexneri 2a str. 301
ugauauuaagcagacggcucauc

SEQ ID NO: 3898480 - RNA, 22 nt, Shigella flexneri 2a str. 301
ugauauucccguuuucuuuuac

SEQ ID NO: 3898481 - RNA, 18 nt, Shigella flexneri 2a str. 301
ugauauuucgaauuuucc

SEQ ID NO: 3898482 - RNA, 18 nt, Shigella flexneri 2a str. 301
ugauauuucggcauuuuu

SEQ ID NO: 3898483 - RNA, 14 nt, Shigella flexneri 2a str. 301
ugaucaaauacuuc

SEQ ID NO: 3898484 - RNA, 15 nt, Shigella flexneri 2a str. 301
ugaucaacagcauca

SEQ ID NO: 3898485 - RNA, 12 nt, Shigella flexneri 2a str. 301
ugaucaccagua

SEQ ID NO: 3898486 - RNA, 19 nt, Shigella flexneri 2a str. 301
ugaucacccacaucagcgg

SEQ ID NO: 3898487 - RNA, 23 nt, Shigella flexneri 2a str. 301
ugaucaccguaaugaugauccag

SEQ ID NO: 3898488 - RNA, 13 nt, Shigella flexneri 2a str. 301
ugaucaccugcau

SEQ ID NO: 3898489 - RNA, 18 nt, Shigella flexneri 2a str. 301
ugaucaccugcauacaaa

SEQ ID NO: 3898490 - RNA, 18 nt, Shigella flexneri 2a str. 301
ugaucacuuucaccggcg

SEQ ID NO: 3898491 - RNA, 22 nt, Shigella flexneri 2a str. 301
ugaucagcaacgccgguuccag

SEQ ID NO: 3898492 - RNA, 16 nt, Shigella flexneri 2a str. 301
ugaucagcaaucugaa

SEQ ID NO: 3898493 - RNA, 17 nt, Shigella flexneri 2a str. 301
ugaucauaaaaauuaaa

SEQ ID NO: 3898494 - RNA, 19 nt, Shigella flexneri 2a str. 301
ugaucauagcgaauaaucc

SEQ ID NO: 3898495 - RNA, 22 nt, Shigella flexneri 2a str. 301
ugaucauccgccucuaacagau

SEQ ID NO: 3898496 - RNA, 23 nt, Shigella flexneri 2a str. 301
ugaucauccgccucuaacagauc

SEQ ID NO: 3898497 - RNA, 14 nt, Shigella flexneri 2a str. 301
ugaucauccggcuu

SEQ ID NO: 3898498 - RNA, 23 nt, Shigella flexneri 2a str. 301
ugaucaugugcaggauuaauaaa

SEQ ID NO: 3898499 - RNA, 13 nt, Shigella flexneri 2a str. 301
ugauccaggagcu

SEQ ID NO: 3898500 - RNA, 19 nt, Shigella flexneri 2a str. 301
ugauccaucagguaguguu

SEQ ID NO: 3898501 - RNA, 17 nt, Shigella flexneri 2a str. 301
ugaucccaguuuucgcc

SEQ ID NO: 3898502 - RNA, 17 nt, Shigella flexneri 2a str. 301
ugauccccgcuuccugc

SEQ ID NO: 3898503 - RNA, 21 nt, Shigella flexneri 2a str. 301
ugauccccgcuuccugcagcg

SEQ ID NO: 3898504 - RNA, 19 nt, Shigella flexneri 2a str. 301
ugauccccggaaucagagg

SEQ ID NO: 3898505 - RNA, 22 nt, Shigella flexneri 2a str. 301
ugaucgagaucggccagcaccu

SEQ ID NO: 3898506 - RNA, 16 nt, Shigella flexneri 2a str. 301
ugaucgaggcaaagag

SEQ ID NO: 3898507 - RNA, 13 nt, Shigella flexneri 2a str. 301
ugaucgauccacg

SEQ ID NO: 3898508 - RNA, 15 nt, Shigella flexneri 2a str. 301
ugaucgccauauuuc

SEQ ID NO: 3898509 - RNA, 20 nt, Shigella flexneri 2a str. 301
ugaucgccauauuucuccau

SEQ ID NO: 3898510 - RNA, 19 nt, Shigella flexneri 2a str. 301
ugaucgccgcacuuucucc

SEQ ID NO: 3898511 - RNA, 14 nt, Shigella flexneri 2a str. 301
ugaucggcgagaua

SEQ ID NO: 3898512 - RNA, 23 nt, Shigella flexneri 2a str. 301
ugaucgugccaggaccauucaca

SEQ ID NO: 3898513 - RNA, 18 nt, Shigella flexneri 2a str. 301
ugaucuaccgcuucccuu

SEQ ID NO: 3898514 - RNA, 17 nt, Shigella flexneri 2a str. 301
ugaucuccuuggagaaa

SEQ ID NO: 3898515 - RNA, 18 nt, Shigella flexneri 2a str. 301
ugaucuccuuuguaccag

SEQ ID NO: 3898516 - RNA, 19 nt, Shigella flexneri 2a str. 301
ugaucucuaaggcaugaau

SEQ ID NO: 3898517 - RNA, 21 nt, Shigella flexneri 2a str. 301
ugaucugcgucgcuuuccagu

SEQ ID NO: 3898518 - RNA, 12 nt, Shigella flexneri 2a str. 301
ugaucuucauag

SEQ ID NO: 3898519 - RNA, 22 nt, Shigella flexneri 2a str. 301
ugaucuucauagauagccagca

SEQ ID NO: 3898520 - RNA, 14 nt, Shigella flexneri 2a str. 301
ugaucuuucuucag

SEQ ID NO: 3898521 - RNA, 14 nt, Shigella flexneri 2a str. 301
ugaucuuuuuauug

SEQ ID NO: 3898522 - RNA, 13 nt, Shigella flexneri 2a str. 301
ugaugaaaaaacc

SEQ ID NO: 3898523 - RNA, 14 nt, Shigella flexneri 2a str. 301
ugaugaacccgguc

SEQ ID NO: 3898524 - RNA, 16 nt, Shigella flexneri 2a str. 301
ugaugaaguccacgcg

SEQ ID NO: 3898525 - RNA, 17 nt, Shigella flexneri 2a str. 301
ugcaaacgauaaaagug

SEQ ID NO: 3898526 - RNA, 14 nt, Shigella flexneri 2a str. 301
ugcaaauauuaaua

SEQ ID NO: 3898527 - RNA, 17 nt, Shigella flexneri 2a str. 301
ugcaaaucggcaaucuc

SEQ ID NO: 3898528 - RNA, 17 nt, Shigella flexneri 2a str. 301
ugcaaaugccagauaag

SEQ ID NO: 3898529 - RNA, 18 nt, Shigella flexneri 2a str. 301
ugcaaauuauuugcguag

SEQ ID NO: 3898530 - RNA, 14 nt, Shigella flexneri 2a str. 301
ugcaaauucaauau

SEQ ID NO: 3898531 - RNA, 22 nt, Shigella flexneri 2a str. 301
ugcaacaacugaaaaaaaauua

SEQ ID NO: 3898532 - RNA, 22 nt, Shigella flexneri 2a str. 301
ugcaacaagaggcaauaguucu

SEQ ID NO: 3898533 - RNA, 14 nt, Shigella flexneri 2a str. 301
ugcaacagcaccag

SEQ ID NO: 3898534 - RNA, 17 nt, Shigella flexneri 2a str. 301
ugcaacauguugaaucu

SEQ ID NO: 3898535 - RNA, 14 nt, Shigella flexneri 2a str. 301
ugcaaccuuuucca

SEQ ID NO: 3898536 - RNA, 22 nt, Shigella flexneri 2a str. 301
ugcaacgaaucaaaucccugau

SEQ ID NO: 3898537 - RNA, 13 nt, Shigella flexneri 2a str. 301
ugcaacgagugca

SEQ ID NO: 3898538 - RNA, 18 nt, Shigella flexneri 2a str. 301
ugcaacgcccaucaacau

SEQ ID NO: 3898539 - RNA, 20 nt, Shigella flexneri 2a str. 301
ugcaacguccugcaacggcg

SEQ ID NO: 3898540 - RNA, 15 nt, Shigella flexneri 2a str. 301
ugcaacugcgcggca

SEQ ID NO: 3898541 - RNA, 12 nt, Shigella flexneri 2a str. 301
ugcaagaaauga

SEQ ID NO: 3898542 - RNA, 14 nt, Shigella flexneri 2a str. 301
ugcaagaaaugaca

SEQ ID NO: 3898543 - RNA, 21 nt, Shigella flexneri 2a str. 301
ugcaagacgaugacauuaucu

SEQ ID NO: 3898544 - RNA, 15 nt, Shigella flexneri 2a str. 301
ugcaagauagcgcgu

SEQ ID NO: 3898545 - RNA, 17 nt, Shigella flexneri 2a str. 301
ugcaagauagcgcguug

SEQ ID NO: 3898546 - RNA, 18 nt, Shigella flexneri 2a str. 301
ugcaagaucgcucaucag

SEQ ID NO: 3898547 - RNA, 13 nt, Shigella flexneri 2a str. 301
ugcaagauguuaa

SEQ ID NO: 3898548 - RNA, 18 nt, Shigella flexneri 2a str. 301
ugcaagcgggguaaaugc

SEQ ID NO: 3898549 - RNA, 18 nt, Shigella flexneri 2a str. 301
ugcaaggugaaagcaauu

SEQ ID NO: 3898550 - RNA, 18 nt, Shigella flexneri 2a str. 301
ugcaauaauggaaccuaa

SEQ ID NO: 3898551 - RNA, 17 nt, Shigella flexneri 2a str. 301
ugcaauaauuuacagcc

SEQ ID NO: 3898552 - RNA, 19 nt, Shigella flexneri 2a str. 301
ugcaauaauuuacagccug

SEQ ID NO: 3898553 - RNA, 23 nt, Shigella flexneri 2a str. 301
ugcaauaccauggcucaccagca

SEQ ID NO: 3898554 - RNA, 21 nt, Shigella flexneri 2a str. 301
ugcaauagauugaauuagcaa

SEQ ID NO: 3898555 - RNA, 16 nt, Shigella flexneri 2a str. 301
ugcaauaucaaccuga

SEQ ID NO: 3898556 - RNA, 19 nt, Shigella flexneri 2a str. 301
ugcaaucaccacugccagc

SEQ ID NO: 3898557 - RNA, 13 nt, Shigella flexneri 2a str. 301
ugcaaucagauaa

SEQ ID NO: 3898558 - RNA, 12 nt, Shigella flexneri 2a str. 301
ugcaaucagcgg

SEQ ID NO: 3898559 - RNA, 20 nt, Shigella flexneri 2a str. 301
ugcaaucaguucaaauucau

SEQ ID NO: 3898560 - RNA, 12 nt, Shigella flexneri 2a str. 301
ugcaaucaucuu

SEQ ID NO: 3898561 - RNA, 24 nt, Shigella flexneri 2a str. 301
ugcaaucuacaaaagauuauugcu

SEQ ID NO: 3898562 - RNA, 18 nt, Shigella flexneri 2a str. 301
ugcaaugaaaaaccgugu

SEQ ID NO: 3898563 - RNA, 19 nt, Shigella flexneri 2a str. 301
ugcaaugccguuugcugca

SEQ ID NO: 3898564 - RNA, 23 nt, Shigella flexneri 2a str. 301
ugcaaugccguuugcugcaugau

SEQ ID NO: 3898565 - RNA, 19 nt, Shigella flexneri 2a str. 301
ugcaaugucaucagcauuc

SEQ ID NO: 3898566 - RNA, 23 nt, Shigella flexneri 2a str. 301
ugcaaugucaucagcauucucau

SEQ ID NO: 3898567 - RNA, 22 nt, Shigella flexneri 2a str. 301
ugcaauuaaggucggcuuugaa

SEQ ID NO: 3898568 - RNA, 16 nt, Shigella flexneri 2a str. 301
ugcaauuauuaaccug

SEQ ID NO: 3898569 - RNA, 19 nt, Shigella flexneri 2a str. 301
ugcaauuccaucauaucac

SEQ ID NO: 3898570 - RNA, 12 nt, Shigella flexneri 2a str. 301
ugcaauugcucc

SEQ ID NO: 3898571 - RNA, 22 nt, Shigella flexneri 2a str. 301
ugcaauuuguggugaagccacc

SEQ ID NO: 3898572 - RNA, 17 nt, Shigella flexneri 2a str. 301
ugcacaaagguuucgua

SEQ ID NO: 3898573 - RNA, 18 nt, Shigella flexneri 2a str. 301
ugcacaaauagccagcag

SEQ ID NO: 3898574 - RNA, 12 nt, Shigella flexneri 2a str. 301
ugcacaaauuug

SEQ ID NO: 3898575 - RNA, 14 nt, Shigella flexneri 2a str. 301
ugcacaacaaucug

SEQ ID NO: 3898576 - RNA, 17 nt, Shigella flexneri 2a str. 301
ugcacaagaugccugau

SEQ ID NO: 3898577 - RNA, 22 nt, Shigella flexneri 2a str. 301
ugcacaagcgauaacucgcuuu

SEQ ID NO: 3898578 - RNA, 20 nt, Shigella flexneri 2a str. 301
ugcacaaucguguggcauca

SEQ ID NO: 3898579 - RNA, 19 nt, Shigella flexneri 2a str. 301
ugcacacagggcgcuagcc

SEQ ID NO: 3898580 - RNA, 18 nt, Shigella flexneri 2a str. 301
ugcacaccccgcgcagcu

SEQ ID NO: 3898581 - RNA, 15 nt, Shigella flexneri 2a str. 301
ugcacacuuuccaua

SEQ ID NO: 3898582 - RNA, 15 nt, Shigella flexneri 2a str. 301
ugcacagcacgcuuu

SEQ ID NO: 3898583 - RNA, 12 nt, Shigella flexneri 2a str. 301
ugcacaggcaag

SEQ ID NO: 3898584 - RNA, 20 nt, Shigella flexneri 2a str. 301
ugcacauccacgccuuuuuu

SEQ ID NO: 3898585 - RNA, 14 nt, Shigella flexneri 2a str. 301
ugcacaucuaacca

SEQ ID NO: 3898586 - RNA, 13 nt, Shigella flexneri 2a str. 301
ugcacaugcuuca

SEQ ID NO: 3898587 - RNA, 20 nt, Shigella flexneri 2a str. 301
ugcacauucccugcagucac

SEQ ID NO: 3898588 - RNA, 17 nt, Shigella flexneri 2a str. 301
ugcaccaacaaauagag

SEQ ID NO: 3898589 - RNA, 17 nt, Shigella flexneri 2a str. 301
ugcaccagcuggcuguc

SEQ ID NO: 3898590 - RNA, 17 nt, Shigella flexneri 2a str. 301
ugcaccauaaauccaac

SEQ ID NO: 3898591 - RNA, 18 nt, Shigella flexneri 2a str. 301
ugcaccaucaggcauauu

SEQ ID NO: 3898592 - RNA, 19 nt, Shigella flexneri 2a str. 301
ugcaccccgagcuuaugca

SEQ ID NO: 3898593 - RNA, 21 nt, Shigella flexneri 2a str. 301
ugcaccgacuggcuccgggaa

SEQ ID NO: 3898594 - RNA, 23 nt, Shigella flexneri 2a str. 301
ugcaccgaguucuucacugacgc

SEQ ID NO: 3898595 - RNA, 17 nt, Shigella flexneri 2a str. 301
ugcaccgauugccggau

SEQ ID NO: 3898596 - RNA, 20 nt, Shigella flexneri 2a str. 301
ugcaccggcgacaucccagg

SEQ ID NO: 3898597 - RNA, 13 nt, Shigella flexneri 2a str. 301
ugcaccgggcuuu

SEQ ID NO: 3898598 - RNA, 18 nt, Shigella flexneri 2a str. 301
ugcaccugauccagcucu

SEQ ID NO: 3898599 - RNA, 17 nt, Shigella flexneri 2a str. 301
ugcaccuuuuccaccaa

SEQ ID NO: 3898600 - RNA, 16 nt, Shigella flexneri 2a str. 301
ugcacgaggcuggcuu

SEQ ID NO: 3898601 - RNA, 17 nt, Shigella flexneri 2a str. 301
ugcacgaggcuggcuuu

SEQ ID NO: 3898602 - RNA, 17 nt, Shigella flexneri 2a str. 301
ugcacgauauaccgugc

SEQ ID NO: 3898603 - RNA, 15 nt, Shigella flexneri 2a str. 301
ugcacgaugccugau

SEQ ID NO: 3898604 - RNA, 15 nt, Shigella flexneri 2a str. 301
ugcacgcagaucggu

SEQ ID NO: 3898605 - RNA, 21 nt, Shigella flexneri 2a str. 301
ugcacgcagaucgguugccau

SEQ ID NO: 3898606 - RNA, 15 nt, Shigella flexneri 2a str. 301
ugcacgcgcuucagu

SEQ ID NO: 3898607 - RNA, 16 nt, Shigella flexneri 2a str. 301
ugcacgcuaguuuccu

SEQ ID NO: 3898608 - RNA, 22 nt, Shigella flexneri 2a str. 301
ugcacggagauauccagcgccg

SEQ ID NO: 3898609 - RNA, 21 nt, Shigella flexneri 2a str. 301
ugcacggcuucccacgucaga

SEQ ID NO: 3898610 - RNA, 20 nt, Shigella flexneri 2a str. 301
ugcacuagacgaugaaaaag

SEQ ID NO: 3898611 - RNA, 16 nt, Shigella flexneri 2a str. 301
ugcacuagguuuucgu

SEQ ID NO: 3898612 - RNA, 17 nt, Shigella flexneri 2a str. 301
ugcacucgcauccucuu

SEQ ID NO: 3898613 - RNA, 19 nt, Shigella flexneri 2a str. 301
ugcacucgcauccucuuua

SEQ ID NO: 3898614 - RNA, 17 nt, Shigella flexneri 2a str. 301
ugcacugaaugccggau

SEQ ID NO: 3898615 - RNA, 17 nt, Shigella flexneri 2a str. 301
ugcacuuugucaauaau

SEQ ID NO: 3898616 - RNA, 16 nt, Shigella flexneri 2a str. 301
ugcagaaacaaccuga

SEQ ID NO: 3898617 - RNA, 20 nt, Shigella flexneri 2a str. 301
ugcagaaacaaccugagcgu

SEQ ID NO: 3898618 - RNA, 21 nt, Shigella flexneri 2a str. 301
ugcagaaauugucuccaccaa

SEQ ID NO: 3898619 - RNA, 14 nt, Shigella flexneri 2a str. 301
ugcagaaucaaucu

SEQ ID NO: 3898620 - RNA, 16 nt, Shigella flexneri 2a str. 301
ugcagaaugauggcug

SEQ ID NO: 3898621 - RNA, 14 nt, Shigella flexneri 2a str. 301
ugcagacaaaguga

SEQ ID NO: 3898622 - RNA, 20 nt, Shigella flexneri 2a str. 301
ugcagacaugacgcccggca

SEQ ID NO: 3898623 - RNA, 21 nt, Shigella flexneri 2a str. 301
ugcagacaugacgcccggcaa

SEQ ID NO: 3898624 - RNA, 22 nt, Shigella flexneri 2a str. 301
ugcagacaugacgcccggcaag

SEQ ID NO: 3898625 - RNA, 16 nt, Shigella flexneri 2a str. 301
ugccaccaauaaugaa

SEQ ID NO: 3898626 - RNA, 14 nt, Shigella flexneri 2a str. 301
ugccaccacaccgg

SEQ ID NO: 3898627 - RNA, 22 nt, Shigella flexneri 2a str. 301
ugccaccacaccggaccagacg

SEQ ID NO: 3898628 - RNA, 15 nt, Shigella flexneri 2a str. 301
ugccaccaccagcgu

SEQ ID NO: 3898629 - RNA, 14 nt, Shigella flexneri 2a str. 301
ugccaccagcagcg

SEQ ID NO: 3898630 - RNA, 19 nt, Shigella flexneri 2a str. 301
ugccaccagugcaggcacc

SEQ ID NO: 3898631 - RNA, 19 nt, Shigella flexneri 2a str. 301
ugccaccuccaagccugau

SEQ ID NO: 3898632 - RNA, 15 nt, Shigella flexneri 2a str. 301
ugccaccugugcaau

SEQ ID NO: 3898633 - RNA, 16 nt, Shigella flexneri 2a str. 301
ugccacgccacagccg

SEQ ID NO: 3898634 - RNA, 22 nt, Shigella flexneri 2a str. 301
ugccacgguaugacccagcgcg

SEQ ID NO: 3898635 - RNA, 21 nt, Shigella flexneri 2a str. 301
ugccagaaagcguauccauca

SEQ ID NO: 3898636 - RNA, 22 nt, Shigella flexneri 2a str. 301
ugccagaaagcguauccaucac

SEQ ID NO: 3898637 - RNA, 16 nt, Shigella flexneri 2a str. 301
ugccagaaauccaggc

SEQ ID NO: 3898638 - RNA, 14 nt, Shigella flexneri 2a str. 301
ugccagaaggggga

SEQ ID NO: 3898639 - RNA, 20 nt, Shigella flexneri 2a str. 301
ugccagaauagccgcagcca

SEQ ID NO: 3898640 - RNA, 22 nt, Shigella flexneri 2a str. 301
ugccagaauagccgcagccauc

SEQ ID NO: 3898641 - RNA, 23 nt, Shigella flexneri 2a str. 301
ugccagaauuaacgcugacaccc

SEQ ID NO: 3898642 - RNA, 18 nt, Shigella flexneri 2a str. 301
ugccagaccaaacagcau

SEQ ID NO: 3898643 - RNA, 19 nt, Shigella flexneri 2a str. 301
ugccagacgaauaaaacag

SEQ ID NO: 3898644 - RNA, 22 nt, Shigella flexneri 2a str. 301
ugccagacgaauaaaacagaaa

SEQ ID NO: 3898645 - RNA, 14 nt, Shigella flexneri 2a str. 301
ugccagagcagcaa

SEQ ID NO: 3898646 - RNA, 18 nt, Shigella flexneri 2a str. 301
ugccagaggagccaucac

SEQ ID NO: 3898647 - RNA, 16 nt, Shigella flexneri 2a str. 301
ugccagauaaauauua

SEQ ID NO: 3898648 - RNA, 15 nt, Shigella flexneri 2a str. 301
ugccagauaagacac

SEQ ID NO: 3898649 - RNA, 16 nt, Shigella flexneri 2a str. 301
ugccagauaagacacu

SEQ ID NO: 3898650 - RNA, 15 nt, Shigella flexneri 2a str. 301
ugccagauguugucu

SEQ ID NO: 3898651 - RNA, 22 nt, Shigella flexneri 2a str. 301
ugccagcaacggccaaauaucc

SEQ ID NO: 3898652 - RNA, 13 nt, Shigella flexneri 2a str. 301
ugccagcacagau

SEQ ID NO: 3898653 - RNA, 12 nt, Shigella flexneri 2a str. 301
ugccagcaccac

SEQ ID NO: 3898654 - RNA, 12 nt, Shigella flexneri 2a str. 301
ugccagcaugca

SEQ ID NO: 3898655 - RNA, 20 nt, Shigella flexneri 2a str. 301
ugccagccacaccuggugca

SEQ ID NO: 3898656 - RNA, 13 nt, Shigella flexneri 2a str. 301
ugccagccaggau

SEQ ID NO: 3898657 - RNA, 19 nt, Shigella flexneri 2a str. 301
ugccagccaucuuucgcag

SEQ ID NO: 3898658 - RNA, 21 nt, Shigella flexneri 2a str. 301
ugccagccaucuuucgcagau

SEQ ID NO: 3898659 - RNA, 18 nt, Shigella flexneri 2a str. 301
ugccagccaugagacaaa

SEQ ID NO: 3898660 - RNA, 22 nt, Shigella flexneri 2a str. 301
ugccagcccuaaucccgugccg

SEQ ID NO: 3898661 - RNA, 22 nt, Shigella flexneri 2a str. 301
ugccagccgccgcuaucggcaa

SEQ ID NO: 3898662 - RNA, 16 nt, Shigella flexneri 2a str. 301
ugccagcgaagaagug

SEQ ID NO: 3898663 - RNA, 22 nt, Shigella flexneri 2a str. 301
ugccagcgguggugacugguuu

SEQ ID NO: 3898664 - RNA, 23 nt, Shigella flexneri 2a str. 301
ugccagcguaccaugauccugca

SEQ ID NO: 3898665 - RNA, 14 nt, Shigella flexneri 2a str. 301
ugccagcgugucga

SEQ ID NO: 3898666 - RNA, 20 nt, Shigella flexneri 2a str. 301
ugccagcucggauaaggcuu

SEQ ID NO: 3898667 - RNA, 13 nt, Shigella flexneri 2a str. 301
ugccagcugcuca

SEQ ID NO: 3898668 - RNA, 17 nt, Shigella flexneri 2a str. 301
ugccagcuucagcgcgu

SEQ ID NO: 3898669 - RNA, 18 nt, Shigella flexneri 2a str. 301
ugccagcuuucaccugcg

SEQ ID NO: 3898670 - RNA, 18 nt, Shigella flexneri 2a str. 301
ugccaggaacacugguuc

SEQ ID NO: 3898671 - RNA, 21 nt, Shigella flexneri 2a str. 301
ugccaggccaguucuucuuca

SEQ ID NO: 3898672 - RNA, 23 nt, Shigella flexneri 2a str. 301
ugccaggcuggcagaugcgucuu

SEQ ID NO: 3898673 - RNA, 20 nt, Shigella flexneri 2a str. 301
ugccagggcuuuuuuauuuc

SEQ ID NO: 3898674 - RNA, 21 nt, Shigella flexneri 2a str. 301
ugccagguaaacaccuucauc

SEQ ID NO: 3898675 - RNA, 15 nt, Shigella flexneri 2a str. 301
ugccagguagucacg

SEQ ID NO: 3898676 - RNA, 22 nt, Shigella flexneri 2a str. 301
ugccaggucaucauugcaguca

SEQ ID NO: 3898677 - RNA, 14 nt, Shigella flexneri 2a str. 301
ugccagguucgaua

SEQ ID NO: 3898678 - RNA, 15 nt, Shigella flexneri 2a str. 301
ugccaguaaagcagc

SEQ ID NO: 3898679 - RNA, 20 nt, Shigella flexneri 2a str. 301
ugccaguaacagaacgcaua

SEQ ID NO: 3898680 - RNA, 22 nt, Shigella flexneri 2a str. 301
ugccaguaacagaacgcauaac

SEQ ID NO: 3898681 - RNA, 23 nt, Shigella flexneri 2a str. 301
ugccaguaacagaacgcauaaca

SEQ ID NO: 3898682 - RNA, 16 nt, Shigella flexneri 2a str. 301
ugccaguaaucacgau

SEQ ID NO: 3898683 - RNA, 19 nt, Shigella flexneri 2a str. 301
ugccaguaauccggcuucc

SEQ ID NO: 3898684 - RNA, 19 nt, Shigella flexneri 2a str. 301
ugccaguacgccaaucugc

SEQ ID NO: 3898685 - RNA, 23 nt, Shigella flexneri 2a str. 301
ugccaguacgccaaucugcaaaa

SEQ ID NO: 3898686 - RNA, 13 nt, Shigella flexneri 2a str. 301
ugccagucaauca

SEQ ID NO: 3898687 - RNA, 17 nt, Shigella flexneri 2a str. 301
ugccagucaaugaaauu

SEQ ID NO: 3898688 - RNA, 15 nt, Shigella flexneri 2a str. 301
ugccagucagcucca

SEQ ID NO: 3898689 - RNA, 14 nt, Shigella flexneri 2a str. 301
ugccagucuggcuu

SEQ ID NO: 3898690 - RNA, 15 nt, Shigella flexneri 2a str. 301
ugccagugaugcgca

SEQ ID NO: 3898691 - RNA, 21 nt, Shigella flexneri 2a str. 301
ugccagugaugcgcaggguaa

SEQ ID NO: 3898692 - RNA, 14 nt, Shigella flexneri 2a str. 301
ugccagugcugcuu

SEQ ID NO: 3898693 - RNA, 15 nt, Shigella flexneri 2a str. 301
ugccaguucccccug

SEQ ID NO: 3898694 - RNA, 18 nt, Shigella flexneri 2a str. 301
ugccaguuguugcugaau

SEQ ID NO: 3898695 - RNA, 13 nt, Shigella flexneri 2a str. 301
ugccauaacgcgu

SEQ ID NO: 3898696 - RNA, 13 nt, Shigella flexneri 2a str. 301
ugccauacagaca

SEQ ID NO: 3898697 - RNA, 14 nt, Shigella flexneri 2a str. 301
ugccauauacgcca

SEQ ID NO: 3898698 - RNA, 15 nt, Shigella flexneri 2a str. 301
ugccauauagcccca

SEQ ID NO: 3898699 - RNA, 17 nt, Shigella flexneri 2a str. 301
ugccaucaacuucucgc

SEQ ID NO: 3898700 - RNA, 16 nt, Shigella flexneri 2a str. 301
ugccaucagcgccuga

SEQ ID NO: 3898701 - RNA, 20 nt, Shigella flexneri 2a str. 301
ugccaucagggcggccgcca

SEQ ID NO: 3898702 - RNA, 19 nt, Shigella flexneri 2a str. 301
ugccaucauaaaucggaaa

SEQ ID NO: 3898703 - RNA, 19 nt, Shigella flexneri 2a str. 301
ugccaucauacagccggca

SEQ ID NO: 3898704 - RNA, 19 nt, Shigella flexneri 2a str. 301
ugccaucgcauagcgcaau

SEQ ID NO: 3898705 - RNA, 23 nt, Shigella flexneri 2a str. 301
ugccaucgcauagcgcaauaaca

SEQ ID NO: 3898706 - RNA, 15 nt, Shigella flexneri 2a str. 301
ugccaucgggcuaga

SEQ ID NO: 3898707 - RNA, 18 nt, Shigella flexneri 2a str. 301
ugccaucugccagcaagc

SEQ ID NO: 3898708 - RNA, 19 nt, Shigella flexneri 2a str. 301
ugccaugaccgcuccgcca

SEQ ID NO: 3898709 - RNA, 20 nt, Shigella flexneri 2a str. 301
ugccaugacuuucuggcacg

SEQ ID NO: 3898710 - RNA, 22 nt, Shigella flexneri 2a str. 301
ugccaugguuuggaucuguugc

SEQ ID NO: 3898711 - RNA, 16 nt, Shigella flexneri 2a str. 301
ugccauguucaucaag

SEQ ID NO: 3898712 - RNA, 14 nt, Shigella flexneri 2a str. 301
ugccauuccacaaa

SEQ ID NO: 3898713 - RNA, 19 nt, Shigella flexneri 2a str. 301
ugccauuggcauaaauaau

SEQ ID NO: 3898714 - RNA, 16 nt, Shigella flexneri 2a str. 301
ugccauuuccagcgcu

SEQ ID NO: 3898715 - RNA, 24 nt, Shigella flexneri 2a str. 301
ugccauuucuggcgucaaagcugc

SEQ ID NO: 3898716 - RNA, 15 nt, Shigella flexneri 2a str. 301
ugcccaaucucacca

SEQ ID NO: 3898717 - RNA, 18 nt, Shigella flexneri 2a str. 301
ugcccaccgguuuccggg

SEQ ID NO: 3898718 - RNA, 15 nt, Shigella flexneri 2a str. 301
ugcccacgccgcauu

SEQ ID NO: 3898719 - RNA, 17 nt, Shigella flexneri 2a str. 301
ugcccacgcgcacgcug

SEQ ID NO: 3898720 - RNA, 22 nt, Shigella flexneri 2a str. 301
ugcccacgcgcacgcugguaac

SEQ ID NO: 3898721 - RNA, 20 nt, Shigella flexneri 2a str. 301
ugcccacgcuuuucaucaga

SEQ ID NO: 3898722 - RNA, 16 nt, Shigella flexneri 2a str. 301
ugcccacucaacgguu

SEQ ID NO: 3898723 - RNA, 15 nt, Shigella flexneri 2a str. 301
ugcccagaaaccagu

SEQ ID NO: 3898724 - RNA, 17 nt, Shigella flexneri 2a str. 301
ugccggaugcggugcaa

SEQ ID NO: 3898725 - RNA, 21 nt, Shigella flexneri 2a str. 301
ugccggauguuugcauccggc

SEQ ID NO: 3898726 - RNA, 19 nt, Shigella flexneri 2a str. 301
ugccgggguagaccgcgcu

SEQ ID NO: 3898727 - RNA, 14 nt, Shigella flexneri 2a str. 301
ugccgguaaugcug

SEQ ID NO: 3898728 - RNA, 17 nt, Shigella flexneri 2a str. 301
ugccgguacagccggaa

SEQ ID NO: 3898729 - RNA, 14 nt, Shigella flexneri 2a str. 301
ugccggugaugccg

SEQ ID NO: 3898730 - RNA, 14 nt, Shigella flexneri 2a str. 301
ugccgguuccugca

SEQ ID NO: 3898731 - RNA, 21 nt, Shigella flexneri 2a str. 301
ugccguaaaucccagugccug

SEQ ID NO: 3898732 - RNA, 14 nt, Shigella flexneri 2a str. 301
ugccguacaggcag

SEQ ID NO: 3898733 - RNA, 15 nt, Shigella flexneri 2a str. 301
ugccguacaggcagc

SEQ ID NO: 3898734 - RNA, 16 nt, Shigella flexneri 2a str. 301
ugccguacaggcagcu

SEQ ID NO: 3898735 - RNA, 19 nt, Shigella flexneri 2a str. 301
ugccguaggcccagccgug

SEQ ID NO: 3898736 - RNA, 15 nt, Shigella flexneri 2a str. 301
ugccgucaccagcau

SEQ ID NO: 3898737 - RNA, 19 nt, Shigella flexneri 2a str. 301
ugccguccggcaucgcaaa

SEQ ID NO: 3898738 - RNA, 21 nt, Shigella flexneri 2a str. 301
ugccgucugggcaaaaucauc

SEQ ID NO: 3898739 - RNA, 12 nt, Shigella flexneri 2a str. 301
ugccgugcagca

SEQ ID NO: 3898740 - RNA, 19 nt, Shigella flexneri 2a str. 301
ugccguuauacaucgcuuu

SEQ ID NO: 3898741 - RNA, 14 nt, Shigella flexneri 2a str. 301
ugccguuucuauca

SEQ ID NO: 3898742 - RNA, 19 nt, Shigella flexneri 2a str. 301
ugccuacacaaugccugau

SEQ ID NO: 3898743 - RNA, 15 nt, Shigella flexneri 2a str. 301
ugccuacauauuuuu

SEQ ID NO: 3898744 - RNA, 20 nt, Shigella flexneri 2a str. 301
ugccuaccaaaccugcacgc

SEQ ID NO: 3898745 - RNA, 15 nt, Shigella flexneri 2a str. 301
ugccuacguuuuuua

SEQ ID NO: 3898746 - RNA, 22 nt, Shigella flexneri 2a str. 301
ugccucaacccuuuuuuaaaca

SEQ ID NO: 3898747 - RNA, 13 nt, Shigella flexneri 2a str. 301
ugccuccagcgac

SEQ ID NO: 3898748 - RNA, 18 nt, Shigella flexneri 2a str. 301
ugccucgcugaagcuuac

SEQ ID NO: 3898749 - RNA, 19 nt, Shigella flexneri 2a str. 301
ugccucgggauccaugcac

SEQ ID NO: 3898750 - RNA, 19 nt, Shigella flexneri 2a str. 301
ugccugagacagacagccu

SEQ ID NO: 3898751 - RNA, 17 nt, Shigella flexneri 2a str. 301
ugccugaugcgacgcug

SEQ ID NO: 3898752 - RNA, 22 nt, Shigella flexneri 2a str. 301
ugccugaugcgcuacgcuuauc

SEQ ID NO: 3898753 - RNA, 17 nt, Shigella flexneri 2a str. 301
ugccugauggccugcuc

SEQ ID NO: 3898754 - RNA, 18 nt, Shigella flexneri 2a str. 301
ugccugauguacaaccau

SEQ ID NO: 3898755 - RNA, 13 nt, Shigella flexneri 2a str. 301
ugccugcacucag

SEQ ID NO: 3898756 - RNA, 17 nt, Shigella flexneri 2a str. 301
ugccugcacuuuguguc

SEQ ID NO: 3898757 - RNA, 13 nt, Shigella flexneri 2a str. 301
ugccugcagcugc

SEQ ID NO: 3898758 - RNA, 17 nt, Shigella flexneri 2a str. 301
ugccugccagcuugcga

SEQ ID NO: 3898759 - RNA, 20 nt, Shigella flexneri 2a str. 301
ugccugcugugccagugcca

SEQ ID NO: 3898760 - RNA, 22 nt, Shigella flexneri 2a str. 301
ugccugggcgauuuccuucagc

SEQ ID NO: 3898761 - RNA, 20 nt, Shigella flexneri 2a str. 301
ugccuggguuuucacagaag

SEQ ID NO: 3898762 - RNA, 17 nt, Shigella flexneri 2a str. 301
ugccuguacggcaguga

SEQ ID NO: 3898763 - RNA, 22 nt, Shigella flexneri 2a str. 301
ugccuguacggcagugaacgcg

SEQ ID NO: 3898764 - RNA, 14 nt, Shigella flexneri 2a str. 301
ugccugucgggaca

SEQ ID NO: 3898765 - RNA, 22 nt, Shigella flexneri 2a str. 301
ugccugugcaaccuuuuccauu

SEQ ID NO: 3898766 - RNA, 16 nt, Shigella flexneri 2a str. 301
ugccuguucgccgccg

SEQ ID NO: 3898767 - RNA, 22 nt, Shigella flexneri 2a str. 301
ugccuuagccacaaagcagggc

SEQ ID NO: 3898768 - RNA, 23 nt, Shigella flexneri 2a str. 301
ugccuuagccacaaagcagggcu

SEQ ID NO: 3898769 - RNA, 19 nt, Shigella flexneri 2a str. 301
ugccuuauccggcaugaaa

SEQ ID NO: 3898770 - RNA, 21 nt, Shigella flexneri 2a str. 301
ugccuucacaggccgccaggc

SEQ ID NO: 3898771 - RNA, 23 nt, Shigella flexneri 2a str. 301
ugccuucacggcuuugucauuaa

SEQ ID NO: 3898772 - RNA, 14 nt, Shigella flexneri 2a str. 301
ugccuucauacugc

SEQ ID NO: 3898773 - RNA, 20 nt, Shigella flexneri 2a str. 301
ugccuuccagcgaugcccag

SEQ ID NO: 3898774 - RNA, 13 nt, Shigella flexneri 2a str. 301
ugccuuccauccc

SEQ ID NO: 3898775 - RNA, 16 nt, Shigella flexneri 2a str. 301
ugccuuccccgagcgg

SEQ ID NO: 3898776 - RNA, 22 nt, Shigella flexneri 2a str. 301
ugccuugaguuuuucaucccuc

SEQ ID NO: 3898777 - RNA, 15 nt, Shigella flexneri 2a str. 301
ugccuuucagcgcau

SEQ ID NO: 3898778 - RNA, 14 nt, Shigella flexneri 2a str. 301
ugccuuugaaaucg

SEQ ID NO: 3898779 - RNA, 14 nt, Shigella flexneri 2a str. 301
ugcgaaaaaaaagc

SEQ ID NO: 3898780 - RNA, 18 nt, Shigella flexneri 2a str. 301
ugcgaaaaaaucauccau

SEQ ID NO: 3898781 - RNA, 16 nt, Shigella flexneri 2a str. 301
ugcgaaagcgagcagu

SEQ ID NO: 3898782 - RNA, 17 nt, Shigella flexneri 2a str. 301
ugcgaaagcgucagcuu

SEQ ID NO: 3898783 - RNA, 22 nt, Shigella flexneri 2a str. 301
ugcgaaagcgucagcuuucaga

SEQ ID NO: 3898784 - RNA, 16 nt, Shigella flexneri 2a str. 301
ugcgaacugugcaccc

SEQ ID NO: 3898785 - RNA, 13 nt, Shigella flexneri 2a str. 301
ugcgaagccgcau

SEQ ID NO: 3898786 - RNA, 15 nt, Shigella flexneri 2a str. 301
ugcgaagguggcgga

SEQ ID NO: 3898787 - RNA, 17 nt, Shigella flexneri 2a str. 301
ugcgaagguggcggaau

SEQ ID NO: 3898788 - RNA, 15 nt, Shigella flexneri 2a str. 301
ugcgaaguuuuuccg

SEQ ID NO: 3898789 - RNA, 17 nt, Shigella flexneri 2a str. 301
ugcgaaguuuuuccgcc

SEQ ID NO: 3898790 - RNA, 16 nt, Shigella flexneri 2a str. 301
ugcgaauaaugguauc

SEQ ID NO: 3898791 - RNA, 13 nt, Shigella flexneri 2a str. 301
ugcgaauuauaau

SEQ ID NO: 3898792 - RNA, 16 nt, Shigella flexneri 2a str. 301
ugcgaauugccaccau

SEQ ID NO: 3898793 - RNA, 18 nt, Shigella flexneri 2a str. 301
ugcgaauugccaccaucc

SEQ ID NO: 3898794 - RNA, 21 nt, Shigella flexneri 2a str. 301
ugcgacaaacauugcugccag

SEQ ID NO: 3898795 - RNA, 20 nt, Shigella flexneri 2a str. 301
ugcgacaacuggcagcaccg

SEQ ID NO: 3898796 - RNA, 16 nt, Shigella flexneri 2a str. 301
ugcgacaggagccgca

SEQ ID NO: 3898797 - RNA, 20 nt, Shigella flexneri 2a str. 301
ugcgacagggaucucuucca

SEQ ID NO: 3898798 - RNA, 16 nt, Shigella flexneri 2a str. 301
ugcgacgcuuaacgcg

SEQ ID NO: 3898799 - RNA, 18 nt, Shigella flexneri 2a str. 301
ugcgacgcuuaacgcguc

SEQ ID NO: 3898800 - RNA, 23 nt, Shigella flexneri 2a str. 301
ugcgacgcuuacgcgucuuauca

SEQ ID NO: 3898801 - RNA, 16 nt, Shigella flexneri 2a str. 301
ugcgacgcuugacgcg

SEQ ID NO: 3898802 - RNA, 16 nt, Shigella flexneri 2a str. 301
ugcgacgcuugccgcg

SEQ ID NO: 3898803 - RNA, 14 nt, Shigella flexneri 2a str. 301
ugcgagcaaagcgc

SEQ ID NO: 3898804 - RNA, 21 nt, Shigella flexneri 2a str. 301
ugcgagcaaagcgcagccguc

SEQ ID NO: 3898805 - RNA, 15 nt, Shigella flexneri 2a str. 301
ugcgagcgccuuauc

SEQ ID NO: 3898806 - RNA, 14 nt, Shigella flexneri 2a str. 301
ugcgagcuuucgac

SEQ ID NO: 3898807 - RNA, 21 nt, Shigella flexneri 2a str. 301
ugcgagguuauccgccagcgc

SEQ ID NO: 3898808 - RNA, 17 nt, Shigella flexneri 2a str. 301
ugcgaguuuucgcaucc

SEQ ID NO: 3898809 - RNA, 17 nt, Shigella flexneri 2a str. 301
ugcgauagccuucagug

SEQ ID NO: 3898810 - RNA, 22 nt, Shigella flexneri 2a str. 301
ugcgauaucgacggcgugcuga

SEQ ID NO: 3898811 - RNA, 15 nt, Shigella flexneri 2a str. 301
ugcgaucaggcauuc

SEQ ID NO: 3898812 - RNA, 21 nt, Shigella flexneri 2a str. 301
ugcgaugaacgccugggaagu

SEQ ID NO: 3898813 - RNA, 22 nt, Shigella flexneri 2a str. 301
ugcgcaaaauucacgccacugu

SEQ ID NO: 3898814 - RNA, 17 nt, Shigella flexneri 2a str. 301
ugcgcaaacuucuucag

SEQ ID NO: 3898815 - RNA, 19 nt, Shigella flexneri 2a str. 301
ugcgcaacugaggcaauaa

SEQ ID NO: 3898816 - RNA, 21 nt, Shigella flexneri 2a str. 301
ugcgcaacugaggcaauaaug

SEQ ID NO: 3898817 - RNA, 22 nt, Shigella flexneri 2a str. 301
ugcgcaacugaggcaauaauga

SEQ ID NO: 3898818 - RNA, 11 nt, Shigella flexneri 2a str. 301
ugcgcaauaac

SEQ ID NO: 3898819 - RNA, 17 nt, Shigella flexneri 2a str. 301
ugcgcaaugcguuuagu

SEQ ID NO: 3898820 - RNA, 20 nt, Shigella flexneri 2a str. 301
ugcgcagaguuuccaggcug

SEQ ID NO: 3898821 - RNA, 18 nt, Shigella flexneri 2a str. 301
ugcgcaguaccagcaacg

SEQ ID NO: 3898822 - RNA, 20 nt, Shigella flexneri 2a str. 301
ugcgcauuucccagcaagaa

SEQ ID NO: 3898823 - RNA, 21 nt, Shigella flexneri 2a str. 301
ugcgccaaacagaugaugcgu

SEQ ID NO: 3898824 - RNA, 15 nt, Shigella flexneri 2a str. 301
ugcguagcugagcaa

SEQ ID NO: 3898825 - RNA, 21 nt, Shigella flexneri 2a str. 301
ugcguagucugaccucuucua

SEQ ID NO: 3898826 - RNA, 14 nt, Shigella flexneri 2a str. 301
ugcgucauccagca

SEQ ID NO: 3898827 - RNA, 18 nt, Shigella flexneri 2a str. 301
ugcguccaaauagcucaa

SEQ ID NO: 3898828 - RNA, 18 nt, Shigella flexneri 2a str. 301
ugcguccgguaauuuuua

SEQ ID NO: 3898829 - RNA, 14 nt, Shigella flexneri 2a str. 301
ugcgucgcacucuc

SEQ ID NO: 3898830 - RNA, 17 nt, Shigella flexneri 2a str. 301
ugcgucgcauccggcaa

SEQ ID NO: 3898831 - RNA, 13 nt, Shigella flexneri 2a str. 301
ugcgucgccgccu

SEQ ID NO: 3898832 - RNA, 20 nt, Shigella flexneri 2a str. 301
ugcgucucaucaguuaacgg

SEQ ID NO: 3898833 - RNA, 12 nt, Shigella flexneri 2a str. 301
ugcgucuuccgu

SEQ ID NO: 3898834 - RNA, 16 nt, Shigella flexneri 2a str. 301
ugcgugaguuuuuguc

SEQ ID NO: 3898835 - RNA, 19 nt, Shigella flexneri 2a str. 301
ugcgugcgcugcuuguucc

SEQ ID NO: 3898836 - RNA, 20 nt, Shigella flexneri 2a str. 301
ugcgugcggcaaauaccgga

SEQ ID NO: 3898837 - RNA, 15 nt, Shigella flexneri 2a str. 301
ugcgugcggcggugg

SEQ ID NO: 3898838 - RNA, 21 nt, Shigella flexneri 2a str. 301
ugcguggcagauuaggauuaa

SEQ ID NO: 3898839 - RNA, 20 nt, Shigella flexneri 2a str. 301
ugcguuaagacuuuuuucau

SEQ ID NO: 3898840 - RNA, 13 nt, Shigella flexneri 2a str. 301
ugcguucagcagu

SEQ ID NO: 3898841 - RNA, 20 nt, Shigella flexneri 2a str. 301
ugcguucagcaguucugcca

SEQ ID NO: 3898842 - RNA, 21 nt, Shigella flexneri 2a str. 301
ugcguuccagcauguuauuca

SEQ ID NO: 3898843 - RNA, 18 nt, Shigella flexneri 2a str. 301
ugcguuccggcaugauuc

SEQ ID NO: 3898844 - RNA, 22 nt, Shigella flexneri 2a str. 301
ugcguugucaucgaauaaauug

SEQ ID NO: 3898845 - RNA, 19 nt, Shigella flexneri 2a str. 301
ugcguugucgccauccaga

SEQ ID NO: 3898846 - RNA, 15 nt, Shigella flexneri 2a str. 301
ugcguuuguccgccg

SEQ ID NO: 3898847 - RNA, 17 nt, Shigella flexneri 2a str. 301
ugcguuuguccgccgga

SEQ ID NO: 3898848 - RNA, 18 nt, Shigella flexneri 2a str. 301
ugcguuuuccggcacgca

SEQ ID NO: 3898849 - RNA, 16 nt, Shigella flexneri 2a str. 301
ugcguuuuuaucuuca

SEQ ID NO: 3898850 - RNA, 18 nt, Shigella flexneri 2a str. 301
ugcuaaaaacaucaugau

SEQ ID NO: 3898851 - RNA, 13 nt, Shigella flexneri 2a str. 301
ugcuaacucauca

SEQ ID NO: 3898852 - RNA, 22 nt, Shigella flexneri 2a str. 301
ugcuaacucaucaccaucaggc

SEQ ID NO: 3898853 - RNA, 24 nt, Shigella flexneri 2a str. 301
ugcuaagcgcgguaaaaucuucac

SEQ ID NO: 3898854 - RNA, 20 nt, Shigella flexneri 2a str. 301
ugcuagcggguuaagcgcgc

SEQ ID NO: 3898855 - RNA, 19 nt, Shigella flexneri 2a str. 301
ugcuaguuaucuccuugcu

SEQ ID NO: 3898856 - RNA, 23 nt, Shigella flexneri 2a str. 301
ugcuaguuaucuccuugcuggug

SEQ ID NO: 3898857 - RNA, 21 nt, Shigella flexneri 2a str. 301
ugcuaucuccuguugugaugc

SEQ ID NO: 3898858 - RNA, 22 nt, Shigella flexneri 2a str. 301
ugcuaugguccguucucaccag

SEQ ID NO: 3898859 - RNA, 16 nt, Shigella flexneri 2a str. 301
ugcuauucaccagcaa

SEQ ID NO: 3898860 - RNA, 13 nt, Shigella flexneri 2a str. 301
ugcuauuccuuga

SEQ ID NO: 3898861 - RNA, 19 nt, Shigella flexneri 2a str. 301
ugcuauugcggaugaaagu

SEQ ID NO: 3898862 - RNA, 19 nt, Shigella flexneri 2a str. 301
ugcucaaacuucgucacag

SEQ ID NO: 3898863 - RNA, 21 nt, Shigella flexneri 2a str. 301
ugcucaacaaaccguugcugc

SEQ ID NO: 3898864 - RNA, 22 nt, Shigella flexneri 2a str. 301
ugcucaacccuuuccagcgccg

SEQ ID NO: 3898865 - RNA, 14 nt, Shigella flexneri 2a str. 301
ugcucaacugccag

SEQ ID NO: 3898866 - RNA, 13 nt, Shigella flexneri 2a str. 301
ugcucaaugaguu

SEQ ID NO: 3898867 - RNA, 19 nt, Shigella flexneri 2a str. 301
ugcucaaugccugaugcgc

SEQ ID NO: 3898868 - RNA, 17 nt, Shigella flexneri 2a str. 301
ugcucaauugacaguuu

SEQ ID NO: 3898869 - RNA, 18 nt, Shigella flexneri 2a str. 301
ugcucacaaccccggcaa

SEQ ID NO: 3898870 - RNA, 20 nt, Shigella flexneri 2a str. 301
ugcucacgccacgguauuag

SEQ ID NO: 3898871 - RNA, 22 nt, Shigella flexneri 2a str. 301
ugcucacucccggggcgcggug

SEQ ID NO: 3898872 - RNA, 19 nt, Shigella flexneri 2a str. 301
ugcucagcccguaacucac

SEQ ID NO: 3898873 - RNA, 20 nt, Shigella flexneri 2a str. 301
ugcucaggaguaaacuuucc

SEQ ID NO: 3898874 - RNA, 16 nt, Shigella flexneri 2a str. 301
ugcucauaaaaugauu

SEQ ID NO: 3898875 - RNA, 23 nt, Shigella flexneri 2a str. 301
ugcucauagaccauugcaucauc

SEQ ID NO: 3898876 - RNA, 18 nt, Shigella flexneri 2a str. 301
ugcucaucagcccggcaa

SEQ ID NO: 3898877 - RNA, 22 nt, Shigella flexneri 2a str. 301
ugcucaucagcgguaaaacgcc

SEQ ID NO: 3898878 - RNA, 14 nt, Shigella flexneri 2a str. 301
ugcucaucgauauc

SEQ ID NO: 3898879 - RNA, 16 nt, Shigella flexneri 2a str. 301
ugcucaucgauaucga

SEQ ID NO: 3898880 - RNA, 21 nt, Shigella flexneri 2a str. 301
ugcucaucgauaucgaccacu

SEQ ID NO: 3898881 - RNA, 14 nt, Shigella flexneri 2a str. 301
ugcuccacgcugca

SEQ ID NO: 3898882 - RNA, 13 nt, Shigella flexneri 2a str. 301
ugcuccagcagau

SEQ ID NO: 3898883 - RNA, 18 nt, Shigella flexneri 2a str. 301
ugcuccagcguaccugcc

SEQ ID NO: 3898884 - RNA, 20 nt, Shigella flexneri 2a str. 301
ugcuccagucguucaaccac

SEQ ID NO: 3898885 - RNA, 12 nt, Shigella flexneri 2a str. 301
ugcuccauccau

SEQ ID NO: 3898886 - RNA, 20 nt, Shigella flexneri 2a str. 301
ugcuccccagaauccaggaa

SEQ ID NO: 3898887 - RNA, 22 nt, Shigella flexneri 2a str. 301
ugcucccgcugcggugacgcaa

SEQ ID NO: 3898888 - RNA, 19 nt, Shigella flexneri 2a str. 301
ugcucccggcaaugcgccg

SEQ ID NO: 3898889 - RNA, 23 nt, Shigella flexneri 2a str. 301
ugcuccggcgcgauaucgacgac

SEQ ID NO: 3898890 - RNA, 14 nt, Shigella flexneri 2a str. 301
ugcuccuuaauaaa

SEQ ID NO: 3898891 - RNA, 23 nt, Shigella flexneri 2a str. 301
ugcucgacagcgcuaauacgaug

SEQ ID NO: 3898892 - RNA, 22 nt, Shigella flexneri 2a str. 301
ugcucgcagaaauaccccgcca

SEQ ID NO: 3898893 - RNA, 20 nt, Shigella flexneri 2a str. 301
ugcucgccacgucacucuuu

SEQ ID NO: 3898894 - RNA, 16 nt, Shigella flexneri 2a str. 301
ugcucgcccuggaugc

SEQ ID NO: 3898895 - RNA, 18 nt, Shigella flexneri 2a str. 301
ugcucgcccuggaugcag

SEQ ID NO: 3898896 - RNA, 17 nt, Shigella flexneri 2a str. 301
ugcucgcgagaacggcg

SEQ ID NO: 3898897 - RNA, 14 nt, Shigella flexneri 2a str. 301
ugcucgcuggaagu

SEQ ID NO: 3898898 - RNA, 16 nt, Shigella flexneri 2a str. 301
ugcucguaaguuaacu

SEQ ID NO: 3898899 - RNA, 12 nt, Shigella flexneri 2a str. 301
ugcucguacguu

SEQ ID NO: 3898900 - RNA, 18 nt, Shigella flexneri 2a str. 301
ugcucguauaaugacugc

SEQ ID NO: 3898901 - RNA, 14 nt, Shigella flexneri 2a str. 301
ugcucgucagccgg

SEQ ID NO: 3898902 - RNA, 18 nt, Shigella flexneri 2a str. 301
ugcucgucauccgccagu

SEQ ID NO: 3898903 - RNA, 15 nt, Shigella flexneri 2a str. 301
ugcucuaacccuucc

SEQ ID NO: 3898904 - RNA, 22 nt, Shigella flexneri 2a str. 301
ugcucuaacccuuccagauuca

SEQ ID NO: 3898905 - RNA, 21 nt, Shigella flexneri 2a str. 301
ugcucucaaagacguuaaaaa

SEQ ID NO: 3898906 - RNA, 22 nt, Shigella flexneri 2a str. 301
ugcucucaucacuacagcgaaa

SEQ ID NO: 3898907 - RNA, 17 nt, Shigella flexneri 2a str. 301
ugcucucgggcaguaaa

SEQ ID NO: 3898908 - RNA, 20 nt, Shigella flexneri 2a str. 301
ugcucugaggcugaugacaa

SEQ ID NO: 3898909 - RNA, 22 nt, Shigella flexneri 2a str. 301
ugcucugaggcugaugacaaac

SEQ ID NO: 3898910 - RNA, 20 nt, Shigella flexneri 2a str. 301
ugcucuggugcggcaaaaac

SEQ ID NO: 3898911 - RNA, 12 nt, Shigella flexneri 2a str. 301
ugcucuuucagc

SEQ ID NO: 3898912 - RNA, 16 nt, Shigella flexneri 2a str. 301
ugcucuuucagcaccg

SEQ ID NO: 3898913 - RNA, 14 nt, Shigella flexneri 2a str. 301
ugcugaaaucacag

SEQ ID NO: 3898914 - RNA, 15 nt, Shigella flexneri 2a str. 301
ugcugaaccguaggc

SEQ ID NO: 3898915 - RNA, 13 nt, Shigella flexneri 2a str. 301
ugcugaacucgac

SEQ ID NO: 3898916 - RNA, 18 nt, Shigella flexneri 2a str. 301
ugcugaacuuaugcaaaa

SEQ ID NO: 3898917 - RNA, 16 nt, Shigella flexneri 2a str. 301
ugcugaauccccuucu

SEQ ID NO: 3898918 - RNA, 23 nt, Shigella flexneri 2a str. 301
ugcugaauuugaccuugcggcuu

SEQ ID NO: 3898919 - RNA, 22 nt, Shigella flexneri 2a str. 301
ugcugaauuuuuuucucgcggc

SEQ ID NO: 3898920 - RNA, 15 nt, Shigella flexneri 2a str. 301
ugcugacaaugugcu

SEQ ID NO: 3898921 - RNA, 22 nt, Shigella flexneri 2a str. 301
ugcugacauaauuggcacuuua

SEQ ID NO: 3898922 - RNA, 14 nt, Shigella flexneri 2a str. 301
ugcugaccaccagc

SEQ ID NO: 3898923 - RNA, 15 nt, Shigella flexneri 2a str. 301
ugcuuuaucaaucac

SEQ ID NO: 3898924 - RNA, 13 nt, Shigella flexneri 2a str. 301
ugcuuuaucgaac

SEQ ID NO: 3898925 - RNA, 17 nt, Shigella flexneri 2a str. 301
ugcuuucagcacuuauc

SEQ ID NO: 3898926 - RNA, 20 nt, Shigella flexneri 2a str. 301
ugcuuucagcacuuaucucu

SEQ ID NO: 3898927 - RNA, 19 nt, Shigella flexneri 2a str. 301
ugcuuucuuucacggccac

SEQ ID NO: 3898928 - RNA, 17 nt, Shigella flexneri 2a str. 301
ugcuuuucauacaaucg

SEQ ID NO: 3898929 - RNA, 15 nt, Shigella flexneri 2a str. 301
ugcuuuucccuccac

SEQ ID NO: 3898930 - RNA, 17 nt, Shigella flexneri 2a str. 301
ugcuuuuguuaauugcu

SEQ ID NO: 3898931 - RNA, 18 nt, Shigella flexneri 2a str. 301
ugcuuuuuacuagccugc

SEQ ID NO: 3898932 - RNA, 22 nt, Shigella flexneri 2a str. 301
ugcuuuuuacuagccugcuccc

SEQ ID NO: 3898933 - RNA, 14 nt, Shigella flexneri 2a str. 301
ugcuuuuucgcgau

SEQ ID NO: 3898934 - RNA, 12 nt, Shigella flexneri 2a str. 301
uggaaaacaaca

SEQ ID NO: 3898935 - RNA, 13 nt, Shigella flexneri 2a str. 301
uggaaaagaaaac

SEQ ID NO: 3898936 - RNA, 14 nt, Shigella flexneri 2a str. 301
uggaaacagcacca

SEQ ID NO: 3898937 - RNA, 19 nt, Shigella flexneri 2a str. 301
uggaaacggacagaccugc

SEQ ID NO: 3898938 - RNA, 12 nt, Shigella flexneri 2a str. 301
uggaaaucaaaa

SEQ ID NO: 3898939 - RNA, 21 nt, Shigella flexneri 2a str. 301
uggaaauguccgcgaacagca

SEQ ID NO: 3898940 - RNA, 22 nt, Shigella flexneri 2a str. 301
uggaacacuuugccgucagcca

SEQ ID NO: 3898941 - RNA, 20 nt, Shigella flexneri 2a str. 301
uggaacaucaccccgccggg

SEQ ID NO: 3898942 - RNA, 13 nt, Shigella flexneri 2a str. 301
uggaacccgcagc

SEQ ID NO: 3898943 - RNA, 17 nt, Shigella flexneri 2a str. 301
uggaacgcguacagaaa

SEQ ID NO: 3898944 - RNA, 20 nt, Shigella flexneri 2a str. 301
uggaacgcguaucuuuauaa

SEQ ID NO: 3898945 - RNA, 17 nt, Shigella flexneri 2a str. 301
uggaacggcagauccaa

SEQ ID NO: 3898946 - RNA, 23 nt, Shigella flexneri 2a str. 301
uggaagaccugacuguuccagca

SEQ ID NO: 3898947 - RNA, 15 nt, Shigella flexneri 2a str. 301
uggaagacguugauu

SEQ ID NO: 3898948 - RNA, 20 nt, Shigella flexneri 2a str. 301
uggaagccacaaucgcagcg

SEQ ID NO: 3898949 - RNA, 18 nt, Shigella flexneri 2a str. 301
uggaagcgcccgucacug

SEQ ID NO: 3898950 - RNA, 14 nt, Shigella flexneri 2a str. 301
uggaaggguugaaa

SEQ ID NO: 3898951 - RNA, 19 nt, Shigella flexneri 2a str. 301
uggaaggguugaaauauau

SEQ ID NO: 3898952 - RNA, 13 nt, Shigella flexneri 2a str. 301
uggaauaagccaa

SEQ ID NO: 3898953 - RNA, 19 nt, Shigella flexneri 2a str. 301
uggaauacauauauuacaa

SEQ ID NO: 3898954 - RNA, 14 nt, Shigella flexneri 2a str. 301
uggaaugagcaucu

SEQ ID NO: 3898955 - RNA, 12 nt, Shigella flexneri 2a str. 301
uggaauggucaa

SEQ ID NO: 3898956 - RNA, 20 nt, Shigella flexneri 2a str. 301
uggaauggucaaugguggca

SEQ ID NO: 3898957 - RNA, 15 nt, Shigella flexneri 2a str. 301
uggaauuuguccacc

SEQ ID NO: 3898958 - RNA, 14 nt, Shigella flexneri 2a str. 301
uggacaacauuccu

SEQ ID NO: 3898959 - RNA, 16 nt, Shigella flexneri 2a str. 301
uggacagacuggcuau

SEQ ID NO: 3898960 - RNA, 15 nt, Shigella flexneri 2a str. 301
uggaccagcggguug

SEQ ID NO: 3898961 - RNA, 21 nt, Shigella flexneri 2a str. 301
uggacgccguauucacuuuca

SEQ ID NO: 3898962 - RNA, 22 nt, Shigella flexneri 2a str. 301
uggacgccguauucacuuucaa

SEQ ID NO: 3898963 - RNA, 19 nt, Shigella flexneri 2a str. 301
uggacgccguuuaaaggga

SEQ ID NO: 3898964 - RNA, 16 nt, Shigella flexneri 2a str. 301
uggacgcgccaacaaa

SEQ ID NO: 3898965 - RNA, 21 nt, Shigella flexneri 2a str. 301
uggacgcucaggcuacuuuuc

SEQ ID NO: 3898966 - RNA, 13 nt, Shigella flexneri 2a str. 301
uggacgguaaaaa

SEQ ID NO: 3898967 - RNA, 18 nt, Shigella flexneri 2a str. 301
uggacguuugauuuuuaa

SEQ ID NO: 3898968 - RNA, 17 nt, Shigella flexneri 2a str. 301
uggagaguugcaccagc

SEQ ID NO: 3898969 - RNA, 18 nt, Shigella flexneri 2a str. 301
uggagaguugcaccagca

SEQ ID NO: 3898970 - RNA, 22 nt, Shigella flexneri 2a str. 301
uggagaguugcaccagcaacaa

SEQ ID NO: 3898971 - RNA, 16 nt, Shigella flexneri 2a str. 301
uggagauaaacuccac

SEQ ID NO: 3898972 - RNA, 16 nt, Shigella flexneri 2a str. 301
uggagauaucgccagg

SEQ ID NO: 3898973 - RNA, 19 nt, Shigella flexneri 2a str. 301
uggagcaacacgccagcgu

SEQ ID NO: 3898974 - RNA, 13 nt, Shigella flexneri 2a str. 301
uggagcaggaacu

SEQ ID NO: 3898975 - RNA, 17 nt, Shigella flexneri 2a str. 301
uggagcuaaacagcgcu

SEQ ID NO: 3898976 - RNA, 22 nt, Shigella flexneri 2a str. 301
uggagggaaauuaaaugguuaa

SEQ ID NO: 3898977 - RNA, 15 nt, Shigella flexneri 2a str. 301
uggaguaauaauuuc

SEQ ID NO: 3898978 - RNA, 22 nt, Shigella flexneri 2a str. 301
uggagucauuaccgaacaacaa

SEQ ID NO: 3898979 - RNA, 13 nt, Shigella flexneri 2a str. 301
uggaguggcccag

SEQ ID NO: 3898980 - RNA, 22 nt, Shigella flexneri 2a str. 301
uggauaaacacucgcuguggca

SEQ ID NO: 3898981 - RNA, 20 nt, Shigella flexneri 2a str. 301
uggauaauccaucccgcucu

SEQ ID NO: 3898982 - RNA, 14 nt, Shigella flexneri 2a str. 301
uggaucaaaucucg

SEQ ID NO: 3898983 - RNA, 16 nt, Shigella flexneri 2a str. 301
uggaucaacaggcacu

SEQ ID NO: 3898984 - RNA, 13 nt, Shigella flexneri 2a str. 301
uggaucaagcccc

SEQ ID NO: 3898985 - RNA, 19 nt, Shigella flexneri 2a str. 301
uggaucaagccccagcagg

SEQ ID NO: 3898986 - RNA, 21 nt, Shigella flexneri 2a str. 301
uggaucaaggauugcagcacu

SEQ ID NO: 3898987 - RNA, 22 nt, Shigella flexneri 2a str. 301
uggaucaaggauugcagcacug

SEQ ID NO: 3898988 - RNA, 15 nt, Shigella flexneri 2a str. 301
uggaucccagaagau

SEQ ID NO: 3898989 - RNA, 15 nt, Shigella flexneri 2a str. 301
uggaucccucuuucu

SEQ ID NO: 3898990 - RNA, 18 nt, Shigella flexneri 2a str. 301
uggaucguaucgucaaca

SEQ ID NO: 3898991 - RNA, 18 nt, Shigella flexneri 2a str. 301
uggaugaacauaaucugc

SEQ ID NO: 3898992 - RNA, 21 nt, Shigella flexneri 2a str. 301
uggaugaacuucgcagccgug

SEQ ID NO: 3898993 - RNA, 20 nt, Shigella flexneri 2a str. 301
uggaugacauugaugcgcca

SEQ ID NO: 3898994 - RNA, 22 nt, Shigella flexneri 2a str. 301
uggaugcaaucacaaauagacg

SEQ ID NO: 3898995 - RNA, 20 nt, Shigella flexneri 2a str. 301
uggaugcgauguucccccag

SEQ ID NO: 3898996 - RNA, 23 nt, Shigella flexneri 2a str. 301
uggaugcgauguucccccagcca

SEQ ID NO: 3898997 - RNA, 15 nt, Shigella flexneri 2a str. 301
uggaugcggaaccau

SEQ ID NO: 3898998 - RNA, 22 nt, Shigella flexneri 2a str. 301
uggauggcaaagugcaucucac

SEQ ID NO: 3898999 - RNA, 13 nt, Shigella flexneri 2a str. 301
uggauuaaauugc

SEQ ID NO: 3899000 - RNA, 22 nt, Shigella flexneri 2a str. 301
uggauuagcgaccgaacagauc

SEQ ID NO: 3899001 - RNA, 13 nt, Shigella flexneri 2a str. 301
uggauuaucuuca

SEQ ID NO: 3899002 - RNA, 14 nt, Shigella flexneri 2a str. 301
uggauuaucuucac

SEQ ID NO: 3899003 - RNA, 13 nt, Shigella flexneri 2a str. 301
uggauucagcacc

SEQ ID NO: 3899004 - RNA, 14 nt, Shigella flexneri 2a str. 301
uggauucagcaccg

SEQ ID NO: 3899005 - RNA, 20 nt, Shigella flexneri 2a str. 301
uggauucucgcaagagcagg

SEQ ID NO: 3899006 - RNA, 16 nt, Shigella flexneri 2a str. 301
uggauugcugaaauac

SEQ ID NO: 3899007 - RNA, 17 nt, Shigella flexneri 2a str. 301
uggcaaaacggcucuua

SEQ ID NO: 3899008 - RNA, 21 nt, Shigella flexneri 2a str. 301
uggcaaaagacaccaucgcgc

SEQ ID NO: 3899009 - RNA, 14 nt, Shigella flexneri 2a str. 301
uggcaaaaucaaaa

SEQ ID NO: 3899010 - RNA, 14 nt, Shigella flexneri 2a str. 301
uggcaaacuacaaa

SEQ ID NO: 3899011 - RNA, 17 nt, Shigella flexneri 2a str. 301
uggcaaagguucaagca

SEQ ID NO: 3899012 - RNA, 22 nt, Shigella flexneri 2a str. 301
uggcaaagugcaucucaccguu

SEQ ID NO: 3899013 - RNA, 17 nt, Shigella flexneri 2a str. 301
uggcaaaucaguggcug

SEQ ID NO: 3899014 - RNA, 16 nt, Shigella flexneri 2a str. 301
uggcaaauuuauuauc

SEQ ID NO: 3899015 - RNA, 15 nt, Shigella flexneri 2a str. 301
uggcaaccagcagau

SEQ ID NO: 3899016 - RNA, 16 nt, Shigella flexneri 2a str. 301
uggcaaccagcggcug

SEQ ID NO: 3899017 - RNA, 15 nt, Shigella flexneri 2a str. 301
uggcaacgcgccgcc

SEQ ID NO: 3899018 - RNA, 16 nt, Shigella flexneri 2a str. 301
uggcaacgcgccgcca

SEQ ID NO: 3899019 - RNA, 16 nt, Shigella flexneri 2a str. 301
uggcaacuuuaauaau

SEQ ID NO: 3899020 - RNA, 10 nt, Shigella flexneri 2a str. 301
uggcaagcag

SEQ ID NO: 3899021 - RNA, 16 nt, Shigella flexneri 2a str. 301
uggcaagcccagcacc

SEQ ID NO: 3899022 - RNA, 20 nt, Shigella flexneri 2a str. 301
uggcaauacgauccugagca

SEQ ID NO: 3899023 - RNA, 15 nt, Shigella flexneri 2a str. 301
uggcgggauguguaa

SEQ ID NO: 3899024 - RNA, 16 nt, Shigella flexneri 2a str. 301
uggcggggaucacucc

SEQ ID NO: 3899025 - RNA, 18 nt, Shigella flexneri 2a str. 301
uggcggguggcgauaaua

SEQ ID NO: 3899026 - RNA, 17 nt, Shigella flexneri 2a str. 301
uggcguaaagccuuuua

SEQ ID NO: 3899027 - RNA, 16 nt, Shigella flexneri 2a str. 301
uggcguacccaucaac

SEQ ID NO: 3899028 - RNA, 19 nt, Shigella flexneri 2a str. 301
uggcgucacgccgaccaga

SEQ ID NO: 3899029 - RNA, 21 nt, Shigella flexneri 2a str. 301
uggcgucacgccgaccagacc

SEQ ID NO: 3899030 - RNA, 21 nt, Shigella flexneri 2a str. 301
uggcgucggauauaaaaaacc

SEQ ID NO: 3899031 - RNA, 19 nt, Shigella flexneri 2a str. 301
uggcgucuccugccgagcg

SEQ ID NO: 3899032 - RNA, 17 nt, Shigella flexneri 2a str. 301
uggcguuaggcacauca

SEQ ID NO: 3899033 - RNA, 16 nt, Shigella flexneri 2a str. 301
uggcguucagcgacgu

SEQ ID NO: 3899034 - RNA, 14 nt, Shigella flexneri 2a str. 301
uggcguugcaccga

SEQ ID NO: 3899035 - RNA, 20 nt, Shigella flexneri 2a str. 301
uggcguuuccagcaguucca

SEQ ID NO: 3899036 - RNA, 22 nt, Shigella flexneri 2a str. 301
uggcguuugaccaacaccggua

SEQ ID NO: 3899037 - RNA, 14 nt, Shigella flexneri 2a str. 301
uggcguuugccacc

SEQ ID NO: 3899038 - RNA, 21 nt, Shigella flexneri 2a str. 301
uggcguuuuuccaaaacugga

SEQ ID NO: 3899039 - RNA, 22 nt, Shigella flexneri 2a str. 301
uggcuaaucggcugcagugcaa

SEQ ID NO: 3899040 - RNA, 21 nt, Shigella flexneri 2a str. 301
uggcuauaaaugaacugggca

SEQ ID NO: 3899041 - RNA, 15 nt, Shigella flexneri 2a str. 301
uggcuaugggauauu

SEQ ID NO: 3899042 - RNA, 14 nt, Shigella flexneri 2a str. 301
uggcucaacaacug

SEQ ID NO: 3899043 - RNA, 18 nt, Shigella flexneri 2a str. 301
uggcucaaucgccaccac

SEQ ID NO: 3899044 - RNA, 13 nt, Shigella flexneri 2a str. 301
uggcucaccagca

SEQ ID NO: 3899045 - RNA, 18 nt, Shigella flexneri 2a str. 301
uggcucagauugaacgcu

SEQ ID NO: 3899046 - RNA, 16 nt, Shigella flexneri 2a str. 301
uggcucaucaaacaac

SEQ ID NO: 3899047 - RNA, 16 nt, Shigella flexneri 2a str. 301
uggcucaucaagcaca

SEQ ID NO: 3899048 - RNA, 18 nt, Shigella flexneri 2a str. 301
uggcucugauugauucag

SEQ ID NO: 3899049 - RNA, 20 nt, Shigella flexneri 2a str. 301
uggcugaacgacaaauucag

SEQ ID NO: 3899050 - RNA, 21 nt, Shigella flexneri 2a str. 301
uggcugacauaaacaccagca

SEQ ID NO: 3899051 - RNA, 13 nt, Shigella flexneri 2a str. 301
uggcugaccagaa

SEQ ID NO: 3899052 - RNA, 15 nt, Shigella flexneri 2a str. 301
uggcugagcacuauc

SEQ ID NO: 3899053 - RNA, 21 nt, Shigella flexneri 2a str. 301
uggcugagugaaucagaagac

SEQ ID NO: 3899054 - RNA, 21 nt, Shigella flexneri 2a str. 301
uggcugauuaacguuuccauu

SEQ ID NO: 3899055 - RNA, 20 nt, Shigella flexneri 2a str. 301
uggcugcaaagcauuuuuuc

SEQ ID NO: 3899056 - RNA, 21 nt, Shigella flexneri 2a str. 301
uggcugccgagcaaaucgcgg

SEQ ID NO: 3899057 - RNA, 16 nt, Shigella flexneri 2a str. 301
uggcuggaacaacgug

SEQ ID NO: 3899058 - RNA, 16 nt, Shigella flexneri 2a str. 301
uggcugugcguuaccc

SEQ ID NO: 3899059 - RNA, 18 nt, Shigella flexneri 2a str. 301
uggcuguuuucagcacca

SEQ ID NO: 3899060 - RNA, 19 nt, Shigella flexneri 2a str. 301
uggcuguuuucagcaccag

SEQ ID NO: 3899061 - RNA, 19 nt, Shigella flexneri 2a str. 301
uggcuuaaacgcagagaca

SEQ ID NO: 3899062 - RNA, 13 nt, Shigella flexneri 2a str. 301
uggcuucauccac

SEQ ID NO: 3899063 - RNA, 18 nt, Shigella flexneri 2a str. 301
uggcuucgguuuuuauuu

SEQ ID NO: 3899064 - RNA, 14 nt, Shigella flexneri 2a str. 301
uggcuugccagcca

SEQ ID NO: 3899065 - RNA, 17 nt, Shigella flexneri 2a str. 301
uggcuuuccaccaucac

SEQ ID NO: 3899066 - RNA, 14 nt, Shigella flexneri 2a str. 301
uggcuuuccgggag

SEQ ID NO: 3899067 - RNA, 16 nt, Shigella flexneri 2a str. 301
uggcuuuccgggagca

SEQ ID NO: 3899068 - RNA, 15 nt, Shigella flexneri 2a str. 301
uggcuuugcccuggc

SEQ ID NO: 3899069 - RNA, 13 nt, Shigella flexneri 2a str. 301
ugggaaauccaac

SEQ ID NO: 3899070 - RNA, 13 nt, Shigella flexneri 2a str. 301
ugggaacaccgua

SEQ ID NO: 3899071 - RNA, 13 nt, Shigella flexneri 2a str. 301
ugggaagccucca

SEQ ID NO: 3899072 - RNA, 14 nt, Shigella flexneri 2a str. 301
ugggaaggugcgga

SEQ ID NO: 3899073 - RNA, 13 nt, Shigella flexneri 2a str. 301
ugggaauagcggc

SEQ ID NO: 3899074 - RNA, 15 nt, Shigella flexneri 2a str. 301
ugggacgcagacugg

SEQ ID NO: 3899075 - RNA, 15 nt, Shigella flexneri 2a str. 301
ugggaucaaaaaugu

SEQ ID NO: 3899076 - RNA, 21 nt, Shigella flexneri 2a str. 301
ugggaugguuuugcuuuauua

SEQ ID NO: 3899077 - RNA, 13 nt, Shigella flexneri 2a str. 301
ugggauuaaaaag

SEQ ID NO: 3899078 - RNA, 23 nt, Shigella flexneri 2a str. 301
ugggauucaccaaucggcagaac

SEQ ID NO: 3899079 - RNA, 14 nt, Shigella flexneri 2a str. 301
ugggauugcuucag

SEQ ID NO: 3899080 - RNA, 20 nt, Shigella flexneri 2a str. 301
ugggauugcuucaguugccu

SEQ ID NO: 3899081 - RNA, 15 nt, Shigella flexneri 2a str. 301
ugggcaaucucacuc

SEQ ID NO: 3899082 - RNA, 20 nt, Shigella flexneri 2a str. 301
ugggcaaucucacuccggcc

SEQ ID NO: 3899083 - RNA, 17 nt, Shigella flexneri 2a str. 301
ugggcaggaaaaucagc

SEQ ID NO: 3899084 - RNA, 22 nt, Shigella flexneri 2a str. 301
ugggcaggaaaaucagcaucaa

SEQ ID NO: 3899085 - RNA, 18 nt, Shigella flexneri 2a str. 301
ugggcaguugcgcgcgca

SEQ ID NO: 3899086 - RNA, 15 nt, Shigella flexneri 2a str. 301
ugggccagaaaaaac

SEQ ID NO: 3899087 - RNA, 16 nt, Shigella flexneri 2a str. 301
ugggccagaaaaaacg

SEQ ID NO: 3899088 - RNA, 16 nt, Shigella flexneri 2a str. 301
ugggccugaaagcuca

SEQ ID NO: 3899089 - RNA, 13 nt, Shigella flexneri 2a str. 301
ugggcgaagagaa

SEQ ID NO: 3899090 - RNA, 21 nt, Shigella flexneri 2a str. 301
ugggcgaagagaaagaacgag

SEQ ID NO: 3899091 - RNA, 23 nt, Shigella flexneri 2a str. 301
ugggcgagggcaaaccucaccgc

SEQ ID NO: 3899092 - RNA, 21 nt, Shigella flexneri 2a str. 301
ugggcgauacgggcucgggca

SEQ ID NO: 3899093 - RNA, 22 nt, Shigella flexneri 2a str. 301
ugggcggcgugauuggcaucau

SEQ ID NO: 3899094 - RNA, 12 nt, Shigella flexneri 2a str. 301
ugggcucaucaa

SEQ ID NO: 3899095 - RNA, 16 nt, Shigella flexneri 2a str. 301
ugggcuucauccagca

SEQ ID NO: 3899096 - RNA, 17 nt, Shigella flexneri 2a str. 301
ugggcuucauccagcag

SEQ ID NO: 3899097 - RNA, 15 nt, Shigella flexneri 2a str. 301
ugggcuucuuuauga

SEQ ID NO: 3899098 - RNA, 16 nt, Shigella flexneri 2a str. 301
uggggaaaaacacaaa

SEQ ID NO: 3899099 - RNA, 18 nt, Shigella flexneri 2a str. 301
uggggauagcgcugcugc

SEQ ID NO: 3899100 - RNA, 19 nt, Shigella flexneri 2a str. 301
uggggauagcgcugcugca

SEQ ID NO: 3899101 - RNA, 14 nt, Shigella flexneri 2a str. 301
uggggcaaaugguu

SEQ ID NO: 3899102 - RNA, 19 nt, Shigella flexneri 2a str. 301
uggggcaggggcuucuucc

SEQ ID NO: 3899103 - RNA, 12 nt, Shigella flexneri 2a str. 301
uggggcuggcgg

SEQ ID NO: 3899104 - RNA, 22 nt, Shigella flexneri 2a str. 301
ugggguugcagaaacaaccuga

SEQ ID NO: 3899105 - RNA, 14 nt, Shigella flexneri 2a str. 301
uggguacgaaaagg

SEQ ID NO: 3899106 - RNA, 20 nt, Shigella flexneri 2a str. 301
uggguacgaaaagggcugga

SEQ ID NO: 3899107 - RNA, 19 nt, Shigella flexneri 2a str. 301
uggguauauuucaggccaa

SEQ ID NO: 3899108 - RNA, 23 nt, Shigella flexneri 2a str. 301
ugggucacucaggccaaaugaca

SEQ ID NO: 3899109 - RNA, 18 nt, Shigella flexneri 2a str. 301
ugggucggcgauaaccau

SEQ ID NO: 3899110 - RNA, 16 nt, Shigella flexneri 2a str. 301
ugggugagcgaugcug

SEQ ID NO: 3899111 - RNA, 18 nt, Shigella flexneri 2a str. 301
ugggugccgcgcagcgug

SEQ ID NO: 3899112 - RNA, 14 nt, Shigella flexneri 2a str. 301
uggguggcagaucc

SEQ ID NO: 3899113 - RNA, 17 nt, Shigella flexneri 2a str. 301
ugggugucgccuuccac

SEQ ID NO: 3899114 - RNA, 21 nt, Shigella flexneri 2a str. 301
uggguucacuuuccccggcau

SEQ ID NO: 3899115 - RNA, 18 nt, Shigella flexneri 2a str. 301
uggguucgauuucauuca

SEQ ID NO: 3899116 - RNA, 15 nt, Shigella flexneri 2a str. 301
uggguuucauccugc

SEQ ID NO: 3899117 - RNA, 15 nt, Shigella flexneri 2a str. 301
uggguuuccggaucg

SEQ ID NO: 3899118 - RNA, 16 nt, Shigella flexneri 2a str. 301
uggguuucuaauuuuu

SEQ ID NO: 3899119 - RNA, 20 nt, Shigella flexneri 2a str. 301
uggguuuguccauaaaaugc

SEQ ID NO: 3899120 - RNA, 21 nt, Shigella flexneri 2a str. 301
uggguuuguccauaaaaugca

SEQ ID NO: 3899121 - RNA, 19 nt, Shigella flexneri 2a str. 301
ugguaaaaccgacuuaaaa

SEQ ID NO: 3899122 - RNA, 23 nt, Shigella flexneri 2a str. 301
ugguaaagccgauuaaucuucca

SEQ ID NO: 3899123 - RNA, 22 nt, Shigella flexneri 2a str. 301
uguaauaguguauuaaucuauu

SEQ ID NO: 3899124 - RNA, 18 nt, Shigella flexneri 2a str. 301
uguaaucauauuaaauuu

SEQ ID NO: 3899125 - RNA, 14 nt, Shigella flexneri 2a str. 301
uguaauccucuuug

SEQ ID NO: 3899126 - RNA, 22 nt, Shigella flexneri 2a str. 301
uguaauuaaauuaucaacuauc

SEQ ID NO: 3899127 - RNA, 22 nt, Shigella flexneri 2a str. 301
uguaauuugaucgauggcagua

SEQ ID NO: 3899128 - RNA, 15 nt, Shigella flexneri 2a str. 301
uguacaaacccagcc

SEQ ID NO: 3899129 - RNA, 16 nt, Shigella flexneri 2a str. 301
uguacaggcuccugua

SEQ ID NO: 3899130 - RNA, 14 nt, Shigella flexneri 2a str. 301
uguacaugcugcuu

SEQ ID NO: 3899131 - RNA, 22 nt, Shigella flexneri 2a str. 301
uguacauuaccacgauuuugac

SEQ ID NO: 3899132 - RNA, 21 nt, Shigella flexneri 2a str. 301
uguaccaccagaaucgccagc

SEQ ID NO: 3899133 - RNA, 23 nt, Shigella flexneri 2a str. 301
uguacccuuaacucuuccugaua

SEQ ID NO: 3899134 - RNA, 18 nt, Shigella flexneri 2a str. 301
uguaccggauaaauuuaa

SEQ ID NO: 3899135 - RNA, 17 nt, Shigella flexneri 2a str. 301
uguaccguugcugccag

SEQ ID NO: 3899136 - RNA, 20 nt, Shigella flexneri 2a str. 301
uguaccuucacgcgcuccag

SEQ ID NO: 3899137 - RNA, 22 nt, Shigella flexneri 2a str. 301
uguaccuucacgcgcuccagga

SEQ ID NO: 3899138 - RNA, 23 nt, Shigella flexneri 2a str. 301
uguaccuucacgcgcuccaggag

SEQ ID NO: 3899139 - RNA, 14 nt, Shigella flexneri 2a str. 301
uguacgacaaaaga

SEQ ID NO: 3899140 - RNA, 15 nt, Shigella flexneri 2a str. 301
uguacuccagcagac

SEQ ID NO: 3899141 - RNA, 20 nt, Shigella flexneri 2a str. 301
uguacuccagcagaccagca

SEQ ID NO: 3899142 - RNA, 19 nt, Shigella flexneri 2a str. 301
uguacuggcaauagcggac

SEQ ID NO: 3899143 - RNA, 22 nt, Shigella flexneri 2a str. 301
uguacuuccggacguucagcca

SEQ ID NO: 3899144 - RNA, 13 nt, Shigella flexneri 2a str. 301
uguacuuuccagc

SEQ ID NO: 3899145 - RNA, 18 nt, Shigella flexneri 2a str. 301
uguacuuuccagccacag

SEQ ID NO: 3899146 - RNA, 18 nt, Shigella flexneri 2a str. 301
uguagaccggauaaggaa

SEQ ID NO: 3899147 - RNA, 18 nt, Shigella flexneri 2a str. 301
uguagauaaaacacucuu

SEQ ID NO: 3899148 - RNA, 17 nt, Shigella flexneri 2a str. 301
uguagcgcugcaaacca

SEQ ID NO: 3899149 - RNA, 18 nt, Shigella flexneri 2a str. 301
uguagcguuaccagcaaa

SEQ ID NO: 3899150 - RNA, 16 nt, Shigella flexneri 2a str. 301
uguagcuacgcaucaa

SEQ ID NO: 3899151 - RNA, 19 nt, Shigella flexneri 2a str. 301
uguaggccagauaagacgc

SEQ ID NO: 3899152 - RNA, 23 nt, Shigella flexneri 2a str. 301
uguaggccagauaagacguucac

SEQ ID NO: 3899153 - RNA, 20 nt, Shigella flexneri 2a str. 301
uguaggccggauaaggcauu

SEQ ID NO: 3899154 - RNA, 23 nt, Shigella flexneri 2a str. 301
uguaggccggauaaggcguucac

SEQ ID NO: 3899155 - RNA, 19 nt, Shigella flexneri 2a str. 301
uguaggccugauaagacgc

SEQ ID NO: 3899156 - RNA, 21 nt, Shigella flexneri 2a str. 301
uguaggccugauaagcguagc

SEQ ID NO: 3899157 - RNA, 17 nt, Shigella flexneri 2a str. 301
uguaggccugauaagug

SEQ ID NO: 3899158 - RNA, 18 nt, Shigella flexneri 2a str. 301
uguaggcggauaaggcgu

SEQ ID NO: 3899159 - RNA, 19 nt, Shigella flexneri 2a str. 301
uguaggcuggauaaggcgu

SEQ ID NO: 3899160 - RNA, 23 nt, Shigella flexneri 2a str. 301
uguaguacccggccuguuuaucc

SEQ ID NO: 3899161 - RNA, 21 nt, Shigella flexneri 2a str. 301
uguaguccuaacagagcacug

SEQ ID NO: 3899162 - RNA, 13 nt, Shigella flexneri 2a str. 301
uguagugcuccca

SEQ ID NO: 3899163 - RNA, 23 nt, Shigella flexneri 2a str. 301
uguagugcucccaaaacugcuug

SEQ ID NO: 3899164 - RNA, 14 nt, Shigella flexneri 2a str. 301
uguauauaaauguu

SEQ ID NO: 3899165 - RNA, 14 nt, Shigella flexneri 2a str. 301
uguauaucaaacca

SEQ ID NO: 3899166 - RNA, 21 nt, Shigella flexneri 2a str. 301
uguaucaacaauaaaaccagu

SEQ ID NO: 3899167 - RNA, 21 nt, Shigella flexneri 2a str. 301
uguaucgacgcgccagcaccg

SEQ ID NO: 3899168 - RNA, 21 nt, Shigella flexneri 2a str. 301
uguaucggcggcgauguccag

SEQ ID NO: 3899169 - RNA, 19 nt, Shigella flexneri 2a str. 301
uguaucugcagauuaugcc

SEQ ID NO: 3899170 - RNA, 18 nt, Shigella flexneri 2a str. 301
uguaugccgaauaaagca

SEQ ID NO: 3899171 - RNA, 21 nt, Shigella flexneri 2a str. 301
uguauguaggguacagcacga

SEQ ID NO: 3899172 - RNA, 16 nt, Shigella flexneri 2a str. 301
uguauuacaacgugcu

SEQ ID NO: 3899173 - RNA, 13 nt, Shigella flexneri 2a str. 301
uguauucaugccc

SEQ ID NO: 3899174 - RNA, 14 nt, Shigella flexneri 2a str. 301
uguauucaugcccu

SEQ ID NO: 3899175 - RNA, 17 nt, Shigella flexneri 2a str. 301
uguauucaugcccugcc

SEQ ID NO: 3899176 - RNA, 11 nt, Shigella flexneri 2a str. 301
ugucaaaucca

SEQ ID NO: 3899177 - RNA, 23 nt, Shigella flexneri 2a str. 301
ugucaacuccaguuccgguacga

SEQ ID NO: 3899178 - RNA, 14 nt, Shigella flexneri 2a str. 301
ugucaauaaacgcc

SEQ ID NO: 3899179 - RNA, 14 nt, Shigella flexneri 2a str. 301
ugucacaaauagag

SEQ ID NO: 3899180 - RNA, 16 nt, Shigella flexneri 2a str. 301
ugucaccacccugccc

SEQ ID NO: 3899181 - RNA, 22 nt, Shigella flexneri 2a str. 301
ugucaccauuggcauugguauc

SEQ ID NO: 3899182 - RNA, 23 nt, Shigella flexneri 2a str. 301
ugucaccgccaggugaaauccgg

SEQ ID NO: 3899183 - RNA, 14 nt, Shigella flexneri 2a str. 301
ugucacguuuugug

SEQ ID NO: 3899184 - RNA, 21 nt, Shigella flexneri 2a str. 301
ugucacuaugagguagccuga

SEQ ID NO: 3899185 - RNA, 17 nt, Shigella flexneri 2a str. 301
ugucacugacuauuucc

SEQ ID NO: 3899186 - RNA, 15 nt, Shigella flexneri 2a str. 301
ugucagaugcggcgu

SEQ ID NO: 3899187 - RNA, 13 nt, Shigella flexneri 2a str. 301
ugucagcaacugu

SEQ ID NO: 3899188 - RNA, 16 nt, Shigella flexneri 2a str. 301
ugucagcacuuccagc

SEQ ID NO: 3899189 - RNA, 16 nt, Shigella flexneri 2a str. 301
ugucagcucauccagc

SEQ ID NO: 3899190 - RNA, 22 nt, Shigella flexneri 2a str. 301
ugucaguauaacuacugauggc

SEQ ID NO: 3899191 - RNA, 16 nt, Shigella flexneri 2a str. 301
ugucaguggacgauaa

SEQ ID NO: 3899192 - RNA, 20 nt, Shigella flexneri 2a str. 301
ugucauaaaucagcgugaug

SEQ ID NO: 3899193 - RNA, 22 nt, Shigella flexneri 2a str. 301
ugucauaacacagguaacuuaa

SEQ ID NO: 3899194 - RNA, 23 nt, Shigella flexneri 2a str. 301
ugucauacgggcuguagcuuuuc

SEQ ID NO: 3899195 - RNA, 14 nt, Shigella flexneri 2a str. 301
ugucauacugccca

SEQ ID NO: 3899196 - RNA, 22 nt, Shigella flexneri 2a str. 301
ugucauaggugucaaccagcca

SEQ ID NO: 3899197 - RNA, 15 nt, Shigella flexneri 2a str. 301
ugucaucaacgacgg

SEQ ID NO: 3899198 - RNA, 13 nt, Shigella flexneri 2a str. 301
ugucaucagcauu

SEQ ID NO: 3899199 - RNA, 23 nt, Shigella flexneri 2a str. 301
ugucaucagcauucucaucacca

SEQ ID NO: 3899200 - RNA, 21 nt, Shigella flexneri 2a str. 301
ugucaucgaauaaauugagcu

SEQ ID NO: 3899201 - RNA, 22 nt, Shigella flexneri 2a str. 301
ugucaucuucgaaaguagaagc

SEQ ID NO: 3899202 - RNA, 16 nt, Shigella flexneri 2a str. 301
ugucaugacuacacua

SEQ ID NO: 3899203 - RNA, 20 nt, Shigella flexneri 2a str. 301
ugucaugaguaaacuuuugg

SEQ ID NO: 3899204 - RNA, 13 nt, Shigella flexneri 2a str. 301
ugucaugcagcuc

SEQ ID NO: 3899205 - RNA, 15 nt, Shigella flexneri 2a str. 301
ugucaugcagcucca

SEQ ID NO: 3899206 - RNA, 17 nt, Shigella flexneri 2a str. 301
ugucaugcgcucuccca

SEQ ID NO: 3899207 - RNA, 21 nt, Shigella flexneri 2a str. 301
ugucauguauauuauccauca

SEQ ID NO: 3899208 - RNA, 18 nt, Shigella flexneri 2a str. 301
ugucauuaaagccgccaa

SEQ ID NO: 3899209 - RNA, 21 nt, Shigella flexneri 2a str. 301
ugucauuaaagccgccaaacg

SEQ ID NO: 3899210 - RNA, 22 nt, Shigella flexneri 2a str. 301
ugucauucgccugacgcaauaa

SEQ ID NO: 3899211 - RNA, 22 nt, Shigella flexneri 2a str. 301
uguccaaauccuucagcaacuu

SEQ ID NO: 3899212 - RNA, 17 nt, Shigella flexneri 2a str. 301
uguccaccacgcugcau

SEQ ID NO: 3899213 - RNA, 22 nt, Shigella flexneri 2a str. 301
uguccacgccgcugucuaccag

SEQ ID NO: 3899214 - RNA, 15 nt, Shigella flexneri 2a str. 301
uguccagcacgccgc

SEQ ID NO: 3899215 - RNA, 15 nt, Shigella flexneri 2a str. 301
uguccagcggcauaa

SEQ ID NO: 3899216 - RNA, 16 nt, Shigella flexneri 2a str. 301
uguccagguuauuaaa

SEQ ID NO: 3899217 - RNA, 22 nt, Shigella flexneri 2a str. 301
uguccauagcgauguauuucau

SEQ ID NO: 3899218 - RNA, 22 nt, Shigella flexneri 2a str. 301
ugucccaagugauuuuuaauag

SEQ ID NO: 3899219 - RNA, 23 nt, Shigella flexneri 2a str. 301
ugucccacuggucgcccugggua

SEQ ID NO: 3899220 - RNA, 21 nt, Shigella flexneri 2a str. 301
uguccgauuuguucucuucug

SEQ ID NO: 3899221 - RNA, 16 nt, Shigella flexneri 2a str. 301
uguccgcuucaccacc

SEQ ID NO: 3899222 - RNA, 14 nt, Shigella flexneri 2a str. 301
uguuacguuucucu

SEQ ID NO: 3899223 - RNA, 20 nt, Shigella flexneri 2a str. 301
uguuagaugugggcaaucuc

SEQ ID NO: 3899224 - RNA, 22 nt, Shigella flexneri 2a str. 301
uguuagcaugcuggcugcgcuc

SEQ ID NO: 3899225 - RNA, 20 nt, Shigella flexneri 2a str. 301
uguuagcgaauaaaguagaa

SEQ ID NO: 3899226 - RNA, 18 nt, Shigella flexneri 2a str. 301
uguuagcggcgacaauaa

SEQ ID NO: 3899227 - RNA, 14 nt, Shigella flexneri 2a str. 301
uguuauccaccgaa

SEQ ID NO: 3899228 - RNA, 22 nt, Shigella flexneri 2a str. 301
uguuauccaccgaaauaaucag

SEQ ID NO: 3899229 - RNA, 22 nt, Shigella flexneri 2a str. 301
uguuauccgacuuauucuucaa

SEQ ID NO: 3899230 - RNA, 16 nt, Shigella flexneri 2a str. 301
uguuaugagauaauuc

SEQ ID NO: 3899231 - RNA, 15 nt, Shigella flexneri 2a str. 301
uguucaacaauucgu

SEQ ID NO: 3899232 - RNA, 13 nt, Shigella flexneri 2a str. 301
uguucaauaucga

SEQ ID NO: 3899233 - RNA, 20 nt, Shigella flexneri 2a str. 301
uguucaccacugaauaacau

SEQ ID NO: 3899234 - RNA, 15 nt, Shigella flexneri 2a str. 301
uguucacgaaaacag

SEQ ID NO: 3899235 - RNA, 19 nt, Shigella flexneri 2a str. 301
uguucacgaaaacagcgca

SEQ ID NO: 3899236 - RNA, 11 nt, Shigella flexneri 2a str. 301
uguucacugcc

SEQ ID NO: 3899237 - RNA, 13 nt, Shigella flexneri 2a str. 301
uguucacugugcu

SEQ ID NO: 3899238 - RNA, 22 nt, Shigella flexneri 2a str. 301
uguucacuuuugcugcaaaauu

SEQ ID NO: 3899239 - RNA, 17 nt, Shigella flexneri 2a str. 301
uguucagaaagcgccag

SEQ ID NO: 3899240 - RNA, 13 nt, Shigella flexneri 2a str. 301
uguucagauaaug

SEQ ID NO: 3899241 - RNA, 18 nt, Shigella flexneri 2a str. 301
uguucagauggccaauaa

SEQ ID NO: 3899242 - RNA, 18 nt, Shigella flexneri 2a str. 301
uguucagccugacagcac

SEQ ID NO: 3899243 - RNA, 15 nt, Shigella flexneri 2a str. 301
uguucagcgggcagg

SEQ ID NO: 3899244 - RNA, 22 nt, Shigella flexneri 2a str. 301
uguucagcgggcagggcaucaa

SEQ ID NO: 3899245 - RNA, 17 nt, Shigella flexneri 2a str. 301
uguucauagugccugau

SEQ ID NO: 3899246 - RNA, 13 nt, Shigella flexneri 2a str. 301
uguucaucugcau

SEQ ID NO: 3899247 - RNA, 23 nt, Shigella flexneri 2a str. 301
uguuccagacgcugcauugacaa

SEQ ID NO: 3899248 - RNA, 16 nt, Shigella flexneri 2a str. 301
uguuccagcaaauccc

SEQ ID NO: 3899249 - RNA, 18 nt, Shigella flexneri 2a str. 301
uguuccaguugauacagg

SEQ ID NO: 3899250 - RNA, 15 nt, Shigella flexneri 2a str. 301
uguuccaucuuuaug

SEQ ID NO: 3899251 - RNA, 15 nt, Shigella flexneri 2a str. 301
uguuccgccagcgac

SEQ ID NO: 3899252 - RNA, 12 nt, Shigella flexneri 2a str. 301
uguuccucugcu

SEQ ID NO: 3899253 - RNA, 14 nt, Shigella flexneri 2a str. 301
uguuccucugcucc

SEQ ID NO: 3899254 - RNA, 20 nt, Shigella flexneri 2a str. 301
uguuccugaacgcccgcaua

SEQ ID NO: 3899255 - RNA, 21 nt, Shigella flexneri 2a str. 301
uguucgcccacgcgcauuccc

SEQ ID NO: 3899256 - RNA, 22 nt, Shigella flexneri 2a str. 301
uguucgcccacgcgcauuccca

SEQ ID NO: 3899257 - RNA, 23 nt, Shigella flexneri 2a str. 301
uguucggcauucugcuggccugg

SEQ ID NO: 3899258 - RNA, 20 nt, Shigella flexneri 2a str. 301
uguucguuguaucaacagcg

SEQ ID NO: 3899259 - RNA, 13 nt, Shigella flexneri 2a str. 301
uguucucagcaca

SEQ ID NO: 3899260 - RNA, 13 nt, Shigella flexneri 2a str. 301
uguucucccauag

SEQ ID NO: 3899261 - RNA, 14 nt, Shigella flexneri 2a str. 301
uguucuccuggccc

SEQ ID NO: 3899262 - RNA, 16 nt, Shigella flexneri 2a str. 301
uguucuccuggcccgg

SEQ ID NO: 3899263 - RNA, 14 nt, Shigella flexneri 2a str. 301
uguucucuucugcu

SEQ ID NO: 3899264 - RNA, 13 nt, Shigella flexneri 2a str. 301
uguucugaaucac

SEQ ID NO: 3899265 - RNA, 18 nt, Shigella flexneri 2a str. 301
uguucugcgccaaacaga

SEQ ID NO: 3899266 - RNA, 18 nt, Shigella flexneri 2a str. 301
uguugaaaagccggaaug

SEQ ID NO: 3899267 - RNA, 21 nt, Shigella flexneri 2a str. 301
uguugagaugguuacuuuuua

SEQ ID NO: 3899268 - RNA, 14 nt, Shigella flexneri 2a str. 301
uguugauaaggaaa

SEQ ID NO: 3899269 - RNA, 14 nt, Shigella flexneri 2a str. 301
uguugauccaggag

SEQ ID NO: 3899270 - RNA, 17 nt, Shigella flexneri 2a str. 301
uguugauggggguccug

SEQ ID NO: 3899271 - RNA, 23 nt, Shigella flexneri 2a str. 301
uguugcaagacgaugacauuauc

SEQ ID NO: 3899272 - RNA, 19 nt, Shigella flexneri 2a str. 301
uguugcaccaucaggcaua

SEQ ID NO: 3899273 - RNA, 20 nt, Shigella flexneri 2a str. 301
uguugcaccgaguucuucac

SEQ ID NO: 3899274 - RNA, 18 nt, Shigella flexneri 2a str. 301
uguugccacacgcccaac

SEQ ID NO: 3899275 - RNA, 21 nt, Shigella flexneri 2a str. 301
uguugccauuucugcugccac

SEQ ID NO: 3899276 - RNA, 22 nt, Shigella flexneri 2a str. 301
uguugcccagcgcaucaggcaa

SEQ ID NO: 3899277 - RNA, 22 nt, Shigella flexneri 2a str. 301
uguugccgccgugugcaauauc

SEQ ID NO: 3899278 - RNA, 20 nt, Shigella flexneri 2a str. 301
uguugcgccaguaaauuuau

SEQ ID NO: 3899279 - RNA, 17 nt, Shigella flexneri 2a str. 301
uguugcgcugaaacuuu

SEQ ID NO: 3899280 - RNA, 14 nt, Shigella flexneri 2a str. 301
uguugcugaaauuc

SEQ ID NO: 3899281 - RNA, 18 nt, Shigella flexneri 2a str. 301
uguugcugccgacaaaug

SEQ ID NO: 3899282 - RNA, 14 nt, Shigella flexneri 2a str. 301
uguuggauccccug

SEQ ID NO: 3899283 - RNA, 20 nt, Shigella flexneri 2a str. 301
uguuggcaggccaaaaaaca

SEQ ID NO: 3899284 - RNA, 22 nt, Shigella flexneri 2a str. 301
uguuggccaacccgcgugguuu

SEQ ID NO: 3899285 - RNA, 16 nt, Shigella flexneri 2a str. 301
uguuguaagcuugaca

SEQ ID NO: 3899286 - RNA, 17 nt, Shigella flexneri 2a str. 301
uguuguaauaguguauu

SEQ ID NO: 3899287 - RNA, 18 nt, Shigella flexneri 2a str. 301
uguuguagacaugguaaa

SEQ ID NO: 3899288 - RNA, 16 nt, Shigella flexneri 2a str. 301
uguuguagaccggaaa

SEQ ID NO: 3899289 - RNA, 21 nt, Shigella flexneri 2a str. 301
uguuguauccuguuuuuaagu

SEQ ID NO: 3899290 - RNA, 20 nt, Shigella flexneri 2a str. 301
uguugucuucucaacacauu

SEQ ID NO: 3899291 - RNA, 17 nt, Shigella flexneri 2a str. 301
uguuguuuuuucaaccu

SEQ ID NO: 3899292 - RNA, 20 nt, Shigella flexneri 2a str. 301
uguuguuuuuucaaccuaaa

SEQ ID NO: 3899293 - RNA, 12 nt, Shigella flexneri 2a str. 301
uguuuaaauauc

SEQ ID NO: 3899294 - RNA, 13 nt, Shigella flexneri 2a str. 301
uguuuaaccaaca

SEQ ID NO: 3899295 - RNA, 15 nt, Shigella flexneri 2a str. 301
uguuuaaccgcuuca

SEQ ID NO: 3899296 - RNA, 18 nt, Shigella flexneri 2a str. 301
uguuuaaggaaaaacgaa

SEQ ID NO: 3899297 - RNA, 19 nt, Shigella flexneri 2a str. 301
uguuuaauggcaaaaacuu

SEQ ID NO: 3899298 - RNA, 19 nt, Shigella flexneri 2a str. 301
uguuuaccggugccagcaa

SEQ ID NO: 3899299 - RNA, 18 nt, Shigella flexneri 2a str. 301
uguuuagguugaacccuu

SEQ ID NO: 3899300 - RNA, 15 nt, Shigella flexneri 2a str. 301
uguuuaucuucccag

SEQ ID NO: 3899301 - RNA, 13 nt, Shigella flexneri 2a str. 301
uguuuauguugug

SEQ ID NO: 3899302 - RNA, 12 nt, Shigella flexneri 2a str. 301
uguuucagaaau

SEQ ID NO: 3899303 - RNA, 17 nt, Shigella flexneri 2a str. 301
uguuuccagauuuugcu

SEQ ID NO: 3899304 - RNA, 16 nt, Shigella flexneri 2a str. 301
uguuuccauauguacg

SEQ ID NO: 3899305 - RNA, 15 nt, Shigella flexneri 2a str. 301
uguuucgaucagcaa

SEQ ID NO: 3899306 - RNA, 14 nt, Shigella flexneri 2a str. 301
uguuucugguggaa

SEQ ID NO: 3899307 - RNA, 16 nt, Shigella flexneri 2a str. 301
uguuugaaucaacaua

SEQ ID NO: 3899308 - RNA, 16 nt, Shigella flexneri 2a str. 301
uguuuuagagaauuaa

SEQ ID NO: 3899309 - RNA, 13 nt, Shigella flexneri 2a str. 301
uguuuuauguuca

SEQ ID NO: 3899310 - RNA, 13 nt, Shigella flexneri 2a str. 301
uguuuuccagcac

SEQ ID NO: 3899311 - RNA, 22 nt, Shigella flexneri 2a str. 301
uguuuuccguugugcgauccac

SEQ ID NO: 3899312 - RNA, 14 nt, Shigella flexneri 2a str. 301
uguuuugaacuuca

SEQ ID NO: 3899313 - RNA, 23 nt, Shigella flexneri 2a str. 301
uguuuuuucaaccuaaaguaaag

SEQ ID NO: 3899314 - RNA, 12 nt, Shigella flexneri 2a str. 301
uuaaaaaaagca

SEQ ID NO: 3899315 - RNA, 10 nt, Shigella flexneri 2a str. 301
uuaaaaacag

SEQ ID NO: 3899316 - RNA, 16 nt, Shigella flexneri 2a str. 301
uuaaaaacccgccaug

SEQ ID NO: 3899317 - RNA, 18 nt, Shigella flexneri 2a str. 301
uuaaaaacccugcagaaa

SEQ ID NO: 3899318 - RNA, 12 nt, Shigella flexneri 2a str. 301
uuaaaaagugcu

SEQ ID NO: 3899319 - RNA, 11 nt, Shigella flexneri 2a str. 301
uuaaaagcgcg

SEQ ID NO: 3899320 - RNA, 17 nt, Shigella flexneri 2a str. 301
uuaaaauuucaugcuga

SEQ ID NO: 3899321 - RNA, 18 nt, Shigella flexneri 2a str. 301
uuaaacacgggguuaaau

SEQ ID NO: 3899322 - RNA, 16 nt, Shigella flexneri 2a str. 301
uuaauuauuaacaaaa

SEQ ID NO: 3899323 - RNA, 16 nt, Shigella flexneri 2a str. 301
uuaauucauacaucgc

SEQ ID NO: 3899324 - RNA, 14 nt, Shigella flexneri 2a str. 301
uuaauuccggugaa

SEQ ID NO: 3899325 - RNA, 23 nt, Shigella flexneri 2a str. 301
uuaauucugagagcaugaaauga

SEQ ID NO: 3899326 - RNA, 15 nt, Shigella flexneri 2a str. 301
uuaauucuuugagca

SEQ ID NO: 3899327 - RNA, 20 nt, Shigella flexneri 2a str. 301
uuaauugcccgaagccaauu

SEQ ID NO: 3899328 - RNA, 17 nt, Shigella flexneri 2a str. 301
uuaauugccguuaaaac

SEQ ID NO: 3899329 - RNA, 15 nt, Shigella flexneri 2a str. 301
uuaauuucgacgggc

SEQ ID NO: 3899330 - RNA, 18 nt, Shigella flexneri 2a str. 301
uuaauuucgacgggcugg

SEQ ID NO: 3899331 - RNA, 20 nt, Shigella flexneri 2a str. 301
uuaauuuugugcagcaugca

SEQ ID NO: 3899332 - RNA, 14 nt, Shigella flexneri 2a str. 301
uuacaacaucaaca

SEQ ID NO: 3899333 - RNA, 16 nt, Shigella flexneri 2a str. 301
uuacaacguauugaaa

SEQ ID NO: 3899334 - RNA, 16 nt, Shigella flexneri 2a str. 301
uuacaagcaacuugca

SEQ ID NO: 3899335 - RNA, 22 nt, Shigella flexneri 2a str. 301
uuacaauuuacguuuuaaaccu

SEQ ID NO: 3899336 - RNA, 19 nt, Shigella flexneri 2a str. 301
uuacacaaauccagcaccg

SEQ ID NO: 3899337 - RNA, 13 nt, Shigella flexneri 2a str. 301
uuacacaauuuug

SEQ ID NO: 3899338 - RNA, 19 nt, Shigella flexneri 2a str. 301
uuacaccaauaccgcccac

SEQ ID NO: 3899339 - RNA, 13 nt, Shigella flexneri 2a str. 301
uuacagcaacgcc

SEQ ID NO: 3899340 - RNA, 15 nt, Shigella flexneri 2a str. 301
uuacagccugccagc

SEQ ID NO: 3899341 - RNA, 22 nt, Shigella flexneri 2a str. 301
uuacagccugccagcaugcaua

SEQ ID NO: 3899342 - RNA, 23 nt, Shigella flexneri 2a str. 301
uuacaggguaaaaccaugccauc

SEQ ID NO: 3899343 - RNA, 21 nt, Shigella flexneri 2a str. 301
uuacaguagcuauaaaccugc

SEQ ID NO: 3899344 - RNA, 12 nt, Shigella flexneri 2a str. 301
uuacaguuucug

SEQ ID NO: 3899345 - RNA, 17 nt, Shigella flexneri 2a str. 301
uuacaguuucugacuca

SEQ ID NO: 3899346 - RNA, 20 nt, Shigella flexneri 2a str. 301
uuacaucagcguaggacaca

SEQ ID NO: 3899347 - RNA, 22 nt, Shigella flexneri 2a str. 301
uuacaucagcguaggacacaga

SEQ ID NO: 3899348 - RNA, 11 nt, Shigella flexneri 2a str. 301
uuacaucauca

SEQ ID NO: 3899349 - RNA, 15 nt, Shigella flexneri 2a str. 301
uuacaucaucagaaa

SEQ ID NO: 3899350 - RNA, 16 nt, Shigella flexneri 2a str. 301
uuacaucaucagaaau

SEQ ID NO: 3899351 - RNA, 18 nt, Shigella flexneri 2a str. 301
uuacaugcgcgacaaaaa

SEQ ID NO: 3899352 - RNA, 19 nt, Shigella flexneri 2a str. 301
uuacaugcugguguaacuu

SEQ ID NO: 3899353 - RNA, 22 nt, Shigella flexneri 2a str. 301
uuacauuaucgcgucuaaauuu

SEQ ID NO: 3899354 - RNA, 18 nt, Shigella flexneri 2a str. 301
uuaccaaauuggcaaaau

SEQ ID NO: 3899355 - RNA, 16 nt, Shigella flexneri 2a str. 301
uuacccaaucccccac

SEQ ID NO: 3899356 - RNA, 13 nt, Shigella flexneri 2a str. 301
uuacccagauaau

SEQ ID NO: 3899357 - RNA, 21 nt, Shigella flexneri 2a str. 301
uuaccgauccccggauucaug

SEQ ID NO: 3899358 - RNA, 22 nt, Shigella flexneri 2a str. 301
uuaccgauccccggauucaugc

SEQ ID NO: 3899359 - RNA, 15 nt, Shigella flexneri 2a str. 301
uuaccgaucgccagc

SEQ ID NO: 3899360 - RNA, 13 nt, Shigella flexneri 2a str. 301
uuaccgcaccacc

SEQ ID NO: 3899361 - RNA, 20 nt, Shigella flexneri 2a str. 301
uuaccgcaccaccagcagcu

SEQ ID NO: 3899362 - RNA, 23 nt, Shigella flexneri 2a str. 301
uuaccgccacagcagccuucgcc

SEQ ID NO: 3899363 - RNA, 19 nt, Shigella flexneri 2a str. 301
uuaccgcccccgcuaucca

SEQ ID NO: 3899364 - RNA, 21 nt, Shigella flexneri 2a str. 301
uuaccgcgccauguugccugg

SEQ ID NO: 3899365 - RNA, 16 nt, Shigella flexneri 2a str. 301
uuaccggucacuggca

SEQ ID NO: 3899366 - RNA, 12 nt, Shigella flexneri 2a str. 301
uuaccggucagg

SEQ ID NO: 3899367 - RNA, 18 nt, Shigella flexneri 2a str. 301
uuaccguaaugaucgcga

SEQ ID NO: 3899368 - RNA, 22 nt, Shigella flexneri 2a str. 301
uuaccguaccaaccgcaauugc

SEQ ID NO: 3899369 - RNA, 15 nt, Shigella flexneri 2a str. 301
uuaccuccgcuuugu

SEQ ID NO: 3899370 - RNA, 16 nt, Shigella flexneri 2a str. 301
uuaccugaaaaaacaa

SEQ ID NO: 3899371 - RNA, 14 nt, Shigella flexneri 2a str. 301
uuacgaccagccga

SEQ ID NO: 3899372 - RNA, 21 nt, Shigella flexneri 2a str. 301
uuacgaccuacaaucaauggu

SEQ ID NO: 3899373 - RNA, 22 nt, Shigella flexneri 2a str. 301
uuacgacucaaccccagccauu

SEQ ID NO: 3899374 - RNA, 19 nt, Shigella flexneri 2a str. 301
uuacgagugcgcucuucaa

SEQ ID NO: 3899375 - RNA, 19 nt, Shigella flexneri 2a str. 301
uuacgauccaccaccgcaa

SEQ ID NO: 3899376 - RNA, 20 nt, Shigella flexneri 2a str. 301
uuacgcaaaaccucuuccag

SEQ ID NO: 3899377 - RNA, 21 nt, Shigella flexneri 2a str. 301
uuacgcagcauuggguaaaau

SEQ ID NO: 3899378 - RNA, 13 nt, Shigella flexneri 2a str. 301
uuacgccaggcau

SEQ ID NO: 3899379 - RNA, 17 nt, Shigella flexneri 2a str. 301
uuacgccccaacacaau

SEQ ID NO: 3899380 - RNA, 20 nt, Shigella flexneri 2a str. 301
uuacgccccgguuucucuuc

SEQ ID NO: 3899381 - RNA, 14 nt, Shigella flexneri 2a str. 301
uuacgcccgugaug

SEQ ID NO: 3899382 - RNA, 16 nt, Shigella flexneri 2a str. 301
uuacgccgagcgccag

SEQ ID NO: 3899383 - RNA, 18 nt, Shigella flexneri 2a str. 301
uuacgccgcauccggcaa

SEQ ID NO: 3899384 - RNA, 19 nt, Shigella flexneri 2a str. 301
uuacgccgcauccggcaua

SEQ ID NO: 3899385 - RNA, 20 nt, Shigella flexneri 2a str. 301
uuacgccgcaucuggcauaa

SEQ ID NO: 3899386 - RNA, 19 nt, Shigella flexneri 2a str. 301
uuacgcggaucgagaaucu

SEQ ID NO: 3899387 - RNA, 16 nt, Shigella flexneri 2a str. 301
uuacgcucaccaaaac

SEQ ID NO: 3899388 - RNA, 16 nt, Shigella flexneri 2a str. 301
uuacgcucacugcaaa

SEQ ID NO: 3899389 - RNA, 21 nt, Shigella flexneri 2a str. 301
uuacgcucccacggaauagaa

SEQ ID NO: 3899390 - RNA, 16 nt, Shigella flexneri 2a str. 301
uuacggacgugggggu

SEQ ID NO: 3899391 - RNA, 23 nt, Shigella flexneri 2a str. 301
uuacggagcaggcguuaaaacag

SEQ ID NO: 3899392 - RNA, 22 nt, Shigella flexneri 2a str. 301
uuacggcugcggauguauuggc

SEQ ID NO: 3899393 - RNA, 23 nt, Shigella flexneri 2a str. 301
uuacgggcgaaguucgccaucaa

SEQ ID NO: 3899394 - RNA, 17 nt, Shigella flexneri 2a str. 301
uuacgggcgauauaccu

SEQ ID NO: 3899395 - RNA, 17 nt, Shigella flexneri 2a str. 301
uuacgugcacaggcaac

SEQ ID NO: 3899396 - RNA, 21 nt, Shigella flexneri 2a str. 301
uuacguggguaggaucacaag

SEQ ID NO: 3899397 - RNA, 15 nt, Shigella flexneri 2a str. 301
uuacguuacccagca

SEQ ID NO: 3899398 - RNA, 17 nt, Shigella flexneri 2a str. 301
uuacguuuccgcuauca

SEQ ID NO: 3899399 - RNA, 23 nt, Shigella flexneri 2a str. 301
uuacguuucucugcuaauuuauc

SEQ ID NO: 3899400 - RNA, 12 nt, Shigella flexneri 2a str. 301
uuacuaaaugug

SEQ ID NO: 3899401 - RNA, 17 nt, Shigella flexneri 2a str. 301
uuacuaaguacauuaag

SEQ ID NO: 3899402 - RNA, 13 nt, Shigella flexneri 2a str. 301
uuacuagccugcu

SEQ ID NO: 3899403 - RNA, 19 nt, Shigella flexneri 2a str. 301
uuacuagccugcucccuua

SEQ ID NO: 3899404 - RNA, 13 nt, Shigella flexneri 2a str. 301
uuacucauaaaua

SEQ ID NO: 3899405 - RNA, 16 nt, Shigella flexneri 2a str. 301
uuacuccacuuccugc

SEQ ID NO: 3899406 - RNA, 14 nt, Shigella flexneri 2a str. 301
uuacugaaaaugaa

SEQ ID NO: 3899407 - RNA, 17 nt, Shigella flexneri 2a str. 301
uuacugaaaaugaaagc

SEQ ID NO: 3899408 - RNA, 16 nt, Shigella flexneri 2a str. 301
uuacugcagccagcgu

SEQ ID NO: 3899409 - RNA, 12 nt, Shigella flexneri 2a str. 301
uuacugcauuca

SEQ ID NO: 3899410 - RNA, 20 nt, Shigella flexneri 2a str. 301
uuacugcauugaauuucuau

SEQ ID NO: 3899411 - RNA, 17 nt, Shigella flexneri 2a str. 301
uuacuggcuuucauuuu

SEQ ID NO: 3899412 - RNA, 16 nt, Shigella flexneri 2a str. 301
uuacugucgcgcagca

SEQ ID NO: 3899413 - RNA, 14 nt, Shigella flexneri 2a str. 301
uuacugucugcuuc

SEQ ID NO: 3899414 - RNA, 10 nt, Shigella flexneri 2a str. 301
uuacuuaaug

SEQ ID NO: 3899415 - RNA, 13 nt, Shigella flexneri 2a str. 301
uuacuuacacauc

SEQ ID NO: 3899416 - RNA, 14 nt, Shigella flexneri 2a str. 301
uuacuuacgaaaaa

SEQ ID NO: 3899417 - RNA, 21 nt, Shigella flexneri 2a str. 301
uuacuuacgaaaaaagggcau

SEQ ID NO: 3899418 - RNA, 14 nt, Shigella flexneri 2a str. 301
uuacuucacgcagu

SEQ ID NO: 3899419 - RNA, 19 nt, Shigella flexneri 2a str. 301
uuacuucacgcagucgcag

SEQ ID NO: 3899420 - RNA, 16 nt, Shigella flexneri 2a str. 301
uuacuucucgauaaac

SEQ ID NO: 3899421 - RNA, 12 nt, Shigella flexneri 2a str. 301
uuacuuuauuua

SEQ ID NO: 3899422 - RNA, 20 nt, Shigella flexneri 2a str. 301
uuaucuacagcauuuccuua

SEQ ID NO: 3899423 - RNA, 17 nt, Shigella flexneri 2a str. 301
uuaucuauaacaaaacu

SEQ ID NO: 3899424 - RNA, 19 nt, Shigella flexneri 2a str. 301
uuaucucccuguaucccag

SEQ ID NO: 3899425 - RNA, 22 nt, Shigella flexneri 2a str. 301
uuaucugauuugauaaugccag

SEQ ID NO: 3899426 - RNA, 15 nt, Shigella flexneri 2a str. 301
uuaucugcaauuacu

SEQ ID NO: 3899427 - RNA, 20 nt, Shigella flexneri 2a str. 301
uuaucugccgaacaggcugc

SEQ ID NO: 3899428 - RNA, 11 nt, Shigella flexneri 2a str. 301
uuaucuucaca

SEQ ID NO: 3899429 - RNA, 23 nt, Shigella flexneri 2a str. 301
uuaucuucgagauucuuaaaguc

SEQ ID NO: 3899430 - RNA, 19 nt, Shigella flexneri 2a str. 301
uuaugaaauaucuucaaua

SEQ ID NO: 3899431 - RNA, 22 nt, Shigella flexneri 2a str. 301
uuaugacuacgacauugaagaa

SEQ ID NO: 3899432 - RNA, 14 nt, Shigella flexneri 2a str. 301
uuaugaguauuuaa

SEQ ID NO: 3899433 - RNA, 21 nt, Shigella flexneri 2a str. 301
uuaugcacaccccgcgcagcu

SEQ ID NO: 3899434 - RNA, 21 nt, Shigella flexneri 2a str. 301
uuaugccauguucaucaagcu

SEQ ID NO: 3899435 - RNA, 19 nt, Shigella flexneri 2a str. 301
uuaugcccggacuagcgcu

SEQ ID NO: 3899436 - RNA, 22 nt, Shigella flexneri 2a str. 301
uuaugccgaucaucauccagca

SEQ ID NO: 3899437 - RNA, 18 nt, Shigella flexneri 2a str. 301
uuaugcucucguuaagua

SEQ ID NO: 3899438 - RNA, 21 nt, Shigella flexneri 2a str. 301
uuauggauaaaggccugccgc

SEQ ID NO: 3899439 - RNA, 16 nt, Shigella flexneri 2a str. 301
uuauggcgauaucaaa

SEQ ID NO: 3899440 - RNA, 21 nt, Shigella flexneri 2a str. 301
uuauggcuggcuggcaucuug

SEQ ID NO: 3899441 - RNA, 17 nt, Shigella flexneri 2a str. 301
uuaugggccaacggcau

SEQ ID NO: 3899442 - RNA, 23 nt, Shigella flexneri 2a str. 301
uuauggguaugucacugaugaca

SEQ ID NO: 3899443 - RNA, 18 nt, Shigella flexneri 2a str. 301
uuaugguagugccgucag

SEQ ID NO: 3899444 - RNA, 20 nt, Shigella flexneri 2a str. 301
uuaugguagugccgucagca

SEQ ID NO: 3899445 - RNA, 18 nt, Shigella flexneri 2a str. 301
uuaugugguuaugccauu

SEQ ID NO: 3899446 - RNA, 21 nt, Shigella flexneri 2a str. 301
uuauguucagauaaugcccga

SEQ ID NO: 3899447 - RNA, 13 nt, Shigella flexneri 2a str. 301
uuauuaaauuuaa

SEQ ID NO: 3899448 - RNA, 17 nt, Shigella flexneri 2a str. 301
uuauuaaauuuaauaau

SEQ ID NO: 3899449 - RNA, 18 nt, Shigella flexneri 2a str. 301
uuauuaaauuuaauaaua

SEQ ID NO: 3899450 - RNA, 14 nt, Shigella flexneri 2a str. 301
uuauuaauucuaaa

SEQ ID NO: 3899451 - RNA, 14 nt, Shigella flexneri 2a str. 301
uuauuacugcguau

SEQ ID NO: 3899452 - RNA, 19 nt, Shigella flexneri 2a str. 301
uuauuacuuaucccugucu

SEQ ID NO: 3899453 - RNA, 14 nt, Shigella flexneri 2a str. 301
uuauuauuuacuug

SEQ ID NO: 3899454 - RNA, 15 nt, Shigella flexneri 2a str. 301
uuauucagcagacca

SEQ ID NO: 3899455 - RNA, 21 nt, Shigella flexneri 2a str. 301
uuauucagcuggcagugcuau

SEQ ID NO: 3899456 - RNA, 21 nt, Shigella flexneri 2a str. 301
uuauucaggcccgccagcgcc

SEQ ID NO: 3899457 - RNA, 22 nt, Shigella flexneri 2a str. 301
uuauucaugccuguauugguuu

SEQ ID NO: 3899458 - RNA, 16 nt, Shigella flexneri 2a str. 301
uuauuccauccugcuc

SEQ ID NO: 3899459 - RNA, 12 nt, Shigella flexneri 2a str. 301
uuauugauaacc

SEQ ID NO: 3899460 - RNA, 15 nt, Shigella flexneri 2a str. 301
uuauugauuaaagga

SEQ ID NO: 3899461 - RNA, 19 nt, Shigella flexneri 2a str. 301
uuauugggcgaaagaaaag

SEQ ID NO: 3899462 - RNA, 14 nt, Shigella flexneri 2a str. 301
uuauuguagccugc

SEQ ID NO: 3899463 - RNA, 23 nt, Shigella flexneri 2a str. 301
uuauuucaacagauuacauuaaa

SEQ ID NO: 3899464 - RNA, 19 nt, Shigella flexneri 2a str. 301
uuauuucaaugcauuauca

SEQ ID NO: 3899465 - RNA, 14 nt, Shigella flexneri 2a str. 301
uuauuucauguuug

SEQ ID NO: 3899466 - RNA, 14 nt, Shigella flexneri 2a str. 301
uuauuuccugcauu

SEQ ID NO: 3899467 - RNA, 17 nt, Shigella flexneri 2a str. 301
uuauuuggugaauauga

SEQ ID NO: 3899468 - RNA, 17 nt, Shigella flexneri 2a str. 301
uuauuuugcccugcuau

SEQ ID NO: 3899469 - RNA, 15 nt, Shigella flexneri 2a str. 301
uucaaaaacaaagaa

SEQ ID NO: 3899470 - RNA, 17 nt, Shigella flexneri 2a str. 301
uucaaaaaccugaccua

SEQ ID NO: 3899471 - RNA, 20 nt, Shigella flexneri 2a str. 301
uucaaaaacuaauucaccuu

SEQ ID NO: 3899472 - RNA, 20 nt, Shigella flexneri 2a str. 301
uucaaaaauaaguugccacg

SEQ ID NO: 3899473 - RNA, 16 nt, Shigella flexneri 2a str. 301
uucaaaagaugagaaa

SEQ ID NO: 3899474 - RNA, 21 nt, Shigella flexneri 2a str. 301
uucaaacgcuucuggcgacau

SEQ ID NO: 3899475 - RNA, 22 nt, Shigella flexneri 2a str. 301
uucaaacugaagauugaacagc

SEQ ID NO: 3899476 - RNA, 12 nt, Shigella flexneri 2a str. 301
uucaaagcgauu

SEQ ID NO: 3899477 - RNA, 17 nt, Shigella flexneri 2a str. 301
uucaaagguaaugguca

SEQ ID NO: 3899478 - RNA, 20 nt, Shigella flexneri 2a str. 301
uucaaaguaauauucaacgu

SEQ ID NO: 3899479 - RNA, 23 nt, Shigella flexneri 2a str. 301
uucaaagugauauccaccgcguu

SEQ ID NO: 3899480 - RNA, 18 nt, Shigella flexneri 2a str. 301
uucaaaucauuacaguuu

SEQ ID NO: 3899481 - RNA, 17 nt, Shigella flexneri 2a str. 301
uucaaauccucaaugac

SEQ ID NO: 3899482 - RNA, 14 nt, Shigella flexneri 2a str. 301
uucaaauccuucag

SEQ ID NO: 3899483 - RNA, 17 nt, Shigella flexneri 2a str. 301
uucaaauccuucagacu

SEQ ID NO: 3899484 - RNA, 21 nt, Shigella flexneri 2a str. 301
uucaaaucgacgcgugaaaau

SEQ ID NO: 3899485 - RNA, 22 nt, Shigella flexneri 2a str. 301
uucaaauuacgauccaccaccg

SEQ ID NO: 3899486 - RNA, 16 nt, Shigella flexneri 2a str. 301
uucaaauuaugucuca

SEQ ID NO: 3899487 - RNA, 18 nt, Shigella flexneri 2a str. 301
uucaacacacugaauaaa

SEQ ID NO: 3899488 - RNA, 19 nt, Shigella flexneri 2a str. 301
uucaacagauuacauuaaa

SEQ ID NO: 3899489 - RNA, 21 nt, Shigella flexneri 2a str. 301
uucaacagguuaacucccccu

SEQ ID NO: 3899490 - RNA, 23 nt, Shigella flexneri 2a str. 301
uucaacagguuuuguugcccagc

SEQ ID NO: 3899491 - RNA, 22 nt, Shigella flexneri 2a str. 301
uucaacaguaaacucgacuuuc

SEQ ID NO: 3899492 - RNA, 15 nt, Shigella flexneri 2a str. 301
uucaacagucgccac

SEQ ID NO: 3899493 - RNA, 22 nt, Shigella flexneri 2a str. 301
uucaacauauccuucacacaua

SEQ ID NO: 3899494 - RNA, 18 nt, Shigella flexneri 2a str. 301
uucaacaucaucucccac

SEQ ID NO: 3899495 - RNA, 17 nt, Shigella flexneri 2a str. 301
uucaaccauucgcgcac

SEQ ID NO: 3899496 - RNA, 21 nt, Shigella flexneri 2a str. 301
uucaaccuaaaguaaaggaac

SEQ ID NO: 3899497 - RNA, 15 nt, Shigella flexneri 2a str. 301
uucaacgaagaaaac

SEQ ID NO: 3899498 - RNA, 23 nt, Shigella flexneri 2a str. 301
uucaacgacccagccagacgcca

SEQ ID NO: 3899499 - RNA, 22 nt, Shigella flexneri 2a str. 301
uucaacgccccauuuuuaauaa

SEQ ID NO: 3899500 - RNA, 23 nt, Shigella flexneri 2a str. 301
uucaacggacgauuugccgucuc

SEQ ID NO: 3899501 - RNA, 13 nt, Shigella flexneri 2a str. 301
uucaacuucagca

SEQ ID NO: 3899502 - RNA, 18 nt, Shigella flexneri 2a str. 301
uucaagaauuaaaauauc

SEQ ID NO: 3899503 - RNA, 19 nt, Shigella flexneri 2a str. 301
uucaagacaucaauaaaca

SEQ ID NO: 3899504 - RNA, 22 nt, Shigella flexneri 2a str. 301
uucaagacgaauaccuucuucc

SEQ ID NO: 3899505 - RNA, 23 nt, Shigella flexneri 2a str. 301
uucaagacgaauaccuucuuccu

SEQ ID NO: 3899506 - RNA, 19 nt, Shigella flexneri 2a str. 301
uucaagccaggcuuuaaau

SEQ ID NO: 3899507 - RNA, 22 nt, Shigella flexneri 2a str. 301
uucaagcucaaaauaauacaca

SEQ ID NO: 3899508 - RNA, 14 nt, Shigella flexneri 2a str. 301
uucaaguccccccc

SEQ ID NO: 3899509 - RNA, 22 nt, Shigella flexneri 2a str. 301
uucaaguccccccccucgcacc

SEQ ID NO: 3899510 - RNA, 23 nt, Shigella flexneri 2a str. 301
uucaagucccguccucgguacca

SEQ ID NO: 3899511 - RNA, 23 nt, Shigella flexneri 2a str. 301
uucaagucucggaagguuucuuc

SEQ ID NO: 3899512 - RNA, 16 nt, Shigella flexneri 2a str. 301
uucaauaaccugcaaa

SEQ ID NO: 3899513 - RNA, 15 nt, Shigella flexneri 2a str. 301
uucaauaacuccauc

SEQ ID NO: 3899514 - RNA, 18 nt, Shigella flexneri 2a str. 301
uucaauaccgccugcaaa

SEQ ID NO: 3899515 - RNA, 21 nt, Shigella flexneri 2a str. 301
uucaauaccgccugcaaauaa

SEQ ID NO: 3899516 - RNA, 22 nt, Shigella flexneri 2a str. 301
uucaauacgcuccaguaccugc

SEQ ID NO: 3899517 - RNA, 21 nt, Shigella flexneri 2a str. 301
uucaauauauugaauuugcau

SEQ ID NO: 3899518 - RNA, 21 nt, Shigella flexneri 2a str. 301
uucaauauauugcugaaauaa

SEQ ID NO: 3899519 - RNA, 18 nt, Shigella flexneri 2a str. 301
uucaauauggaaguuuug

SEQ ID NO: 3899520 - RNA, 23 nt, Shigella flexneri 2a str. 301
uucagcaauucucucuucagcuu

SEQ ID NO: 3899521 - RNA, 22 nt, Shigella flexneri 2a str. 301
uucagcaccgcgcuauuuuccu

SEQ ID NO: 3899522 - RNA, 14 nt, Shigella flexneri 2a str. 301
uucagcagcggcac

SEQ ID NO: 3899523 - RNA, 20 nt, Shigella flexneri 2a str. 301
uucagcagcucaucaagcug

SEQ ID NO: 3899524 - RNA, 17 nt, Shigella flexneri 2a str. 301
uucagcaguucugccag

SEQ ID NO: 3899525 - RNA, 18 nt, Shigella flexneri 2a str. 301
uucagccaguugaucucu

SEQ ID NO: 3899526 - RNA, 21 nt, Shigella flexneri 2a str. 301
uucagccauacguugcauaaa

SEQ ID NO: 3899527 - RNA, 15 nt, Shigella flexneri 2a str. 301
uucagccccagcacu

SEQ ID NO: 3899528 - RNA, 16 nt, Shigella flexneri 2a str. 301
uucagcgaaaaagucc

SEQ ID NO: 3899529 - RNA, 19 nt, Shigella flexneri 2a str. 301
uucagcgccugauacagcc

SEQ ID NO: 3899530 - RNA, 15 nt, Shigella flexneri 2a str. 301
uucagcgcgacgcuc

SEQ ID NO: 3899531 - RNA, 14 nt, Shigella flexneri 2a str. 301
uucagcggcacugu

SEQ ID NO: 3899532 - RNA, 21 nt, Shigella flexneri 2a str. 301
uucagcgucgugaaacgcguc

SEQ ID NO: 3899533 - RNA, 14 nt, Shigella flexneri 2a str. 301
uucagcgugcccac

SEQ ID NO: 3899534 - RNA, 16 nt, Shigella flexneri 2a str. 301
uucagcguuccccaga

SEQ ID NO: 3899535 - RNA, 16 nt, Shigella flexneri 2a str. 301
uucagcucaagaaucu

SEQ ID NO: 3899536 - RNA, 16 nt, Shigella flexneri 2a str. 301
uucagcucgcuaaagc

SEQ ID NO: 3899537 - RNA, 17 nt, Shigella flexneri 2a str. 301
uucagcuuauucaucaa

SEQ ID NO: 3899538 - RNA, 20 nt, Shigella flexneri 2a str. 301
uucagcuuuuuagcgaucuc

SEQ ID NO: 3899539 - RNA, 23 nt, Shigella flexneri 2a str. 301
uucaggaaacugcgcccgcuuuu

SEQ ID NO: 3899540 - RNA, 16 nt, Shigella flexneri 2a str. 301
uucaggaaauaaauaa

SEQ ID NO: 3899541 - RNA, 16 nt, Shigella flexneri 2a str. 301
uucaggaacaccgcac

SEQ ID NO: 3899542 - RNA, 21 nt, Shigella flexneri 2a str. 301
uucaggaacaccgcacgcaga

SEQ ID NO: 3899543 - RNA, 16 nt, Shigella flexneri 2a str. 301
uucaggaauucagaaa

SEQ ID NO: 3899544 - RNA, 19 nt, Shigella flexneri 2a str. 301
uucaggaauucagaaaaau

SEQ ID NO: 3899545 - RNA, 15 nt, Shigella flexneri 2a str. 301
uucaggaugguauug

SEQ ID NO: 3899546 - RNA, 23 nt, Shigella flexneri 2a str. 301
uucaggauggucaacgucaacuu

SEQ ID NO: 3899547 - RNA, 19 nt, Shigella flexneri 2a str. 301
uucaggccgccgucaucac

SEQ ID NO: 3899548 - RNA, 17 nt, Shigella flexneri 2a str. 301
uucagggccgauauagc

SEQ ID NO: 3899549 - RNA, 17 nt, Shigella flexneri 2a str. 301
uucaggguaugaauggc

SEQ ID NO: 3899550 - RNA, 10 nt, Shigella flexneri 2a str. 301
uucaggucag

SEQ ID NO: 3899551 - RNA, 20 nt, Shigella flexneri 2a str. 301
uucagguuacgcccuucacc

SEQ ID NO: 3899552 - RNA, 16 nt, Shigella flexneri 2a str. 301
uucagguuguuuucug

SEQ ID NO: 3899553 - RNA, 14 nt, Shigella flexneri 2a str. 301
uucaguaaugaagg

SEQ ID NO: 3899554 - RNA, 18 nt, Shigella flexneri 2a str. 301
uucaguacgaaauaacug

SEQ ID NO: 3899555 - RNA, 14 nt, Shigella flexneri 2a str. 301
uucaguacguucac

SEQ ID NO: 3899556 - RNA, 15 nt, Shigella flexneri 2a str. 301
uucaguaugguauua

SEQ ID NO: 3899557 - RNA, 15 nt, Shigella flexneri 2a str. 301
uucaguauugagcaa

SEQ ID NO: 3899558 - RNA, 19 nt, Shigella flexneri 2a str. 301
uucagugacuucugccagc

SEQ ID NO: 3899559 - RNA, 14 nt, Shigella flexneri 2a str. 301
uucagugcaaaugc

SEQ ID NO: 3899560 - RNA, 19 nt, Shigella flexneri 2a str. 301
uucaguggcuuaucuuccu

SEQ ID NO: 3899561 - RNA, 23 nt, Shigella flexneri 2a str. 301
uucaguguccagcggcauaaaac

SEQ ID NO: 3899562 - RNA, 16 nt, Shigella flexneri 2a str. 301
uucaguucagaaagca

SEQ ID NO: 3899563 - RNA, 19 nt, Shigella flexneri 2a str. 301
uucaguuugccgcucaguu

SEQ ID NO: 3899564 - RNA, 23 nt, Shigella flexneri 2a str. 301
uucauaaacacgguuuuucauug

SEQ ID NO: 3899565 - RNA, 19 nt, Shigella flexneri 2a str. 301
uucauaaagagguggggga

SEQ ID NO: 3899566 - RNA, 20 nt, Shigella flexneri 2a str. 301
uucauaauauauaaagauuc

SEQ ID NO: 3899567 - RNA, 22 nt, Shigella flexneri 2a str. 301
uucauacccugaaucaaucaga

SEQ ID NO: 3899568 - RNA, 12 nt, Shigella flexneri 2a str. 301
uucauacugccg

SEQ ID NO: 3899569 - RNA, 17 nt, Shigella flexneri 2a str. 301
uucauagauagccagca

SEQ ID NO: 3899570 - RNA, 18 nt, Shigella flexneri 2a str. 301
uucauaggcuuccacuuc

SEQ ID NO: 3899571 - RNA, 16 nt, Shigella flexneri 2a str. 301
uucauauccgucauau

SEQ ID NO: 3899572 - RNA, 13 nt, Shigella flexneri 2a str. 301
uucauaucugcca

SEQ ID NO: 3899573 - RNA, 18 nt, Shigella flexneri 2a str. 301
uucauauucaauuugcaa

SEQ ID NO: 3899574 - RNA, 15 nt, Shigella flexneri 2a str. 301
uucaucacaccaguc

SEQ ID NO: 3899575 - RNA, 18 nt, Shigella flexneri 2a str. 301
uucaucacgaaaaucauu

SEQ ID NO: 3899576 - RNA, 23 nt, Shigella flexneri 2a str. 301
uucaucacugaauuucgccgcac

SEQ ID NO: 3899577 - RNA, 20 nt, Shigella flexneri 2a str. 301
uucaucacuugauccauauc

SEQ ID NO: 3899578 - RNA, 17 nt, Shigella flexneri 2a str. 301
uucaucauccucuucag

SEQ ID NO: 3899579 - RNA, 24 nt, Shigella flexneri 2a str. 301
uucaucauccuuugggcauuugca

SEQ ID NO: 3899580 - RNA, 17 nt, Shigella flexneri 2a str. 301
uucaucccucucaucca

SEQ ID NO: 3899581 - RNA, 14 nt, Shigella flexneri 2a str. 301
uucauccguuuccc

SEQ ID NO: 3899582 - RNA, 22 nt, Shigella flexneri 2a str. 301
uucauccuguacgacaaaagaa

SEQ ID NO: 3899583 - RNA, 23 nt, Shigella flexneri 2a str. 301
uucauccuguacgacaaaagaau

SEQ ID NO: 3899584 - RNA, 19 nt, Shigella flexneri 2a str. 301
uucaucgcggucagcugcu

SEQ ID NO: 3899585 - RNA, 15 nt, Shigella flexneri 2a str. 301
uucaucgcuaaaaua

SEQ ID NO: 3899586 - RNA, 23 nt, Shigella flexneri 2a str. 301
uucaucggcggugaccagcagca

SEQ ID NO: 3899587 - RNA, 14 nt, Shigella flexneri 2a str. 301
uucaucgugcucgc

SEQ ID NO: 3899588 - RNA, 13 nt, Shigella flexneri 2a str. 301
uucaucucaaaca

SEQ ID NO: 3899589 - RNA, 13 nt, Shigella flexneri 2a str. 301
uucaucucaguga

SEQ ID NO: 3899590 - RNA, 18 nt, Shigella flexneri 2a str. 301
uucaucucuucacgcuuu

SEQ ID NO: 3899591 - RNA, 15 nt, Shigella flexneri 2a str. 301
uucaucucuucuucc

SEQ ID NO: 3899592 - RNA, 11 nt, Shigella flexneri 2a str. 301
uucaucugccu

SEQ ID NO: 3899593 - RNA, 13 nt, Shigella flexneri 2a str. 301
uucaucuucaguc

SEQ ID NO: 3899594 - RNA, 18 nt, Shigella flexneri 2a str. 301
uucaucuucauccggcug

SEQ ID NO: 3899595 - RNA, 22 nt, Shigella flexneri 2a str. 301
uucaucuucuucgaaacguucc

SEQ ID NO: 3899596 - RNA, 20 nt, Shigella flexneri 2a str. 301
uucaucuuuccaaaccucag

SEQ ID NO: 3899597 - RNA, 19 nt, Shigella flexneri 2a str. 301
uucaugaucuuuuuugucg

SEQ ID NO: 3899598 - RNA, 17 nt, Shigella flexneri 2a str. 301
uucaugcaggccauguu

SEQ ID NO: 3899599 - RNA, 15 nt, Shigella flexneri 2a str. 301
uucaugccauccgca

SEQ ID NO: 3899600 - RNA, 20 nt, Shigella flexneri 2a str. 301
uucaugccuguauugguuuc

SEQ ID NO: 3899601 - RNA, 16 nt, Shigella flexneri 2a str. 301
uucaugcgaauacacc

SEQ ID NO: 3899602 - RNA, 17 nt, Shigella flexneri 2a str. 301
uucaugcuauuccuuga

SEQ ID NO: 3899603 - RNA, 22 nt, Shigella flexneri 2a str. 301
uucaugcugacaucaagccaga

SEQ ID NO: 3899604 - RNA, 21 nt, Shigella flexneri 2a str. 301
uucaugguacgggacagcagg

SEQ ID NO: 3899605 - RNA, 22 nt, Shigella flexneri 2a str. 301
uucaugguacgggacagcaggu

SEQ ID NO: 3899606 - RNA, 20 nt, Shigella flexneri 2a str. 301
uucauguucagauuguugau

SEQ ID NO: 3899607 - RNA, 15 nt, Shigella flexneri 2a str. 301
uucauuaaagccgcc

SEQ ID NO: 3899608 - RNA, 16 nt, Shigella flexneri 2a str. 301
uucauuaccaaccuga

SEQ ID NO: 3899609 - RNA, 20 nt, Shigella flexneri 2a str. 301
uucauuaccuuuuuucccuu

SEQ ID NO: 3899610 - RNA, 12 nt, Shigella flexneri 2a str. 301
uucauuccuuga

SEQ ID NO: 3899611 - RNA, 22 nt, Shigella flexneri 2a str. 301
uucauugaacgggugauuuccc

SEQ ID NO: 3899612 - RNA, 23 nt, Shigella flexneri 2a str. 301
uucauugaacgggugauuucccc

SEQ ID NO: 3899613 - RNA, 15 nt, Shigella flexneri 2a str. 301
uucauuguucuccca

SEQ ID NO: 3899614 - RNA, 12 nt, Shigella flexneri 2a str. 301
uucauuguugac

SEQ ID NO: 3899615 - RNA, 13 nt, Shigella flexneri 2a str. 301
uucauuguugacu

SEQ ID NO: 3899616 - RNA, 13 nt, Shigella flexneri 2a str. 301
uucauuuacauca

SEQ ID NO: 3899617 - RNA, 13 nt, Shigella flexneri 2a str. 301
uucauuugccagc

SEQ ID NO: 3899618 - RNA, 21 nt, Shigella flexneri 2a str. 301
uucauuugccagcuucagcgc

SEQ ID NO: 3899619 - RNA, 15 nt, Shigella flexneri 2a str. 301
uucauuuuggcgaau

SEQ ID NO: 3899620 - RNA, 20 nt, Shigella flexneri 2a str. 301
uuccgcgucaaucugcccga

SEQ ID NO: 3899621 - RNA, 17 nt, Shigella flexneri 2a str. 301
uuccgcguuacccauuc

SEQ ID NO: 3899622 - RNA, 21 nt, Shigella flexneri 2a str. 301
uuccgcugcaaguuuugucag

SEQ ID NO: 3899623 - RNA, 14 nt, Shigella flexneri 2a str. 301
uuccgcuucugcuu

SEQ ID NO: 3899624 - RNA, 22 nt, Shigella flexneri 2a str. 301
uuccggaucgccaaagcggcag

SEQ ID NO: 3899625 - RNA, 15 nt, Shigella flexneri 2a str. 301
uuccggcaccacaaa

SEQ ID NO: 3899626 - RNA, 23 nt, Shigella flexneri 2a str. 301
uuccggcagaagcaaucauccca

SEQ ID NO: 3899627 - RNA, 18 nt, Shigella flexneri 2a str. 301
uuccggcagcauguguaa

SEQ ID NO: 3899628 - RNA, 15 nt, Shigella flexneri 2a str. 301
uuccggccaucgccu

SEQ ID NO: 3899629 - RNA, 17 nt, Shigella flexneri 2a str. 301
uuccggcguccaccugc

SEQ ID NO: 3899630 - RNA, 14 nt, Shigella flexneri 2a str. 301
uuccggcuuguuca

SEQ ID NO: 3899631 - RNA, 20 nt, Shigella flexneri 2a str. 301
uuccgggaucugauucugau

SEQ ID NO: 3899632 - RNA, 13 nt, Shigella flexneri 2a str. 301
uuccguaccagcc

SEQ ID NO: 3899633 - RNA, 14 nt, Shigella flexneri 2a str. 301
uuccguaccagccu

SEQ ID NO: 3899634 - RNA, 15 nt, Shigella flexneri 2a str. 301
uuccgucagcaaagu

SEQ ID NO: 3899635 - RNA, 15 nt, Shigella flexneri 2a str. 301
uuccgucagcggcaa

SEQ ID NO: 3899636 - RNA, 13 nt, Shigella flexneri 2a str. 301
uuccgucaucuua

SEQ ID NO: 3899637 - RNA, 19 nt, Shigella flexneri 2a str. 301
uuccguucaaaacagcccu

SEQ ID NO: 3899638 - RNA, 15 nt, Shigella flexneri 2a str. 301
uuccucauuucccug

SEQ ID NO: 3899639 - RNA, 11 nt, Shigella flexneri 2a str. 301
uuccuccauuu

SEQ ID NO: 3899640 - RNA, 18 nt, Shigella flexneri 2a str. 301
uuccucgucccaaaagcu

SEQ ID NO: 3899641 - RNA, 24 nt, Shigella flexneri 2a str. 301
uuccucuucgcguaacugaagcau

SEQ ID NO: 3899642 - RNA, 16 nt, Shigella flexneri 2a str. 301
uuccugaacucgccag

SEQ ID NO: 3899643 - RNA, 18 nt, Shigella flexneri 2a str. 301
uuccugaacucgccagcc

SEQ ID NO: 3899644 - RNA, 13 nt, Shigella flexneri 2a str. 301
uuccugagaggau

SEQ ID NO: 3899645 - RNA, 18 nt, Shigella flexneri 2a str. 301
uuccugagcacuggggcu

SEQ ID NO: 3899646 - RNA, 16 nt, Shigella flexneri 2a str. 301
uuccugaguaauaacu

SEQ ID NO: 3899647 - RNA, 15 nt, Shigella flexneri 2a str. 301
uuccugagugaauau

SEQ ID NO: 3899648 - RNA, 19 nt, Shigella flexneri 2a str. 301
uuccugauacaugaaugau

SEQ ID NO: 3899649 - RNA, 16 nt, Shigella flexneri 2a str. 301
uuccugcaacuucucu

SEQ ID NO: 3899650 - RNA, 15 nt, Shigella flexneri 2a str. 301
uuccugccaguuuuu

SEQ ID NO: 3899651 - RNA, 17 nt, Shigella flexneri 2a str. 301
uuccugcgcuuccagcu

SEQ ID NO: 3899652 - RNA, 22 nt, Shigella flexneri 2a str. 301
uuccugcggagcaaccugcacg

SEQ ID NO: 3899653 - RNA, 22 nt, Shigella flexneri 2a str. 301
uuccugcggcagacgcucgcca

SEQ ID NO: 3899654 - RNA, 23 nt, Shigella flexneri 2a str. 301
uuccugcggcagacgcucgccau

SEQ ID NO: 3899655 - RNA, 14 nt, Shigella flexneri 2a str. 301
uuccugcgucgcua

SEQ ID NO: 3899656 - RNA, 21 nt, Shigella flexneri 2a str. 301
uuccuggaaccagugaauacu

SEQ ID NO: 3899657 - RNA, 19 nt, Shigella flexneri 2a str. 301
uuccuggagaguguuuuau

SEQ ID NO: 3899658 - RNA, 17 nt, Shigella flexneri 2a str. 301
uuccuggucggcaaacu

SEQ ID NO: 3899659 - RNA, 22 nt, Shigella flexneri 2a str. 301
uuccuggucggcaaacugcuga

SEQ ID NO: 3899660 - RNA, 21 nt, Shigella flexneri 2a str. 301
uuccugguucucacuguucac

SEQ ID NO: 3899661 - RNA, 20 nt, Shigella flexneri 2a str. 301
uuccuguagcguuaccagca

SEQ ID NO: 3899662 - RNA, 15 nt, Shigella flexneri 2a str. 301
uuccuuaacauccau

SEQ ID NO: 3899663 - RNA, 17 nt, Shigella flexneri 2a str. 301
uuccuuaacauccaucg

SEQ ID NO: 3899664 - RNA, 16 nt, Shigella flexneri 2a str. 301
uuccuuaugacuacga

SEQ ID NO: 3899665 - RNA, 20 nt, Shigella flexneri 2a str. 301
uuccuucgcuuccuguauau

SEQ ID NO: 3899666 - RNA, 15 nt, Shigella flexneri 2a str. 301
uuccuugaaaaagag

SEQ ID NO: 3899667 - RNA, 19 nt, Shigella flexneri 2a str. 301
uuccuugaaaaagagguug

SEQ ID NO: 3899668 - RNA, 16 nt, Shigella flexneri 2a str. 301
uuccuuggauauuuua

SEQ ID NO: 3899669 - RNA, 17 nt, Shigella flexneri 2a str. 301
uucgaaaaaaaagaaga

SEQ ID NO: 3899670 - RNA, 18 nt, Shigella flexneri 2a str. 301
uucgaaaaaaaagaagac

SEQ ID NO: 3899671 - RNA, 21 nt, Shigella flexneri 2a str. 301
uucgaaaaaaaagaagaccug

SEQ ID NO: 3899672 - RNA, 20 nt, Shigella flexneri 2a str. 301
uucgaaaauggccucggcua

SEQ ID NO: 3899673 - RNA, 20 nt, Shigella flexneri 2a str. 301
uucgaaaccacccaccgcac

SEQ ID NO: 3899674 - RNA, 19 nt, Shigella flexneri 2a str. 301
uucgaaauagagaaaguaa

SEQ ID NO: 3899675 - RNA, 22 nt, Shigella flexneri 2a str. 301
uucgaaccacaaaagacgauag

SEQ ID NO: 3899676 - RNA, 18 nt, Shigella flexneri 2a str. 301
uucgaauauucugaagca

SEQ ID NO: 3899677 - RNA, 15 nt, Shigella flexneri 2a str. 301
uucgacaacugcuga

SEQ ID NO: 3899678 - RNA, 18 nt, Shigella flexneri 2a str. 301
uucgaccagccaggccgc

SEQ ID NO: 3899679 - RNA, 17 nt, Shigella flexneri 2a str. 301
uucgaccggguuucuua

SEQ ID NO: 3899680 - RNA, 12 nt, Shigella flexneri 2a str. 301
uucgacuucauc

SEQ ID NO: 3899681 - RNA, 20 nt, Shigella flexneri 2a str. 301
uucgagaagcaagcauuaua

SEQ ID NO: 3899682 - RNA, 18 nt, Shigella flexneri 2a str. 301
uucgagcaggucagucag

SEQ ID NO: 3899683 - RNA, 22 nt, Shigella flexneri 2a str. 301
uucgagcaucacaucaaauccc

SEQ ID NO: 3899684 - RNA, 15 nt, Shigella flexneri 2a str. 301
uucgaguacauccac

SEQ ID NO: 3899685 - RNA, 17 nt, Shigella flexneri 2a str. 301
uucgauaaacucaauca

SEQ ID NO: 3899686 - RNA, 14 nt, Shigella flexneri 2a str. 301
uucgauaaucaaau

SEQ ID NO: 3899687 - RNA, 14 nt, Shigella flexneri 2a str. 301
uucgaugagagcgg

SEQ ID NO: 3899688 - RNA, 14 nt, Shigella flexneri 2a str. 301
uucgauugcacaaa

SEQ ID NO: 3899689 - RNA, 15 nt, Shigella flexneri 2a str. 301
uucgcaaaaaaccau

SEQ ID NO: 3899690 - RNA, 20 nt, Shigella flexneri 2a str. 301
uucgcacaccgcugacuuuc

SEQ ID NO: 3899691 - RNA, 20 nt, Shigella flexneri 2a str. 301
uucgcacgaaccguaaaagc

SEQ ID NO: 3899692 - RNA, 20 nt, Shigella flexneri 2a str. 301
uucgcagagugauucuuugu

SEQ ID NO: 3899693 - RNA, 20 nt, Shigella flexneri 2a str. 301
uucgccaaaucgcugcugcu

SEQ ID NO: 3899694 - RNA, 19 nt, Shigella flexneri 2a str. 301
uucgccaggucagagagcc

SEQ ID NO: 3899695 - RNA, 16 nt, Shigella flexneri 2a str. 301
uucgccauuccuguag

SEQ ID NO: 3899696 - RNA, 15 nt, Shigella flexneri 2a str. 301
uucgcccgccagcgu

SEQ ID NO: 3899697 - RNA, 15 nt, Shigella flexneri 2a str. 301
uucgccgaacacaca

SEQ ID NO: 3899698 - RNA, 21 nt, Shigella flexneri 2a str. 301
uucgccgaugaaguacagccc

SEQ ID NO: 3899699 - RNA, 16 nt, Shigella flexneri 2a str. 301
uucgccgcacgcucaa

SEQ ID NO: 3899700 - RNA, 23 nt, Shigella flexneri 2a str. 301
uucgccgcagcaucgucaucauu

SEQ ID NO: 3899701 - RNA, 19 nt, Shigella flexneri 2a str. 301
uucgccgguuccagcuuca

SEQ ID NO: 3899702 - RNA, 15 nt, Shigella flexneri 2a str. 301
uucgccugaaauaau

SEQ ID NO: 3899703 - RNA, 19 nt, Shigella flexneri 2a str. 301
uucgccugcguacuggcau

SEQ ID NO: 3899704 - RNA, 15 nt, Shigella flexneri 2a str. 301
uucgcgaaucgccac

SEQ ID NO: 3899705 - RNA, 19 nt, Shigella flexneri 2a str. 301
uucgcgaaucgccacaacu

SEQ ID NO: 3899706 - RNA, 16 nt, Shigella flexneri 2a str. 301
uucgcgccaauccaga

SEQ ID NO: 3899707 - RNA, 18 nt, Shigella flexneri 2a str. 301
uucgcgccgcauccggca

SEQ ID NO: 3899708 - RNA, 23 nt, Shigella flexneri 2a str. 301
uucgcuaagauaccccagcgcaa

SEQ ID NO: 3899709 - RNA, 20 nt, Shigella flexneri 2a str. 301
uucgcuacgaucgauaacca

SEQ ID NO: 3899710 - RNA, 21 nt, Shigella flexneri 2a str. 301
uucgcuccccugcaaauuauu

SEQ ID NO: 3899711 - RNA, 17 nt, Shigella flexneri 2a str. 301
uucgcugaaaggcgauu

SEQ ID NO: 3899712 - RNA, 17 nt, Shigella flexneri 2a str. 301
uucgcugaauaccgauu

SEQ ID NO: 3899713 - RNA, 15 nt, Shigella flexneri 2a str. 301
uucgcugacaguacc

SEQ ID NO: 3899714 - RNA, 14 nt, Shigella flexneri 2a str. 301
uucgcugccacacc

SEQ ID NO: 3899715 - RNA, 16 nt, Shigella flexneri 2a str. 301
uucgcugccacaccau

SEQ ID NO: 3899716 - RNA, 18 nt, Shigella flexneri 2a str. 301
uucgcuggaauaaucgua

SEQ ID NO: 3899717 - RNA, 21 nt, Shigella flexneri 2a str. 301
uucgcuuaccaugccaacgcg

SEQ ID NO: 3899718 - RNA, 20 nt, Shigella flexneri 2a str. 301
uucggacauguuuuccagca

SEQ ID NO: 3899719 - RNA, 17 nt, Shigella flexneri 2a str. 301
uucggacguuugccaug

SEQ ID NO: 3899720 - RNA, 22 nt, Shigella flexneri 2a str. 301
uucuguagauaaaacacucuuu

SEQ ID NO: 3899721 - RNA, 23 nt, Shigella flexneri 2a str. 301
uucuguaugccggauaagguguu

SEQ ID NO: 3899722 - RNA, 20 nt, Shigella flexneri 2a str. 301
uucugucgauaaacucaugg

SEQ ID NO: 3899723 - RNA, 19 nt, Shigella flexneri 2a str. 301
uucugugcaaucgccgcug

SEQ ID NO: 3899724 - RNA, 19 nt, Shigella flexneri 2a str. 301
uucugugcagccaaaaaug

SEQ ID NO: 3899725 - RNA, 13 nt, Shigella flexneri 2a str. 301
uucugugcaucug

SEQ ID NO: 3899726 - RNA, 14 nt, Shigella flexneri 2a str. 301
uucuguugcugaaa

SEQ ID NO: 3899727 - RNA, 21 nt, Shigella flexneri 2a str. 301
uucuguugcugaaauuccauc

SEQ ID NO: 3899728 - RNA, 19 nt, Shigella flexneri 2a str. 301
uucuuaccccugauuuugu

SEQ ID NO: 3899729 - RNA, 17 nt, Shigella flexneri 2a str. 301
uucuuacgccgacuaau

SEQ ID NO: 3899730 - RNA, 16 nt, Shigella flexneri 2a str. 301
uucuuacuguagugcu

SEQ ID NO: 3899731 - RNA, 17 nt, Shigella flexneri 2a str. 301
uucuucaacaauugaag

SEQ ID NO: 3899732 - RNA, 20 nt, Shigella flexneri 2a str. 301
uucuucaacaccacuuuugc

SEQ ID NO: 3899733 - RNA, 16 nt, Shigella flexneri 2a str. 301
uucuucaacgaagaaa

SEQ ID NO: 3899734 - RNA, 17 nt, Shigella flexneri 2a str. 301
uucuucacggaaaauau

SEQ ID NO: 3899735 - RNA, 18 nt, Shigella flexneri 2a str. 301
uucuucacggaaaauauu

SEQ ID NO: 3899736 - RNA, 22 nt, Shigella flexneri 2a str. 301
uucuucagcguccgggaaaucc

SEQ ID NO: 3899737 - RNA, 21 nt, Shigella flexneri 2a str. 301
uucuucauucccggaaauugc

SEQ ID NO: 3899738 - RNA, 12 nt, Shigella flexneri 2a str. 301
uucuuccagcau

SEQ ID NO: 3899739 - RNA, 21 nt, Shigella flexneri 2a str. 301
uucuuccagcaucgcccccau

SEQ ID NO: 3899740 - RNA, 14 nt, Shigella flexneri 2a str. 301
uucuuccaguuccg

SEQ ID NO: 3899741 - RNA, 15 nt, Shigella flexneri 2a str. 301
uucuucccaaaucuu

SEQ ID NO: 3899742 - RNA, 11 nt, Shigella flexneri 2a str. 301
uucuuccuuga

SEQ ID NO: 3899743 - RNA, 15 nt, Shigella flexneri 2a str. 301
uucuuccuugaaaug

SEQ ID NO: 3899744 - RNA, 15 nt, Shigella flexneri 2a str. 301
uucuucgaagcacuc

SEQ ID NO: 3899745 - RNA, 22 nt, Shigella flexneri 2a str. 301
uucuucgauguguugcaaauaa

SEQ ID NO: 3899746 - RNA, 20 nt, Shigella flexneri 2a str. 301
uucuucgcuuucgaacaacu

SEQ ID NO: 3899747 - RNA, 17 nt, Shigella flexneri 2a str. 301
uucuucggucagagaau

SEQ ID NO: 3899748 - RNA, 23 nt, Shigella flexneri 2a str. 301
uucuucgguucguaagcaagaac

SEQ ID NO: 3899749 - RNA, 21 nt, Shigella flexneri 2a str. 301
uucuucguuaaacagcuugga

SEQ ID NO: 3899750 - RNA, 19 nt, Shigella flexneri 2a str. 301
uucuucuagcgcaauaacc

SEQ ID NO: 3899751 - RNA, 18 nt, Shigella flexneri 2a str. 301
uucuucucaaccuuuccu

SEQ ID NO: 3899752 - RNA, 15 nt, Shigella flexneri 2a str. 301
uucuucuucacuaag

SEQ ID NO: 3899753 - RNA, 14 nt, Shigella flexneri 2a str. 301
uucuucuucagcgc

SEQ ID NO: 3899754 - RNA, 15 nt, Shigella flexneri 2a str. 301
uucuucuucagcgcu

SEQ ID NO: 3899755 - RNA, 16 nt, Shigella flexneri 2a str. 301
uucuucuucugacuca

SEQ ID NO: 3899756 - RNA, 14 nt, Shigella flexneri 2a str. 301
uucuugccuuuccu

SEQ ID NO: 3899757 - RNA, 16 nt, Shigella flexneri 2a str. 301
uucuugcuguuugcga

SEQ ID NO: 3899758 - RNA, 14 nt, Shigella flexneri 2a str. 301
uucuuuaaauaugg

SEQ ID NO: 3899759 - RNA, 22 nt, Shigella flexneri 2a str. 301
uucuuuacugcccgcuugcgcc

SEQ ID NO: 3899760 - RNA, 18 nt, Shigella flexneri 2a str. 301
uucuuucgcccaauaaaa

SEQ ID NO: 3899761 - RNA, 23 nt, Shigella flexneri 2a str. 301
uucuuucgcccaauaaaaaacgc

SEQ ID NO: 3899762 - RNA, 23 nt, Shigella flexneri 2a str. 301
uucuuugcgcccccgauccagcg

SEQ ID NO: 3899763 - RNA, 13 nt, Shigella flexneri 2a str. 301
uucuuugcugccg

SEQ ID NO: 3899764 - RNA, 23 nt, Shigella flexneri 2a str. 301
uucuuugcugccguuaacccguc

SEQ ID NO: 3899765 - RNA, 15 nt, Shigella flexneri 2a str. 301
uucuuuuaccuucag

SEQ ID NO: 3899766 - RNA, 19 nt, Shigella flexneri 2a str. 301
uucuuuugcgguuaauggu

SEQ ID NO: 3899767 - RNA, 18 nt, Shigella flexneri 2a str. 301
uugaaaaaccagacgaua

SEQ ID NO: 3899768 - RNA, 20 nt, Shigella flexneri 2a str. 301
uugaaaaauaaagucuuagc

SEQ ID NO: 3899769 - RNA, 14 nt, Shigella flexneri 2a str. 301
uugaaaaaucaaaa

SEQ ID NO: 3899770 - RNA, 16 nt, Shigella flexneri 2a str. 301
uugaaaaaucaaaaaa

SEQ ID NO: 3899771 - RNA, 23 nt, Shigella flexneri 2a str. 301
uugaaaaaucaaaaaacuggaaa

SEQ ID NO: 3899772 - RNA, 23 nt, Shigella flexneri 2a str. 301
uugaaacgaaaucuuguuuuuuu

SEQ ID NO: 3899773 - RNA, 23 nt, Shigella flexneri 2a str. 301
uugaaacgaguggugucgucaaa

SEQ ID NO: 3899774 - RNA, 23 nt, Shigella flexneri 2a str. 301
uugaaacgauggugccgguacgc

SEQ ID NO: 3899775 - RNA, 16 nt, Shigella flexneri 2a str. 301
uugaaauauauccuau

SEQ ID NO: 3899776 - RNA, 13 nt, Shigella flexneri 2a str. 301
uugaaaucgaaca

SEQ ID NO: 3899777 - RNA, 18 nt, Shigella flexneri 2a str. 301
uugaaaucgaacagguug

SEQ ID NO: 3899778 - RNA, 22 nt, Shigella flexneri 2a str. 301
uugaaaugugguuucacuuucu

SEQ ID NO: 3899779 - RNA, 21 nt, Shigella flexneri 2a str. 301
uugaacaaccagaaagaugca

SEQ ID NO: 3899780 - RNA, 19 nt, Shigella flexneri 2a str. 301
uugaacauaucagcgcaaa

SEQ ID NO: 3899781 - RNA, 19 nt, Shigella flexneri 2a str. 301
uugaacccggcaucaacca

SEQ ID NO: 3899782 - RNA, 21 nt, Shigella flexneri 2a str. 301
uugaacggauauuuugccagg

SEQ ID NO: 3899783 - RNA, 16 nt, Shigella flexneri 2a str. 301
uugaacuuuaagcuga

SEQ ID NO: 3899784 - RNA, 16 nt, Shigella flexneri 2a str. 301
uugaagaguuugauca

SEQ ID NO: 3899785 - RNA, 12 nt, Shigella flexneri 2a str. 301
uugaagauuagc

SEQ ID NO: 3899786 - RNA, 20 nt, Shigella flexneri 2a str. 301
uugaagcaauccauaccagc

SEQ ID NO: 3899787 - RNA, 21 nt, Shigella flexneri 2a str. 301
uugaagcaauccauaccagca

SEQ ID NO: 3899788 - RNA, 22 nt, Shigella flexneri 2a str. 301
uugaagcgcggaacaaauacuu

SEQ ID NO: 3899789 - RNA, 16 nt, Shigella flexneri 2a str. 301
uugaaggcagcauucg

SEQ ID NO: 3899790 - RNA, 11 nt, Shigella flexneri 2a str. 301
uugaagucagg

SEQ ID NO: 3899791 - RNA, 15 nt, Shigella flexneri 2a str. 301
uugaaugucugucug

SEQ ID NO: 3899792 - RNA, 15 nt, Shigella flexneri 2a str. 301
uugaauugcucagua

SEQ ID NO: 3899793 - RNA, 14 nt, Shigella flexneri 2a str. 301
uugaauuuauguuu

SEQ ID NO: 3899794 - RNA, 18 nt, Shigella flexneri 2a str. 301
uugaauuuggaagaauuu

SEQ ID NO: 3899795 - RNA, 19 nt, Shigella flexneri 2a str. 301
uugacaagcucaccucuuu

SEQ ID NO: 3899796 - RNA, 22 nt, Shigella flexneri 2a str. 301
uugacauauaaccggcaacaga

SEQ ID NO: 3899797 - RNA, 14 nt, Shigella flexneri 2a str. 301
uugacauguugcug

SEQ ID NO: 3899798 - RNA, 14 nt, Shigella flexneri 2a str. 301
uugaccgccagcgc

SEQ ID NO: 3899799 - RNA, 16 nt, Shigella flexneri 2a str. 301
uugaccgccagcgcca

SEQ ID NO: 3899800 - RNA, 21 nt, Shigella flexneri 2a str. 301
uugacgagauagcgaaguaga

SEQ ID NO: 3899801 - RNA, 22 nt, Shigella flexneri 2a str. 301
uugacgagauagcgaaguagac

SEQ ID NO: 3899802 - RNA, 15 nt, Shigella flexneri 2a str. 301
uugacgccaaggagu

SEQ ID NO: 3899803 - RNA, 16 nt, Shigella flexneri 2a str. 301
uugacgcccccaaacu

SEQ ID NO: 3899804 - RNA, 18 nt, Shigella flexneri 2a str. 301
uugacgcgucuuaucagg

SEQ ID NO: 3899805 - RNA, 21 nt, Shigella flexneri 2a str. 301
uugacgcgucuuaucaggccu

SEQ ID NO: 3899806 - RNA, 21 nt, Shigella flexneri 2a str. 301
uugacgcuguuguuuuuucaa

SEQ ID NO: 3899807 - RNA, 13 nt, Shigella flexneri 2a str. 301
uugacguccagcc

SEQ ID NO: 3899808 - RNA, 15 nt, Shigella flexneri 2a str. 301
uugacuacaccauua

SEQ ID NO: 3899809 - RNA, 20 nt, Shigella flexneri 2a str. 301
uugacugaaaaguuaauguu

SEQ ID NO: 3899810 - RNA, 15 nt, Shigella flexneri 2a str. 301
uugacuggaugccag

SEQ ID NO: 3899811 - RNA, 21 nt, Shigella flexneri 2a str. 301
uugagaacgacagugacuucc

SEQ ID NO: 3899812 - RNA, 15 nt, Shigella flexneri 2a str. 301
uugagaauaaccucu

SEQ ID NO: 3899813 - RNA, 17 nt, Shigella flexneri 2a str. 301
uugagagugcgaaacga

SEQ ID NO: 3899814 - RNA, 17 nt, Shigella flexneri 2a str. 301
uugagcaggagcagcag

SEQ ID NO: 3899815 - RNA, 15 nt, Shigella flexneri 2a str. 301
uugagcaucugcaaa

SEQ ID NO: 3899816 - RNA, 20 nt, Shigella flexneri 2a str. 301
uugagccaaaaugccugaug

SEQ ID NO: 3899817 - RNA, 18 nt, Shigella flexneri 2a str. 301
uugagcuggucugaauca

SEQ ID NO: 3899818 - RNA, 14 nt, Shigella flexneri 2a str. 301
uugagcuugaacau

SEQ ID NO: 3899819 - RNA, 13 nt, Shigella flexneri 2a str. 301
uugccguugaucu

SEQ ID NO: 3899820 - RNA, 18 nt, Shigella flexneri 2a str. 301
uugccucguucuucccuc

SEQ ID NO: 3899821 - RNA, 14 nt, Shigella flexneri 2a str. 301
uugccugaucgcgc

SEQ ID NO: 3899822 - RNA, 19 nt, Shigella flexneri 2a str. 301
uugccugaucgcgcaaaca

SEQ ID NO: 3899823 - RNA, 20 nt, Shigella flexneri 2a str. 301
uugccugauggccugcucaa

SEQ ID NO: 3899824 - RNA, 19 nt, Shigella flexneri 2a str. 301
uugccugcgaagcucuuuc

SEQ ID NO: 3899825 - RNA, 15 nt, Shigella flexneri 2a str. 301
uugccugugcaaccu

SEQ ID NO: 3899826 - RNA, 18 nt, Shigella flexneri 2a str. 301
uugccugugcaaccuuuu

SEQ ID NO: 3899827 - RNA, 19 nt, Shigella flexneri 2a str. 301
uugccugugcaaccuuuuc

SEQ ID NO: 3899828 - RNA, 18 nt, Shigella flexneri 2a str. 301
uugcgaauuauaauuccu

SEQ ID NO: 3899829 - RNA, 15 nt, Shigella flexneri 2a str. 301
uugcgacgagaaaau

SEQ ID NO: 3899830 - RNA, 21 nt, Shigella flexneri 2a str. 301
uugcgcacaucaauuugccca

SEQ ID NO: 3899831 - RNA, 15 nt, Shigella flexneri 2a str. 301
uugcgcaguaccagc

SEQ ID NO: 3899832 - RNA, 16 nt, Shigella flexneri 2a str. 301
uugcgcauccagcgcu

SEQ ID NO: 3899833 - RNA, 16 nt, Shigella flexneri 2a str. 301
uugcgcauggcauuuu

SEQ ID NO: 3899834 - RNA, 12 nt, Shigella flexneri 2a str. 301
uugcgccagcgc

SEQ ID NO: 3899835 - RNA, 14 nt, Shigella flexneri 2a str. 301
uugcgccgucaugc

SEQ ID NO: 3899836 - RNA, 15 nt, Shigella flexneri 2a str. 301
uugcgccucaagaau

SEQ ID NO: 3899837 - RNA, 23 nt, Shigella flexneri 2a str. 301
uugcgccugauaaucugcugaac

SEQ ID NO: 3899838 - RNA, 15 nt, Shigella flexneri 2a str. 301
uugcgccuuuaauau

SEQ ID NO: 3899839 - RNA, 18 nt, Shigella flexneri 2a str. 301
uugcgcgacguugcuucu

SEQ ID NO: 3899840 - RNA, 15 nt, Shigella flexneri 2a str. 301
uugcgcgacuuuuuc

SEQ ID NO: 3899841 - RNA, 18 nt, Shigella flexneri 2a str. 301
uugcgcguaacgaucgcc

SEQ ID NO: 3899842 - RNA, 24 nt, Shigella flexneri 2a str. 301
uugcgcgucgcccaguucuacaau

SEQ ID NO: 3899843 - RNA, 18 nt, Shigella flexneri 2a str. 301
uugcgcuuuucuaccacc

SEQ ID NO: 3899844 - RNA, 13 nt, Shigella flexneri 2a str. 301
uugcggaugcagc

SEQ ID NO: 3899845 - RNA, 18 nt, Shigella flexneri 2a str. 301
uugcggcggcgcaaagcg

SEQ ID NO: 3899846 - RNA, 18 nt, Shigella flexneri 2a str. 301
uugcggcguauccggcuc

SEQ ID NO: 3899847 - RNA, 16 nt, Shigella flexneri 2a str. 301
uugcggcuauauucaa

SEQ ID NO: 3899848 - RNA, 19 nt, Shigella flexneri 2a str. 301
uugcggcuuuugaagcuga

SEQ ID NO: 3899849 - RNA, 14 nt, Shigella flexneri 2a str. 301
uugcguaucgacca

SEQ ID NO: 3899850 - RNA, 16 nt, Shigella flexneri 2a str. 301
uugcgucagcuucaga

SEQ ID NO: 3899851 - RNA, 13 nt, Shigella flexneri 2a str. 301
uugcgucgccagu

SEQ ID NO: 3899852 - RNA, 21 nt, Shigella flexneri 2a str. 301
uugcguuccaucagauucagc

SEQ ID NO: 3899853 - RNA, 19 nt, Shigella flexneri 2a str. 301
uugcuaaccaacaaugcaa

SEQ ID NO: 3899854 - RNA, 19 nt, Shigella flexneri 2a str. 301
uugcuaacuggaaaggaau

SEQ ID NO: 3899855 - RNA, 23 nt, Shigella flexneri 2a str. 301
uugcuaccccugagacaguuauu

SEQ ID NO: 3899856 - RNA, 15 nt, Shigella flexneri 2a str. 301
uugcucaagcugaac

SEQ ID NO: 3899857 - RNA, 19 nt, Shigella flexneri 2a str. 301
uugcucagaaucacgccaa

SEQ ID NO: 3899858 - RNA, 23 nt, Shigella flexneri 2a str. 301
uugcucaggaguaaacuuucccu

SEQ ID NO: 3899859 - RNA, 13 nt, Shigella flexneri 2a str. 301
uugcucauaaaau

SEQ ID NO: 3899860 - RNA, 14 nt, Shigella flexneri 2a str. 301
uugcucaucccgcc

SEQ ID NO: 3899861 - RNA, 12 nt, Shigella flexneri 2a str. 301
uugcuccagaaa

SEQ ID NO: 3899862 - RNA, 13 nt, Shigella flexneri 2a str. 301
uugcuccauccau

SEQ ID NO: 3899863 - RNA, 16 nt, Shigella flexneri 2a str. 301
uugcuccugcucauca

SEQ ID NO: 3899864 - RNA, 11 nt, Shigella flexneri 2a str. 301
uugcucgcacu

SEQ ID NO: 3899865 - RNA, 23 nt, Shigella flexneri 2a str. 301
uugcucuaacggucgcggaacau

SEQ ID NO: 3899866 - RNA, 16 nt, Shigella flexneri 2a str. 301
uugcucucgggcagua

SEQ ID NO: 3899867 - RNA, 16 nt, Shigella flexneri 2a str. 301
uugcucugcagcagcc

SEQ ID NO: 3899868 - RNA, 13 nt, Shigella flexneri 2a str. 301
uugcucuguuuuc

SEQ ID NO: 3899869 - RNA, 23 nt, Shigella flexneri 2a str. 301
uugcucuucuccggcuguuucag

SEQ ID NO: 3899870 - RNA, 15 nt, Shigella flexneri 2a str. 301
uugcugaaauacaga

SEQ ID NO: 3899871 - RNA, 23 nt, Shigella flexneri 2a str. 301
uugcugagaucaaacucuuucaa

SEQ ID NO: 3899872 - RNA, 20 nt, Shigella flexneri 2a str. 301
uugcugccgccaguucuucc

SEQ ID NO: 3899873 - RNA, 22 nt, Shigella flexneri 2a str. 301
uugcugccgccaguucuuccag

SEQ ID NO: 3899874 - RNA, 21 nt, Shigella flexneri 2a str. 301
uugcugccuucacggcuuugu

SEQ ID NO: 3899875 - RNA, 21 nt, Shigella flexneri 2a str. 301
uugcugcgacgcaaacgacga

SEQ ID NO: 3899876 - RNA, 20 nt, Shigella flexneri 2a str. 301
uugcugcgcccgcagcggcg

SEQ ID NO: 3899877 - RNA, 20 nt, Shigella flexneri 2a str. 301
uugcugcggcguuccccagu

SEQ ID NO: 3899878 - RNA, 17 nt, Shigella flexneri 2a str. 301
uugcugcugauccagcu

SEQ ID NO: 3899879 - RNA, 18 nt, Shigella flexneri 2a str. 301
uugcuggacgcauugcau

SEQ ID NO: 3899880 - RNA, 21 nt, Shigella flexneri 2a str. 301
uugcuggacgcauugcauuuc

SEQ ID NO: 3899881 - RNA, 22 nt, Shigella flexneri 2a str. 301
uugcuggacuugaaccagcgac

SEQ ID NO: 3899882 - RNA, 20 nt, Shigella flexneri 2a str. 301
uugcuggauaagaugcuaca

SEQ ID NO: 3899883 - RNA, 14 nt, Shigella flexneri 2a str. 301
uugcugguuuugua

SEQ ID NO: 3899884 - RNA, 21 nt, Shigella flexneri 2a str. 301
uugcuguaauuucacaccauc

SEQ ID NO: 3899885 - RNA, 15 nt, Shigella flexneri 2a str. 301
uugcugugcuuuaca

SEQ ID NO: 3899886 - RNA, 23 nt, Shigella flexneri 2a str. 301
uugcuuaaauacgccucuucaua

SEQ ID NO: 3899887 - RNA, 23 nt, Shigella flexneri 2a str. 301
uugcuucaauacgcuccaguacc

SEQ ID NO: 3899888 - RNA, 14 nt, Shigella flexneri 2a str. 301
uugcuucaccagca

SEQ ID NO: 3899889 - RNA, 17 nt, Shigella flexneri 2a str. 301
uugcuucaccagcagcg

SEQ ID NO: 3899890 - RNA, 16 nt, Shigella flexneri 2a str. 301
uugcuucguuuacugu

SEQ ID NO: 3899891 - RNA, 18 nt, Shigella flexneri 2a str. 301
uugcuucuaugaguggaa

SEQ ID NO: 3899892 - RNA, 12 nt, Shigella flexneri 2a str. 301
uugcuucugcuu

SEQ ID NO: 3899893 - RNA, 13 nt, Shigella flexneri 2a str. 301
uugcuucugcuuc

SEQ ID NO: 3899894 - RNA, 19 nt, Shigella flexneri 2a str. 301
uugcuuuuaccauacugga

SEQ ID NO: 3899895 - RNA, 17 nt, Shigella flexneri 2a str. 301
uuggaucugauccaaca

SEQ ID NO: 3899896 - RNA, 17 nt, Shigella flexneri 2a str. 301
uuggcacagaagucacc

SEQ ID NO: 3899897 - RNA, 13 nt, Shigella flexneri 2a str. 301
uuggcagaaacag

SEQ ID NO: 3899898 - RNA, 16 nt, Shigella flexneri 2a str. 301
uuggcagaaacagcca

SEQ ID NO: 3899899 - RNA, 14 nt, Shigella flexneri 2a str. 301
uuggcagacaacca

SEQ ID NO: 3899900 - RNA, 23 nt, Shigella flexneri 2a str. 301
uuggcagagcaacauacagugga

SEQ ID NO: 3899901 - RNA, 19 nt, Shigella flexneri 2a str. 301
uuggcauaaauaauaagag

SEQ ID NO: 3899902 - RNA, 19 nt, Shigella flexneri 2a str. 301
uuggcaucgauaucaacca

SEQ ID NO: 3899903 - RNA, 17 nt, Shigella flexneri 2a str. 301
uuggcaucguauuucag

SEQ ID NO: 3899904 - RNA, 21 nt, Shigella flexneri 2a str. 301
uuggcaucguauuucagaccu

SEQ ID NO: 3899905 - RNA, 16 nt, Shigella flexneri 2a str. 301
uuggccugacagguga

SEQ ID NO: 3899906 - RNA, 23 nt, Shigella flexneri 2a str. 301
uuggcgcgaaccaucaccucuuc

SEQ ID NO: 3899907 - RNA, 20 nt, Shigella flexneri 2a str. 301
uuggcgcucugacaccauca

SEQ ID NO: 3899908 - RNA, 15 nt, Shigella flexneri 2a str. 301
uuggcguaccauuaa

SEQ ID NO: 3899909 - RNA, 18 nt, Shigella flexneri 2a str. 301
uuggcucuucgcuccagu

SEQ ID NO: 3899910 - RNA, 20 nt, Shigella flexneri 2a str. 301
uuggcugagugaaucagaag

SEQ ID NO: 3899911 - RNA, 12 nt, Shigella flexneri 2a str. 301
uuggcuggcccu

SEQ ID NO: 3899912 - RNA, 17 nt, Shigella flexneri 2a str. 301
uuggcuucguguacaaa

SEQ ID NO: 3899913 - RNA, 14 nt, Shigella flexneri 2a str. 301
uugggaucgccagg

SEQ ID NO: 3899914 - RNA, 17 nt, Shigella flexneri 2a str. 301
uugggaugccgaaaaaa

SEQ ID NO: 3899915 - RNA, 18 nt, Shigella flexneri 2a str. 301
uugggauucagugguagc

SEQ ID NO: 3899916 - RNA, 15 nt, Shigella flexneri 2a str. 301
uugggcucaucaaua

SEQ ID NO: 3899917 - RNA, 20 nt, Shigella flexneri 2a str. 301
uuggggcauauuaucagcaa

SEQ ID NO: 3899918 - RNA, 13 nt, Shigella flexneri 2a str. 301
uuggguauucauu

SEQ ID NO: 3899919 - RNA, 22 nt, Shigella flexneri 2a str. 301
uuuaacuucgcguucuguggca

SEQ ID NO: 3899920 - RNA, 14 nt, Shigella flexneri 2a str. 301
uuuaacuuuaauuu

SEQ ID NO: 3899921 - RNA, 13 nt, Shigella flexneri 2a str. 301
uuuaaguuuaugg

SEQ ID NO: 3899922 - RNA, 23 nt, Shigella flexneri 2a str. 301
uuuaauaaucucgccuuaucaga

SEQ ID NO: 3899923 - RNA, 20 nt, Shigella flexneri 2a str. 301
uuuaauauccggugcauuca

SEQ ID NO: 3899924 - RNA, 16 nt, Shigella flexneri 2a str. 301
uuuaauauuaaaccac

SEQ ID NO: 3899925 - RNA, 13 nt, Shigella flexneri 2a str. 301
uuuaaucacacca

SEQ ID NO: 3899926 - RNA, 12 nt, Shigella flexneri 2a str. 301
uuuaaucaccug

SEQ ID NO: 3899927 - RNA, 16 nt, Shigella flexneri 2a str. 301
uuuaaugccaaucuuc

SEQ ID NO: 3899928 - RNA, 14 nt, Shigella flexneri 2a str. 301
uuuaauggauguaa

SEQ ID NO: 3899929 - RNA, 21 nt, Shigella flexneri 2a str. 301
uuuaauguccuggcgggaaua

SEQ ID NO: 3899930 - RNA, 17 nt, Shigella flexneri 2a str. 301
uuuaauuauccccucaa

SEQ ID NO: 3899931 - RNA, 12 nt, Shigella flexneri 2a str. 301
uuuaauucagga

SEQ ID NO: 3899932 - RNA, 12 nt, Shigella flexneri 2a str. 301
uuuaauuccugc

SEQ ID NO: 3899933 - RNA, 12 nt, Shigella flexneri 2a str. 301
uuuaauuuuuca

SEQ ID NO: 3899934 - RNA, 22 nt, Shigella flexneri 2a str. 301
uuuacagccggacccacacccc

SEQ ID NO: 3899935 - RNA, 18 nt, Shigella flexneri 2a str. 301
uuuacaggcucaaagacu

SEQ ID NO: 3899936 - RNA, 13 nt, Shigella flexneri 2a str. 301
uuuacaucaucag

SEQ ID NO: 3899937 - RNA, 21 nt, Shigella flexneri 2a str. 301
uuuacaucaucagaaaugcca

SEQ ID NO: 3899938 - RNA, 12 nt, Shigella flexneri 2a str. 301
uuuacaugcgcg

SEQ ID NO: 3899939 - RNA, 22 nt, Shigella flexneri 2a str. 301
uuuacaugcgcgacaaaaauua

SEQ ID NO: 3899940 - RNA, 17 nt, Shigella flexneri 2a str. 301
uuuacauguucaaaaaa

SEQ ID NO: 3899941 - RNA, 22 nt, Shigella flexneri 2a str. 301
uuuacauuaucgcgucuaaauu

SEQ ID NO: 3899942 - RNA, 19 nt, Shigella flexneri 2a str. 301
uuuacccaaacuuaacacu

SEQ ID NO: 3899943 - RNA, 21 nt, Shigella flexneri 2a str. 301
uuuaccccacgucaucuguca

SEQ ID NO: 3899944 - RNA, 21 nt, Shigella flexneri 2a str. 301
uuuacccgguuaaguaaaauc

SEQ ID NO: 3899945 - RNA, 14 nt, Shigella flexneri 2a str. 301
uuuacccuacacca

SEQ ID NO: 3899946 - RNA, 18 nt, Shigella flexneri 2a str. 301
uuuaccgcaacucauuua

SEQ ID NO: 3899947 - RNA, 17 nt, Shigella flexneri 2a str. 301
uuuaccggugccagcaa

SEQ ID NO: 3899948 - RNA, 21 nt, Shigella flexneri 2a str. 301
uuuaccguagcguucuuugag

SEQ ID NO: 3899949 - RNA, 14 nt, Shigella flexneri 2a str. 301
uuuaccgucaccga

SEQ ID NO: 3899950 - RNA, 16 nt, Shigella flexneri 2a str. 301
uuuaccucgaaaacca

SEQ ID NO: 3899951 - RNA, 15 nt, Shigella flexneri 2a str. 301
uuuaccucuuucuca

SEQ ID NO: 3899952 - RNA, 18 nt, Shigella flexneri 2a str. 301
uuuaccugcgccggucac

SEQ ID NO: 3899953 - RNA, 13 nt, Shigella flexneri 2a str. 301
uuuacgcaaccac

SEQ ID NO: 3899954 - RNA, 14 nt, Shigella flexneri 2a str. 301
uuuacgcaaccaca

SEQ ID NO: 3899955 - RNA, 12 nt, Shigella flexneri 2a str. 301
uuuacgccgcau

SEQ ID NO: 3899956 - RNA, 15 nt, Shigella flexneri 2a str. 301
uuuacgcuuuccagc

SEQ ID NO: 3899957 - RNA, 17 nt, Shigella flexneri 2a str. 301
uuuacggcugcauuaug

SEQ ID NO: 3899958 - RNA, 17 nt, Shigella flexneri 2a str. 301
uuuacggcuugcgcgca

SEQ ID NO: 3899959 - RNA, 12 nt, Shigella flexneri 2a str. 301
uuuacgucugca

SEQ ID NO: 3899960 - RNA, 18 nt, Shigella flexneri 2a str. 301
uuuacguucuuacauucc

SEQ ID NO: 3899961 - RNA, 17 nt, Shigella flexneri 2a str. 301
uuuacugauaauuuuuu

SEQ ID NO: 3899962 - RNA, 19 nt, Shigella flexneri 2a str. 301
uuuacugauaauuuuuuca

SEQ ID NO: 3899963 - RNA, 16 nt, Shigella flexneri 2a str. 301
uuuacuuacuucagca

SEQ ID NO: 3899964 - RNA, 11 nt, Shigella flexneri 2a str. 301
uuuacuuugcu

SEQ ID NO: 3899965 - RNA, 14 nt, Shigella flexneri 2a str. 301
uuuagcauaaaaac

SEQ ID NO: 3899966 - RNA, 18 nt, Shigella flexneri 2a str. 301
uuuagccgcuucugcagc

SEQ ID NO: 3899967 - RNA, 21 nt, Shigella flexneri 2a str. 301
uuuagcugucccaagugauuu

SEQ ID NO: 3899968 - RNA, 19 nt, Shigella flexneri 2a str. 301
uuuaggcacaguagcccac

SEQ ID NO: 3899969 - RNA, 22 nt, Shigella flexneri 2a str. 301
uuuaguaacaacggauuauccc

SEQ ID NO: 3899970 - RNA, 13 nt, Shigella flexneri 2a str. 301
uuuaguauuguua

SEQ ID NO: 3899971 - RNA, 23 nt, Shigella flexneri 2a str. 301
uuuauaaagaacucgaggauaaa

SEQ ID NO: 3899972 - RNA, 20 nt, Shigella flexneri 2a str. 301
uuuauaacggugcugcacau

SEQ ID NO: 3899973 - RNA, 18 nt, Shigella flexneri 2a str. 301
uuuauaaucuuuaaaaaa

SEQ ID NO: 3899974 - RNA, 19 nt, Shigella flexneri 2a str. 301
uuuauaccaacaaaaaacg

SEQ ID NO: 3899975 - RNA, 20 nt, Shigella flexneri 2a str. 301
uuuauagagauuuuucccca

SEQ ID NO: 3899976 - RNA, 17 nt, Shigella flexneri 2a str. 301
uuuauagcguugcccga

SEQ ID NO: 3899977 - RNA, 19 nt, Shigella flexneri 2a str. 301
uuuauagcuuauucuuauu

SEQ ID NO: 3899978 - RNA, 22 nt, Shigella flexneri 2a str. 301
uuuauaucugguuugccacguu

SEQ ID NO: 3899979 - RNA, 13 nt, Shigella flexneri 2a str. 301
uuuaucaggccac

SEQ ID NO: 3899980 - RNA, 16 nt, Shigella flexneri 2a str. 301
uuuaucaucacccaac

SEQ ID NO: 3899981 - RNA, 18 nt, Shigella flexneri 2a str. 301
uuuaucaucggucagcgu

SEQ ID NO: 3899982 - RNA, 12 nt, Shigella flexneri 2a str. 301
uuuauccagcca

SEQ ID NO: 3899983 - RNA, 15 nt, Shigella flexneri 2a str. 301
uuuaucccaauuauc

SEQ ID NO: 3899984 - RNA, 15 nt, Shigella flexneri 2a str. 301
uuuaucccuucucca

SEQ ID NO: 3899985 - RNA, 20 nt, Shigella flexneri 2a str. 301
uuuauccugacgagcuuucu

SEQ ID NO: 3899986 - RNA, 13 nt, Shigella flexneri 2a str. 301
uuuaucgagaaua

SEQ ID NO: 3899987 - RNA, 23 nt, Shigella flexneri 2a str. 301
uuuaucgauaaauggcgcaucca

SEQ ID NO: 3899988 - RNA, 16 nt, Shigella flexneri 2a str. 301
uuuaucguuuucacga

SEQ ID NO: 3899989 - RNA, 20 nt, Shigella flexneri 2a str. 301
uuuaucugugaacucaggcu

SEQ ID NO: 3899990 - RNA, 22 nt, Shigella flexneri 2a str. 301
uuuaucuucaagaaucauaggc

SEQ ID NO: 3899991 - RNA, 12 nt, Shigella flexneri 2a str. 301
uuuaucuuccca

SEQ ID NO: 3899992 - RNA, 20 nt, Shigella flexneri 2a str. 301
uuuaucuucgagauucuuaa

SEQ ID NO: 3899993 - RNA, 13 nt, Shigella flexneri 2a str. 301
uuuaugauauuuu

SEQ ID NO: 3899994 - RNA, 14 nt, Shigella flexneri 2a str. 301
uuuaugcacauugg

SEQ ID NO: 3899995 - RNA, 19 nt, Shigella flexneri 2a str. 301
uuuaugccggaucaggcgu

SEQ ID NO: 3899996 - RNA, 19 nt, Shigella flexneri 2a str. 301
uuuaugcgccuuuaccaga

SEQ ID NO: 3899997 - RNA, 15 nt, Shigella flexneri 2a str. 301
uuuaugggagauuuu

SEQ ID NO: 3899998 - RNA, 21 nt, Shigella flexneri 2a str. 301
uuuaugggcacggugcggggu

SEQ ID NO: 3899999 - RNA, 22 nt, Shigella flexneri 2a str. 301
uuuaugguagugccgucagcag

SEQ ID NO: 3900000 - RNA, 22 nt, Shigella flexneri 2a str. 301
uuuauuaacucagcauuauuuu

SEQ ID NO: 3900001 - RNA, 23 nt, Shigella flexneri 2a str. 301
uuuauuaauccagggaucaacau

SEQ ID NO: 3900002 - RNA, 15 nt, Shigella flexneri 2a str. 301
uuuauuaauucuaaa

SEQ ID NO: 3900003 - RNA, 19 nt, Shigella flexneri 2a str. 301
uuuauucugacgccaccau

SEQ ID NO: 3900004 - RNA, 15 nt, Shigella flexneri 2a str. 301
uuuauugacaaucgc

SEQ ID NO: 3900005 - RNA, 16 nt, Shigella flexneri 2a str. 301
uuuauugacauguuga

SEQ ID NO: 3900006 - RNA, 22 nt, Shigella flexneri 2a str. 301
uuuauuguuaaguuuaucccaa

SEQ ID NO: 3900007 - RNA, 19 nt, Shigella flexneri 2a str. 301
uuuauuucuguauuacaga

SEQ ID NO: 3900008 - RNA, 22 nt, Shigella flexneri 2a str. 301
uuuauuuuuuuucaggaaauaa

SEQ ID NO: 3900009 - RNA, 14 nt, Shigella flexneri 2a str. 301
uuucaaacaggcug

SEQ ID NO: 3900010 - RNA, 18 nt, Shigella flexneri 2a str. 301
uuucaaagguaaugguca

SEQ ID NO: 3900011 - RNA, 20 nt, Shigella flexneri 2a str. 301
uuucaacaauacaaaugccu

SEQ ID NO: 3900012 - RNA, 13 nt, Shigella flexneri 2a str. 301
uuucaaccuaaag

SEQ ID NO: 3900013 - RNA, 16 nt, Shigella flexneri 2a str. 301
uuucaaccuaaaguaa

SEQ ID NO: 3900014 - RNA, 19 nt, Shigella flexneri 2a str. 301
uuucaacguacucugccac

SEQ ID NO: 3900015 - RNA, 13 nt, Shigella flexneri 2a str. 301
uuucaagauuagc

SEQ ID NO: 3900016 - RNA, 18 nt, Shigella flexneri 2a str. 301
uuucaagcucaaaauaau

SEQ ID NO: 3900017 - RNA, 21 nt, Shigella flexneri 2a str. 301
uuucaagugacauacucuuuc

SEQ ID NO: 3900018 - RNA, 22 nt, Shigella flexneri 2a str. 301
uuucaauaaccugcaaaauagu

SEQ ID NO: 3900019 - RNA, 19 nt, Shigella flexneri 2a str. 301
uuuccugcggaugcgccau

SEQ ID NO: 3900020 - RNA, 21 nt, Shigella flexneri 2a str. 301
uuuccugcucaaugucuguca

SEQ ID NO: 3900021 - RNA, 19 nt, Shigella flexneri 2a str. 301
uuuccugcugcaucugaaa

SEQ ID NO: 3900022 - RNA, 18 nt, Shigella flexneri 2a str. 301
uuuccugcuucacgccca

SEQ ID NO: 3900023 - RNA, 24 nt, Shigella flexneri 2a str. 301
uuuccuggucggcaaacugcugau

SEQ ID NO: 3900024 - RNA, 16 nt, Shigella flexneri 2a str. 301
uuuccugguucucacu

SEQ ID NO: 3900025 - RNA, 20 nt, Shigella flexneri 2a str. 301
uuuccuucaggaucaaccgc

SEQ ID NO: 3900026 - RNA, 20 nt, Shigella flexneri 2a str. 301
uuucgaaccacaaaagacga

SEQ ID NO: 3900027 - RNA, 17 nt, Shigella flexneri 2a str. 301
uuucgaacgccaguuca

SEQ ID NO: 3900028 - RNA, 17 nt, Shigella flexneri 2a str. 301
uuucgaauguggcagca

SEQ ID NO: 3900029 - RNA, 19 nt, Shigella flexneri 2a str. 301
uuucgagcaggucagucag

SEQ ID NO: 3900030 - RNA, 13 nt, Shigella flexneri 2a str. 301
uuucgauaaucaa

SEQ ID NO: 3900031 - RNA, 16 nt, Shigella flexneri 2a str. 301
uuucgaucuggcagcu

SEQ ID NO: 3900032 - RNA, 12 nt, Shigella flexneri 2a str. 301
uuucgcacugca

SEQ ID NO: 3900033 - RNA, 22 nt, Shigella flexneri 2a str. 301
uuucgccagcgccaguuuuugu

SEQ ID NO: 3900034 - RNA, 15 nt, Shigella flexneri 2a str. 301
uuucgccagcucaac

SEQ ID NO: 3900035 - RNA, 23 nt, Shigella flexneri 2a str. 301
uuucgccgcauccggcaauucuc

SEQ ID NO: 3900036 - RNA, 13 nt, Shigella flexneri 2a str. 301
uuucgccuuucug

SEQ ID NO: 3900037 - RNA, 17 nt, Shigella flexneri 2a str. 301
uuucgcggcauaacaga

SEQ ID NO: 3900038 - RNA, 15 nt, Shigella flexneri 2a str. 301
uuucgcuggcagacu

SEQ ID NO: 3900039 - RNA, 17 nt, Shigella flexneri 2a str. 301
uuucgcuuuaucgccua

SEQ ID NO: 3900040 - RNA, 18 nt, Shigella flexneri 2a str. 301
uuucggaaagaucgccac

SEQ ID NO: 3900041 - RNA, 19 nt, Shigella flexneri 2a str. 301
uuucggacgauauuuuucc

SEQ ID NO: 3900042 - RNA, 15 nt, Shigella flexneri 2a str. 301
uuucgucguacugac

SEQ ID NO: 3900043 - RNA, 21 nt, Shigella flexneri 2a str. 301
uuucguguggaguaauaauuu

SEQ ID NO: 3900044 - RNA, 17 nt, Shigella flexneri 2a str. 301
uuucguuugaaaacugg

SEQ ID NO: 3900045 - RNA, 20 nt, Shigella flexneri 2a str. 301
uuucuaauagccaucacaaa

SEQ ID NO: 3900046 - RNA, 22 nt, Shigella flexneri 2a str. 301
uuucuaucaaggcgauguuccu

SEQ ID NO: 3900047 - RNA, 12 nt, Shigella flexneri 2a str. 301
uuucucaauaua

SEQ ID NO: 3900048 - RNA, 11 nt, Shigella flexneri 2a str. 301
uuucucccucg

SEQ ID NO: 3900049 - RNA, 14 nt, Shigella flexneri 2a str. 301
uuucuccugcgccu

SEQ ID NO: 3900050 - RNA, 15 nt, Shigella flexneri 2a str. 301
uuucuccuucacucu

SEQ ID NO: 3900051 - RNA, 20 nt, Shigella flexneri 2a str. 301
uuucucgguauuacaaugcg

SEQ ID NO: 3900052 - RNA, 13 nt, Shigella flexneri 2a str. 301
uuucucuucaucu

SEQ ID NO: 3900053 - RNA, 17 nt, Shigella flexneri 2a str. 301
uuucucuuuaaacagau

SEQ ID NO: 3900054 - RNA, 12 nt, Shigella flexneri 2a str. 301
uuucucuuucag

SEQ ID NO: 3900055 - RNA, 15 nt, Shigella flexneri 2a str. 301
uuucugaaacugauc

SEQ ID NO: 3900056 - RNA, 17 nt, Shigella flexneri 2a str. 301
uuucugagucaauuucu

SEQ ID NO: 3900057 - RNA, 22 nt, Shigella flexneri 2a str. 301
uuucugcagcgcggcgagagcu

SEQ ID NO: 3900058 - RNA, 17 nt, Shigella flexneri 2a str. 301
uuucugcaucaaccaac

SEQ ID NO: 3900059 - RNA, 11 nt, Shigella flexneri 2a str. 301
uuucugccuca

SEQ ID NO: 3900060 - RNA, 16 nt, Shigella flexneri 2a str. 301
uuucugccuugaguuu

SEQ ID NO: 3900061 - RNA, 15 nt, Shigella flexneri 2a str. 301
uuucugcugccacuu

SEQ ID NO: 3900062 - RNA, 15 nt, Shigella flexneri 2a str. 301
uuucugcuuuucccu

SEQ ID NO: 3900063 - RNA, 18 nt, Shigella flexneri 2a str. 301
uuucuggaguuaaauuaa

SEQ ID NO: 3900064 - RNA, 16 nt, Shigella flexneri 2a str. 301
uuucuggaugccaucg

SEQ ID NO: 3900065 - RNA, 18 nt, Shigella flexneri 2a str. 301
uuucuggaugccaucgca

SEQ ID NO: 3900066 - RNA, 17 nt, Shigella flexneri 2a str. 301
uuucuggcaucacuucu

SEQ ID NO: 3900067 - RNA, 21 nt, Shigella flexneri 2a str. 301
uuucuggcggcuuauauauua

SEQ ID NO: 3900068 - RNA, 14 nt, Shigella flexneri 2a str. 301
uuucuggcgucaaa

SEQ ID NO: 3900069 - RNA, 17 nt, Shigella flexneri 2a str. 301
uuucuggucauugccag

SEQ ID NO: 3900070 - RNA, 15 nt, Shigella flexneri 2a str. 301
uuucuggucugcugg

SEQ ID NO: 3900071 - RNA, 13 nt, Shigella flexneri 2a str. 301
uuucuuaaauuaa

SEQ ID NO: 3900072 - RNA, 20 nt, Shigella flexneri 2a str. 301
uuucuucauuaaauuuccgc

SEQ ID NO: 3900073 - RNA, 16 nt, Shigella flexneri 2a str. 301
uuucuuucaccucuuc

SEQ ID NO: 3900074 - RNA, 13 nt, Shigella flexneri 2a str. 301
uuucuuucaucag

SEQ ID NO: 3900075 - RNA, 14 nt, Shigella flexneri 2a str. 301
uuugaaaaaaccug

SEQ ID NO: 3900076 - RNA, 20 nt, Shigella flexneri 2a str. 301
uuugaaaauaacaucgccag

SEQ ID NO: 3900077 - RNA, 21 nt, Shigella flexneri 2a str. 301
uuugaaaugaugucgcugucu

SEQ ID NO: 3900078 - RNA, 18 nt, Shigella flexneri 2a str. 301
uuugaaauugugauaaaa

SEQ ID NO: 3900079 - RNA, 23 nt, Shigella flexneri 2a str. 301
uuugaacugggcgcggcccacuu

SEQ ID NO: 3900080 - RNA, 17 nt, Shigella flexneri 2a str. 301
uuugaauaucuccucug

SEQ ID NO: 3900081 - RNA, 17 nt, Shigella flexneri 2a str. 301
uuugacaacaucaucug

SEQ ID NO: 3900082 - RNA, 16 nt, Shigella flexneri 2a str. 301
uuugacaacucaucac

SEQ ID NO: 3900083 - RNA, 19 nt, Shigella flexneri 2a str. 301
uuugacagccccugugcca

SEQ ID NO: 3900084 - RNA, 22 nt, Shigella flexneri 2a str. 301
uuugacagccccugugccagcu

SEQ ID NO: 3900085 - RNA, 17 nt, Shigella flexneri 2a str. 301
uuugagccaaaaugccu

SEQ ID NO: 3900086 - RNA, 14 nt, Shigella flexneri 2a str. 301
uuugaguucacugc

SEQ ID NO: 3900087 - RNA, 22 nt, Shigella flexneri 2a str. 301
uuugauaaaccuccagcaucag

SEQ ID NO: 3900088 - RNA, 13 nt, Shigella flexneri 2a str. 301
uuugauauuuauu

SEQ ID NO: 3900089 - RNA, 12 nt, Shigella flexneri 2a str. 301
uuugaugccagc

SEQ ID NO: 3900090 - RNA, 20 nt, Shigella flexneri 2a str. 301
uuugcaaaguuccuauauuu

SEQ ID NO: 3900091 - RNA, 15 nt, Shigella flexneri 2a str. 301
uuugcaacuuucgcu

SEQ ID NO: 3900092 - RNA, 21 nt, Shigella flexneri 2a str. 301
uuugcaaucagauaaaauaca

SEQ ID NO: 3900093 - RNA, 22 nt, Shigella flexneri 2a str. 301
uuugcaccccaauuaauugcca

SEQ ID NO: 3900094 - RNA, 12 nt, Shigella flexneri 2a str. 301
uuugcagauuca

SEQ ID NO: 3900095 - RNA, 20 nt, Shigella flexneri 2a str. 301
uuugcagccauaaauuuacc

SEQ ID NO: 3900096 - RNA, 14 nt, Shigella flexneri 2a str. 301
uuugcagcuuugcu

SEQ ID NO: 3900097 - RNA, 19 nt, Shigella flexneri 2a str. 301
uuugcaggucguccugcaa

SEQ ID NO: 3900098 - RNA, 18 nt, Shigella flexneri 2a str. 301
uuugcaggugaccagcag

SEQ ID NO: 3900099 - RNA, 13 nt, Shigella flexneri 2a str. 301
uuugcauccagcu

SEQ ID NO: 3900100 - RNA, 20 nt, Shigella flexneri 2a str. 301
uuugcaucguccacuugaaa

SEQ ID NO: 3900101 - RNA, 24 nt, Shigella flexneri 2a str. 301
uuugcauuacugcuaucugccaga

SEQ ID NO: 3900102 - RNA, 15 nt, Shigella flexneri 2a str. 301
uuugccaaacgcguc

SEQ ID NO: 3900103 - RNA, 20 nt, Shigella flexneri 2a str. 301
uuugccaauagcguuuugcg

SEQ ID NO: 3900104 - RNA, 21 nt, Shigella flexneri 2a str. 301
uuugccagucuggcuucgcug

SEQ ID NO: 3900105 - RNA, 21 nt, Shigella flexneri 2a str. 301
uuugccaucagcgccugaugg

SEQ ID NO: 3900106 - RNA, 15 nt, Shigella flexneri 2a str. 301
uuugccaucucugca

SEQ ID NO: 3900107 - RNA, 15 nt, Shigella flexneri 2a str. 301
uuugcccacagagcu

SEQ ID NO: 3900108 - RNA, 16 nt, Shigella flexneri 2a str. 301
uuugcccgcagaucca

SEQ ID NO: 3900109 - RNA, 15 nt, Shigella flexneri 2a str. 301
uuugcccgcuuggca

SEQ ID NO: 3900110 - RNA, 13 nt, Shigella flexneri 2a str. 301
uuugccuccccaa

SEQ ID NO: 3900111 - RNA, 17 nt, Shigella flexneri 2a str. 301
uuugccucguucuuccc

SEQ ID NO: 3900112 - RNA, 19 nt, Shigella flexneri 2a str. 301
uuugccugugcaaccuuuu

SEQ ID NO: 3900113 - RNA, 23 nt, Shigella flexneri 2a str. 301
uuugcgccaucgccacaccagua

SEQ ID NO: 3900114 - RNA, 13 nt, Shigella flexneri 2a str. 301
uuugcgccuggau

SEQ ID NO: 3900115 - RNA, 19 nt, Shigella flexneri 2a str. 301
uuugcgcguaaacaaacaa

SEQ ID NO: 3900116 - RNA, 22 nt, Shigella flexneri 2a str. 301
uuugcgcguaacgaucgccugg

SEQ ID NO: 3900117 - RNA, 22 nt, Shigella flexneri 2a str. 301
uuugcguagucugaccucuucu

SEQ ID NO: 3900118 - RNA, 18 nt, Shigella flexneri 2a str. 301
uuugcgucagcucacaaa

SEQ ID NO: 3900119 - RNA, 20 nt, Shigella flexneri 2a str. 301
uuuucgaucacuuuuaaauu

SEQ ID NO: 3900120 - RNA, 21 nt, Shigella flexneri 2a str. 301
uuuucgaucuguuuuagagaa

SEQ ID NO: 3900121 - RNA, 16 nt, Shigella flexneri 2a str. 301
uuuucgccaucucaaa

SEQ ID NO: 3900122 - RNA, 11 nt, Shigella flexneri 2a str. 301
uuuucgcuggc

SEQ ID NO: 3900123 - RNA, 15 nt, Shigella flexneri 2a str. 301
uuuucgcuggcagac

SEQ ID NO: 3900124 - RNA, 19 nt, Shigella flexneri 2a str. 301
uuuucguuuggggcauauu

SEQ ID NO: 3900125 - RNA, 13 nt, Shigella flexneri 2a str. 301
uuuucguuuuaau

SEQ ID NO: 3900126 - RNA, 22 nt, Shigella flexneri 2a str. 301
uuuucuaugcgcucccguaauu

SEQ ID NO: 3900127 - RNA, 18 nt, Shigella flexneri 2a str. 301
uuuucuauuuugcauuau

SEQ ID NO: 3900128 - RNA, 11 nt, Shigella flexneri 2a str. 301
uuuucucuauc

SEQ ID NO: 3900129 - RNA, 16 nt, Shigella flexneri 2a str. 301
uuuucuggaugccauc

SEQ ID NO: 3900130 - RNA, 15 nt, Shigella flexneri 2a str. 301
uuuucuggcacaacu

SEQ ID NO: 3900131 - RNA, 21 nt, Shigella flexneri 2a str. 301
uuuucuuaacaaaaacuuuug

SEQ ID NO: 3900132 - RNA, 21 nt, Shigella flexneri 2a str. 301
uuuucuucagccccuccacau

SEQ ID NO: 3900133 - RNA, 12 nt, Shigella flexneri 2a str. 301
uuuucuucaguu

SEQ ID NO: 3900134 - RNA, 13 nt, Shigella flexneri 2a str. 301
uuuucuuccaacc

SEQ ID NO: 3900135 - RNA, 11 nt, Shigella flexneri 2a str. 301
uuuucuuucac

SEQ ID NO: 3900136 - RNA, 11 nt, Shigella flexneri 2a str. 301
uuuugaacaga

SEQ ID NO: 3900137 - RNA, 16 nt, Shigella flexneri 2a str. 301
uuuugaacagaccaca

SEQ ID NO: 3900138 - RNA, 17 nt, Shigella flexneri 2a str. 301
uuuugacgcccccaaac

SEQ ID NO: 3900139 - RNA, 14 nt, Shigella flexneri 2a str. 301
uuuugagcgguaca

SEQ ID NO: 3900140 - RNA, 17 nt, Shigella flexneri 2a str. 301
uuuugcaacgcuuugcu

SEQ ID NO: 3900141 - RNA, 13 nt, Shigella flexneri 2a str. 301
uuuugcaauaaug

SEQ ID NO: 3900142 - RNA, 20 nt, Shigella flexneri 2a str. 301
uuuugcaggaaaaacugccc

SEQ ID NO: 3900143 - RNA, 22 nt, Shigella flexneri 2a str. 301
uuuugccaccccuuuugacuuu

SEQ ID NO: 3900144 - RNA, 14 nt, Shigella flexneri 2a str. 301
uuuugccgaauuca

SEQ ID NO: 3900145 - RNA, 16 nt, Shigella flexneri 2a str. 301
uuuugcggaucugcuc

SEQ ID NO: 3900146 - RNA, 11 nt, Shigella flexneri 2a str. 301
uuuugcugccg

SEQ ID NO: 3900147 - RNA, 20 nt, Shigella flexneri 2a str. 301
uuuugcuugcgauagcgcac

SEQ ID NO: 3900148 - RNA, 21 nt, Shigella flexneri 2a str. 301
uuuugcuuucuauaagauacu

SEQ ID NO: 3900149 - RNA, 18 nt, Shigella flexneri 2a str. 301
uuuuggagaucacgccac

SEQ ID NO: 3900150 - RNA, 15 nt, Shigella flexneri 2a str. 301
uuuuguaggccugau

SEQ ID NO: 3900151 - RNA, 20 nt, Shigella flexneri 2a str. 301
uuuugucaugcgcucuccca

SEQ ID NO: 3900152 - RNA, 13 nt, Shigella flexneri 2a str. 301
uuuuguccccuca

SEQ ID NO: 3900153 - RNA, 14 nt, Shigella flexneri 2a str. 301
uuuuguuuaaauau

SEQ ID NO: 3900154 - RNA, 22 nt, Shigella flexneri 2a str. 301
uuuuguuucugaaucucuaagc

SEQ ID NO: 3900155 - RNA, 14 nt, Shigella flexneri 2a str. 301
uuuuuaaauuuccc

SEQ ID NO: 3900156 - RNA, 19 nt, Shigella flexneri 2a str. 301
uuuuuaauagagauagccu

SEQ ID NO: 3900157 - RNA, 19 nt, Shigella flexneri 2a str. 301
uuuuuacaucaucagaaau

SEQ ID NO: 3900158 - RNA, 22 nt, Shigella flexneri 2a str. 301
uuuuuacauguucaaaaaaauc

SEQ ID NO: 3900159 - RNA, 13 nt, Shigella flexneri 2a str. 301
uuuuuacccagca

SEQ ID NO: 3900160 - RNA, 23 nt, Shigella flexneri 2a str. 301
uuuuuagcacaaaaauagcccca

SEQ ID NO: 3900161 - RNA, 14 nt, Shigella flexneri 2a str. 301
uuuuuaguuagcaa

SEQ ID NO: 3900162 - RNA, 23 nt, Shigella flexneri 2a str. 301
uuuuuaguuguaaucauauuaaa

SEQ ID NO: 3900163 - RNA, 17 nt, Shigella flexneri 2a str. 301
uuuuuauagcuuauucu

SEQ ID NO: 3900164 - RNA, 12 nt, Shigella flexneri 2a str. 301
uuuuuaucuuca

SEQ ID NO: 3900165 - RNA, 23 nt, Shigella flexneri 2a str. 301
uuuuuaugaguuuggugccacgc

SEQ ID NO: 3900166 - RNA, 12 nt, Shigella flexneri 2a str. 301
uuuuuaugcuuc

SEQ ID NO: 3900167 - RNA, 21 nt, Shigella flexneri 2a str. 301
uuuuuaugguggaguuaccag

SEQ ID NO: 3900168 - RNA, 22 nt, Shigella flexneri 2a str. 301
uuuuucaacauauccuucacac

SEQ ID NO: 3900169 - RNA, 21 nt, Shigella flexneri 2a str. 301
uuuuucaagaaucggcuuugu

SEQ ID NO: 3900170 - RNA, 19 nt, Shigella flexneri 2a str. 301
uuuuucacugcggcaagaa

SEQ ID NO: 3900171 - RNA, 12 nt, Shigella flexneri 2a str. 301
uuuuucaucccu

SEQ ID NO: 3900172 - RNA, 23 nt, Shigella flexneri 2a str. 301
uuuuuccaacaggcgagaaacgc

SEQ ID NO: 3900173 - RNA, 22 nt, Shigella flexneri 2a str. 301
uuuuuccagguacuuuugaaug

SEQ ID NO: 3900174 - RNA, 15 nt, Shigella flexneri 2a str. 301
uuuuuccgcaaaaac

SEQ ID NO: 3900175 - RNA, 14 nt, Shigella flexneri 2a str. 301
uuuuuccgcuuugu

SEQ ID NO: 3900176 - RNA, 13 nt, Shigella flexneri 2a str. 301
uuuuucgaaccga

SEQ ID NO: 3900177 - RNA, 21 nt, Shigella flexneri 2a str. 301
uuuuucgacaaacaccgaacc

SEQ ID NO: 3900178 - RNA, 18 nt, Shigella flexneri 2a str. 301
uuuuucggacgauauuuu

SEQ ID NO: 3900179 - RNA, 21 nt, Shigella flexneri 2a str. 301
uuuuucugcacuacgcaggga

SEQ ID NO: 3900180 - RNA, 11 nt, Shigella flexneri 2a str. 301
uuuuugaagcg

SEQ ID NO: 3900181 - RNA, 16 nt, Shigella flexneri 2a str. 301
uuuuugagcagcauua

SEQ ID NO: 3900182 - RNA, 19 nt, Shigella flexneri 2a str. 301
uuuuugauaaucuucuucg

SEQ ID NO: 3900183 - RNA, 22 nt, Shigella flexneri 2a str. 301
uuuuugcaaucagauaaaauac

SEQ ID NO: 3900184 - RNA, 19 nt, Shigella flexneri 2a str. 301
uuuuugccugccagucaau

SEQ ID NO: 3900185 - RNA, 19 nt, Shigella flexneri 2a str. 301
uuuuugcgcgaagaaacga

SEQ ID NO: 3900186 - RNA, 18 nt, Shigella flexneri 2a str. 301
uuuuugcguccuggcaac

SEQ ID NO: 3900187 - RNA, 20 nt, Shigella flexneri 2a str. 301
uuuuuggaggugaagguaag

SEQ ID NO: 3900188 - RNA, 11 nt, Shigella flexneri 2a str. 301
uuuuuucacau

SEQ ID NO: 3900189 - RNA, 13 nt, Shigella flexneri 2a str. 301
uuuuuucuuccca

SEQ ID NO: 3900190 - RNA, 16 nt, Shigella flexneri 2a str. 301
uuuuuugccaaauauc

SEQ ID NO: 3900191 - RNA, 11 nt, Shigella flexneri 2a str. 301
uuuuuuuaugc

SEQ ID NO: 3900192 - RNA, 13 nt, Shigella flexneri 2a str. 301
uuuuuuucaaccu

SEQ ID NO: 3900193 - RNA, 11 nt, Shigella flexneri 2a str. 301
uuuuuuuucag

SEQ ID NO: 3900194 - RNA, 11 nt, Shigella flexneri 2a str. 301
aaaaaaaagau

SEQ ID NO: 3900195 - RNA, 13 nt, Shigella flexneri 2a str. 301
aaaaaaagcauuu

SEQ ID NO: 3900196 - RNA, 13 nt, Shigella flexneri 2a str. 301
aaaaaacaauaug

SEQ ID NO: 3900197 - RNA, 17 nt, Shigella flexneri 2a str. 301
aaaaaaccagaaaggga

SEQ ID NO: 3900198 - RNA, 20 nt, Shigella flexneri 2a str. 301
aaaaaacuggaaaaauaauu

SEQ ID NO: 3900199 - RNA, 13 nt, Shigella flexneri 2a str. 301
aaaaaagaauuca

SEQ ID NO: 3900200 - RNA, 11 nt, Shigella flexneri 2a str. 301
aaaaaagagcg

SEQ ID NO: 3900201 - RNA, 16 nt, Shigella flexneri 2a str. 301
aaaaaaugagaaagcc

SEQ ID NO: 3900202 - RNA, 13 nt, Shigella flexneri 2a str. 301
aaaaaauuaacaa

SEQ ID NO: 3900203 - RNA, 19 nt, Shigella flexneri 2a str. 301
aaaaaauuaacaaaacaau

SEQ ID NO: 3900204 - RNA, 10 nt, Shigella flexneri 2a str. 301
aaaaaauuua

SEQ ID NO: 3900205 - RNA, 12 nt, Shigella flexneri 2a str. 301
aaaaacacaaag

SEQ ID NO: 3900206 - RNA, 20 nt, Shigella flexneri 2a str. 301
aaaaacacugggaugaaagu

SEQ ID NO: 3900207 - RNA, 13 nt, Shigella flexneri 2a str. 301
aaaaacagcauca

SEQ ID NO: 3900208 - RNA, 16 nt, Shigella flexneri 2a str. 301
aaaaacagccagcagc

SEQ ID NO: 3900209 - RNA, 22 nt, Shigella flexneri 2a str. 301
aaaaaccagaaagggaagaaca

SEQ ID NO: 3900210 - RNA, 12 nt, Shigella flexneri 2a str. 301
aaaaaccagaga

SEQ ID NO: 3900211 - RNA, 22 nt, Shigella flexneri 2a str. 301
aaaaacccgccccugacaggcg

SEQ ID NO: 3900212 - RNA, 16 nt, Shigella flexneri 2a str. 301
aaaaacccgccgaagc

SEQ ID NO: 3900213 - RNA, 12 nt, Shigella flexneri 2a str. 301
aaaaacccugca

SEQ ID NO: 3900214 - RNA, 17 nt, Shigella flexneri 2a str. 301
aaaaacccugcagaaac

SEQ ID NO: 3900215 - RNA, 17 nt, Shigella flexneri 2a str. 301
aaaaacccuuccagcac

SEQ ID NO: 3900216 - RNA, 13 nt, Shigella flexneri 2a str. 301
aaaaacccuucuu

SEQ ID NO: 3900217 - RNA, 22 nt, Shigella flexneri 2a str. 301
aaaaaccuccggcguuucagau

SEQ ID NO: 3900218 - RNA, 16 nt, Shigella flexneri 2a str. 301
aaaaacucauaaauuc

SEQ ID NO: 3900219 - RNA, 22 nt, Shigella flexneri 2a str. 301
aaaaacugccgcacuuugagca

SEQ ID NO: 3900220 - RNA, 14 nt, Shigella flexneri 2a str. 301
aaaaacuuuuguau

SEQ ID NO: 3900221 - RNA, 12 nt, Shigella flexneri 2a str. 301
aaaaagaaaaaa

SEQ ID NO: 3900222 - RNA, 13 nt, Shigella flexneri 2a str. 301
aaaaagaaagaag

SEQ ID NO: 3900223 - RNA, 11 nt, Shigella flexneri 2a str. 301
aaaaagaagac

SEQ ID NO: 3900224 - RNA, 15 nt, Shigella flexneri 2a str. 301
aaaaagaaggaaaau

SEQ ID NO: 3900225 - RNA, 21 nt, Shigella flexneri 2a str. 301
aaaaagagcagcugauugaaa

SEQ ID NO: 3900226 - RNA, 15 nt, Shigella flexneri 2a str. 301
aaaaagcauuuaaua

SEQ ID NO: 3900227 - RNA, 16 nt, Shigella flexneri 2a str. 301
aaaaagcauuuaauac

SEQ ID NO: 3900228 - RNA, 17 nt, Shigella flexneri 2a str. 301
aaaaagccaaucacaaa

SEQ ID NO: 3900229 - RNA, 18 nt, Shigella flexneri 2a str. 301
aaaaagcguauccugacg

SEQ ID NO: 3900230 - RNA, 19 nt, Shigella flexneri 2a str. 301
aaaaaggcgaaaggcuggc

SEQ ID NO: 3900231 - RNA, 22 nt, Shigella flexneri 2a str. 301
aaaaaggcgugaucuccuugga

SEQ ID NO: 3900232 - RNA, 19 nt, Shigella flexneri 2a str. 301
aaaaaggcugacaaaucag

SEQ ID NO: 3900233 - RNA, 20 nt, Shigella flexneri 2a str. 301
aaaaaggcugacaaaucaga

SEQ ID NO: 3900234 - RNA, 23 nt, Shigella flexneri 2a str. 301
aaaaagguccuguaaugagaaua

SEQ ID NO: 3900235 - RNA, 21 nt, Shigella flexneri 2a str. 301
aaaaaggugagucgcaaaacu

SEQ ID NO: 3900236 - RNA, 22 nt, Shigella flexneri 2a str. 301
aaaaaguagggcugauaaacaa

SEQ ID NO: 3900237 - RNA, 17 nt, Shigella flexneri 2a str. 301
aaaaaguaguuccagca

SEQ ID NO: 3900238 - RNA, 16 nt, Shigella flexneri 2a str. 301
aaaaagucagaucguu

SEQ ID NO: 3900239 - RNA, 17 nt, Shigella flexneri 2a str. 301
aaaaagugcuuucugaa

SEQ ID NO: 3900240 - RNA, 11 nt, Shigella flexneri 2a str. 301
aaaaauaaaag

SEQ ID NO: 3900241 - RNA, 12 nt, Shigella flexneri 2a str. 301
aaaaauaaaugc

SEQ ID NO: 3900242 - RNA, 14 nt, Shigella flexneri 2a str. 301
aaaaauaaucaucu

SEQ ID NO: 3900243 - RNA, 15 nt, Shigella flexneri 2a str. 301
aaaaauaaucugauu

SEQ ID NO: 3900244 - RNA, 15 nt, Shigella flexneri 2a str. 301
aaaaauaauuuuaaa

SEQ ID NO: 3900245 - RNA, 14 nt, Shigella flexneri 2a str. 301
aaaaaucaaaaaac

SEQ ID NO: 3900246 - RNA, 13 nt, Shigella flexneri 2a str. 301
aaaaaucaauaaa

SEQ ID NO: 3900247 - RNA, 14 nt, Shigella flexneri 2a str. 301
aaaaaucaauauau

SEQ ID NO: 3900248 - RNA, 21 nt, Shigella flexneri 2a str. 301
aaaaaucaugcaauaaauaug

SEQ ID NO: 3900249 - RNA, 22 nt, Shigella flexneri 2a str. 301
aaaaauccagauuuauaaaaga

SEQ ID NO: 3900250 - RNA, 18 nt, Shigella flexneri 2a str. 301
aaaaaucgacaaaaucgg

SEQ ID NO: 3900251 - RNA, 12 nt, Shigella flexneri 2a str. 301
aaaaaugcccga

SEQ ID NO: 3900252 - RNA, 22 nt, Shigella flexneri 2a str. 301
aaaaauggccagacauuauaaa

SEQ ID NO: 3900253 - RNA, 12 nt, Shigella flexneri 2a str. 301
aaaaauggcugg

SEQ ID NO: 3900254 - RNA, 21 nt, Shigella flexneri 2a str. 301
aaaaaugugaagaggaacaaa

SEQ ID NO: 3900255 - RNA, 15 nt, Shigella flexneri 2a str. 301
aaaaauuacaaaaag

SEQ ID NO: 3900256 - RNA, 23 nt, Shigella flexneri 2a str. 301
aaaaauuagcaauaccauuuaca

SEQ ID NO: 3900257 - RNA, 14 nt, Shigella flexneri 2a str. 301
aaaacaacacaaac

SEQ ID NO: 3900258 - RNA, 20 nt, Shigella flexneri 2a str. 301
aaaacaacggaacgaaaaaa

SEQ ID NO: 3900259 - RNA, 22 nt, Shigella flexneri 2a str. 301
aaaacaacggaacgaaaaaaau

SEQ ID NO: 3900260 - RNA, 19 nt, Shigella flexneri 2a str. 301
aaaacaaugggaaaacagg

SEQ ID NO: 3900261 - RNA, 23 nt, Shigella flexneri 2a str. 301
aaaacacaacgcuuucaacaacc

SEQ ID NO: 3900262 - RNA, 13 nt, Shigella flexneri 2a str. 301
aaaacacagcauc

SEQ ID NO: 3900263 - RNA, 18 nt, Shigella flexneri 2a str. 301
aaaacaccacaaaacgga

SEQ ID NO: 3900264 - RNA, 14 nt, Shigella flexneri 2a str. 301
aaaacacucuucaa

SEQ ID NO: 3900265 - RNA, 14 nt, Shigella flexneri 2a str. 301
aaaacacucuuuuu

SEQ ID NO: 3900266 - RNA, 20 nt, Shigella flexneri 2a str. 301
aaaacagacgagggaaaaua

SEQ ID NO: 3900267 - RNA, 22 nt, Shigella flexneri 2a str. 301
aaaacagcaaagcgugcaaaua

SEQ ID NO: 3900268 - RNA, 19 nt, Shigella flexneri 2a str. 301
aaaacagcacuccugccac

SEQ ID NO: 3900269 - RNA, 14 nt, Shigella flexneri 2a str. 301
aaaacagccagcgc

SEQ ID NO: 3900270 - RNA, 22 nt, Shigella flexneri 2a str. 301
aaaacagcgcaccagaaacaau

SEQ ID NO: 3900271 - RNA, 22 nt, Shigella flexneri 2a str. 301
aaaacagcgcagcucuggcaua

SEQ ID NO: 3900272 - RNA, 22 nt, Shigella flexneri 2a str. 301
aaaauccagauuuauaaaagaa

SEQ ID NO: 3900273 - RNA, 22 nt, Shigella flexneri 2a str. 301
aaaauccauuuucuauuuugca

SEQ ID NO: 3900274 - RNA, 23 nt, Shigella flexneri 2a str. 301
aaaauccauuuucuauuuugcau

SEQ ID NO: 3900275 - RNA, 16 nt, Shigella flexneri 2a str. 301
aaaaucccacugccaa

SEQ ID NO: 3900276 - RNA, 16 nt, Shigella flexneri 2a str. 301
aaaaucgacagcagga

SEQ ID NO: 3900277 - RNA, 17 nt, Shigella flexneri 2a str. 301
aaaaucgacaucugcaa

SEQ ID NO: 3900278 - RNA, 23 nt, Shigella flexneri 2a str. 301
aaaaucgcaaauugacuacacca

SEQ ID NO: 3900279 - RNA, 15 nt, Shigella flexneri 2a str. 301
aaaaucgcaagaucu

SEQ ID NO: 3900280 - RNA, 16 nt, Shigella flexneri 2a str. 301
aaaaucguaagcagga

SEQ ID NO: 3900281 - RNA, 19 nt, Shigella flexneri 2a str. 301
aaaaucguaagcaggagau

SEQ ID NO: 3900282 - RNA, 14 nt, Shigella flexneri 2a str. 301
aaaaucucaaugua

SEQ ID NO: 3900283 - RNA, 21 nt, Shigella flexneri 2a str. 301
aaaaucuccugccaauacaaa

SEQ ID NO: 3900284 - RNA, 20 nt, Shigella flexneri 2a str. 301
aaaaucucgacuucuucauu

SEQ ID NO: 3900285 - RNA, 14 nt, Shigella flexneri 2a str. 301
aaaaucuucguuau

SEQ ID NO: 3900286 - RNA, 18 nt, Shigella flexneri 2a str. 301
aaaaucuucguuauccca

SEQ ID NO: 3900287 - RNA, 18 nt, Shigella flexneri 2a str. 301
aaaaugagcaccgaacag

SEQ ID NO: 3900288 - RNA, 19 nt, Shigella flexneri 2a str. 301
aaaaugagugccaaaaaaa

SEQ ID NO: 3900289 - RNA, 20 nt, Shigella flexneri 2a str. 301
aaaaugagugccaaaaaaau

SEQ ID NO: 3900290 - RNA, 21 nt, Shigella flexneri 2a str. 301
aaaaugauguagaccugauac

SEQ ID NO: 3900291 - RNA, 22 nt, Shigella flexneri 2a str. 301
aaaaugauguagaccugauaca

SEQ ID NO: 3900292 - RNA, 21 nt, Shigella flexneri 2a str. 301
aaaaugcaucggcauaaucau

SEQ ID NO: 3900293 - RNA, 15 nt, Shigella flexneri 2a str. 301
aaaaugccccagcgc

SEQ ID NO: 3900294 - RNA, 16 nt, Shigella flexneri 2a str. 301
aaaaugccgcacauca

SEQ ID NO: 3900295 - RNA, 13 nt, Shigella flexneri 2a str. 301
aaaaugccugaug

SEQ ID NO: 3900296 - RNA, 20 nt, Shigella flexneri 2a str. 301
aaaaugccuuuaccgacaua

SEQ ID NO: 3900297 - RNA, 23 nt, Shigella flexneri 2a str. 301
aaaaugcgcggucggaaaauuau

SEQ ID NO: 3900298 - RNA, 16 nt, Shigella flexneri 2a str. 301
aaaaugcugcaauugc

SEQ ID NO: 3900299 - RNA, 15 nt, Shigella flexneri 2a str. 301
aaaauggccagccag

SEQ ID NO: 3900300 - RNA, 17 nt, Shigella flexneri 2a str. 301
aaaaugguggagauaaa

SEQ ID NO: 3900301 - RNA, 13 nt, Shigella flexneri 2a str. 301
aaaaugugccaga

SEQ ID NO: 3900302 - RNA, 20 nt, Shigella flexneri 2a str. 301
aaaaugugcccggacagucc

SEQ ID NO: 3900303 - RNA, 19 nt, Shigella flexneri 2a str. 301
aaaauguugcgccucaaga

SEQ ID NO: 3900304 - RNA, 23 nt, Shigella flexneri 2a str. 301
aaaauguuuaugccugguugagu

SEQ ID NO: 3900305 - RNA, 15 nt, Shigella flexneri 2a str. 301
aaaauuaacaaaaca

SEQ ID NO: 3900306 - RNA, 22 nt, Shigella flexneri 2a str. 301
aaaauuaacaaaacaaugggaa

SEQ ID NO: 3900307 - RNA, 14 nt, Shigella flexneri 2a str. 301
aaaauucaagacau

SEQ ID NO: 3900308 - RNA, 19 nt, Shigella flexneri 2a str. 301
aaaauucaagacaucaaua

SEQ ID NO: 3900309 - RNA, 15 nt, Shigella flexneri 2a str. 301
aaaauucaucaaaug

SEQ ID NO: 3900310 - RNA, 22 nt, Shigella flexneri 2a str. 301
aaaauucauucaauuaauaaca

SEQ ID NO: 3900311 - RNA, 23 nt, Shigella flexneri 2a str. 301
aaaauucauucaauuaauaacac

SEQ ID NO: 3900312 - RNA, 15 nt, Shigella flexneri 2a str. 301
aaaauucuccagcgc

SEQ ID NO: 3900313 - RNA, 22 nt, Shigella flexneri 2a str. 301
aaaauucuuacguaauuuauaa

SEQ ID NO: 3900314 - RNA, 15 nt, Shigella flexneri 2a str. 301
aaaauuggcuucguu

SEQ ID NO: 3900315 - RNA, 21 nt, Shigella flexneri 2a str. 301
aaaauuguguaaauucaauaa

SEQ ID NO: 3900316 - RNA, 14 nt, Shigella flexneri 2a str. 301
aaaauuuucauugc

SEQ ID NO: 3900317 - RNA, 14 nt, Shigella flexneri 2a str. 301
aaacaaaucacuau

SEQ ID NO: 3900318 - RNA, 22 nt, Shigella flexneri 2a str. 301
aaacaacgagccaauaaaaaua

SEQ ID NO: 3900319 - RNA, 21 nt, Shigella flexneri 2a str. 301
aaacaacggaacgaaaaaaau

SEQ ID NO: 3900320 - RNA, 15 nt, Shigella flexneri 2a str. 301
aaacaagcguacaaa

SEQ ID NO: 3900321 - RNA, 22 nt, Shigella flexneri 2a str. 301
aaacaaguucuucgaagcacuc

SEQ ID NO: 3900322 - RNA, 12 nt, Shigella flexneri 2a str. 301
aaacaauaauug

SEQ ID NO: 3900323 - RNA, 23 nt, Shigella flexneri 2a str. 301
aaacaauguucaucugcauuccg

SEQ ID NO: 3900324 - RNA, 18 nt, Shigella flexneri 2a str. 301
aaacacaaaguaaacaau

SEQ ID NO: 3900325 - RNA, 16 nt, Shigella flexneri 2a str. 301
aaacacaauauucaua

SEQ ID NO: 3900326 - RNA, 17 nt, Shigella flexneri 2a str. 301
aaacacaauauucauag

SEQ ID NO: 3900327 - RNA, 13 nt, Shigella flexneri 2a str. 301
aaacaccagaaug

SEQ ID NO: 3900328 - RNA, 14 nt, Shigella flexneri 2a str. 301
aaacaccagaaugc

SEQ ID NO: 3900329 - RNA, 12 nt, Shigella flexneri 2a str. 301
aaacaccagcaa

SEQ ID NO: 3900330 - RNA, 14 nt, Shigella flexneri 2a str. 301
aaacaccgucgcaa

SEQ ID NO: 3900331 - RNA, 22 nt, Shigella flexneri 2a str. 301
aaacacgacaugacccggcgua

SEQ ID NO: 3900332 - RNA, 18 nt, Shigella flexneri 2a str. 301
aaacacugggaugaaagu

SEQ ID NO: 3900333 - RNA, 14 nt, Shigella flexneri 2a str. 301
aaacacuugcggca

SEQ ID NO: 3900334 - RNA, 13 nt, Shigella flexneri 2a str. 301
aaacagaaauuca

SEQ ID NO: 3900335 - RNA, 14 nt, Shigella flexneri 2a str. 301
aaacagagcgggcu

SEQ ID NO: 3900336 - RNA, 21 nt, Shigella flexneri 2a str. 301
aaacagcaaagcgugcaaaua

SEQ ID NO: 3900337 - RNA, 21 nt, Shigella flexneri 2a str. 301
aaacagcagaacgaccagcgc

SEQ ID NO: 3900338 - RNA, 14 nt, Shigella flexneri 2a str. 301
aaacagccauaacc

SEQ ID NO: 3900339 - RNA, 18 nt, Shigella flexneri 2a str. 301
aaacagcgacaccagcca

SEQ ID NO: 3900340 - RNA, 22 nt, Shigella flexneri 2a str. 301
aaacagcgaguuaacaccagaa

SEQ ID NO: 3900341 - RNA, 17 nt, Shigella flexneri 2a str. 301
aaacagcgcaaaacgca

SEQ ID NO: 3900342 - RNA, 23 nt, Shigella flexneri 2a str. 301
aaacagcgcaccagaaacaauaa

SEQ ID NO: 3900343 - RNA, 13 nt, Shigella flexneri 2a str. 301
aaacagcgccaga

SEQ ID NO: 3900344 - RNA, 11 nt, Shigella flexneri 2a str. 301
aaacagcugcu

SEQ ID NO: 3900345 - RNA, 22 nt, Shigella flexneri 2a str. 301
aaacagcugcugguaauccgug

SEQ ID NO: 3900346 - RNA, 22 nt, Shigella flexneri 2a str. 301
aaacaggauauguaagcagaaa

SEQ ID NO: 3900347 - RNA, 12 nt, Shigella flexneri 2a str. 301
aaacaggaucug

SEQ ID NO: 3900348 - RNA, 13 nt, Shigella flexneri 2a str. 301
aaacaggaucugg

SEQ ID NO: 3900349 - RNA, 17 nt, Shigella flexneri 2a str. 301
aaacagggcaauuaaaa

SEQ ID NO: 3900350 - RNA, 14 nt, Shigella flexneri 2a str. 301
aaacagggcuuuac

SEQ ID NO: 3900351 - RNA, 18 nt, Shigella flexneri 2a str. 301
aaacaggggcuggaagau

SEQ ID NO: 3900352 - RNA, 16 nt, Shigella flexneri 2a str. 301
aaacagguaaagacca

SEQ ID NO: 3900353 - RNA, 22 nt, Shigella flexneri 2a str. 301
aaacagguaaagaccauaaaua

SEQ ID NO: 3900354 - RNA, 22 nt, Shigella flexneri 2a str. 301
aaacaggucuguaugacaacaa

SEQ ID NO: 3900355 - RNA, 16 nt, Shigella flexneri 2a str. 301
aaacagucuggagcaa

SEQ ID NO: 3900356 - RNA, 21 nt, Shigella flexneri 2a str. 301
aaacagugcccauacccgaug

SEQ ID NO: 3900357 - RNA, 12 nt, Shigella flexneri 2a str. 301
aaacaucaaacc

SEQ ID NO: 3900358 - RNA, 19 nt, Shigella flexneri 2a str. 301
aaacaucaccaaugaaagc

SEQ ID NO: 3900359 - RNA, 21 nt, Shigella flexneri 2a str. 301
aaacaucaccaaugaaagccc

SEQ ID NO: 3900360 - RNA, 14 nt, Shigella flexneri 2a str. 301
aaacaucagcuauu

SEQ ID NO: 3900361 - RNA, 21 nt, Shigella flexneri 2a str. 301
aaacaucagcuauucuuauaa

SEQ ID NO: 3900362 - RNA, 23 nt, Shigella flexneri 2a str. 301
aaacaucgcugauuucaccaucu

SEQ ID NO: 3900363 - RNA, 16 nt, Shigella flexneri 2a str. 301
aaacaugcaaaccauc

SEQ ID NO: 3900364 - RNA, 14 nt, Shigella flexneri 2a str. 301
aaacaugccaacaa

SEQ ID NO: 3900365 - RNA, 12 nt, Shigella flexneri 2a str. 301
aaacauggaaac

SEQ ID NO: 3900366 - RNA, 20 nt, Shigella flexneri 2a str. 301
aaacauggaaaccaucaucu

SEQ ID NO: 3900367 - RNA, 15 nt, Shigella flexneri 2a str. 301
aaacauugcugccag

SEQ ID NO: 3900368 - RNA, 18 nt, Shigella flexneri 2a str. 301
aaacauuuucauuugcgc

SEQ ID NO: 3900369 - RNA, 20 nt, Shigella flexneri 2a str. 301
aaaccaaagcgguugaacug

SEQ ID NO: 3900370 - RNA, 18 nt, Shigella flexneri 2a str. 301
aaaccacccaccagcgcc

SEQ ID NO: 3900371 - RNA, 16 nt, Shigella flexneri 2a str. 301
aaacucucaaaacaac

SEQ ID NO: 3900372 - RNA, 17 nt, Shigella flexneri 2a str. 301
aaacucucaaaacaaca

SEQ ID NO: 3900373 - RNA, 19 nt, Shigella flexneri 2a str. 301
aaacucucaaaacaacaca

SEQ ID NO: 3900374 - RNA, 17 nt, Shigella flexneri 2a str. 301
aaacucucaucuuugaa

SEQ ID NO: 3900375 - RNA, 20 nt, Shigella flexneri 2a str. 301
aaacucucaucuuugaaauc

SEQ ID NO: 3900376 - RNA, 20 nt, Shigella flexneri 2a str. 301
aaacucucuauuccaccauc

SEQ ID NO: 3900377 - RNA, 13 nt, Shigella flexneri 2a str. 301
aaacucugcggca

SEQ ID NO: 3900378 - RNA, 16 nt, Shigella flexneri 2a str. 301
aaacugagccaaacgc

SEQ ID NO: 3900379 - RNA, 14 nt, Shigella flexneri 2a str. 301
aaacugaugcccua

SEQ ID NO: 3900380 - RNA, 13 nt, Shigella flexneri 2a str. 301
aaacugccugaua

SEQ ID NO: 3900381 - RNA, 15 nt, Shigella flexneri 2a str. 301
aaacugccugauacu

SEQ ID NO: 3900382 - RNA, 22 nt, Shigella flexneri 2a str. 301
aaacugcgucgacauagccauc

SEQ ID NO: 3900383 - RNA, 14 nt, Shigella flexneri 2a str. 301
aaacuggaaaaaua

SEQ ID NO: 3900384 - RNA, 22 nt, Shigella flexneri 2a str. 301
aaacuggaaaaauaauuuuaaa

SEQ ID NO: 3900385 - RNA, 15 nt, Shigella flexneri 2a str. 301
aaacuggauuacaaa

SEQ ID NO: 3900386 - RNA, 20 nt, Shigella flexneri 2a str. 301
aaacuggccucuuggcaucu

SEQ ID NO: 3900387 - RNA, 17 nt, Shigella flexneri 2a str. 301
aaacuggcguuuuucca

SEQ ID NO: 3900388 - RNA, 21 nt, Shigella flexneri 2a str. 301
aaacuggcguuuuuccaaaac

SEQ ID NO: 3900389 - RNA, 20 nt, Shigella flexneri 2a str. 301
aaacuggcugauaaaacucu

SEQ ID NO: 3900390 - RNA, 13 nt, Shigella flexneri 2a str. 301
aaacuggcugugc

SEQ ID NO: 3900391 - RNA, 21 nt, Shigella flexneri 2a str. 301
aaacuggguuuugaucuccag

SEQ ID NO: 3900392 - RNA, 23 nt, Shigella flexneri 2a str. 301
aaacugguagcuguagguaaaac

SEQ ID NO: 3900393 - RNA, 15 nt, Shigella flexneri 2a str. 301
aaacuguuuacaggc

SEQ ID NO: 3900394 - RNA, 16 nt, Shigella flexneri 2a str. 301
aaacuucacuuccccg

SEQ ID NO: 3900395 - RNA, 15 nt, Shigella flexneri 2a str. 301
aaacuucgucacagc

SEQ ID NO: 3900396 - RNA, 18 nt, Shigella flexneri 2a str. 301
aaacuugaacgcgagaaa

SEQ ID NO: 3900397 - RNA, 22 nt, Shigella flexneri 2a str. 301
aaacuugaacgcgagaaaagca

SEQ ID NO: 3900398 - RNA, 17 nt, Shigella flexneri 2a str. 301
aaacuugcguaucgacc

SEQ ID NO: 3900399 - RNA, 21 nt, Shigella flexneri 2a str. 301
aaacuuuaauuuuucaauauc

SEQ ID NO: 3900400 - RNA, 12 nt, Shigella flexneri 2a str. 301
aaacuuuuaaau

SEQ ID NO: 3900401 - RNA, 13 nt, Shigella flexneri 2a str. 301
aaacuuuuaaauu

SEQ ID NO: 3900402 - RNA, 20 nt, Shigella flexneri 2a str. 301
aaacuuuucccuacugcuga

SEQ ID NO: 3900403 - RNA, 23 nt, Shigella flexneri 2a str. 301
aaacuuuucccuacugcugacau

SEQ ID NO: 3900404 - RNA, 11 nt, Shigella flexneri 2a str. 301
aaagaaaagau

SEQ ID NO: 3900405 - RNA, 13 nt, Shigella flexneri 2a str. 301
aaagaaaucccau

SEQ ID NO: 3900406 - RNA, 18 nt, Shigella flexneri 2a str. 301
aaagaagcggugaaaaaa

SEQ ID NO: 3900407 - RNA, 19 nt, Shigella flexneri 2a str. 301
aaagaagcggugaaaaaau

SEQ ID NO: 3900408 - RNA, 13 nt, Shigella flexneri 2a str. 301
aaagaaggaaaau

SEQ ID NO: 3900409 - RNA, 16 nt, Shigella flexneri 2a str. 301
aaagaaggcauaacuc

SEQ ID NO: 3900410 - RNA, 12 nt, Shigella flexneri 2a str. 301
aaagaauugcag

SEQ ID NO: 3900411 - RNA, 18 nt, Shigella flexneri 2a str. 301
aaagaccaggaaacccaa

SEQ ID NO: 3900412 - RNA, 13 nt, Shigella flexneri 2a str. 301
aaagacguuaaaa

SEQ ID NO: 3900413 - RNA, 16 nt, Shigella flexneri 2a str. 301
aaagagaacucuuuuu

SEQ ID NO: 3900414 - RNA, 16 nt, Shigella flexneri 2a str. 301
aaagagaguuacuggc

SEQ ID NO: 3900415 - RNA, 15 nt, Shigella flexneri 2a str. 301
aaagagcaucagcag

SEQ ID NO: 3900416 - RNA, 16 nt, Shigella flexneri 2a str. 301
aaagagcaucagcagu

SEQ ID NO: 3900417 - RNA, 19 nt, Shigella flexneri 2a str. 301
aaagagcauuacacgcggc

SEQ ID NO: 3900418 - RNA, 18 nt, Shigella flexneri 2a str. 301
aaagaggcguuugcaggu

SEQ ID NO: 3900419 - RNA, 16 nt, Shigella flexneri 2a str. 301
aaagagggcauggcgc

SEQ ID NO: 3900420 - RNA, 16 nt, Shigella flexneri 2a str. 301
aaagaguaaaguuagu

SEQ ID NO: 3900421 - RNA, 16 nt, Shigella flexneri 2a str. 301
aaagauccguaaugcc

SEQ ID NO: 3900422 - RNA, 15 nt, Shigella flexneri 2a str. 301
aaagaucgccacugc

SEQ ID NO: 3900423 - RNA, 22 nt, Shigella flexneri 2a str. 301
aaagaucugcgugaguuuuugu

SEQ ID NO: 3900424 - RNA, 22 nt, Shigella flexneri 2a str. 301
aaagaugccauuggcauaaaua

SEQ ID NO: 3900425 - RNA, 23 nt, Shigella flexneri 2a str. 301
aaagauggauugcugaaauacag

SEQ ID NO: 3900426 - RNA, 21 nt, Shigella flexneri 2a str. 301
aaagauggcgcgcagaaagag

SEQ ID NO: 3900427 - RNA, 13 nt, Shigella flexneri 2a str. 301
aaagauuaaaaaa

SEQ ID NO: 3900428 - RNA, 20 nt, Shigella flexneri 2a str. 301
aaagauuaaaaaaacaccac

SEQ ID NO: 3900429 - RNA, 13 nt, Shigella flexneri 2a str. 301
aaagauuuuacca

SEQ ID NO: 3900430 - RNA, 13 nt, Shigella flexneri 2a str. 301
aaagcaaaaauaa

SEQ ID NO: 3900431 - RNA, 20 nt, Shigella flexneri 2a str. 301
aaagcaaaaauaagcgacgu

SEQ ID NO: 3900432 - RNA, 14 nt, Shigella flexneri 2a str. 301
aaagcaagccaggu

SEQ ID NO: 3900433 - RNA, 14 nt, Shigella flexneri 2a str. 301
aaagcaauuccagc

SEQ ID NO: 3900434 - RNA, 16 nt, Shigella flexneri 2a str. 301
aaagcaauuccagcgc

SEQ ID NO: 3900435 - RNA, 12 nt, Shigella flexneri 2a str. 301
aaagcacaaaau

SEQ ID NO: 3900436 - RNA, 19 nt, Shigella flexneri 2a str. 301
aaagcacagaaucuaagau

SEQ ID NO: 3900437 - RNA, 21 nt, Shigella flexneri 2a str. 301
aaagcacccagcaauccugca

SEQ ID NO: 3900438 - RNA, 22 nt, Shigella flexneri 2a str. 301
aaagcacuuuuuguaauuuuuu

SEQ ID NO: 3900439 - RNA, 20 nt, Shigella flexneri 2a str. 301
aaagcagacuuuuugcggca

SEQ ID NO: 3900440 - RNA, 16 nt, Shigella flexneri 2a str. 301
aaagcagauaacccag

SEQ ID NO: 3900441 - RNA, 17 nt, Shigella flexneri 2a str. 301
aaagcagauaacccagc

SEQ ID NO: 3900442 - RNA, 12 nt, Shigella flexneri 2a str. 301
aaagcagcgaag

SEQ ID NO: 3900443 - RNA, 14 nt, Shigella flexneri 2a str. 301
aaagcaggccagau

SEQ ID NO: 3900444 - RNA, 22 nt, Shigella flexneri 2a str. 301
aaagcaggcuggaguuacccag

SEQ ID NO: 3900445 - RNA, 17 nt, Shigella flexneri 2a str. 301
aaagcagguuuuacgca

SEQ ID NO: 3900446 - RNA, 16 nt, Shigella flexneri 2a str. 301
aaagcauuuuuucaca

SEQ ID NO: 3900447 - RNA, 15 nt, Shigella flexneri 2a str. 301
aaagccaacagcagc

SEQ ID NO: 3900448 - RNA, 23 nt, Shigella flexneri 2a str. 301
aaagccacggauauauccguggc

SEQ ID NO: 3900449 - RNA, 17 nt, Shigella flexneri 2a str. 301
aaagcccauaccacagc

SEQ ID NO: 3900450 - RNA, 17 nt, Shigella flexneri 2a str. 301
aaagcccaucauccgcg

SEQ ID NO: 3900451 - RNA, 14 nt, Shigella flexneri 2a str. 301
aaagccccaccagc

SEQ ID NO: 3900452 - RNA, 16 nt, Shigella flexneri 2a str. 301
aaagccccaccagcaa

SEQ ID NO: 3900453 - RNA, 20 nt, Shigella flexneri 2a str. 301
aaagcccccgcaacauugcg

SEQ ID NO: 3900454 - RNA, 13 nt, Shigella flexneri 2a str. 301
aaagcccgccauc

SEQ ID NO: 3900455 - RNA, 15 nt, Shigella flexneri 2a str. 301
aaagcccucaccgaa

SEQ ID NO: 3900456 - RNA, 21 nt, Shigella flexneri 2a str. 301
aaagcccuugccgaugcggga

SEQ ID NO: 3900457 - RNA, 16 nt, Shigella flexneri 2a str. 301
aaagccgccaucucuu

SEQ ID NO: 3900458 - RNA, 20 nt, Shigella flexneri 2a str. 301
aaagccgccaucucuuccag

SEQ ID NO: 3900459 - RNA, 20 nt, Shigella flexneri 2a str. 301
aaagccggaugaucauccgg

SEQ ID NO: 3900460 - RNA, 21 nt, Shigella flexneri 2a str. 301
aaagccucucgcgaggagagg

SEQ ID NO: 3900461 - RNA, 23 nt, Shigella flexneri 2a str. 301
aaagccucucgcgaggagaggcc

SEQ ID NO: 3900462 - RNA, 13 nt, Shigella flexneri 2a str. 301
aaagccugcuuca

SEQ ID NO: 3900463 - RNA, 22 nt, Shigella flexneri 2a str. 301
aaagccuguaacgccuuuucca

SEQ ID NO: 3900464 - RNA, 16 nt, Shigella flexneri 2a str. 301
aaagccuuucacuucg

SEQ ID NO: 3900465 - RNA, 15 nt, Shigella flexneri 2a str. 301
aaagccuuuugccag

SEQ ID NO: 3900466 - RNA, 16 nt, Shigella flexneri 2a str. 301
aaagccuuuugccagu

SEQ ID NO: 3900467 - RNA, 13 nt, Shigella flexneri 2a str. 301
aaagcgaagcgaa

SEQ ID NO: 3900468 - RNA, 15 nt, Shigella flexneri 2a str. 301
aaagcgacuuugccu

SEQ ID NO: 3900469 - RNA, 13 nt, Shigella flexneri 2a str. 301
aaagcgagcagua

SEQ ID NO: 3900470 - RNA, 15 nt, Shigella flexneri 2a str. 301
aaagcgcaccugauc

SEQ ID NO: 3900471 - RNA, 12 nt, Shigella flexneri 2a str. 301
aaauacagauuc

SEQ ID NO: 3900472 - RNA, 18 nt, Shigella flexneri 2a str. 301
aaauacagcaauggaaaa

SEQ ID NO: 3900473 - RNA, 11 nt, Shigella flexneri 2a str. 301
aaauacaugac

SEQ ID NO: 3900474 - RNA, 15 nt, Shigella flexneri 2a str. 301
aaauacccaaaaaau

SEQ ID NO: 3900475 - RNA, 20 nt, Shigella flexneri 2a str. 301
aaauaccggacacacuucau

SEQ ID NO: 3900476 - RNA, 23 nt, Shigella flexneri 2a str. 301
aaauacgcuuuuucccugguaaa

SEQ ID NO: 3900477 - RNA, 19 nt, Shigella flexneri 2a str. 301
aaauacuggcuaagaagcc

SEQ ID NO: 3900478 - RNA, 21 nt, Shigella flexneri 2a str. 301
aaauacuguuuaucuucccag

SEQ ID NO: 3900479 - RNA, 22 nt, Shigella flexneri 2a str. 301
aaauacuguuuaucuucccagc

SEQ ID NO: 3900480 - RNA, 15 nt, Shigella flexneri 2a str. 301
aaauagaaagugacu

SEQ ID NO: 3900481 - RNA, 16 nt, Shigella flexneri 2a str. 301
aaauagacacaagaaa

SEQ ID NO: 3900482 - RNA, 19 nt, Shigella flexneri 2a str. 301
aaauagaggaaucugauua

SEQ ID NO: 3900483 - RNA, 14 nt, Shigella flexneri 2a str. 301
aaauagcaaaguaa

SEQ ID NO: 3900484 - RNA, 20 nt, Shigella flexneri 2a str. 301
aaauagcaaaguaauaauga

SEQ ID NO: 3900485 - RNA, 17 nt, Shigella flexneri 2a str. 301
aaauagccaaucauucc

SEQ ID NO: 3900486 - RNA, 21 nt, Shigella flexneri 2a str. 301
aaauagccaaucauucccauu

SEQ ID NO: 3900487 - RNA, 17 nt, Shigella flexneri 2a str. 301
aaauagccaauucccag

SEQ ID NO: 3900488 - RNA, 17 nt, Shigella flexneri 2a str. 301
aaauagccccugacugg

SEQ ID NO: 3900489 - RNA, 14 nt, Shigella flexneri 2a str. 301
aaauagccugccag

SEQ ID NO: 3900490 - RNA, 23 nt, Shigella flexneri 2a str. 301
aaauagugccuggcugcgugagg

SEQ ID NO: 3900491 - RNA, 13 nt, Shigella flexneri 2a str. 301
aaauauaaaacaa

SEQ ID NO: 3900492 - RNA, 23 nt, Shigella flexneri 2a str. 301
aaauaucaaagacaaauuuugaa

SEQ ID NO: 3900493 - RNA, 23 nt, Shigella flexneri 2a str. 301
aaauaucacucggggcuuuucuc

SEQ ID NO: 3900494 - RNA, 21 nt, Shigella flexneri 2a str. 301
aaauauccguagugaaaaagc

SEQ ID NO: 3900495 - RNA, 17 nt, Shigella flexneri 2a str. 301
aaauaucgcccauauga

SEQ ID NO: 3900496 - RNA, 22 nt, Shigella flexneri 2a str. 301
aaauaucuauauacaaucacac

SEQ ID NO: 3900497 - RNA, 13 nt, Shigella flexneri 2a str. 301
aaauaucuuauag

SEQ ID NO: 3900498 - RNA, 16 nt, Shigella flexneri 2a str. 301
aaauauggcgcaccga

SEQ ID NO: 3900499 - RNA, 21 nt, Shigella flexneri 2a str. 301
aaauaugggugcaaugagaau

SEQ ID NO: 3900500 - RNA, 22 nt, Shigella flexneri 2a str. 301
aaauauggugaaaguaaaaaag

SEQ ID NO: 3900501 - RNA, 13 nt, Shigella flexneri 2a str. 301
aaauauuaauaau

SEQ ID NO: 3900502 - RNA, 14 nt, Shigella flexneri 2a str. 301
aaauauuaauaaua

SEQ ID NO: 3900503 - RNA, 16 nt, Shigella flexneri 2a str. 301
aaauauuaauaauaca

SEQ ID NO: 3900504 - RNA, 15 nt, Shigella flexneri 2a str. 301
aaauauugagcagaa

SEQ ID NO: 3900505 - RNA, 15 nt, Shigella flexneri 2a str. 301
aaaucaaacagaaua

SEQ ID NO: 3900506 - RNA, 12 nt, Shigella flexneri 2a str. 301
aaaucaaaccaa

SEQ ID NO: 3900507 - RNA, 15 nt, Shigella flexneri 2a str. 301
aaaucaacaugaaaa

SEQ ID NO: 3900508 - RNA, 19 nt, Shigella flexneri 2a str. 301
aaaucaacaugaaaauaac

SEQ ID NO: 3900509 - RNA, 22 nt, Shigella flexneri 2a str. 301
aaaucaacaugaaaauaaccau

SEQ ID NO: 3900510 - RNA, 22 nt, Shigella flexneri 2a str. 301
aaaucaacauguuccugccagu

SEQ ID NO: 3900511 - RNA, 22 nt, Shigella flexneri 2a str. 301
aaaucaacgacaaaaauaccac

SEQ ID NO: 3900512 - RNA, 15 nt, Shigella flexneri 2a str. 301
aaaucaacgccgcau

SEQ ID NO: 3900513 - RNA, 22 nt, Shigella flexneri 2a str. 301
aaaucaacuugacgauuaacgc

SEQ ID NO: 3900514 - RNA, 11 nt, Shigella flexneri 2a str. 301
aaaucaccaca

SEQ ID NO: 3900515 - RNA, 14 nt, Shigella flexneri 2a str. 301
aaaucaccaccagc

SEQ ID NO: 3900516 - RNA, 17 nt, Shigella flexneri 2a str. 301
aaaucaccaccagcacc

SEQ ID NO: 3900517 - RNA, 21 nt, Shigella flexneri 2a str. 301
aaaucaccauauucagcagca

SEQ ID NO: 3900518 - RNA, 16 nt, Shigella flexneri 2a str. 301
aaaucacgauugcugc

SEQ ID NO: 3900519 - RNA, 13 nt, Shigella flexneri 2a str. 301
aaaucacgcauca

SEQ ID NO: 3900520 - RNA, 13 nt, Shigella flexneri 2a str. 301
aaaucacgcaucg

SEQ ID NO: 3900521 - RNA, 13 nt, Shigella flexneri 2a str. 301
aaaucacgcgccu

SEQ ID NO: 3900522 - RNA, 20 nt, Shigella flexneri 2a str. 301
aaaucacgcugcugauuaaa

SEQ ID NO: 3900523 - RNA, 18 nt, Shigella flexneri 2a str. 301
aaaucacgucgauuuuua

SEQ ID NO: 3900524 - RNA, 16 nt, Shigella flexneri 2a str. 301
aaaucacuaaacccga

SEQ ID NO: 3900525 - RNA, 22 nt, Shigella flexneri 2a str. 301
aaaucacuaaacccgaccacuu

SEQ ID NO: 3900526 - RNA, 20 nt, Shigella flexneri 2a str. 301
aaaucacuauuaaagaaagu

SEQ ID NO: 3900527 - RNA, 22 nt, Shigella flexneri 2a str. 301
aaaucacuauuaaagaaaguaa

SEQ ID NO: 3900528 - RNA, 14 nt, Shigella flexneri 2a str. 301
aaaucagaaaucac

SEQ ID NO: 3900529 - RNA, 19 nt, Shigella flexneri 2a str. 301
aaaucagguggcuauaaau

SEQ ID NO: 3900530 - RNA, 22 nt, Shigella flexneri 2a str. 301
aaaucaguggcuggaacaacgu

SEQ ID NO: 3900531 - RNA, 15 nt, Shigella flexneri 2a str. 301
aaaucauaaaaauca

SEQ ID NO: 3900532 - RNA, 17 nt, Shigella flexneri 2a str. 301
aaaucauauaauuguuc

SEQ ID NO: 3900533 - RNA, 22 nt, Shigella flexneri 2a str. 301
aaaucauauaucgcaagucauu

SEQ ID NO: 3900534 - RNA, 14 nt, Shigella flexneri 2a str. 301
aaaucaucaucuuu

SEQ ID NO: 3900535 - RNA, 16 nt, Shigella flexneri 2a str. 301
aaaucaucaucuuuau

SEQ ID NO: 3900536 - RNA, 19 nt, Shigella flexneri 2a str. 301
aaaucaucauugcuguuuu

SEQ ID NO: 3900537 - RNA, 22 nt, Shigella flexneri 2a str. 301
aaaucaucauugcuguuuuaca

SEQ ID NO: 3900538 - RNA, 21 nt, Shigella flexneri 2a str. 301
aaaucauccagacugcucagc

SEQ ID NO: 3900539 - RNA, 12 nt, Shigella flexneri 2a str. 301
aaaucauccgcu

SEQ ID NO: 3900540 - RNA, 21 nt, Shigella flexneri 2a str. 301
aaauccaccaguggacggcug

SEQ ID NO: 3900541 - RNA, 17 nt, Shigella flexneri 2a str. 301
aaaucccagugccugca

SEQ ID NO: 3900542 - RNA, 18 nt, Shigella flexneri 2a str. 301
aaaucccagugccugcau

SEQ ID NO: 3900543 - RNA, 23 nt, Shigella flexneri 2a str. 301
aaaucccgccgcuggcgggauuu

SEQ ID NO: 3900544 - RNA, 19 nt, Shigella flexneri 2a str. 301
aaaucccgcuucaacgacc

SEQ ID NO: 3900545 - RNA, 14 nt, Shigella flexneri 2a str. 301
aaauccgaacuauu

SEQ ID NO: 3900546 - RNA, 16 nt, Shigella flexneri 2a str. 301
aaauccgcacucaucu

SEQ ID NO: 3900547 - RNA, 18 nt, Shigella flexneri 2a str. 301
aaauccgcacucaucuua

SEQ ID NO: 3900548 - RNA, 22 nt, Shigella flexneri 2a str. 301
aaauccugucuggcgaauaaua

SEQ ID NO: 3900549 - RNA, 19 nt, Shigella flexneri 2a str. 301
aaauccuucacuuuugcca

SEQ ID NO: 3900550 - RNA, 20 nt, Shigella flexneri 2a str. 301
aaauccuucacuuuugccag

SEQ ID NO: 3900551 - RNA, 14 nt, Shigella flexneri 2a str. 301
aaaucgacagccag

SEQ ID NO: 3900552 - RNA, 18 nt, Shigella flexneri 2a str. 301
aaaucgauaaaacuuccc

SEQ ID NO: 3900553 - RNA, 20 nt, Shigella flexneri 2a str. 301
aaaucgauaaaacuucccgu

SEQ ID NO: 3900554 - RNA, 16 nt, Shigella flexneri 2a str. 301
aaaucgaucaucaccu

SEQ ID NO: 3900555 - RNA, 18 nt, Shigella flexneri 2a str. 301
aaaucgcaagaucucauu

SEQ ID NO: 3900556 - RNA, 11 nt, Shigella flexneri 2a str. 301
aaaucgcccgg

SEQ ID NO: 3900557 - RNA, 21 nt, Shigella flexneri 2a str. 301
aaaucggcgcggaaucgcccu

SEQ ID NO: 3900558 - RNA, 14 nt, Shigella flexneri 2a str. 301
aaaucggugggcug

SEQ ID NO: 3900559 - RNA, 18 nt, Shigella flexneri 2a str. 301
aaaucggugggcugacau

SEQ ID NO: 3900560 - RNA, 17 nt, Shigella flexneri 2a str. 301
aaaucgucgagggauuu

SEQ ID NO: 3900561 - RNA, 17 nt, Shigella flexneri 2a str. 301
aaaucuauuauuauuuu

SEQ ID NO: 3900562 - RNA, 15 nt, Shigella flexneri 2a str. 301
aaaucuauugcaaca

SEQ ID NO: 3900563 - RNA, 22 nt, Shigella flexneri 2a str. 301
aaaucucacccgguacaucaau

SEQ ID NO: 3900564 - RNA, 21 nt, Shigella flexneri 2a str. 301
aaaucucagcccgaugauaaa

SEQ ID NO: 3900565 - RNA, 12 nt, Shigella flexneri 2a str. 301
aaaucuccagau

SEQ ID NO: 3900566 - RNA, 11 nt, Shigella flexneri 2a str. 301
aaaucuccauu

SEQ ID NO: 3900567 - RNA, 21 nt, Shigella flexneri 2a str. 301
aaaucuccugccaauacaaaa

SEQ ID NO: 3900568 - RNA, 18 nt, Shigella flexneri 2a str. 301
aaaucugauuaauauuga

SEQ ID NO: 3900569 - RNA, 19 nt, Shigella flexneri 2a str. 301
aaaucugcccguuaaccau

SEQ ID NO: 3900570 - RNA, 12 nt, Shigella flexneri 2a str. 301
aaaucuggugcu

SEQ ID NO: 3900571 - RNA, 20 nt, Shigella flexneri 2a str. 301
aacaacacauucaauaacac

SEQ ID NO: 3900572 - RNA, 21 nt, Shigella flexneri 2a str. 301
aacaacagcgauuauggauca

SEQ ID NO: 3900573 - RNA, 22 nt, Shigella flexneri 2a str. 301
aacaacagucccaggcagaagc

SEQ ID NO: 3900574 - RNA, 19 nt, Shigella flexneri 2a str. 301
aacaacaguuuuaucucca

SEQ ID NO: 3900575 - RNA, 21 nt, Shigella flexneri 2a str. 301
aacaacccuaaagcacccagc

SEQ ID NO: 3900576 - RNA, 18 nt, Shigella flexneri 2a str. 301
aacaacgagccaauaaaa

SEQ ID NO: 3900577 - RNA, 19 nt, Shigella flexneri 2a str. 301
aacaacgcgcggaacugau

SEQ ID NO: 3900578 - RNA, 21 nt, Shigella flexneri 2a str. 301
aacaacgcgcggaacugauga

SEQ ID NO: 3900579 - RNA, 22 nt, Shigella flexneri 2a str. 301
aacaacgggcaccgccgccgcu

SEQ ID NO: 3900580 - RNA, 17 nt, Shigella flexneri 2a str. 301
aacaacugaaaaaaaau

SEQ ID NO: 3900581 - RNA, 12 nt, Shigella flexneri 2a str. 301
aacaagcgaauu

SEQ ID NO: 3900582 - RNA, 16 nt, Shigella flexneri 2a str. 301
aacaagcguacaaaau

SEQ ID NO: 3900583 - RNA, 15 nt, Shigella flexneri 2a str. 301
aacaaggcaggauua

SEQ ID NO: 3900584 - RNA, 22 nt, Shigella flexneri 2a str. 301
aacaauaauuaucauuacaauu

SEQ ID NO: 3900585 - RNA, 15 nt, Shigella flexneri 2a str. 301
aacaauacaaaugcc

SEQ ID NO: 3900586 - RNA, 18 nt, Shigella flexneri 2a str. 301
aacaauauuugcagaggu

SEQ ID NO: 3900587 - RNA, 14 nt, Shigella flexneri 2a str. 301
aacaaucacaauag

SEQ ID NO: 3900588 - RNA, 18 nt, Shigella flexneri 2a str. 301
aacaaucacaauagaaau

SEQ ID NO: 3900589 - RNA, 18 nt, Shigella flexneri 2a str. 301
aacaaucucuuccagaau

SEQ ID NO: 3900590 - RNA, 22 nt, Shigella flexneri 2a str. 301
aacaaucugcaaaucgaucuca

SEQ ID NO: 3900591 - RNA, 23 nt, Shigella flexneri 2a str. 301
aacaaugagauauuuaaaugauu

SEQ ID NO: 3900592 - RNA, 19 nt, Shigella flexneri 2a str. 301
aacaaugccgauaaauaca

SEQ ID NO: 3900593 - RNA, 12 nt, Shigella flexneri 2a str. 301
aacaaugggaaa

SEQ ID NO: 3900594 - RNA, 15 nt, Shigella flexneri 2a str. 301
aacaaugggaaaaca

SEQ ID NO: 3900595 - RNA, 14 nt, Shigella flexneri 2a str. 301
aacaauguuguggc

SEQ ID NO: 3900596 - RNA, 19 nt, Shigella flexneri 2a str. 301
aacaauuaacguaucaauu

SEQ ID NO: 3900597 - RNA, 20 nt, Shigella flexneri 2a str. 301
aacaauuaacguaucaauua

SEQ ID NO: 3900598 - RNA, 22 nt, Shigella flexneri 2a str. 301
aacaauucccgcagcuccagcc

SEQ ID NO: 3900599 - RNA, 21 nt, Shigella flexneri 2a str. 301
aacaauugagauucaaauaag

SEQ ID NO: 3900600 - RNA, 13 nt, Shigella flexneri 2a str. 301
aacacaacgcuuu

SEQ ID NO: 3900601 - RNA, 15 nt, Shigella flexneri 2a str. 301
aacacaauauucaua

SEQ ID NO: 3900602 - RNA, 18 nt, Shigella flexneri 2a str. 301
aacacagcaucuggauga

SEQ ID NO: 3900603 - RNA, 17 nt, Shigella flexneri 2a str. 301
aacacagguaacuuaaa

SEQ ID NO: 3900604 - RNA, 13 nt, Shigella flexneri 2a str. 301
aacacauaacgcc

SEQ ID NO: 3900605 - RNA, 15 nt, Shigella flexneri 2a str. 301
aacacauccaguggc

SEQ ID NO: 3900606 - RNA, 17 nt, Shigella flexneri 2a str. 301
aacacauucaauaacac

SEQ ID NO: 3900607 - RNA, 19 nt, Shigella flexneri 2a str. 301
aacacauugugaaugauca

SEQ ID NO: 3900608 - RNA, 14 nt, Shigella flexneri 2a str. 301
aacaccaaacccug

SEQ ID NO: 3900609 - RNA, 17 nt, Shigella flexneri 2a str. 301
aacaccaccugccagag

SEQ ID NO: 3900610 - RNA, 13 nt, Shigella flexneri 2a str. 301
aacaccagcagua

SEQ ID NO: 3900611 - RNA, 20 nt, Shigella flexneri 2a str. 301
aacaccaucauauuuuccau

SEQ ID NO: 3900612 - RNA, 21 nt, Shigella flexneri 2a str. 301
aacacccgaccaucaacuaaa

SEQ ID NO: 3900613 - RNA, 21 nt, Shigella flexneri 2a str. 301
aacaccgauuuuguaaaagaa

SEQ ID NO: 3900614 - RNA, 23 nt, Shigella flexneri 2a str. 301
aacaccgugcauuucucacuuuu

SEQ ID NO: 3900615 - RNA, 20 nt, Shigella flexneri 2a str. 301
aacaccguugcccgcauuau

SEQ ID NO: 3900616 - RNA, 12 nt, Shigella flexneri 2a str. 301
aacaccuggcgc

SEQ ID NO: 3900617 - RNA, 18 nt, Shigella flexneri 2a str. 301
aacaccuguuccaguggc

SEQ ID NO: 3900618 - RNA, 15 nt, Shigella flexneri 2a str. 301
aacaccuguugcgcg

SEQ ID NO: 3900619 - RNA, 18 nt, Shigella flexneri 2a str. 301
aacaccuucauccagcau

SEQ ID NO: 3900620 - RNA, 19 nt, Shigella flexneri 2a str. 301
aacaccuucauccagcauc

SEQ ID NO: 3900621 - RNA, 14 nt, Shigella flexneri 2a str. 301
aacacgaucagcca

SEQ ID NO: 3900622 - RNA, 22 nt, Shigella flexneri 2a str. 301
aacacgaucucacgcugaaaga

SEQ ID NO: 3900623 - RNA, 19 nt, Shigella flexneri 2a str. 301
aacacgcgaccaaaggcga

SEQ ID NO: 3900624 - RNA, 15 nt, Shigella flexneri 2a str. 301
aacacgcucaggcga

SEQ ID NO: 3900625 - RNA, 21 nt, Shigella flexneri 2a str. 301
aacacggcagcaaccgcuucc

SEQ ID NO: 3900626 - RNA, 18 nt, Shigella flexneri 2a str. 301
aacacguugcacuagguu

SEQ ID NO: 3900627 - RNA, 19 nt, Shigella flexneri 2a str. 301
aacacucaguccgccuuca

SEQ ID NO: 3900628 - RNA, 16 nt, Shigella flexneri 2a str. 301
aacacucucugaagua

SEQ ID NO: 3900629 - RNA, 15 nt, Shigella flexneri 2a str. 301
aacacucuuccaguc

SEQ ID NO: 3900630 - RNA, 14 nt, Shigella flexneri 2a str. 301
aacacucuuuuuga

SEQ ID NO: 3900631 - RNA, 20 nt, Shigella flexneri 2a str. 301
aacacuuguuaugagauaau

SEQ ID NO: 3900632 - RNA, 19 nt, Shigella flexneri 2a str. 301
aacacuuuacgcuuuuuga

SEQ ID NO: 3900633 - RNA, 14 nt, Shigella flexneri 2a str. 301
aacagaacaauaau

SEQ ID NO: 3900634 - RNA, 23 nt, Shigella flexneri 2a str. 301
aacagaacgcgccuuaaaaacca

SEQ ID NO: 3900635 - RNA, 13 nt, Shigella flexneri 2a str. 301
aacagacaaaaag

SEQ ID NO: 3900636 - RNA, 12 nt, Shigella flexneri 2a str. 301
aacagaccaaug

SEQ ID NO: 3900637 - RNA, 19 nt, Shigella flexneri 2a str. 301
aacagaccagcaccggugc

SEQ ID NO: 3900638 - RNA, 15 nt, Shigella flexneri 2a str. 301
aacagaccaguaaag

SEQ ID NO: 3900639 - RNA, 17 nt, Shigella flexneri 2a str. 301
aacagacuggcaacgac

SEQ ID NO: 3900640 - RNA, 12 nt, Shigella flexneri 2a str. 301
aacagagauuac

SEQ ID NO: 3900641 - RNA, 16 nt, Shigella flexneri 2a str. 301
aacagauaaaucauaa

SEQ ID NO: 3900642 - RNA, 21 nt, Shigella flexneri 2a str. 301
aacagauaggcaucagcaauu

SEQ ID NO: 3900643 - RNA, 20 nt, Shigella flexneri 2a str. 301
aacagauaguuaccguacuc

SEQ ID NO: 3900644 - RNA, 21 nt, Shigella flexneri 2a str. 301
aacagaugaugcgucucauca

SEQ ID NO: 3900645 - RNA, 22 nt, Shigella flexneri 2a str. 301
aacagaugaugcgucucaucag

SEQ ID NO: 3900646 - RNA, 16 nt, Shigella flexneri 2a str. 301
aacagcaaccuccguc

SEQ ID NO: 3900647 - RNA, 19 nt, Shigella flexneri 2a str. 301
aacagcaauacguuucaua

SEQ ID NO: 3900648 - RNA, 13 nt, Shigella flexneri 2a str. 301
aacagcacaucag

SEQ ID NO: 3900649 - RNA, 15 nt, Shigella flexneri 2a str. 301
aacagcaccagcagg

SEQ ID NO: 3900650 - RNA, 23 nt, Shigella flexneri 2a str. 301
aacagcaccagcaggugauacau

SEQ ID NO: 3900651 - RNA, 11 nt, Shigella flexneri 2a str. 301
aacagcaccau

SEQ ID NO: 3900652 - RNA, 16 nt, Shigella flexneri 2a str. 301
aacagcaccauccgcc

SEQ ID NO: 3900653 - RNA, 20 nt, Shigella flexneri 2a str. 301
aacagcagaacgaccagcgc

SEQ ID NO: 3900654 - RNA, 16 nt, Shigella flexneri 2a str. 301
aacagcaggcagaucc

SEQ ID NO: 3900655 - RNA, 13 nt, Shigella flexneri 2a str. 301
aacagccagaagc

SEQ ID NO: 3900656 - RNA, 15 nt, Shigella flexneri 2a str. 301
aacagccagaagccc

SEQ ID NO: 3900657 - RNA, 17 nt, Shigella flexneri 2a str. 301
aacagccagcagcgaau

SEQ ID NO: 3900658 - RNA, 21 nt, Shigella flexneri 2a str. 301
aacagccagcgcugacgugau

SEQ ID NO: 3900659 - RNA, 21 nt, Shigella flexneri 2a str. 301
aacagccauaaccccaccagc

SEQ ID NO: 3900660 - RNA, 22 nt, Shigella flexneri 2a str. 301
aacagccauaaccccaccagca

SEQ ID NO: 3900661 - RNA, 16 nt, Shigella flexneri 2a str. 301
aacagcccaaucaucg

SEQ ID NO: 3900662 - RNA, 16 nt, Shigella flexneri 2a str. 301
aacagccccugagcgu

SEQ ID NO: 3900663 - RNA, 19 nt, Shigella flexneri 2a str. 301
aacagcgcaccagaaacaa

SEQ ID NO: 3900664 - RNA, 22 nt, Shigella flexneri 2a str. 301
aacagcgcaccagaaacaauaa

SEQ ID NO: 3900665 - RNA, 11 nt, Shigella flexneri 2a str. 301
aacagcgcauu

SEQ ID NO: 3900666 - RNA, 23 nt, Shigella flexneri 2a str. 301
aacagcgccuguuuaccgcucac

SEQ ID NO: 3900667 - RNA, 19 nt, Shigella flexneri 2a str. 301
aacagcgcgccagccacca

SEQ ID NO: 3900668 - RNA, 20 nt, Shigella flexneri 2a str. 301
aacagcgguguacccugcuc

SEQ ID NO: 3900669 - RNA, 22 nt, Shigella flexneri 2a str. 301
aacagcgguuuugcuauccagu

SEQ ID NO: 3900670 - RNA, 20 nt, Shigella flexneri 2a str. 301
aaccaccccaccuuaccugu

SEQ ID NO: 3900671 - RNA, 20 nt, Shigella flexneri 2a str. 301
aaccaccgucgucccuuccg

SEQ ID NO: 3900672 - RNA, 21 nt, Shigella flexneri 2a str. 301
aaccaccuccacgcccagcgc

SEQ ID NO: 3900673 - RNA, 16 nt, Shigella flexneri 2a str. 301
aaccacgcaaaauccc

SEQ ID NO: 3900674 - RNA, 14 nt, Shigella flexneri 2a str. 301
aaccacgcaauaaa

SEQ ID NO: 3900675 - RNA, 23 nt, Shigella flexneri 2a str. 301
aaccacgccuaaaauccacaucg

SEQ ID NO: 3900676 - RNA, 17 nt, Shigella flexneri 2a str. 301
aaccacggaaaggcagu

SEQ ID NO: 3900677 - RNA, 16 nt, Shigella flexneri 2a str. 301
aaccacggaauaacca

SEQ ID NO: 3900678 - RNA, 19 nt, Shigella flexneri 2a str. 301
aaccacuauuauggcgcag

SEQ ID NO: 3900679 - RNA, 20 nt, Shigella flexneri 2a str. 301
aaccagaaagggaagaacau

SEQ ID NO: 3900680 - RNA, 14 nt, Shigella flexneri 2a str. 301
aaccagacugugaa

SEQ ID NO: 3900681 - RNA, 15 nt, Shigella flexneri 2a str. 301
aaccagagaauauua

SEQ ID NO: 3900682 - RNA, 14 nt, Shigella flexneri 2a str. 301
aaccagcaggcugg

SEQ ID NO: 3900683 - RNA, 16 nt, Shigella flexneri 2a str. 301
aaccagcgcagacacc

SEQ ID NO: 3900684 - RNA, 18 nt, Shigella flexneri 2a str. 301
aaccagcgcagacaccag

SEQ ID NO: 3900685 - RNA, 22 nt, Shigella flexneri 2a str. 301
aaccagcgcggcgauaaugccc

SEQ ID NO: 3900686 - RNA, 18 nt, Shigella flexneri 2a str. 301
aaccagcgucagccagaa

SEQ ID NO: 3900687 - RNA, 21 nt, Shigella flexneri 2a str. 301
aaccagcuuaugccuguccuc

SEQ ID NO: 3900688 - RNA, 19 nt, Shigella flexneri 2a str. 301
aaccagggaaaaaagcccc

SEQ ID NO: 3900689 - RNA, 15 nt, Shigella flexneri 2a str. 301
aaccaguaaugaucg

SEQ ID NO: 3900690 - RNA, 19 nt, Shigella flexneri 2a str. 301
aaccagucgccgcuuucaa

SEQ ID NO: 3900691 - RNA, 23 nt, Shigella flexneri 2a str. 301
aaccaguuacgugcugcgcagac

SEQ ID NO: 3900692 - RNA, 15 nt, Shigella flexneri 2a str. 301
aaccauaaaaucaca

SEQ ID NO: 3900693 - RNA, 20 nt, Shigella flexneri 2a str. 301
aaccauacauaaaaaagccg

SEQ ID NO: 3900694 - RNA, 18 nt, Shigella flexneri 2a str. 301
aaccauauaugauaauua

SEQ ID NO: 3900695 - RNA, 21 nt, Shigella flexneri 2a str. 301
aaccaucaggaugacaaacuu

SEQ ID NO: 3900696 - RNA, 21 nt, Shigella flexneri 2a str. 301
aaccaucgagaaucagcgaga

SEQ ID NO: 3900697 - RNA, 23 nt, Shigella flexneri 2a str. 301
aaccaugacgcacuuucgcuuua

SEQ ID NO: 3900698 - RNA, 15 nt, Shigella flexneri 2a str. 301
aaccaugucaucaau

SEQ ID NO: 3900699 - RNA, 19 nt, Shigella flexneri 2a str. 301
aaccaugucgcauccgaca

SEQ ID NO: 3900700 - RNA, 14 nt, Shigella flexneri 2a str. 301
aaccauuucugcga

SEQ ID NO: 3900701 - RNA, 21 nt, Shigella flexneri 2a str. 301
aaccauuuguucguguuaaca

SEQ ID NO: 3900702 - RNA, 22 nt, Shigella flexneri 2a str. 301
aacccaacguucguacugcccu

SEQ ID NO: 3900703 - RNA, 14 nt, Shigella flexneri 2a str. 301
aacccacacauuuc

SEQ ID NO: 3900704 - RNA, 13 nt, Shigella flexneri 2a str. 301
aacccauccagca

SEQ ID NO: 3900705 - RNA, 15 nt, Shigella flexneri 2a str. 301
aacccauccagcaga

SEQ ID NO: 3900706 - RNA, 17 nt, Shigella flexneri 2a str. 301
aaccccggcaaaugucg

SEQ ID NO: 3900707 - RNA, 16 nt, Shigella flexneri 2a str. 301
aacccgaccacuucca

SEQ ID NO: 3900708 - RNA, 17 nt, Shigella flexneri 2a str. 301
aacccgcagcuuaauga

SEQ ID NO: 3900709 - RNA, 19 nt, Shigella flexneri 2a str. 301
aacccgccagaccagcuac

SEQ ID NO: 3900710 - RNA, 18 nt, Shigella flexneri 2a str. 301
aacccgcccagugccgag

SEQ ID NO: 3900711 - RNA, 16 nt, Shigella flexneri 2a str. 301
aacccgcucaaacacc

SEQ ID NO: 3900712 - RNA, 17 nt, Shigella flexneri 2a str. 301
aacccggcaccaacaaa

SEQ ID NO: 3900713 - RNA, 23 nt, Shigella flexneri 2a str. 301
aacccggccugcucccgaaccuu

SEQ ID NO: 3900714 - RNA, 16 nt, Shigella flexneri 2a str. 301
aacccucuccccaagg

SEQ ID NO: 3900715 - RNA, 19 nt, Shigella flexneri 2a str. 301
aacccugagcgguuaacac

SEQ ID NO: 3900716 - RNA, 22 nt, Shigella flexneri 2a str. 301
aacccugagugaauuguuuuau

SEQ ID NO: 3900717 - RNA, 22 nt, Shigella flexneri 2a str. 301
aacccugauuucgugauuguug

SEQ ID NO: 3900718 - RNA, 11 nt, Shigella flexneri 2a str. 301
aacccugcaga

SEQ ID NO: 3900719 - RNA, 21 nt, Shigella flexneri 2a str. 301
aacccuucaagaauuaaaaua

SEQ ID NO: 3900720 - RNA, 18 nt, Shigella flexneri 2a str. 301
aacccuugcguuucugac

SEQ ID NO: 3900721 - RNA, 22 nt, Shigella flexneri 2a str. 301
aaccgacgguaacucugaugac

SEQ ID NO: 3900722 - RNA, 13 nt, Shigella flexneri 2a str. 301
aaccgacugccau

SEQ ID NO: 3900723 - RNA, 18 nt, Shigella flexneri 2a str. 301
aaccgagguuaaugaucg

SEQ ID NO: 3900724 - RNA, 15 nt, Shigella flexneri 2a str. 301
aaccgcaaaugauua

SEQ ID NO: 3900725 - RNA, 15 nt, Shigella flexneri 2a str. 301
aaccgcacuccauug

SEQ ID NO: 3900726 - RNA, 18 nt, Shigella flexneri 2a str. 301
aaccgcaguguaguucug

SEQ ID NO: 3900727 - RNA, 22 nt, Shigella flexneri 2a str. 301
aaccgcaguguaguucuggccu

SEQ ID NO: 3900728 - RNA, 21 nt, Shigella flexneri 2a str. 301
aaccgcaucaacagugccaau

SEQ ID NO: 3900729 - RNA, 17 nt, Shigella flexneri 2a str. 301
aaccgcauccagauucu

SEQ ID NO: 3900730 - RNA, 15 nt, Shigella flexneri 2a str. 301
aaccgccaauuucug

SEQ ID NO: 3900731 - RNA, 16 nt, Shigella flexneri 2a str. 301
aaccgccagcuaggcg

SEQ ID NO: 3900732 - RNA, 22 nt, Shigella flexneri 2a str. 301
aaccgccaguaaucuggccaau

SEQ ID NO: 3900733 - RNA, 22 nt, Shigella flexneri 2a str. 301
aaccgcccagugccagcaccac

SEQ ID NO: 3900734 - RNA, 13 nt, Shigella flexneri 2a str. 301
aaccgccuggcgc

SEQ ID NO: 3900735 - RNA, 14 nt, Shigella flexneri 2a str. 301
aaccgcgacuggga

SEQ ID NO: 3900736 - RNA, 19 nt, Shigella flexneri 2a str. 301
aaccgcgcagcgggcauuu

SEQ ID NO: 3900737 - RNA, 18 nt, Shigella flexneri 2a str. 301
aaccgcugccuucggcgu

SEQ ID NO: 3900738 - RNA, 22 nt, Shigella flexneri 2a str. 301
aaccgcuguugucugaaugaua

SEQ ID NO: 3900739 - RNA, 19 nt, Shigella flexneri 2a str. 301
aaccgcuuuagcggugaag

SEQ ID NO: 3900740 - RNA, 13 nt, Shigella flexneri 2a str. 301
aaccgcuuuucca

SEQ ID NO: 3900741 - RNA, 16 nt, Shigella flexneri 2a str. 301
aaccggauuuucacca

SEQ ID NO: 3900742 - RNA, 13 nt, Shigella flexneri 2a str. 301
aaccggcaagcaa

SEQ ID NO: 3900743 - RNA, 15 nt, Shigella flexneri 2a str. 301
aaccgggaagaucca

SEQ ID NO: 3900744 - RNA, 14 nt, Shigella flexneri 2a str. 301
aaccgguaaagaag

SEQ ID NO: 3900745 - RNA, 15 nt, Shigella flexneri 2a str. 301
aaccgguaaagaaga

SEQ ID NO: 3900746 - RNA, 15 nt, Shigella flexneri 2a str. 301
aaccggucguuacca

SEQ ID NO: 3900747 - RNA, 14 nt, Shigella flexneri 2a str. 301
aaccguacagcaug

SEQ ID NO: 3900748 - RNA, 13 nt, Shigella flexneri 2a str. 301
aaccguaccaaaa

SEQ ID NO: 3900749 - RNA, 14 nt, Shigella flexneri 2a str. 301
aaccguacgcauca

SEQ ID NO: 3900750 - RNA, 16 nt, Shigella flexneri 2a str. 301
aaccguacgcaucacc

SEQ ID NO: 3900751 - RNA, 21 nt, Shigella flexneri 2a str. 301
aaccguaguggccacagauaa

SEQ ID NO: 3900752 - RNA, 19 nt, Shigella flexneri 2a str. 301
aaccgugcgggcaucaucu

SEQ ID NO: 3900753 - RNA, 19 nt, Shigella flexneri 2a str. 301
aaccguugcuggaaaaccu

SEQ ID NO: 3900754 - RNA, 20 nt, Shigella flexneri 2a str. 301
aaccguuugauugaaaaaua

SEQ ID NO: 3900755 - RNA, 13 nt, Shigella flexneri 2a str. 301
aaccuaaaccaaa

SEQ ID NO: 3900756 - RNA, 20 nt, Shigella flexneri 2a str. 301
aaccuaaaguaaaggaacaa

SEQ ID NO: 3900757 - RNA, 16 nt, Shigella flexneri 2a str. 301
aaccuaacgcugucgg

SEQ ID NO: 3900758 - RNA, 19 nt, Shigella flexneri 2a str. 301
aaccuacgugcgcaauaac

SEQ ID NO: 3900759 - RNA, 21 nt, Shigella flexneri 2a str. 301
aaccucagaguuaaccugaaa

SEQ ID NO: 3900760 - RNA, 14 nt, Shigella flexneri 2a str. 301
aaccucgcccgcag

SEQ ID NO: 3900761 - RNA, 16 nt, Shigella flexneri 2a str. 301
aaccucuuccagcaga

SEQ ID NO: 3900762 - RNA, 18 nt, Shigella flexneri 2a str. 301
aaccugaauauuaguacu

SEQ ID NO: 3900763 - RNA, 14 nt, Shigella flexneri 2a str. 301
aaccugacaacaaa

SEQ ID NO: 3900764 - RNA, 16 nt, Shigella flexneri 2a str. 301
aaccugcacgaaacca

SEQ ID NO: 3900765 - RNA, 21 nt, Shigella flexneri 2a str. 301
aaccugccgccuuaaaccucu

SEQ ID NO: 3900766 - RNA, 18 nt, Shigella flexneri 2a str. 301
aaccugcggguuggcuuu

SEQ ID NO: 3900767 - RNA, 17 nt, Shigella flexneri 2a str. 301
aaccugguggugcugga

SEQ ID NO: 3900768 - RNA, 20 nt, Shigella flexneri 2a str. 301
aaccugguguucggcauucu

SEQ ID NO: 3900769 - RNA, 17 nt, Shigella flexneri 2a str. 301
aaccugugacagcagcg

SEQ ID NO: 3900770 - RNA, 15 nt, Shigella flexneri 2a str. 301
aacgcggcccaggcg

SEQ ID NO: 3900771 - RNA, 17 nt, Shigella flexneri 2a str. 301
aacgcgggcuucuucuu

SEQ ID NO: 3900772 - RNA, 15 nt, Shigella flexneri 2a str. 301
aacgcguacccagca

SEQ ID NO: 3900773 - RNA, 21 nt, Shigella flexneri 2a str. 301
aacgcguccaucacuaccagc

SEQ ID NO: 3900774 - RNA, 19 nt, Shigella flexneri 2a str. 301
aacgcgucuuaucuggccu

SEQ ID NO: 3900775 - RNA, 16 nt, Shigella flexneri 2a str. 301
aacgcguucacugccg

SEQ ID NO: 3900776 - RNA, 12 nt, Shigella flexneri 2a str. 301
aacgcucacuug

SEQ ID NO: 3900777 - RNA, 16 nt, Shigella flexneri 2a str. 301
aacgcugacauauuuu

SEQ ID NO: 3900778 - RNA, 15 nt, Shigella flexneri 2a str. 301
aacgcugccagccgc

SEQ ID NO: 3900779 - RNA, 14 nt, Shigella flexneri 2a str. 301
aacgcuggcagcau

SEQ ID NO: 3900780 - RNA, 14 nt, Shigella flexneri 2a str. 301
aacgcuggucgcga

SEQ ID NO: 3900781 - RNA, 12 nt, Shigella flexneri 2a str. 301
aacgcuggugag

SEQ ID NO: 3900782 - RNA, 21 nt, Shigella flexneri 2a str. 301
aacgcuguccggcgcacuggu

SEQ ID NO: 3900783 - RNA, 19 nt, Shigella flexneri 2a str. 301
aacgcugugcguaaucgcc

SEQ ID NO: 3900784 - RNA, 21 nt, Shigella flexneri 2a str. 301
aacgcugugcguaaucgccga

SEQ ID NO: 3900785 - RNA, 15 nt, Shigella flexneri 2a str. 301
aacgcuuaaaacgcu

SEQ ID NO: 3900786 - RNA, 22 nt, Shigella flexneri 2a str. 301
aacgcuucucccagccgcccug

SEQ ID NO: 3900787 - RNA, 18 nt, Shigella flexneri 2a str. 301
aacgcuucugucgcuuca

SEQ ID NO: 3900788 - RNA, 13 nt, Shigella flexneri 2a str. 301
aacgcuuucccug

SEQ ID NO: 3900789 - RNA, 19 nt, Shigella flexneri 2a str. 301
aacgcuuucccugaagcag

SEQ ID NO: 3900790 - RNA, 14 nt, Shigella flexneri 2a str. 301
aacgcuuucuuugg

SEQ ID NO: 3900791 - RNA, 20 nt, Shigella flexneri 2a str. 301
aacgcuuucuuuggcaucaa

SEQ ID NO: 3900792 - RNA, 19 nt, Shigella flexneri 2a str. 301
aacgcuuuuuugagcagca

SEQ ID NO: 3900793 - RNA, 14 nt, Shigella flexneri 2a str. 301
aacggacccgcgau

SEQ ID NO: 3900794 - RNA, 13 nt, Shigella flexneri 2a str. 301
aacggagcaaaaa

SEQ ID NO: 3900795 - RNA, 12 nt, Shigella flexneri 2a str. 301
aacggagcuacc

SEQ ID NO: 3900796 - RNA, 21 nt, Shigella flexneri 2a str. 301
aacggauaugauuuaaaaaau

SEQ ID NO: 3900797 - RNA, 17 nt, Shigella flexneri 2a str. 301
aacggaugaugcucccc

SEQ ID NO: 3900798 - RNA, 17 nt, Shigella flexneri 2a str. 301
aacggaugcagcaucau

SEQ ID NO: 3900799 - RNA, 21 nt, Shigella flexneri 2a str. 301
aacggcaagaucagcauccau

SEQ ID NO: 3900800 - RNA, 17 nt, Shigella flexneri 2a str. 301
aacggcacggaaagcag

SEQ ID NO: 3900801 - RNA, 19 nt, Shigella flexneri 2a str. 301
aacggcacggaaagcagca

SEQ ID NO: 3900802 - RNA, 22 nt, Shigella flexneri 2a str. 301
aacggcacggaaagcagcauac

SEQ ID NO: 3900803 - RNA, 13 nt, Shigella flexneri 2a str. 301
aacggcagagaaa

SEQ ID NO: 3900804 - RNA, 22 nt, Shigella flexneri 2a str. 301
aacggcagagaaaccacaucaa

SEQ ID NO: 3900805 - RNA, 22 nt, Shigella flexneri 2a str. 301
aacggcagaguuguucugcgac

SEQ ID NO: 3900806 - RNA, 21 nt, Shigella flexneri 2a str. 301
aacggcgaugcuuugaccucc

SEQ ID NO: 3900807 - RNA, 21 nt, Shigella flexneri 2a str. 301
aacggcgcgguuuccaccuuc

SEQ ID NO: 3900808 - RNA, 20 nt, Shigella flexneri 2a str. 301
aacggcucacgcccaucagc

SEQ ID NO: 3900809 - RNA, 18 nt, Shigella flexneri 2a str. 301
aacggcugauaacaauau

SEQ ID NO: 3900810 - RNA, 18 nt, Shigella flexneri 2a str. 301
aacggcugcuucggucag

SEQ ID NO: 3900811 - RNA, 20 nt, Shigella flexneri 2a str. 301
aacggcugcuucggucagca

SEQ ID NO: 3900812 - RNA, 21 nt, Shigella flexneri 2a str. 301
aacggcugcuucggucagcac

SEQ ID NO: 3900813 - RNA, 18 nt, Shigella flexneri 2a str. 301
aacggcugggaaaucacc

SEQ ID NO: 3900814 - RNA, 12 nt, Shigella flexneri 2a str. 301
aacgggcaccgc

SEQ ID NO: 3900815 - RNA, 21 nt, Shigella flexneri 2a str. 301
aacgggcaggguggugacacc

SEQ ID NO: 3900816 - RNA, 15 nt, Shigella flexneri 2a str. 301
aacggggcugccagc

SEQ ID NO: 3900817 - RNA, 22 nt, Shigella flexneri 2a str. 301
aacgguccuuaccaugcugcag

SEQ ID NO: 3900818 - RNA, 21 nt, Shigella flexneri 2a str. 301
aacggucgugcgagauaacca

SEQ ID NO: 3900819 - RNA, 17 nt, Shigella flexneri 2a str. 301
aacggugauacugaucg

SEQ ID NO: 3900820 - RNA, 23 nt, Shigella flexneri 2a str. 301
aacggugccauugaccagcugcc

SEQ ID NO: 3900821 - RNA, 22 nt, Shigella flexneri 2a str. 301
aacggugcggcucucuuucucc

SEQ ID NO: 3900822 - RNA, 15 nt, Shigella flexneri 2a str. 301
aacggugcugcacau

SEQ ID NO: 3900823 - RNA, 14 nt, Shigella flexneri 2a str. 301
aacgguuaacaguu

SEQ ID NO: 3900824 - RNA, 22 nt, Shigella flexneri 2a str. 301
aacgguucuuuggucaggcgcu

SEQ ID NO: 3900825 - RNA, 20 nt, Shigella flexneri 2a str. 301
aacgguuuauccccaaggau

SEQ ID NO: 3900826 - RNA, 13 nt, Shigella flexneri 2a str. 301
aacgguuucagca

SEQ ID NO: 3900827 - RNA, 12 nt, Shigella flexneri 2a str. 301
aacgguuuucac

SEQ ID NO: 3900828 - RNA, 15 nt, Shigella flexneri 2a str. 301
aacguaaacgcagca

SEQ ID NO: 3900829 - RNA, 21 nt, Shigella flexneri 2a str. 301
aacguacgcaauccucuuuuc

SEQ ID NO: 3900830 - RNA, 22 nt, Shigella flexneri 2a str. 301
aacguaggcaauuggcgcauca

SEQ ID NO: 3900831 - RNA, 12 nt, Shigella flexneri 2a str. 301
aacgucaaacgc

SEQ ID NO: 3900832 - RNA, 14 nt, Shigella flexneri 2a str. 301
aacgucaacgacgg

SEQ ID NO: 3900833 - RNA, 22 nt, Shigella flexneri 2a str. 301
aacgucaacgacggcuucucgg

SEQ ID NO: 3900834 - RNA, 20 nt, Shigella flexneri 2a str. 301
aacgucacccaggagaugcc

SEQ ID NO: 3900835 - RNA, 15 nt, Shigella flexneri 2a str. 301
aacgucaccucagga

SEQ ID NO: 3900836 - RNA, 20 nt, Shigella flexneri 2a str. 301
aacgucaggugagcgucauu

SEQ ID NO: 3900837 - RNA, 13 nt, Shigella flexneri 2a str. 301
aacguccggcaau

SEQ ID NO: 3900838 - RNA, 17 nt, Shigella flexneri 2a str. 301
aacguccgguuaaaucg

SEQ ID NO: 3900839 - RNA, 17 nt, Shigella flexneri 2a str. 301
aacguccugcaacggcg

SEQ ID NO: 3900840 - RNA, 22 nt, Shigella flexneri 2a str. 301
aacgucgcaagacgaaaaauga

SEQ ID NO: 3900841 - RNA, 15 nt, Shigella flexneri 2a str. 301
aacgucgcaucugac

SEQ ID NO: 3900842 - RNA, 16 nt, Shigella flexneri 2a str. 301
aacgucgguuucauca

SEQ ID NO: 3900843 - RNA, 20 nt, Shigella flexneri 2a str. 301
aacgucgucgugaagcagag

SEQ ID NO: 3900844 - RNA, 14 nt, Shigella flexneri 2a str. 301
aacgugaaguucgu

SEQ ID NO: 3900845 - RNA, 20 nt, Shigella flexneri 2a str. 301
aacgugagcgguuucgccuc

SEQ ID NO: 3900846 - RNA, 16 nt, Shigella flexneri 2a str. 301
aacgugcaaaaucaaa

SEQ ID NO: 3900847 - RNA, 21 nt, Shigella flexneri 2a str. 301
aacgugcagguuuuguagguc

SEQ ID NO: 3900848 - RNA, 20 nt, Shigella flexneri 2a str. 301
aacgugcgguuucccggcag

SEQ ID NO: 3900849 - RNA, 23 nt, Shigella flexneri 2a str. 301
aacgugcucaccacgcagcagcc

SEQ ID NO: 3900850 - RNA, 13 nt, Shigella flexneri 2a str. 301
aacguggccauga

SEQ ID NO: 3900851 - RNA, 21 nt, Shigella flexneri 2a str. 301
aacgugugcuuuguucaugcc

SEQ ID NO: 3900852 - RNA, 14 nt, Shigella flexneri 2a str. 301
aacguuaucgccga

SEQ ID NO: 3900853 - RNA, 21 nt, Shigella flexneri 2a str. 301
aacguuccccaggguuucucc

SEQ ID NO: 3900854 - RNA, 17 nt, Shigella flexneri 2a str. 301
aacguugaauuucaggu

SEQ ID NO: 3900855 - RNA, 19 nt, Shigella flexneri 2a str. 301
aacguugagaauggccaau

SEQ ID NO: 3900856 - RNA, 22 nt, Shigella flexneri 2a str. 301
aacguugcugcgccgagcaaua

SEQ ID NO: 3900857 - RNA, 17 nt, Shigella flexneri 2a str. 301
aacguuuacagggaugg

SEQ ID NO: 3900858 - RNA, 22 nt, Shigella flexneri 2a str. 301
aacguuucuuucaucaggucaa

SEQ ID NO: 3900859 - RNA, 13 nt, Shigella flexneri 2a str. 301
aacuaaaaacagc

SEQ ID NO: 3900860 - RNA, 20 nt, Shigella flexneri 2a str. 301
aacuaaaacuuuauucagug

SEQ ID NO: 3900861 - RNA, 12 nt, Shigella flexneri 2a str. 301
aacuaaacaacg

SEQ ID NO: 3900862 - RNA, 12 nt, Shigella flexneri 2a str. 301
aacuacaaauua

SEQ ID NO: 3900863 - RNA, 24 nt, Shigella flexneri 2a str. 301
aacuacauagcguguugauuauaa

SEQ ID NO: 3900864 - RNA, 17 nt, Shigella flexneri 2a str. 301
aacuacggcaaaagaau

SEQ ID NO: 3900865 - RNA, 21 nt, Shigella flexneri 2a str. 301
aacuacggcaaaagaauauca

SEQ ID NO: 3900866 - RNA, 14 nt, Shigella flexneri 2a str. 301
aacuagcuguugua

SEQ ID NO: 3900867 - RNA, 23 nt, Shigella flexneri 2a str. 301
aacuagcuguuguaaugauuuaa

SEQ ID NO: 3900868 - RNA, 20 nt, Shigella flexneri 2a str. 301
aacuauauucucaaaauaca

SEQ ID NO: 3900869 - RNA, 20 nt, Shigella flexneri 2a str. 301
aacuuaucaucaggcgaagg

SEQ ID NO: 3900870 - RNA, 23 nt, Shigella flexneri 2a str. 301
aacuuaucaucgcaaaugaugca

SEQ ID NO: 3900871 - RNA, 21 nt, Shigella flexneri 2a str. 301
aacuucaccgguucaucacga

SEQ ID NO: 3900872 - RNA, 16 nt, Shigella flexneri 2a str. 301
aacuucacuuccccga

SEQ ID NO: 3900873 - RNA, 13 nt, Shigella flexneri 2a str. 301
aacuucagcagca

SEQ ID NO: 3900874 - RNA, 23 nt, Shigella flexneri 2a str. 301
aacuucagcccuuuaauggcuuu

SEQ ID NO: 3900875 - RNA, 13 nt, Shigella flexneri 2a str. 301
aacuucaucagca

SEQ ID NO: 3900876 - RNA, 15 nt, Shigella flexneri 2a str. 301
aacuucccgcaucca

SEQ ID NO: 3900877 - RNA, 17 nt, Shigella flexneri 2a str. 301
aacuuccugcuggcugu

SEQ ID NO: 3900878 - RNA, 22 nt, Shigella flexneri 2a str. 301
aacuuccugcuggcuguaaaau

SEQ ID NO: 3900879 - RNA, 19 nt, Shigella flexneri 2a str. 301
aacuucgccauuucgucgu

SEQ ID NO: 3900880 - RNA, 11 nt, Shigella flexneri 2a str. 301
aacuucgcgag

SEQ ID NO: 3900881 - RNA, 16 nt, Shigella flexneri 2a str. 301
aacuucgcguuguaua

SEQ ID NO: 3900882 - RNA, 16 nt, Shigella flexneri 2a str. 301
aacuucgguuaccaca

SEQ ID NO: 3900883 - RNA, 14 nt, Shigella flexneri 2a str. 301
aacuucgucacagc

SEQ ID NO: 3900884 - RNA, 21 nt, Shigella flexneri 2a str. 301
aacuucguuagguucucucag

SEQ ID NO: 3900885 - RNA, 20 nt, Shigella flexneri 2a str. 301
aacuucucgcaagccgaaua

SEQ ID NO: 3900886 - RNA, 18 nt, Shigella flexneri 2a str. 301
aacuucucuucuuccgcu

SEQ ID NO: 3900887 - RNA, 22 nt, Shigella flexneri 2a str. 301
aacuucucuucuuccgcuucaa

SEQ ID NO: 3900888 - RNA, 13 nt, Shigella flexneri 2a str. 301
aacuucucuuucg

SEQ ID NO: 3900889 - RNA, 22 nt, Shigella flexneri 2a str. 301
aacuucuuuacuggcuuucauu

SEQ ID NO: 3900890 - RNA, 19 nt, Shigella flexneri 2a str. 301
aacuugugcucguguugca

SEQ ID NO: 3900891 - RNA, 21 nt, Shigella flexneri 2a str. 301
aacuuguugucuucucaacac

SEQ ID NO: 3900892 - RNA, 16 nt, Shigella flexneri 2a str. 301
aacuuuaagcugaaaa

SEQ ID NO: 3900893 - RNA, 14 nt, Shigella flexneri 2a str. 301
aacuuucaucagca

SEQ ID NO: 3900894 - RNA, 20 nt, Shigella flexneri 2a str. 301
aacuuucugcgauagcagca

SEQ ID NO: 3900895 - RNA, 20 nt, Shigella flexneri 2a str. 301
aacuuugaagcccaguaccg

SEQ ID NO: 3900896 - RNA, 17 nt, Shigella flexneri 2a str. 301
aacuuugccgugaacaa

SEQ ID NO: 3900897 - RNA, 21 nt, Shigella flexneri 2a str. 301
aacuuuguuagcgaauaaagu

SEQ ID NO: 3900898 - RNA, 18 nt, Shigella flexneri 2a str. 301
aacuuuguucugaaucac

SEQ ID NO: 3900899 - RNA, 14 nt, Shigella flexneri 2a str. 301
aacuuuucaacaaa

SEQ ID NO: 3900900 - RNA, 18 nt, Shigella flexneri 2a str. 301
aacuuuucaacaaauucu

SEQ ID NO: 3900901 - RNA, 19 nt, Shigella flexneri 2a str. 301
aagaaaaaacuaacagugu

SEQ ID NO: 3900902 - RNA, 21 nt, Shigella flexneri 2a str. 301
aagaaaaaaugaccggccagc

SEQ ID NO: 3900903 - RNA, 16 nt, Shigella flexneri 2a str. 301
aagaaaacguuucaac

SEQ ID NO: 3900904 - RNA, 23 nt, Shigella flexneri 2a str. 301
aagaaaaucaauccaguguaaaa

SEQ ID NO: 3900905 - RNA, 22 nt, Shigella flexneri 2a str. 301
aagaaaauggccagccagcaga

SEQ ID NO: 3900906 - RNA, 21 nt, Shigella flexneri 2a str. 301
aagaaacaccagaaugcccca

SEQ ID NO: 3900907 - RNA, 11 nt, Shigella flexneri 2a str. 301
aagaaacaucc

SEQ ID NO: 3900908 - RNA, 15 nt, Shigella flexneri 2a str. 301
aagaaaccgaaguug

SEQ ID NO: 3900909 - RNA, 17 nt, Shigella flexneri 2a str. 301
aagaaagcaauauugau

SEQ ID NO: 3900910 - RNA, 17 nt, Shigella flexneri 2a str. 301
aagaaagcaaugaaauu

SEQ ID NO: 3900911 - RNA, 21 nt, Shigella flexneri 2a str. 301
aagaaagcaaugaaauucauu

SEQ ID NO: 3900912 - RNA, 14 nt, Shigella flexneri 2a str. 301
aagaacaagcaaac

SEQ ID NO: 3900913 - RNA, 23 nt, Shigella flexneri 2a str. 301
aagaacaccagagccugccaaug

SEQ ID NO: 3900914 - RNA, 16 nt, Shigella flexneri 2a str. 301
aagaacaguuaacagc

SEQ ID NO: 3900915 - RNA, 18 nt, Shigella flexneri 2a str. 301
aagaaccaacgcugccag

SEQ ID NO: 3900916 - RNA, 16 nt, Shigella flexneri 2a str. 301
aagaacgccauaaaag

SEQ ID NO: 3900917 - RNA, 23 nt, Shigella flexneri 2a str. 301
aagaacugacuuccacuuccugc

SEQ ID NO: 3900918 - RNA, 22 nt, Shigella flexneri 2a str. 301
aagaacuguugaccauuugugc

SEQ ID NO: 3900919 - RNA, 11 nt, Shigella flexneri 2a str. 301
aagaagaccug

SEQ ID NO: 3900920 - RNA, 23 nt, Shigella flexneri 2a str. 301
aagaagaucguggagaacaauau

SEQ ID NO: 3900921 - RNA, 19 nt, Shigella flexneri 2a str. 301
aagaagcggugaaaaaauu

SEQ ID NO: 3900922 - RNA, 22 nt, Shigella flexneri 2a str. 301
aagaagcuuuccacgcaggcau

SEQ ID NO: 3900923 - RNA, 13 nt, Shigella flexneri 2a str. 301
aagaaggaaaaua

SEQ ID NO: 3900924 - RNA, 15 nt, Shigella flexneri 2a str. 301
aagaaggcauaacuc

SEQ ID NO: 3900925 - RNA, 14 nt, Shigella flexneri 2a str. 301
aagaauagagaaug

SEQ ID NO: 3900926 - RNA, 14 nt, Shigella flexneri 2a str. 301
aagaauagccgcaa

SEQ ID NO: 3900927 - RNA, 18 nt, Shigella flexneri 2a str. 301
aagaaucacuucaucgcc

SEQ ID NO: 3900928 - RNA, 17 nt, Shigella flexneri 2a str. 301
aagaaucaugccaaaaa

SEQ ID NO: 3900929 - RNA, 19 nt, Shigella flexneri 2a str. 301
aagaaucgggcaacguuga

SEQ ID NO: 3900930 - RNA, 21 nt, Shigella flexneri 2a str. 301
aagaauuaaaauaucaggcug

SEQ ID NO: 3900931 - RNA, 17 nt, Shigella flexneri 2a str. 301
aagaauugauaaaaaaa

SEQ ID NO: 3900932 - RNA, 14 nt, Shigella flexneri 2a str. 301
aagaauugcagaua

SEQ ID NO: 3900933 - RNA, 16 nt, Shigella flexneri 2a str. 301
aagaauugcagauacc

SEQ ID NO: 3900934 - RNA, 22 nt, Shigella flexneri 2a str. 301
aagaauugcagauaccacauca

SEQ ID NO: 3900935 - RNA, 23 nt, Shigella flexneri 2a str. 301
aagaauugcagauaccacaucaa

SEQ ID NO: 3900936 - RNA, 15 nt, Shigella flexneri 2a str. 301
aagaauuucaucgcc

SEQ ID NO: 3900937 - RNA, 21 nt, Shigella flexneri 2a str. 301
aagaauuucuuuacugacagg

SEQ ID NO: 3900938 - RNA, 12 nt, Shigella flexneri 2a str. 301
aagaauuuuugc

SEQ ID NO: 3900939 - RNA, 11 nt, Shigella flexneri 2a str. 301
aagacacacua

SEQ ID NO: 3900940 - RNA, 22 nt, Shigella flexneri 2a str. 301
aagacacugacgcgucuuaucu

SEQ ID NO: 3900941 - RNA, 18 nt, Shigella flexneri 2a str. 301
aagacagcgaggucacac

SEQ ID NO: 3900942 - RNA, 21 nt, Shigella flexneri 2a str. 301
aagacauagcacauaaaaugg

SEQ ID NO: 3900943 - RNA, 19 nt, Shigella flexneri 2a str. 301
aagacaucaauaaacaaug

SEQ ID NO: 3900944 - RNA, 18 nt, Shigella flexneri 2a str. 301
aagacauccagcccggcg

SEQ ID NO: 3900945 - RNA, 16 nt, Shigella flexneri 2a str. 301
aagacaucgcccgauu

SEQ ID NO: 3900946 - RNA, 21 nt, Shigella flexneri 2a str. 301
aagacaucgcccgauucacau

SEQ ID NO: 3900947 - RNA, 22 nt, Shigella flexneri 2a str. 301
aagaccaauccgccagccaauu

SEQ ID NO: 3900948 - RNA, 17 nt, Shigella flexneri 2a str. 301
aagaccaggaaacccaa

SEQ ID NO: 3900949 - RNA, 20 nt, Shigella flexneri 2a str. 301
aagaccugccgggcugaugc

SEQ ID NO: 3900950 - RNA, 13 nt, Shigella flexneri 2a str. 301
aagacgcagcaug

SEQ ID NO: 3900951 - RNA, 20 nt, Shigella flexneri 2a str. 301
aagacgccccggcgucgcau

SEQ ID NO: 3900952 - RNA, 21 nt, Shigella flexneri 2a str. 301
aagacgcgaccggcgucgcau

SEQ ID NO: 3900953 - RNA, 13 nt, Shigella flexneri 2a str. 301
aagacgcgccagc

SEQ ID NO: 3900954 - RNA, 20 nt, Shigella flexneri 2a str. 301
aagacgcgccagcgucgcau

SEQ ID NO: 3900955 - RNA, 20 nt, Shigella flexneri 2a str. 301
aagacgcgcuagcgucgcau

SEQ ID NO: 3900956 - RNA, 21 nt, Shigella flexneri 2a str. 301
aagacgcggcaagcgucgcau

SEQ ID NO: 3900957 - RNA, 21 nt, Shigella flexneri 2a str. 301
aagacgcguaaagcgucgcau

SEQ ID NO: 3900958 - RNA, 14 nt, Shigella flexneri 2a str. 301
aagacgcgucaagc

SEQ ID NO: 3900959 - RNA, 17 nt, Shigella flexneri 2a str. 301
aagacgcuccagugugg

SEQ ID NO: 3900960 - RNA, 17 nt, Shigella flexneri 2a str. 301
aagacgugcgccacaac

SEQ ID NO: 3900961 - RNA, 20 nt, Shigella flexneri 2a str. 301
aagacgugucaacaucgcau

SEQ ID NO: 3900962 - RNA, 18 nt, Shigella flexneri 2a str. 301
aagacguucacgucgcau

SEQ ID NO: 3900963 - RNA, 14 nt, Shigella flexneri 2a str. 301
aagacugaugacaa

SEQ ID NO: 3900964 - RNA, 18 nt, Shigella flexneri 2a str. 301
aagacuggcaaagcaggc

SEQ ID NO: 3900965 - RNA, 15 nt, Shigella flexneri 2a str. 301
aagacuguaaauacu

SEQ ID NO: 3900966 - RNA, 23 nt, Shigella flexneri 2a str. 301
aagacuuuuuucaugggugccag

SEQ ID NO: 3900967 - RNA, 14 nt, Shigella flexneri 2a str. 301
aagagaaaaccccc

SEQ ID NO: 3900968 - RNA, 16 nt, Shigella flexneri 2a str. 301
aagccaagcgccgccu

SEQ ID NO: 3900969 - RNA, 17 nt, Shigella flexneri 2a str. 301
aagccaaucacaaaaag

SEQ ID NO: 3900970 - RNA, 19 nt, Shigella flexneri 2a str. 301
aagccacaaucgcagcgca

SEQ ID NO: 3900971 - RNA, 16 nt, Shigella flexneri 2a str. 301
aagccaccgaacaaaa

SEQ ID NO: 3900972 - RNA, 14 nt, Shigella flexneri 2a str. 301
aagccaccgccgcu

SEQ ID NO: 3900973 - RNA, 13 nt, Shigella flexneri 2a str. 301
aagccacgccgaa

SEQ ID NO: 3900974 - RNA, 14 nt, Shigella flexneri 2a str. 301
aagccagaauuaau

SEQ ID NO: 3900975 - RNA, 17 nt, Shigella flexneri 2a str. 301
aagccaguccagaaaug

SEQ ID NO: 3900976 - RNA, 22 nt, Shigella flexneri 2a str. 301
aagccauaucguucugccagau

SEQ ID NO: 3900977 - RNA, 21 nt, Shigella flexneri 2a str. 301
aagccaugcccgugcugacag

SEQ ID NO: 3900978 - RNA, 20 nt, Shigella flexneri 2a str. 301
aagccaugcuuugcauccca

SEQ ID NO: 3900979 - RNA, 11 nt, Shigella flexneri 2a str. 301
aagcccagaac

SEQ ID NO: 3900980 - RNA, 18 nt, Shigella flexneri 2a str. 301
aagcccauaccacagcaa

SEQ ID NO: 3900981 - RNA, 21 nt, Shigella flexneri 2a str. 301
aagcccaucaguacaccaccu

SEQ ID NO: 3900982 - RNA, 14 nt, Shigella flexneri 2a str. 301
aagccccaccagca

SEQ ID NO: 3900983 - RNA, 18 nt, Shigella flexneri 2a str. 301
aagccccgcauaaagcga

SEQ ID NO: 3900984 - RNA, 15 nt, Shigella flexneri 2a str. 301
aagccccguagccau

SEQ ID NO: 3900985 - RNA, 17 nt, Shigella flexneri 2a str. 301
aagccccguagccauga

SEQ ID NO: 3900986 - RNA, 15 nt, Shigella flexneri 2a str. 301
aagccgaucgugcua

SEQ ID NO: 3900987 - RNA, 15 nt, Shigella flexneri 2a str. 301
aagccgcauccgguu

SEQ ID NO: 3900988 - RNA, 23 nt, Shigella flexneri 2a str. 301
aagccgccacgaccugcagaaaa

SEQ ID NO: 3900989 - RNA, 20 nt, Shigella flexneri 2a str. 301
aagccgccgguagucaccgc

SEQ ID NO: 3900990 - RNA, 17 nt, Shigella flexneri 2a str. 301
aagccgcuaacagcagc

SEQ ID NO: 3900991 - RNA, 23 nt, Shigella flexneri 2a str. 301
aagccgcuaacagcagcagcgca

SEQ ID NO: 3900992 - RNA, 14 nt, Shigella flexneri 2a str. 301
aagccggugaacgu

SEQ ID NO: 3900993 - RNA, 18 nt, Shigella flexneri 2a str. 301
aagccgucccuaccggua

SEQ ID NO: 3900994 - RNA, 13 nt, Shigella flexneri 2a str. 301
aagccgugaauca

SEQ ID NO: 3900995 - RNA, 14 nt, Shigella flexneri 2a str. 301
aagccgugaaucac

SEQ ID NO: 3900996 - RNA, 13 nt, Shigella flexneri 2a str. 301
aagccguugcuga

SEQ ID NO: 3900997 - RNA, 17 nt, Shigella flexneri 2a str. 301
aagccuaagaagucauu

SEQ ID NO: 3900998 - RNA, 18 nt, Shigella flexneri 2a str. 301
aagccugcuucaaacgcu

SEQ ID NO: 3900999 - RNA, 17 nt, Shigella flexneri 2a str. 301
aagccuuccgcaaacag

SEQ ID NO: 3901000 - RNA, 22 nt, Shigella flexneri 2a str. 301
aagccuucgccuuucaguucaa

SEQ ID NO: 3901001 - RNA, 19 nt, Shigella flexneri 2a str. 301
aagccuuuaccgcgcucga

SEQ ID NO: 3901002 - RNA, 13 nt, Shigella flexneri 2a str. 301
aagccuuucagga

SEQ ID NO: 3901003 - RNA, 16 nt, Shigella flexneri 2a str. 301
aagccuuuuaccgccu

SEQ ID NO: 3901004 - RNA, 18 nt, Shigella flexneri 2a str. 301
aagcgacuuugccuggcg

SEQ ID NO: 3901005 - RNA, 19 nt, Shigella flexneri 2a str. 301
aagcgagaguuacagcucu

SEQ ID NO: 3901006 - RNA, 14 nt, Shigella flexneri 2a str. 301
aagcgagcaguaca

SEQ ID NO: 3901007 - RNA, 21 nt, Shigella flexneri 2a str. 301
aagcgagguauuuucugaaac

SEQ ID NO: 3901008 - RNA, 17 nt, Shigella flexneri 2a str. 301
aagcgauaaaaauaccg

SEQ ID NO: 3901009 - RNA, 15 nt, Shigella flexneri 2a str. 301
aagcgauaaccuuca

SEQ ID NO: 3901010 - RNA, 14 nt, Shigella flexneri 2a str. 301
aagcgaugcugaug

SEQ ID NO: 3901011 - RNA, 20 nt, Shigella flexneri 2a str. 301
aagcgaugguggugggggaa

SEQ ID NO: 3901012 - RNA, 16 nt, Shigella flexneri 2a str. 301
aagcgcaaaauaccag

SEQ ID NO: 3901013 - RNA, 15 nt, Shigella flexneri 2a str. 301
aagcgcaaaggccag

SEQ ID NO: 3901014 - RNA, 22 nt, Shigella flexneri 2a str. 301
aagcgcacguuguuacaauuua

SEQ ID NO: 3901015 - RNA, 15 nt, Shigella flexneri 2a str. 301
aagcgcagcgccccc

SEQ ID NO: 3901016 - RNA, 17 nt, Shigella flexneri 2a str. 301
aagcgcauccggcacca

SEQ ID NO: 3901017 - RNA, 18 nt, Shigella flexneri 2a str. 301
aagcgcauccggcaccag

SEQ ID NO: 3901018 - RNA, 23 nt, Shigella flexneri 2a str. 301
aagcgccagauaugaucgaaaau

SEQ ID NO: 3901019 - RNA, 19 nt, Shigella flexneri 2a str. 301
aagcgcccgucacugaauc

SEQ ID NO: 3901020 - RNA, 17 nt, Shigella flexneri 2a str. 301
aagcgccgaguaaaaaa

SEQ ID NO: 3901021 - RNA, 19 nt, Shigella flexneri 2a str. 301
aagcgccgccucagccaga

SEQ ID NO: 3901022 - RNA, 20 nt, Shigella flexneri 2a str. 301
aagcgccggacauugcguuu

SEQ ID NO: 3901023 - RNA, 15 nt, Shigella flexneri 2a str. 301
aagcgccucaagcuc

SEQ ID NO: 3901024 - RNA, 18 nt, Shigella flexneri 2a str. 301
aagcgcggauuuuauuca

SEQ ID NO: 3901025 - RNA, 15 nt, Shigella flexneri 2a str. 301
aagcgcgucaccacc

SEQ ID NO: 3901026 - RNA, 17 nt, Shigella flexneri 2a str. 301
aagcgcguguuacugga

SEQ ID NO: 3901027 - RNA, 14 nt, Shigella flexneri 2a str. 301
aagcgcuaugcgca

SEQ ID NO: 3901028 - RNA, 21 nt, Shigella flexneri 2a str. 301
aagcggcacugcucuuuaaca

SEQ ID NO: 3901029 - RNA, 21 nt, Shigella flexneri 2a str. 301
aagcggcguugcucuucuccg

SEQ ID NO: 3901030 - RNA, 15 nt, Shigella flexneri 2a str. 301
aagcggcguuuucag

SEQ ID NO: 3901031 - RNA, 15 nt, Shigella flexneri 2a str. 301
aagcgggugucccag

SEQ ID NO: 3901032 - RNA, 14 nt, Shigella flexneri 2a str. 301
aagcggugaaaaaa

SEQ ID NO: 3901033 - RNA, 15 nt, Shigella flexneri 2a str. 301
aagcggugcgaugcc

SEQ ID NO: 3901034 - RNA, 22 nt, Shigella flexneri 2a str. 301
aagcguaaaaccucacgcaucc

SEQ ID NO: 3901035 - RNA, 14 nt, Shigella flexneri 2a str. 301
aagcguagcgcauc

SEQ ID NO: 3901036 - RNA, 21 nt, Shigella flexneri 2a str. 301
aagcguagcgcaucgggcgau

SEQ ID NO: 3901037 - RNA, 22 nt, Shigella flexneri 2a str. 301
aagcgucaaguugacucucauc

SEQ ID NO: 3901038 - RNA, 14 nt, Shigella flexneri 2a str. 301
aagcgucgcaucag

SEQ ID NO: 3901039 - RNA, 18 nt, Shigella flexneri 2a str. 301
aagcgucgcaucaggcau

SEQ ID NO: 3901040 - RNA, 15 nt, Shigella flexneri 2a str. 301
aagcgugcaaauaua

SEQ ID NO: 3901041 - RNA, 15 nt, Shigella flexneri 2a str. 301
aagcguuucaucuuc

SEQ ID NO: 3901042 - RNA, 18 nt, Shigella flexneri 2a str. 301
aagcguuuugccaguucg

SEQ ID NO: 3901043 - RNA, 15 nt, Shigella flexneri 2a str. 301
aagcucaaaauaaua

SEQ ID NO: 3901044 - RNA, 14 nt, Shigella flexneri 2a str. 301
aagcuccaccaguu

SEQ ID NO: 3901045 - RNA, 12 nt, Shigella flexneri 2a str. 301
aagcuccagcau

SEQ ID NO: 3901046 - RNA, 17 nt, Shigella flexneri 2a str. 301
aagcucgccaccauuga

SEQ ID NO: 3901047 - RNA, 14 nt, Shigella flexneri 2a str. 301
aagcucguuguuua

SEQ ID NO: 3901048 - RNA, 16 nt, Shigella flexneri 2a str. 301
aagcucucuuccaguu

SEQ ID NO: 3901049 - RNA, 18 nt, Shigella flexneri 2a str. 301
aagcucucuuccaguucg

SEQ ID NO: 3901050 - RNA, 19 nt, Shigella flexneri 2a str. 301
aagcucuguauauaaaugu

SEQ ID NO: 3901051 - RNA, 19 nt, Shigella flexneri 2a str. 301
aagcucuucaugcagcaug

SEQ ID NO: 3901052 - RNA, 13 nt, Shigella flexneri 2a str. 301
aagcugacaggcg

SEQ ID NO: 3901053 - RNA, 20 nt, Shigella flexneri 2a str. 301
aagcugacaggcgcugauga

SEQ ID NO: 3901054 - RNA, 22 nt, Shigella flexneri 2a str. 301
aagcugagcacaaaacaggucg

SEQ ID NO: 3901055 - RNA, 20 nt, Shigella flexneri 2a str. 301
aagcugcaaguauucacucu

SEQ ID NO: 3901056 - RNA, 20 nt, Shigella flexneri 2a str. 301
aagcugcggauccugagcaa

SEQ ID NO: 3901057 - RNA, 21 nt, Shigella flexneri 2a str. 301
aagcugcggauccugagcaaa

SEQ ID NO: 3901058 - RNA, 22 nt, Shigella flexneri 2a str. 301
aagcugcugacggugauaauca

SEQ ID NO: 3901059 - RNA, 15 nt, Shigella flexneri 2a str. 301
aagcugcuguuaacu

SEQ ID NO: 3901060 - RNA, 17 nt, Shigella flexneri 2a str. 301
aagcuggaaaucaaugg

SEQ ID NO: 3901061 - RNA, 20 nt, Shigella flexneri 2a str. 301
aagcuggaaggguugaaaua

SEQ ID NO: 3901062 - RNA, 13 nt, Shigella flexneri 2a str. 301
aagcuggcaaagu

SEQ ID NO: 3901063 - RNA, 16 nt, Shigella flexneri 2a str. 301
aagcuggcagaaguug

SEQ ID NO: 3901064 - RNA, 18 nt, Shigella flexneri 2a str. 301
aagcuggcagaaguuguc

SEQ ID NO: 3901065 - RNA, 22 nt, Shigella flexneri 2a str. 301
aagcuggcgauauuauccccug

SEQ ID NO: 3901066 - RNA, 22 nt, Shigella flexneri 2a str. 301
aagcugggcgguggcgauccgg

SEQ ID NO: 3901067 - RNA, 20 nt, Shigella flexneri 2a str. 301
aagcuguaaaggugauauag

SEQ ID NO: 3901068 - RNA, 14 nt, Shigella flexneri 2a str. 301
aagcuguaucccag

SEQ ID NO: 3901069 - RNA, 18 nt, Shigella flexneri 2a str. 301
aagcuguaucccagccca

SEQ ID NO: 3901070 - RNA, 24 nt, Shigella flexneri 2a str. 301
aagcuguaucccagcccagcggaa

SEQ ID NO: 3901071 - RNA, 20 nt, Shigella flexneri 2a str. 301
aagcugugcgauagcaacga

SEQ ID NO: 3901072 - RNA, 14 nt, Shigella flexneri 2a str. 301
aagcuguucuuccc

SEQ ID NO: 3901073 - RNA, 22 nt, Shigella flexneri 2a str. 301
aagcuuacguuacccagcacgg

SEQ ID NO: 3901074 - RNA, 14 nt, Shigella flexneri 2a str. 301
aagcuuuccacgca

SEQ ID NO: 3901075 - RNA, 19 nt, Shigella flexneri 2a str. 301
aaggaaacucucaaaacaa

SEQ ID NO: 3901076 - RNA, 13 nt, Shigella flexneri 2a str. 301
aaggaaaguaaau

SEQ ID NO: 3901077 - RNA, 13 nt, Shigella flexneri 2a str. 301
aaggaacaagggu

SEQ ID NO: 3901078 - RNA, 23 nt, Shigella flexneri 2a str. 301
aaggaagccugacagggaaggga

SEQ ID NO: 3901079 - RNA, 20 nt, Shigella flexneri 2a str. 301
aaggacaaaaauucaggaau

SEQ ID NO: 3901080 - RNA, 14 nt, Shigella flexneri 2a str. 301
aaggagauaaaccg

SEQ ID NO: 3901081 - RNA, 22 nt, Shigella flexneri 2a str. 301
aaggauaaaaaagggugcugca

SEQ ID NO: 3901082 - RNA, 13 nt, Shigella flexneri 2a str. 301
aaggauaugugaa

SEQ ID NO: 3901083 - RNA, 18 nt, Shigella flexneri 2a str. 301
aaggauugcagcacugau

SEQ ID NO: 3901084 - RNA, 20 nt, Shigella flexneri 2a str. 301
aaggcaacgccccuucugcc

SEQ ID NO: 3901085 - RNA, 23 nt, Shigella flexneri 2a str. 301
aaggcaacgccccuucugccgca

SEQ ID NO: 3901086 - RNA, 13 nt, Shigella flexneri 2a str. 301
aaggcaagaaaau

SEQ ID NO: 3901087 - RNA, 17 nt, Shigella flexneri 2a str. 301
aaggcacaacugcgacc

SEQ ID NO: 3901088 - RNA, 15 nt, Shigella flexneri 2a str. 301
aaggcagaaacaaac

SEQ ID NO: 3901089 - RNA, 15 nt, Shigella flexneri 2a str. 301
aaggcagccuuucuc

SEQ ID NO: 3901090 - RNA, 16 nt, Shigella flexneri 2a str. 301
aaggcauuaaacgcau

SEQ ID NO: 3901091 - RNA, 19 nt, Shigella flexneri 2a str. 301
aaggcauuaaacgcauaca

SEQ ID NO: 3901092 - RNA, 18 nt, Shigella flexneri 2a str. 301
aaggcauuuacgccgcau

SEQ ID NO: 3901093 - RNA, 22 nt, Shigella flexneri 2a str. 301
aaggccaacgaaaaauggggga

SEQ ID NO: 3901094 - RNA, 13 nt, Shigella flexneri 2a str. 301
aaggccagaacca

SEQ ID NO: 3901095 - RNA, 23 nt, Shigella flexneri 2a str. 301
aaggccagaccguggucagaaaa

SEQ ID NO: 3901096 - RNA, 15 nt, Shigella flexneri 2a str. 301
aaggccagccaggca

SEQ ID NO: 3901097 - RNA, 16 nt, Shigella flexneri 2a str. 301
aaggccgacagcaggc

SEQ ID NO: 3901098 - RNA, 23 nt, Shigella flexneri 2a str. 301
aaggccgacagcaggcucagaag

SEQ ID NO: 3901099 - RNA, 21 nt, Shigella flexneri 2a str. 301
aaggccggagaagaugcguca

SEQ ID NO: 3901100 - RNA, 15 nt, Shigella flexneri 2a str. 301
aaggccggagcaugc

SEQ ID NO: 3901101 - RNA, 20 nt, Shigella flexneri 2a str. 301
aaggccguuuucaacaccgc

SEQ ID NO: 3901102 - RNA, 19 nt, Shigella flexneri 2a str. 301
aaggcgaaaccuccgcaau

SEQ ID NO: 3901103 - RNA, 16 nt, Shigella flexneri 2a str. 301
aaggcgaaaggcuggc

SEQ ID NO: 3901104 - RNA, 22 nt, Shigella flexneri 2a str. 301
aaggcgagcaaucacuugcgca

SEQ ID NO: 3901105 - RNA, 13 nt, Shigella flexneri 2a str. 301
aaggcgagcgcgg

SEQ ID NO: 3901106 - RNA, 23 nt, Shigella flexneri 2a str. 301
aaggcgcauugcuggcugcggga

SEQ ID NO: 3901107 - RNA, 16 nt, Shigella flexneri 2a str. 301
aaggcgcgguuucugc

SEQ ID NO: 3901108 - RNA, 18 nt, Shigella flexneri 2a str. 301
aaggcgcucauuuucucu

SEQ ID NO: 3901109 - RNA, 18 nt, Shigella flexneri 2a str. 301
aaggcgcuuugcaccaga

SEQ ID NO: 3901110 - RNA, 18 nt, Shigella flexneri 2a str. 301
aaggcggcagaacagaac

SEQ ID NO: 3901111 - RNA, 16 nt, Shigella flexneri 2a str. 301
aaggcgggaauaauuu

SEQ ID NO: 3901112 - RNA, 23 nt, Shigella flexneri 2a str. 301
aaggcgucaauuuguuccgccag

SEQ ID NO: 3901113 - RNA, 14 nt, Shigella flexneri 2a str. 301
aaggcguucacgcc

SEQ ID NO: 3901114 - RNA, 23 nt, Shigella flexneri 2a str. 301
aaggcguuggugauaaaacgcag

SEQ ID NO: 3901115 - RNA, 18 nt, Shigella flexneri 2a str. 301
aaggcguuuacgccgcau

SEQ ID NO: 3901116 - RNA, 20 nt, Shigella flexneri 2a str. 301
aaggcguuuacgccgcaucc

SEQ ID NO: 3901117 - RNA, 23 nt, Shigella flexneri 2a str. 301
aaggcguuuucgccacaucaggu

SEQ ID NO: 3901118 - RNA, 16 nt, Shigella flexneri 2a str. 301
aaggcugacaaaucag

SEQ ID NO: 3901119 - RNA, 17 nt, Shigella flexneri 2a str. 301
aaggcuuucgugaagcu

SEQ ID NO: 3901120 - RNA, 19 nt, Shigella flexneri 2a str. 301
aagggaggauuucuccccc

SEQ ID NO: 3901121 - RNA, 15 nt, Shigella flexneri 2a str. 301
aagggcggcgagaaa

SEQ ID NO: 3901122 - RNA, 14 nt, Shigella flexneri 2a str. 301
aagggcuaacgugc

SEQ ID NO: 3901123 - RNA, 18 nt, Shigella flexneri 2a str. 301
aagggguuuuccaguuca

SEQ ID NO: 3901124 - RNA, 15 nt, Shigella flexneri 2a str. 301
aagggucagggagaa

SEQ ID NO: 3901125 - RNA, 16 nt, Shigella flexneri 2a str. 301
aaggguguucauccug

SEQ ID NO: 3901126 - RNA, 16 nt, Shigella flexneri 2a str. 301
aaggguuucgcgguug

SEQ ID NO: 3901127 - RNA, 20 nt, Shigella flexneri 2a str. 301
aagguaaugcgcgagccaua

SEQ ID NO: 3901128 - RNA, 13 nt, Shigella flexneri 2a str. 301
aagguagaauaag

SEQ ID NO: 3901129 - RNA, 20 nt, Shigella flexneri 2a str. 301
aagguagaauaaggcuuucg

SEQ ID NO: 3901130 - RNA, 13 nt, Shigella flexneri 2a str. 301
aagguagucccug

SEQ ID NO: 3901131 - RNA, 22 nt, Shigella flexneri 2a str. 301
aagguaucgcacugaugugaca

SEQ ID NO: 3901132 - RNA, 13 nt, Shigella flexneri 2a str. 301
aaggucagacgaa

SEQ ID NO: 3901133 - RNA, 22 nt, Shigella flexneri 2a str. 301
aaggucaucaaucauuuuuuga

SEQ ID NO: 3901134 - RNA, 18 nt, Shigella flexneri 2a str. 301
aaggucauccaaaucgcc

SEQ ID NO: 3901135 - RNA, 13 nt, Shigella flexneri 2a str. 301
aaggucauugcga

SEQ ID NO: 3901136 - RNA, 17 nt, Shigella flexneri 2a str. 301
aaggucggcuuugaaua

SEQ ID NO: 3901137 - RNA, 16 nt, Shigella flexneri 2a str. 301
aaggugauauagaaaa

SEQ ID NO: 3901138 - RNA, 17 nt, Shigella flexneri 2a str. 301
aaggugcaucggggaau

SEQ ID NO: 3901139 - RNA, 18 nt, Shigella flexneri 2a str. 301
aagguggcgaagugccag

SEQ ID NO: 3901140 - RNA, 21 nt, Shigella flexneri 2a str. 301
aagguggcgaagugccagucg

SEQ ID NO: 3901141 - RNA, 21 nt, Shigella flexneri 2a str. 301
aaggugugggcaaucacuuug

SEQ ID NO: 3901142 - RNA, 16 nt, Shigella flexneri 2a str. 301
aagguuaaaccgccag

SEQ ID NO: 3901143 - RNA, 17 nt, Shigella flexneri 2a str. 301
aagguuaacuguggcgu

SEQ ID NO: 3901144 - RNA, 16 nt, Shigella flexneri 2a str. 301
aagguuacccgcacgg

SEQ ID NO: 3901145 - RNA, 15 nt, Shigella flexneri 2a str. 301
aagguuucaguaaca

SEQ ID NO: 3901146 - RNA, 18 nt, Shigella flexneri 2a str. 301
aagguuugaaaaaaccug

SEQ ID NO: 3901147 - RNA, 15 nt, Shigella flexneri 2a str. 301
aagguuuuaaucgcu

SEQ ID NO: 3901148 - RNA, 16 nt, Shigella flexneri 2a str. 301
aaguaaaaaagaagga

SEQ ID NO: 3901149 - RNA, 18 nt, Shigella flexneri 2a str. 301
aaguaaaaaagaaggaaa

SEQ ID NO: 3901150 - RNA, 19 nt, Shigella flexneri 2a str. 301
aaguaaaaaagaaggaaaa

SEQ ID NO: 3901151 - RNA, 16 nt, Shigella flexneri 2a str. 301
aaguaaaccaccaguc

SEQ ID NO: 3901152 - RNA, 18 nt, Shigella flexneri 2a str. 301
aaguaaaggcacaagggu

SEQ ID NO: 3901153 - RNA, 19 nt, Shigella flexneri 2a str. 301
aaguaacaauagcgaacag

SEQ ID NO: 3901154 - RNA, 19 nt, Shigella flexneri 2a str. 301
aaguaagaauugauaaaaa

SEQ ID NO: 3901155 - RNA, 18 nt, Shigella flexneri 2a str. 301
aaguaaggcgggaauaau

SEQ ID NO: 3901156 - RNA, 15 nt, Shigella flexneri 2a str. 301
aaguaauaaugauca

SEQ ID NO: 3901157 - RNA, 23 nt, Shigella flexneri 2a str. 301
aaguaauagaacuauaauugcuu

SEQ ID NO: 3901158 - RNA, 13 nt, Shigella flexneri 2a str. 301
aaguaaucuauau

SEQ ID NO: 3901159 - RNA, 14 nt, Shigella flexneri 2a str. 301
aaguaauucauuca

SEQ ID NO: 3901160 - RNA, 22 nt, Shigella flexneri 2a str. 301
aaguacacauaaacagguaaag

SEQ ID NO: 3901161 - RNA, 18 nt, Shigella flexneri 2a str. 301
aaguacagcccaggcacu

SEQ ID NO: 3901162 - RNA, 20 nt, Shigella flexneri 2a str. 301
aaguaccaucguccagcagc

SEQ ID NO: 3901163 - RNA, 21 nt, Shigella flexneri 2a str. 301
aaguaccaucguccagcagca

SEQ ID NO: 3901164 - RNA, 15 nt, Shigella flexneri 2a str. 301
aaguacgauacagaa

SEQ ID NO: 3901165 - RNA, 18 nt, Shigella flexneri 2a str. 301
aaguacgauacagaagca

SEQ ID NO: 3901166 - RNA, 14 nt, Shigella flexneri 2a str. 301
aaguacuccugcuc

SEQ ID NO: 3901167 - RNA, 19 nt, Shigella flexneri 2a str. 301
aaguacucuuugaacagcc

SEQ ID NO: 3901168 - RNA, 22 nt, Shigella flexneri 2a str. 301
aauaguuauagccguaacugua

SEQ ID NO: 3901169 - RNA, 15 nt, Shigella flexneri 2a str. 301
aauaguuucacgcug

SEQ ID NO: 3901170 - RNA, 19 nt, Shigella flexneri 2a str. 301
aauaguuucagccucugcc

SEQ ID NO: 3901171 - RNA, 20 nt, Shigella flexneri 2a str. 301
aauaguuuccgcuucugcuu

SEQ ID NO: 3901172 - RNA, 17 nt, Shigella flexneri 2a str. 301
aauauaaaacaacggaa

SEQ ID NO: 3901173 - RNA, 23 nt, Shigella flexneri 2a str. 301
aauauaaaacaacggaacgaaaa

SEQ ID NO: 3901174 - RNA, 12 nt, Shigella flexneri 2a str. 301
aauauacaggcg

SEQ ID NO: 3901175 - RNA, 14 nt, Shigella flexneri 2a str. 301
aauauauaauuaaa

SEQ ID NO: 3901176 - RNA, 18 nt, Shigella flexneri 2a str. 301
aauauauaauuaaaaaua

SEQ ID NO: 3901177 - RNA, 11 nt, Shigella flexneri 2a str. 301
aauauauccua

SEQ ID NO: 3901178 - RNA, 15 nt, Shigella flexneri 2a str. 301
aauauaugcauugau

SEQ ID NO: 3901179 - RNA, 15 nt, Shigella flexneri 2a str. 301
aauaucaaauaaaaa

SEQ ID NO: 3901180 - RNA, 18 nt, Shigella flexneri 2a str. 301
aauaucaagaucaucaaa

SEQ ID NO: 3901181 - RNA, 13 nt, Shigella flexneri 2a str. 301
aauaucaaucuuc

SEQ ID NO: 3901182 - RNA, 13 nt, Shigella flexneri 2a str. 301
aauaucaucauuu

SEQ ID NO: 3901183 - RNA, 22 nt, Shigella flexneri 2a str. 301
aauauccaccgggguaaaucca

SEQ ID NO: 3901184 - RNA, 21 nt, Shigella flexneri 2a str. 301
aauauccguagugaaaaagcu

SEQ ID NO: 3901185 - RNA, 20 nt, Shigella flexneri 2a str. 301
aauauccgucgaaaaugauc

SEQ ID NO: 3901186 - RNA, 13 nt, Shigella flexneri 2a str. 301
aauauccugcgcu

SEQ ID NO: 3901187 - RNA, 15 nt, Shigella flexneri 2a str. 301
aauaucgauaucgua

SEQ ID NO: 3901188 - RNA, 19 nt, Shigella flexneri 2a str. 301
aauaucgcggcacagaaac

SEQ ID NO: 3901189 - RNA, 19 nt, Shigella flexneri 2a str. 301
aauaucggcaccagcgcag

SEQ ID NO: 3901190 - RNA, 22 nt, Shigella flexneri 2a str. 301
aauaucguugauuguugcgcga

SEQ ID NO: 3901191 - RNA, 13 nt, Shigella flexneri 2a str. 301
aauaucuccagcu

SEQ ID NO: 3901192 - RNA, 19 nt, Shigella flexneri 2a str. 301
aauaucugccggaagacac

SEQ ID NO: 3901193 - RNA, 21 nt, Shigella flexneri 2a str. 301
aauaucugccggaagacacau

SEQ ID NO: 3901194 - RNA, 17 nt, Shigella flexneri 2a str. 301
aauaucuguauaaccug

SEQ ID NO: 3901195 - RNA, 23 nt, Shigella flexneri 2a str. 301
aauaucuuauagacuaaauuuca

SEQ ID NO: 3901196 - RNA, 20 nt, Shigella flexneri 2a str. 301
aauaucuuccacuucacggc

SEQ ID NO: 3901197 - RNA, 16 nt, Shigella flexneri 2a str. 301
aauaucuuucauauuc

SEQ ID NO: 3901198 - RNA, 17 nt, Shigella flexneri 2a str. 301
aauaucuuucauauuca

SEQ ID NO: 3901199 - RNA, 22 nt, Shigella flexneri 2a str. 301
aauaucuuucugccaccaguaa

SEQ ID NO: 3901200 - RNA, 15 nt, Shigella flexneri 2a str. 301
aauaucuuuucaggu

SEQ ID NO: 3901201 - RNA, 19 nt, Shigella flexneri 2a str. 301
aauaugaacaugaaaaaac

SEQ ID NO: 3901202 - RNA, 14 nt, Shigella flexneri 2a str. 301
aauaugcauaaacc

SEQ ID NO: 3901203 - RNA, 22 nt, Shigella flexneri 2a str. 301
aauaugcccauguucgcggcuu

SEQ ID NO: 3901204 - RNA, 23 nt, Shigella flexneri 2a str. 301
aauaugcggugccauuaaaccaa

SEQ ID NO: 3901205 - RNA, 21 nt, Shigella flexneri 2a str. 301
aauaugcugaaucgccaaaaa

SEQ ID NO: 3901206 - RNA, 23 nt, Shigella flexneri 2a str. 301
aauaugcugaaucgccaaaaaca

SEQ ID NO: 3901207 - RNA, 19 nt, Shigella flexneri 2a str. 301
aauaugcugguuccugacu

SEQ ID NO: 3901208 - RNA, 20 nt, Shigella flexneri 2a str. 301
aauaugcugguuccugacuc

SEQ ID NO: 3901209 - RNA, 23 nt, Shigella flexneri 2a str. 301
aauauggaacggaugcagcauca

SEQ ID NO: 3901210 - RNA, 21 nt, Shigella flexneri 2a str. 301
aauaugggucggcgauaacca

SEQ ID NO: 3901211 - RNA, 20 nt, Shigella flexneri 2a str. 301
aauauggugaaaguaaaaaa

SEQ ID NO: 3901212 - RNA, 22 nt, Shigella flexneri 2a str. 301
aauauggugaaaguaaaaaaga

SEQ ID NO: 3901213 - RNA, 16 nt, Shigella flexneri 2a str. 301
aauaugucguuauaua

SEQ ID NO: 3901214 - RNA, 21 nt, Shigella flexneri 2a str. 301
aauaugugaucgaauauauca

SEQ ID NO: 3901215 - RNA, 17 nt, Shigella flexneri 2a str. 301
aauauuaacgccagccu

SEQ ID NO: 3901216 - RNA, 19 nt, Shigella flexneri 2a str. 301
aauauuaacuuaauaaaca

SEQ ID NO: 3901217 - RNA, 13 nt, Shigella flexneri 2a str. 301
aauauuaaugcug

SEQ ID NO: 3901218 - RNA, 18 nt, Shigella flexneri 2a str. 301
aauauucauuaaaacuga

SEQ ID NO: 3901219 - RNA, 18 nt, Shigella flexneri 2a str. 301
aauauuccuuaugguuca

SEQ ID NO: 3901220 - RNA, 20 nt, Shigella flexneri 2a str. 301
aauauucgccucguucccag

SEQ ID NO: 3901221 - RNA, 13 nt, Shigella flexneri 2a str. 301
aauauugauaaua

SEQ ID NO: 3901222 - RNA, 14 nt, Shigella flexneri 2a str. 301
aauauuuccaguuc

SEQ ID NO: 3901223 - RNA, 22 nt, Shigella flexneri 2a str. 301
aauauuucccggccagucguag

SEQ ID NO: 3901224 - RNA, 21 nt, Shigella flexneri 2a str. 301
aauauuucucggcaaauucau

SEQ ID NO: 3901225 - RNA, 14 nt, Shigella flexneri 2a str. 301
aauauuuuuaugcc

SEQ ID NO: 3901226 - RNA, 21 nt, Shigella flexneri 2a str. 301
aaucaaaaaacuggaaaaaua

SEQ ID NO: 3901227 - RNA, 20 nt, Shigella flexneri 2a str. 301
aaucaaaaaaggcugacaaa

SEQ ID NO: 3901228 - RNA, 15 nt, Shigella flexneri 2a str. 301
aaucaaauaaaaaua

SEQ ID NO: 3901229 - RNA, 22 nt, Shigella flexneri 2a str. 301
aaucaaauaccaccagcgaaag

SEQ ID NO: 3901230 - RNA, 13 nt, Shigella flexneri 2a str. 301
aaucaaauacccu

SEQ ID NO: 3901231 - RNA, 20 nt, Shigella flexneri 2a str. 301
aaucaacaccacugccagau

SEQ ID NO: 3901232 - RNA, 21 nt, Shigella flexneri 2a str. 301
aaucaaccauacggucugcca

SEQ ID NO: 3901233 - RNA, 21 nt, Shigella flexneri 2a str. 301
aaucaaccgcgccugaccauu

SEQ ID NO: 3901234 - RNA, 14 nt, Shigella flexneri 2a str. 301
aaucaacgccgcau

SEQ ID NO: 3901235 - RNA, 16 nt, Shigella flexneri 2a str. 301
aaucaacgcgaaaaug

SEQ ID NO: 3901236 - RNA, 21 nt, Shigella flexneri 2a str. 301
aaucaacgcgaaaaugcccca

SEQ ID NO: 3901237 - RNA, 17 nt, Shigella flexneri 2a str. 301
aaucaacgcgauauaau

SEQ ID NO: 3901238 - RNA, 18 nt, Shigella flexneri 2a str. 301
aaucaacgcgauauaaua

SEQ ID NO: 3901239 - RNA, 13 nt, Shigella flexneri 2a str. 301
aaucaacugccca

SEQ ID NO: 3901240 - RNA, 17 nt, Shigella flexneri 2a str. 301
aaucaacuggcgcgcgu

SEQ ID NO: 3901241 - RNA, 22 nt, Shigella flexneri 2a str. 301
aaucaagcgccgaguaaaaaaa

SEQ ID NO: 3901242 - RNA, 22 nt, Shigella flexneri 2a str. 301
aaucaagcgccgccagucgaau

SEQ ID NO: 3901243 - RNA, 14 nt, Shigella flexneri 2a str. 301
aaucaaggugauug

SEQ ID NO: 3901244 - RNA, 19 nt, Shigella flexneri 2a str. 301
aaucaauaauuaaucuggu

SEQ ID NO: 3901245 - RNA, 13 nt, Shigella flexneri 2a str. 301
aaucaaucagagc

SEQ ID NO: 3901246 - RNA, 20 nt, Shigella flexneri 2a str. 301
aaucaauccaguguaaaaca

SEQ ID NO: 3901247 - RNA, 13 nt, Shigella flexneri 2a str. 301
aaucaaucgcccc

SEQ ID NO: 3901248 - RNA, 18 nt, Shigella flexneri 2a str. 301
aaucaaucuuuacacaca

SEQ ID NO: 3901249 - RNA, 21 nt, Shigella flexneri 2a str. 301
aaucaauggucccgacaaccu

SEQ ID NO: 3901250 - RNA, 17 nt, Shigella flexneri 2a str. 301
aaucaauucaucgcucu

SEQ ID NO: 3901251 - RNA, 15 nt, Shigella flexneri 2a str. 301
aaucaauuuuucauc

SEQ ID NO: 3901252 - RNA, 23 nt, Shigella flexneri 2a str. 301
aaucacaaaaaguaguuccagca

SEQ ID NO: 3901253 - RNA, 13 nt, Shigella flexneri 2a str. 301
aaucacaaauaga

SEQ ID NO: 3901254 - RNA, 17 nt, Shigella flexneri 2a str. 301
aaucacaauagaaauau

SEQ ID NO: 3901255 - RNA, 21 nt, Shigella flexneri 2a str. 301
aaucacaauagaaauauugau

SEQ ID NO: 3901256 - RNA, 18 nt, Shigella flexneri 2a str. 301
aaucacaauggucaacau

SEQ ID NO: 3901257 - RNA, 17 nt, Shigella flexneri 2a str. 301
aaucacacaaccaugca

SEQ ID NO: 3901258 - RNA, 21 nt, Shigella flexneri 2a str. 301
aaucacacuaaccguuucuaa

SEQ ID NO: 3901259 - RNA, 17 nt, Shigella flexneri 2a str. 301
aaucacagcggcgaaug

SEQ ID NO: 3901260 - RNA, 14 nt, Shigella flexneri 2a str. 301
aaucaccacacaac

SEQ ID NO: 3901261 - RNA, 20 nt, Shigella flexneri 2a str. 301
aaucaccauauucagcagca

SEQ ID NO: 3901262 - RNA, 16 nt, Shigella flexneri 2a str. 301
aaucaccaucagcagc

SEQ ID NO: 3901263 - RNA, 21 nt, Shigella flexneri 2a str. 301
aaucaccaucagcagcaacaa

SEQ ID NO: 3901264 - RNA, 17 nt, Shigella flexneri 2a str. 301
aaucaccgccagcaagg

SEQ ID NO: 3901265 - RNA, 13 nt, Shigella flexneri 2a str. 301
aaucaccgcuuca

SEQ ID NO: 3901266 - RNA, 22 nt, Shigella flexneri 2a str. 301
aaucaccgcuucacucccugcc

SEQ ID NO: 3901267 - RNA, 13 nt, Shigella flexneri 2a str. 301
aaucgauaaacca

SEQ ID NO: 3901268 - RNA, 20 nt, Shigella flexneri 2a str. 301
aaucgaucgcguaauaaaau

SEQ ID NO: 3901269 - RNA, 18 nt, Shigella flexneri 2a str. 301
aaucgaucucaaugagcc

SEQ ID NO: 3901270 - RNA, 17 nt, Shigella flexneri 2a str. 301
aaucgcaacgccuuccg

SEQ ID NO: 3901271 - RNA, 20 nt, Shigella flexneri 2a str. 301
aaucgcacguugucagcaac

SEQ ID NO: 3901272 - RNA, 13 nt, Shigella flexneri 2a str. 301
aaucgcagcgcaa

SEQ ID NO: 3901273 - RNA, 16 nt, Shigella flexneri 2a str. 301
aaucgcaguagcgggc

SEQ ID NO: 3901274 - RNA, 22 nt, Shigella flexneri 2a str. 301
aaucgcauugacgccaaaauaa

SEQ ID NO: 3901275 - RNA, 14 nt, Shigella flexneri 2a str. 301
aaucgccaaaaaca

SEQ ID NO: 3901276 - RNA, 19 nt, Shigella flexneri 2a str. 301
aaucgccacaacuucaacg

SEQ ID NO: 3901277 - RNA, 21 nt, Shigella flexneri 2a str. 301
aaucgccagcaaaaucaccau

SEQ ID NO: 3901278 - RNA, 18 nt, Shigella flexneri 2a str. 301
aaucgccagcggcagcuc

SEQ ID NO: 3901279 - RNA, 17 nt, Shigella flexneri 2a str. 301
aaucgccaguaguaacc

SEQ ID NO: 3901280 - RNA, 19 nt, Shigella flexneri 2a str. 301
aaucgccaucuuuacaccu

SEQ ID NO: 3901281 - RNA, 19 nt, Shigella flexneri 2a str. 301
aaucgcccagcgcguaaau

SEQ ID NO: 3901282 - RNA, 21 nt, Shigella flexneri 2a str. 301
aaucgcccggauauccacccg

SEQ ID NO: 3901283 - RNA, 19 nt, Shigella flexneri 2a str. 301
aaucgccgaaccagugcuc

SEQ ID NO: 3901284 - RNA, 17 nt, Shigella flexneri 2a str. 301
aaucgccguauaauauc

SEQ ID NO: 3901285 - RNA, 20 nt, Shigella flexneri 2a str. 301
aaucgccguauaauaucuuu

SEQ ID NO: 3901286 - RNA, 23 nt, Shigella flexneri 2a str. 301
aaucgccuuaauaacccacacca

SEQ ID NO: 3901287 - RNA, 16 nt, Shigella flexneri 2a str. 301
aaucgcuacugauaau

SEQ ID NO: 3901288 - RNA, 17 nt, Shigella flexneri 2a str. 301
aaucgcuacugauaaua

SEQ ID NO: 3901289 - RNA, 14 nt, Shigella flexneri 2a str. 301
aaucgcugaauauc

SEQ ID NO: 3901290 - RNA, 18 nt, Shigella flexneri 2a str. 301
aaucgcuucauaaagaua

SEQ ID NO: 3901291 - RNA, 22 nt, Shigella flexneri 2a str. 301
aaucgcuucaucgcccacauca

SEQ ID NO: 3901292 - RNA, 14 nt, Shigella flexneri 2a str. 301
aaucgcuucauuua

SEQ ID NO: 3901293 - RNA, 24 nt, Shigella flexneri 2a str. 301
aaucgcuuuuucugcaucaaccaa

SEQ ID NO: 3901294 - RNA, 16 nt, Shigella flexneri 2a str. 301
aaucggaaacaaauac

SEQ ID NO: 3901295 - RNA, 21 nt, Shigella flexneri 2a str. 301
aaucggcgaagagagcgccag

SEQ ID NO: 3901296 - RNA, 14 nt, Shigella flexneri 2a str. 301
aaucggcugaacgu

SEQ ID NO: 3901297 - RNA, 18 nt, Shigella flexneri 2a str. 301
aaucggcugaacgugcuc

SEQ ID NO: 3901298 - RNA, 17 nt, Shigella flexneri 2a str. 301
aaucgggaaaaucugcg

SEQ ID NO: 3901299 - RNA, 14 nt, Shigella flexneri 2a str. 301
aaucgggaaauaac

SEQ ID NO: 3901300 - RNA, 11 nt, Shigella flexneri 2a str. 301
aaucgggcaac

SEQ ID NO: 3901301 - RNA, 17 nt, Shigella flexneri 2a str. 301
aaucgggcagcacauag

SEQ ID NO: 3901302 - RNA, 17 nt, Shigella flexneri 2a str. 301
aaucggugcaaaugcca

SEQ ID NO: 3901303 - RNA, 19 nt, Shigella flexneri 2a str. 301
aaucgguucgccugcacca

SEQ ID NO: 3901304 - RNA, 15 nt, Shigella flexneri 2a str. 301
aaucguaaucagcau

SEQ ID NO: 3901305 - RNA, 17 nt, Shigella flexneri 2a str. 301
aaucguacucaccagac

SEQ ID NO: 3901306 - RNA, 13 nt, Shigella flexneri 2a str. 301
aaucgucaucagc

SEQ ID NO: 3901307 - RNA, 16 nt, Shigella flexneri 2a str. 301
aaucgucaucgacagc

SEQ ID NO: 3901308 - RNA, 18 nt, Shigella flexneri 2a str. 301
aaucgucgguuccguuca

SEQ ID NO: 3901309 - RNA, 16 nt, Shigella flexneri 2a str. 301
aaucuaaaacccggua

SEQ ID NO: 3901310 - RNA, 22 nt, Shigella flexneri 2a str. 301
aaucuacaaaagauuauugcuu

SEQ ID NO: 3901311 - RNA, 22 nt, Shigella flexneri 2a str. 301
aaucuacgguggaacauuuacc

SEQ ID NO: 3901312 - RNA, 13 nt, Shigella flexneri 2a str. 301
aaucuauugcaac

SEQ ID NO: 3901313 - RNA, 21 nt, Shigella flexneri 2a str. 301
aaucuauugcaacauguugaa

SEQ ID NO: 3901314 - RNA, 17 nt, Shigella flexneri 2a str. 301
aaucucaauguauuccc

SEQ ID NO: 3901315 - RNA, 15 nt, Shigella flexneri 2a str. 301
aaucucaauuuucac

SEQ ID NO: 3901316 - RNA, 24 nt, Shigella flexneri 2a str. 301
aaucucacccgguacaucaauacc

SEQ ID NO: 3901317 - RNA, 15 nt, Shigella flexneri 2a str. 301
aaucucagcccgaug

SEQ ID NO: 3901318 - RNA, 15 nt, Shigella flexneri 2a str. 301
aaucuccauuucauu

SEQ ID NO: 3901319 - RNA, 15 nt, Shigella flexneri 2a str. 301
aaucucgcguuucga

SEQ ID NO: 3901320 - RNA, 22 nt, Shigella flexneri 2a str. 301
aaucucugguuuguuuucagau

SEQ ID NO: 3901321 - RNA, 16 nt, Shigella flexneri 2a str. 301
aaucugacaacaccaa

SEQ ID NO: 3901322 - RNA, 14 nt, Shigella flexneri 2a str. 301
aaucugauaaucca

SEQ ID NO: 3901323 - RNA, 20 nt, Shigella flexneri 2a str. 301
aaucugauagugauccauca

SEQ ID NO: 3901324 - RNA, 12 nt, Shigella flexneri 2a str. 301
aaucugauauac

SEQ ID NO: 3901325 - RNA, 14 nt, Shigella flexneri 2a str. 301
aaucugauauuuag

SEQ ID NO: 3901326 - RNA, 17 nt, Shigella flexneri 2a str. 301
aaucugauauuuagcca

SEQ ID NO: 3901327 - RNA, 17 nt, Shigella flexneri 2a str. 301
aaucugcaaaauaccaa

SEQ ID NO: 3901328 - RNA, 20 nt, Shigella flexneri 2a str. 301
aaucugcaaauuauguucuc

SEQ ID NO: 3901329 - RNA, 12 nt, Shigella flexneri 2a str. 301
aaucugccagaa

SEQ ID NO: 3901330 - RNA, 11 nt, Shigella flexneri 2a str. 301
aaucugccagc

SEQ ID NO: 3901331 - RNA, 19 nt, Shigella flexneri 2a str. 301
aaucugcccguuaaccaua

SEQ ID NO: 3901332 - RNA, 20 nt, Shigella flexneri 2a str. 301
aaucuggcagccuaauuccu

SEQ ID NO: 3901333 - RNA, 15 nt, Shigella flexneri 2a str. 301
aaucuggcgcaggug

SEQ ID NO: 3901334 - RNA, 17 nt, Shigella flexneri 2a str. 301
aaucugucagguaacaa

SEQ ID NO: 3901335 - RNA, 19 nt, Shigella flexneri 2a str. 301
aaucuguuuauuugacagc

SEQ ID NO: 3901336 - RNA, 19 nt, Shigella flexneri 2a str. 301
aaucuuagugcgccugauc

SEQ ID NO: 3901337 - RNA, 15 nt, Shigella flexneri 2a str. 301
aaucuuauaugauga

SEQ ID NO: 3901338 - RNA, 21 nt, Shigella flexneri 2a str. 301
aaucuuauaugaugaaacuga

SEQ ID NO: 3901339 - RNA, 17 nt, Shigella flexneri 2a str. 301
aaucuucacuaaaauca

SEQ ID NO: 3901340 - RNA, 12 nt, Shigella flexneri 2a str. 301
aaucuuccagaa

SEQ ID NO: 3901341 - RNA, 20 nt, Shigella flexneri 2a str. 301
aaucuuccagaucaccgcag

SEQ ID NO: 3901342 - RNA, 13 nt, Shigella flexneri 2a str. 301
aaucuugaaacca

SEQ ID NO: 3901343 - RNA, 15 nt, Shigella flexneri 2a str. 301
aaucuugcaaauuca

SEQ ID NO: 3901344 - RNA, 20 nt, Shigella flexneri 2a str. 301
aaucuuguucucagcacauu

SEQ ID NO: 3901345 - RNA, 14 nt, Shigella flexneri 2a str. 301
aaucuuuaaaaaaa

SEQ ID NO: 3901346 - RNA, 22 nt, Shigella flexneri 2a str. 301
aaucuuuuugggguuuuaauuc

SEQ ID NO: 3901347 - RNA, 11 nt, Shigella flexneri 2a str. 301
aaugaaaaacc

SEQ ID NO: 3901348 - RNA, 22 nt, Shigella flexneri 2a str. 301
aaugaaaccuucuugacgcuga

SEQ ID NO: 3901349 - RNA, 22 nt, Shigella flexneri 2a str. 301
aaugaaacgcaaauacugacug

SEQ ID NO: 3901350 - RNA, 14 nt, Shigella flexneri 2a str. 301
aaugaaauccauug

SEQ ID NO: 3901351 - RNA, 15 nt, Shigella flexneri 2a str. 301
aaugaacaccaaacc

SEQ ID NO: 3901352 - RNA, 22 nt, Shigella flexneri 2a str. 301
aaugaacgccaccccacaccag

SEQ ID NO: 3901353 - RNA, 18 nt, Shigella flexneri 2a str. 301
aaugaagaaccgcaccag

SEQ ID NO: 3901354 - RNA, 21 nt, Shigella flexneri 2a str. 301
aaugaaucaucguucauauau

SEQ ID NO: 3901355 - RNA, 12 nt, Shigella flexneri 2a str. 301
aaugaauggacu

SEQ ID NO: 3901356 - RNA, 17 nt, Shigella flexneri 2a str. 301
aaugacagccagcaagu

SEQ ID NO: 3901357 - RNA, 18 nt, Shigella flexneri 2a str. 301
aaugacagccagcaaguc

SEQ ID NO: 3901358 - RNA, 19 nt, Shigella flexneri 2a str. 301
aaugacagccagcaagucu

SEQ ID NO: 3901359 - RNA, 20 nt, Shigella flexneri 2a str. 301
aaugacaucaucgccccgcu

SEQ ID NO: 3901360 - RNA, 12 nt, Shigella flexneri 2a str. 301
aaugaccgcgcc

SEQ ID NO: 3901361 - RNA, 14 nt, Shigella flexneri 2a str. 301
aaugacgaucgguu

SEQ ID NO: 3901362 - RNA, 14 nt, Shigella flexneri 2a str. 301
aaugacgaugcacc

SEQ ID NO: 3901363 - RNA, 18 nt, Shigella flexneri 2a str. 301
aaugacguuaauaaaauu

SEQ ID NO: 3901364 - RNA, 13 nt, Shigella flexneri 2a str. 301
aaugacuccaacu

SEQ ID NO: 3901365 - RNA, 21 nt, Shigella flexneri 2a str. 301
aaugacuccaacuuacugaua

SEQ ID NO: 3901366 - RNA, 22 nt, Shigella flexneri 2a str. 301
aaugacuccaacuuacugauag

SEQ ID NO: 3901367 - RNA, 20 nt, Shigella flexneri 2a str. 301
aaugucagaugcggcgugaa

SEQ ID NO: 3901368 - RNA, 16 nt, Shigella flexneri 2a str. 301
aauguccuggcgggaa

SEQ ID NO: 3901369 - RNA, 21 nt, Shigella flexneri 2a str. 301
aaugucgggauuuucgaugaa

SEQ ID NO: 3901370 - RNA, 17 nt, Shigella flexneri 2a str. 301
aaugucugucugacaac

SEQ ID NO: 3901371 - RNA, 15 nt, Shigella flexneri 2a str. 301
aaugugaaaacccug

SEQ ID NO: 3901372 - RNA, 21 nt, Shigella flexneri 2a str. 301
aaugugacagagccauugccc

SEQ ID NO: 3901373 - RNA, 16 nt, Shigella flexneri 2a str. 301
aaugugccguaaccaa

SEQ ID NO: 3901374 - RNA, 13 nt, Shigella flexneri 2a str. 301
aauguggcagcaa

SEQ ID NO: 3901375 - RNA, 13 nt, Shigella flexneri 2a str. 301
aauguuaaagaga

SEQ ID NO: 3901376 - RNA, 14 nt, Shigella flexneri 2a str. 301
aauguuagcaaucc

SEQ ID NO: 3901377 - RNA, 19 nt, Shigella flexneri 2a str. 301
aauguuagcaauccuugag

SEQ ID NO: 3901378 - RNA, 15 nt, Shigella flexneri 2a str. 301
aauguuccagugcgu

SEQ ID NO: 3901379 - RNA, 19 nt, Shigella flexneri 2a str. 301
aauguuccaucaccagauu

SEQ ID NO: 3901380 - RNA, 13 nt, Shigella flexneri 2a str. 301
aauguucgucaua

SEQ ID NO: 3901381 - RNA, 19 nt, Shigella flexneri 2a str. 301
aauguucguccauuucagc

SEQ ID NO: 3901382 - RNA, 20 nt, Shigella flexneri 2a str. 301
aauguuguaagcuugacaua

SEQ ID NO: 3901383 - RNA, 15 nt, Shigella flexneri 2a str. 301
aauguuuaugccugg

SEQ ID NO: 3901384 - RNA, 12 nt, Shigella flexneri 2a str. 301
aauguuucugca

SEQ ID NO: 3901385 - RNA, 11 nt, Shigella flexneri 2a str. 301
aauguuugcca

SEQ ID NO: 3901386 - RNA, 17 nt, Shigella flexneri 2a str. 301
aauuaaacccgcaggcg

SEQ ID NO: 3901387 - RNA, 15 nt, Shigella flexneri 2a str. 301
aauuaaauuaucaac

SEQ ID NO: 3901388 - RNA, 15 nt, Shigella flexneri 2a str. 301
aauuaacaaaacaau

SEQ ID NO: 3901389 - RNA, 21 nt, Shigella flexneri 2a str. 301
aauuaacaccuagugcagaua

SEQ ID NO: 3901390 - RNA, 16 nt, Shigella flexneri 2a str. 301
aauuaacgaaaucuca

SEQ ID NO: 3901391 - RNA, 17 nt, Shigella flexneri 2a str. 301
aauuaacgguaauaauu

SEQ ID NO: 3901392 - RNA, 22 nt, Shigella flexneri 2a str. 301
aauuaacguaucaauuagauuu

SEQ ID NO: 3901393 - RNA, 18 nt, Shigella flexneri 2a str. 301
aauuaagaauguuaaaua

SEQ ID NO: 3901394 - RNA, 20 nt, Shigella flexneri 2a str. 301
aauuaagcccggucaucagu

SEQ ID NO: 3901395 - RNA, 17 nt, Shigella flexneri 2a str. 301
aauuaauaaucacauaa

SEQ ID NO: 3901396 - RNA, 21 nt, Shigella flexneri 2a str. 301
aauuaauccuuucgaaaaacc

SEQ ID NO: 3901397 - RNA, 13 nt, Shigella flexneri 2a str. 301
aauuaauugugaa

SEQ ID NO: 3901398 - RNA, 21 nt, Shigella flexneri 2a str. 301
aauuacacaucaggcgauaau

SEQ ID NO: 3901399 - RNA, 17 nt, Shigella flexneri 2a str. 301
aauuacacccuuaauca

SEQ ID NO: 3901400 - RNA, 17 nt, Shigella flexneri 2a str. 301
aauuacagcgcauugcu

SEQ ID NO: 3901401 - RNA, 15 nt, Shigella flexneri 2a str. 301
aauuacaguuucuga

SEQ ID NO: 3901402 - RNA, 21 nt, Shigella flexneri 2a str. 301
aauuacccuuuauuuucuggg

SEQ ID NO: 3901403 - RNA, 22 nt, Shigella flexneri 2a str. 301
aauuacccuuuauuuucuggga

SEQ ID NO: 3901404 - RNA, 18 nt, Shigella flexneri 2a str. 301
aauuacgcuguucauccc

SEQ ID NO: 3901405 - RNA, 17 nt, Shigella flexneri 2a str. 301
aauuacggauuacaugg

SEQ ID NO: 3901406 - RNA, 13 nt, Shigella flexneri 2a str. 301
aauuacucauacu

SEQ ID NO: 3901407 - RNA, 21 nt, Shigella flexneri 2a str. 301
aauuacucccgugccagagca

SEQ ID NO: 3901408 - RNA, 22 nt, Shigella flexneri 2a str. 301
aauuacucccgugccagagcau

SEQ ID NO: 3901409 - RNA, 17 nt, Shigella flexneri 2a str. 301
aauuacugagagaaaaa

SEQ ID NO: 3901410 - RNA, 18 nt, Shigella flexneri 2a str. 301
aauuacugagagaaaaaa

SEQ ID NO: 3901411 - RNA, 24 nt, Shigella flexneri 2a str. 301
aauuacugagagaaaaaaaagcau

SEQ ID NO: 3901412 - RNA, 13 nt, Shigella flexneri 2a str. 301
aauuacugagcaa

SEQ ID NO: 3901413 - RNA, 18 nt, Shigella flexneri 2a str. 301
aauuacugccuuaaucaa

SEQ ID NO: 3901414 - RNA, 21 nt, Shigella flexneri 2a str. 301
aauuacugccuugaugaaaaa

SEQ ID NO: 3901415 - RNA, 15 nt, Shigella flexneri 2a str. 301
aauuacugcuuaaau

SEQ ID NO: 3901416 - RNA, 21 nt, Shigella flexneri 2a str. 301
aauuacugggaugugaaaaug

SEQ ID NO: 3901417 - RNA, 21 nt, Shigella flexneri 2a str. 301
aauuagauuuaauaacaacga

SEQ ID NO: 3901418 - RNA, 17 nt, Shigella flexneri 2a str. 301
aauuagcaauauuuuua

SEQ ID NO: 3901419 - RNA, 16 nt, Shigella flexneri 2a str. 301
aauuagcuuuaaucca

SEQ ID NO: 3901420 - RNA, 20 nt, Shigella flexneri 2a str. 301
aauuaucacaacuucgcgaa

SEQ ID NO: 3901421 - RNA, 23 nt, Shigella flexneri 2a str. 301
aauuauccccucaaccucuugua

SEQ ID NO: 3901422 - RNA, 21 nt, Shigella flexneri 2a str. 301
aauuaucccugcggaaaaaag

SEQ ID NO: 3901423 - RNA, 22 nt, Shigella flexneri 2a str. 301
aauuaucccugcggaaaaaaga

SEQ ID NO: 3901424 - RNA, 23 nt, Shigella flexneri 2a str. 301
aauuaucccugcggaaaaaagaa

SEQ ID NO: 3901425 - RNA, 12 nt, Shigella flexneri 2a str. 301
aauuaugaagug

SEQ ID NO: 3901426 - RNA, 14 nt, Shigella flexneri 2a str. 301
aauuauuaacaaaa

SEQ ID NO: 3901427 - RNA, 13 nt, Shigella flexneri 2a str. 301
aauuauuaccauc

SEQ ID NO: 3901428 - RNA, 23 nt, Shigella flexneri 2a str. 301
aauucaaacaguucuggaagaga

SEQ ID NO: 3901429 - RNA, 12 nt, Shigella flexneri 2a str. 301
aauucaaauccu

SEQ ID NO: 3901430 - RNA, 18 nt, Shigella flexneri 2a str. 301
aauucaacgcguuuuuuc

SEQ ID NO: 3901431 - RNA, 14 nt, Shigella flexneri 2a str. 301
aauucaauauauug

SEQ ID NO: 3901432 - RNA, 11 nt, Shigella flexneri 2a str. 301
aauucaaugaa

SEQ ID NO: 3901433 - RNA, 22 nt, Shigella flexneri 2a str. 301
aauucaaugacaguaucgccaa

SEQ ID NO: 3901434 - RNA, 19 nt, Shigella flexneri 2a str. 301
aauucacgcaggcgagaau

SEQ ID NO: 3901435 - RNA, 23 nt, Shigella flexneri 2a str. 301
aauucacgccacugucauauuug

SEQ ID NO: 3901436 - RNA, 14 nt, Shigella flexneri 2a str. 301
aauucacgccuucu

SEQ ID NO: 3901437 - RNA, 15 nt, Shigella flexneri 2a str. 301
aauucacucuauacc

SEQ ID NO: 3901438 - RNA, 16 nt, Shigella flexneri 2a str. 301
aauucagaaaaauaca

SEQ ID NO: 3901439 - RNA, 21 nt, Shigella flexneri 2a str. 301
aauucauaagaagcuuuucuc

SEQ ID NO: 3901440 - RNA, 18 nt, Shigella flexneri 2a str. 301
aauucauacaucgcgcuu

SEQ ID NO: 3901441 - RNA, 16 nt, Shigella flexneri 2a str. 301
aauucaucaucagcau

SEQ ID NO: 3901442 - RNA, 22 nt, Shigella flexneri 2a str. 301
aauucaucuucacuucaucccu

SEQ ID NO: 3901443 - RNA, 20 nt, Shigella flexneri 2a str. 301
aauucauuugaauaguuaau

SEQ ID NO: 3901444 - RNA, 23 nt, Shigella flexneri 2a str. 301
aauuccacgccauagcggagcaa

SEQ ID NO: 3901445 - RNA, 19 nt, Shigella flexneri 2a str. 301
aauuccacgcgccacgcac

SEQ ID NO: 3901446 - RNA, 23 nt, Shigella flexneri 2a str. 301
aauuccauuucccugacaaauca

SEQ ID NO: 3901447 - RNA, 12 nt, Shigella flexneri 2a str. 301
aauucccagaau

SEQ ID NO: 3901448 - RNA, 18 nt, Shigella flexneri 2a str. 301
aauucccaguuacugcca

SEQ ID NO: 3901449 - RNA, 18 nt, Shigella flexneri 2a str. 301
aauucccgagcugcucgu

SEQ ID NO: 3901450 - RNA, 13 nt, Shigella flexneri 2a str. 301
aauucccgcuucu

SEQ ID NO: 3901451 - RNA, 14 nt, Shigella flexneri 2a str. 301
aauucccugcgcca

SEQ ID NO: 3901452 - RNA, 14 nt, Shigella flexneri 2a str. 301
aauuccgaacaaaa

SEQ ID NO: 3901453 - RNA, 18 nt, Shigella flexneri 2a str. 301
aauuccgaauuucauccu

SEQ ID NO: 3901454 - RNA, 21 nt, Shigella flexneri 2a str. 301
aauuccggcuugguguggaua

SEQ ID NO: 3901455 - RNA, 23 nt, Shigella flexneri 2a str. 301
aauuccggcuuguucaucaccau

SEQ ID NO: 3901456 - RNA, 18 nt, Shigella flexneri 2a str. 301
aauuccucccguuaugau

SEQ ID NO: 3901457 - RNA, 19 nt, Shigella flexneri 2a str. 301
aauucgaaauagagaaagu

SEQ ID NO: 3901458 - RNA, 21 nt, Shigella flexneri 2a str. 301
aauucgaaauagagaaaguaa

SEQ ID NO: 3901459 - RNA, 16 nt, Shigella flexneri 2a str. 301
aauucgacuuucucug

SEQ ID NO: 3901460 - RNA, 23 nt, Shigella flexneri 2a str. 301
aauucgcgucggcgucagcgcca

SEQ ID NO: 3901461 - RNA, 19 nt, Shigella flexneri 2a str. 301
aauucgcugaauaccgauu

SEQ ID NO: 3901462 - RNA, 16 nt, Shigella flexneri 2a str. 301
aauucuaaauguucaa

SEQ ID NO: 3901463 - RNA, 12 nt, Shigella flexneri 2a str. 301
aauucuacagaa

SEQ ID NO: 3901464 - RNA, 14 nt, Shigella flexneri 2a str. 301
aauucuacagaaau

SEQ ID NO: 3901465 - RNA, 18 nt, Shigella flexneri 2a str. 301
aauucuacagaaaugaaa

SEQ ID NO: 3901466 - RNA, 21 nt, Shigella flexneri 2a str. 301
aauucuacagaaaugaaaaaa

SEQ ID NO: 3901467 - RNA, 21 nt, Shigella flexneri 2a str. 301
aauuuuuccagcauuucuucc

SEQ ID NO: 3901468 - RNA, 22 nt, Shigella flexneri 2a str. 301
aauuuuucguuuaugaucauca

SEQ ID NO: 3901469 - RNA, 21 nt, Shigella flexneri 2a str. 301
aauuuuuucacuguucugaua

SEQ ID NO: 3901470 - RNA, 14 nt, Shigella flexneri 2a str. 301
acaaaaaaaacagc

SEQ ID NO: 3901471 - RNA, 22 nt, Shigella flexneri 2a str. 301
acaaaaaaaacagcgcccaaca

SEQ ID NO: 3901472 - RNA, 13 nt, Shigella flexneri 2a str. 301
acaaaaaacaaag

SEQ ID NO: 3901473 - RNA, 14 nt, Shigella flexneri 2a str. 301
acaaaaaagaguaa

SEQ ID NO: 3901474 - RNA, 16 nt, Shigella flexneri 2a str. 301
acaaaaaagccaauca

SEQ ID NO: 3901475 - RNA, 22 nt, Shigella flexneri 2a str. 301
acaaaaaagccaaucacaaaaa

SEQ ID NO: 3901476 - RNA, 15 nt, Shigella flexneri 2a str. 301
acaaaaaaugugaag

SEQ ID NO: 3901477 - RNA, 21 nt, Shigella flexneri 2a str. 301
acaaaaaguaguuccagcaug

SEQ ID NO: 3901478 - RNA, 14 nt, Shigella flexneri 2a str. 301
acaaaaauagcccc

SEQ ID NO: 3901479 - RNA, 14 nt, Shigella flexneri 2a str. 301
acaaaacaauggga

SEQ ID NO: 3901480 - RNA, 21 nt, Shigella flexneri 2a str. 301
acaaaaccacgacuuuuuguc

SEQ ID NO: 3901481 - RNA, 12 nt, Shigella flexneri 2a str. 301
acaaaaccugca

SEQ ID NO: 3901482 - RNA, 12 nt, Shigella flexneri 2a str. 301
acaaaaccugcc

SEQ ID NO: 3901483 - RNA, 13 nt, Shigella flexneri 2a str. 301
acaaaaccugccg

SEQ ID NO: 3901484 - RNA, 21 nt, Shigella flexneri 2a str. 301
acaaaagaauggcuguagggu

SEQ ID NO: 3901485 - RNA, 21 nt, Shigella flexneri 2a str. 301
acaaaauccugccagcgugag

SEQ ID NO: 3901486 - RNA, 17 nt, Shigella flexneri 2a str. 301
acaaaaucggaaacaaa

SEQ ID NO: 3901487 - RNA, 22 nt, Shigella flexneri 2a str. 301
acaaaaucgugaaaaaucaaua

SEQ ID NO: 3901488 - RNA, 19 nt, Shigella flexneri 2a str. 301
acaaaaucuauugcaacau

SEQ ID NO: 3901489 - RNA, 15 nt, Shigella flexneri 2a str. 301
acaaaaucuucguua

SEQ ID NO: 3901490 - RNA, 15 nt, Shigella flexneri 2a str. 301
acaaaauggcaaagc

SEQ ID NO: 3901491 - RNA, 12 nt, Shigella flexneri 2a str. 301
acaaaauuuaac

SEQ ID NO: 3901492 - RNA, 16 nt, Shigella flexneri 2a str. 301
acaaaauuuucagcgu

SEQ ID NO: 3901493 - RNA, 23 nt, Shigella flexneri 2a str. 301
acaaacagcgccuguuuaccgcu

SEQ ID NO: 3901494 - RNA, 20 nt, Shigella flexneri 2a str. 301
acaaacaucauccagugccg

SEQ ID NO: 3901495 - RNA, 14 nt, Shigella flexneri 2a str. 301
acaaacgacgggcc

SEQ ID NO: 3901496 - RNA, 16 nt, Shigella flexneri 2a str. 301
acaaacgccagauaca

SEQ ID NO: 3901497 - RNA, 15 nt, Shigella flexneri 2a str. 301
acaaacgcugacaua

SEQ ID NO: 3901498 - RNA, 19 nt, Shigella flexneri 2a str. 301
acaaacgcuguaauuacca

SEQ ID NO: 3901499 - RNA, 18 nt, Shigella flexneri 2a str. 301
acaaacguugcugacugu

SEQ ID NO: 3901500 - RNA, 18 nt, Shigella flexneri 2a str. 301
acaaacugguguugaaac

SEQ ID NO: 3901501 - RNA, 16 nt, Shigella flexneri 2a str. 301
acaaacuuaccgccgc

SEQ ID NO: 3901502 - RNA, 12 nt, Shigella flexneri 2a str. 301
acaaagcaugau

SEQ ID NO: 3901503 - RNA, 21 nt, Shigella flexneri 2a str. 301
acaaagugcacuuugucaaua

SEQ ID NO: 3901504 - RNA, 14 nt, Shigella flexneri 2a str. 301
acaaauaaaagcaa

SEQ ID NO: 3901505 - RNA, 19 nt, Shigella flexneri 2a str. 301
acaaauacgcuuuuucccu

SEQ ID NO: 3901506 - RNA, 20 nt, Shigella flexneri 2a str. 301
acaaauacgcuuuuucccug

SEQ ID NO: 3901507 - RNA, 16 nt, Shigella flexneri 2a str. 301
acaaauagacacaaga

SEQ ID NO: 3901508 - RNA, 19 nt, Shigella flexneri 2a str. 301
acaaauagagauagaaugc

SEQ ID NO: 3901509 - RNA, 15 nt, Shigella flexneri 2a str. 301
acaaauagccaauuc

SEQ ID NO: 3901510 - RNA, 19 nt, Shigella flexneri 2a str. 301
acaaauagccaauucccag

SEQ ID NO: 3901511 - RNA, 17 nt, Shigella flexneri 2a str. 301
acaaauagccagcagag

SEQ ID NO: 3901512 - RNA, 21 nt, Shigella flexneri 2a str. 301
acaaaugaccgacguuaugcu

SEQ ID NO: 3901513 - RNA, 18 nt, Shigella flexneri 2a str. 301
acaaauggcaaugacuag

SEQ ID NO: 3901514 - RNA, 19 nt, Shigella flexneri 2a str. 301
acaaauggcaguaucggca

SEQ ID NO: 3901515 - RNA, 14 nt, Shigella flexneri 2a str. 301
acaaaugugccauu

SEQ ID NO: 3901516 - RNA, 22 nt, Shigella flexneri 2a str. 301
acaaauuucaucgcuacaccaa

SEQ ID NO: 3901517 - RNA, 22 nt, Shigella flexneri 2a str. 301
acaaauuugugcaaauucaaua

SEQ ID NO: 3901518 - RNA, 16 nt, Shigella flexneri 2a str. 301
acaaauuugugcucug

SEQ ID NO: 3901519 - RNA, 15 nt, Shigella flexneri 2a str. 301
acaacaaacgcaaac

SEQ ID NO: 3901520 - RNA, 14 nt, Shigella flexneri 2a str. 301
acaacaacacccau

SEQ ID NO: 3901521 - RNA, 13 nt, Shigella flexneri 2a str. 301
acaacaccgugca

SEQ ID NO: 3901522 - RNA, 18 nt, Shigella flexneri 2a str. 301
acaacacgccgauaauca

SEQ ID NO: 3901523 - RNA, 17 nt, Shigella flexneri 2a str. 301
acaacacucucugaagu

SEQ ID NO: 3901524 - RNA, 13 nt, Shigella flexneri 2a str. 301
acaacacuucaua

SEQ ID NO: 3901525 - RNA, 21 nt, Shigella flexneri 2a str. 301
acaacagucccaggcagaagc

SEQ ID NO: 3901526 - RNA, 22 nt, Shigella flexneri 2a str. 301
acaacagucccaggcagaagcg

SEQ ID NO: 3901527 - RNA, 17 nt, Shigella flexneri 2a str. 301
acaacaucaucugccac

SEQ ID NO: 3901528 - RNA, 13 nt, Shigella flexneri 2a str. 301
acaacaugcagcc

SEQ ID NO: 3901529 - RNA, 23 nt, Shigella flexneri 2a str. 301
acaacaugcuauugcgccagccu

SEQ ID NO: 3901530 - RNA, 13 nt, Shigella flexneri 2a str. 301
acaaccaucccca

SEQ ID NO: 3901531 - RNA, 13 nt, Shigella flexneri 2a str. 301
acaacccacacau

SEQ ID NO: 3901532 - RNA, 14 nt, Shigella flexneri 2a str. 301
acaacccacacauu

SEQ ID NO: 3901533 - RNA, 15 nt, Shigella flexneri 2a str. 301
acaaccgaggcucaa

SEQ ID NO: 3901534 - RNA, 12 nt, Shigella flexneri 2a str. 301
acaaccggauau

SEQ ID NO: 3901535 - RNA, 20 nt, Shigella flexneri 2a str. 301
acaaccugcuggaaaggccg

SEQ ID NO: 3901536 - RNA, 22 nt, Shigella flexneri 2a str. 301
acaaccuugccauuccacaaaa

SEQ ID NO: 3901537 - RNA, 21 nt, Shigella flexneri 2a str. 301
acaacgaagccgugccacagg

SEQ ID NO: 3901538 - RNA, 18 nt, Shigella flexneri 2a str. 301
acaacgaccggccauucc

SEQ ID NO: 3901539 - RNA, 19 nt, Shigella flexneri 2a str. 301
acaacgcgcacuuugucuu

SEQ ID NO: 3901540 - RNA, 19 nt, Shigella flexneri 2a str. 301
acaacgcuuuuugguucau

SEQ ID NO: 3901541 - RNA, 13 nt, Shigella flexneri 2a str. 301
acaacggaacgaa

SEQ ID NO: 3901542 - RNA, 18 nt, Shigella flexneri 2a str. 301
acaacguaucuugcguca

SEQ ID NO: 3901543 - RNA, 16 nt, Shigella flexneri 2a str. 301
acaacgucgccagucc

SEQ ID NO: 3901544 - RNA, 21 nt, Shigella flexneri 2a str. 301
acaacgugugcuuuguucaug

SEQ ID NO: 3901545 - RNA, 12 nt, Shigella flexneri 2a str. 301
acaacucaucac

SEQ ID NO: 3901546 - RNA, 21 nt, Shigella flexneri 2a str. 301
acaacucaucacuguaggcca

SEQ ID NO: 3901547 - RNA, 22 nt, Shigella flexneri 2a str. 301
acaacucgcuuaagccaucauc

SEQ ID NO: 3901548 - RNA, 21 nt, Shigella flexneri 2a str. 301
acaacucggcggcuuaaccgu

SEQ ID NO: 3901549 - RNA, 16 nt, Shigella flexneri 2a str. 301
acaacugaaaaaaaau

SEQ ID NO: 3901550 - RNA, 18 nt, Shigella flexneri 2a str. 301
acaacugaaaaaaaauua

SEQ ID NO: 3901551 - RNA, 23 nt, Shigella flexneri 2a str. 301
acaacugcgaccguacaaccaaa

SEQ ID NO: 3901552 - RNA, 21 nt, Shigella flexneri 2a str. 301
acaacuucaacguugaauuuc

SEQ ID NO: 3901553 - RNA, 13 nt, Shigella flexneri 2a str. 301
acaacuucccugu

SEQ ID NO: 3901554 - RNA, 16 nt, Shigella flexneri 2a str. 301
acaacuuucaucagca

SEQ ID NO: 3901555 - RNA, 16 nt, Shigella flexneri 2a str. 301
acaagaaucaugccaa

SEQ ID NO: 3901556 - RNA, 14 nt, Shigella flexneri 2a str. 301
acaagacuguaaau

SEQ ID NO: 3901557 - RNA, 20 nt, Shigella flexneri 2a str. 301
acaagcccgcugccgcagau

SEQ ID NO: 3901558 - RNA, 19 nt, Shigella flexneri 2a str. 301
acaagcgauaacucgcuuu

SEQ ID NO: 3901559 - RNA, 15 nt, Shigella flexneri 2a str. 301
acaagcguaagagaa

SEQ ID NO: 3901560 - RNA, 14 nt, Shigella flexneri 2a str. 301
acaagcuccggcuu

SEQ ID NO: 3901561 - RNA, 21 nt, Shigella flexneri 2a str. 301
acaagcuuacguuacccagca

SEQ ID NO: 3901562 - RNA, 19 nt, Shigella flexneri 2a str. 301
acaaggaauguggcaauga

SEQ ID NO: 3901563 - RNA, 21 nt, Shigella flexneri 2a str. 301
acaaggaauguggcaaugagu

SEQ ID NO: 3901564 - RNA, 22 nt, Shigella flexneri 2a str. 301
acaaggaauguggcaaugagug

SEQ ID NO: 3901565 - RNA, 14 nt, Shigella flexneri 2a str. 301
acaaggcaucguga

SEQ ID NO: 3901566 - RNA, 15 nt, Shigella flexneri 2a str. 301
acaagggugagggag

SEQ ID NO: 3901567 - RNA, 14 nt, Shigella flexneri 2a str. 301
acaccaacgccccg

SEQ ID NO: 3901568 - RNA, 17 nt, Shigella flexneri 2a str. 301
acaccaauuucugaagg

SEQ ID NO: 3901569 - RNA, 21 nt, Shigella flexneri 2a str. 301
acaccaccaauggcuggccug

SEQ ID NO: 3901570 - RNA, 17 nt, Shigella flexneri 2a str. 301
acaccaccuaacccgcu

SEQ ID NO: 3901571 - RNA, 14 nt, Shigella flexneri 2a str. 301
acaccaccugccag

SEQ ID NO: 3901572 - RNA, 14 nt, Shigella flexneri 2a str. 301
acaccacugcgcau

SEQ ID NO: 3901573 - RNA, 17 nt, Shigella flexneri 2a str. 301
acaccacugcgcauaau

SEQ ID NO: 3901574 - RNA, 16 nt, Shigella flexneri 2a str. 301
acaccagaaugcccca

SEQ ID NO: 3901575 - RNA, 16 nt, Shigella flexneri 2a str. 301
acaccagcaauaaugc

SEQ ID NO: 3901576 - RNA, 21 nt, Shigella flexneri 2a str. 301
acaccauaaaacaaauccgcu

SEQ ID NO: 3901577 - RNA, 22 nt, Shigella flexneri 2a str. 301
acaccauaucuaugguuuuuuc

SEQ ID NO: 3901578 - RNA, 12 nt, Shigella flexneri 2a str. 301
acaccaucaaca

SEQ ID NO: 3901579 - RNA, 14 nt, Shigella flexneri 2a str. 301
acaccaucaacaaa

SEQ ID NO: 3901580 - RNA, 15 nt, Shigella flexneri 2a str. 301
acaccaugccgguga

SEQ ID NO: 3901581 - RNA, 20 nt, Shigella flexneri 2a str. 301
acaccauugauaauccauca

SEQ ID NO: 3901582 - RNA, 22 nt, Shigella flexneri 2a str. 301
acaccauugauaauccaucacu

SEQ ID NO: 3901583 - RNA, 16 nt, Shigella flexneri 2a str. 301
acacccaaaacaaagc

SEQ ID NO: 3901584 - RNA, 12 nt, Shigella flexneri 2a str. 301
acacccagcccc

SEQ ID NO: 3901585 - RNA, 14 nt, Shigella flexneri 2a str. 301
acacccaguucaac

SEQ ID NO: 3901586 - RNA, 15 nt, Shigella flexneri 2a str. 301
acaccccuucauuca

SEQ ID NO: 3901587 - RNA, 22 nt, Shigella flexneri 2a str. 301
acacccgacgugcagcaucgau

SEQ ID NO: 3901588 - RNA, 17 nt, Shigella flexneri 2a str. 301
acacccgguaucaaacc

SEQ ID NO: 3901589 - RNA, 16 nt, Shigella flexneri 2a str. 301
acaccgauugccccug

SEQ ID NO: 3901590 - RNA, 14 nt, Shigella flexneri 2a str. 301
acaccgauuuugua

SEQ ID NO: 3901591 - RNA, 21 nt, Shigella flexneri 2a str. 301
acaccgauuuuguaaaagaag

SEQ ID NO: 3901592 - RNA, 22 nt, Shigella flexneri 2a str. 301
acaccgauuuuguaaaagaagg

SEQ ID NO: 3901593 - RNA, 15 nt, Shigella flexneri 2a str. 301
acaccgcacgcagaa

SEQ ID NO: 3901594 - RNA, 21 nt, Shigella flexneri 2a str. 301
acaccgcagccgccacaauaa

SEQ ID NO: 3901595 - RNA, 12 nt, Shigella flexneri 2a str. 301
acaccgcgacgg

SEQ ID NO: 3901596 - RNA, 21 nt, Shigella flexneri 2a str. 301
acaccgcgaucuuccacgccu

SEQ ID NO: 3901597 - RNA, 12 nt, Shigella flexneri 2a str. 301
acaccgcgugag

SEQ ID NO: 3901598 - RNA, 22 nt, Shigella flexneri 2a str. 301
acaccgcugacuuucaaacgcc

SEQ ID NO: 3901599 - RNA, 16 nt, Shigella flexneri 2a str. 301
acaccggcaauaauua

SEQ ID NO: 3901600 - RNA, 24 nt, Shigella flexneri 2a str. 301
acaccgguagagauuaacgucacu

SEQ ID NO: 3901601 - RNA, 19 nt, Shigella flexneri 2a str. 301
acaccgguuuaccggccag

SEQ ID NO: 3901602 - RNA, 16 nt, Shigella flexneri 2a str. 301
acaccgucgcaauacc

SEQ ID NO: 3901603 - RNA, 22 nt, Shigella flexneri 2a str. 301
acaccugggcaauggugaacug

SEQ ID NO: 3901604 - RNA, 16 nt, Shigella flexneri 2a str. 301
acaccuguuccagugg

SEQ ID NO: 3901605 - RNA, 21 nt, Shigella flexneri 2a str. 301
acaccuguugcgcgucgccca

SEQ ID NO: 3901606 - RNA, 23 nt, Shigella flexneri 2a str. 301
acaccuguugcgcgucgcccagu

SEQ ID NO: 3901607 - RNA, 19 nt, Shigella flexneri 2a str. 301
acaccuucagcgaagccca

SEQ ID NO: 3901608 - RNA, 20 nt, Shigella flexneri 2a str. 301
acaccuucagcgaagcccac

SEQ ID NO: 3901609 - RNA, 20 nt, Shigella flexneri 2a str. 301
acaccuucucaggccuacaa

SEQ ID NO: 3901610 - RNA, 19 nt, Shigella flexneri 2a str. 301
acacgccaggccacgcuuu

SEQ ID NO: 3901611 - RNA, 13 nt, Shigella flexneri 2a str. 301
acacgccgauauc

SEQ ID NO: 3901612 - RNA, 20 nt, Shigella flexneri 2a str. 301
acacgccgccagaccaauag

SEQ ID NO: 3901613 - RNA, 11 nt, Shigella flexneri 2a str. 301
acacgccgugc

SEQ ID NO: 3901614 - RNA, 20 nt, Shigella flexneri 2a str. 301
acacgcuaccaaaaaaucaa

SEQ ID NO: 3901615 - RNA, 20 nt, Shigella flexneri 2a str. 301
acacgcuaccacaagccacc

SEQ ID NO: 3901616 - RNA, 20 nt, Shigella flexneri 2a str. 301
acacgcucuggcaggcuuca

SEQ ID NO: 3901617 - RNA, 21 nt, Shigella flexneri 2a str. 301
acacgcugcgguuuacgccag

SEQ ID NO: 3901618 - RNA, 19 nt, Shigella flexneri 2a str. 301
acacggcagcaaccgcuuc

SEQ ID NO: 3901619 - RNA, 19 nt, Shigella flexneri 2a str. 301
acacggcguauacaagaac

SEQ ID NO: 3901620 - RNA, 14 nt, Shigella flexneri 2a str. 301
acacuaacagaaca

SEQ ID NO: 3901621 - RNA, 20 nt, Shigella flexneri 2a str. 301
acacuaaccguuucuaauau

SEQ ID NO: 3901622 - RNA, 20 nt, Shigella flexneri 2a str. 301
acacuaacgcgucuuaucug

SEQ ID NO: 3901623 - RNA, 16 nt, Shigella flexneri 2a str. 301
acacuaccggaaccca

SEQ ID NO: 3901624 - RNA, 19 nt, Shigella flexneri 2a str. 301
acacuauaaaauaaccaca

SEQ ID NO: 3901625 - RNA, 14 nt, Shigella flexneri 2a str. 301
acacuauuuccuug

SEQ ID NO: 3901626 - RNA, 17 nt, Shigella flexneri 2a str. 301
acacucggcgcggaugc

SEQ ID NO: 3901627 - RNA, 19 nt, Shigella flexneri 2a str. 301
acacucggcgucaaacggc

SEQ ID NO: 3901628 - RNA, 21 nt, Shigella flexneri 2a str. 301
acacucggcgucaaacggcua

SEQ ID NO: 3901629 - RNA, 17 nt, Shigella flexneri 2a str. 301
acacugaaccgaaaugg

SEQ ID NO: 3901630 - RNA, 21 nt, Shigella flexneri 2a str. 301
acacugaaccgaaauggcugc

SEQ ID NO: 3901631 - RNA, 17 nt, Shigella flexneri 2a str. 301
acacugaauaaaaaugu

SEQ ID NO: 3901632 - RNA, 20 nt, Shigella flexneri 2a str. 301
acacugaauaaaaaugugca

SEQ ID NO: 3901633 - RNA, 20 nt, Shigella flexneri 2a str. 301
acacugacgcgucuuaucug

SEQ ID NO: 3901634 - RNA, 14 nt, Shigella flexneri 2a str. 301
acacugaugacagg

SEQ ID NO: 3901635 - RNA, 18 nt, Shigella flexneri 2a str. 301
acacugcuuacaggcugg

SEQ ID NO: 3901636 - RNA, 17 nt, Shigella flexneri 2a str. 301
acacuggcaaaaucaaa

SEQ ID NO: 3901637 - RNA, 22 nt, Shigella flexneri 2a str. 301
acacuggcauccccgcccuucc

SEQ ID NO: 3901638 - RNA, 19 nt, Shigella flexneri 2a str. 301
acacugggaugaaagugau

SEQ ID NO: 3901639 - RNA, 21 nt, Shigella flexneri 2a str. 301
acacugguucccaacaacagc

SEQ ID NO: 3901640 - RNA, 21 nt, Shigella flexneri 2a str. 301
acacuguaagccaccgaacaa

SEQ ID NO: 3901641 - RNA, 13 nt, Shigella flexneri 2a str. 301
acacuuagccugu

SEQ ID NO: 3901642 - RNA, 20 nt, Shigella flexneri 2a str. 301
acacuucacacacuuuuauu

SEQ ID NO: 3901643 - RNA, 20 nt, Shigella flexneri 2a str. 301
acacuuuccaguuccggcau

SEQ ID NO: 3901644 - RNA, 21 nt, Shigella flexneri 2a str. 301
acacuuuccaguuccggcauu

SEQ ID NO: 3901645 - RNA, 13 nt, Shigella flexneri 2a str. 301
acacuuuucuuua

SEQ ID NO: 3901646 - RNA, 15 nt, Shigella flexneri 2a str. 301
acagaaaugaaaaaa

SEQ ID NO: 3901647 - RNA, 16 nt, Shigella flexneri 2a str. 301
acagaaaugaaaaaau

SEQ ID NO: 3901648 - RNA, 12 nt, Shigella flexneri 2a str. 301
acagaaauggua

SEQ ID NO: 3901649 - RNA, 20 nt, Shigella flexneri 2a str. 301
acagaaaugguaaagaaggc

SEQ ID NO: 3901650 - RNA, 15 nt, Shigella flexneri 2a str. 301
acagaaauucagcgu

SEQ ID NO: 3901651 - RNA, 13 nt, Shigella flexneri 2a str. 301
acagaacaauaau

SEQ ID NO: 3901652 - RNA, 22 nt, Shigella flexneri 2a str. 301
acagaacaauaauaacucucuu

SEQ ID NO: 3901653 - RNA, 14 nt, Shigella flexneri 2a str. 301
acagaaggccagga

SEQ ID NO: 3901654 - RNA, 17 nt, Shigella flexneri 2a str. 301
acagaagugaagcaugg

SEQ ID NO: 3901655 - RNA, 17 nt, Shigella flexneri 2a str. 301
acagaaucugaaggaug

SEQ ID NO: 3901656 - RNA, 19 nt, Shigella flexneri 2a str. 301
acagaaugcgggcgaaaac

SEQ ID NO: 3901657 - RNA, 18 nt, Shigella flexneri 2a str. 301
acagaauggcaucugaua

SEQ ID NO: 3901658 - RNA, 14 nt, Shigella flexneri 2a str. 301
acagaauguugcuu

SEQ ID NO: 3901659 - RNA, 20 nt, Shigella flexneri 2a str. 301
acagacagccucaagcaccc

SEQ ID NO: 3901660 - RNA, 13 nt, Shigella flexneri 2a str. 301
acagacaguaaua

SEQ ID NO: 3901661 - RNA, 18 nt, Shigella flexneri 2a str. 301
acagacauaaagccugcu

SEQ ID NO: 3901662 - RNA, 24 nt, Shigella flexneri 2a str. 301
acagaccaaaacgugcagcugccu

SEQ ID NO: 3901663 - RNA, 19 nt, Shigella flexneri 2a str. 301
acagaccacauuccaggcc

SEQ ID NO: 3901664 - RNA, 17 nt, Shigella flexneri 2a str. 301
acagaccaguaaagugc

SEQ ID NO: 3901665 - RNA, 14 nt, Shigella flexneri 2a str. 301
acagaccauaaccg

SEQ ID NO: 3901666 - RNA, 13 nt, Shigella flexneri 2a str. 301
acaggaugggcau

SEQ ID NO: 3901667 - RNA, 19 nt, Shigella flexneri 2a str. 301
acaggcaaccgauagcugg

SEQ ID NO: 3901668 - RNA, 14 nt, Shigella flexneri 2a str. 301
acaggcagcaauca

SEQ ID NO: 3901669 - RNA, 14 nt, Shigella flexneri 2a str. 301
acaggcagcuuaga

SEQ ID NO: 3901670 - RNA, 22 nt, Shigella flexneri 2a str. 301
acaggccaucacauccugauag

SEQ ID NO: 3901671 - RNA, 16 nt, Shigella flexneri 2a str. 301
acaggcgaucuucccg

SEQ ID NO: 3901672 - RNA, 19 nt, Shigella flexneri 2a str. 301
acaggcgcuggguaaagag

SEQ ID NO: 3901673 - RNA, 21 nt, Shigella flexneri 2a str. 301
acaggcggguaaucuuuccag

SEQ ID NO: 3901674 - RNA, 18 nt, Shigella flexneri 2a str. 301
acaggcugguuucucuuc

SEQ ID NO: 3901675 - RNA, 18 nt, Shigella flexneri 2a str. 301
acaggcuuuccugauaau

SEQ ID NO: 3901676 - RNA, 22 nt, Shigella flexneri 2a str. 301
acagggccaggaaucgcaaacc

SEQ ID NO: 3901677 - RNA, 17 nt, Shigella flexneri 2a str. 301
acagggcuuacugaaaa

SEQ ID NO: 3901678 - RNA, 15 nt, Shigella flexneri 2a str. 301
acagguaaggcgcga

SEQ ID NO: 3901679 - RNA, 21 nt, Shigella flexneri 2a str. 301
acaggucaaaguaaccuuuga

SEQ ID NO: 3901680 - RNA, 19 nt, Shigella flexneri 2a str. 301
acaggucgagaacaacggc

SEQ ID NO: 3901681 - RNA, 22 nt, Shigella flexneri 2a str. 301
acaggucgccagucccuuucag

SEQ ID NO: 3901682 - RNA, 12 nt, Shigella flexneri 2a str. 301
acaggucuguau

SEQ ID NO: 3901683 - RNA, 15 nt, Shigella flexneri 2a str. 301
acaggugccggauuu

SEQ ID NO: 3901684 - RNA, 16 nt, Shigella flexneri 2a str. 301
acaggugcuccagggu

SEQ ID NO: 3901685 - RNA, 23 nt, Shigella flexneri 2a str. 301
acagguggcaaauggcgaaggau

SEQ ID NO: 3901686 - RNA, 17 nt, Shigella flexneri 2a str. 301
acagguggcguuugcca

SEQ ID NO: 3901687 - RNA, 15 nt, Shigella flexneri 2a str. 301
acagguuuaaacaga

SEQ ID NO: 3901688 - RNA, 20 nt, Shigella flexneri 2a str. 301
acagguuuaaacagagauua

SEQ ID NO: 3901689 - RNA, 16 nt, Shigella flexneri 2a str. 301
acagguuucaaugcac

SEQ ID NO: 3901690 - RNA, 16 nt, Shigella flexneri 2a str. 301
acaguaacccggcacc

SEQ ID NO: 3901691 - RNA, 21 nt, Shigella flexneri 2a str. 301
acaguaucaucauuauuaaua

SEQ ID NO: 3901692 - RNA, 23 nt, Shigella flexneri 2a str. 301
acaguaucugaaucaaaaucauc

SEQ ID NO: 3901693 - RNA, 13 nt, Shigella flexneri 2a str. 301
acagucaggcugu

SEQ ID NO: 3901694 - RNA, 22 nt, Shigella flexneri 2a str. 301
acagucgcccgaccaucgccag

SEQ ID NO: 3901695 - RNA, 14 nt, Shigella flexneri 2a str. 301
acagugaaucucuu

SEQ ID NO: 3901696 - RNA, 18 nt, Shigella flexneri 2a str. 301
acagugaccaucuuccag

SEQ ID NO: 3901697 - RNA, 20 nt, Shigella flexneri 2a str. 301
acagugaccaucuuccagca

SEQ ID NO: 3901698 - RNA, 22 nt, Shigella flexneri 2a str. 301
acagugaccaucuuccagcauc

SEQ ID NO: 3901699 - RNA, 15 nt, Shigella flexneri 2a str. 301
acagugacccgcagc

SEQ ID NO: 3901700 - RNA, 16 nt, Shigella flexneri 2a str. 301
acagugacuuccguac

SEQ ID NO: 3901701 - RNA, 22 nt, Shigella flexneri 2a str. 301
acagugacuuccguaccagccu

SEQ ID NO: 3901702 - RNA, 16 nt, Shigella flexneri 2a str. 301
acaguuauaaaaugau

SEQ ID NO: 3901703 - RNA, 12 nt, Shigella flexneri 2a str. 301
acaguucaaucu

SEQ ID NO: 3901704 - RNA, 17 nt, Shigella flexneri 2a str. 301
acaguuccgcaaagccc

SEQ ID NO: 3901705 - RNA, 16 nt, Shigella flexneri 2a str. 301
acaguucuucaaaaau

SEQ ID NO: 3901706 - RNA, 19 nt, Shigella flexneri 2a str. 301
acaguucuucaaaaauaau

SEQ ID NO: 3901707 - RNA, 15 nt, Shigella flexneri 2a str. 301
acaguugcucaauca

SEQ ID NO: 3901708 - RNA, 13 nt, Shigella flexneri 2a str. 301
acaguuguaaagu

SEQ ID NO: 3901709 - RNA, 23 nt, Shigella flexneri 2a str. 301
acaguuuucagugcuucaccgau

SEQ ID NO: 3901710 - RNA, 13 nt, Shigella flexneri 2a str. 301
acauaaaaaccug

SEQ ID NO: 3901711 - RNA, 21 nt, Shigella flexneri 2a str. 301
acauaaaacgcuuacgcuuca

SEQ ID NO: 3901712 - RNA, 20 nt, Shigella flexneri 2a str. 301
acauaacgccaauucauucc

SEQ ID NO: 3901713 - RNA, 14 nt, Shigella flexneri 2a str. 301
acauaacugccucg

SEQ ID NO: 3901714 - RNA, 21 nt, Shigella flexneri 2a str. 301
acauaauccagacacuccaga

SEQ ID NO: 3901715 - RNA, 12 nt, Shigella flexneri 2a str. 301
acauaauggccg

SEQ ID NO: 3901716 - RNA, 17 nt, Shigella flexneri 2a str. 301
acauacagaucgugcau

SEQ ID NO: 3901717 - RNA, 15 nt, Shigella flexneri 2a str. 301
acauaccuaaaagca

SEQ ID NO: 3901718 - RNA, 22 nt, Shigella flexneri 2a str. 301
acauaccuaaaagcacgccaga

SEQ ID NO: 3901719 - RNA, 23 nt, Shigella flexneri 2a str. 301
acauaccuaaaagcacgccagac

SEQ ID NO: 3901720 - RNA, 18 nt, Shigella flexneri 2a str. 301
acauacugagaaccuuua

SEQ ID NO: 3901721 - RNA, 21 nt, Shigella flexneri 2a str. 301
acauacuuaaauaaugcuucu

SEQ ID NO: 3901722 - RNA, 19 nt, Shigella flexneri 2a str. 301
acauagaaacucauaugca

SEQ ID NO: 3901723 - RNA, 18 nt, Shigella flexneri 2a str. 301
acauagaucuaaaugcca

SEQ ID NO: 3901724 - RNA, 14 nt, Shigella flexneri 2a str. 301
acauagccaucccu

SEQ ID NO: 3901725 - RNA, 16 nt, Shigella flexneri 2a str. 301
acauagcgugacacca

SEQ ID NO: 3901726 - RNA, 20 nt, Shigella flexneri 2a str. 301
acauagcguguugauuauaa

SEQ ID NO: 3901727 - RNA, 18 nt, Shigella flexneri 2a str. 301
acauaguagccagccaga

SEQ ID NO: 3901728 - RNA, 18 nt, Shigella flexneri 2a str. 301
acauaguagguccugacc

SEQ ID NO: 3901729 - RNA, 14 nt, Shigella flexneri 2a str. 301
acauauaucgaaaa

SEQ ID NO: 3901730 - RNA, 15 nt, Shigella flexneri 2a str. 301
acauaucacaauuga

SEQ ID NO: 3901731 - RNA, 18 nt, Shigella flexneri 2a str. 301
acauaucacaauugaugc

SEQ ID NO: 3901732 - RNA, 23 nt, Shigella flexneri 2a str. 301
acauaucaggcuccggaaauuug

SEQ ID NO: 3901733 - RNA, 16 nt, Shigella flexneri 2a str. 301
acauauccuucacaca

SEQ ID NO: 3901734 - RNA, 17 nt, Shigella flexneri 2a str. 301
acauauccuucacacau

SEQ ID NO: 3901735 - RNA, 12 nt, Shigella flexneri 2a str. 301
acauaugcacau

SEQ ID NO: 3901736 - RNA, 12 nt, Shigella flexneri 2a str. 301
acauauucacca

SEQ ID NO: 3901737 - RNA, 19 nt, Shigella flexneri 2a str. 301
acauauuuuuguugaaaua

SEQ ID NO: 3901738 - RNA, 15 nt, Shigella flexneri 2a str. 301
acaucaaccagaucg

SEQ ID NO: 3901739 - RNA, 14 nt, Shigella flexneri 2a str. 301
acaucaacccgccc

SEQ ID NO: 3901740 - RNA, 21 nt, Shigella flexneri 2a str. 301
acaucaauggaugcaaucaca

SEQ ID NO: 3901741 - RNA, 22 nt, Shigella flexneri 2a str. 301
acaucacaccugcucagcccgu

SEQ ID NO: 3901742 - RNA, 23 nt, Shigella flexneri 2a str. 301
acaucaccccgccgggcuuacca

SEQ ID NO: 3901743 - RNA, 22 nt, Shigella flexneri 2a str. 301
acaucaccgacguuugcgccca

SEQ ID NO: 3901744 - RNA, 21 nt, Shigella flexneri 2a str. 301
acaucaccguucagcuugcgu

SEQ ID NO: 3901745 - RNA, 14 nt, Shigella flexneri 2a str. 301
acaucacgcagcug

SEQ ID NO: 3901746 - RNA, 20 nt, Shigella flexneri 2a str. 301
acaucacuccauccagcaac

SEQ ID NO: 3901747 - RNA, 22 nt, Shigella flexneri 2a str. 301
acaucacuccauccagcaacaa

SEQ ID NO: 3901748 - RNA, 15 nt, Shigella flexneri 2a str. 301
acaucacuguuugac

SEQ ID NO: 3901749 - RNA, 21 nt, Shigella flexneri 2a str. 301
acaucagaggcgaaccgcugu

SEQ ID NO: 3901750 - RNA, 22 nt, Shigella flexneri 2a str. 301
acaucagauaaucgccauccug

SEQ ID NO: 3901751 - RNA, 19 nt, Shigella flexneri 2a str. 301
acaucagccagaugcaccg

SEQ ID NO: 3901752 - RNA, 16 nt, Shigella flexneri 2a str. 301
acaucaguuggaugcu

SEQ ID NO: 3901753 - RNA, 14 nt, Shigella flexneri 2a str. 301
acaucauacggguc

SEQ ID NO: 3901754 - RNA, 16 nt, Shigella flexneri 2a str. 301
acaucaucaaagccaa

SEQ ID NO: 3901755 - RNA, 11 nt, Shigella flexneri 2a str. 301
acaucaucaga

SEQ ID NO: 3901756 - RNA, 19 nt, Shigella flexneri 2a str. 301
acaucaucagaaaugccag

SEQ ID NO: 3901757 - RNA, 20 nt, Shigella flexneri 2a str. 301
acaucaucagaaaugccagu

SEQ ID NO: 3901758 - RNA, 16 nt, Shigella flexneri 2a str. 301
acaucauccagugccg

SEQ ID NO: 3901759 - RNA, 20 nt, Shigella flexneri 2a str. 301
acaucauccugacccagcaa

SEQ ID NO: 3901760 - RNA, 13 nt, Shigella flexneri 2a str. 301
acaucaucgcccc

SEQ ID NO: 3901761 - RNA, 15 nt, Shigella flexneri 2a str. 301
acaucaucugccacu

SEQ ID NO: 3901762 - RNA, 18 nt, Shigella flexneri 2a str. 301
acaucauuaguaccuucc

SEQ ID NO: 3901763 - RNA, 14 nt, Shigella flexneri 2a str. 301
acaucauucccgcc

SEQ ID NO: 3901764 - RNA, 18 nt, Shigella flexneri 2a str. 301
acauccacgccuuuuuuc

SEQ ID NO: 3901765 - RNA, 13 nt, Shigella flexneri 2a str. 301
acaucccagcaga

SEQ ID NO: 3901766 - RNA, 19 nt, Shigella flexneri 2a str. 301
accaacggcgagccagcgc

SEQ ID NO: 3901767 - RNA, 14 nt, Shigella flexneri 2a str. 301
accaacuccagcgg

SEQ ID NO: 3901768 - RNA, 18 nt, Shigella flexneri 2a str. 301
accaacugauccugacaa

SEQ ID NO: 3901769 - RNA, 17 nt, Shigella flexneri 2a str. 301
accaacuucagcaacaa

SEQ ID NO: 3901770 - RNA, 21 nt, Shigella flexneri 2a str. 301
accaacuucagcaacaaaaug

SEQ ID NO: 3901771 - RNA, 14 nt, Shigella flexneri 2a str. 301
accaagaccaaucc

SEQ ID NO: 3901772 - RNA, 19 nt, Shigella flexneri 2a str. 301
accaagaccaauccgccag

SEQ ID NO: 3901773 - RNA, 17 nt, Shigella flexneri 2a str. 301
accaauaacuacggcuc

SEQ ID NO: 3901774 - RNA, 13 nt, Shigella flexneri 2a str. 301
accaauaaucaau

SEQ ID NO: 3901775 - RNA, 12 nt, Shigella flexneri 2a str. 301
accaauaauccc

SEQ ID NO: 3901776 - RNA, 15 nt, Shigella flexneri 2a str. 301
accaauaaugaacgc

SEQ ID NO: 3901777 - RNA, 20 nt, Shigella flexneri 2a str. 301
accaauaaugaacgccaccc

SEQ ID NO: 3901778 - RNA, 18 nt, Shigella flexneri 2a str. 301
accaauaccaaugaccag

SEQ ID NO: 3901779 - RNA, 22 nt, Shigella flexneri 2a str. 301
accaauaccgcccaccaccagc

SEQ ID NO: 3901780 - RNA, 23 nt, Shigella flexneri 2a str. 301
accaauagcccaugcaucggcca

SEQ ID NO: 3901781 - RNA, 12 nt, Shigella flexneri 2a str. 301
accaaucaccac

SEQ ID NO: 3901782 - RNA, 15 nt, Shigella flexneri 2a str. 301
accaaucaccgccag

SEQ ID NO: 3901783 - RNA, 17 nt, Shigella flexneri 2a str. 301
accaaucagaaaggcgu

SEQ ID NO: 3901784 - RNA, 12 nt, Shigella flexneri 2a str. 301
accaauccgcca

SEQ ID NO: 3901785 - RNA, 18 nt, Shigella flexneri 2a str. 301
accaaucgcgggcaacgu

SEQ ID NO: 3901786 - RNA, 17 nt, Shigella flexneri 2a str. 301
accaaucggcagaacgg

SEQ ID NO: 3901787 - RNA, 21 nt, Shigella flexneri 2a str. 301
accaaugaaagccccaccagc

SEQ ID NO: 3901788 - RNA, 19 nt, Shigella flexneri 2a str. 301
accaaugauaaguuucacu

SEQ ID NO: 3901789 - RNA, 21 nt, Shigella flexneri 2a str. 301
accaaugauugggucauuucc

SEQ ID NO: 3901790 - RNA, 16 nt, Shigella flexneri 2a str. 301
accaaugccgcggcgc

SEQ ID NO: 3901791 - RNA, 13 nt, Shigella flexneri 2a str. 301
accaauggcaaua

SEQ ID NO: 3901792 - RNA, 13 nt, Shigella flexneri 2a str. 301
accaauggcuuuu

SEQ ID NO: 3901793 - RNA, 16 nt, Shigella flexneri 2a str. 301
accaauguaggccuga

SEQ ID NO: 3901794 - RNA, 23 nt, Shigella flexneri 2a str. 301
accaaugucgaaagccccagccc

SEQ ID NO: 3901795 - RNA, 23 nt, Shigella flexneri 2a str. 301
accaauguggguguuaagcgcag

SEQ ID NO: 3901796 - RNA, 22 nt, Shigella flexneri 2a str. 301
accaauguuacgaccuuccuga

SEQ ID NO: 3901797 - RNA, 21 nt, Shigella flexneri 2a str. 301
accaauucuccaaugccguuc

SEQ ID NO: 3901798 - RNA, 12 nt, Shigella flexneri 2a str. 301
accacaaaagcg

SEQ ID NO: 3901799 - RNA, 13 nt, Shigella flexneri 2a str. 301
accacaaccgccg

SEQ ID NO: 3901800 - RNA, 14 nt, Shigella flexneri 2a str. 301
accacaaccgccgu

SEQ ID NO: 3901801 - RNA, 16 nt, Shigella flexneri 2a str. 301
accacaaugaagaaag

SEQ ID NO: 3901802 - RNA, 14 nt, Shigella flexneri 2a str. 301
accacaaugcaaua

SEQ ID NO: 3901803 - RNA, 15 nt, Shigella flexneri 2a str. 301
accacaauugaccag

SEQ ID NO: 3901804 - RNA, 12 nt, Shigella flexneri 2a str. 301
accacaccaacc

SEQ ID NO: 3901805 - RNA, 16 nt, Shigella flexneri 2a str. 301
accacacccgcaagac

SEQ ID NO: 3901806 - RNA, 20 nt, Shigella flexneri 2a str. 301
accacacccgcaagacgaac

SEQ ID NO: 3901807 - RNA, 19 nt, Shigella flexneri 2a str. 301
accacaccggaccagacga

SEQ ID NO: 3901808 - RNA, 13 nt, Shigella flexneri 2a str. 301
accacaccgucag

SEQ ID NO: 3901809 - RNA, 21 nt, Shigella flexneri 2a str. 301
accacagaccggacugacucc

SEQ ID NO: 3901810 - RNA, 15 nt, Shigella flexneri 2a str. 301
accacagcaaaacac

SEQ ID NO: 3901811 - RNA, 16 nt, Shigella flexneri 2a str. 301
accacaguaacgccug

SEQ ID NO: 3901812 - RNA, 18 nt, Shigella flexneri 2a str. 301
accacagugacccgcagc

SEQ ID NO: 3901813 - RNA, 15 nt, Shigella flexneri 2a str. 301
accacaucaaucccu

SEQ ID NO: 3901814 - RNA, 22 nt, Shigella flexneri 2a str. 301
accacaugaucauucaccagcc

SEQ ID NO: 3901815 - RNA, 11 nt, Shigella flexneri 2a str. 301
accacaugauu

SEQ ID NO: 3901816 - RNA, 22 nt, Shigella flexneri 2a str. 301
accacauguuguacaugcugcu

SEQ ID NO: 3901817 - RNA, 23 nt, Shigella flexneri 2a str. 301
accacauguuguacaugcugcuu

SEQ ID NO: 3901818 - RNA, 17 nt, Shigella flexneri 2a str. 301
accaccaaaaacgccau

SEQ ID NO: 3901819 - RNA, 16 nt, Shigella flexneri 2a str. 301
accaccaaugucgaaa

SEQ ID NO: 3901820 - RNA, 14 nt, Shigella flexneri 2a str. 301
accaccagacgagc

SEQ ID NO: 3901821 - RNA, 12 nt, Shigella flexneri 2a str. 301
accaccagcaau

SEQ ID NO: 3901822 - RNA, 13 nt, Shigella flexneri 2a str. 301
accaccagcacac

SEQ ID NO: 3901823 - RNA, 14 nt, Shigella flexneri 2a str. 301
accaccagcacacu

SEQ ID NO: 3901824 - RNA, 12 nt, Shigella flexneri 2a str. 301
accaccagcacg

SEQ ID NO: 3901825 - RNA, 15 nt, Shigella flexneri 2a str. 301
accaccagcagcugc

SEQ ID NO: 3901826 - RNA, 18 nt, Shigella flexneri 2a str. 301
accaccagcggaauauca

SEQ ID NO: 3901827 - RNA, 23 nt, Shigella flexneri 2a str. 301
accaccagugccauuaacaggcc

SEQ ID NO: 3901828 - RNA, 14 nt, Shigella flexneri 2a str. 301
accacccaccagcg

SEQ ID NO: 3901829 - RNA, 15 nt, Shigella flexneri 2a str. 301
accacccaccgcagc

SEQ ID NO: 3901830 - RNA, 17 nt, Shigella flexneri 2a str. 301
accacccagcagcgccg

SEQ ID NO: 3901831 - RNA, 17 nt, Shigella flexneri 2a str. 301
accacccauuuuaaugu

SEQ ID NO: 3901832 - RNA, 23 nt, Shigella flexneri 2a str. 301
accacccgcagcgaucugcaccu

SEQ ID NO: 3901833 - RNA, 15 nt, Shigella flexneri 2a str. 301
accacccgcagugau

SEQ ID NO: 3901834 - RNA, 21 nt, Shigella flexneri 2a str. 301
accaccgacgugguuaacgac

SEQ ID NO: 3901835 - RNA, 19 nt, Shigella flexneri 2a str. 301
accaccgauauugccaccu

SEQ ID NO: 3901836 - RNA, 21 nt, Shigella flexneri 2a str. 301
accaccgaugaucaacagcau

SEQ ID NO: 3901837 - RNA, 16 nt, Shigella flexneri 2a str. 301
accaccgcaaucgcca

SEQ ID NO: 3901838 - RNA, 17 nt, Shigella flexneri 2a str. 301
accaccgcaaucgccag

SEQ ID NO: 3901839 - RNA, 18 nt, Shigella flexneri 2a str. 301
accaccgcaaucgccagu

SEQ ID NO: 3901840 - RNA, 16 nt, Shigella flexneri 2a str. 301
accaccgcaguaaucg

SEQ ID NO: 3901841 - RNA, 17 nt, Shigella flexneri 2a str. 301
accaccggacgcacacg

SEQ ID NO: 3901842 - RNA, 18 nt, Shigella flexneri 2a str. 301
accaccgucccaguaauu

SEQ ID NO: 3901843 - RNA, 23 nt, Shigella flexneri 2a str. 301
accaccguuuuuucugccucugc

SEQ ID NO: 3901844 - RNA, 19 nt, Shigella flexneri 2a str. 301
accaccugauugcugcugc

SEQ ID NO: 3901845 - RNA, 20 nt, Shigella flexneri 2a str. 301
accaccuuacuuacacauca

SEQ ID NO: 3901846 - RNA, 14 nt, Shigella flexneri 2a str. 301
accacgaaaacagc

SEQ ID NO: 3901847 - RNA, 14 nt, Shigella flexneri 2a str. 301
accacgacuucugu

SEQ ID NO: 3901848 - RNA, 14 nt, Shigella flexneri 2a str. 301
accacgcagcagcc

SEQ ID NO: 3901849 - RNA, 17 nt, Shigella flexneri 2a str. 301
accacgcagcguuggca

SEQ ID NO: 3901850 - RNA, 17 nt, Shigella flexneri 2a str. 301
accacgccaagaaacac

SEQ ID NO: 3901851 - RNA, 16 nt, Shigella flexneri 2a str. 301
accacgccgauaauca

SEQ ID NO: 3901852 - RNA, 24 nt, Shigella flexneri 2a str. 301
accacgccgauaaucaacgcgccg

SEQ ID NO: 3901853 - RNA, 18 nt, Shigella flexneri 2a str. 301
accacgcuccaucauguc

SEQ ID NO: 3901854 - RNA, 14 nt, Shigella flexneri 2a str. 301
accacggaguugac

SEQ ID NO: 3901855 - RNA, 16 nt, Shigella flexneri 2a str. 301
accacggcagcaacuu

SEQ ID NO: 3901856 - RNA, 18 nt, Shigella flexneri 2a str. 301
accacggccaaaucgcca

SEQ ID NO: 3901857 - RNA, 16 nt, Shigella flexneri 2a str. 301
accacggccuuccucg

SEQ ID NO: 3901858 - RNA, 15 nt, Shigella flexneri 2a str. 301
accacguaccacggc

SEQ ID NO: 3901859 - RNA, 18 nt, Shigella flexneri 2a str. 301
accacguaccacggcauu

SEQ ID NO: 3901860 - RNA, 15 nt, Shigella flexneri 2a str. 301
accacguucauuuca

SEQ ID NO: 3901861 - RNA, 16 nt, Shigella flexneri 2a str. 301
accacguucauuucau

SEQ ID NO: 3901862 - RNA, 14 nt, Shigella flexneri 2a str. 301
accacguugacaaa

SEQ ID NO: 3901863 - RNA, 13 nt, Shigella flexneri 2a str. 301
accacguuuuuca

SEQ ID NO: 3901864 - RNA, 20 nt, Shigella flexneri 2a str. 301
accacguuuuucaauucacg

SEQ ID NO: 3901865 - RNA, 15 nt, Shigella flexneri 2a str. 301
accacuacaucaagu

SEQ ID NO: 3901866 - RNA, 17 nt, Shigella flexneri 2a str. 301
accacuauuauggcgca

SEQ ID NO: 3901867 - RNA, 17 nt, Shigella flexneri 2a str. 301
accaguccuacacacgc

SEQ ID NO: 3901868 - RNA, 20 nt, Shigella flexneri 2a str. 301
accaguccuacacacgccag

SEQ ID NO: 3901869 - RNA, 17 nt, Shigella flexneri 2a str. 301
accaguccugugacuca

SEQ ID NO: 3901870 - RNA, 23 nt, Shigella flexneri 2a str. 301
accaguuacguuuaugccacugu

SEQ ID NO: 3901871 - RNA, 15 nt, Shigella flexneri 2a str. 301
accaguucacaccag

SEQ ID NO: 3901872 - RNA, 21 nt, Shigella flexneri 2a str. 301
accaguugguagguccagccg

SEQ ID NO: 3901873 - RNA, 22 nt, Shigella flexneri 2a str. 301
accaguugguagguccagccgc

SEQ ID NO: 3901874 - RNA, 22 nt, Shigella flexneri 2a str. 301
accaguuuuuacgcccgugaug

SEQ ID NO: 3901875 - RNA, 22 nt, Shigella flexneri 2a str. 301
accauaaaacgcgcuacugaau

SEQ ID NO: 3901876 - RNA, 18 nt, Shigella flexneri 2a str. 301
accauaaauauggugaaa

SEQ ID NO: 3901877 - RNA, 22 nt, Shigella flexneri 2a str. 301
accauaaauauggugaaaguaa

SEQ ID NO: 3901878 - RNA, 14 nt, Shigella flexneri 2a str. 301
accauaaaucagau

SEQ ID NO: 3901879 - RNA, 19 nt, Shigella flexneri 2a str. 301
accauaaauccaacaacac

SEQ ID NO: 3901880 - RNA, 14 nt, Shigella flexneri 2a str. 301
accauaaauuucac

SEQ ID NO: 3901881 - RNA, 22 nt, Shigella flexneri 2a str. 301
accauaaauuucacgucacgcu

SEQ ID NO: 3901882 - RNA, 21 nt, Shigella flexneri 2a str. 301
accauacugcuuaaaccauuc

SEQ ID NO: 3901883 - RNA, 23 nt, Shigella flexneri 2a str. 301
accauaguauuuauccauaauuu

SEQ ID NO: 3901884 - RNA, 19 nt, Shigella flexneri 2a str. 301
accauauagcgcacaugca

SEQ ID NO: 3901885 - RNA, 16 nt, Shigella flexneri 2a str. 301
accauauucagcagca

SEQ ID NO: 3901886 - RNA, 17 nt, Shigella flexneri 2a str. 301
accauauucagcagcag

SEQ ID NO: 3901887 - RNA, 19 nt, Shigella flexneri 2a str. 301
accauauuuaugcagugca

SEQ ID NO: 3901888 - RNA, 21 nt, Shigella flexneri 2a str. 301
accaucaaguagcagguaauc

SEQ ID NO: 3901889 - RNA, 15 nt, Shigella flexneri 2a str. 301
accaucaauggauga

SEQ ID NO: 3901890 - RNA, 16 nt, Shigella flexneri 2a str. 301
accaucaccaucgccc

SEQ ID NO: 3901891 - RNA, 15 nt, Shigella flexneri 2a str. 301
accaucaccucuuca

SEQ ID NO: 3901892 - RNA, 13 nt, Shigella flexneri 2a str. 301
accaucagcagca

SEQ ID NO: 3901893 - RNA, 17 nt, Shigella flexneri 2a str. 301
accaucagcugccaggg

SEQ ID NO: 3901894 - RNA, 18 nt, Shigella flexneri 2a str. 301
accaucaggaugacaaac

SEQ ID NO: 3901895 - RNA, 14 nt, Shigella flexneri 2a str. 301
accaucauauuuuc

SEQ ID NO: 3901896 - RNA, 14 nt, Shigella flexneri 2a str. 301
accaucauggaagc

SEQ ID NO: 3901897 - RNA, 14 nt, Shigella flexneri 2a str. 301
accaucccgccgau

SEQ ID NO: 3901898 - RNA, 22 nt, Shigella flexneri 2a str. 301
accaucgagaaucagcgagaca

SEQ ID NO: 3901899 - RNA, 23 nt, Shigella flexneri 2a str. 301
accaucgagaaucagcgagacaa

SEQ ID NO: 3901900 - RNA, 18 nt, Shigella flexneri 2a str. 301
accaucgcaaacaguaca

SEQ ID NO: 3901901 - RNA, 23 nt, Shigella flexneri 2a str. 301
accaucgccauuuaacgcaucac

SEQ ID NO: 3901902 - RNA, 18 nt, Shigella flexneri 2a str. 301
accaucgccccacccaag

SEQ ID NO: 3901903 - RNA, 17 nt, Shigella flexneri 2a str. 301
accaucggcaccaccaa

SEQ ID NO: 3901904 - RNA, 21 nt, Shigella flexneri 2a str. 301
accaucggcaccaccaaaaac

SEQ ID NO: 3901905 - RNA, 19 nt, Shigella flexneri 2a str. 301
accaucgguuguuuucaga

SEQ ID NO: 3901906 - RNA, 18 nt, Shigella flexneri 2a str. 301
accaucguacaggcacau

SEQ ID NO: 3901907 - RNA, 20 nt, Shigella flexneri 2a str. 301
accaucguacaggcacaugu

SEQ ID NO: 3901908 - RNA, 14 nt, Shigella flexneri 2a str. 301
accaucguccagca

SEQ ID NO: 3901909 - RNA, 20 nt, Shigella flexneri 2a str. 301
accaucguccagcagcaaug

SEQ ID NO: 3901910 - RNA, 22 nt, Shigella flexneri 2a str. 301
accaucguugcuaacggccacg

SEQ ID NO: 3901911 - RNA, 20 nt, Shigella flexneri 2a str. 301
accaucuuccaguugcacgc

SEQ ID NO: 3901912 - RNA, 13 nt, Shigella flexneri 2a str. 301
accaucuuugcug

SEQ ID NO: 3901913 - RNA, 13 nt, Shigella flexneri 2a str. 301
accaugacgccga

SEQ ID NO: 3901914 - RNA, 23 nt, Shigella flexneri 2a str. 301
accaugcaauuaccgccaccagg

SEQ ID NO: 3901915 - RNA, 15 nt, Shigella flexneri 2a str. 301
accaugcgcaucauc

SEQ ID NO: 3901916 - RNA, 13 nt, Shigella flexneri 2a str. 301
accaugucaucaa

SEQ ID NO: 3901917 - RNA, 14 nt, Shigella flexneri 2a str. 301
accaugucaucaau

SEQ ID NO: 3901918 - RNA, 15 nt, Shigella flexneri 2a str. 301
accauguucacugcc

SEQ ID NO: 3901919 - RNA, 22 nt, Shigella flexneri 2a str. 301
accauguugcgcagaguuucca

SEQ ID NO: 3901920 - RNA, 19 nt, Shigella flexneri 2a str. 301
accauuaaucgauaaacca

SEQ ID NO: 3901921 - RNA, 21 nt, Shigella flexneri 2a str. 301
accauuagacaguuugccuuc

SEQ ID NO: 3901922 - RNA, 14 nt, Shigella flexneri 2a str. 301
accauuauuaaauu

SEQ ID NO: 3901923 - RNA, 16 nt, Shigella flexneri 2a str. 301
accauugaagcaaucc

SEQ ID NO: 3901924 - RNA, 22 nt, Shigella flexneri 2a str. 301
accauugaggauugcgccuuua

SEQ ID NO: 3901925 - RNA, 23 nt, Shigella flexneri 2a str. 301
accauugcaucgaggaaaaccag

SEQ ID NO: 3901926 - RNA, 20 nt, Shigella flexneri 2a str. 301
accauugcugccgccaguuc

SEQ ID NO: 3901927 - RNA, 20 nt, Shigella flexneri 2a str. 301
accauuggcauugguaucgg

SEQ ID NO: 3901928 - RNA, 18 nt, Shigella flexneri 2a str. 301
accauuggucuuugugcc

SEQ ID NO: 3901929 - RNA, 14 nt, Shigella flexneri 2a str. 301
accauuucugcgag

SEQ ID NO: 3901930 - RNA, 16 nt, Shigella flexneri 2a str. 301
accauuugugcuggca

SEQ ID NO: 3901931 - RNA, 13 nt, Shigella flexneri 2a str. 301
acccaacaugccg

SEQ ID NO: 3901932 - RNA, 14 nt, Shigella flexneri 2a str. 301
acccaaccggcaau

SEQ ID NO: 3901933 - RNA, 17 nt, Shigella flexneri 2a str. 301
acccaacgcaaagagag

SEQ ID NO: 3901934 - RNA, 21 nt, Shigella flexneri 2a str. 301
acccaacgcaaagagagaagc

SEQ ID NO: 3901935 - RNA, 22 nt, Shigella flexneri 2a str. 301
acccaacgccacucucgccccu

SEQ ID NO: 3901936 - RNA, 17 nt, Shigella flexneri 2a str. 301
acccaacucucgucggu

SEQ ID NO: 3901937 - RNA, 14 nt, Shigella flexneri 2a str. 301
acccaaucccccac

SEQ ID NO: 3901938 - RNA, 20 nt, Shigella flexneri 2a str. 301
acccaaucccccacuuuuaa

SEQ ID NO: 3901939 - RNA, 21 nt, Shigella flexneri 2a str. 301
acccaaugaccacuccggcau

SEQ ID NO: 3901940 - RNA, 17 nt, Shigella flexneri 2a str. 301
acccaaugugaccucuu

SEQ ID NO: 3901941 - RNA, 12 nt, Shigella flexneri 2a str. 301
acccacaccccc

SEQ ID NO: 3901942 - RNA, 14 nt, Shigella flexneri 2a str. 301
acccacacuucaau

SEQ ID NO: 3901943 - RNA, 17 nt, Shigella flexneri 2a str. 301
acccacaucagcggcac

SEQ ID NO: 3901944 - RNA, 16 nt, Shigella flexneri 2a str. 301
acccacauguugcgcu

SEQ ID NO: 3901945 - RNA, 22 nt, Shigella flexneri 2a str. 301
acccaccgggcagacgugacca

SEQ ID NO: 3901946 - RNA, 21 nt, Shigella flexneri 2a str. 301
acccaccgguccuaacaacca

SEQ ID NO: 3901947 - RNA, 20 nt, Shigella flexneri 2a str. 301
acccacgguacucaucacgu

SEQ ID NO: 3901948 - RNA, 19 nt, Shigella flexneri 2a str. 301
acccagaaucucuuuuguu

SEQ ID NO: 3901949 - RNA, 16 nt, Shigella flexneri 2a str. 301
acccagacaaaauuca

SEQ ID NO: 3901950 - RNA, 13 nt, Shigella flexneri 2a str. 301
acccagcaaggcg

SEQ ID NO: 3901951 - RNA, 16 nt, Shigella flexneri 2a str. 301
acccagcaauccugca

SEQ ID NO: 3901952 - RNA, 18 nt, Shigella flexneri 2a str. 301
acccagcaccaguaccau

SEQ ID NO: 3901953 - RNA, 15 nt, Shigella flexneri 2a str. 301
acccagcaccgcaga

SEQ ID NO: 3901954 - RNA, 11 nt, Shigella flexneri 2a str. 301
acccagcagca

SEQ ID NO: 3901955 - RNA, 21 nt, Shigella flexneri 2a str. 301
acccagcagguccccgagcac

SEQ ID NO: 3901956 - RNA, 23 nt, Shigella flexneri 2a str. 301
acccagcagguccccgagcacau

SEQ ID NO: 3901957 - RNA, 16 nt, Shigella flexneri 2a str. 301
acccagccagacgcca

SEQ ID NO: 3901958 - RNA, 22 nt, Shigella flexneri 2a str. 301
acccaggcccgcgugccggaag

SEQ ID NO: 3901959 - RNA, 23 nt, Shigella flexneri 2a str. 301
acccaguuucggcaucagcagaa

SEQ ID NO: 3901960 - RNA, 15 nt, Shigella flexneri 2a str. 301
acccauccagcagag

SEQ ID NO: 3901961 - RNA, 24 nt, Shigella flexneri 2a str. 301
acccaugacuuugaucugaccgaa

SEQ ID NO: 3901962 - RNA, 21 nt, Shigella flexneri 2a str. 301
acccaugugauuuaaaucaaa

SEQ ID NO: 3901963 - RNA, 18 nt, Shigella flexneri 2a str. 301
acccauguugaucgccac

SEQ ID NO: 3901964 - RNA, 16 nt, Shigella flexneri 2a str. 301
accccaaaaaguugga

SEQ ID NO: 3901965 - RNA, 21 nt, Shigella flexneri 2a str. 301
accccaacugggugcacuuac

SEQ ID NO: 3901966 - RNA, 15 nt, Shigella flexneri 2a str. 301
accccaauguagccg

SEQ ID NO: 3901967 - RNA, 21 nt, Shigella flexneri 2a str. 301
accccaauuaauugccagccg

SEQ ID NO: 3901968 - RNA, 15 nt, Shigella flexneri 2a str. 301
accccacagccccga

SEQ ID NO: 3901969 - RNA, 14 nt, Shigella flexneri 2a str. 301
accccaccagcaug

SEQ ID NO: 3901970 - RNA, 21 nt, Shigella flexneri 2a str. 301
accccacgcucucgcagcuca

SEQ ID NO: 3901971 - RNA, 14 nt, Shigella flexneri 2a str. 301
accccacgucaucu

SEQ ID NO: 3901972 - RNA, 20 nt, Shigella flexneri 2a str. 301
accccagaccaaucccgcca

SEQ ID NO: 3901973 - RNA, 22 nt, Shigella flexneri 2a str. 301
accccagcgcaagggccgcagc

SEQ ID NO: 3901974 - RNA, 20 nt, Shigella flexneri 2a str. 301
accccaggccgcguaccgca

SEQ ID NO: 3901975 - RNA, 15 nt, Shigella flexneri 2a str. 301
accccauugaagaau

SEQ ID NO: 3901976 - RNA, 17 nt, Shigella flexneri 2a str. 301
acccccaccccggcccu

SEQ ID NO: 3901977 - RNA, 13 nt, Shigella flexneri 2a str. 301
acccccagacgac

SEQ ID NO: 3901978 - RNA, 15 nt, Shigella flexneri 2a str. 301
acccccgaacgggua

SEQ ID NO: 3901979 - RNA, 14 nt, Shigella flexneri 2a str. 301
acccccuccuuuua

SEQ ID NO: 3901980 - RNA, 22 nt, Shigella flexneri 2a str. 301
accccgagcuuaugcaauagcg

SEQ ID NO: 3901981 - RNA, 14 nt, Shigella flexneri 2a str. 301
accccgauggcuug

SEQ ID NO: 3901982 - RNA, 21 nt, Shigella flexneri 2a str. 301
accccgcaauuucauuauuca

SEQ ID NO: 3901983 - RNA, 21 nt, Shigella flexneri 2a str. 301
accccgccagcagaaugacau

SEQ ID NO: 3901984 - RNA, 17 nt, Shigella flexneri 2a str. 301
accccgccgggcuuacc

SEQ ID NO: 3901985 - RNA, 18 nt, Shigella flexneri 2a str. 301
accccgcuugcuguuccu

SEQ ID NO: 3901986 - RNA, 17 nt, Shigella flexneri 2a str. 301
accccggcccucucccu

SEQ ID NO: 3901987 - RNA, 22 nt, Shigella flexneri 2a str. 301
accccggcggccggaugacaga

SEQ ID NO: 3901988 - RNA, 14 nt, Shigella flexneri 2a str. 301
accccgucaccacu

SEQ ID NO: 3901989 - RNA, 19 nt, Shigella flexneri 2a str. 301
accccgucaccacuucacc

SEQ ID NO: 3901990 - RNA, 16 nt, Shigella flexneri 2a str. 301
accccugcggccgguu

SEQ ID NO: 3901991 - RNA, 16 nt, Shigella flexneri 2a str. 301
acccgacgugcagcau

SEQ ID NO: 3901992 - RNA, 22 nt, Shigella flexneri 2a str. 301
acccgaucgccaucaugcacac

SEQ ID NO: 3901993 - RNA, 17 nt, Shigella flexneri 2a str. 301
acccgauggcgugcccg

SEQ ID NO: 3901994 - RNA, 18 nt, Shigella flexneri 2a str. 301
acccgcaacaaugccgau

SEQ ID NO: 3901995 - RNA, 14 nt, Shigella flexneri 2a str. 301
acccgcacagucac

SEQ ID NO: 3901996 - RNA, 21 nt, Shigella flexneri 2a str. 301
acccgcacggccgcaagcaga

SEQ ID NO: 3901997 - RNA, 21 nt, Shigella flexneri 2a str. 301
acccgcaggcgcaauggcgca

SEQ ID NO: 3901998 - RNA, 21 nt, Shigella flexneri 2a str. 301
acccgcagugauugccgcaac

SEQ ID NO: 3901999 - RNA, 13 nt, Shigella flexneri 2a str. 301
acccgccagacca

SEQ ID NO: 3902000 - RNA, 22 nt, Shigella flexneri 2a str. 301
acccgcccaccauguucacugc

SEQ ID NO: 3902001 - RNA, 15 nt, Shigella flexneri 2a str. 301
acccgcgaccaccag

SEQ ID NO: 3902002 - RNA, 18 nt, Shigella flexneri 2a str. 301
acccgcgaggcgcauaag

SEQ ID NO: 3902003 - RNA, 15 nt, Shigella flexneri 2a str. 301
acccgcgaucgccug

SEQ ID NO: 3902004 - RNA, 23 nt, Shigella flexneri 2a str. 301
acccgcgugguuuuugugccggg

SEQ ID NO: 3902005 - RNA, 17 nt, Shigella flexneri 2a str. 301
acccgcucaaacaccgu

SEQ ID NO: 3902006 - RNA, 16 nt, Shigella flexneri 2a str. 301
acccgcucauaauaca

SEQ ID NO: 3902007 - RNA, 20 nt, Shigella flexneri 2a str. 301
acccgcucgccauaucuucu

SEQ ID NO: 3902008 - RNA, 20 nt, Shigella flexneri 2a str. 301
acccgcuguaaaugcugcuc

SEQ ID NO: 3902009 - RNA, 18 nt, Shigella flexneri 2a str. 301
acccggaggaaagcaccu

SEQ ID NO: 3902010 - RNA, 16 nt, Shigella flexneri 2a str. 301
acccggccugcucccg

SEQ ID NO: 3902011 - RNA, 21 nt, Shigella flexneri 2a str. 301
acccguagcuguucaggagaa

SEQ ID NO: 3902012 - RNA, 19 nt, Shigella flexneri 2a str. 301
acccgugcuguuaauaucu

SEQ ID NO: 3902013 - RNA, 23 nt, Shigella flexneri 2a str. 301
acccguuaagcguucauccaaca

SEQ ID NO: 3902014 - RNA, 22 nt, Shigella flexneri 2a str. 301
acccguugguuugauagcaaua

SEQ ID NO: 3902015 - RNA, 13 nt, Shigella flexneri 2a str. 301
acccuaaagcacc

SEQ ID NO: 3902016 - RNA, 17 nt, Shigella flexneri 2a str. 301
acccuaaauccgccauc

SEQ ID NO: 3902017 - RNA, 14 nt, Shigella flexneri 2a str. 301
acccuaacaucauc

SEQ ID NO: 3902018 - RNA, 15 nt, Shigella flexneri 2a str. 301
acccuaacccucucc

SEQ ID NO: 3902019 - RNA, 13 nt, Shigella flexneri 2a str. 301
acccuauccccaa

SEQ ID NO: 3902020 - RNA, 14 nt, Shigella flexneri 2a str. 301
acccucaacaacag

SEQ ID NO: 3902021 - RNA, 13 nt, Shigella flexneri 2a str. 301
acccucacgcauu

SEQ ID NO: 3902022 - RNA, 23 nt, Shigella flexneri 2a str. 301
acccucgaccaucuccuuacugc

SEQ ID NO: 3902023 - RNA, 19 nt, Shigella flexneri 2a str. 301
acccucuccccagaagggc

SEQ ID NO: 3902024 - RNA, 21 nt, Shigella flexneri 2a str. 301
acccugaguuuucaguaccgc

SEQ ID NO: 3902025 - RNA, 14 nt, Shigella flexneri 2a str. 301
acccugaucaauca

SEQ ID NO: 3902026 - RNA, 16 nt, Shigella flexneri 2a str. 301
acccugaucaaucacu

SEQ ID NO: 3902027 - RNA, 12 nt, Shigella flexneri 2a str. 301
acccugcggcug

SEQ ID NO: 3902028 - RNA, 15 nt, Shigella flexneri 2a str. 301
acccugcggcugcug

SEQ ID NO: 3902029 - RNA, 16 nt, Shigella flexneri 2a str. 301
acccugcucgcuggaa

SEQ ID NO: 3902030 - RNA, 14 nt, Shigella flexneri 2a str. 301
acccuguccgccau

SEQ ID NO: 3902031 - RNA, 21 nt, Shigella flexneri 2a str. 301
acccuguccgccauggcuucu

SEQ ID NO: 3902032 - RNA, 22 nt, Shigella flexneri 2a str. 301
acccuucaaucccgccaaugca

SEQ ID NO: 3902033 - RNA, 14 nt, Shigella flexneri 2a str. 301
acccuuccagcacg

SEQ ID NO: 3902034 - RNA, 12 nt, Shigella flexneri 2a str. 301
acccuucuucca

SEQ ID NO: 3902035 - RNA, 13 nt, Shigella flexneri 2a str. 301
acccuuuauuuuc

SEQ ID NO: 3902036 - RNA, 13 nt, Shigella flexneri 2a str. 301
acccuuuuuuaaa

SEQ ID NO: 3902037 - RNA, 22 nt, Shigella flexneri 2a str. 301
accgaaauggcugccaaugaua

SEQ ID NO: 3902038 - RNA, 16 nt, Shigella flexneri 2a str. 301
accgaaccuguuuuca

SEQ ID NO: 3902039 - RNA, 15 nt, Shigella flexneri 2a str. 301
accgaacggagucgg

SEQ ID NO: 3902040 - RNA, 23 nt, Shigella flexneri 2a str. 301
accgaaguggacgaacaguucaa

SEQ ID NO: 3902041 - RNA, 12 nt, Shigella flexneri 2a str. 301
accgaaguugua

SEQ ID NO: 3902042 - RNA, 16 nt, Shigella flexneri 2a str. 301
accgaauucaaauccu

SEQ ID NO: 3902043 - RNA, 17 nt, Shigella flexneri 2a str. 301
accgacaauauugaugc

SEQ ID NO: 3902044 - RNA, 22 nt, Shigella flexneri 2a str. 301
accgacaauccgguagguucaa

SEQ ID NO: 3902045 - RNA, 14 nt, Shigella flexneri 2a str. 301
accgacgauuaaac

SEQ ID NO: 3902046 - RNA, 21 nt, Shigella flexneri 2a str. 301
accgacuccgacgcagugggu

SEQ ID NO: 3902047 - RNA, 19 nt, Shigella flexneri 2a str. 301
accgacugcggccugaguu

SEQ ID NO: 3902048 - RNA, 21 nt, Shigella flexneri 2a str. 301
accgacuggcuccgggaaaac

SEQ ID NO: 3902049 - RNA, 15 nt, Shigella flexneri 2a str. 301
accgagaagcagcaa

SEQ ID NO: 3902050 - RNA, 13 nt, Shigella flexneri 2a str. 301
accgagauaacgu

SEQ ID NO: 3902051 - RNA, 17 nt, Shigella flexneri 2a str. 301
accgagauaaugguuuc

SEQ ID NO: 3902052 - RNA, 22 nt, Shigella flexneri 2a str. 301
accgaggcauucagccaguucu

SEQ ID NO: 3902053 - RNA, 23 nt, Shigella flexneri 2a str. 301
accgaggccaaaaccacagugac

SEQ ID NO: 3902054 - RNA, 22 nt, Shigella flexneri 2a str. 301
accgaggcucaacaccguuacc

SEQ ID NO: 3902055 - RNA, 14 nt, Shigella flexneri 2a str. 301
accgauauccgcca

SEQ ID NO: 3902056 - RNA, 17 nt, Shigella flexneri 2a str. 301
accgauauucgccgcga

SEQ ID NO: 3902057 - RNA, 15 nt, Shigella flexneri 2a str. 301
accgauauugccacc

SEQ ID NO: 3902058 - RNA, 13 nt, Shigella flexneri 2a str. 301
accgaucaucacg

SEQ ID NO: 3902059 - RNA, 21 nt, Shigella flexneri 2a str. 301
accgauccccggauucaugcu

SEQ ID NO: 3902060 - RNA, 19 nt, Shigella flexneri 2a str. 301
accgauccggcaccaaugu

SEQ ID NO: 3902061 - RNA, 20 nt, Shigella flexneri 2a str. 301
accgauccugaaguggcguu

SEQ ID NO: 3902062 - RNA, 21 nt, Shigella flexneri 2a str. 301
accgaugaucaacagcaucau

SEQ ID NO: 3902063 - RNA, 23 nt, Shigella flexneri 2a str. 301
accgaugaucgccaucagugcca

SEQ ID NO: 3902064 - RNA, 12 nt, Shigella flexneri 2a str. 301
accgauucccag

SEQ ID NO: 3902065 - RNA, 15 nt, Shigella flexneri 2a str. 301
accgauuucacccac

SEQ ID NO: 3902066 - RNA, 13 nt, Shigella flexneri 2a str. 301
accggauuuucac

SEQ ID NO: 3902067 - RNA, 14 nt, Shigella flexneri 2a str. 301
accggauuuucacc

SEQ ID NO: 3902068 - RNA, 18 nt, Shigella flexneri 2a str. 301
accggauuuucaccaucg

SEQ ID NO: 3902069 - RNA, 17 nt, Shigella flexneri 2a str. 301
accggauuuuuuuuccg

SEQ ID NO: 3902070 - RNA, 16 nt, Shigella flexneri 2a str. 301
accggcaaacuucguc

SEQ ID NO: 3902071 - RNA, 16 nt, Shigella flexneri 2a str. 301
accggcaaagaaccaa

SEQ ID NO: 3902072 - RNA, 16 nt, Shigella flexneri 2a str. 301
accggcaaccagcacc

SEQ ID NO: 3902073 - RNA, 16 nt, Shigella flexneri 2a str. 301
accggcaauaauuaac

SEQ ID NO: 3902074 - RNA, 14 nt, Shigella flexneri 2a str. 301
accggcaaucugcu

SEQ ID NO: 3902075 - RNA, 20 nt, Shigella flexneri 2a str. 301
accggccguaagaaagucau

SEQ ID NO: 3902076 - RNA, 19 nt, Shigella flexneri 2a str. 301
accggcuuucgcuucaacc

SEQ ID NO: 3902077 - RNA, 15 nt, Shigella flexneri 2a str. 301
accgggcgaauuuac

SEQ ID NO: 3902078 - RNA, 14 nt, Shigella flexneri 2a str. 301
accgggcuguucac

SEQ ID NO: 3902079 - RNA, 16 nt, Shigella flexneri 2a str. 301
accggggacaggcggc

SEQ ID NO: 3902080 - RNA, 17 nt, Shigella flexneri 2a str. 301
accggggacaggcgggc

SEQ ID NO: 3902081 - RNA, 19 nt, Shigella flexneri 2a str. 301
accgggugguaauaccacc

SEQ ID NO: 3902082 - RNA, 17 nt, Shigella flexneri 2a str. 301
accggguuuucaaugau

SEQ ID NO: 3902083 - RNA, 21 nt, Shigella flexneri 2a str. 301
accggguuuucaaugauaaag

SEQ ID NO: 3902084 - RNA, 17 nt, Shigella flexneri 2a str. 301
accgguaacgauuucau

SEQ ID NO: 3902085 - RNA, 17 nt, Shigella flexneri 2a str. 301
accgguacaaacaucau

SEQ ID NO: 3902086 - RNA, 21 nt, Shigella flexneri 2a str. 301
accgguaugaauuugcagcca

SEQ ID NO: 3902087 - RNA, 20 nt, Shigella flexneri 2a str. 301
accgguucggacauguuuuc

SEQ ID NO: 3902088 - RNA, 22 nt, Shigella flexneri 2a str. 301
accgguucggggcuguuuucca

SEQ ID NO: 3902089 - RNA, 23 nt, Shigella flexneri 2a str. 301
accgguucggggcuguuuuccag

SEQ ID NO: 3902090 - RNA, 14 nt, Shigella flexneri 2a str. 301
accgguucgugcca

SEQ ID NO: 3902091 - RNA, 14 nt, Shigella flexneri 2a str. 301
accgguugcuggau

SEQ ID NO: 3902092 - RNA, 13 nt, Shigella flexneri 2a str. 301
accguaaacagau

SEQ ID NO: 3902093 - RNA, 23 nt, Shigella flexneri 2a str. 301
accguaaguaagauaaaagcaau

SEQ ID NO: 3902094 - RNA, 14 nt, Shigella flexneri 2a str. 301
accguaccaaaaug

SEQ ID NO: 3902095 - RNA, 14 nt, Shigella flexneri 2a str. 301
accguaccggcacc

SEQ ID NO: 3902096 - RNA, 12 nt, Shigella flexneri 2a str. 301
accguacgcauc

SEQ ID NO: 3902097 - RNA, 15 nt, Shigella flexneri 2a str. 301
accguagacuuuagc

SEQ ID NO: 3902098 - RNA, 12 nt, Shigella flexneri 2a str. 301
accguaggccgu

SEQ ID NO: 3902099 - RNA, 21 nt, Shigella flexneri 2a str. 301
accguaggccguauccggcau

SEQ ID NO: 3902100 - RNA, 21 nt, Shigella flexneri 2a str. 301
accguaguccauacccagcau

SEQ ID NO: 3902101 - RNA, 23 nt, Shigella flexneri 2a str. 301
accguaguccauacccagcauca

SEQ ID NO: 3902102 - RNA, 22 nt, Shigella flexneri 2a str. 301
accguaucccccagagcaaagu

SEQ ID NO: 3902103 - RNA, 16 nt, Shigella flexneri 2a str. 301
accguaucuaccacug

SEQ ID NO: 3902104 - RNA, 18 nt, Shigella flexneri 2a str. 301
accguauuuugguaauga

SEQ ID NO: 3902105 - RNA, 17 nt, Shigella flexneri 2a str. 301
accgucaaaaaaacggc

SEQ ID NO: 3902106 - RNA, 14 nt, Shigella flexneri 2a str. 301
accgucacuucuuc

SEQ ID NO: 3902107 - RNA, 18 nt, Shigella flexneri 2a str. 301
accgucaucuuccaccug

SEQ ID NO: 3902108 - RNA, 16 nt, Shigella flexneri 2a str. 301
accguccggcgggcaa

SEQ ID NO: 3902109 - RNA, 14 nt, Shigella flexneri 2a str. 301
accgucgccuucau

SEQ ID NO: 3902110 - RNA, 17 nt, Shigella flexneri 2a str. 301
accgucguuacugucgc

SEQ ID NO: 3902111 - RNA, 16 nt, Shigella flexneri 2a str. 301
accgucugcgccgagg

SEQ ID NO: 3902112 - RNA, 12 nt, Shigella flexneri 2a str. 301
accgucuguaac

SEQ ID NO: 3902113 - RNA, 16 nt, Shigella flexneri 2a str. 301
accgucuucccgcagc

SEQ ID NO: 3902114 - RNA, 19 nt, Shigella flexneri 2a str. 301
accgucuucccgcagccac

SEQ ID NO: 3902115 - RNA, 14 nt, Shigella flexneri 2a str. 301
accgugaaaauggc

SEQ ID NO: 3902116 - RNA, 15 nt, Shigella flexneri 2a str. 301
accgugcaucuguug

SEQ ID NO: 3902117 - RNA, 17 nt, Shigella flexneri 2a str. 301
accgugcauuucucacu

SEQ ID NO: 3902118 - RNA, 20 nt, Shigella flexneri 2a str. 301
accgugcgggcaucaucuuc

SEQ ID NO: 3902119 - RNA, 22 nt, Shigella flexneri 2a str. 301
accgugcuucgccuuacucacc

SEQ ID NO: 3902120 - RNA, 16 nt, Shigella flexneri 2a str. 301
accguggcguaaauca

SEQ ID NO: 3902121 - RNA, 18 nt, Shigella flexneri 2a str. 301
accguggcguaaaucauc

SEQ ID NO: 3902122 - RNA, 20 nt, Shigella flexneri 2a str. 301
accgugguugcgccugggcc

SEQ ID NO: 3902123 - RNA, 18 nt, Shigella flexneri 2a str. 301
accguguaaaaugacucg

SEQ ID NO: 3902124 - RNA, 18 nt, Shigella flexneri 2a str. 301
accguuaagaugguuacg

SEQ ID NO: 3902125 - RNA, 14 nt, Shigella flexneri 2a str. 301
accguucaggcaca

SEQ ID NO: 3902126 - RNA, 20 nt, Shigella flexneri 2a str. 301
accguucauuaacgccccaa

SEQ ID NO: 3902127 - RNA, 12 nt, Shigella flexneri 2a str. 301
accguugccaac

SEQ ID NO: 3902128 - RNA, 21 nt, Shigella flexneri 2a str. 301
accguugccaaccugaacaau

SEQ ID NO: 3902129 - RNA, 16 nt, Shigella flexneri 2a str. 301
accguugcuggaaaac

SEQ ID NO: 3902130 - RNA, 14 nt, Shigella flexneri 2a str. 301
accguuggccugau

SEQ ID NO: 3902131 - RNA, 22 nt, Shigella flexneri 2a str. 301
accguuggccugauaaacauag

SEQ ID NO: 3902132 - RNA, 23 nt, Shigella flexneri 2a str. 301
accguuggcgcguguuccagaga

SEQ ID NO: 3902133 - RNA, 12 nt, Shigella flexneri 2a str. 301
accguuggcgcu

SEQ ID NO: 3902134 - RNA, 21 nt, Shigella flexneri 2a str. 301
accguugguuaauuuuucaaa

SEQ ID NO: 3902135 - RNA, 23 nt, Shigella flexneri 2a str. 301
accguugguuaauuuuucaaacu

SEQ ID NO: 3902136 - RNA, 19 nt, Shigella flexneri 2a str. 301
accguuuacgucauuaccg

SEQ ID NO: 3902137 - RNA, 17 nt, Shigella flexneri 2a str. 301
accguuucgcagucgcc

SEQ ID NO: 3902138 - RNA, 15 nt, Shigella flexneri 2a str. 301
accguuuuuucugcc

SEQ ID NO: 3902139 - RNA, 16 nt, Shigella flexneri 2a str. 301
accuaaaaaaucccac

SEQ ID NO: 3902140 - RNA, 19 nt, Shigella flexneri 2a str. 301
accuaaacguuuaaaaacu

SEQ ID NO: 3902141 - RNA, 18 nt, Shigella flexneri 2a str. 301
accuaaaguaaaggcaca

SEQ ID NO: 3902142 - RNA, 13 nt, Shigella flexneri 2a str. 301
accuaacagcauc

SEQ ID NO: 3902143 - RNA, 14 nt, Shigella flexneri 2a str. 301
accuaaccugauau

SEQ ID NO: 3902144 - RNA, 21 nt, Shigella flexneri 2a str. 301
accuacaaaaucuugcaaaau

SEQ ID NO: 3902145 - RNA, 21 nt, Shigella flexneri 2a str. 301
accuaccaucuccugcaacga

SEQ ID NO: 3902146 - RNA, 19 nt, Shigella flexneri 2a str. 301
accuaccugcaguucauca

SEQ ID NO: 3902147 - RNA, 21 nt, Shigella flexneri 2a str. 301
accuacgcuuucgaugugaac

SEQ ID NO: 3902148 - RNA, 20 nt, Shigella flexneri 2a str. 301
accuacuuuuuaauucagga

SEQ ID NO: 3902149 - RNA, 22 nt, Shigella flexneri 2a str. 301
accuacuuuuuaauucaggaaa

SEQ ID NO: 3902150 - RNA, 21 nt, Shigella flexneri 2a str. 301
accuagcaaacuaucugugua

SEQ ID NO: 3902151 - RNA, 15 nt, Shigella flexneri 2a str. 301
accuagcacuguaaa

SEQ ID NO: 3902152 - RNA, 20 nt, Shigella flexneri 2a str. 301
accuagcacuguaaaccucu

SEQ ID NO: 3902153 - RNA, 22 nt, Shigella flexneri 2a str. 301
accuaugcgugggccgcgucgg

SEQ ID NO: 3902154 - RNA, 13 nt, Shigella flexneri 2a str. 301
accucaaaggccg

SEQ ID NO: 3902155 - RNA, 20 nt, Shigella flexneri 2a str. 301
accucagcgaacaggaccuu

SEQ ID NO: 3902156 - RNA, 22 nt, Shigella flexneri 2a str. 301
accucaucaccacagacaaaca

SEQ ID NO: 3902157 - RNA, 17 nt, Shigella flexneri 2a str. 301
accucaucagacaccag

SEQ ID NO: 3902158 - RNA, 20 nt, Shigella flexneri 2a str. 301
accucauuaagaugcauuua

SEQ ID NO: 3902159 - RNA, 14 nt, Shigella flexneri 2a str. 301
accuccagcaucag

SEQ ID NO: 3902160 - RNA, 19 nt, Shigella flexneri 2a str. 301
accuccagcgaaggaucac

SEQ ID NO: 3902161 - RNA, 22 nt, Shigella flexneri 2a str. 301
accuccagcgaaggaucacccc

SEQ ID NO: 3902162 - RNA, 17 nt, Shigella flexneri 2a str. 301
accuccagcuccgccag

SEQ ID NO: 3902163 - RNA, 23 nt, Shigella flexneri 2a str. 301
accuccuggaucacaauccgcuc

SEQ ID NO: 3902164 - RNA, 14 nt, Shigella flexneri 2a str. 301
accuccuucacagu

SEQ ID NO: 3902165 - RNA, 19 nt, Shigella flexneri 2a str. 301
accucgcccauuuuucaug

SEQ ID NO: 3902166 - RNA, 19 nt, Shigella flexneri 2a str. 301
accucgccccgugaugaac

SEQ ID NO: 3902167 - RNA, 23 nt, Shigella flexneri 2a str. 301
accucgccccgugaugaacugcg

SEQ ID NO: 3902168 - RNA, 13 nt, Shigella flexneri 2a str. 301
accucguccuguu

SEQ ID NO: 3902169 - RNA, 17 nt, Shigella flexneri 2a str. 301
accucugcugcugcguu

SEQ ID NO: 3902170 - RNA, 21 nt, Shigella flexneri 2a str. 301
accucuggcgaauagaaagca

SEQ ID NO: 3902171 - RNA, 23 nt, Shigella flexneri 2a str. 301
accucuggcgaauagaaagcaag

SEQ ID NO: 3902172 - RNA, 23 nt, Shigella flexneri 2a str. 301
accucuucggcagucacuuuuuu

SEQ ID NO: 3902173 - RNA, 21 nt, Shigella flexneri 2a str. 301
accucuucuaccacaugauua

SEQ ID NO: 3902174 - RNA, 22 nt, Shigella flexneri 2a str. 301
accucuuucgcacgaaccguaa

SEQ ID NO: 3902175 - RNA, 15 nt, Shigella flexneri 2a str. 301
accugaaaaaacaaa

SEQ ID NO: 3902176 - RNA, 18 nt, Shigella flexneri 2a str. 301
accugaaagccgaugccc

SEQ ID NO: 3902177 - RNA, 19 nt, Shigella flexneri 2a str. 301
accugaaagccgaugcccc

SEQ ID NO: 3902178 - RNA, 11 nt, Shigella flexneri 2a str. 301
accugaacucg

SEQ ID NO: 3902179 - RNA, 12 nt, Shigella flexneri 2a str. 301
accugaauauua

SEQ ID NO: 3902180 - RNA, 13 nt, Shigella flexneri 2a str. 301
accugaauauuag

SEQ ID NO: 3902181 - RNA, 15 nt, Shigella flexneri 2a str. 301
accugaaucgucaga

SEQ ID NO: 3902182 - RNA, 13 nt, Shigella flexneri 2a str. 301
accugacaacaaa

SEQ ID NO: 3902183 - RNA, 13 nt, Shigella flexneri 2a str. 301
accugaccgcgag

SEQ ID NO: 3902184 - RNA, 18 nt, Shigella flexneri 2a str. 301
accugacuguuccagcac

SEQ ID NO: 3902185 - RNA, 15 nt, Shigella flexneri 2a str. 301
accugaucagcaauc

SEQ ID NO: 3902186 - RNA, 15 nt, Shigella flexneri 2a str. 301
accugauccagcucu

SEQ ID NO: 3902187 - RNA, 16 nt, Shigella flexneri 2a str. 301
accugauccagcucuu

SEQ ID NO: 3902188 - RNA, 20 nt, Shigella flexneri 2a str. 301
accugauccagcucuucuuc

SEQ ID NO: 3902189 - RNA, 23 nt, Shigella flexneri 2a str. 301
accugauuaaacgggucaucaaa

SEQ ID NO: 3902190 - RNA, 23 nt, Shigella flexneri 2a str. 301
accugauuaccgugaaucaccac

SEQ ID NO: 3902191 - RNA, 20 nt, Shigella flexneri 2a str. 301
accugauugaccgccagcgc

SEQ ID NO: 3902192 - RNA, 13 nt, Shigella flexneri 2a str. 301
accugauuuugcc

SEQ ID NO: 3902193 - RNA, 18 nt, Shigella flexneri 2a str. 301
accugcaaauucaauaaa

SEQ ID NO: 3902194 - RNA, 22 nt, Shigella flexneri 2a str. 301
accugcaaauucaauaaauugc

SEQ ID NO: 3902195 - RNA, 22 nt, Shigella flexneri 2a str. 301
accugcacaaauagccagcaga

SEQ ID NO: 3902196 - RNA, 22 nt, Shigella flexneri 2a str. 301
accugcacguuagcccuuugua

SEQ ID NO: 3902197 - RNA, 16 nt, Shigella flexneri 2a str. 301
accugcauacaaauaa

SEQ ID NO: 3902198 - RNA, 23 nt, Shigella flexneri 2a str. 301
accugccagcgccgacagcagcc

SEQ ID NO: 3902199 - RNA, 22 nt, Shigella flexneri 2a str. 301
accugccagggagcgaaaaagc

SEQ ID NO: 3902200 - RNA, 14 nt, Shigella flexneri 2a str. 301
accugcccuccggu

SEQ ID NO: 3902201 - RNA, 12 nt, Shigella flexneri 2a str. 301
accugccggagc

SEQ ID NO: 3902202 - RNA, 14 nt, Shigella flexneri 2a str. 301
accugccuuacaua

SEQ ID NO: 3902203 - RNA, 17 nt, Shigella flexneri 2a str. 301
accugcgcaggcauuca

SEQ ID NO: 3902204 - RNA, 20 nt, Shigella flexneri 2a str. 301
accugcgccugcaccauugc

SEQ ID NO: 3902205 - RNA, 19 nt, Shigella flexneri 2a str. 301
accugcggcaccagcggua

SEQ ID NO: 3902206 - RNA, 13 nt, Shigella flexneri 2a str. 301
accugcguucagc

SEQ ID NO: 3902207 - RNA, 23 nt, Shigella flexneri 2a str. 301
accugcguucagcaguucugcca

SEQ ID NO: 3902208 - RNA, 21 nt, Shigella flexneri 2a str. 301
accugcuuuaaaagcucgcuc

SEQ ID NO: 3902209 - RNA, 18 nt, Shigella flexneri 2a str. 301
accuggaaauuuugcuga

SEQ ID NO: 3902210 - RNA, 20 nt, Shigella flexneri 2a str. 301
accuggccugggaucaucag

SEQ ID NO: 3902211 - RNA, 16 nt, Shigella flexneri 2a str. 301
accuggcgcagcugcg

SEQ ID NO: 3902212 - RNA, 16 nt, Shigella flexneri 2a str. 301
accuggcgcuguucgg

SEQ ID NO: 3902213 - RNA, 14 nt, Shigella flexneri 2a str. 301
accuggcuugccgg

SEQ ID NO: 3902214 - RNA, 21 nt, Shigella flexneri 2a str. 301
accugggaaauccaacagacc

SEQ ID NO: 3902215 - RNA, 22 nt, Shigella flexneri 2a str. 301
accugggcaauggugaacugcc

SEQ ID NO: 3902216 - RNA, 22 nt, Shigella flexneri 2a str. 301
accugggucugcagauauucau

SEQ ID NO: 3902217 - RNA, 19 nt, Shigella flexneri 2a str. 301
accugggugagcgucaucg

SEQ ID NO: 3902218 - RNA, 12 nt, Shigella flexneri 2a str. 301
accuggucgcug

SEQ ID NO: 3902219 - RNA, 17 nt, Shigella flexneri 2a str. 301
accuggugcagcggcuc

SEQ ID NO: 3902220 - RNA, 17 nt, Shigella flexneri 2a str. 301
accugguguucggcauu

SEQ ID NO: 3902221 - RNA, 20 nt, Shigella flexneri 2a str. 301
accugguguucggcauucug

SEQ ID NO: 3902222 - RNA, 14 nt, Shigella flexneri 2a str. 301
accuguaccagccc

SEQ ID NO: 3902223 - RNA, 22 nt, Shigella flexneri 2a str. 301
accuguaguguguugcaauaca

SEQ ID NO: 3902224 - RNA, 19 nt, Shigella flexneri 2a str. 301
accuguccuguaggccuga

SEQ ID NO: 3902225 - RNA, 22 nt, Shigella flexneri 2a str. 301
accuguccuguaggccugauaa

SEQ ID NO: 3902226 - RNA, 21 nt, Shigella flexneri 2a str. 301
accugugaauuucuaagcugc

SEQ ID NO: 3902227 - RNA, 18 nt, Shigella flexneri 2a str. 301
accuguuccaguggcuga

SEQ ID NO: 3902228 - RNA, 20 nt, Shigella flexneri 2a str. 301
accuguucgucccgauucag

SEQ ID NO: 3902229 - RNA, 17 nt, Shigella flexneri 2a str. 301
accuguugaaauuauug

SEQ ID NO: 3902230 - RNA, 12 nt, Shigella flexneri 2a str. 301
accuguuuucac

SEQ ID NO: 3902231 - RNA, 15 nt, Shigella flexneri 2a str. 301
accuuaaaacaauau

SEQ ID NO: 3902232 - RNA, 14 nt, Shigella flexneri 2a str. 301
accuuaaauggccc

SEQ ID NO: 3902233 - RNA, 21 nt, Shigella flexneri 2a str. 301
accuuaaucagaauuuuucgc

SEQ ID NO: 3902234 - RNA, 14 nt, Shigella flexneri 2a str. 301
accuuacccgcgac

SEQ ID NO: 3902235 - RNA, 20 nt, Shigella flexneri 2a str. 301
accuuaccuguguuuugcau

SEQ ID NO: 3902236 - RNA, 17 nt, Shigella flexneri 2a str. 301
accuuacggcacuccuc

SEQ ID NO: 3902237 - RNA, 15 nt, Shigella flexneri 2a str. 301
accuuacggucagua

SEQ ID NO: 3902238 - RNA, 23 nt, Shigella flexneri 2a str. 301
accuuacuuccgguuacgccacc

SEQ ID NO: 3902239 - RNA, 14 nt, Shigella flexneri 2a str. 301
accuuaucaaucuc

SEQ ID NO: 3902240 - RNA, 19 nt, Shigella flexneri 2a str. 301
accuucacagaaggccagg

SEQ ID NO: 3902241 - RNA, 12 nt, Shigella flexneri 2a str. 301
accuucacgcgc

SEQ ID NO: 3902242 - RNA, 22 nt, Shigella flexneri 2a str. 301
accuucagcgaagcccacgccg

SEQ ID NO: 3902243 - RNA, 23 nt, Shigella flexneri 2a str. 301
accuucagcgaagcccacgccgc

SEQ ID NO: 3902244 - RNA, 14 nt, Shigella flexneri 2a str. 301
accuucaggcacaa

SEQ ID NO: 3902245 - RNA, 15 nt, Shigella flexneri 2a str. 301
accuucauccagcau

SEQ ID NO: 3902246 - RNA, 14 nt, Shigella flexneri 2a str. 301
accuucauuugcca

SEQ ID NO: 3902247 - RNA, 16 nt, Shigella flexneri 2a str. 301
accuucccgucuacaa

SEQ ID NO: 3902248 - RNA, 18 nt, Shigella flexneri 2a str. 301
accuucccgucuacaaaa

SEQ ID NO: 3902249 - RNA, 16 nt, Shigella flexneri 2a str. 301
accuuccgguuucaaa

SEQ ID NO: 3902250 - RNA, 21 nt, Shigella flexneri 2a str. 301
accuuccucaccguuuaagaa

SEQ ID NO: 3902251 - RNA, 21 nt, Shigella flexneri 2a str. 301
accuucgaaugccgcagcacc

SEQ ID NO: 3902252 - RNA, 23 nt, Shigella flexneri 2a str. 301
accuucgccucccguuuauuuac

SEQ ID NO: 3902253 - RNA, 13 nt, Shigella flexneri 2a str. 301
accuucgcggcac

SEQ ID NO: 3902254 - RNA, 16 nt, Shigella flexneri 2a str. 301
accuucgcggcacugg

SEQ ID NO: 3902255 - RNA, 16 nt, Shigella flexneri 2a str. 301
accuucgcgguaauga

SEQ ID NO: 3902256 - RNA, 23 nt, Shigella flexneri 2a str. 301
accuucgcgguaaugacuccaac

SEQ ID NO: 3902257 - RNA, 17 nt, Shigella flexneri 2a str. 301
accuucggauugcccug

SEQ ID NO: 3902258 - RNA, 20 nt, Shigella flexneri 2a str. 301
accuucguuauauccaggca

SEQ ID NO: 3902259 - RNA, 12 nt, Shigella flexneri 2a str. 301
accuucuuccca

SEQ ID NO: 3902260 - RNA, 11 nt, Shigella flexneri 2a str. 301
accuucuuccu

SEQ ID NO: 3902261 - RNA, 18 nt, Shigella flexneri 2a str. 301
accuucuuccugcgccag

SEQ ID NO: 3902262 - RNA, 23 nt, Shigella flexneri 2a str. 301
accuugcaauaauuuacagccug

SEQ ID NO: 3902263 - RNA, 17 nt, Shigella flexneri 2a str. 301
accuugcacucgcagaa

SEQ ID NO: 3902264 - RNA, 21 nt, Shigella flexneri 2a str. 301
accuugcgccucaacccauuu

SEQ ID NO: 3902265 - RNA, 13 nt, Shigella flexneri 2a str. 301
acgcaaacaccag

SEQ ID NO: 3902266 - RNA, 18 nt, Shigella flexneri 2a str. 301
acgcaaacaccagcgaau

SEQ ID NO: 3902267 - RNA, 19 nt, Shigella flexneri 2a str. 301
acgcaaacaccagcgaaug

SEQ ID NO: 3902268 - RNA, 14 nt, Shigella flexneri 2a str. 301
acgcaaacgugggg

SEQ ID NO: 3902269 - RNA, 19 nt, Shigella flexneri 2a str. 301
acgcaacaucgcaauccuu

SEQ ID NO: 3902270 - RNA, 12 nt, Shigella flexneri 2a str. 301
acgcaaccacaa

SEQ ID NO: 3902271 - RNA, 13 nt, Shigella flexneri 2a str. 301
acgcaaccacaaa

SEQ ID NO: 3902272 - RNA, 18 nt, Shigella flexneri 2a str. 301
acgcaaccgcaaaugauu

SEQ ID NO: 3902273 - RNA, 18 nt, Shigella flexneri 2a str. 301
acgcaagcggcauccagg

SEQ ID NO: 3902274 - RNA, 16 nt, Shigella flexneri 2a str. 301
acgcaauaauggacaa

SEQ ID NO: 3902275 - RNA, 13 nt, Shigella flexneri 2a str. 301
acgcaauaccugg

SEQ ID NO: 3902276 - RNA, 15 nt, Shigella flexneri 2a str. 301
acgcaaucaaaaaag

SEQ ID NO: 3902277 - RNA, 23 nt, Shigella flexneri 2a str. 301
acgcaauuccagcaagccacugg

SEQ ID NO: 3902278 - RNA, 16 nt, Shigella flexneri 2a str. 301
acgcacagaacaaaau

SEQ ID NO: 3902279 - RNA, 20 nt, Shigella flexneri 2a str. 301
acgcacagcccgccgccauc

SEQ ID NO: 3902280 - RNA, 12 nt, Shigella flexneri 2a str. 301
acgcaccaugca

SEQ ID NO: 3902281 - RNA, 15 nt, Shigella flexneri 2a str. 301
acgcaccaugcacgg

SEQ ID NO: 3902282 - RNA, 17 nt, Shigella flexneri 2a str. 301
acgcaccgccaccaccg

SEQ ID NO: 3902283 - RNA, 19 nt, Shigella flexneri 2a str. 301
acgcaccgcguauugcucu

SEQ ID NO: 3902284 - RNA, 14 nt, Shigella flexneri 2a str. 301
acgcacugcuugaa

SEQ ID NO: 3902285 - RNA, 19 nt, Shigella flexneri 2a str. 301
acgcacuuccggugccggu

SEQ ID NO: 3902286 - RNA, 16 nt, Shigella flexneri 2a str. 301
acgcagaaccagaagc

SEQ ID NO: 3902287 - RNA, 12 nt, Shigella flexneri 2a str. 301
acgcagaacuga

SEQ ID NO: 3902288 - RNA, 16 nt, Shigella flexneri 2a str. 301
acgcagaaucucugcg

SEQ ID NO: 3902289 - RNA, 22 nt, Shigella flexneri 2a str. 301
acgcagaaucuucuucucagcc

SEQ ID NO: 3902290 - RNA, 14 nt, Shigella flexneri 2a str. 301
acgcagacacugcu

SEQ ID NO: 3902291 - RNA, 21 nt, Shigella flexneri 2a str. 301
acgcagacacugcugauaauc

SEQ ID NO: 3902292 - RNA, 23 nt, Shigella flexneri 2a str. 301
acgcagacacugcugauaaucca

SEQ ID NO: 3902293 - RNA, 21 nt, Shigella flexneri 2a str. 301
acgcagaccaaagucaaacug

SEQ ID NO: 3902294 - RNA, 18 nt, Shigella flexneri 2a str. 301
acgcagagacaucaccaa

SEQ ID NO: 3902295 - RNA, 17 nt, Shigella flexneri 2a str. 301
acgcagcaucaucauaa

SEQ ID NO: 3902296 - RNA, 17 nt, Shigella flexneri 2a str. 301
acgcagcauuggguaaa

SEQ ID NO: 3902297 - RNA, 21 nt, Shigella flexneri 2a str. 301
acgcagcauuggguaaaaugg

SEQ ID NO: 3902298 - RNA, 18 nt, Shigella flexneri 2a str. 301
acgcagcgguauaaucug

SEQ ID NO: 3902299 - RNA, 17 nt, Shigella flexneri 2a str. 301
acgcagcgucagcacca

SEQ ID NO: 3902300 - RNA, 21 nt, Shigella flexneri 2a str. 301
acgcagcgucucauaccggau

SEQ ID NO: 3902301 - RNA, 19 nt, Shigella flexneri 2a str. 301
acgcaggaugcaauuguug

SEQ ID NO: 3902302 - RNA, 16 nt, Shigella flexneri 2a str. 301
acgcaggcgagaauca

SEQ ID NO: 3902303 - RNA, 18 nt, Shigella flexneri 2a str. 301
acgcaggcggcuggcauc

SEQ ID NO: 3902304 - RNA, 21 nt, Shigella flexneri 2a str. 301
acgcagggaguuaccgugugc

SEQ ID NO: 3902305 - RNA, 19 nt, Shigella flexneri 2a str. 301
acgcagucucucuccguua

SEQ ID NO: 3902306 - RNA, 15 nt, Shigella flexneri 2a str. 301
acgcagugauaacuc

SEQ ID NO: 3902307 - RNA, 22 nt, Shigella flexneri 2a str. 301
acgcaguggguaaugcugugaa

SEQ ID NO: 3902308 - RNA, 20 nt, Shigella flexneri 2a str. 301
acgcagugguuaacaaucac

SEQ ID NO: 3902309 - RNA, 23 nt, Shigella flexneri 2a str. 301
acgcagugguuaacaaucacaau

SEQ ID NO: 3902310 - RNA, 14 nt, Shigella flexneri 2a str. 301
acgcaguuccgcca

SEQ ID NO: 3902311 - RNA, 15 nt, Shigella flexneri 2a str. 301
acgcauaacagcccg

SEQ ID NO: 3902312 - RNA, 17 nt, Shigella flexneri 2a str. 301
acgcauccaccagauaa

SEQ ID NO: 3902313 - RNA, 16 nt, Shigella flexneri 2a str. 301
acgcaucgccaaacag

SEQ ID NO: 3902314 - RNA, 17 nt, Shigella flexneri 2a str. 301
acgcaucggcuaaacca

SEQ ID NO: 3902315 - RNA, 17 nt, Shigella flexneri 2a str. 301
acgcaucuucuccggcc

SEQ ID NO: 3902316 - RNA, 19 nt, Shigella flexneri 2a str. 301
acgcaucuucuccggccuu

SEQ ID NO: 3902317 - RNA, 12 nt, Shigella flexneri 2a str. 301
acgcaugcacau

SEQ ID NO: 3902318 - RNA, 15 nt, Shigella flexneri 2a str. 301
acgcauucagcaaau

SEQ ID NO: 3902319 - RNA, 18 nt, Shigella flexneri 2a str. 301
acgcauugcucacuuccu

SEQ ID NO: 3902320 - RNA, 15 nt, Shigella flexneri 2a str. 301
acgccaaauucuuua

SEQ ID NO: 3902321 - RNA, 15 nt, Shigella flexneri 2a str. 301
acgccaaccagcuga

SEQ ID NO: 3902322 - RNA, 16 nt, Shigella flexneri 2a str. 301
acgccaagaaagagcg

SEQ ID NO: 3902323 - RNA, 16 nt, Shigella flexneri 2a str. 301
acgccaaucugcaaaa

SEQ ID NO: 3902324 - RNA, 21 nt, Shigella flexneri 2a str. 301
acgccaaucugcaaaauacca

SEQ ID NO: 3902325 - RNA, 19 nt, Shigella flexneri 2a str. 301
acgccaauuacgcgcaaua

SEQ ID NO: 3902326 - RNA, 19 nt, Shigella flexneri 2a str. 301
acgccacaauacugaucau

SEQ ID NO: 3902327 - RNA, 20 nt, Shigella flexneri 2a str. 301
acgccacaauacugaucauc

SEQ ID NO: 3902328 - RNA, 15 nt, Shigella flexneri 2a str. 301
acgccaccccacacc

SEQ ID NO: 3902329 - RNA, 17 nt, Shigella flexneri 2a str. 301
acgccaccccacaccag

SEQ ID NO: 3902330 - RNA, 20 nt, Shigella flexneri 2a str. 301
acgccaccuuucucggcauc

SEQ ID NO: 3902331 - RNA, 14 nt, Shigella flexneri 2a str. 301
acgccagacugcgc

SEQ ID NO: 3902332 - RNA, 15 nt, Shigella flexneri 2a str. 301
acgccagauacauca

SEQ ID NO: 3902333 - RNA, 19 nt, Shigella flexneri 2a str. 301
acgccagcgcuuuuggcgc

SEQ ID NO: 3902334 - RNA, 15 nt, Shigella flexneri 2a str. 301
acgccaggccacgcu

SEQ ID NO: 3902335 - RNA, 22 nt, Shigella flexneri 2a str. 301
acgccagucacggugcagcucg

SEQ ID NO: 3902336 - RNA, 23 nt, Shigella flexneri 2a str. 301
acgccagucacggugcagcucgc

SEQ ID NO: 3902337 - RNA, 21 nt, Shigella flexneri 2a str. 301
acgccagucgcacacaacaga

SEQ ID NO: 3902338 - RNA, 12 nt, Shigella flexneri 2a str. 301
acgccaguuuaa

SEQ ID NO: 3902339 - RNA, 17 nt, Shigella flexneri 2a str. 301
acgccauaccugcacaa

SEQ ID NO: 3902340 - RNA, 18 nt, Shigella flexneri 2a str. 301
acgccauacggcuaugaa

SEQ ID NO: 3902341 - RNA, 16 nt, Shigella flexneri 2a str. 301
acgccaucaucggcaa

SEQ ID NO: 3902342 - RNA, 13 nt, Shigella flexneri 2a str. 301
acgccaucgccag

SEQ ID NO: 3902343 - RNA, 16 nt, Shigella flexneri 2a str. 301
acgccaucgccagcag

SEQ ID NO: 3902344 - RNA, 17 nt, Shigella flexneri 2a str. 301
acgccaucgccagcagc

SEQ ID NO: 3902345 - RNA, 16 nt, Shigella flexneri 2a str. 301
acgccaucgccaggaa

SEQ ID NO: 3902346 - RNA, 18 nt, Shigella flexneri 2a str. 301
acgccaucucccggcaua

SEQ ID NO: 3902347 - RNA, 14 nt, Shigella flexneri 2a str. 301
acgccaucucuuua

SEQ ID NO: 3902348 - RNA, 16 nt, Shigella flexneri 2a str. 301
acgccaugaagauggu

SEQ ID NO: 3902349 - RNA, 17 nt, Shigella flexneri 2a str. 301
acgccauuaaccgugcg

SEQ ID NO: 3902350 - RNA, 19 nt, Shigella flexneri 2a str. 301
acgcccaauccggccuaca

SEQ ID NO: 3902351 - RNA, 15 nt, Shigella flexneri 2a str. 301
acgcccaaugcccag

SEQ ID NO: 3902352 - RNA, 18 nt, Shigella flexneri 2a str. 301
acgcccacgccagccugc

SEQ ID NO: 3902353 - RNA, 12 nt, Shigella flexneri 2a str. 301
acgcccagcgca

SEQ ID NO: 3902354 - RNA, 21 nt, Shigella flexneri 2a str. 301
acgcccauaaauacgucuuua

SEQ ID NO: 3902355 - RNA, 16 nt, Shigella flexneri 2a str. 301
acgcccaucauucagu

SEQ ID NO: 3902356 - RNA, 17 nt, Shigella flexneri 2a str. 301
acgccccacagacccag

SEQ ID NO: 3902357 - RNA, 14 nt, Shigella flexneri 2a str. 301
acgccccagauugc

SEQ ID NO: 3902358 - RNA, 17 nt, Shigella flexneri 2a str. 301
acgccccgguuucucuu

SEQ ID NO: 3902359 - RNA, 20 nt, Shigella flexneri 2a str. 301
acgcccgucaacggugccau

SEQ ID NO: 3902360 - RNA, 19 nt, Shigella flexneri 2a str. 301
acgcccugcgcuggugaaa

SEQ ID NO: 3902361 - RNA, 13 nt, Shigella flexneri 2a str. 301
acgcccuggaaga

SEQ ID NO: 3902362 - RNA, 22 nt, Shigella flexneri 2a str. 301
acgcccuggaagaaaaacuggc

SEQ ID NO: 3902363 - RNA, 16 nt, Shigella flexneri 2a str. 301
acgccgaaugccgggu

SEQ ID NO: 3902364 - RNA, 19 nt, Shigella flexneri 2a str. 301
acgccgaaugccggguaau

SEQ ID NO: 3902365 - RNA, 20 nt, Shigella flexneri 2a str. 301
acgcugaauacgcaccgcuc

SEQ ID NO: 3902366 - RNA, 18 nt, Shigella flexneri 2a str. 301
acgcugaugucagcacuu

SEQ ID NO: 3902367 - RNA, 20 nt, Shigella flexneri 2a str. 301
acgcugauuaaagacggcgg

SEQ ID NO: 3902368 - RNA, 13 nt, Shigella flexneri 2a str. 301
acgcugauugcau

SEQ ID NO: 3902369 - RNA, 23 nt, Shigella flexneri 2a str. 301
acgcugcaaggcucuauacgcau

SEQ ID NO: 3902370 - RNA, 17 nt, Shigella flexneri 2a str. 301
acgcugcacaauugcca

SEQ ID NO: 3902371 - RNA, 18 nt, Shigella flexneri 2a str. 301
acgcugcaucgccaaucu

SEQ ID NO: 3902372 - RNA, 22 nt, Shigella flexneri 2a str. 301
acgcugcauggcaacuuuaaua

SEQ ID NO: 3902373 - RNA, 23 nt, Shigella flexneri 2a str. 301
acgcugccccugguuaucuucca

SEQ ID NO: 3902374 - RNA, 14 nt, Shigella flexneri 2a str. 301
acgcugcucaaugg

SEQ ID NO: 3902375 - RNA, 23 nt, Shigella flexneri 2a str. 301
acgcugcugccggcacaggcauc

SEQ ID NO: 3902376 - RNA, 22 nt, Shigella flexneri 2a str. 301
acgcuggcagcaagugcggcgc

SEQ ID NO: 3902377 - RNA, 13 nt, Shigella flexneri 2a str. 301
acgcuggcccagu

SEQ ID NO: 3902378 - RNA, 18 nt, Shigella flexneri 2a str. 301
acgcuggcgcgccgccuc

SEQ ID NO: 3902379 - RNA, 21 nt, Shigella flexneri 2a str. 301
acgcuggcuuugcccuggcgc

SEQ ID NO: 3902380 - RNA, 15 nt, Shigella flexneri 2a str. 301
acgcuguaauuacca

SEQ ID NO: 3902381 - RNA, 18 nt, Shigella flexneri 2a str. 301
acgcuguagccgccgucg

SEQ ID NO: 3902382 - RNA, 22 nt, Shigella flexneri 2a str. 301
acgcuguccggcgcacuggugc

SEQ ID NO: 3902383 - RNA, 13 nt, Shigella flexneri 2a str. 301
acgcugucggcaa

SEQ ID NO: 3902384 - RNA, 20 nt, Shigella flexneri 2a str. 301
acgcugucggcaagauacug

SEQ ID NO: 3902385 - RNA, 21 nt, Shigella flexneri 2a str. 301
acgcuguuccggcggcagggu

SEQ ID NO: 3902386 - RNA, 20 nt, Shigella flexneri 2a str. 301
acgcuguuguuuuuucaacc

SEQ ID NO: 3902387 - RNA, 22 nt, Shigella flexneri 2a str. 301
acgcuuaaccccgggcuggauu

SEQ ID NO: 3902388 - RNA, 21 nt, Shigella flexneri 2a str. 301
acgcuuauaaauguguaauca

SEQ ID NO: 3902389 - RNA, 14 nt, Shigella flexneri 2a str. 301
acgcuuaucaggcc

SEQ ID NO: 3902390 - RNA, 15 nt, Shigella flexneri 2a str. 301
acgcuuaucccagcc

SEQ ID NO: 3902391 - RNA, 20 nt, Shigella flexneri 2a str. 301
acgcuucaaucugauauuua

SEQ ID NO: 3902392 - RNA, 23 nt, Shigella flexneri 2a str. 301
acgcuucugucgcuucacgcagg

SEQ ID NO: 3902393 - RNA, 16 nt, Shigella flexneri 2a str. 301
acgcuugagcaggagc

SEQ ID NO: 3902394 - RNA, 20 nt, Shigella flexneri 2a str. 301
acgcuugauucuguucagua

SEQ ID NO: 3902395 - RNA, 22 nt, Shigella flexneri 2a str. 301
acgcuuucacccggaucaauua

SEQ ID NO: 3902396 - RNA, 12 nt, Shigella flexneri 2a str. 301
acgcuuucccug

SEQ ID NO: 3902397 - RNA, 14 nt, Shigella flexneri 2a str. 301
acgcuuucucacca

SEQ ID NO: 3902398 - RNA, 13 nt, Shigella flexneri 2a str. 301
acgcuuucuuugg

SEQ ID NO: 3902399 - RNA, 17 nt, Shigella flexneri 2a str. 301
acgcuuugcaggcuggu

SEQ ID NO: 3902400 - RNA, 17 nt, Shigella flexneri 2a str. 301
acgcuuugcugauugcu

SEQ ID NO: 3902401 - RNA, 14 nt, Shigella flexneri 2a str. 301
acgcuuuucagugc

SEQ ID NO: 3902402 - RNA, 15 nt, Shigella flexneri 2a str. 301
acgcuuuucaucaga

SEQ ID NO: 3902403 - RNA, 21 nt, Shigella flexneri 2a str. 301
acggaaagcagauaacccagc

SEQ ID NO: 3902404 - RNA, 14 nt, Shigella flexneri 2a str. 301
acggaaagcagcau

SEQ ID NO: 3902405 - RNA, 16 nt, Shigella flexneri 2a str. 301
acggaagcgaaacugc

SEQ ID NO: 3902406 - RNA, 15 nt, Shigella flexneri 2a str. 301
acggaauaaccagcg

SEQ ID NO: 3902407 - RNA, 16 nt, Shigella flexneri 2a str. 301
acggaaugauauuggu

SEQ ID NO: 3902408 - RNA, 11 nt, Shigella flexneri 2a str. 301
acggacaugaa

SEQ ID NO: 3902409 - RNA, 13 nt, Shigella flexneri 2a str. 301
acggaccaauaaa

SEQ ID NO: 3902410 - RNA, 15 nt, Shigella flexneri 2a str. 301
acggacgcgcggcga

SEQ ID NO: 3902411 - RNA, 22 nt, Shigella flexneri 2a str. 301
acggacucggcgucgguaaaga

SEQ ID NO: 3902412 - RNA, 15 nt, Shigella flexneri 2a str. 301
acggacuuccagcgg

SEQ ID NO: 3902413 - RNA, 21 nt, Shigella flexneri 2a str. 301
acggagcugccaggccgcauc

SEQ ID NO: 3902414 - RNA, 17 nt, Shigella flexneri 2a str. 301
acggaguugaccagcuc

SEQ ID NO: 3902415 - RNA, 21 nt, Shigella flexneri 2a str. 301
acggauagcagaaaacucacg

SEQ ID NO: 3902416 - RNA, 20 nt, Shigella flexneri 2a str. 301
acggaucaggcggcucaccu

SEQ ID NO: 3902417 - RNA, 15 nt, Shigella flexneri 2a str. 301
acggaucuuuucuuu

SEQ ID NO: 3902418 - RNA, 22 nt, Shigella flexneri 2a str. 301
acggaugaauaaaauucuccag

SEQ ID NO: 3902419 - RNA, 16 nt, Shigella flexneri 2a str. 301
acggaugaugcucccc

SEQ ID NO: 3902420 - RNA, 11 nt, Shigella flexneri 2a str. 301
acggaugcagc

SEQ ID NO: 3902421 - RNA, 14 nt, Shigella flexneri 2a str. 301
acggaugccaauca

SEQ ID NO: 3902422 - RNA, 13 nt, Shigella flexneri 2a str. 301
acggaugcgaaug

SEQ ID NO: 3902423 - RNA, 22 nt, Shigella flexneri 2a str. 301
acggauguuucuucaacaccac

SEQ ID NO: 3902424 - RNA, 15 nt, Shigella flexneri 2a str. 301
acggauucagugagc

SEQ ID NO: 3902425 - RNA, 16 nt, Shigella flexneri 2a str. 301
acggcaacacgccugg

SEQ ID NO: 3902426 - RNA, 13 nt, Shigella flexneri 2a str. 301
acggcaauaccug

SEQ ID NO: 3902427 - RNA, 19 nt, Shigella flexneri 2a str. 301
acggcaauucccagaaugu

SEQ ID NO: 3902428 - RNA, 22 nt, Shigella flexneri 2a str. 301
acggcaauucccagaauguuaa

SEQ ID NO: 3902429 - RNA, 21 nt, Shigella flexneri 2a str. 301
acggcaauuuuaccuagcacu

SEQ ID NO: 3902430 - RNA, 12 nt, Shigella flexneri 2a str. 301
acggcaccaccc

SEQ ID NO: 3902431 - RNA, 18 nt, Shigella flexneri 2a str. 301
acggcacucgcuggcacu

SEQ ID NO: 3902432 - RNA, 21 nt, Shigella flexneri 2a str. 301
acggcagaaguaguugcuguc

SEQ ID NO: 3902433 - RNA, 18 nt, Shigella flexneri 2a str. 301
acggcagagaucgccgcu

SEQ ID NO: 3902434 - RNA, 19 nt, Shigella flexneri 2a str. 301
acggcagcaacggcaguuu

SEQ ID NO: 3902435 - RNA, 22 nt, Shigella flexneri 2a str. 301
acggcaggaucaggcaaacgaa

SEQ ID NO: 3902436 - RNA, 13 nt, Shigella flexneri 2a str. 301
acggcagugaaca

SEQ ID NO: 3902437 - RNA, 13 nt, Shigella flexneri 2a str. 301
acggcagugaacg

SEQ ID NO: 3902438 - RNA, 16 nt, Shigella flexneri 2a str. 301
acggcauaagccgucc

SEQ ID NO: 3902439 - RNA, 16 nt, Shigella flexneri 2a str. 301
acggcauacguugcag

SEQ ID NO: 3902440 - RNA, 15 nt, Shigella flexneri 2a str. 301
acggcaucaacauca

SEQ ID NO: 3902441 - RNA, 18 nt, Shigella flexneri 2a str. 301
acggcaucccaacucauu

SEQ ID NO: 3902442 - RNA, 14 nt, Shigella flexneri 2a str. 301
acggcaucguccau

SEQ ID NO: 3902443 - RNA, 18 nt, Shigella flexneri 2a str. 301
acggcaugaaagcgaugc

SEQ ID NO: 3902444 - RNA, 21 nt, Shigella flexneri 2a str. 301
acggcauucugcacauuauca

SEQ ID NO: 3902445 - RNA, 19 nt, Shigella flexneri 2a str. 301
acggcauuuccgccaauca

SEQ ID NO: 3902446 - RNA, 22 nt, Shigella flexneri 2a str. 301
acggcauuuccgccaaucaaga

SEQ ID NO: 3902447 - RNA, 16 nt, Shigella flexneri 2a str. 301
acggcauuuugcugau

SEQ ID NO: 3902448 - RNA, 18 nt, Shigella flexneri 2a str. 301
acggcauuuugcugaugc

SEQ ID NO: 3902449 - RNA, 15 nt, Shigella flexneri 2a str. 301
acggccacucugccu

SEQ ID NO: 3902450 - RNA, 18 nt, Shigella flexneri 2a str. 301
acggcccugugccugcgu

SEQ ID NO: 3902451 - RNA, 18 nt, Shigella flexneri 2a str. 301
acggccugaccaugcuca

SEQ ID NO: 3902452 - RNA, 20 nt, Shigella flexneri 2a str. 301
acggccugaccaugcucaac

SEQ ID NO: 3902453 - RNA, 22 nt, Shigella flexneri 2a str. 301
acggcgcgacuuuaaucaccug

SEQ ID NO: 3902454 - RNA, 20 nt, Shigella flexneri 2a str. 301
acggcggaaagggccgcagu

SEQ ID NO: 3902455 - RNA, 15 nt, Shigella flexneri 2a str. 301
acggcggagucauuc

SEQ ID NO: 3902456 - RNA, 17 nt, Shigella flexneri 2a str. 301
acggcgggugacuuccc

SEQ ID NO: 3902457 - RNA, 14 nt, Shigella flexneri 2a str. 301
acggcgucaacacc

SEQ ID NO: 3902458 - RNA, 14 nt, Shigella flexneri 2a str. 301
acggcgugccgucg

SEQ ID NO: 3902459 - RNA, 19 nt, Shigella flexneri 2a str. 301
acggcgugcugaugcacga

SEQ ID NO: 3902460 - RNA, 20 nt, Shigella flexneri 2a str. 301
acggcgugcugaugcacgau

SEQ ID NO: 3902461 - RNA, 17 nt, Shigella flexneri 2a str. 301
acggcguggcaucaaua

SEQ ID NO: 3902462 - RNA, 20 nt, Shigella flexneri 2a str. 301
acggcguuaacuguacaggc

SEQ ID NO: 3902463 - RNA, 17 nt, Shigella flexneri 2a str. 301
acggcguuuccagcucg

SEQ ID NO: 3902464 - RNA, 13 nt, Shigella flexneri 2a str. 301
acggcuaaaaaaa

SEQ ID NO: 3902465 - RNA, 15 nt, Shigella flexneri 2a str. 301
acgugaccaguacca

SEQ ID NO: 3902466 - RNA, 16 nt, Shigella flexneri 2a str. 301
acgugcaccgucacuu

SEQ ID NO: 3902467 - RNA, 16 nt, Shigella flexneri 2a str. 301
acgugccgcagcuucu

SEQ ID NO: 3902468 - RNA, 20 nt, Shigella flexneri 2a str. 301
acgugcggccguuccauuca

SEQ ID NO: 3902469 - RNA, 22 nt, Shigella flexneri 2a str. 301
acgugcguaccauuaucaccaa

SEQ ID NO: 3902470 - RNA, 22 nt, Shigella flexneri 2a str. 301
acgugcucaccacgcagcagcc

SEQ ID NO: 3902471 - RNA, 19 nt, Shigella flexneri 2a str. 301
acgugcugcauuugccccu

SEQ ID NO: 3902472 - RNA, 16 nt, Shigella flexneri 2a str. 301
acguggcacauucuga

SEQ ID NO: 3902473 - RNA, 20 nt, Shigella flexneri 2a str. 301
acguggggugaauaaucgca

SEQ ID NO: 3902474 - RNA, 19 nt, Shigella flexneri 2a str. 301
acguggguaggaucagaau

SEQ ID NO: 3902475 - RNA, 19 nt, Shigella flexneri 2a str. 301
acguggucgaauccccuca

SEQ ID NO: 3902476 - RNA, 18 nt, Shigella flexneri 2a str. 301
acguguaggccugauaag

SEQ ID NO: 3902477 - RNA, 20 nt, Shigella flexneri 2a str. 301
acguguaggccugauaagcg

SEQ ID NO: 3902478 - RNA, 17 nt, Shigella flexneri 2a str. 301
acgugucuuaucaggcc

SEQ ID NO: 3902479 - RNA, 22 nt, Shigella flexneri 2a str. 301
acguuaacuuucguguguuuuc

SEQ ID NO: 3902480 - RNA, 13 nt, Shigella flexneri 2a str. 301
acguuaagaaaac

SEQ ID NO: 3902481 - RNA, 15 nt, Shigella flexneri 2a str. 301
acguuacccagcacg

SEQ ID NO: 3902482 - RNA, 18 nt, Shigella flexneri 2a str. 301
acguuacguacuuccuua

SEQ ID NO: 3902483 - RNA, 14 nt, Shigella flexneri 2a str. 301
acguuagaaacaaa

SEQ ID NO: 3902484 - RNA, 20 nt, Shigella flexneri 2a str. 301
acguuaguguggccaguucc

SEQ ID NO: 3902485 - RNA, 21 nt, Shigella flexneri 2a str. 301
acguuaugcaccgacaauccg

SEQ ID NO: 3902486 - RNA, 16 nt, Shigella flexneri 2a str. 301
acguucacccaucacu

SEQ ID NO: 3902487 - RNA, 13 nt, Shigella flexneri 2a str. 301
acguucaguucac

SEQ ID NO: 3902488 - RNA, 19 nt, Shigella flexneri 2a str. 301
acguucaucgggcauugca

SEQ ID NO: 3902489 - RNA, 15 nt, Shigella flexneri 2a str. 301
acguuccuuucuugc

SEQ ID NO: 3902490 - RNA, 22 nt, Shigella flexneri 2a str. 301
acguucggugauauacgucacu

SEQ ID NO: 3902491 - RNA, 13 nt, Shigella flexneri 2a str. 301
acguucuaccgua

SEQ ID NO: 3902492 - RNA, 20 nt, Shigella flexneri 2a str. 301
acguucugaucuuucuucag

SEQ ID NO: 3902493 - RNA, 19 nt, Shigella flexneri 2a str. 301
acguucugcguaauguuua

SEQ ID NO: 3902494 - RNA, 21 nt, Shigella flexneri 2a str. 301
acguucugucuccggcaucca

SEQ ID NO: 3902495 - RNA, 17 nt, Shigella flexneri 2a str. 301
acguucuuaauaccgua

SEQ ID NO: 3902496 - RNA, 16 nt, Shigella flexneri 2a str. 301
acguucuuacauuccg

SEQ ID NO: 3902497 - RNA, 21 nt, Shigella flexneri 2a str. 301
acguucuucgcugacaguacc

SEQ ID NO: 3902498 - RNA, 18 nt, Shigella flexneri 2a str. 301
acguugccggauauaccc

SEQ ID NO: 3902499 - RNA, 22 nt, Shigella flexneri 2a str. 301
acguugccguaugcgccacagg

SEQ ID NO: 3902500 - RNA, 18 nt, Shigella flexneri 2a str. 301
acguugcguugcagcagg

SEQ ID NO: 3902501 - RNA, 18 nt, Shigella flexneri 2a str. 301
acguugcucaaggguuuc

SEQ ID NO: 3902502 - RNA, 19 nt, Shigella flexneri 2a str. 301
acguugcuucaugccggau

SEQ ID NO: 3902503 - RNA, 13 nt, Shigella flexneri 2a str. 301
acguuggcaaagu

SEQ ID NO: 3902504 - RNA, 14 nt, Shigella flexneri 2a str. 301
acguuggcgcauaa

SEQ ID NO: 3902505 - RNA, 17 nt, Shigella flexneri 2a str. 301
acguuggcggugccauc

SEQ ID NO: 3902506 - RNA, 16 nt, Shigella flexneri 2a str. 301
acguugucaguucuuu

SEQ ID NO: 3902507 - RNA, 14 nt, Shigella flexneri 2a str. 301
acguugucauacgg

SEQ ID NO: 3902508 - RNA, 17 nt, Shigella flexneri 2a str. 301
acguuuauucccgcgaa

SEQ ID NO: 3902509 - RNA, 18 nt, Shigella flexneri 2a str. 301
acguuucaaacaggcugc

SEQ ID NO: 3902510 - RNA, 19 nt, Shigella flexneri 2a str. 301
acguuucaaccugcacauc

SEQ ID NO: 3902511 - RNA, 13 nt, Shigella flexneri 2a str. 301
acguuucccggaa

SEQ ID NO: 3902512 - RNA, 10 nt, Shigella flexneri 2a str. 301
acguuucucu

SEQ ID NO: 3902513 - RNA, 15 nt, Shigella flexneri 2a str. 301
acguuugccaugcau

SEQ ID NO: 3902514 - RNA, 19 nt, Shigella flexneri 2a str. 301
acguuuuaaaccuacgugc

SEQ ID NO: 3902515 - RNA, 18 nt, Shigella flexneri 2a str. 301
acguuuuacgcgucacgc

SEQ ID NO: 3902516 - RNA, 22 nt, Shigella flexneri 2a str. 301
acguuuuuuacucuuguggcca

SEQ ID NO: 3902517 - RNA, 17 nt, Shigella flexneri 2a str. 301
acuaaacccgaccacuu

SEQ ID NO: 3902518 - RNA, 20 nt, Shigella flexneri 2a str. 301
acuaaacccgaccacuucca

SEQ ID NO: 3902519 - RNA, 13 nt, Shigella flexneri 2a str. 301
acuaaaugugcaa

SEQ ID NO: 3902520 - RNA, 13 nt, Shigella flexneri 2a str. 301
acuaacagaacaa

SEQ ID NO: 3902521 - RNA, 16 nt, Shigella flexneri 2a str. 301
acuaacgcgucuuauc

SEQ ID NO: 3902522 - RNA, 22 nt, Shigella flexneri 2a str. 301
acuaacuucugaucuacagccu

SEQ ID NO: 3902523 - RNA, 23 nt, Shigella flexneri 2a str. 301
acuaacuucugaucuacagccuu

SEQ ID NO: 3902524 - RNA, 19 nt, Shigella flexneri 2a str. 301
acuaacuuuacucuuuuuu

SEQ ID NO: 3902525 - RNA, 22 nt, Shigella flexneri 2a str. 301
acuaagaauguccauuauuuca

SEQ ID NO: 3902526 - RNA, 17 nt, Shigella flexneri 2a str. 301
acuaaggcgaacauaag

SEQ ID NO: 3902527 - RNA, 15 nt, Shigella flexneri 2a str. 301
acuaauacaccauca

SEQ ID NO: 3902528 - RNA, 23 nt, Shigella flexneri 2a str. 301
acuaaucgacaguugcugcguga

SEQ ID NO: 3902529 - RNA, 22 nt, Shigella flexneri 2a str. 301
acuaaucugacaacaccaauuu

SEQ ID NO: 3902530 - RNA, 17 nt, Shigella flexneri 2a str. 301
acuaauugagcgugaag

SEQ ID NO: 3902531 - RNA, 16 nt, Shigella flexneri 2a str. 301
acuacaaauccaacac

SEQ ID NO: 3902532 - RNA, 19 nt, Shigella flexneri 2a str. 301
acuacaaauccaacaccag

SEQ ID NO: 3902533 - RNA, 20 nt, Shigella flexneri 2a str. 301
acuacaaugucgggauuuuc

SEQ ID NO: 3902534 - RNA, 20 nt, Shigella flexneri 2a str. 301
acuacagaggaaucgcuguu

SEQ ID NO: 3902535 - RNA, 17 nt, Shigella flexneri 2a str. 301
acuacaggacaucuuga

SEQ ID NO: 3902536 - RNA, 13 nt, Shigella flexneri 2a str. 301
acuaccauaaaaa

SEQ ID NO: 3902537 - RNA, 15 nt, Shigella flexneri 2a str. 301
acuaccauccgaguu

SEQ ID NO: 3902538 - RNA, 19 nt, Shigella flexneri 2a str. 301
acuaccauuuguucuuuuu

SEQ ID NO: 3902539 - RNA, 15 nt, Shigella flexneri 2a str. 301
acuacccauauuuaa

SEQ ID NO: 3902540 - RNA, 23 nt, Shigella flexneri 2a str. 301
acuacccgcauuuucuucauucg

SEQ ID NO: 3902541 - RNA, 16 nt, Shigella flexneri 2a str. 301
acuaccgcccgaugaa

SEQ ID NO: 3902542 - RNA, 15 nt, Shigella flexneri 2a str. 301
acuacgacauugaag

SEQ ID NO: 3902543 - RNA, 20 nt, Shigella flexneri 2a str. 301
acuacgacgccaagaaagag

SEQ ID NO: 3902544 - RNA, 18 nt, Shigella flexneri 2a str. 301
acuacgccaacagaagug

SEQ ID NO: 3902545 - RNA, 20 nt, Shigella flexneri 2a str. 301
acuacggaguaaccugccug

SEQ ID NO: 3902546 - RNA, 22 nt, Shigella flexneri 2a str. 301
acuacggcuucugacauaacca

SEQ ID NO: 3902547 - RNA, 14 nt, Shigella flexneri 2a str. 301
acuacguagaucau

SEQ ID NO: 3902548 - RNA, 14 nt, Shigella flexneri 2a str. 301
acuacguucaauca

SEQ ID NO: 3902549 - RNA, 23 nt, Shigella flexneri 2a str. 301
acuacucuauacaggauaauuag

SEQ ID NO: 3902550 - RNA, 19 nt, Shigella flexneri 2a str. 301
acuagacgaugaaaaagaa

SEQ ID NO: 3902551 - RNA, 18 nt, Shigella flexneri 2a str. 301
acuagaugugcaguuccu

SEQ ID NO: 3902552 - RNA, 19 nt, Shigella flexneri 2a str. 301
acuagccugcucccuuauc

SEQ ID NO: 3902553 - RNA, 15 nt, Shigella flexneri 2a str. 301
acuagcucaauaaaa

SEQ ID NO: 3902554 - RNA, 20 nt, Shigella flexneri 2a str. 301
acuagcucaauaaaagaaau

SEQ ID NO: 3902555 - RNA, 14 nt, Shigella flexneri 2a str. 301
acuagugauaacca

SEQ ID NO: 3902556 - RNA, 13 nt, Shigella flexneri 2a str. 301
acuaucaucgccg

SEQ ID NO: 3902557 - RNA, 18 nt, Shigella flexneri 2a str. 301
acuaucauugcgugguuu

SEQ ID NO: 3902558 - RNA, 21 nt, Shigella flexneri 2a str. 301
acuaucauugcgugguuuuug

SEQ ID NO: 3902559 - RNA, 17 nt, Shigella flexneri 2a str. 301
acuauccuggacuuuaa

SEQ ID NO: 3902560 - RNA, 23 nt, Shigella flexneri 2a str. 301
acuaucgaaaguuuaccagccaa

SEQ ID NO: 3902561 - RNA, 23 nt, Shigella flexneri 2a str. 301
acuaucuugcuucugacuauaua

SEQ ID NO: 3902562 - RNA, 19 nt, Shigella flexneri 2a str. 301
acuaugacugccacaaggg

SEQ ID NO: 3902563 - RNA, 15 nt, Shigella flexneri 2a str. 301
acuaugcggaugcca

SEQ ID NO: 3902564 - RNA, 13 nt, Shigella flexneri 2a str. 301
acucucugaagua

SEQ ID NO: 3902565 - RNA, 15 nt, Shigella flexneri 2a str. 301
acucucuuuugcuug

SEQ ID NO: 3902566 - RNA, 21 nt, Shigella flexneri 2a str. 301
acucugaaacucgaccagcag

SEQ ID NO: 3902567 - RNA, 19 nt, Shigella flexneri 2a str. 301
acucugggcugaagaguaa

SEQ ID NO: 3902568 - RNA, 22 nt, Shigella flexneri 2a str. 301
acucuuccugauacaugaauga

SEQ ID NO: 3902569 - RNA, 17 nt, Shigella flexneri 2a str. 301
acucuucguucuucuuc

SEQ ID NO: 3902570 - RNA, 23 nt, Shigella flexneri 2a str. 301
acucuucugaaaaggucacuccc

SEQ ID NO: 3902571 - RNA, 13 nt, Shigella flexneri 2a str. 301
acucuuuauuuca

SEQ ID NO: 3902572 - RNA, 17 nt, Shigella flexneri 2a str. 301
acucuuucaauuuguag

SEQ ID NO: 3902573 - RNA, 19 nt, Shigella flexneri 2a str. 301
acucuuucagcaccagccc

SEQ ID NO: 3902574 - RNA, 12 nt, Shigella flexneri 2a str. 301
acucuuucccgg

SEQ ID NO: 3902575 - RNA, 23 nt, Shigella flexneri 2a str. 301
acucuuucgacggcaucagaaac

SEQ ID NO: 3902576 - RNA, 20 nt, Shigella flexneri 2a str. 301
acucuuugaugaaacaugau

SEQ ID NO: 3902577 - RNA, 12 nt, Shigella flexneri 2a str. 301
acucuuuuuccu

SEQ ID NO: 3902578 - RNA, 13 nt, Shigella flexneri 2a str. 301
acucuuuuuuccg

SEQ ID NO: 3902579 - RNA, 22 nt, Shigella flexneri 2a str. 301
acucuuuuuuccgcuuugugua

SEQ ID NO: 3902580 - RNA, 16 nt, Shigella flexneri 2a str. 301
acugaaacgucaccca

SEQ ID NO: 3902581 - RNA, 13 nt, Shigella flexneri 2a str. 301
acugaaaggcgcu

SEQ ID NO: 3902582 - RNA, 18 nt, Shigella flexneri 2a str. 301
acugaaauuuuaugauaa

SEQ ID NO: 3902583 - RNA, 16 nt, Shigella flexneri 2a str. 301
acugaacaaaaaagag

SEQ ID NO: 3902584 - RNA, 23 nt, Shigella flexneri 2a str. 301
acugaacaaaaaagaguaaaguu

SEQ ID NO: 3902585 - RNA, 20 nt, Shigella flexneri 2a str. 301
acugaaccgcgcaauugcac

SEQ ID NO: 3902586 - RNA, 16 nt, Shigella flexneri 2a str. 301
acugaagcauugccga

SEQ ID NO: 3902587 - RNA, 12 nt, Shigella flexneri 2a str. 301
acugaauacgcu

SEQ ID NO: 3902588 - RNA, 20 nt, Shigella flexneri 2a str. 301
acugaaugacgacguaccag

SEQ ID NO: 3902589 - RNA, 15 nt, Shigella flexneri 2a str. 301
acugaaugaucacuu

SEQ ID NO: 3902590 - RNA, 15 nt, Shigella flexneri 2a str. 301
acugacaaacugcgc

SEQ ID NO: 3902591 - RNA, 19 nt, Shigella flexneri 2a str. 301
acugacaauucaggggcau

SEQ ID NO: 3902592 - RNA, 14 nt, Shigella flexneri 2a str. 301
acugacaauuugcc

SEQ ID NO: 3902593 - RNA, 14 nt, Shigella flexneri 2a str. 301
acugacaucaaacc

SEQ ID NO: 3902594 - RNA, 19 nt, Shigella flexneri 2a str. 301
acugacaucagcauccgca

SEQ ID NO: 3902595 - RNA, 20 nt, Shigella flexneri 2a str. 301
acugacauuacggauuaaau

SEQ ID NO: 3902596 - RNA, 15 nt, Shigella flexneri 2a str. 301
acugaccacaaaggc

SEQ ID NO: 3902597 - RNA, 14 nt, Shigella flexneri 2a str. 301
acugaccaccacca

SEQ ID NO: 3902598 - RNA, 15 nt, Shigella flexneri 2a str. 301
acugaccgaaaccgu

SEQ ID NO: 3902599 - RNA, 18 nt, Shigella flexneri 2a str. 301
acugacgaaucaaauaaa

SEQ ID NO: 3902600 - RNA, 16 nt, Shigella flexneri 2a str. 301
acugacgcgucuuauc

SEQ ID NO: 3902601 - RNA, 21 nt, Shigella flexneri 2a str. 301
acugacggaucccgccaacag

SEQ ID NO: 3902602 - RNA, 14 nt, Shigella flexneri 2a str. 301
acugacuuucguuu

SEQ ID NO: 3902603 - RNA, 16 nt, Shigella flexneri 2a str. 301
acugagagaaaaaaaa

SEQ ID NO: 3902604 - RNA, 14 nt, Shigella flexneri 2a str. 301
acugagauggcuuc

SEQ ID NO: 3902605 - RNA, 14 nt, Shigella flexneri 2a str. 301
acugaggcaauaau

SEQ ID NO: 3902606 - RNA, 14 nt, Shigella flexneri 2a str. 301
acugaggccgccac

SEQ ID NO: 3902607 - RNA, 12 nt, Shigella flexneri 2a str. 301
acugaguugcag

SEQ ID NO: 3902608 - RNA, 15 nt, Shigella flexneri 2a str. 301
acugauaaaccuuca

SEQ ID NO: 3902609 - RNA, 18 nt, Shigella flexneri 2a str. 301
acugauaacgcauuucau

SEQ ID NO: 3902610 - RNA, 18 nt, Shigella flexneri 2a str. 301
acugauaagcugagcaca

SEQ ID NO: 3902611 - RNA, 12 nt, Shigella flexneri 2a str. 301
acugaucaucau

SEQ ID NO: 3902612 - RNA, 15 nt, Shigella flexneri 2a str. 301
acugaucaucgccca

SEQ ID NO: 3902613 - RNA, 14 nt, Shigella flexneri 2a str. 301
acugauccugacaa

SEQ ID NO: 3902614 - RNA, 16 nt, Shigella flexneri 2a str. 301
acugaucgucaucaaa

SEQ ID NO: 3902615 - RNA, 22 nt, Shigella flexneri 2a str. 301
acugaucgucaucaaacggcau

SEQ ID NO: 3902616 - RNA, 15 nt, Shigella flexneri 2a str. 301
acugaugaauaaaua

SEQ ID NO: 3902617 - RNA, 17 nt, Shigella flexneri 2a str. 301
acugaugaauaaauaca

SEQ ID NO: 3902618 - RNA, 19 nt, Shigella flexneri 2a str. 301
acugaugaauaaauacauu

SEQ ID NO: 3902619 - RNA, 22 nt, Shigella flexneri 2a str. 301
acugaugacaaacacaaaacug

SEQ ID NO: 3902620 - RNA, 23 nt, Shigella flexneri 2a str. 301
acugauuaacaggcggcuaugcu

SEQ ID NO: 3902621 - RNA, 13 nt, Shigella flexneri 2a str. 301
acugauugaacug

SEQ ID NO: 3902622 - RNA, 15 nt, Shigella flexneri 2a str. 301
acugauugccacccu

SEQ ID NO: 3902623 - RNA, 14 nt, Shigella flexneri 2a str. 301
acugauuuagcucc

SEQ ID NO: 3902624 - RNA, 15 nt, Shigella flexneri 2a str. 301
acugcaaaaagcagg

SEQ ID NO: 3902625 - RNA, 17 nt, Shigella flexneri 2a str. 301
acugcaaaccaugacgc

SEQ ID NO: 3902626 - RNA, 16 nt, Shigella flexneri 2a str. 301
acugcaaaucaccaca

SEQ ID NO: 3902627 - RNA, 16 nt, Shigella flexneri 2a str. 301
acugcacaccgcggaa

SEQ ID NO: 3902628 - RNA, 19 nt, Shigella flexneri 2a str. 301
acugcacgaugccucauca

SEQ ID NO: 3902629 - RNA, 23 nt, Shigella flexneri 2a str. 301
acugcauaaucgcaacgccuucc

SEQ ID NO: 3902630 - RNA, 23 nt, Shigella flexneri 2a str. 301
acugcauaaugccgguggugacc

SEQ ID NO: 3902631 - RNA, 12 nt, Shigella flexneri 2a str. 301
acugcaucagca

SEQ ID NO: 3902632 - RNA, 16 nt, Shigella flexneri 2a str. 301
acugcaucuuccgugg

SEQ ID NO: 3902633 - RNA, 17 nt, Shigella flexneri 2a str. 301
acugcauucccaucgca

SEQ ID NO: 3902634 - RNA, 16 nt, Shigella flexneri 2a str. 301
acugccacaagggcau

SEQ ID NO: 3902635 - RNA, 20 nt, Shigella flexneri 2a str. 301
acugccacaagggcauauuu

SEQ ID NO: 3902636 - RNA, 23 nt, Shigella flexneri 2a str. 301
acugccaccagcagcguuuugua

SEQ ID NO: 3902637 - RNA, 13 nt, Shigella flexneri 2a str. 301
acugccagaauag

SEQ ID NO: 3902638 - RNA, 14 nt, Shigella flexneri 2a str. 301
acugccaucuuccg

SEQ ID NO: 3902639 - RNA, 23 nt, Shigella flexneri 2a str. 301
acugcccugaucgcuguggaaca

SEQ ID NO: 3902640 - RNA, 19 nt, Shigella flexneri 2a str. 301
acugccggaacugccugcu

SEQ ID NO: 3902641 - RNA, 20 nt, Shigella flexneri 2a str. 301
acugccggaugcggcgugaa

SEQ ID NO: 3902642 - RNA, 16 nt, Shigella flexneri 2a str. 301
acugcgaccgaucacc

SEQ ID NO: 3902643 - RNA, 19 nt, Shigella flexneri 2a str. 301
acugcgaccguacaaccaa

SEQ ID NO: 3902644 - RNA, 13 nt, Shigella flexneri 2a str. 301
acugcgacgcggc

SEQ ID NO: 3902645 - RNA, 17 nt, Shigella flexneri 2a str. 301
acugcgaugggagcagc

SEQ ID NO: 3902646 - RNA, 23 nt, Shigella flexneri 2a str. 301
acugcgaugggagcagccagcca

SEQ ID NO: 3902647 - RNA, 18 nt, Shigella flexneri 2a str. 301
acugcgccacgguguugu

SEQ ID NO: 3902648 - RNA, 15 nt, Shigella flexneri 2a str. 301
acugcgccaucaaug

SEQ ID NO: 3902649 - RNA, 16 nt, Shigella flexneri 2a str. 301
acugcgcccgccagca

SEQ ID NO: 3902650 - RNA, 12 nt, Shigella flexneri 2a str. 301
acugcgccgcuc

SEQ ID NO: 3902651 - RNA, 14 nt, Shigella flexneri 2a str. 301
acugcgccgcucag

SEQ ID NO: 3902652 - RNA, 22 nt, Shigella flexneri 2a str. 301
acugcgcgagcgucauauagcc

SEQ ID NO: 3902653 - RNA, 19 nt, Shigella flexneri 2a str. 301
acugcgcgauuaucauuuu

SEQ ID NO: 3902654 - RNA, 18 nt, Shigella flexneri 2a str. 301
acugcgcgccgcgcugcu

SEQ ID NO: 3902655 - RNA, 13 nt, Shigella flexneri 2a str. 301
acugcgcgcgcca

SEQ ID NO: 3902656 - RNA, 23 nt, Shigella flexneri 2a str. 301
acugcgcgcgccacuuuuugcuc

SEQ ID NO: 3902657 - RNA, 20 nt, Shigella flexneri 2a str. 301
acugcgcguuaaagagcauu

SEQ ID NO: 3902658 - RNA, 23 nt, Shigella flexneri 2a str. 301
acugcgggcgaaaguguaaagca

SEQ ID NO: 3902659 - RNA, 14 nt, Shigella flexneri 2a str. 301
acugcggucuaaau

SEQ ID NO: 3902660 - RNA, 19 nt, Shigella flexneri 2a str. 301
acugcggucuaaaucuucc

SEQ ID NO: 3902661 - RNA, 20 nt, Shigella flexneri 2a str. 301
acugcggucuaaaucuuccg

SEQ ID NO: 3902662 - RNA, 23 nt, Shigella flexneri 2a str. 301
acugcguauuuccugccagaccu

SEQ ID NO: 3902663 - RNA, 20 nt, Shigella flexneri 2a str. 301
acugcgucauuucgaagaaa

SEQ ID NO: 3902664 - RNA, 20 nt, Shigella flexneri 2a str. 301
acuuauucaaucucuucaca

SEQ ID NO: 3902665 - RNA, 12 nt, Shigella flexneri 2a str. 301
acuucaaacaaa

SEQ ID NO: 3902666 - RNA, 13 nt, Shigella flexneri 2a str. 301
acuucaaccacau

SEQ ID NO: 3902667 - RNA, 14 nt, Shigella flexneri 2a str. 301
acuucaaccacauu

SEQ ID NO: 3902668 - RNA, 22 nt, Shigella flexneri 2a str. 301
acuucaacgcaagaacgugccg

SEQ ID NO: 3902669 - RNA, 16 nt, Shigella flexneri 2a str. 301
acuucacacacuuuua

SEQ ID NO: 3902670 - RNA, 16 nt, Shigella flexneri 2a str. 301
acuucacaucaccaua

SEQ ID NO: 3902671 - RNA, 17 nt, Shigella flexneri 2a str. 301
acuucacccaucgccag

SEQ ID NO: 3902672 - RNA, 15 nt, Shigella flexneri 2a str. 301
acuucacggcugcua

SEQ ID NO: 3902673 - RNA, 23 nt, Shigella flexneri 2a str. 301
acuucacggcugcuaauauuuuc

SEQ ID NO: 3902674 - RNA, 13 nt, Shigella flexneri 2a str. 301
acuucacuucuuc

SEQ ID NO: 3902675 - RNA, 14 nt, Shigella flexneri 2a str. 301
acuucacuucuucu

SEQ ID NO: 3902676 - RNA, 16 nt, Shigella flexneri 2a str. 301
acuucauaugcgccag

SEQ ID NO: 3902677 - RNA, 17 nt, Shigella flexneri 2a str. 301
acuucaucacgaugcaa

SEQ ID NO: 3902678 - RNA, 22 nt, Shigella flexneri 2a str. 301
acuucaucacuaccuucuuccc

SEQ ID NO: 3902679 - RNA, 22 nt, Shigella flexneri 2a str. 301
acuucaucauaacccuuuccuu

SEQ ID NO: 3902680 - RNA, 17 nt, Shigella flexneri 2a str. 301
acuucaucaucguugau

SEQ ID NO: 3902681 - RNA, 22 nt, Shigella flexneri 2a str. 301
acuucauccggauacagcccca

SEQ ID NO: 3902682 - RNA, 13 nt, Shigella flexneri 2a str. 301
acuucaucgccca

SEQ ID NO: 3902683 - RNA, 23 nt, Shigella flexneri 2a str. 301
acuucaucggcggugaccagcag

SEQ ID NO: 3902684 - RNA, 11 nt, Shigella flexneri 2a str. 301
acuucaugacc

SEQ ID NO: 3902685 - RNA, 19 nt, Shigella flexneri 2a str. 301
acuucaugaguuccacugg

SEQ ID NO: 3902686 - RNA, 16 nt, Shigella flexneri 2a str. 301
acuucauuaaccacga

SEQ ID NO: 3902687 - RNA, 18 nt, Shigella flexneri 2a str. 301
acuuccaccacuuccugc

SEQ ID NO: 3902688 - RNA, 16 nt, Shigella flexneri 2a str. 301
acuuccaccagcggcu

SEQ ID NO: 3902689 - RNA, 14 nt, Shigella flexneri 2a str. 301
acuuccacgcagau

SEQ ID NO: 3902690 - RNA, 17 nt, Shigella flexneri 2a str. 301
acuuccacguuccccag

SEQ ID NO: 3902691 - RNA, 20 nt, Shigella flexneri 2a str. 301
acuuccagcaguucgcccgc

SEQ ID NO: 3902692 - RNA, 23 nt, Shigella flexneri 2a str. 301
acuuccagcguagugaaggcaaa

SEQ ID NO: 3902693 - RNA, 17 nt, Shigella flexneri 2a str. 301
acuuccaugccuaagcg

SEQ ID NO: 3902694 - RNA, 21 nt, Shigella flexneri 2a str. 301
acuucccucccguuucccugu

SEQ ID NO: 3902695 - RNA, 13 nt, Shigella flexneri 2a str. 301
acuuccgcccauc

SEQ ID NO: 3902696 - RNA, 14 nt, Shigella flexneri 2a str. 301
acuuccgcccaucg

SEQ ID NO: 3902697 - RNA, 15 nt, Shigella flexneri 2a str. 301
acuuccgcccaucgc

SEQ ID NO: 3902698 - RNA, 19 nt, Shigella flexneri 2a str. 301
acuuccggacguucagcca

SEQ ID NO: 3902699 - RNA, 20 nt, Shigella flexneri 2a str. 301
acuuccggacguucagccau

SEQ ID NO: 3902700 - RNA, 16 nt, Shigella flexneri 2a str. 301
acuuccguaccagccu

SEQ ID NO: 3902701 - RNA, 18 nt, Shigella flexneri 2a str. 301
acuuccguaccagccuug

SEQ ID NO: 3902702 - RNA, 21 nt, Shigella flexneri 2a str. 301
acuuccgucccagccuugcca

SEQ ID NO: 3902703 - RNA, 20 nt, Shigella flexneri 2a str. 301
acuuccugagugaauauuua

SEQ ID NO: 3902704 - RNA, 23 nt, Shigella flexneri 2a str. 301
acuuccugcggagcaaccugcac

SEQ ID NO: 3902705 - RNA, 18 nt, Shigella flexneri 2a str. 301
acuuccuuuuuuauuuac

SEQ ID NO: 3902706 - RNA, 23 nt, Shigella flexneri 2a str. 301
acuucgcguucuguggcagggca

SEQ ID NO: 3902707 - RNA, 20 nt, Shigella flexneri 2a str. 301
acuucgcuuacgccugccag

SEQ ID NO: 3902708 - RNA, 18 nt, Shigella flexneri 2a str. 301
acuucggccugcgcgaug

SEQ ID NO: 3902709 - RNA, 12 nt, Shigella flexneri 2a str. 301
acuucucuuucg

SEQ ID NO: 3902710 - RNA, 18 nt, Shigella flexneri 2a str. 301
acuucugccggauauuca

SEQ ID NO: 3902711 - RNA, 13 nt, Shigella flexneri 2a str. 301
acuucugcgucga

SEQ ID NO: 3902712 - RNA, 16 nt, Shigella flexneri 2a str. 301
acuucuguuacuccag

SEQ ID NO: 3902713 - RNA, 22 nt, Shigella flexneri 2a str. 301
acuucuuagucccaaacagcag

SEQ ID NO: 3902714 - RNA, 24 nt, Shigella flexneri 2a str. 301
acuucuuagucccaaacagcagaa

SEQ ID NO: 3902715 - RNA, 11 nt, Shigella flexneri 2a str. 301
acuucuucagc

SEQ ID NO: 3902716 - RNA, 16 nt, Shigella flexneri 2a str. 301
acuucuucauucaucc

SEQ ID NO: 3902717 - RNA, 17 nt, Shigella flexneri 2a str. 301
acuucuuccuugaaaug

SEQ ID NO: 3902718 - RNA, 18 nt, Shigella flexneri 2a str. 301
acuucuuccuugaaaugg

SEQ ID NO: 3902719 - RNA, 22 nt, Shigella flexneri 2a str. 301
acuucuucguagcguuuuuuca

SEQ ID NO: 3902720 - RNA, 18 nt, Shigella flexneri 2a str. 301
acuucuucuucgcugcag

SEQ ID NO: 3902721 - RNA, 16 nt, Shigella flexneri 2a str. 301
acuucuucuuguucau

SEQ ID NO: 3902722 - RNA, 13 nt, Shigella flexneri 2a str. 301
acuugaaaauuau

SEQ ID NO: 3902723 - RNA, 12 nt, Shigella flexneri 2a str. 301
acuugaaccagc

SEQ ID NO: 3902724 - RNA, 17 nt, Shigella flexneri 2a str. 301
acuugcaaucuuuagca

SEQ ID NO: 3902725 - RNA, 16 nt, Shigella flexneri 2a str. 301
acuugcggacccggcg

SEQ ID NO: 3902726 - RNA, 14 nt, Shigella flexneri 2a str. 301
acuugcggcaccca

SEQ ID NO: 3902727 - RNA, 21 nt, Shigella flexneri 2a str. 301
acuugcucaaucgcauggcug

SEQ ID NO: 3902728 - RNA, 22 nt, Shigella flexneri 2a str. 301
acuugggcgauuuuugcagcaa

SEQ ID NO: 3902729 - RNA, 15 nt, Shigella flexneri 2a str. 301
acuuuaagcugaaaa

SEQ ID NO: 3902730 - RNA, 23 nt, Shigella flexneri 2a str. 301
acuuuaaugccacauuagauaaa

SEQ ID NO: 3902731 - RNA, 14 nt, Shigella flexneri 2a str. 301
acuuuaauuuugug

SEQ ID NO: 3902732 - RNA, 19 nt, Shigella flexneri 2a str. 301
acuuuaauuuugugcagca

SEQ ID NO: 3902733 - RNA, 15 nt, Shigella flexneri 2a str. 301
acuuuaauuuuucaa

SEQ ID NO: 3902734 - RNA, 17 nt, Shigella flexneri 2a str. 301
acuuuacucuuuuuugu

SEQ ID NO: 3902735 - RNA, 18 nt, Shigella flexneri 2a str. 301
acuuuagccgguuuuuca

SEQ ID NO: 3902736 - RNA, 16 nt, Shigella flexneri 2a str. 301
acuuuaucugauuuga

SEQ ID NO: 3902737 - RNA, 15 nt, Shigella flexneri 2a str. 301
acuuuaugaaccuga

SEQ ID NO: 3902738 - RNA, 18 nt, Shigella flexneri 2a str. 301
acuuucaaacgccacagc

SEQ ID NO: 3902739 - RNA, 15 nt, Shigella flexneri 2a str. 301
acuuucacgcccaua

SEQ ID NO: 3902740 - RNA, 14 nt, Shigella flexneri 2a str. 301
acuuuccagccaca

SEQ ID NO: 3902741 - RNA, 15 nt, Shigella flexneri 2a str. 301
acuuuccagccacag

SEQ ID NO: 3902742 - RNA, 20 nt, Shigella flexneri 2a str. 301
acuuuccagccacaguucga

SEQ ID NO: 3902743 - RNA, 20 nt, Shigella flexneri 2a str. 301
acuuuccaugccaucugcca

SEQ ID NO: 3902744 - RNA, 20 nt, Shigella flexneri 2a str. 301
acuuuccuuaacuccucgcc

SEQ ID NO: 3902745 - RNA, 23 nt, Shigella flexneri 2a str. 301
acuuucgccugcggcgcaugcau

SEQ ID NO: 3902746 - RNA, 19 nt, Shigella flexneri 2a str. 301
acuuucggcaaccucgccc

SEQ ID NO: 3902747 - RNA, 22 nt, Shigella flexneri 2a str. 301
acuuucggcagaaaauccacca

SEQ ID NO: 3902748 - RNA, 16 nt, Shigella flexneri 2a str. 301
acuuucucuucaucua

SEQ ID NO: 3902749 - RNA, 18 nt, Shigella flexneri 2a str. 301
acuuucucuucaucuaua

SEQ ID NO: 3902750 - RNA, 19 nt, Shigella flexneri 2a str. 301
acuuugacauguugcugac

SEQ ID NO: 3902751 - RNA, 18 nt, Shigella flexneri 2a str. 301
acuuugccgucagccacu

SEQ ID NO: 3902752 - RNA, 11 nt, Shigella flexneri 2a str. 301
acuuugccugg

SEQ ID NO: 3902753 - RNA, 13 nt, Shigella flexneri 2a str. 301
acuuugucaaaaa

SEQ ID NO: 3902754 - RNA, 20 nt, Shigella flexneri 2a str. 301
acuuugugcaauugcucccu

SEQ ID NO: 3902755 - RNA, 18 nt, Shigella flexneri 2a str. 301
acuuuguuagcgaauaaa

SEQ ID NO: 3902756 - RNA, 15 nt, Shigella flexneri 2a str. 301
acuuuguucugaauc

SEQ ID NO: 3902757 - RNA, 17 nt, Shigella flexneri 2a str. 301
acuuuguucugaaucac

SEQ ID NO: 3902758 - RNA, 17 nt, Shigella flexneri 2a str. 301
acuuuuaaaucgccaag

SEQ ID NO: 3902759 - RNA, 16 nt, Shigella flexneri 2a str. 301
acuuuuacagcuuagc

SEQ ID NO: 3902760 - RNA, 13 nt, Shigella flexneri 2a str. 301
acuuuuaccugcu

SEQ ID NO: 3902761 - RNA, 16 nt, Shigella flexneri 2a str. 301
acuuuuacucucugga

SEQ ID NO: 3902762 - RNA, 16 nt, Shigella flexneri 2a str. 301
acuuuuauuaacucag

SEQ ID NO: 3902763 - RNA, 21 nt, Shigella flexneri 2a str. 301
acuuuucaagucucggaaggu

SEQ ID NO: 3902764 - RNA, 22 nt, Shigella flexneri 2a str. 301
agaacugauaacgcauuucaug

SEQ ID NO: 3902765 - RNA, 20 nt, Shigella flexneri 2a str. 301
agaacugcaacucaccuuua

SEQ ID NO: 3902766 - RNA, 15 nt, Shigella flexneri 2a str. 301
agaacugcgccagac

SEQ ID NO: 3902767 - RNA, 19 nt, Shigella flexneri 2a str. 301
agaacuguagacaaaaugu

SEQ ID NO: 3902768 - RNA, 13 nt, Shigella flexneri 2a str. 301
agaacuucugcaa

SEQ ID NO: 3902769 - RNA, 15 nt, Shigella flexneri 2a str. 301
agaacuucugcaacg

SEQ ID NO: 3902770 - RNA, 19 nt, Shigella flexneri 2a str. 301
agaacuuuaucgaucacau

SEQ ID NO: 3902771 - RNA, 20 nt, Shigella flexneri 2a str. 301
agaagaaagcaaugaaauuc

SEQ ID NO: 3902772 - RNA, 14 nt, Shigella flexneri 2a str. 301
agaagaaagccgga

SEQ ID NO: 3902773 - RNA, 20 nt, Shigella flexneri 2a str. 301
agaagagaggcgugccaggu

SEQ ID NO: 3902774 - RNA, 18 nt, Shigella flexneri 2a str. 301
agaagagcggcaaacgua

SEQ ID NO: 3902775 - RNA, 20 nt, Shigella flexneri 2a str. 301
agaagaucguggagaacaau

SEQ ID NO: 3902776 - RNA, 21 nt, Shigella flexneri 2a str. 301
agaagaucguggagaacaaua

SEQ ID NO: 3902777 - RNA, 19 nt, Shigella flexneri 2a str. 301
agaagauuuuuugccagca

SEQ ID NO: 3902778 - RNA, 20 nt, Shigella flexneri 2a str. 301
agaagauuuuuugccagcac

SEQ ID NO: 3902779 - RNA, 22 nt, Shigella flexneri 2a str. 301
agaagcaccguugcccggagca

SEQ ID NO: 3902780 - RNA, 13 nt, Shigella flexneri 2a str. 301
agaagcagcaaca

SEQ ID NO: 3902781 - RNA, 19 nt, Shigella flexneri 2a str. 301
agaagcagcaacacaauca

SEQ ID NO: 3902782 - RNA, 21 nt, Shigella flexneri 2a str. 301
agaagcaugaacauugcugcu

SEQ ID NO: 3902783 - RNA, 13 nt, Shigella flexneri 2a str. 301
agaagcauuuuac

SEQ ID NO: 3902784 - RNA, 23 nt, Shigella flexneri 2a str. 301
agaagccaccgcgccacgaccua

SEQ ID NO: 3902785 - RNA, 19 nt, Shigella flexneri 2a str. 301
agaagccauuaaacaccag

SEQ ID NO: 3902786 - RNA, 21 nt, Shigella flexneri 2a str. 301
agaagccauuaaacaccagua

SEQ ID NO: 3902787 - RNA, 13 nt, Shigella flexneri 2a str. 301
agaagccugcugg

SEQ ID NO: 3902788 - RNA, 18 nt, Shigella flexneri 2a str. 301
agaagccugcuggcccca

SEQ ID NO: 3902789 - RNA, 15 nt, Shigella flexneri 2a str. 301
agaagcgcgugcuaa

SEQ ID NO: 3902790 - RNA, 15 nt, Shigella flexneri 2a str. 301
agaagcggaaaucac

SEQ ID NO: 3902791 - RNA, 16 nt, Shigella flexneri 2a str. 301
agaagcguaaauccca

SEQ ID NO: 3902792 - RNA, 23 nt, Shigella flexneri 2a str. 301
agaagcguagguguuacgcggau

SEQ ID NO: 3902793 - RNA, 20 nt, Shigella flexneri 2a str. 301
agaagcugacgacgaagaaa

SEQ ID NO: 3902794 - RNA, 19 nt, Shigella flexneri 2a str. 301
agaagcugcaggaccauac

SEQ ID NO: 3902795 - RNA, 23 nt, Shigella flexneri 2a str. 301
agaagcugcugccgcuguugcgu

SEQ ID NO: 3902796 - RNA, 12 nt, Shigella flexneri 2a str. 301
agaagcuuaccg

SEQ ID NO: 3902797 - RNA, 14 nt, Shigella flexneri 2a str. 301
agaagcuuuccauc

SEQ ID NO: 3902798 - RNA, 21 nt, Shigella flexneri 2a str. 301
agaagcuuuucucaauauaau

SEQ ID NO: 3902799 - RNA, 14 nt, Shigella flexneri 2a str. 301
agaaggaaaauaca

SEQ ID NO: 3902800 - RNA, 13 nt, Shigella flexneri 2a str. 301
agaagguugccau

SEQ ID NO: 3902801 - RNA, 21 nt, Shigella flexneri 2a str. 301
agaaguaaacgccgagcugga

SEQ ID NO: 3902802 - RNA, 17 nt, Shigella flexneri 2a str. 301
agaaguaacaacuggcu

SEQ ID NO: 3902803 - RNA, 15 nt, Shigella flexneri 2a str. 301
agaagucgaucauau

SEQ ID NO: 3902804 - RNA, 20 nt, Shigella flexneri 2a str. 301
agaaguuccagggcagcagu

SEQ ID NO: 3902805 - RNA, 16 nt, Shigella flexneri 2a str. 301
agaauaaaacaggcag

SEQ ID NO: 3902806 - RNA, 23 nt, Shigella flexneri 2a str. 301
agaauaaaacaggcagcugccag

SEQ ID NO: 3902807 - RNA, 22 nt, Shigella flexneri 2a str. 301
agaauaacggcugauaacaaua

SEQ ID NO: 3902808 - RNA, 17 nt, Shigella flexneri 2a str. 301
agaauaagcgcagcugc

SEQ ID NO: 3902809 - RNA, 23 nt, Shigella flexneri 2a str. 301
agaauaccugccugucacgcagg

SEQ ID NO: 3902810 - RNA, 23 nt, Shigella flexneri 2a str. 301
agaauauacggaaugauauuggu

SEQ ID NO: 3902811 - RNA, 15 nt, Shigella flexneri 2a str. 301
agaauaucuucuguu

SEQ ID NO: 3902812 - RNA, 18 nt, Shigella flexneri 2a str. 301
agaauaugcuuugccuua

SEQ ID NO: 3902813 - RNA, 15 nt, Shigella flexneri 2a str. 301
agaauauugugcuca

SEQ ID NO: 3902814 - RNA, 15 nt, Shigella flexneri 2a str. 301
agaaucaaucucagc

SEQ ID NO: 3902815 - RNA, 16 nt, Shigella flexneri 2a str. 301
agaaucauaaauacaa

SEQ ID NO: 3902816 - RNA, 18 nt, Shigella flexneri 2a str. 301
agaauccaggaaagccau

SEQ ID NO: 3902817 - RNA, 17 nt, Shigella flexneri 2a str. 301
agaaucguaaagaucug

SEQ ID NO: 3902818 - RNA, 16 nt, Shigella flexneri 2a str. 301
agaaugacaacugcau

SEQ ID NO: 3902819 - RNA, 22 nt, Shigella flexneri 2a str. 301
agaaugacaacugcauuuucaa

SEQ ID NO: 3902820 - RNA, 17 nt, Shigella flexneri 2a str. 301
agaaugacaucaucgcc

SEQ ID NO: 3902821 - RNA, 21 nt, Shigella flexneri 2a str. 301
agaaugcgggcgaaaacaucg

SEQ ID NO: 3902822 - RNA, 17 nt, Shigella flexneri 2a str. 301
agaaugcucgcuggcag

SEQ ID NO: 3902823 - RNA, 19 nt, Shigella flexneri 2a str. 301
agaauggcaucagaaggag

SEQ ID NO: 3902824 - RNA, 15 nt, Shigella flexneri 2a str. 301
agaauggcuguaggg

SEQ ID NO: 3902825 - RNA, 17 nt, Shigella flexneri 2a str. 301
agaaugguuucauucca

SEQ ID NO: 3902826 - RNA, 19 nt, Shigella flexneri 2a str. 301
agaauguccauuauuucaa

SEQ ID NO: 3902827 - RNA, 22 nt, Shigella flexneri 2a str. 301
agaauguuaacgccaauuaaug

SEQ ID NO: 3902828 - RNA, 18 nt, Shigella flexneri 2a str. 301
agaauuaaaacagguacu

SEQ ID NO: 3902829 - RNA, 14 nt, Shigella flexneri 2a str. 301
agaauuaacgcuga

SEQ ID NO: 3902830 - RNA, 16 nt, Shigella flexneri 2a str. 301
agaauucacgcacuuc

SEQ ID NO: 3902831 - RNA, 19 nt, Shigella flexneri 2a str. 301
agaauucccccauugaaac

SEQ ID NO: 3902832 - RNA, 15 nt, Shigella flexneri 2a str. 301
agaauugauaaaaaa

SEQ ID NO: 3902833 - RNA, 21 nt, Shigella flexneri 2a str. 301
agaauugcagauaccacauca

SEQ ID NO: 3902834 - RNA, 23 nt, Shigella flexneri 2a str. 301
agaauuuccuucgcuuccuguau

SEQ ID NO: 3902835 - RNA, 20 nt, Shigella flexneri 2a str. 301
agaauuucuuuacugacagg

SEQ ID NO: 3902836 - RNA, 16 nt, Shigella flexneri 2a str. 301
agaauuuguaggccgg

SEQ ID NO: 3902837 - RNA, 13 nt, Shigella flexneri 2a str. 301
agaauuuuucacu

SEQ ID NO: 3902838 - RNA, 20 nt, Shigella flexneri 2a str. 301
agaauuuuucgcuaaaaaau

SEQ ID NO: 3902839 - RNA, 13 nt, Shigella flexneri 2a str. 301
agacaaaauguuc

SEQ ID NO: 3902840 - RNA, 16 nt, Shigella flexneri 2a str. 301
agacaaaauguucguc

SEQ ID NO: 3902841 - RNA, 12 nt, Shigella flexneri 2a str. 301
agacaaaguaac

SEQ ID NO: 3902842 - RNA, 14 nt, Shigella flexneri 2a str. 301
agacaaaugaacac

SEQ ID NO: 3902843 - RNA, 16 nt, Shigella flexneri 2a str. 301
agacaaaugucacugc

SEQ ID NO: 3902844 - RNA, 16 nt, Shigella flexneri 2a str. 301
agacaaauuuugaaca

SEQ ID NO: 3902845 - RNA, 19 nt, Shigella flexneri 2a str. 301
agacaaauuuugaacagaa

SEQ ID NO: 3902846 - RNA, 20 nt, Shigella flexneri 2a str. 301
agacaaauuuugaacagaac

SEQ ID NO: 3902847 - RNA, 21 nt, Shigella flexneri 2a str. 301
agacaacaugagaacaguuca

SEQ ID NO: 3902848 - RNA, 14 nt, Shigella flexneri 2a str. 301
agacaacccacaca

SEQ ID NO: 3902849 - RNA, 16 nt, Shigella flexneri 2a str. 301
agacaacccacacauu

SEQ ID NO: 3902850 - RNA, 13 nt, Shigella flexneri 2a str. 301
agacaacuucccu

SEQ ID NO: 3902851 - RNA, 14 nt, Shigella flexneri 2a str. 301
agacaacuucccug

SEQ ID NO: 3902852 - RNA, 15 nt, Shigella flexneri 2a str. 301
agacaauauaacugc

SEQ ID NO: 3902853 - RNA, 17 nt, Shigella flexneri 2a str. 301
agacaauauaacugcgg

SEQ ID NO: 3902854 - RNA, 13 nt, Shigella flexneri 2a str. 301
agacacauugcgg

SEQ ID NO: 3902855 - RNA, 11 nt, Shigella flexneri 2a str. 301
agacaccagaa

SEQ ID NO: 3902856 - RNA, 17 nt, Shigella flexneri 2a str. 301
agacaccgcccaacaga

SEQ ID NO: 3902857 - RNA, 14 nt, Shigella flexneri 2a str. 301
agacaccgcugcuu

SEQ ID NO: 3902858 - RNA, 18 nt, Shigella flexneri 2a str. 301
agacacgccgccagacca

SEQ ID NO: 3902859 - RNA, 15 nt, Shigella flexneri 2a str. 301
agacagccuaccaga

SEQ ID NO: 3902860 - RNA, 16 nt, Shigella flexneri 2a str. 301
agacagccuaccagac

SEQ ID NO: 3902861 - RNA, 17 nt, Shigella flexneri 2a str. 301
agacagcgucacaucag

SEQ ID NO: 3902862 - RNA, 14 nt, Shigella flexneri 2a str. 301
agacaguucuuccu

SEQ ID NO: 3902863 - RNA, 16 nt, Shigella flexneri 2a str. 301
agacaguucuuccugg

SEQ ID NO: 3902864 - RNA, 18 nt, Shigella flexneri 2a str. 301
agagaaacgccagcagca

SEQ ID NO: 3902865 - RNA, 20 nt, Shigella flexneri 2a str. 301
agagaacaucaauccaaaca

SEQ ID NO: 3902866 - RNA, 13 nt, Shigella flexneri 2a str. 301
agagaaccagcug

SEQ ID NO: 3902867 - RNA, 20 nt, Shigella flexneri 2a str. 301
agagaacuguagacaaaaug

SEQ ID NO: 3902868 - RNA, 17 nt, Shigella flexneri 2a str. 301
agagaagcacguucauc

SEQ ID NO: 3902869 - RNA, 18 nt, Shigella flexneri 2a str. 301
agagaauggggucagcag

SEQ ID NO: 3902870 - RNA, 14 nt, Shigella flexneri 2a str. 301
agagacacaacaau

SEQ ID NO: 3902871 - RNA, 13 nt, Shigella flexneri 2a str. 301
agagacagaauca

SEQ ID NO: 3902872 - RNA, 20 nt, Shigella flexneri 2a str. 301
agagacagccgaaaagguag

SEQ ID NO: 3902873 - RNA, 22 nt, Shigella flexneri 2a str. 301
agagacuauuucuucaucggua

SEQ ID NO: 3902874 - RNA, 21 nt, Shigella flexneri 2a str. 301
agagacuuuuccagccgacca

SEQ ID NO: 3902875 - RNA, 22 nt, Shigella flexneri 2a str. 301
agagacuuuuccagccgaccau

SEQ ID NO: 3902876 - RNA, 22 nt, Shigella flexneri 2a str. 301
agagagcagucagguucagcgu

SEQ ID NO: 3902877 - RNA, 20 nt, Shigella flexneri 2a str. 301
agagagugacgucauagcag

SEQ ID NO: 3902878 - RNA, 15 nt, Shigella flexneri 2a str. 301
agagauagccugauc

SEQ ID NO: 3902879 - RNA, 21 nt, Shigella flexneri 2a str. 301
agagauaguguugguaaauaa

SEQ ID NO: 3902880 - RNA, 20 nt, Shigella flexneri 2a str. 301
agagauccaccacgcuguag

SEQ ID NO: 3902881 - RNA, 13 nt, Shigella flexneri 2a str. 301
agagauccuggcg

SEQ ID NO: 3902882 - RNA, 20 nt, Shigella flexneri 2a str. 301
agagaucuugagaaauuaac

SEQ ID NO: 3902883 - RNA, 18 nt, Shigella flexneri 2a str. 301
agagaucuugcgcgacca

SEQ ID NO: 3902884 - RNA, 18 nt, Shigella flexneri 2a str. 301
agagauuacuuuauuuau

SEQ ID NO: 3902885 - RNA, 17 nt, Shigella flexneri 2a str. 301
agagauuugcuccagcg

SEQ ID NO: 3902886 - RNA, 19 nt, Shigella flexneri 2a str. 301
agagauuuuuccccaccuc

SEQ ID NO: 3902887 - RNA, 12 nt, Shigella flexneri 2a str. 301
agagcaaauaaa

SEQ ID NO: 3902888 - RNA, 13 nt, Shigella flexneri 2a str. 301
agagcaaauaaaa

SEQ ID NO: 3902889 - RNA, 19 nt, Shigella flexneri 2a str. 301
agagcaaauaaaacaucac

SEQ ID NO: 3902890 - RNA, 14 nt, Shigella flexneri 2a str. 301
agagcaacccccuc

SEQ ID NO: 3902891 - RNA, 13 nt, Shigella flexneri 2a str. 301
agagcacaucacu

SEQ ID NO: 3902892 - RNA, 11 nt, Shigella flexneri 2a str. 301
agagcagcacg

SEQ ID NO: 3902893 - RNA, 23 nt, Shigella flexneri 2a str. 301
agagcagcaucaauaacccuggu

SEQ ID NO: 3902894 - RNA, 15 nt, Shigella flexneri 2a str. 301
agagcaucagcagug

SEQ ID NO: 3902895 - RNA, 14 nt, Shigella flexneri 2a str. 301
agagcaucaugaau

SEQ ID NO: 3902896 - RNA, 20 nt, Shigella flexneri 2a str. 301
agagcaugaaaugaaaauca

SEQ ID NO: 3902897 - RNA, 12 nt, Shigella flexneri 2a str. 301
agagcauuacac

SEQ ID NO: 3902898 - RNA, 13 nt, Shigella flexneri 2a str. 301
agagccaccaacu

SEQ ID NO: 3902899 - RNA, 18 nt, Shigella flexneri 2a str. 301
agagccagccccacagca

SEQ ID NO: 3902900 - RNA, 19 nt, Shigella flexneri 2a str. 301
agagccagccccacagcag

SEQ ID NO: 3902901 - RNA, 21 nt, Shigella flexneri 2a str. 301
agagccgcgauaaaaucccau

SEQ ID NO: 3902902 - RNA, 18 nt, Shigella flexneri 2a str. 301
agagccugaauaaacgcc

SEQ ID NO: 3902903 - RNA, 20 nt, Shigella flexneri 2a str. 301
agagcgccucccuuuuucaa

SEQ ID NO: 3902904 - RNA, 14 nt, Shigella flexneri 2a str. 301
agagcggagcaaug

SEQ ID NO: 3902905 - RNA, 15 nt, Shigella flexneri 2a str. 301
agagcgucuggaaga

SEQ ID NO: 3902906 - RNA, 20 nt, Shigella flexneri 2a str. 301
agagcuggaaguuacucaaa

SEQ ID NO: 3902907 - RNA, 20 nt, Shigella flexneri 2a str. 301
agagcuggcgaacgugcagg

SEQ ID NO: 3902908 - RNA, 16 nt, Shigella flexneri 2a str. 301
agagcuugugcaccag

SEQ ID NO: 3902909 - RNA, 17 nt, Shigella flexneri 2a str. 301
agagcuuucauuucaau

SEQ ID NO: 3902910 - RNA, 22 nt, Shigella flexneri 2a str. 301
agagcuuuguugcgcugaagua

SEQ ID NO: 3902911 - RNA, 23 nt, Shigella flexneri 2a str. 301
agagcuuuucagccugaagauca

SEQ ID NO: 3902912 - RNA, 13 nt, Shigella flexneri 2a str. 301
agaggagccauca

SEQ ID NO: 3902913 - RNA, 16 nt, Shigella flexneri 2a str. 301
agaggcgcagaugaag

SEQ ID NO: 3902914 - RNA, 20 nt, Shigella flexneri 2a str. 301
agagggccggggugggggug

SEQ ID NO: 3902915 - RNA, 20 nt, Shigella flexneri 2a str. 301
agagggcgauaaaucuccac

SEQ ID NO: 3902916 - RNA, 21 nt, Shigella flexneri 2a str. 301
agaggguuagggugaggggaa

SEQ ID NO: 3902917 - RNA, 14 nt, Shigella flexneri 2a str. 301
agaggucuuuucuc

SEQ ID NO: 3902918 - RNA, 17 nt, Shigella flexneri 2a str. 301
agagguuauaaauaaaa

SEQ ID NO: 3902919 - RNA, 19 nt, Shigella flexneri 2a str. 301
agagguuauaaauaaaaau

SEQ ID NO: 3902920 - RNA, 15 nt, Shigella flexneri 2a str. 301
agaguacugccggga

SEQ ID NO: 3902921 - RNA, 20 nt, Shigella flexneri 2a str. 301
agagucaugcguuugagugg

SEQ ID NO: 3902922 - RNA, 15 nt, Shigella flexneri 2a str. 301
agagucgacacagau

SEQ ID NO: 3902923 - RNA, 21 nt, Shigella flexneri 2a str. 301
agagugacgucauagcaguac

SEQ ID NO: 3902924 - RNA, 15 nt, Shigella flexneri 2a str. 301
agagugauucuuugu

SEQ ID NO: 3902925 - RNA, 20 nt, Shigella flexneri 2a str. 301
agagugccgaagaacauaaa

SEQ ID NO: 3902926 - RNA, 16 nt, Shigella flexneri 2a str. 301
agaguggaacaauaca

SEQ ID NO: 3902927 - RNA, 20 nt, Shigella flexneri 2a str. 301
agagugguuagagcacagau

SEQ ID NO: 3902928 - RNA, 22 nt, Shigella flexneri 2a str. 301
agagugguuagccggauaaaca

SEQ ID NO: 3902929 - RNA, 23 nt, Shigella flexneri 2a str. 301
agaguucuacuccaguuccggac

SEQ ID NO: 3902930 - RNA, 19 nt, Shigella flexneri 2a str. 301
agaguugaaaaacaugucu

SEQ ID NO: 3902931 - RNA, 14 nt, Shigella flexneri 2a str. 301
agaguugagcaguc

SEQ ID NO: 3902932 - RNA, 16 nt, Shigella flexneri 2a str. 301
agaguugcaccagcaa

SEQ ID NO: 3902933 - RNA, 17 nt, Shigella flexneri 2a str. 301
agauaaaacgacaccac

SEQ ID NO: 3902934 - RNA, 16 nt, Shigella flexneri 2a str. 301
agauaaaauuaacgac

SEQ ID NO: 3902935 - RNA, 12 nt, Shigella flexneri 2a str. 301
agauaaacaacc

SEQ ID NO: 3902936 - RNA, 14 nt, Shigella flexneri 2a str. 301
agauaaaccccuuu

SEQ ID NO: 3902937 - RNA, 17 nt, Shigella flexneri 2a str. 301
agauaaacgaccacucu

SEQ ID NO: 3902938 - RNA, 21 nt, Shigella flexneri 2a str. 301
agauaaacgaccacucuuucg

SEQ ID NO: 3902939 - RNA, 13 nt, Shigella flexneri 2a str. 301
agauaaauuacug

SEQ ID NO: 3902940 - RNA, 19 nt, Shigella flexneri 2a str. 301
agauaaccacguucauuuc

SEQ ID NO: 3902941 - RNA, 23 nt, Shigella flexneri 2a str. 301
agauaaccccgcuugcuguuccu

SEQ ID NO: 3902942 - RNA, 21 nt, Shigella flexneri 2a str. 301
agauaacgccuggcaguggug

SEQ ID NO: 3902943 - RNA, 21 nt, Shigella flexneri 2a str. 301
agauaacuacccaaccgauaa

SEQ ID NO: 3902944 - RNA, 15 nt, Shigella flexneri 2a str. 301
agauaaggcguucac

SEQ ID NO: 3902945 - RNA, 23 nt, Shigella flexneri 2a str. 301
agauaaggcguucacgccgcauc

SEQ ID NO: 3902946 - RNA, 20 nt, Shigella flexneri 2a str. 301
agauaaugcccgaugaccuu

SEQ ID NO: 3902947 - RNA, 22 nt, Shigella flexneri 2a str. 301
agauaauuaugccgaucaucau

SEQ ID NO: 3902948 - RNA, 14 nt, Shigella flexneri 2a str. 301
agauacaggccacc

SEQ ID NO: 3902949 - RNA, 19 nt, Shigella flexneri 2a str. 301
agauacaguuuuugcgcuu

SEQ ID NO: 3902950 - RNA, 15 nt, Shigella flexneri 2a str. 301
agauacaucagcgac

SEQ ID NO: 3902951 - RNA, 15 nt, Shigella flexneri 2a str. 301
agauaccccagcgca

SEQ ID NO: 3902952 - RNA, 21 nt, Shigella flexneri 2a str. 301
agauacccggauacaacucgc

SEQ ID NO: 3902953 - RNA, 15 nt, Shigella flexneri 2a str. 301
agauacgaccguucc

SEQ ID NO: 3902954 - RNA, 19 nt, Shigella flexneri 2a str. 301
agauacgacugauaucugc

SEQ ID NO: 3902955 - RNA, 14 nt, Shigella flexneri 2a str. 301
agauacggcgcauc

SEQ ID NO: 3902956 - RNA, 16 nt, Shigella flexneri 2a str. 301
agauacugaugaacgc

SEQ ID NO: 3902957 - RNA, 14 nt, Shigella flexneri 2a str. 301
agauagaacugcau

SEQ ID NO: 3902958 - RNA, 16 nt, Shigella flexneri 2a str. 301
agauagaaugccaagu

SEQ ID NO: 3902959 - RNA, 20 nt, Shigella flexneri 2a str. 301
agauagaggucauuaggcca

SEQ ID NO: 3902960 - RNA, 17 nt, Shigella flexneri 2a str. 301
agauagcaacagcagcc

SEQ ID NO: 3902961 - RNA, 12 nt, Shigella flexneri 2a str. 301
agauagccagca

SEQ ID NO: 3902962 - RNA, 15 nt, Shigella flexneri 2a str. 301
agauagccagcaaca

SEQ ID NO: 3902963 - RNA, 22 nt, Shigella flexneri 2a str. 301
agauagccagguuuaccagcag

SEQ ID NO: 3902964 - RNA, 21 nt, Shigella flexneri 2a str. 301
agauuggcuucauugauuaac

SEQ ID NO: 3902965 - RNA, 23 nt, Shigella flexneri 2a str. 301
agauuggucaguaagccuuucag

SEQ ID NO: 3902966 - RNA, 18 nt, Shigella flexneri 2a str. 301
agauugucggcagccagu

SEQ ID NO: 3902967 - RNA, 15 nt, Shigella flexneri 2a str. 301
agauuguugacaaag

SEQ ID NO: 3902968 - RNA, 20 nt, Shigella flexneri 2a str. 301
agauuuacuauuauuuuuca

SEQ ID NO: 3902969 - RNA, 15 nt, Shigella flexneri 2a str. 301
agauuuauaaaagaa

SEQ ID NO: 3902970 - RNA, 21 nt, Shigella flexneri 2a str. 301
agauuuccaagcgcggcaggc

SEQ ID NO: 3902971 - RNA, 17 nt, Shigella flexneri 2a str. 301
agauuucccauucuugg

SEQ ID NO: 3902972 - RNA, 18 nt, Shigella flexneri 2a str. 301
agauuuuaccgucaccga

SEQ ID NO: 3902973 - RNA, 11 nt, Shigella flexneri 2a str. 301
agauuuugcuu

SEQ ID NO: 3902974 - RNA, 14 nt, Shigella flexneri 2a str. 301
agauuuuuccccac

SEQ ID NO: 3902975 - RNA, 16 nt, Shigella flexneri 2a str. 301
agcaaaaacgcauacg

SEQ ID NO: 3902976 - RNA, 20 nt, Shigella flexneri 2a str. 301
agcaaaaauaaaugcuugac

SEQ ID NO: 3902977 - RNA, 17 nt, Shigella flexneri 2a str. 301
agcaaaaauaagcgacg

SEQ ID NO: 3902978 - RNA, 16 nt, Shigella flexneri 2a str. 301
agcaaaagugguguug

SEQ ID NO: 3902979 - RNA, 22 nt, Shigella flexneri 2a str. 301
agcaaaagugguguugaagaaa

SEQ ID NO: 3902980 - RNA, 19 nt, Shigella flexneri 2a str. 301
agcaaaauagcuguuuauu

SEQ ID NO: 3902981 - RNA, 12 nt, Shigella flexneri 2a str. 301
agcaaaaucacc

SEQ ID NO: 3902982 - RNA, 14 nt, Shigella flexneri 2a str. 301
agcaaaaucaccau

SEQ ID NO: 3902983 - RNA, 19 nt, Shigella flexneri 2a str. 301
agcaaaaucguaagcagga

SEQ ID NO: 3902984 - RNA, 21 nt, Shigella flexneri 2a str. 301
agcaaacccgaccaccauuuu

SEQ ID NO: 3902985 - RNA, 14 nt, Shigella flexneri 2a str. 301
agcaaacgaaagca

SEQ ID NO: 3902986 - RNA, 22 nt, Shigella flexneri 2a str. 301
agcaaacgaaagcagggcggca

SEQ ID NO: 3902987 - RNA, 15 nt, Shigella flexneri 2a str. 301
agcaaacgauucaaa

SEQ ID NO: 3902988 - RNA, 11 nt, Shigella flexneri 2a str. 301
agcaaacgcag

SEQ ID NO: 3902989 - RNA, 22 nt, Shigella flexneri 2a str. 301
agcaaacuugaacuuaucauca

SEQ ID NO: 3902990 - RNA, 13 nt, Shigella flexneri 2a str. 301
agcaaagcgugca

SEQ ID NO: 3902991 - RNA, 17 nt, Shigella flexneri 2a str. 301
agcaaaggaauggucgg

SEQ ID NO: 3902992 - RNA, 12 nt, Shigella flexneri 2a str. 301
agcaaaggugcc

SEQ ID NO: 3902993 - RNA, 18 nt, Shigella flexneri 2a str. 301
agcaaaguggcgcagagc

SEQ ID NO: 3902994 - RNA, 22 nt, Shigella flexneri 2a str. 301
agcaaauaaaacaucaccaaug

SEQ ID NO: 3902995 - RNA, 16 nt, Shigella flexneri 2a str. 301
agcaaauagauaaaau

SEQ ID NO: 3902996 - RNA, 22 nt, Shigella flexneri 2a str. 301
agcaaaucaaauaauuacuucg

SEQ ID NO: 3902997 - RNA, 16 nt, Shigella flexneri 2a str. 301
agcaaauccaucauau

SEQ ID NO: 3902998 - RNA, 20 nt, Shigella flexneri 2a str. 301
agcaaauccaucauaugcgc

SEQ ID NO: 3902999 - RNA, 17 nt, Shigella flexneri 2a str. 301
agcaaaugaauuacacg

SEQ ID NO: 3903000 - RNA, 20 nt, Shigella flexneri 2a str. 301
agcaaauuaucccccagcac

SEQ ID NO: 3903001 - RNA, 23 nt, Shigella flexneri 2a str. 301
agcaaauugaggaucugcgccug

SEQ ID NO: 3903002 - RNA, 12 nt, Shigella flexneri 2a str. 301
agcaaauuuuua

SEQ ID NO: 3903003 - RNA, 14 nt, Shigella flexneri 2a str. 301
agcaacaaaauggc

SEQ ID NO: 3903004 - RNA, 19 nt, Shigella flexneri 2a str. 301
agcaacaaaauggcaaagc

SEQ ID NO: 3903005 - RNA, 22 nt, Shigella flexneri 2a str. 301
agcaacaaaauggcaaagcgau

SEQ ID NO: 3903006 - RNA, 23 nt, Shigella flexneri 2a str. 301
agcaacaaaauggcaaagcgaua

SEQ ID NO: 3903007 - RNA, 13 nt, Shigella flexneri 2a str. 301
agcaacaaauaac

SEQ ID NO: 3903008 - RNA, 14 nt, Shigella flexneri 2a str. 301
agcaacaaauaacc

SEQ ID NO: 3903009 - RNA, 11 nt, Shigella flexneri 2a str. 301
agcaacaacag

SEQ ID NO: 3903010 - RNA, 19 nt, Shigella flexneri 2a str. 301
agcaacaagccaguccaga

SEQ ID NO: 3903011 - RNA, 22 nt, Shigella flexneri 2a str. 301
agcaacacaaacgaauuaucac

SEQ ID NO: 3903012 - RNA, 19 nt, Shigella flexneri 2a str. 301
agcaacagaguugccacua

SEQ ID NO: 3903013 - RNA, 12 nt, Shigella flexneri 2a str. 301
agcaacaggcca

SEQ ID NO: 3903014 - RNA, 17 nt, Shigella flexneri 2a str. 301
agcaacaggccaguucg

SEQ ID NO: 3903015 - RNA, 13 nt, Shigella flexneri 2a str. 301
agcaacaguaaua

SEQ ID NO: 3903016 - RNA, 20 nt, Shigella flexneri 2a str. 301
agcaacauaaccugaaagcc

SEQ ID NO: 3903017 - RNA, 17 nt, Shigella flexneri 2a str. 301
agcaacaugcggugauu

SEQ ID NO: 3903018 - RNA, 21 nt, Shigella flexneri 2a str. 301
agcaaccaaugccaccaggga

SEQ ID NO: 3903019 - RNA, 14 nt, Shigella flexneri 2a str. 301
agcaaccagguaau

SEQ ID NO: 3903020 - RNA, 18 nt, Shigella flexneri 2a str. 301
agcaaccggcgcggcagc

SEQ ID NO: 3903021 - RNA, 18 nt, Shigella flexneri 2a str. 301
agcaaccgguaaagaaga

SEQ ID NO: 3903022 - RNA, 17 nt, Shigella flexneri 2a str. 301
agcaaccggugucauca

SEQ ID NO: 3903023 - RNA, 22 nt, Shigella flexneri 2a str. 301
agcaaccucgcccauuuuucau

SEQ ID NO: 3903024 - RNA, 16 nt, Shigella flexneri 2a str. 301
agcaaccugcacguua

SEQ ID NO: 3903025 - RNA, 21 nt, Shigella flexneri 2a str. 301
agcaaccugcacguuaucaga

SEQ ID NO: 3903026 - RNA, 13 nt, Shigella flexneri 2a str. 301
agcaaccuuuugc

SEQ ID NO: 3903027 - RNA, 22 nt, Shigella flexneri 2a str. 301
agcaacgagacgguuaaaaaca

SEQ ID NO: 3903028 - RNA, 13 nt, Shigella flexneri 2a str. 301
agcaacgccaaau

SEQ ID NO: 3903029 - RNA, 23 nt, Shigella flexneri 2a str. 301
agcaacgccaaauuuaaacgaca

SEQ ID NO: 3903030 - RNA, 18 nt, Shigella flexneri 2a str. 301
agcaacggcacauccaga

SEQ ID NO: 3903031 - RNA, 17 nt, Shigella flexneri 2a str. 301
agcaacggcgaaucuac

SEQ ID NO: 3903032 - RNA, 21 nt, Shigella flexneri 2a str. 301
agcaacucuuuuuccugcugc

SEQ ID NO: 3903033 - RNA, 17 nt, Shigella flexneri 2a str. 301
agcaacugacugacuuc

SEQ ID NO: 3903034 - RNA, 21 nt, Shigella flexneri 2a str. 301
agcaacugacugacuucaaca

SEQ ID NO: 3903035 - RNA, 16 nt, Shigella flexneri 2a str. 301
agcaacugauuuauag

SEQ ID NO: 3903036 - RNA, 22 nt, Shigella flexneri 2a str. 301
agcaacuuaaucaucaaugcca

SEQ ID NO: 3903037 - RNA, 16 nt, Shigella flexneri 2a str. 301
agcaagacaauguuug

SEQ ID NO: 3903038 - RNA, 23 nt, Shigella flexneri 2a str. 301
agcaagagcaaauaaaacaucac

SEQ ID NO: 3903039 - RNA, 20 nt, Shigella flexneri 2a str. 301
agcaagauaguuaaucaaua

SEQ ID NO: 3903040 - RNA, 15 nt, Shigella flexneri 2a str. 301
agcaagcauuauaua

SEQ ID NO: 3903041 - RNA, 14 nt, Shigella flexneri 2a str. 301
agcaaggccagguu

SEQ ID NO: 3903042 - RNA, 22 nt, Shigella flexneri 2a str. 301
agcaagugcggcgcaccagcag

SEQ ID NO: 3903043 - RNA, 22 nt, Shigella flexneri 2a str. 301
agcaauaaacgguagauaauug

SEQ ID NO: 3903044 - RNA, 21 nt, Shigella flexneri 2a str. 301
agcaauaaucagauggcggcu

SEQ ID NO: 3903045 - RNA, 21 nt, Shigella flexneri 2a str. 301
agcaauaaucucuuuacccag

SEQ ID NO: 3903046 - RNA, 14 nt, Shigella flexneri 2a str. 301
agcaauaaugccag

SEQ ID NO: 3903047 - RNA, 14 nt, Shigella flexneri 2a str. 301
agcaauaccgcgaa

SEQ ID NO: 3903048 - RNA, 19 nt, Shigella flexneri 2a str. 301
agcaauaccgcgaaucaua

SEQ ID NO: 3903049 - RNA, 23 nt, Shigella flexneri 2a str. 301
agcaauagccgccauacggaaaa

SEQ ID NO: 3903050 - RNA, 16 nt, Shigella flexneri 2a str. 301
agcaauccugcaugua

SEQ ID NO: 3903051 - RNA, 22 nt, Shigella flexneri 2a str. 301
agcaaucgaccaggccaucagc

SEQ ID NO: 3903052 - RNA, 22 nt, Shigella flexneri 2a str. 301
agcaaucggcuuuuuaugacgc

SEQ ID NO: 3903053 - RNA, 17 nt, Shigella flexneri 2a str. 301
agcaaucucuucaagcu

SEQ ID NO: 3903054 - RNA, 19 nt, Shigella flexneri 2a str. 301
agcaaucugauugacauca

SEQ ID NO: 3903055 - RNA, 22 nt, Shigella flexneri 2a str. 301
agcaaucugauugacaucauuu

SEQ ID NO: 3903056 - RNA, 19 nt, Shigella flexneri 2a str. 301
agcaaugaucucaauaguu

SEQ ID NO: 3903057 - RNA, 14 nt, Shigella flexneri 2a str. 301
agcaauuaacagug

SEQ ID NO: 3903058 - RNA, 17 nt, Shigella flexneri 2a str. 301
agcaauuaacagugaca

SEQ ID NO: 3903059 - RNA, 22 nt, Shigella flexneri 2a str. 301
agcaauucucucuucagcuucc

SEQ ID NO: 3903060 - RNA, 15 nt, Shigella flexneri 2a str. 301
agcaauuucuccgcc

SEQ ID NO: 3903061 - RNA, 17 nt, Shigella flexneri 2a str. 301
agcaauuuuaguaucca

SEQ ID NO: 3903062 - RNA, 21 nt, Shigella flexneri 2a str. 301
agcaauuuuccuugaaaaaga

SEQ ID NO: 3903063 - RNA, 20 nt, Shigella flexneri 2a str. 301
agcagcggucggcuucccug

SEQ ID NO: 3903064 - RNA, 19 nt, Shigella flexneri 2a str. 301
agcagcgguugagagaaga

SEQ ID NO: 3903065 - RNA, 22 nt, Shigella flexneri 2a str. 301
agcagcguaacggcucacgccc

SEQ ID NO: 3903066 - RNA, 21 nt, Shigella flexneri 2a str. 301
agcagcguaccucuaucuuga

SEQ ID NO: 3903067 - RNA, 23 nt, Shigella flexneri 2a str. 301
agcagcguaccucuaucuugauu

SEQ ID NO: 3903068 - RNA, 17 nt, Shigella flexneri 2a str. 301
agcagcuacuggugccu

SEQ ID NO: 3903069 - RNA, 15 nt, Shigella flexneri 2a str. 301
agcagcugacuucca

SEQ ID NO: 3903070 - RNA, 19 nt, Shigella flexneri 2a str. 301
agcagcugcucccagcgca

SEQ ID NO: 3903071 - RNA, 21 nt, Shigella flexneri 2a str. 301
agcagcugcucccagcgcauu

SEQ ID NO: 3903072 - RNA, 14 nt, Shigella flexneri 2a str. 301
agcagcuguagggu

SEQ ID NO: 3903073 - RNA, 12 nt, Shigella flexneri 2a str. 301
agcagcuuucag

SEQ ID NO: 3903074 - RNA, 16 nt, Shigella flexneri 2a str. 301
agcagcuuucagcagc

SEQ ID NO: 3903075 - RNA, 17 nt, Shigella flexneri 2a str. 301
agcagcuuucagcagcg

SEQ ID NO: 3903076 - RNA, 21 nt, Shigella flexneri 2a str. 301
agcaggaauguuguccagggc

SEQ ID NO: 3903077 - RNA, 13 nt, Shigella flexneri 2a str. 301
agcaggagcagca

SEQ ID NO: 3903078 - RNA, 17 nt, Shigella flexneri 2a str. 301
agcaggagcagcagguu

SEQ ID NO: 3903079 - RNA, 21 nt, Shigella flexneri 2a str. 301
agcaggauguuccggcaaagu

SEQ ID NO: 3903080 - RNA, 17 nt, Shigella flexneri 2a str. 301
agcaggccgucgcgcag

SEQ ID NO: 3903081 - RNA, 18 nt, Shigella flexneri 2a str. 301
agcaggcguuaaaacagg

SEQ ID NO: 3903082 - RNA, 20 nt, Shigella flexneri 2a str. 301
agcaggcguuaaaacagguc

SEQ ID NO: 3903083 - RNA, 14 nt, Shigella flexneri 2a str. 301
agcagggcaaacag

SEQ ID NO: 3903084 - RNA, 17 nt, Shigella flexneri 2a str. 301
agcagggcaaacagcac

SEQ ID NO: 3903085 - RNA, 14 nt, Shigella flexneri 2a str. 301
agcaggguugcagc

SEQ ID NO: 3903086 - RNA, 15 nt, Shigella flexneri 2a str. 301
agcagguaaucugcc

SEQ ID NO: 3903087 - RNA, 16 nt, Shigella flexneri 2a str. 301
agcagguaaucugcca

SEQ ID NO: 3903088 - RNA, 15 nt, Shigella flexneri 2a str. 301
agcagguacuggaaa

SEQ ID NO: 3903089 - RNA, 20 nt, Shigella flexneri 2a str. 301
agcaguaauugcagcagcug

SEQ ID NO: 3903090 - RNA, 22 nt, Shigella flexneri 2a str. 301
agcagucgcaacggcuuuggca

SEQ ID NO: 3903091 - RNA, 17 nt, Shigella flexneri 2a str. 301
agcagugaauacccaga

SEQ ID NO: 3903092 - RNA, 22 nt, Shigella flexneri 2a str. 301
agcagugaauacccagaaucuc

SEQ ID NO: 3903093 - RNA, 18 nt, Shigella flexneri 2a str. 301
agcagugacucacgaauc

SEQ ID NO: 3903094 - RNA, 18 nt, Shigella flexneri 2a str. 301
agcaguguuuccggcauu

SEQ ID NO: 3903095 - RNA, 15 nt, Shigella flexneri 2a str. 301
agcaguuccagcauc

SEQ ID NO: 3903096 - RNA, 22 nt, Shigella flexneri 2a str. 301
agcaguucguaauuaagcccgg

SEQ ID NO: 3903097 - RNA, 15 nt, Shigella flexneri 2a str. 301
agcaguuucaccagc

SEQ ID NO: 3903098 - RNA, 16 nt, Shigella flexneri 2a str. 301
agcaguuucaccagca

SEQ ID NO: 3903099 - RNA, 17 nt, Shigella flexneri 2a str. 301
agcaguuucaccagcag

SEQ ID NO: 3903100 - RNA, 18 nt, Shigella flexneri 2a str. 301
agcaguuucaccagcagu

SEQ ID NO: 3903101 - RNA, 20 nt, Shigella flexneri 2a str. 301
agcaguuuccgcgccggcuc

SEQ ID NO: 3903102 - RNA, 20 nt, Shigella flexneri 2a str. 301
agcaguuuuuccccugccag

SEQ ID NO: 3903103 - RNA, 22 nt, Shigella flexneri 2a str. 301
agcaguuuuuccccugccagau

SEQ ID NO: 3903104 - RNA, 13 nt, Shigella flexneri 2a str. 301
agcauaaaaguua

SEQ ID NO: 3903105 - RNA, 16 nt, Shigella flexneri 2a str. 301
agcauaauaagcuuuu

SEQ ID NO: 3903106 - RNA, 21 nt, Shigella flexneri 2a str. 301
agcauaaucaccaucagcagc

SEQ ID NO: 3903107 - RNA, 20 nt, Shigella flexneri 2a str. 301
agcauaccggacgacggcau

SEQ ID NO: 3903108 - RNA, 15 nt, Shigella flexneri 2a str. 301
agcauacgaaucgcc

SEQ ID NO: 3903109 - RNA, 18 nt, Shigella flexneri 2a str. 301
agcauagccccagcgcag

SEQ ID NO: 3903110 - RNA, 15 nt, Shigella flexneri 2a str. 301
agcauaggcauuaaa

SEQ ID NO: 3903111 - RNA, 17 nt, Shigella flexneri 2a str. 301
agcauaggcauuaaaca

SEQ ID NO: 3903112 - RNA, 18 nt, Shigella flexneri 2a str. 301
agcauaggcauuaaacau

SEQ ID NO: 3903113 - RNA, 19 nt, Shigella flexneri 2a str. 301
agcauauaggaggccucgg

SEQ ID NO: 3903114 - RNA, 15 nt, Shigella flexneri 2a str. 301
agcaucaaacuuuua

SEQ ID NO: 3903115 - RNA, 21 nt, Shigella flexneri 2a str. 301
agcaucaacaacaauuucacu

SEQ ID NO: 3903116 - RNA, 21 nt, Shigella flexneri 2a str. 301
agcaucaacccgcucauaaua

SEQ ID NO: 3903117 - RNA, 12 nt, Shigella flexneri 2a str. 301
agcaucaaugac

SEQ ID NO: 3903118 - RNA, 20 nt, Shigella flexneri 2a str. 301
agcaucaaugaccugacuuc

SEQ ID NO: 3903119 - RNA, 14 nt, Shigella flexneri 2a str. 301
agcaucaauugcua

SEQ ID NO: 3903120 - RNA, 15 nt, Shigella flexneri 2a str. 301
agcaucagacugaaa

SEQ ID NO: 3903121 - RNA, 16 nt, Shigella flexneri 2a str. 301
agcaucagcgccacca

SEQ ID NO: 3903122 - RNA, 20 nt, Shigella flexneri 2a str. 301
agcaucauaguggguuucug

SEQ ID NO: 3903123 - RNA, 22 nt, Shigella flexneri 2a str. 301
agcaucauaguggguuucugcc

SEQ ID NO: 3903124 - RNA, 14 nt, Shigella flexneri 2a str. 301
agcauccaacugau

SEQ ID NO: 3903125 - RNA, 16 nt, Shigella flexneri 2a str. 301
agcaucccaccugaaa

SEQ ID NO: 3903126 - RNA, 22 nt, Shigella flexneri 2a str. 301
agcauccccggcaaccacaccc

SEQ ID NO: 3903127 - RNA, 12 nt, Shigella flexneri 2a str. 301
agcauccggcag

SEQ ID NO: 3903128 - RNA, 19 nt, Shigella flexneri 2a str. 301
agcaucgcccaggcgacca

SEQ ID NO: 3903129 - RNA, 18 nt, Shigella flexneri 2a str. 301
agcaucggugaggaucac

SEQ ID NO: 3903130 - RNA, 15 nt, Shigella flexneri 2a str. 301
agcaucguccgccag

SEQ ID NO: 3903131 - RNA, 21 nt, Shigella flexneri 2a str. 301
agcaucguuguuacaacauca

SEQ ID NO: 3903132 - RNA, 22 nt, Shigella flexneri 2a str. 301
agcaucuacucguuuauuaugc

SEQ ID NO: 3903133 - RNA, 16 nt, Shigella flexneri 2a str. 301
agcaucucauccauca

SEQ ID NO: 3903134 - RNA, 19 nt, Shigella flexneri 2a str. 301
agcaucucauccaucaaau

SEQ ID NO: 3903135 - RNA, 18 nt, Shigella flexneri 2a str. 301
agcaucucuacagcgccc

SEQ ID NO: 3903136 - RNA, 17 nt, Shigella flexneri 2a str. 301
agcaucugcaaaauuuc

SEQ ID NO: 3903137 - RNA, 13 nt, Shigella flexneri 2a str. 301
agcaucuggauga

SEQ ID NO: 3903138 - RNA, 18 nt, Shigella flexneri 2a str. 301
agcaugaacauugcugcu

SEQ ID NO: 3903139 - RNA, 18 nt, Shigella flexneri 2a str. 301
agcaugacuaccggggac

SEQ ID NO: 3903140 - RNA, 14 nt, Shigella flexneri 2a str. 301
agcaugauauucac

SEQ ID NO: 3903141 - RNA, 15 nt, Shigella flexneri 2a str. 301
agcaugaucagcgca

SEQ ID NO: 3903142 - RNA, 16 nt, Shigella flexneri 2a str. 301
agcaugaugccugaug

SEQ ID NO: 3903143 - RNA, 21 nt, Shigella flexneri 2a str. 301
agcaugauuucauaacugaug

SEQ ID NO: 3903144 - RNA, 14 nt, Shigella flexneri 2a str. 301
agcaugcacccuca

SEQ ID NO: 3903145 - RNA, 13 nt, Shigella flexneri 2a str. 301
agcaugcauaaca

SEQ ID NO: 3903146 - RNA, 17 nt, Shigella flexneri 2a str. 301
agcaugcauaacagaua

SEQ ID NO: 3903147 - RNA, 16 nt, Shigella flexneri 2a str. 301
agcaugcaucccgccg

SEQ ID NO: 3903148 - RNA, 14 nt, Shigella flexneri 2a str. 301
agcauggcuucuuc

SEQ ID NO: 3903149 - RNA, 18 nt, Shigella flexneri 2a str. 301
agcaugggugaacugcuu

SEQ ID NO: 3903150 - RNA, 18 nt, Shigella flexneri 2a str. 301
agcauguguaaccgcuuu

SEQ ID NO: 3903151 - RNA, 14 nt, Shigella flexneri 2a str. 301
agcauuacacgcgg

SEQ ID NO: 3903152 - RNA, 19 nt, Shigella flexneri 2a str. 301
agcauuauauaaugccagg

SEQ ID NO: 3903153 - RNA, 15 nt, Shigella flexneri 2a str. 301
agcauuauuuuuaaa

SEQ ID NO: 3903154 - RNA, 18 nt, Shigella flexneri 2a str. 301
agcauuauuuuuaaacau

SEQ ID NO: 3903155 - RNA, 20 nt, Shigella flexneri 2a str. 301
agcauuauuuuuaaacauca

SEQ ID NO: 3903156 - RNA, 13 nt, Shigella flexneri 2a str. 301
agcauucaguuac

SEQ ID NO: 3903157 - RNA, 14 nt, Shigella flexneri 2a str. 301
agcauucgccgcau

SEQ ID NO: 3903158 - RNA, 20 nt, Shigella flexneri 2a str. 301
agcauucgcgcacaggcugc

SEQ ID NO: 3903159 - RNA, 17 nt, Shigella flexneri 2a str. 301
agcauuggcaugcacgu

SEQ ID NO: 3903160 - RNA, 19 nt, Shigella flexneri 2a str. 301
agcauuucgcgauauugcu

SEQ ID NO: 3903161 - RNA, 18 nt, Shigella flexneri 2a str. 301
agcauuucuuccagcguu

SEQ ID NO: 3903162 - RNA, 16 nt, Shigella flexneri 2a str. 301
agcauuugcaccuuuu

SEQ ID NO: 3903163 - RNA, 14 nt, Shigella flexneri 2a str. 301
agccccaccagcaa

SEQ ID NO: 3903164 - RNA, 16 nt, Shigella flexneri 2a str. 301
agccccagcacuucgc

SEQ ID NO: 3903165 - RNA, 12 nt, Shigella flexneri 2a str. 301
agccccaguucc

SEQ ID NO: 3903166 - RNA, 22 nt, Shigella flexneri 2a str. 301
agccccgcgaacggggcugcca

SEQ ID NO: 3903167 - RNA, 21 nt, Shigella flexneri 2a str. 301
agccccgcuuuuuucagcgcc

SEQ ID NO: 3903168 - RNA, 13 nt, Shigella flexneri 2a str. 301
agccccguagcca

SEQ ID NO: 3903169 - RNA, 23 nt, Shigella flexneri 2a str. 301
agcccgaaucaguaaugauucgg

SEQ ID NO: 3903170 - RNA, 22 nt, Shigella flexneri 2a str. 301
agcccgccaaccaccgccagua

SEQ ID NO: 3903171 - RNA, 19 nt, Shigella flexneri 2a str. 301
agcccgccaucgcccaucc

SEQ ID NO: 3903172 - RNA, 22 nt, Shigella flexneri 2a str. 301
agcccgccuuugaucucaaacg

SEQ ID NO: 3903173 - RNA, 22 nt, Shigella flexneri 2a str. 301
agcccgcgcgaugagccgcugg

SEQ ID NO: 3903174 - RNA, 22 nt, Shigella flexneri 2a str. 301
agcccgcugccgcagauauucc

SEQ ID NO: 3903175 - RNA, 16 nt, Shigella flexneri 2a str. 301
agcccgguagcaugaa

SEQ ID NO: 3903176 - RNA, 17 nt, Shigella flexneri 2a str. 301
agcccguaacucacuga

SEQ ID NO: 3903177 - RNA, 18 nt, Shigella flexneri 2a str. 301
agcccgugcauaggcggc

SEQ ID NO: 3903178 - RNA, 16 nt, Shigella flexneri 2a str. 301
agcccguguuucugau

SEQ ID NO: 3903179 - RNA, 20 nt, Shigella flexneri 2a str. 301
agcccguguuucugauacag

SEQ ID NO: 3903180 - RNA, 18 nt, Shigella flexneri 2a str. 301
agcccucaccgaagcgag

SEQ ID NO: 3903181 - RNA, 19 nt, Shigella flexneri 2a str. 301
agcccucaccgaagcgagg

SEQ ID NO: 3903182 - RNA, 17 nt, Shigella flexneri 2a str. 301
agcccucauuccucccc

SEQ ID NO: 3903183 - RNA, 16 nt, Shigella flexneri 2a str. 301
agcccucgacauguuc

SEQ ID NO: 3903184 - RNA, 12 nt, Shigella flexneri 2a str. 301
agcccuucacgc

SEQ ID NO: 3903185 - RNA, 20 nt, Shigella flexneri 2a str. 301
agcccuucguaggccagaua

SEQ ID NO: 3903186 - RNA, 22 nt, Shigella flexneri 2a str. 301
agcccuucguaggccagauaag

SEQ ID NO: 3903187 - RNA, 11 nt, Shigella flexneri 2a str. 301
agcccuucuuu

SEQ ID NO: 3903188 - RNA, 16 nt, Shigella flexneri 2a str. 301
agcccuugccgaugcg

SEQ ID NO: 3903189 - RNA, 20 nt, Shigella flexneri 2a str. 301
agcccuuuaauggcuuucau

SEQ ID NO: 3903190 - RNA, 12 nt, Shigella flexneri 2a str. 301
agcccuuucuuu

SEQ ID NO: 3903191 - RNA, 20 nt, Shigella flexneri 2a str. 301
agcccuuuguaggccagaua

SEQ ID NO: 3903192 - RNA, 22 nt, Shigella flexneri 2a str. 301
agccgaaauauggcucugcggc

SEQ ID NO: 3903193 - RNA, 19 nt, Shigella flexneri 2a str. 301
agccgaacuuugcacccca

SEQ ID NO: 3903194 - RNA, 17 nt, Shigella flexneri 2a str. 301
agccgacaaugccacaa

SEQ ID NO: 3903195 - RNA, 14 nt, Shigella flexneri 2a str. 301
agccgaccgcaagg

SEQ ID NO: 3903196 - RNA, 15 nt, Shigella flexneri 2a str. 301
agccgaugccgcugc

SEQ ID NO: 3903197 - RNA, 12 nt, Shigella flexneri 2a str. 301
agccgauuaaaa

SEQ ID NO: 3903198 - RNA, 20 nt, Shigella flexneri 2a str. 301
agccgauuaaaaucagaauc

SEQ ID NO: 3903199 - RNA, 13 nt, Shigella flexneri 2a str. 301
agccgcaaaccug

SEQ ID NO: 3903200 - RNA, 22 nt, Shigella flexneri 2a str. 301
agccgcaccaccgcauccgggc

SEQ ID NO: 3903201 - RNA, 13 nt, Shigella flexneri 2a str. 301
agccgcacgcugg

SEQ ID NO: 3903202 - RNA, 17 nt, Shigella flexneri 2a str. 301
agccgcagccaucagcg

SEQ ID NO: 3903203 - RNA, 14 nt, Shigella flexneri 2a str. 301
agccgccacgaccu

SEQ ID NO: 3903204 - RNA, 14 nt, Shigella flexneri 2a str. 301
agccgccagacaau

SEQ ID NO: 3903205 - RNA, 14 nt, Shigella flexneri 2a str. 301
agccgccagcucuu

SEQ ID NO: 3903206 - RNA, 14 nt, Shigella flexneri 2a str. 301
agccgccaucucuu

SEQ ID NO: 3903207 - RNA, 15 nt, Shigella flexneri 2a str. 301
agccgccaucucuuc

SEQ ID NO: 3903208 - RNA, 22 nt, Shigella flexneri 2a str. 301
agccgccgcuaucggcaaggaa

SEQ ID NO: 3903209 - RNA, 22 nt, Shigella flexneri 2a str. 301
agccgccguuaauuucauguaa

SEQ ID NO: 3903210 - RNA, 19 nt, Shigella flexneri 2a str. 301
agccgcgagaauaugcuga

SEQ ID NO: 3903211 - RNA, 17 nt, Shigella flexneri 2a str. 301
agccgcgccgagcggga

SEQ ID NO: 3903212 - RNA, 23 nt, Shigella flexneri 2a str. 301
agccgcgcuuucuucuucgcgac

SEQ ID NO: 3903213 - RNA, 14 nt, Shigella flexneri 2a str. 301
agccgcuaccagcg

SEQ ID NO: 3903214 - RNA, 23 nt, Shigella flexneri 2a str. 301
agccgcuuggcaagcccagcacc

SEQ ID NO: 3903215 - RNA, 21 nt, Shigella flexneri 2a str. 301
agccggaaaaccaccacuccc

SEQ ID NO: 3903216 - RNA, 14 nt, Shigella flexneri 2a str. 301
agccggacccacac

SEQ ID NO: 3903217 - RNA, 15 nt, Shigella flexneri 2a str. 301
agccggacccacacc

SEQ ID NO: 3903218 - RNA, 16 nt, Shigella flexneri 2a str. 301
agccggaccucuuucu

SEQ ID NO: 3903219 - RNA, 20 nt, Shigella flexneri 2a str. 301
agccggagaaauaccacccg

SEQ ID NO: 3903220 - RNA, 14 nt, Shigella flexneri 2a str. 301
agccggagcuucac

SEQ ID NO: 3903221 - RNA, 17 nt, Shigella flexneri 2a str. 301
agccggaguugcagauu

SEQ ID NO: 3903222 - RNA, 17 nt, Shigella flexneri 2a str. 301
agccggauaaacaaugu

SEQ ID NO: 3903223 - RNA, 15 nt, Shigella flexneri 2a str. 301
agccggaugccucuc

SEQ ID NO: 3903224 - RNA, 16 nt, Shigella flexneri 2a str. 301
agccggaugucuggaa

SEQ ID NO: 3903225 - RNA, 17 nt, Shigella flexneri 2a str. 301
agccgggaugaaaggca

SEQ ID NO: 3903226 - RNA, 23 nt, Shigella flexneri 2a str. 301
agccgguugccugaugcgacgcu

SEQ ID NO: 3903227 - RNA, 22 nt, Shigella flexneri 2a str. 301
agccgguuucacuauuaccgau

SEQ ID NO: 3903228 - RNA, 12 nt, Shigella flexneri 2a str. 301
agccgguuuugg

SEQ ID NO: 3903229 - RNA, 21 nt, Shigella flexneri 2a str. 301
agccgguuuugguuuucuguc

SEQ ID NO: 3903230 - RNA, 12 nt, Shigella flexneri 2a str. 301
agccguacugca

SEQ ID NO: 3903231 - RNA, 19 nt, Shigella flexneri 2a str. 301
agccguacugcauaaugcc

SEQ ID NO: 3903232 - RNA, 16 nt, Shigella flexneri 2a str. 301
agccgucaccgccugc

SEQ ID NO: 3903233 - RNA, 22 nt, Shigella flexneri 2a str. 301
agccgugaaaacagcaaccucc

SEQ ID NO: 3903234 - RNA, 16 nt, Shigella flexneri 2a str. 301
agccgugaaucacucc

SEQ ID NO: 3903235 - RNA, 19 nt, Shigella flexneri 2a str. 301
agccguuaccgauuucacg

SEQ ID NO: 3903236 - RNA, 23 nt, Shigella flexneri 2a str. 301
agccguuucgaauuacacagcca

SEQ ID NO: 3903237 - RNA, 22 nt, Shigella flexneri 2a str. 301
agccuaagaagucauuggcuga

SEQ ID NO: 3903238 - RNA, 18 nt, Shigella flexneri 2a str. 301
agccuaagccauuuaacu

SEQ ID NO: 3903239 - RNA, 23 nt, Shigella flexneri 2a str. 301
agccuaagccauuuaacucaccg

SEQ ID NO: 3903240 - RNA, 14 nt, Shigella flexneri 2a str. 301
agccuacaaaaacu

SEQ ID NO: 3903241 - RNA, 14 nt, Shigella flexneri 2a str. 301
agccuauaacgaaa

SEQ ID NO: 3903242 - RNA, 14 nt, Shigella flexneri 2a str. 301
agccucccauuucc

SEQ ID NO: 3903243 - RNA, 13 nt, Shigella flexneri 2a str. 301
agccucgccgagc

SEQ ID NO: 3903244 - RNA, 19 nt, Shigella flexneri 2a str. 301
agccucuacccgucaccgu

SEQ ID NO: 3903245 - RNA, 22 nt, Shigella flexneri 2a str. 301
agccucuuuuuucagugcaccg

SEQ ID NO: 3903246 - RNA, 21 nt, Shigella flexneri 2a str. 301
agccugacgcccguuuucacc

SEQ ID NO: 3903247 - RNA, 17 nt, Shigella flexneri 2a str. 301
agccugauaagacgcga

SEQ ID NO: 3903248 - RNA, 18 nt, Shigella flexneri 2a str. 301
agccugauacaggaaggc

SEQ ID NO: 3903249 - RNA, 19 nt, Shigella flexneri 2a str. 301
agccugauacaggaaggcc

SEQ ID NO: 3903250 - RNA, 15 nt, Shigella flexneri 2a str. 301
agccugcaaacgcug

SEQ ID NO: 3903251 - RNA, 19 nt, Shigella flexneri 2a str. 301
agccugcagugaaauuaaa

SEQ ID NO: 3903252 - RNA, 12 nt, Shigella flexneri 2a str. 301
agccugccagag

SEQ ID NO: 3903253 - RNA, 19 nt, Shigella flexneri 2a str. 301
agccugccagaggagccau

SEQ ID NO: 3903254 - RNA, 14 nt, Shigella flexneri 2a str. 301
agccugccagcaug

SEQ ID NO: 3903255 - RNA, 19 nt, Shigella flexneri 2a str. 301
agccugccagcaugcauaa

SEQ ID NO: 3903256 - RNA, 14 nt, Shigella flexneri 2a str. 301
agccugcgcuucuu

SEQ ID NO: 3903257 - RNA, 14 nt, Shigella flexneri 2a str. 301
agccugcucaguug

SEQ ID NO: 3903258 - RNA, 12 nt, Shigella flexneri 2a str. 301
agccugcucccu

SEQ ID NO: 3903259 - RNA, 18 nt, Shigella flexneri 2a str. 301
agccugcuucaaacgcug

SEQ ID NO: 3903260 - RNA, 20 nt, Shigella flexneri 2a str. 301
agccuguaccacaaccugca

SEQ ID NO: 3903261 - RNA, 16 nt, Shigella flexneri 2a str. 301
agccuguccacaccca

SEQ ID NO: 3903262 - RNA, 23 nt, Shigella flexneri 2a str. 301
agccugugcggugacguugucau

SEQ ID NO: 3903263 - RNA, 20 nt, Shigella flexneri 2a str. 301
agcgccgcaacuaccagcag

SEQ ID NO: 3903264 - RNA, 14 nt, Shigella flexneri 2a str. 301
agcgccgccacugc

SEQ ID NO: 3903265 - RNA, 23 nt, Shigella flexneri 2a str. 301
agcgccgccagaaucaccucuuu

SEQ ID NO: 3903266 - RNA, 17 nt, Shigella flexneri 2a str. 301
agcgccgcuuuccaggc

SEQ ID NO: 3903267 - RNA, 20 nt, Shigella flexneri 2a str. 301
agcgccgcuuuuugugcgga

SEQ ID NO: 3903268 - RNA, 22 nt, Shigella flexneri 2a str. 301
agcgccgggaaugccacgcaaa

SEQ ID NO: 3903269 - RNA, 21 nt, Shigella flexneri 2a str. 301
agcgccgucuuccccucgaaa

SEQ ID NO: 3903270 - RNA, 19 nt, Shigella flexneri 2a str. 301
agcgccguugcgcccauca

SEQ ID NO: 3903271 - RNA, 20 nt, Shigella flexneri 2a str. 301
agcgccguuuuuuugacggu

SEQ ID NO: 3903272 - RNA, 16 nt, Shigella flexneri 2a str. 301
agcgccucaagcucgc

SEQ ID NO: 3903273 - RNA, 23 nt, Shigella flexneri 2a str. 301
agcgccucggggccacagguaua

SEQ ID NO: 3903274 - RNA, 17 nt, Shigella flexneri 2a str. 301
agcgccugauacagcca

SEQ ID NO: 3903275 - RNA, 14 nt, Shigella flexneri 2a str. 301
agcgccugcugcug

SEQ ID NO: 3903276 - RNA, 20 nt, Shigella flexneri 2a str. 301
agcgccuucuacagcuucac

SEQ ID NO: 3903277 - RNA, 20 nt, Shigella flexneri 2a str. 301
agcgcgcccaacaguagaca

SEQ ID NO: 3903278 - RNA, 20 nt, Shigella flexneri 2a str. 301
agcgcgcgaauauggcggcg

SEQ ID NO: 3903279 - RNA, 15 nt, Shigella flexneri 2a str. 301
agcgcgcgcagcacg

SEQ ID NO: 3903280 - RNA, 19 nt, Shigella flexneri 2a str. 301
agcgcgcgcagcacgguac

SEQ ID NO: 3903281 - RNA, 14 nt, Shigella flexneri 2a str. 301
agcgcgcgccgcca

SEQ ID NO: 3903282 - RNA, 15 nt, Shigella flexneri 2a str. 301
agcgcggcgcaggca

SEQ ID NO: 3903283 - RNA, 17 nt, Shigella flexneri 2a str. 301
agcgcggcgcaggcaau

SEQ ID NO: 3903284 - RNA, 16 nt, Shigella flexneri 2a str. 301
agcgcggggaucacug

SEQ ID NO: 3903285 - RNA, 19 nt, Shigella flexneri 2a str. 301
agcgcggggaucacuggca

SEQ ID NO: 3903286 - RNA, 16 nt, Shigella flexneri 2a str. 301
agcgcggugacgcaca

SEQ ID NO: 3903287 - RNA, 13 nt, Shigella flexneri 2a str. 301
agcgcguucuguu

SEQ ID NO: 3903288 - RNA, 22 nt, Shigella flexneri 2a str. 301
agcgcguucuguucaaaugcgc

SEQ ID NO: 3903289 - RNA, 13 nt, Shigella flexneri 2a str. 301
agcgcguugcgcc

SEQ ID NO: 3903290 - RNA, 20 nt, Shigella flexneri 2a str. 301
agcgcguuuuauaacggcug

SEQ ID NO: 3903291 - RNA, 21 nt, Shigella flexneri 2a str. 301
agcgcuaauacgaugcaaccg

SEQ ID NO: 3903292 - RNA, 14 nt, Shigella flexneri 2a str. 301
agcgcuaccgccga

SEQ ID NO: 3903293 - RNA, 19 nt, Shigella flexneri 2a str. 301
agcgcuaguccgggcauaa

SEQ ID NO: 3903294 - RNA, 18 nt, Shigella flexneri 2a str. 301
agcgcugaagaaaauggc

SEQ ID NO: 3903295 - RNA, 20 nt, Shigella flexneri 2a str. 301
agcgcugaagaaaauggcca

SEQ ID NO: 3903296 - RNA, 14 nt, Shigella flexneri 2a str. 301
agcgcugcaaacca

SEQ ID NO: 3903297 - RNA, 19 nt, Shigella flexneri 2a str. 301
agcgcugcugcacauacug

SEQ ID NO: 3903298 - RNA, 23 nt, Shigella flexneri 2a str. 301
agcgcugcugcacauacugcauc

SEQ ID NO: 3903299 - RNA, 22 nt, Shigella flexneri 2a str. 301
agcgcuggugacaucgccagag

SEQ ID NO: 3903300 - RNA, 23 nt, Shigella flexneri 2a str. 301
agcgcuggugacaucgccagaga

SEQ ID NO: 3903301 - RNA, 15 nt, Shigella flexneri 2a str. 301
agcgcuucacuauga

SEQ ID NO: 3903302 - RNA, 15 nt, Shigella flexneri 2a str. 301
agcgcuuuuggcgcg

SEQ ID NO: 3903303 - RNA, 14 nt, Shigella flexneri 2a str. 301
agcgcuuuuuuccu

SEQ ID NO: 3903304 - RNA, 15 nt, Shigella flexneri 2a str. 301
agcgcuuuuuuccug

SEQ ID NO: 3903305 - RNA, 17 nt, Shigella flexneri 2a str. 301
agcgcuuuuuuccugcc

SEQ ID NO: 3903306 - RNA, 20 nt, Shigella flexneri 2a str. 301
agcggaaacguaacguacug

SEQ ID NO: 3903307 - RNA, 13 nt, Shigella flexneri 2a str. 301
agcggaaaucacg

SEQ ID NO: 3903308 - RNA, 12 nt, Shigella flexneri 2a str. 301
agcggaaaucuc

SEQ ID NO: 3903309 - RNA, 15 nt, Shigella flexneri 2a str. 301
agcggaaaucuccag

SEQ ID NO: 3903310 - RNA, 17 nt, Shigella flexneri 2a str. 301
agcggaaaucuccagau

SEQ ID NO: 3903311 - RNA, 15 nt, Shigella flexneri 2a str. 301
agcggacacuaccau

SEQ ID NO: 3903312 - RNA, 21 nt, Shigella flexneri 2a str. 301
agcggacucaccgagcagcac

SEQ ID NO: 3903313 - RNA, 14 nt, Shigella flexneri 2a str. 301
agcggagguaauaa

SEQ ID NO: 3903314 - RNA, 19 nt, Shigella flexneri 2a str. 301
agcggaucaguuccagcag

SEQ ID NO: 3903315 - RNA, 22 nt, Shigella flexneri 2a str. 301
agcggaucgccgccggagaggg

SEQ ID NO: 3903316 - RNA, 23 nt, Shigella flexneri 2a str. 301
agcggcaggccguggaucacauc

SEQ ID NO: 3903317 - RNA, 18 nt, Shigella flexneri 2a str. 301
agcggccuuuuccuuuca

SEQ ID NO: 3903318 - RNA, 22 nt, Shigella flexneri 2a str. 301
agcggccuuuuccuuucagagu

SEQ ID NO: 3903319 - RNA, 21 nt, Shigella flexneri 2a str. 301
agcggcgacaauaaucaccac

SEQ ID NO: 3903320 - RNA, 16 nt, Shigella flexneri 2a str. 301
agcggcgggcuuuaau

SEQ ID NO: 3903321 - RNA, 16 nt, Shigella flexneri 2a str. 301
agcggcguaucuucca

SEQ ID NO: 3903322 - RNA, 15 nt, Shigella flexneri 2a str. 301
agcggcguuugcucc

SEQ ID NO: 3903323 - RNA, 17 nt, Shigella flexneri 2a str. 301
agcggcucaugcaucag

SEQ ID NO: 3903324 - RNA, 16 nt, Shigella flexneri 2a str. 301
agcggcugccagcaug

SEQ ID NO: 3903325 - RNA, 13 nt, Shigella flexneri 2a str. 301
agcggcugcgcag

SEQ ID NO: 3903326 - RNA, 21 nt, Shigella flexneri 2a str. 301
agcgggcagacaaaacauacc

SEQ ID NO: 3903327 - RNA, 17 nt, Shigella flexneri 2a str. 301
agcgggcguugaagcgu

SEQ ID NO: 3903328 - RNA, 18 nt, Shigella flexneri 2a str. 301
agcggggaacaucaggca

SEQ ID NO: 3903329 - RNA, 17 nt, Shigella flexneri 2a str. 301
agcgggguguauuucac

SEQ ID NO: 3903330 - RNA, 20 nt, Shigella flexneri 2a str. 301
agcgggguucuccugagaau

SEQ ID NO: 3903331 - RNA, 16 nt, Shigella flexneri 2a str. 301
agcggguuaagcgcgc

SEQ ID NO: 3903332 - RNA, 20 nt, Shigella flexneri 2a str. 301
agcggucggagguucgaauc

SEQ ID NO: 3903333 - RNA, 19 nt, Shigella flexneri 2a str. 301
agcggugaaaaaauuaaac

SEQ ID NO: 3903334 - RNA, 21 nt, Shigella flexneri 2a str. 301
agcggugcgaugccuggcaau

SEQ ID NO: 3903335 - RNA, 22 nt, Shigella flexneri 2a str. 301
agcgguggugaaaagagcggua

SEQ ID NO: 3903336 - RNA, 15 nt, Shigella flexneri 2a str. 301
agcgguggugacugg

SEQ ID NO: 3903337 - RNA, 14 nt, Shigella flexneri 2a str. 301
agcgguuacacaug

SEQ ID NO: 3903338 - RNA, 22 nt, Shigella flexneri 2a str. 301
agcgguuguucaagcaucgcaa

SEQ ID NO: 3903339 - RNA, 14 nt, Shigella flexneri 2a str. 301
agcgguuuugccag

SEQ ID NO: 3903340 - RNA, 16 nt, Shigella flexneri 2a str. 301
agcgguuuugccagcg

SEQ ID NO: 3903341 - RNA, 15 nt, Shigella flexneri 2a str. 301
agcgguuuuugcgcc

SEQ ID NO: 3903342 - RNA, 21 nt, Shigella flexneri 2a str. 301
agcgguuuuugcgccauucau

SEQ ID NO: 3903343 - RNA, 22 nt, Shigella flexneri 2a str. 301
agcguaaaucccagcaccguca

SEQ ID NO: 3903344 - RNA, 22 nt, Shigella flexneri 2a str. 301
agcguaacggcucacgcccauc

SEQ ID NO: 3903345 - RNA, 17 nt, Shigella flexneri 2a str. 301
agcguaauugauccgcg

SEQ ID NO: 3903346 - RNA, 18 nt, Shigella flexneri 2a str. 301
agcguacggcaugcguuc

SEQ ID NO: 3903347 - RNA, 14 nt, Shigella flexneri 2a str. 301
agcguagcgcauca

SEQ ID NO: 3903348 - RNA, 22 nt, Shigella flexneri 2a str. 301
agcguagcgcaucaggcaguuu

SEQ ID NO: 3903349 - RNA, 22 nt, Shigella flexneri 2a str. 301
agcguaucuguggcgcuaugcu

SEQ ID NO: 3903350 - RNA, 13 nt, Shigella flexneri 2a str. 301
agcgucacaucag

SEQ ID NO: 3903351 - RNA, 21 nt, Shigella flexneri 2a str. 301
agcgucacuucggcagugcga

SEQ ID NO: 3903352 - RNA, 18 nt, Shigella flexneri 2a str. 301
agcgucagccagaaagaa
